United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 3

SEQ ID NO: 77088 - DNA, 22 bp, Homo sapiens
aggagatggagctcagtgggca

SEQ ID NO: 77089 - DNA, 22 bp, Homo sapiens
tgtgcacaatgtgcaggtttgt

SEQ ID NO: 77090 - DNA, 22 bp, Homo sapiens
atgttctacagatggaaagggg

SEQ ID NO: 77091 - DNA, 20 bp, Homo sapiens
gtgtggccaggagctgcgct

SEQ ID NO: 77092 - DNA, 22 bp, Homo sapiens
atatacacatctttttaaatat

SEQ ID NO: 77093 - DNA, 22 bp, Homo sapiens
agatggagtctcactcttgttg

SEQ ID NO: 77094 - DNA, 22 bp, Homo sapiens
ccacccttgggttcggaggccg

SEQ ID NO: 77095 - DNA, 22 bp, Homo sapiens
gaggtgctgctgtacttcttgc

SEQ ID NO: 77096 - DNA, 22 bp, Homo sapiens
ggagagggtaggggtcctgccc

SEQ ID NO: 77097 - DNA, 23 bp, Homo sapiens
catcatgcaatcttgggatttct

SEQ ID NO: 77098 - DNA, 22 bp, Homo sapiens
cccgagtgtctactcactccca

SEQ ID NO: 77099 - DNA, 22 bp, Homo sapiens
ctgaggctggagtgcagtggtg

SEQ ID NO: 77100 - DNA, 23 bp, Homo sapiens
attttttgtctttgtaactagat

SEQ ID NO: 77101 - DNA, 22 bp, Homo sapiens
actggacagaggaaatatggag

SEQ ID NO: 77102 - DNA, 22 bp, Homo sapiens
gagcaacacgcagtagtatacg

SEQ ID NO: 77103 - DNA, 22 bp, Homo sapiens
agcgccaagtgtgtggaggagg

SEQ ID NO: 77104 - DNA, 22 bp, Homo sapiens
tcacagagatgaacttttgata

SEQ ID NO: 77105 - DNA, 22 bp, Homo sapiens
tggagaagattggtcaccattc

SEQ ID NO: 77106 - DNA, 21 bp, Homo sapiens
ggtgctcgctgatgaggagtg

SEQ ID NO: 77107 - DNA, 22 bp, Homo sapiens
ttgctttgtttaaaagtggtat

SEQ ID NO: 77108 - DNA, 22 bp, Homo sapiens
aaagtgctgggattacaagtgt

SEQ ID NO: 77109 - DNA, 22 bp, Homo sapiens
caggagatgacagggaagaacc

SEQ ID NO: 77110 - DNA, 22 bp, Homo sapiens
tttatagtagcatgatttataa

SEQ ID NO: 77111 - DNA, 22 bp, Homo sapiens
ctgtccatattcaaggggtagg

SEQ ID NO: 77112 - DNA, 22 bp, Homo sapiens
ctgtaatcccagctacctggga

SEQ ID NO: 77113 - DNA, 22 bp, Homo sapiens
ttcaccctggaccagaaattgg

SEQ ID NO: 77114 - DNA, 22 bp, Homo sapiens
tgggaagaggggtataaagaag

SEQ ID NO: 77115 - DNA, 22 bp, Homo sapiens
tcactgtagcctcaactcttgg

SEQ ID NO: 77116 - DNA, 22 bp, Homo sapiens
tcttgggcaatttctctagagg

SEQ ID NO: 77117 - DNA, 22 bp, Homo sapiens
ctgaggcaggatggcctggctg

SEQ ID NO: 77118 - DNA, 22 bp, Homo sapiens
tttctcttcactgtgtgcctca

SEQ ID NO: 77119 - DNA, 22 bp, Homo sapiens
aagtggcagttcaggaagcaga

SEQ ID NO: 77120 - DNA, 22 bp, Homo sapiens
gccagcagcttcttctcatcct

SEQ ID NO: 77121 - DNA, 22 bp, Homo sapiens
gctggctgacagatttggggtg

SEQ ID NO: 77122 - DNA, 22 bp, Homo sapiens
tcaggggcttgaggtgcatgtc

SEQ ID NO: 77123 - DNA, 22 bp, Homo sapiens
tctcctggtacccttcctagca

SEQ ID NO: 77124 - DNA, 17 bp, Homo sapiens
ttcttttctgagccttg

SEQ ID NO: 77125 - DNA, 22 bp, Homo sapiens
gaagaaggtggcccaggggtag

SEQ ID NO: 77126 - DNA, 22 bp, Homo sapiens
agatgtgagaatcaagtgacca

SEQ ID NO: 77127 - DNA, 22 bp, Homo sapiens
taaatgttgtaagtacatctaa

SEQ ID NO: 77128 - DNA, 22 bp, Homo sapiens
gtggccccagggccctgtctgg

SEQ ID NO: 77129 - DNA, 22 bp, Homo sapiens
gatgctgctcgggtgcctggga

SEQ ID NO: 77130 - DNA, 22 bp, Homo sapiens
tacttttagcctatttgattct

SEQ ID NO: 77131 - DNA, 22 bp, Homo sapiens
cctagagccgcacctcctccac

SEQ ID NO: 77132 - DNA, 22 bp, Homo sapiens
aatgttacgatcaacaacacat

SEQ ID NO: 77133 - DNA, 22 bp, Homo sapiens
gaagagctgacagtgtcatcct

SEQ ID NO: 77134 - DNA, 22 bp, Homo sapiens
ccaaagaaacccaagctcaggg

SEQ ID NO: 77135 - DNA, 22 bp, Homo sapiens
gctgggctgcgtcggggaagcc

SEQ ID NO: 77136 - DNA, 22 bp, Homo sapiens
atataatttttggttagctcaa

SEQ ID NO: 77137 - DNA, 22 bp, Homo sapiens
gagcaacagtggcagtggtggg

SEQ ID NO: 77138 - DNA, 22 bp, Homo sapiens
aggtctcttgctgtctctgggc

SEQ ID NO: 77139 - DNA, 23 bp, Homo sapiens
ggaagctcacgtagtcctgcact

SEQ ID NO: 77140 - DNA, 22 bp, Homo sapiens
ttcctttctctggactgcagcc

SEQ ID NO: 77141 - DNA, 22 bp, Homo sapiens
tgtgcctgttcccactttgcct

SEQ ID NO: 77142 - DNA, 22 bp, Homo sapiens
acactgcagatgaaagcataag

SEQ ID NO: 77143 - DNA, 22 bp, Homo sapiens
tgggaggccaaggcaggcggat

SEQ ID NO: 77144 - DNA, 22 bp, Homo sapiens
agatggggtttcatcatgttgg

SEQ ID NO: 77145 - DNA, 22 bp, Homo sapiens
acgcagtttgtggacatttttt

SEQ ID NO: 77146 - DNA, 22 bp, Homo sapiens
gccttgccgctcagcagtgggg

SEQ ID NO: 77147 - DNA, 17 bp, Homo sapiens
ggctgcagtccaggagg

SEQ ID NO: 77148 - DNA, 22 bp, Homo sapiens
ccaggagttggaggctgcagtg

SEQ ID NO: 77149 - DNA, 22 bp, Homo sapiens
ttgcccactggctgttggtcag

SEQ ID NO: 77150 - DNA, 22 bp, Homo sapiens
gtgtttggtcagacgtccgggg

SEQ ID NO: 77151 - DNA, 22 bp, Homo sapiens
aaagtgctgggattacaggcat

SEQ ID NO: 77152 - DNA, 22 bp, Homo sapiens
tggatgctgtaggacacgctct

SEQ ID NO: 77153 - DNA, 22 bp, Homo sapiens
tgtaggagtccaatcaggagac

SEQ ID NO: 77154 - DNA, 23 bp, Homo sapiens
ttgggcaaatcactaacgtctcc

SEQ ID NO: 77155 - DNA, 22 bp, Homo sapiens
acccagggctcaagcgtaggca

SEQ ID NO: 77156 - DNA, 22 bp, Homo sapiens
ccgtggtcacctgagctccttg

SEQ ID NO: 77157 - DNA, 22 bp, Homo sapiens
caatttgccctgttaaattttc

SEQ ID NO: 77158 - DNA, 22 bp, Homo sapiens
atgctatgtaactggcagatag

SEQ ID NO: 77159 - DNA, 20 bp, Homo sapiens
atgctttcttgtgtgctgct

SEQ ID NO: 77160 - DNA, 22 bp, Homo sapiens
tgctgagcgcatccggcggccg

SEQ ID NO: 77161 - DNA, 22 bp, Homo sapiens
tgaactcctgacctcatgatcc

SEQ ID NO: 77162 - DNA, 22 bp, Homo sapiens
ccaggagctggagggtgcagtg

SEQ ID NO: 77163 - DNA, 22 bp, Homo sapiens
gggctgtgaggtgagaacttac

SEQ ID NO: 77164 - DNA, 22 bp, Homo sapiens
tgcctgcctaggaagctgtgaa

SEQ ID NO: 77165 - DNA, 22 bp, Homo sapiens
cagctgttcattgttgccaccc

SEQ ID NO: 77166 - DNA, 22 bp, Homo sapiens
ggagcatgcgctctgtgaccga

SEQ ID NO: 77167 - DNA, 22 bp, Homo sapiens
gatattcctgaaggacagggtt

SEQ ID NO: 77168 - DNA, 22 bp, Homo sapiens
gcatatgatcacgtgtgtcggt

SEQ ID NO: 77169 - DNA, 22 bp, Homo sapiens
ttgtctgcatgattctaggcag

SEQ ID NO: 77170 - DNA, 21 bp, Homo sapiens
agatcctggggtctggggagg

SEQ ID NO: 77171 - DNA, 22 bp, Homo sapiens
ggagaagaggagctggaagcct

SEQ ID NO: 77172 - DNA, 23 bp, Homo sapiens
cagagctggctcagagctgcctg

SEQ ID NO: 77173 - DNA, 22 bp, Homo sapiens
tctaatcctatggtggggaggg

SEQ ID NO: 77174 - DNA, 22 bp, Homo sapiens
tctgttgactcctagcagccat

SEQ ID NO: 77175 - DNA, 22 bp, Homo sapiens
ttgtgggggctgccctgtacgg

SEQ ID NO: 77176 - DNA, 22 bp, Homo sapiens
cctgcctatgagacgttttgcc

SEQ ID NO: 77177 - DNA, 22 bp, Homo sapiens
ggccagcctggggctcccagac

SEQ ID NO: 77178 - DNA, 22 bp, Homo sapiens
acccaggctggagtgcagtggg

SEQ ID NO: 77179 - DNA, 21 bp, Homo sapiens
gttcttgcaggatttccttcc

SEQ ID NO: 77180 - DNA, 22 bp, Homo sapiens
aaagactcactttcagctctgg

SEQ ID NO: 77181 - DNA, 22 bp, Homo sapiens
cttgtagacccctggactcacg

SEQ ID NO: 77182 - DNA, 22 bp, Homo sapiens
gcgagcctctggagtcctctgg

SEQ ID NO: 77183 - DNA, 22 bp, Homo sapiens
tgcctgatgcaggagtatcaga

SEQ ID NO: 77184 - DNA, 22 bp, Homo sapiens
aagaggttgtacctaaagtgtt

SEQ ID NO: 77185 - DNA, 22 bp, Homo sapiens
tggaaagaaagtaaaggcgtat

SEQ ID NO: 77186 - DNA, 22 bp, Homo sapiens
ccaaggtgggaggattgcttga

SEQ ID NO: 77187 - DNA, 22 bp, Homo sapiens
acatgattgtctggcttggcca

SEQ ID NO: 77188 - DNA, 22 bp, Homo sapiens
cctagagctctgctttatctaa

SEQ ID NO: 77189 - DNA, 22 bp, Homo sapiens
agagagcccgggccagggcaca

SEQ ID NO: 77190 - DNA, 22 bp, Homo sapiens
ggtccccccatggtgagcactg

SEQ ID NO: 77191 - DNA, 22 bp, Homo sapiens
tctaggcctggcttgggcccag

SEQ ID NO: 77192 - DNA, 22 bp, Homo sapiens
gcccagccacagtcactttcat

SEQ ID NO: 77193 - DNA, 22 bp, Homo sapiens
cgggcaaggcgagactaggccc

SEQ ID NO: 77194 - DNA, 22 bp, Homo sapiens
tgttcagaacaaaggtaaatga

SEQ ID NO: 77195 - DNA, 22 bp, Homo sapiens
ttgtgagtagtgccgcaataaa

SEQ ID NO: 77196 - DNA, 22 bp, Homo sapiens
ttttctcttccctctggacctg

SEQ ID NO: 77197 - DNA, 22 bp, Homo sapiens
attataggcttgagccaccgtg

SEQ ID NO: 77198 - DNA, 22 bp, Homo sapiens
caaatactacgattcttgcagt

SEQ ID NO: 77199 - DNA, 22 bp, Homo sapiens
tgccaggcgtggtggtgcgcac

SEQ ID NO: 77200 - DNA, 22 bp, Homo sapiens
tttctggcagcgggacaggggt

SEQ ID NO: 77201 - DNA, 22 bp, Homo sapiens
ctgctgaggtggagattgcagt

SEQ ID NO: 77202 - DNA, 22 bp, Homo sapiens
gtgcacatcgtgcaggtttgtt

SEQ ID NO: 77203 - DNA, 22 bp, Homo sapiens
cccatgaggtggaggttgcagt

SEQ ID NO: 77204 - DNA, 22 bp, Homo sapiens
aaggcaaggcttccagctcccc

SEQ ID NO: 77205 - DNA, 22 bp, Homo sapiens
tcactgcaacctctgcctgcca

SEQ ID NO: 77206 - DNA, 19 bp, Homo sapiens
ccatggcaatgatctgatg

SEQ ID NO: 77207 - DNA, 22 bp, Homo sapiens
atgccaggaacaaacagtggtg

SEQ ID NO: 77208 - DNA, 22 bp, Homo sapiens
tccgggagctgaacgtcttgcg

SEQ ID NO: 77209 - DNA, 22 bp, Homo sapiens
tgaggcaggaggattgcaggat

SEQ ID NO: 77210 - DNA, 22 bp, Homo sapiens
tcactgcaagctcctcctcctg

SEQ ID NO: 77211 - DNA, 22 bp, Homo sapiens
gcgggcgggggttcccaggtct

SEQ ID NO: 77212 - DNA, 22 bp, Homo sapiens
ttggtggacctcatcagaaccg

SEQ ID NO: 77213 - DNA, 20 bp, Homo sapiens
gtgcaatggcaccatctcag

SEQ ID NO: 77214 - DNA, 23 bp, Homo sapiens
atgggccaagcaagacccatgac

SEQ ID NO: 77215 - DNA, 22 bp, Homo sapiens
tcactgcaacctctgcctcttg

SEQ ID NO: 77216 - DNA, 22 bp, Homo sapiens
gccttattacctgcactttgaa

SEQ ID NO: 77217 - DNA, 22 bp, Homo sapiens
gaggcagaggttgttgcagtga

SEQ ID NO: 77218 - DNA, 20 bp, Homo sapiens
cagcagtggatgagagtttt

SEQ ID NO: 77219 - DNA, 22 bp, Homo sapiens
gcccaggctggagtgcagtggc

SEQ ID NO: 77220 - DNA, 23 bp, Homo sapiens
gctcatcaggcttagagtcaagg

SEQ ID NO: 77221 - DNA, 22 bp, Homo sapiens
tgacctattagatttccttgcc

SEQ ID NO: 77222 - DNA, 22 bp, Homo sapiens
tgaggcaggacttgcataaagt

SEQ ID NO: 77223 - DNA, 22 bp, Homo sapiens
agtcttcccagaggaggtgcca

SEQ ID NO: 77224 - DNA, 22 bp, Homo sapiens
gtcactgtatccaggttccagc

SEQ ID NO: 77225 - DNA, 22 bp, Homo sapiens
ggctcttccgccaccagccaca

SEQ ID NO: 77226 - DNA, 22 bp, Homo sapiens
tgtctggtgggttgacaggcag

SEQ ID NO: 77227 - DNA, 22 bp, Homo sapiens
ccacgtccagctaattttcgta

SEQ ID NO: 77228 - DNA, 22 bp, Homo sapiens
gaggcagaagttgcagtgagca

SEQ ID NO: 77229 - DNA, 22 bp, Homo sapiens
gcagacgtcaccgagtcgatgg

SEQ ID NO: 77230 - DNA, 22 bp, Homo sapiens
tgcctgttgcccacctgataaa

SEQ ID NO: 77231 - DNA, 22 bp, Homo sapiens
gtagatgagctcacatgacctt

SEQ ID NO: 77232 - DNA, 21 bp, Homo sapiens
aagaggaagcattatggcata

SEQ ID NO: 77233 - DNA, 22 bp, Homo sapiens
cttgcctttgtcttcaaaggct

SEQ ID NO: 77234 - DNA, 22 bp, Homo sapiens
ttccacaatggttaagctcgtt

SEQ ID NO: 77235 - DNA, 22 bp, Homo sapiens
ttctttgcccatgtttcctaag

SEQ ID NO: 77236 - DNA, 22 bp, Homo sapiens
cacccaggctggagtgcagtga

SEQ ID NO: 77237 - DNA, 22 bp, Homo sapiens
cacccaggctggaatgcagtgg

SEQ ID NO: 77238 - DNA, 22 bp, Homo sapiens
ccccatgaagtagggtctctga

SEQ ID NO: 77239 - DNA, 22 bp, Homo sapiens
tgggaagctgcattttaacaag

SEQ ID NO: 77240 - DNA, 23 bp, Homo sapiens
tctctgcatgtcctgagcacatc

SEQ ID NO: 77241 - DNA, 22 bp, Homo sapiens
tgcctgtggaaaggctggtgct

SEQ ID NO: 77242 - DNA, 22 bp, Homo sapiens
ggcgtgggcgaggtgctctatc

SEQ ID NO: 77243 - DNA, 19 bp, Homo sapiens
gactccaactttaagcatg

SEQ ID NO: 77244 - DNA, 22 bp, Homo sapiens
tggctgagttacgaacagagca

SEQ ID NO: 77245 - DNA, 22 bp, Homo sapiens
cttagatgaagtcacagaaccc

SEQ ID NO: 77246 - DNA, 22 bp, Homo sapiens
gcagtggcatgatgtgggctca

SEQ ID NO: 77247 - DNA, 22 bp, Homo sapiens
gagaaatgcatgcatgtcatca

SEQ ID NO: 77248 - DNA, 22 bp, Homo sapiens
aaggccctggcaggaagcagga

SEQ ID NO: 77249 - DNA, 22 bp, Homo sapiens
gggttcttatagtatcagagct

SEQ ID NO: 77250 - DNA, 22 bp, Homo sapiens
cagtgggtcctgcgtctgccag

SEQ ID NO: 77251 - DNA, 22 bp, Homo sapiens
ctggcaagaaatatatatctta

SEQ ID NO: 77252 - DNA, 22 bp, Homo sapiens
gtgctccctccttcctcaagga

SEQ ID NO: 77253 - DNA, 22 bp, Homo sapiens
aggccgaactccaactcctggg

SEQ ID NO: 77254 - DNA, 22 bp, Homo sapiens
ccaggcaggcgatggtgcagtg

SEQ ID NO: 77255 - DNA, 22 bp, Homo sapiens
gcacttcatgactttgtcaaat

SEQ ID NO: 77256 - DNA, 22 bp, Homo sapiens
ggccctgggccctctagcttgt

SEQ ID NO: 77257 - DNA, 22 bp, Homo sapiens
attaagtgactaaagtaatgct

SEQ ID NO: 77258 - DNA, 22 bp, Homo sapiens
accctcttgagggaagcacttt

SEQ ID NO: 77259 - DNA, 22 bp, Homo sapiens
atgttatgtctgggaaggggta

SEQ ID NO: 77260 - DNA, 22 bp, Homo sapiens
cactgcactccagcctgggaga

SEQ ID NO: 77261 - DNA, 22 bp, Homo sapiens
aaggatgattggtaatgacact

SEQ ID NO: 77262 - DNA, 22 bp, Homo sapiens
ggtgggagagctctgtctccag

SEQ ID NO: 77263 - DNA, 22 bp, Homo sapiens
ttccaactttgtcatatattat

SEQ ID NO: 77264 - DNA, 23 bp, Homo sapiens
gcctgggagttgcgatctgcccg

SEQ ID NO: 77265 - DNA, 22 bp, Homo sapiens
caggcgggcaggtgcggcccct

SEQ ID NO: 77266 - DNA, 22 bp, Homo sapiens
aaggagtggggcatatcacaga

SEQ ID NO: 77267 - DNA, 22 bp, Homo sapiens
cctgggaggctgaggctgcagt

SEQ ID NO: 77268 - DNA, 22 bp, Homo sapiens
taacaaagtattgtttgtgtat

SEQ ID NO: 77269 - DNA, 22 bp, Homo sapiens
tggccagctttgactgtaaacc

SEQ ID NO: 77270 - DNA, 22 bp, Homo sapiens
acgatgatgaaagagaacattc

SEQ ID NO: 77271 - DNA, 19 bp, Homo sapiens
gccatcccaagcattttgg

SEQ ID NO: 77272 - DNA, 22 bp, Homo sapiens
aaggtgggtggatcacgaggtc

SEQ ID NO: 77273 - DNA, 22 bp, Homo sapiens
tggaatgcagtgggagcttacc

SEQ ID NO: 77274 - DNA, 22 bp, Homo sapiens
ggcagggagtggagactcccta

SEQ ID NO: 77275 - DNA, 22 bp, Homo sapiens
gcggcaggagtaaaggaggaag

SEQ ID NO: 77276 - DNA, 22 bp, Homo sapiens
tgaccaatactgtggatgccag

SEQ ID NO: 77277 - DNA, 22 bp, Homo sapiens
aggccttaccatagctgtagca

SEQ ID NO: 77278 - DNA, 22 bp, Homo sapiens
ggctctgcttgaggccagcctg

SEQ ID NO: 77279 - DNA, 22 bp, Homo sapiens
cttgacactgtcactcaggcca

SEQ ID NO: 77280 - DNA, 22 bp, Homo sapiens
tcccagctactctagaggctga

SEQ ID NO: 77281 - DNA, 22 bp, Homo sapiens
gcccttctgctgttaggtagcc

SEQ ID NO: 77282 - DNA, 22 bp, Homo sapiens
agccaggatggtctcgatcggc

SEQ ID NO: 77283 - DNA, 22 bp, Homo sapiens
cggccgcagcagtgtcggccca

SEQ ID NO: 77284 - DNA, 22 bp, Homo sapiens
ataggtccaaggagaggtcttt

SEQ ID NO: 77285 - DNA, 22 bp, Homo sapiens
aaaagcaattgcagttcttgcc

SEQ ID NO: 77286 - DNA, 22 bp, Homo sapiens
tgaaatgttaaacaagtggctc

SEQ ID NO: 77287 - DNA, 22 bp, Homo sapiens
aaagaaatagatggcatttaaa

SEQ ID NO: 77288 - DNA, 22 bp, Homo sapiens
ccctcccagatgggcttgaggt

SEQ ID NO: 77289 - DNA, 22 bp, Homo sapiens
cccaggctggagtgtaatggtg

SEQ ID NO: 77290 - DNA, 22 bp, Homo sapiens
tctggtgtcagtattctttgaa

SEQ ID NO: 77291 - DNA, 22 bp, Homo sapiens
ggctcactgcaaactgtgcctc

SEQ ID NO: 77292 - DNA, 19 bp, Homo sapiens
gcagacaggtccagagagg

SEQ ID NO: 77293 - DNA, 21 bp, Homo sapiens
cagaggcctatcacagactcc

SEQ ID NO: 77294 - DNA, 22 bp, Homo sapiens
gcagaccctgaactgggcatgg

SEQ ID NO: 77295 - DNA, 20 bp, Homo sapiens
tcagccattccttacctttc

SEQ ID NO: 77296 - DNA, 22 bp, Homo sapiens
tacaacaatttccacattagaa

SEQ ID NO: 77297 - DNA, 22 bp, Homo sapiens
tgaggcaggagaatcacatgaa

SEQ ID NO: 77298 - DNA, 22 bp, Homo sapiens
gggaagtgagctggaatcaagg

SEQ ID NO: 77299 - DNA, 22 bp, Homo sapiens
cacccaggttggagtgcagtgg

SEQ ID NO: 77300 - DNA, 22 bp, Homo sapiens
agttgttcgtggtggattcgct

SEQ ID NO: 77301 - DNA, 22 bp, Homo sapiens
tgaggcaggtggattacaaggt

SEQ ID NO: 77302 - DNA, 22 bp, Homo sapiens
tgctgaataagacgtggcttgt

SEQ ID NO: 77303 - DNA, 22 bp, Homo sapiens
ttgtggaatgtggctgtcaatt

SEQ ID NO: 77304 - DNA, 22 bp, Homo sapiens
caggctgctgacaggcttggag

SEQ ID NO: 77305 - DNA, 22 bp, Homo sapiens
tacaggcatgtagcatggtgat

SEQ ID NO: 77306 - DNA, 22 bp, Homo sapiens
taggcaagtggaccagaggttt

SEQ ID NO: 77307 - DNA, 22 bp, Homo sapiens
gagcccaggcagaggttgcagt

SEQ ID NO: 77308 - DNA, 22 bp, Homo sapiens
taaatgttttgtgggttgagtt

SEQ ID NO: 77309 - DNA, 22 bp, Homo sapiens
agaaaacataggagacaggaaa

SEQ ID NO: 77310 - DNA, 22 bp, Homo sapiens
aaggccttgccgaaggatgcca

SEQ ID NO: 77311 - DNA, 22 bp, Homo sapiens
tcactgcagcctctgcctcccg

SEQ ID NO: 77312 - DNA, 22 bp, Homo sapiens
gacttctgaattcctatcaggt

SEQ ID NO: 77313 - DNA, 22 bp, Homo sapiens
cgccggcttgaggcaggcggca

SEQ ID NO: 77314 - DNA, 22 bp, Homo sapiens
ggcctgcctcacagtcagcacc

SEQ ID NO: 77315 - DNA, 22 bp, Homo sapiens
gtagtcccagctaccccggagg

SEQ ID NO: 77316 - DNA, 22 bp, Homo sapiens
acttaccagagaggatccgccc

SEQ ID NO: 77317 - DNA, 22 bp, Homo sapiens
ttctgggcacacaggccctggt

SEQ ID NO: 77318 - DNA, 22 bp, Homo sapiens
actgcacttcagcctgggtgac

SEQ ID NO: 77319 - DNA, 22 bp, Homo sapiens
ctgccttttaaagccagtgtta

SEQ ID NO: 77320 - DNA, 22 bp, Homo sapiens
tctgcaacattcctctccccac

SEQ ID NO: 77321 - DNA, 22 bp, Homo sapiens
tcggagctgtagatgaaaccct

SEQ ID NO: 77322 - DNA, 22 bp, Homo sapiens
tcgggctcgctctcctagcgga

SEQ ID NO: 77323 - DNA, 22 bp, Homo sapiens
cttctggcgttggaggtctgag

SEQ ID NO: 77324 - DNA, 22 bp, Homo sapiens
aagaaatgctgatgttggatgg

SEQ ID NO: 77325 - DNA, 22 bp, Homo sapiens
gcttacaggtgaggcagcaaga

SEQ ID NO: 77326 - DNA, 22 bp, Homo sapiens
tcccagagctctggaggttgga

SEQ ID NO: 77327 - DNA, 22 bp, Homo sapiens
gaagagtggttatccctgctgt

SEQ ID NO: 77328 - DNA, 22 bp, Homo sapiens
tcttcctgtcaatgagaattaa

SEQ ID NO: 77329 - DNA, 22 bp, Homo sapiens
tgctcatcaacatgatgatcat

SEQ ID NO: 77330 - DNA, 22 bp, Homo sapiens
actgcacttcagcctgggtgtc

SEQ ID NO: 77331 - DNA, 22 bp, Homo sapiens
catgatctggtcctactgtggg

SEQ ID NO: 77332 - DNA, 22 bp, Homo sapiens
cattccttaacgtggggagtct

SEQ ID NO: 77333 - DNA, 22 bp, Homo sapiens
taacatttaaatttttcacata

SEQ ID NO: 77334 - DNA, 22 bp, Homo sapiens
ggaggtggagctggaagttcca

SEQ ID NO: 77335 - DNA, 22 bp, Homo sapiens
tcttaagcagagaagaagttga

SEQ ID NO: 77336 - DNA, 22 bp, Homo sapiens
ttgggctgaaccctgcagctga

SEQ ID NO: 77337 - DNA, 22 bp, Homo sapiens
gcctggccgggtcttggatttt

SEQ ID NO: 77338 - DNA, 22 bp, Homo sapiens
gagagcaggaggcagcgggacg

SEQ ID NO: 77339 - DNA, 22 bp, Homo sapiens
aggctgagataggtggatcatt

SEQ ID NO: 77340 - DNA, 22 bp, Homo sapiens
ttctcttttcaccagttgctaa

SEQ ID NO: 77341 - DNA, 22 bp, Homo sapiens
tcacgtgagggacctgtgtctg

SEQ ID NO: 77342 - DNA, 22 bp, Homo sapiens
gaccttgtgctccgaggcgggc

SEQ ID NO: 77343 - DNA, 21 bp, Homo sapiens
cgtgactgggtccgtctggct

SEQ ID NO: 77344 - DNA, 22 bp, Homo sapiens
aggatgagccgcgcaagctgac

SEQ ID NO: 77345 - DNA, 22 bp, Homo sapiens
tcagtgatttctggggtgaggg

SEQ ID NO: 77346 - DNA, 22 bp, Homo sapiens
ttttccttcatatcccttatgt

SEQ ID NO: 77347 - DNA, 22 bp, Homo sapiens
tggaacgtcgtaatgttggtta

SEQ ID NO: 77348 - DNA, 22 bp, Homo sapiens
atgttcatatccccattctgat

SEQ ID NO: 77349 - DNA, 22 bp, Homo sapiens
ctgtctgcaggatagtaccctc

SEQ ID NO: 77350 - DNA, 22 bp, Homo sapiens
cacatacccggctattgctgct

SEQ ID NO: 77351 - DNA, 22 bp, Homo sapiens
tcacaatatttatcttccaatt

SEQ ID NO: 77352 - DNA, 22 bp, Homo sapiens
caggaaggcgcggctgtgcctg

SEQ ID NO: 77353 - DNA, 22 bp, Homo sapiens
ccaaagtgctaggattacaggt

SEQ ID NO: 77354 - DNA, 22 bp, Homo sapiens
tttttgggtccaggctgtatct

SEQ ID NO: 77355 - DNA, 22 bp, Homo sapiens
gaagctgagctgaggcatgttg

SEQ ID NO: 77356 - DNA, 22 bp, Homo sapiens
atctagattaggtataagagct

SEQ ID NO: 77357 - DNA, 20 bp, Homo sapiens
ttcatgggagcaaagaggcc

SEQ ID NO: 77358 - DNA, 22 bp, Homo sapiens
cctcgcggcactcgggccggat

SEQ ID NO: 77359 - DNA, 17 bp, Homo sapiens
tggctctgtcctcagct

SEQ ID NO: 77360 - DNA, 22 bp, Homo sapiens
agtgctgggctatctactgcta

SEQ ID NO: 77361 - DNA, 22 bp, Homo sapiens
agttatgtcctcagcaaatcaa

SEQ ID NO: 77362 - DNA, 22 bp, Homo sapiens
tagattcagatatttaggacaa

SEQ ID NO: 77363 - DNA, 22 bp, Homo sapiens
ataaaatttgctactgttaaat

SEQ ID NO: 77364 - DNA, 22 bp, Homo sapiens
ctgaagagaaagggagctcttc

SEQ ID NO: 77365 - DNA, 22 bp, Homo sapiens
cttatagtatgatgttgagaat

SEQ ID NO: 77366 - DNA, 22 bp, Homo sapiens
cacctgtacagggccgggctgg

SEQ ID NO: 77367 - DNA, 22 bp, Homo sapiens
aggtggggaggagtgtctcttt

SEQ ID NO: 77368 - DNA, 22 bp, Homo sapiens
ccaggaggcagaagttgcagtg

SEQ ID NO: 77369 - DNA, 22 bp, Homo sapiens
cagcagcattgctctggattcc

SEQ ID NO: 77370 - DNA, 22 bp, Homo sapiens
ctcttagtaatgccatgaagca

SEQ ID NO: 77371 - DNA, 22 bp, Homo sapiens
tgggctttgagctcggtcacct

SEQ ID NO: 77372 - DNA, 22 bp, Homo sapiens
tcccctttgtcttcctgtgggt

SEQ ID NO: 77373 - DNA, 22 bp, Homo sapiens
agtccgtggccagactcaagag

SEQ ID NO: 77374 - DNA, 22 bp, Homo sapiens
tgccttgtggggaaggatttag

SEQ ID NO: 77375 - DNA, 19 bp, Homo sapiens
gcctcatttccacctcccc

SEQ ID NO: 77376 - DNA, 22 bp, Homo sapiens
cacccaggctggagtgcagtgg

SEQ ID NO: 77377 - DNA, 22 bp, Homo sapiens
tttcctcttctggcaggcaggg

SEQ ID NO: 77378 - DNA, 22 bp, Homo sapiens
caggctggagtgcaatgacgcc

SEQ ID NO: 77379 - DNA, 22 bp, Homo sapiens
gggcggggggagctggaatgaa

SEQ ID NO: 77380 - DNA, 22 bp, Homo sapiens
tgggtgctctgcgaccgtaggg

SEQ ID NO: 77381 - DNA, 22 bp, Homo sapiens
cttcactttaagccaatcatga

SEQ ID NO: 77382 - DNA, 22 bp, Homo sapiens
gagagtctaggaacctcatata

SEQ ID NO: 77383 - DNA, 22 bp, Homo sapiens
agaggaagtaatcaggacctgc

SEQ ID NO: 77384 - DNA, 22 bp, Homo sapiens
ttctgccttggcagggtggtcc

SEQ ID NO: 77385 - DNA, 22 bp, Homo sapiens
ggtggttcacgcctataatccc

SEQ ID NO: 77386 - DNA, 22 bp, Homo sapiens
tagcataacaggtaagagtgag

SEQ ID NO: 77387 - DNA, 22 bp, Homo sapiens
tgtgctcagtctttggctggga

SEQ ID NO: 77388 - DNA, 22 bp, Homo sapiens
tggaagctcaaggcagggtgag

SEQ ID NO: 77389 - DNA, 22 bp, Homo sapiens
aagaggcgccgggtacgtggcg

SEQ ID NO: 77390 - DNA, 20 bp, Homo sapiens
cagcctgcatcatctgcagc

SEQ ID NO: 77391 - DNA, 22 bp, Homo sapiens
tatgccactgctctccatccta

SEQ ID NO: 77392 - DNA, 22 bp, Homo sapiens
gtccccgacgtttggcttgatg

SEQ ID NO: 77393 - DNA, 22 bp, Homo sapiens
ggagcagggaattacagcgcag

SEQ ID NO: 77394 - DNA, 22 bp, Homo sapiens
ctcccagccttcgccagtctga

SEQ ID NO: 77395 - DNA, 22 bp, Homo sapiens
aggcctgaggaccagataaatg

SEQ ID NO: 77396 - DNA, 22 bp, Homo sapiens
ttaataaagtatgaattggaaa

SEQ ID NO: 77397 - DNA, 22 bp, Homo sapiens
gcggccttgtggcggagcaggc

SEQ ID NO: 77398 - DNA, 22 bp, Homo sapiens
ctggagtagccggacgggtctg

SEQ ID NO: 77399 - DNA, 22 bp, Homo sapiens
ccacctgagataagagagctca

SEQ ID NO: 77400 - DNA, 22 bp, Homo sapiens
atcggcaagccccacaccgtcc

SEQ ID NO: 77401 - DNA, 22 bp, Homo sapiens
ctggcaggtggaggttgcagtg

SEQ ID NO: 77402 - DNA, 22 bp, Homo sapiens
tgccctctttctgtacagctcc

SEQ ID NO: 77403 - DNA, 22 bp, Homo sapiens
tctgagctccatgcaggaggct

SEQ ID NO: 77404 - DNA, 22 bp, Homo sapiens
acgcccagactcccatactttg

SEQ ID NO: 77405 - DNA, 21 bp, Homo sapiens
tcacgtggtcacatgagcttt

SEQ ID NO: 77406 - DNA, 17 bp, Homo sapiens
tgtagcttctccttctc

SEQ ID NO: 77407 - DNA, 22 bp, Homo sapiens
gctgcagggagctggaaggctc

SEQ ID NO: 77408 - DNA, 22 bp, Homo sapiens
agacactgttctcacatgcttg

SEQ ID NO: 77409 - DNA, 21 bp, Homo sapiens
agctgcctccacttctgaggc

SEQ ID NO: 77410 - DNA, 22 bp, Homo sapiens
tcctcagtcacggtagcacatt

SEQ ID NO: 77411 - DNA, 22 bp, Homo sapiens
tttccatgtgtactggccagaa

SEQ ID NO: 77412 - DNA, 22 bp, Homo sapiens
gagcccaggaagtggaggctga

SEQ ID NO: 77413 - DNA, 22 bp, Homo sapiens
tagccgggtgttgtgtcatgca

SEQ ID NO: 77414 - DNA, 22 bp, Homo sapiens
gaccctgtttctacaaataatt

SEQ ID NO: 77415 - DNA, 22 bp, Homo sapiens
catctgctgttccttggactca

SEQ ID NO: 77416 - DNA, 22 bp, Homo sapiens
ccctggaggttgaggctgcagt

SEQ ID NO: 77417 - DNA, 22 bp, Homo sapiens
tctgttttgcataatgttcttt

SEQ ID NO: 77418 - DNA, 22 bp, Homo sapiens
aggccagcagcatgacggcatc

SEQ ID NO: 77419 - DNA, 22 bp, Homo sapiens
ggctgtggcagctggaagtggt

SEQ ID NO: 77420 - DNA, 22 bp, Homo sapiens
accccaggaagtggaggtcatg

SEQ ID NO: 77421 - DNA, 19 bp, Homo sapiens
ccctcttgcacaaagcaaa

SEQ ID NO: 77422 - DNA, 22 bp, Homo sapiens
cccaggaattggaggctgcagt

SEQ ID NO: 77423 - DNA, 22 bp, Homo sapiens
tagctaaaccagtatgtgaagg

SEQ ID NO: 77424 - DNA, 21 bp, Homo sapiens
tggtttatgtgcttagggtct

SEQ ID NO: 77425 - DNA, 22 bp, Homo sapiens
cagtaatgggcaagacaatatg

SEQ ID NO: 77426 - DNA, 22 bp, Homo sapiens
tcaagcggactgagatactctg

SEQ ID NO: 77427 - DNA, 22 bp, Homo sapiens
tcgtctgtgaaattgggataag

SEQ ID NO: 77428 - DNA, 22 bp, Homo sapiens
tagccgggtgtggtggaactcc

SEQ ID NO: 77429 - DNA, 19 bp, Homo sapiens
acccagcccaggagtggca

SEQ ID NO: 77430 - DNA, 22 bp, Homo sapiens
gtcttttgctagccagagagct

SEQ ID NO: 77431 - DNA, 22 bp, Homo sapiens
tctgatctgtcagtcatgaagg

SEQ ID NO: 77432 - DNA, 22 bp, Homo sapiens
gctgctctcagagctcatgctg

SEQ ID NO: 77433 - DNA, 18 bp, Homo sapiens
ccatcaccctaactagtg

SEQ ID NO: 77434 - DNA, 22 bp, Homo sapiens
tgacagaggagctggaatgatt

SEQ ID NO: 77435 - DNA, 22 bp, Homo sapiens
acgaatcattcacggacaacac

SEQ ID NO: 77436 - DNA, 23 bp, Homo sapiens
ccactagcacctgttcaacttct

SEQ ID NO: 77437 - DNA, 22 bp, Homo sapiens
aggggagagttaatgtgaatgt

SEQ ID NO: 77438 - DNA, 22 bp, Homo sapiens
atcttctcatgtgtaatgaggt

SEQ ID NO: 77439 - DNA, 21 bp, Homo sapiens
tgtaagtttcatctgaattgg

SEQ ID NO: 77440 - DNA, 22 bp, Homo sapiens
tttctcctcatgactggttgtg

SEQ ID NO: 77441 - DNA, 22 bp, Homo sapiens
gagatcggtaaagagcatgcac

SEQ ID NO: 77442 - DNA, 23 bp, Homo sapiens
gcagaggagcaagctggacacca

SEQ ID NO: 77443 - DNA, 22 bp, Homo sapiens
gctcccagtctgatggaggaga

SEQ ID NO: 77444 - DNA, 22 bp, Homo sapiens
gctgctttggaaagcatggaaa

SEQ ID NO: 77445 - DNA, 22 bp, Homo sapiens
gcttagcaaacatctgtagtcc

SEQ ID NO: 77446 - DNA, 22 bp, Homo sapiens
tataaagagtctcaaagaagtt

SEQ ID NO: 77447 - DNA, 22 bp, Homo sapiens
agttggagtgaacatgagattg

SEQ ID NO: 77448 - DNA, 21 bp, Homo sapiens
tgctgggtttgcccatcaggc

SEQ ID NO: 77449 - DNA, 22 bp, Homo sapiens
attggccatttgcatgtattat

SEQ ID NO: 77450 - DNA, 22 bp, Homo sapiens
taacaatacccattctaattac

SEQ ID NO: 77451 - DNA, 22 bp, Homo sapiens
cctggaggcggaggttgcagtg

SEQ ID NO: 77452 - DNA, 22 bp, Homo sapiens
cttgtattaggaagaatgcttt

SEQ ID NO: 77453 - DNA, 22 bp, Homo sapiens
tgctgctgaggctaaagtatag

SEQ ID NO: 77454 - DNA, 22 bp, Homo sapiens
ataaagtggaggtagtattcat

SEQ ID NO: 77455 - DNA, 22 bp, Homo sapiens
gttatataagacaaatcagagt

SEQ ID NO: 77456 - DNA, 21 bp, Homo sapiens
gaccccagaccagcagacaca

SEQ ID NO: 77457 - DNA, 22 bp, Homo sapiens
tggctcctcacgtcctcagagc

SEQ ID NO: 77458 - DNA, 22 bp, Homo sapiens
tatttaataaaactatggcatg

SEQ ID NO: 77459 - DNA, 22 bp, Homo sapiens
gggctgggattgcttgctgtga

SEQ ID NO: 77460 - DNA, 22 bp, Homo sapiens
aggcactgtgcagtcccaagca

SEQ ID NO: 77461 - DNA, 22 bp, Homo sapiens
gcgccccatctacagtactttt

SEQ ID NO: 77462 - DNA, 20 bp, Homo sapiens
ctgccgaccacagccatgga

SEQ ID NO: 77463 - DNA, 20 bp, Homo sapiens
ttgagcagcagtgctgtgtc

SEQ ID NO: 77464 - DNA, 23 bp, Homo sapiens
gttttacaggtgagaaaatggag

SEQ ID NO: 77465 - DNA, 22 bp, Homo sapiens
tgcaggctcttggtgacgtggg

SEQ ID NO: 77466 - DNA, 21 bp, Homo sapiens
aggcaccacatctccctcccc

SEQ ID NO: 77467 - DNA, 22 bp, Homo sapiens
tccgggaggcagaggttgcagt

SEQ ID NO: 77468 - DNA, 22 bp, Homo sapiens
tgttgcccaggttctctcctgc

SEQ ID NO: 77469 - DNA, 19 bp, Homo sapiens
gatttaaacgtggctctat

SEQ ID NO: 77470 - DNA, 22 bp, Homo sapiens
gtcccataagtagtgcaacttg

SEQ ID NO: 77471 - DNA, 22 bp, Homo sapiens
ggggaaagccagccctgcttcc

SEQ ID NO: 77472 - DNA, 22 bp, Homo sapiens
actgcacttcaccctgggtgac

SEQ ID NO: 77473 - DNA, 22 bp, Homo sapiens
ctcattgcccagatccccacag

SEQ ID NO: 77474 - DNA, 22 bp, Homo sapiens
ttcgttgctttaagccactacg

SEQ ID NO: 77475 - DNA, 22 bp, Homo sapiens
atcaaatacaaagggcataagg

SEQ ID NO: 77476 - DNA, 22 bp, Homo sapiens
ggcctacgccagtatccccagg

SEQ ID NO: 77477 - DNA, 22 bp, Homo sapiens
aagaataagaggatttagaaca

SEQ ID NO: 77478 - DNA, 22 bp, Homo sapiens
gctcactgcaagctctgcctcc

SEQ ID NO: 77479 - DNA, 22 bp, Homo sapiens
atttttctctttccactgagat

SEQ ID NO: 77480 - DNA, 22 bp, Homo sapiens
atgagctcatccgagtcacact

SEQ ID NO: 77481 - DNA, 22 bp, Homo sapiens
ggaggtgggctaaggactctct

SEQ ID NO: 77482 - DNA, 22 bp, Homo sapiens
tcctgagataaatctcatgtga

SEQ ID NO: 77483 - DNA, 17 bp, Homo sapiens
cgggcatggagggcagg

SEQ ID NO: 77484 - DNA, 22 bp, Homo sapiens
cactgcacttcagcctgggtga

SEQ ID NO: 77485 - DNA, 22 bp, Homo sapiens
ctccagattccgtttattcagg

SEQ ID NO: 77486 - DNA, 22 bp, Homo sapiens
acggtgctgggtattggggttc

SEQ ID NO: 77487 - DNA, 22 bp, Homo sapiens
tctgtgctaggcagcctggccc

SEQ ID NO: 77488 - DNA, 22 bp, Homo sapiens
ccaggaggttgaggctgcagtg

SEQ ID NO: 77489 - DNA, 22 bp, Homo sapiens
gggcctgtgtgttcaggagcct

SEQ ID NO: 77490 - DNA, 22 bp, Homo sapiens
ggcaagagggcagatggagtgc

SEQ ID NO: 77491 - DNA, 22 bp, Homo sapiens
aggaattcaagaccagctgggc

SEQ ID NO: 77492 - DNA, 22 bp, Homo sapiens
gtgggggcaggcagtgctagga

SEQ ID NO: 77493 - DNA, 22 bp, Homo sapiens
aagctgttgttcatcctgaatt

SEQ ID NO: 77494 - DNA, 22 bp, Homo sapiens
tgtgtctaatgactatttcttc

SEQ ID NO: 77495 - DNA, 18 bp, Homo sapiens
ccgggctttggtgacaca

SEQ ID NO: 77496 - DNA, 22 bp, Homo sapiens
ccaggagttggaggttgcagtg

SEQ ID NO: 77497 - DNA, 22 bp, Homo sapiens
tacaccattcccaggtggattt

SEQ ID NO: 77498 - DNA, 22 bp, Homo sapiens
tccgggttttacactcacatca

SEQ ID NO: 77499 - DNA, 22 bp, Homo sapiens
caggagctcaagaccaccctgg

SEQ ID NO: 77500 - DNA, 22 bp, Homo sapiens
gcaggtggatcacctgaggtca

SEQ ID NO: 77501 - DNA, 22 bp, Homo sapiens
gaaggaccctctggggtctcag

SEQ ID NO: 77502 - DNA, 21 bp, Homo sapiens
aggcatgagccctgcatggac

SEQ ID NO: 77503 - DNA, 22 bp, Homo sapiens
gcagggaggtttgctgacctgg

SEQ ID NO: 77504 - DNA, 22 bp, Homo sapiens
tgtggggatcttctagcttttc

SEQ ID NO: 77505 - DNA, 22 bp, Homo sapiens
aggattgtgcctccagtcagaa

SEQ ID NO: 77506 - DNA, 22 bp, Homo sapiens
cgtgagcaaaatggacactccc

SEQ ID NO: 77507 - DNA, 22 bp, Homo sapiens
acccggagtcggaggttgcagt

SEQ ID NO: 77508 - DNA, 14 bp, Homo sapiens
gcaggcagatcacc

SEQ ID NO: 77509 - DNA, 22 bp, Homo sapiens
cactaggctggagtgcagtggc

SEQ ID NO: 77510 - DNA, 22 bp, Homo sapiens
aagagggaaattgttggctgct

SEQ ID NO: 77511 - DNA, 22 bp, Homo sapiens
cattaaacaaccttgaatcaat

SEQ ID NO: 77512 - DNA, 22 bp, Homo sapiens
ttcctggtctatttagaattgc

SEQ ID NO: 77513 - DNA, 22 bp, Homo sapiens
caagatcttcctcaatagacct

SEQ ID NO: 77514 - DNA, 22 bp, Homo sapiens
cctcccctcagacagagactgg

SEQ ID NO: 77515 - DNA, 22 bp, Homo sapiens
agcccggcttccccggttgcta

SEQ ID NO: 77516 - DNA, 21 bp, Homo sapiens
gttctacagttttagaattcc

SEQ ID NO: 77517 - DNA, 22 bp, Homo sapiens
gtaggtcagacataagaggaca

SEQ ID NO: 77518 - DNA, 18 bp, Homo sapiens
gcagctagccaggggggc

SEQ ID NO: 77519 - DNA, 22 bp, Homo sapiens
aactcactttgtggcttctgaa

SEQ ID NO: 77520 - DNA, 22 bp, Homo sapiens
aattcacatccgaccaggtcaa

SEQ ID NO: 77521 - DNA, 22 bp, Homo sapiens
agctgctgagccaggctgatgt

SEQ ID NO: 77522 - DNA, 22 bp, Homo sapiens
gccaccccataggtgttaggtg

SEQ ID NO: 77523 - DNA, 18 bp, Homo sapiens
ggtgagggagctggaagc

SEQ ID NO: 77524 - DNA, 22 bp, Homo sapiens
tccagtttccaatcactgcacg

SEQ ID NO: 77525 - DNA, 22 bp, Homo sapiens
caggtgcctcaggatgagacaa

SEQ ID NO: 77526 - DNA, 22 bp, Homo sapiens
ctggcctcggcagcaggaacag

SEQ ID NO: 77527 - DNA, 22 bp, Homo sapiens
acaccatactcatgttggttcc

SEQ ID NO: 77528 - DNA, 22 bp, Homo sapiens
atgaggcaggtggaggctgcca

SEQ ID NO: 77529 - DNA, 22 bp, Homo sapiens
tgggaaggggagctggaaagga

SEQ ID NO: 77530 - DNA, 22 bp, Homo sapiens
ggaggacaggggctgcagcaca

SEQ ID NO: 77531 - DNA, 22 bp, Homo sapiens
gagccaggaggcagagactgca

SEQ ID NO: 77532 - DNA, 22 bp, Homo sapiens
catctgtctgcatgctctgggt

SEQ ID NO: 77533 - DNA, 22 bp, Homo sapiens
tgcagattcaaatgaaatgcaa

SEQ ID NO: 77534 - DNA, 22 bp, Homo sapiens
caggcagaagaagtggaaggac

SEQ ID NO: 77535 - DNA, 22 bp, Homo sapiens
ccaggaggcggaggttgcagtg

SEQ ID NO: 77536 - DNA, 22 bp, Homo sapiens
tgactggattgtcattacgacg

SEQ ID NO: 77537 - DNA, 22 bp, Homo sapiens
cctcgacctccccaggctcagg

SEQ ID NO: 77538 - DNA, 22 bp, Homo sapiens
aagttactggcaagggctgcag

SEQ ID NO: 77539 - DNA, 22 bp, Homo sapiens
tgggcaggggccctgcttccgt

SEQ ID NO: 77540 - DNA, 22 bp, Homo sapiens
aaaatcttgtgacttaggaagg

SEQ ID NO: 77541 - DNA, 22 bp, Homo sapiens
agagaagagtcttgtcaaatta

SEQ ID NO: 77542 - DNA, 22 bp, Homo sapiens
tgagatgaataactcctgctaa

SEQ ID NO: 77543 - DNA, 22 bp, Homo sapiens
ttgcatagtgctgaggttcggg

SEQ ID NO: 77544 - DNA, 22 bp, Homo sapiens
ttgagatggagtctcgcactgt

SEQ ID NO: 77545 - DNA, 22 bp, Homo sapiens
gaatatcccgctatgcaaagta

SEQ ID NO: 77546 - DNA, 22 bp, Homo sapiens
gagtagaactggttatctaata

SEQ ID NO: 77547 - DNA, 22 bp, Homo sapiens
ttcatagtgtttccttccagtg

SEQ ID NO: 77548 - DNA, 21 bp, Homo sapiens
tgactgaggcttcttcacaca

SEQ ID NO: 77549 - DNA, 23 bp, Homo sapiens
aagttagtttcaataaagcaatt

SEQ ID NO: 77550 - DNA, 22 bp, Homo sapiens
gcaagacatgtctaaggtttaa

SEQ ID NO: 77551 - DNA, 22 bp, Homo sapiens
gaccttgtgatccgcccgcctt

SEQ ID NO: 77552 - DNA, 22 bp, Homo sapiens
aaggagaaatggtagatgtgca

SEQ ID NO: 77553 - DNA, 22 bp, Homo sapiens
gagcactgatttatttttgtct

SEQ ID NO: 77554 - DNA, 22 bp, Homo sapiens
atgtttttaaatagacttacag

SEQ ID NO: 77555 - DNA, 22 bp, Homo sapiens
ttaagggccattatggatgggt

SEQ ID NO: 77556 - DNA, 22 bp, Homo sapiens
gagctgaaggagaaagcagggg

SEQ ID NO: 77557 - DNA, 22 bp, Homo sapiens
taagcccaggaatgcacttcag

SEQ ID NO: 77558 - DNA, 22 bp, Homo sapiens
ggagtagctgcattccgagcac

SEQ ID NO: 77559 - DNA, 22 bp, Homo sapiens
aacactctctgttggtaaggct

SEQ ID NO: 77560 - DNA, 22 bp, Homo sapiens
acttattagacatcttcattgt

SEQ ID NO: 77561 - DNA, 22 bp, Homo sapiens
tccttagacaaagagtgggctt

SEQ ID NO: 77562 - DNA, 22 bp, Homo sapiens
ggccttggttccaaagcaggca

SEQ ID NO: 77563 - DNA, 22 bp, Homo sapiens
gtagctctgtttaaagttcttt

SEQ ID NO: 77564 - DNA, 22 bp, Homo sapiens
ccagttccagtgctcacatcca

SEQ ID NO: 77565 - DNA, 22 bp, Homo sapiens
aatgttgcagagtgattgtcca

SEQ ID NO: 77566 - DNA, 20 bp, Homo sapiens
cgcccagtgcggttctgacc

SEQ ID NO: 77567 - DNA, 22 bp, Homo sapiens
aagaggtaaccatagcaaccac

SEQ ID NO: 77568 - DNA, 22 bp, Homo sapiens
cagcctggtccccggctcaccc

SEQ ID NO: 77569 - DNA, 22 bp, Homo sapiens
gctccctggtagccatgctctc

SEQ ID NO: 77570 - DNA, 22 bp, Homo sapiens
gggccggagctgggtcccgcgc

SEQ ID NO: 77571 - DNA, 22 bp, Homo sapiens
cacagagctggaaaggctgggc

SEQ ID NO: 77572 - DNA, 22 bp, Homo sapiens
ggttctctaactttgactggag

SEQ ID NO: 77573 - DNA, 22 bp, Homo sapiens
gcccagagttcaaggctgcagt

SEQ ID NO: 77574 - DNA, 22 bp, Homo sapiens
gaccttcttgctgtgtcctaac

SEQ ID NO: 77575 - DNA, 22 bp, Homo sapiens
gaacactgctgttgggttctga

SEQ ID NO: 77576 - DNA, 22 bp, Homo sapiens
caccatgcctggctaatttttt

SEQ ID NO: 77577 - DNA, 22 bp, Homo sapiens
tttggcggactgagaacgcggg

SEQ ID NO: 77578 - DNA, 22 bp, Homo sapiens
gctcgaccgccagaaacttcct

SEQ ID NO: 77579 - DNA, 22 bp, Homo sapiens
gagcaggtgcctgtagctctct

SEQ ID NO: 77580 - DNA, 22 bp, Homo sapiens
tcactgcaagctccacctcccg

SEQ ID NO: 77581 - DNA, 21 bp, Homo sapiens
cagagctgtccaaaccctgac

SEQ ID NO: 77582 - DNA, 22 bp, Homo sapiens
gaccatcctggccaacgtggta

SEQ ID NO: 77583 - DNA, 22 bp, Homo sapiens
aggctatttccactcttctcat

SEQ ID NO: 77584 - DNA, 22 bp, Homo sapiens
tgggggagctcagtccagccca

SEQ ID NO: 77585 - DNA, 18 bp, Homo sapiens
tgagagcattcgaggcaa

SEQ ID NO: 77586 - DNA, 22 bp, Homo sapiens
taggtttcagaggtgccgggaa

SEQ ID NO: 77587 - DNA, 22 bp, Homo sapiens
atgttggagtcgtaaggcatgg

SEQ ID NO: 77588 - DNA, 22 bp, Homo sapiens
ggcagcactgcagcttgttggg

SEQ ID NO: 77589 - DNA, 22 bp, Homo sapiens
actgcaacacctcctgggttca

SEQ ID NO: 77590 - DNA, 22 bp, Homo sapiens
cccaggaggcagagcttgcagt

SEQ ID NO: 77591 - DNA, 22 bp, Homo sapiens
gggccctgggattcagagcaag

SEQ ID NO: 77592 - DNA, 22 bp, Homo sapiens
agtccaggcattccagccattc

SEQ ID NO: 77593 - DNA, 22 bp, Homo sapiens
agcctctctgttagtcactggg

SEQ ID NO: 77594 - DNA, 22 bp, Homo sapiens
ggtgtccgcgctgtagaaggtc

SEQ ID NO: 77595 - DNA, 22 bp, Homo sapiens
cccactgtttccctgaggctct

SEQ ID NO: 77596 - DNA, 22 bp, Homo sapiens
tctttggatggaaattggagtc

SEQ ID NO: 77597 - DNA, 22 bp, Homo sapiens
acatcctcccgatctactggct

SEQ ID NO: 77598 - DNA, 22 bp, Homo sapiens
taggtttaggagtgaaggtgaa

SEQ ID NO: 77599 - DNA, 22 bp, Homo sapiens
gtggagaggaacccagctctgt

SEQ ID NO: 77600 - DNA, 22 bp, Homo sapiens
caggctggagtgcagtggcgcc

SEQ ID NO: 77601 - DNA, 22 bp, Homo sapiens
agccctcgtttctgcatcctgt

SEQ ID NO: 77602 - DNA, 22 bp, Homo sapiens
cgcccaggctggagtgcagtga

SEQ ID NO: 77603 - DNA, 22 bp, Homo sapiens
ctgagatctttatacgaggcac

SEQ ID NO: 77604 - DNA, 22 bp, Homo sapiens
ctgcatccatgttgctgcaaag

SEQ ID NO: 77605 - DNA, 22 bp, Homo sapiens
tctcccaggcaggagtgcagtg

SEQ ID NO: 77606 - DNA, 22 bp, Homo sapiens
agctggtgtgccagttccagtt

SEQ ID NO: 77607 - DNA, 22 bp, Homo sapiens
tgccctggctcttcttgttcca

SEQ ID NO: 77608 - DNA, 22 bp, Homo sapiens
gctgtcttgctcactcttgcag

SEQ ID NO: 77609 - DNA, 22 bp, Homo sapiens
ccagcagccaccttctcgaaat

SEQ ID NO: 77610 - DNA, 23 bp, Homo sapiens
ggagtgcaatggcgccatctcgg

SEQ ID NO: 77611 - DNA, 22 bp, Homo sapiens
ctgcactgacttccccggctgc

SEQ ID NO: 77612 - DNA, 22 bp, Homo sapiens
tgcgaccctagccccctcactt

SEQ ID NO: 77613 - DNA, 22 bp, Homo sapiens
tttggaaattttcatccagaca

SEQ ID NO: 77614 - DNA, 17 bp, Homo sapiens
tactgaggggtctggag

SEQ ID NO: 77615 - DNA, 22 bp, Homo sapiens
aggaaaatggaccagagttgtt

SEQ ID NO: 77616 - DNA, 22 bp, Homo sapiens
aaaaaattatcatagttcctga

SEQ ID NO: 77617 - DNA, 22 bp, Homo sapiens
aatatcatctctcttttctgca

SEQ ID NO: 77618 - DNA, 22 bp, Homo sapiens
taaagttggacctgattttatt

SEQ ID NO: 77619 - DNA, 22 bp, Homo sapiens
gccgggttcaagccattctcct

SEQ ID NO: 77620 - DNA, 22 bp, Homo sapiens
ctgggcctggggctgttgagag

SEQ ID NO: 77621 - DNA, 22 bp, Homo sapiens
ccagaaaaatcctcccttgtcc

SEQ ID NO: 77622 - DNA, 22 bp, Homo sapiens
gtagaggggtgattctgtgaga

SEQ ID NO: 77623 - DNA, 22 bp, Homo sapiens
aagccctggcgggtggagggcc

SEQ ID NO: 77624 - DNA, 22 bp, Homo sapiens
aagaagagaactggcatcctaa

SEQ ID NO: 77625 - DNA, 22 bp, Homo sapiens
ttagggttacaccagcctcctg

SEQ ID NO: 77626 - DNA, 22 bp, Homo sapiens
gcctggattccttgtttctcag

SEQ ID NO: 77627 - DNA, 22 bp, Homo sapiens
tcgcttgaacccaggaagtgga

SEQ ID NO: 77628 - DNA, 22 bp, Homo sapiens
ggcaaagccctgcctggttcaa

SEQ ID NO: 77629 - DNA, 22 bp, Homo sapiens
tgtttcttacgtttttagaggc

SEQ ID NO: 77630 - DNA, 22 bp, Homo sapiens
cagaggtagcatgctgtggctt

SEQ ID NO: 77631 - DNA, 22 bp, Homo sapiens
tgtgccataggcagcgtggcca

SEQ ID NO: 77632 - DNA, 20 bp, Homo sapiens
aagagcctgggtccctcaga

SEQ ID NO: 77633 - DNA, 22 bp, Homo sapiens
gagcctggagctggaacgaagc

SEQ ID NO: 77634 - DNA, 22 bp, Homo sapiens
ttgtgaatggtgccgcaataaa

SEQ ID NO: 77635 - DNA, 17 bp, Homo sapiens
gggcagggactcctggg

SEQ ID NO: 77636 - DNA, 22 bp, Homo sapiens
tctgttgcaatgtgcatggtga

SEQ ID NO: 77637 - DNA, 22 bp, Homo sapiens
caggcagggagctggaaaggat

SEQ ID NO: 77638 - DNA, 22 bp, Homo sapiens
ctcactgcaagttccacctacc

SEQ ID NO: 77639 - DNA, 22 bp, Homo sapiens
gcttctcaattctcaccctcca

SEQ ID NO: 77640 - DNA, 22 bp, Homo sapiens
ttggcttttatgcagcttaggt

SEQ ID NO: 77641 - DNA, 22 bp, Homo sapiens
cacttgttggtggtgaaatcac

SEQ ID NO: 77642 - DNA, 22 bp, Homo sapiens
cactgcaacctccacctcctgg

SEQ ID NO: 77643 - DNA, 22 bp, Homo sapiens
gtcctgtgagattcatgctcaa

SEQ ID NO: 77644 - DNA, 22 bp, Homo sapiens
ctgggaggcagaggttgcagtg

SEQ ID NO: 77645 - DNA, 22 bp, Homo sapiens
agggaagaggaccagagtctct

SEQ ID NO: 77646 - DNA, 22 bp, Homo sapiens
cagcttggaggaggatctaaga

SEQ ID NO: 77647 - DNA, 22 bp, Homo sapiens
aagatactttgcatgcatgaag

SEQ ID NO: 77648 - DNA, 16 bp, Homo sapiens
gcaggcagatcacatg

SEQ ID NO: 77649 - DNA, 22 bp, Homo sapiens
tgccacagacaggacagaacag

SEQ ID NO: 77650 - DNA, 22 bp, Homo sapiens
gacaattgcttttgccgaataa

SEQ ID NO: 77651 - DNA, 22 bp, Homo sapiens
agtgagagtattaatgtgaact

SEQ ID NO: 77652 - DNA, 22 bp, Homo sapiens
gagcaccgcctccacgatgccc

SEQ ID NO: 77653 - DNA, 22 bp, Homo sapiens
ttttcaggctgatttgtgttag

SEQ ID NO: 77654 - DNA, 20 bp, Homo sapiens
aggggcacctgcgacggggc

SEQ ID NO: 77655 - DNA, 22 bp, Homo sapiens
tcaggaggtccgcccgggaggg

SEQ ID NO: 77656 - DNA, 22 bp, Homo sapiens
actgcactccagcctgggtaac

SEQ ID NO: 77657 - DNA, 22 bp, Homo sapiens
actgcactccaacctgggtgac

SEQ ID NO: 77658 - DNA, 22 bp, Homo sapiens
tcctgccgtcctccggggcctc

SEQ ID NO: 77659 - DNA, 23 bp, Homo sapiens
ctgttatatgggtgttatgtgct

SEQ ID NO: 77660 - DNA, 22 bp, Homo sapiens
acaggcttacaggctgcaagta

SEQ ID NO: 77661 - DNA, 22 bp, Homo sapiens
tgcacgtgtgagcattcacatg

SEQ ID NO: 77662 - DNA, 22 bp, Homo sapiens
ctctgcctcagtgatttcttta

SEQ ID NO: 77663 - DNA, 22 bp, Homo sapiens
tggtacaatcacagctcactgt

SEQ ID NO: 77664 - DNA, 22 bp, Homo sapiens
taggcatgcaaataaatgtgca

SEQ ID NO: 77665 - DNA, 22 bp, Homo sapiens
ccaggggttggaggttgcagtg

SEQ ID NO: 77666 - DNA, 22 bp, Homo sapiens
gcaggcagatcacctgtcagga

SEQ ID NO: 77667 - DNA, 22 bp, Homo sapiens
ggccactgctctccagcctggg

SEQ ID NO: 77668 - DNA, 22 bp, Homo sapiens
atcatgttttaattagcaaact

SEQ ID NO: 77669 - DNA, 22 bp, Homo sapiens
cagcagtgtacaaggtgtcaga

SEQ ID NO: 77670 - DNA, 22 bp, Homo sapiens
tgatatgggaaaagggctcgga

SEQ ID NO: 77671 - DNA, 22 bp, Homo sapiens
tggttgcctctcagagattccg

SEQ ID NO: 77672 - DNA, 22 bp, Homo sapiens
gtgctggggagataggaagaga

SEQ ID NO: 77673 - DNA, 22 bp, Homo sapiens
ctggaaggcggaggttgtagtg

SEQ ID NO: 77674 - DNA, 22 bp, Homo sapiens
caccaggctggagtgcagtggc

SEQ ID NO: 77675 - DNA, 22 bp, Homo sapiens
acaaagtgctgacattacaggc

SEQ ID NO: 77676 - DNA, 22 bp, Homo sapiens
ctcgcatgccctgcctcatcca

SEQ ID NO: 77677 - DNA, 22 bp, Homo sapiens
aaagattaaatcaaattggtca

SEQ ID NO: 77678 - DNA, 22 bp, Homo sapiens
aagcactttatgtcaatgtcct

SEQ ID NO: 77679 - DNA, 22 bp, Homo sapiens
ttctttcagaacacaagtgatt

SEQ ID NO: 77680 - DNA, 22 bp, Homo sapiens
tatccaattcaccattgatggg

SEQ ID NO: 77681 - DNA, 22 bp, Homo sapiens
gcaaacaaggacatacatcctg

SEQ ID NO: 77682 - DNA, 20 bp, Homo sapiens
ttcaggaataagatagcagc

SEQ ID NO: 77683 - DNA, 22 bp, Homo sapiens
aaaagttattgatgcaggacaa

SEQ ID NO: 77684 - DNA, 22 bp, Homo sapiens
tggcccttgttcaaatatgtca

SEQ ID NO: 77685 - DNA, 22 bp, Homo sapiens
tggcagtggcgggactcagggc

SEQ ID NO: 77686 - DNA, 22 bp, Homo sapiens
agtgcaggccccaggccaggcc

SEQ ID NO: 77687 - DNA, 22 bp, Homo sapiens
attgttgggtctcactcctaga

SEQ ID NO: 77688 - DNA, 22 bp, Homo sapiens
taagaaatttagttatagaatg

SEQ ID NO: 77689 - DNA, 22 bp, Homo sapiens
tgggaggccgaggcaggtggat

SEQ ID NO: 77690 - DNA, 22 bp, Homo sapiens
aacccacaaaggatttcagctc

SEQ ID NO: 77691 - DNA, 22 bp, Homo sapiens
tgcatattatgtgtatctgtct

SEQ ID NO: 77692 - DNA, 22 bp, Homo sapiens
attttctatgttgtaattgtta

SEQ ID NO: 77693 - DNA, 22 bp, Homo sapiens
cacgcacgctgggtggaggcgc

SEQ ID NO: 77694 - DNA, 22 bp, Homo sapiens
gaattttattactagtcaactg

SEQ ID NO: 77695 - DNA, 22 bp, Homo sapiens
aggaaggactccatggtccgtc

SEQ ID NO: 77696 - DNA, 22 bp, Homo sapiens
gctcactgcaacctccgccttc

SEQ ID NO: 77697 - DNA, 22 bp, Homo sapiens
aaacccagggttttgtcttccc

SEQ ID NO: 77698 - DNA, 22 bp, Homo sapiens
tttgtcttatccaatctctcag

SEQ ID NO: 77699 - DNA, 22 bp, Homo sapiens
ctactggccatctgatctacaa

SEQ ID NO: 77700 - DNA, 22 bp, Homo sapiens
tctaatccttgctacctgggtg

SEQ ID NO: 77701 - DNA, 22 bp, Homo sapiens
ctgtccccacccaaatctcatc

SEQ ID NO: 77702 - DNA, 18 bp, Homo sapiens
acacttcctggtggtgtg

SEQ ID NO: 77703 - DNA, 22 bp, Homo sapiens
tctgcatattgttaatggaatg

SEQ ID NO: 77704 - DNA, 22 bp, Homo sapiens
agaggccggccgagcccatggg

SEQ ID NO: 77705 - DNA, 22 bp, Homo sapiens
tggaatgtcagctacaagaggg

SEQ ID NO: 77706 - DNA, 18 bp, Homo sapiens
gatatggaaggccatgcc

SEQ ID NO: 77707 - DNA, 22 bp, Homo sapiens
agctgattccactttttcccca

SEQ ID NO: 77708 - DNA, 22 bp, Homo sapiens
agaggaggctctgggatcgtcc

SEQ ID NO: 77709 - DNA, 22 bp, Homo sapiens
ggtttattgttaataagtttga

SEQ ID NO: 77710 - DNA, 22 bp, Homo sapiens
tgaggcaggaggttgagaactg

SEQ ID NO: 77711 - DNA, 22 bp, Homo sapiens
taagcctgcatgaaccatgaga

SEQ ID NO: 77712 - DNA, 22 bp, Homo sapiens
cagagctgtccaaaccctgaca

SEQ ID NO: 77713 - DNA, 22 bp, Homo sapiens
ttgcaaatcagaagtatagatt

SEQ ID NO: 77714 - DNA, 22 bp, Homo sapiens
ttcttctttccaattacatggt

SEQ ID NO: 77715 - DNA, 22 bp, Homo sapiens
gcctggagaaaggaaggtggga

SEQ ID NO: 77716 - DNA, 22 bp, Homo sapiens
ccagcagagcatggggaggaag

SEQ ID NO: 77717 - DNA, 22 bp, Homo sapiens
agcataagttggtacagccact

SEQ ID NO: 77718 - DNA, 22 bp, Homo sapiens
ttggatgagagggtgtggtaca

SEQ ID NO: 77719 - DNA, 22 bp, Homo sapiens
actgcattctttatcccacaac

SEQ ID NO: 77720 - DNA, 22 bp, Homo sapiens
gatctggaatctgaaggctgag

SEQ ID NO: 77721 - DNA, 22 bp, Homo sapiens
agatttggtgtctggttgatat

SEQ ID NO: 77722 - DNA, 22 bp, Homo sapiens
cggtctcccgtgtgtgtgcgct

SEQ ID NO: 77723 - DNA, 22 bp, Homo sapiens
taggtcagaacaagcagtatcg

SEQ ID NO: 77724 - DNA, 22 bp, Homo sapiens
ttcccttaaattatggcatcta

SEQ ID NO: 77725 - DNA, 22 bp, Homo sapiens
aggaggggttctcgggtgctga

SEQ ID NO: 77726 - DNA, 22 bp, Homo sapiens
ccatgaattcactccatgctag

SEQ ID NO: 77727 - DNA, 22 bp, Homo sapiens
ctgatagacaatcaccatggga

SEQ ID NO: 77728 - DNA, 22 bp, Homo sapiens
aaagtgctgaaattacaggggt

SEQ ID NO: 77729 - DNA, 22 bp, Homo sapiens
tgggcagggagctggaaccaca

SEQ ID NO: 77730 - DNA, 22 bp, Homo sapiens
ctggtgtggactccgcgcggag

SEQ ID NO: 77731 - DNA, 22 bp, Homo sapiens
tcttcccccgtgctccagtgca

SEQ ID NO: 77732 - DNA, 22 bp, Homo sapiens
gtgtaagtatctttgtatcttt

SEQ ID NO: 77733 - DNA, 22 bp, Homo sapiens
aagaggttgtctgtgatgagtt

SEQ ID NO: 77734 - DNA, 19 bp, Homo sapiens
agggttacccgctgccacc

SEQ ID NO: 77735 - DNA, 22 bp, Homo sapiens
ctgaacttattgagtgcttgct

SEQ ID NO: 77736 - DNA, 22 bp, Homo sapiens
ttcctagggcagagccgctggg

SEQ ID NO: 77737 - DNA, 22 bp, Homo sapiens
tcgaaataatttagaatataga

SEQ ID NO: 77738 - DNA, 22 bp, Homo sapiens
tttgaagggcacgacaatagtt

SEQ ID NO: 77739 - DNA, 22 bp, Homo sapiens
gccaggttgctgacgacgatct

SEQ ID NO: 77740 - DNA, 22 bp, Homo sapiens
agttgcagacgcagagatgttg

SEQ ID NO: 77741 - DNA, 22 bp, Homo sapiens
acacagggctgcgcctgacccc

SEQ ID NO: 77742 - DNA, 22 bp, Homo sapiens
tgaccgttttggcacccatgct

SEQ ID NO: 77743 - DNA, 22 bp, Homo sapiens
gggcggatcatttgaggtcagg

SEQ ID NO: 77744 - DNA, 22 bp, Homo sapiens
agatttatgtggtcacactcag

SEQ ID NO: 77745 - DNA, 22 bp, Homo sapiens
ttccatacgactgaggtctcgg

SEQ ID NO: 77746 - DNA, 22 bp, Homo sapiens
caggctggagttcagtggtgtg

SEQ ID NO: 77747 - DNA, 21 bp, Homo sapiens
cccaaaagttctgagatggct

SEQ ID NO: 77748 - DNA, 19 bp, Homo sapiens
agagtattgaatttgccct

SEQ ID NO: 77749 - DNA, 22 bp, Homo sapiens
aaagcagaactgagagagctgg

SEQ ID NO: 77750 - DNA, 22 bp, Homo sapiens
ttttctaacatctagtaatttg

SEQ ID NO: 77751 - DNA, 22 bp, Homo sapiens
aaagtgctgggattacaggcct

SEQ ID NO: 77752 - DNA, 22 bp, Homo sapiens
ctgaggaggctaatttgaggat

SEQ ID NO: 77753 - DNA, 22 bp, Homo sapiens
gcagaggacacaggagggcaag

SEQ ID NO: 77754 - DNA, 22 bp, Homo sapiens
gggagctgaaggagccggcggg

SEQ ID NO: 77755 - DNA, 22 bp, Homo sapiens
gccctagcgccagctcagcacc

SEQ ID NO: 77756 - DNA, 22 bp, Homo sapiens
ccgggagcaggcgccaccgcca

SEQ ID NO: 77757 - DNA, 22 bp, Homo sapiens
gggggctaccgtctctggagct

SEQ ID NO: 77758 - DNA, 22 bp, Homo sapiens
actgcgctccagcctgggtgac

SEQ ID NO: 77759 - DNA, 22 bp, Homo sapiens
agccctcttccagccagcacag

SEQ ID NO: 77760 - DNA, 22 bp, Homo sapiens
tgagccgtggtctctgagggtg

SEQ ID NO: 77761 - DNA, 22 bp, Homo sapiens
taatatctacttcatagagttt

SEQ ID NO: 77762 - DNA, 22 bp, Homo sapiens
tgaagactcagaagctaagata

SEQ ID NO: 77763 - DNA, 22 bp, Homo sapiens
cgtctaggccgtgccctgaggt

SEQ ID NO: 77764 - DNA, 22 bp, Homo sapiens
ttcaggaagtgctgcctggtgt

SEQ ID NO: 77765 - DNA, 22 bp, Homo sapiens
ctgatcctcctttaagtagctg

SEQ ID NO: 77766 - DNA, 20 bp, Homo sapiens
aggaaaaatggaaactggag

SEQ ID NO: 77767 - DNA, 22 bp, Homo sapiens
cagcaggaggtgagtagcaggt

SEQ ID NO: 77768 - DNA, 22 bp, Homo sapiens
ggcgtttcaccatgttgaccag

SEQ ID NO: 77769 - DNA, 22 bp, Homo sapiens
ggcctcgcggcttctggtggct

SEQ ID NO: 77770 - DNA, 22 bp, Homo sapiens
ggaggcggaagttgcagtgagc

SEQ ID NO: 77771 - DNA, 22 bp, Homo sapiens
attggtagttttgtatttctct

SEQ ID NO: 77772 - DNA, 22 bp, Homo sapiens
gggaagatagtgttgagggccc

SEQ ID NO: 77773 - DNA, 22 bp, Homo sapiens
caaagtgctaggattataggtg

SEQ ID NO: 77774 - DNA, 22 bp, Homo sapiens
ttgggctcaggagtttgagacc

SEQ ID NO: 77775 - DNA, 19 bp, Homo sapiens
ggggcctgtgatggtcaca

SEQ ID NO: 77776 - DNA, 22 bp, Homo sapiens
aatgtcaaaggctatacattca

SEQ ID NO: 77777 - DNA, 22 bp, Homo sapiens
ggctttgacatgctgaattaaa

SEQ ID NO: 77778 - DNA, 23 bp, Homo sapiens
ggggcctgcaccggtctgcgcgg

SEQ ID NO: 77779 - DNA, 22 bp, Homo sapiens
tcactgcacttcagcttgggca

SEQ ID NO: 77780 - DNA, 22 bp, Homo sapiens
cagccctcctaccctgccaggc

SEQ ID NO: 77781 - DNA, 22 bp, Homo sapiens
gccatcctgatgacaggccact

SEQ ID NO: 77782 - DNA, 22 bp, Homo sapiens
ggcctttgcgtccacgccgctt

SEQ ID NO: 77783 - DNA, 22 bp, Homo sapiens
ccagcttgaagatgtgctggtt

SEQ ID NO: 77784 - DNA, 22 bp, Homo sapiens
cccaggaggttgaggctgcagt

SEQ ID NO: 77785 - DNA, 22 bp, Homo sapiens
tcagtgcagggtgggagagaga

SEQ ID NO: 77786 - DNA, 22 bp, Homo sapiens
gctgccaatccagctgtgggag

SEQ ID NO: 77787 - DNA, 22 bp, Homo sapiens
tttacaacccaagtccagagag

SEQ ID NO: 77788 - DNA, 22 bp, Homo sapiens
gtgttgatgacattttagaaac

SEQ ID NO: 77789 - DNA, 22 bp, Homo sapiens
tcgcaccattgcactccagcca

SEQ ID NO: 77790 - DNA, 22 bp, Homo sapiens
aagaaggcggaccagaagggag

SEQ ID NO: 77791 - DNA, 22 bp, Homo sapiens
ttttcctttgattcccagatgt

SEQ ID NO: 77792 - DNA, 22 bp, Homo sapiens
gtaatctcagctacttgggagg

SEQ ID NO: 77793 - DNA, 22 bp, Homo sapiens
gcaccgccttggaccgcccgct

SEQ ID NO: 77794 - DNA, 22 bp, Homo sapiens
acccaggctggcgtgcagtggc

SEQ ID NO: 77795 - DNA, 22 bp, Homo sapiens
tttacacagaggacactgggct

SEQ ID NO: 77796 - DNA, 22 bp, Homo sapiens
ttttggctctgtctgtatcttt

SEQ ID NO: 77797 - DNA, 22 bp, Homo sapiens
ctgggaggcagaggttgtagtg

SEQ ID NO: 77798 - DNA, 22 bp, Homo sapiens
ggaactcctgctccaagcagct

SEQ ID NO: 77799 - DNA, 22 bp, Homo sapiens
ggtcccaggttgacagggagac

SEQ ID NO: 77800 - DNA, 22 bp, Homo sapiens
tggttacccagtcgctggagtt

SEQ ID NO: 77801 - DNA, 19 bp, Homo sapiens
accttctgggaaacattcc

SEQ ID NO: 77802 - DNA, 22 bp, Homo sapiens
gagaaagcttctttcccacagg

SEQ ID NO: 77803 - DNA, 21 bp, Homo sapiens
cactccacttagaacagggtt

SEQ ID NO: 77804 - DNA, 22 bp, Homo sapiens
ttgtgaatagtgccgcaataaa

SEQ ID NO: 77805 - DNA, 21 bp, Homo sapiens
tgcaatccagcctgggcgaca

SEQ ID NO: 77806 - DNA, 22 bp, Homo sapiens
atggctctgttttttatgctct

SEQ ID NO: 77807 - DNA, 22 bp, Homo sapiens
acagacaagtagttcagacaag

SEQ ID NO: 77808 - DNA, 22 bp, Homo sapiens
taaaatttgtccctgagtgttg

SEQ ID NO: 77809 - DNA, 22 bp, Homo sapiens
gaggctgaggcaggaggatcac

SEQ ID NO: 77810 - DNA, 22 bp, Homo sapiens
atccaccctgtggtggctttct

SEQ ID NO: 77811 - DNA, 22 bp, Homo sapiens
tattttgtgccatgcactgcct

SEQ ID NO: 77812 - DNA, 22 bp, Homo sapiens
gagaggtggaggttgcagtgag

SEQ ID NO: 77813 - DNA, 22 bp, Homo sapiens
aacatgatttcatgcatttaga

SEQ ID NO: 77814 - DNA, 22 bp, Homo sapiens
agcgggtctgcaagccttccct

SEQ ID NO: 77815 - DNA, 22 bp, Homo sapiens
ctggagggctgcagcgaggctg

SEQ ID NO: 77816 - DNA, 22 bp, Homo sapiens
cgcggtggcggcctccagcgcc

SEQ ID NO: 77817 - DNA, 22 bp, Homo sapiens
tccattatacttctgattcaaa

SEQ ID NO: 77818 - DNA, 22 bp, Homo sapiens
gctggtgagcaaaggagaagga

SEQ ID NO: 77819 - DNA, 18 bp, Homo sapiens
tctgtgggatcagtgagg

SEQ ID NO: 77820 - DNA, 22 bp, Homo sapiens
caggtgagaggcggtcctgcat

SEQ ID NO: 77821 - DNA, 22 bp, Homo sapiens
ttctcccatctcagtcttacat

SEQ ID NO: 77822 - DNA, 22 bp, Homo sapiens
gagacacaggcacagaagaggc

SEQ ID NO: 77823 - DNA, 22 bp, Homo sapiens
gcacagccacgtaatgtggtca

SEQ ID NO: 77824 - DNA, 21 bp, Homo sapiens
agaaggcaaaagcagacatct

SEQ ID NO: 77825 - DNA, 23 bp, Homo sapiens
gacagagtgagaccttgtcttac

SEQ ID NO: 77826 - DNA, 22 bp, Homo sapiens
gaggcaggcagattgcttgagg

SEQ ID NO: 77827 - DNA, 22 bp, Homo sapiens
ggggaccctcaggactgcgtct

SEQ ID NO: 77828 - DNA, 19 bp, Homo sapiens
tctgaagaattagagagca

SEQ ID NO: 77829 - DNA, 22 bp, Homo sapiens
ggcgccagcactgcagcgcctc

SEQ ID NO: 77830 - DNA, 22 bp, Homo sapiens
gctgctgggatcctgggtctca

SEQ ID NO: 77831 - DNA, 22 bp, Homo sapiens
tgagtggacacctgcttcttta

SEQ ID NO: 77832 - DNA, 22 bp, Homo sapiens
gagcactgagctggaattggag

SEQ ID NO: 77833 - DNA, 22 bp, Homo sapiens
tttgaggttagctagcagatca

SEQ ID NO: 77834 - DNA, 22 bp, Homo sapiens
gagggccctggctggctccagc

SEQ ID NO: 77835 - DNA, 22 bp, Homo sapiens
ttgagatggagtcttgctctct

SEQ ID NO: 77836 - DNA, 21 bp, Homo sapiens
ctggaggcaggtggtgccagg

SEQ ID NO: 77837 - DNA, 22 bp, Homo sapiens
gaaagtgctctctctatacaca

SEQ ID NO: 77838 - DNA, 22 bp, Homo sapiens
tgttttaagggtcaactgtcac

SEQ ID NO: 77839 - DNA, 22 bp, Homo sapiens
tgttcttgagcctttagaccta

SEQ ID NO: 77840 - DNA, 22 bp, Homo sapiens
ctcagctgcagcctggctggca

SEQ ID NO: 77841 - DNA, 22 bp, Homo sapiens
atttagaactttgtttgccaat

SEQ ID NO: 77842 - DNA, 22 bp, Homo sapiens
ttccccttgataagcagggttg

SEQ ID NO: 77843 - DNA, 22 bp, Homo sapiens
tccgggggtggtagatttcctt

SEQ ID NO: 77844 - DNA, 22 bp, Homo sapiens
tgtacacatggtgtacactccc

SEQ ID NO: 77845 - DNA, 22 bp, Homo sapiens
tgcgggttggtggcatatgcag

SEQ ID NO: 77846 - DNA, 16 bp, Homo sapiens
gcagaggaaaggggag

SEQ ID NO: 77847 - DNA, 22 bp, Homo sapiens
gccttgatctgctgtgtttgag

SEQ ID NO: 77848 - DNA, 22 bp, Homo sapiens
cccaggccccagggcttgtcag

SEQ ID NO: 77849 - DNA, 22 bp, Homo sapiens
gtcaggactctgacccgtcccg

SEQ ID NO: 77850 - DNA, 22 bp, Homo sapiens
accttcaggtgagcacacagat

SEQ ID NO: 77851 - DNA, 22 bp, Homo sapiens
tgccatagcaatggtaagctga

SEQ ID NO: 77852 - DNA, 22 bp, Homo sapiens
tggaaccatcaaagagatcctg

SEQ ID NO: 77853 - DNA, 22 bp, Homo sapiens
gagctactgaaatattgatttt

SEQ ID NO: 77854 - DNA, 22 bp, Homo sapiens
taggcgacagcttgatggtgcg

SEQ ID NO: 77855 - DNA, 22 bp, Homo sapiens
gtggaatttttacctatgaatg

SEQ ID NO: 77856 - DNA, 22 bp, Homo sapiens
cggtcaggtgcagcgttggcac

SEQ ID NO: 77857 - DNA, 22 bp, Homo sapiens
tgacttgtctctttgggagaca

SEQ ID NO: 77858 - DNA, 22 bp, Homo sapiens
tgtcttcaggagtaaatatcat

SEQ ID NO: 77859 - DNA, 22 bp, Homo sapiens
tgggcttggtttctaggtaggt

SEQ ID NO: 77860 - DNA, 22 bp, Homo sapiens
agacatccttcaagtgatatgt

SEQ ID NO: 77861 - DNA, 22 bp, Homo sapiens
ctgtggctctcagaggctgctg

SEQ ID NO: 77862 - DNA, 22 bp, Homo sapiens
gccaggcgggtctcaaactcct

SEQ ID NO: 77863 - DNA, 22 bp, Homo sapiens
tgagcctgagttcaaggctgca

SEQ ID NO: 77864 - DNA, 22 bp, Homo sapiens
tacatagctcctagtgatgcat

SEQ ID NO: 77865 - DNA, 22 bp, Homo sapiens
ctcctgagctctgaggaagctt

SEQ ID NO: 77866 - DNA, 22 bp, Homo sapiens
cagcccaggactgcaggtgttt

SEQ ID NO: 77867 - DNA, 22 bp, Homo sapiens
tccttcactccctctgcatcca

SEQ ID NO: 77868 - DNA, 22 bp, Homo sapiens
ctagggtcaggggcctgcgtcg

SEQ ID NO: 77869 - DNA, 22 bp, Homo sapiens
aggggcgtgctcttccccgacg

SEQ ID NO: 77870 - DNA, 22 bp, Homo sapiens
gctgtctcatacaaggccctgc

SEQ ID NO: 77871 - DNA, 22 bp, Homo sapiens
gaggggcacagtaaagggtccc

SEQ ID NO: 77872 - DNA, 22 bp, Homo sapiens
cttgatgagtcagaactgaagg

SEQ ID NO: 77873 - DNA, 22 bp, Homo sapiens
gattcactcatattttacgttt

SEQ ID NO: 77874 - DNA, 19 bp, Homo sapiens
ctgtccttggctgcactgt

SEQ ID NO: 77875 - DNA, 22 bp, Homo sapiens
tagagctggccgggacagctgg

SEQ ID NO: 77876 - DNA, 22 bp, Homo sapiens
gccagtgcctcgccgcgctcct

SEQ ID NO: 77877 - DNA, 20 bp, Homo sapiens
ttgttagaggaatgccatag

SEQ ID NO: 77878 - DNA, 22 bp, Homo sapiens
ctcagcagtatactctgaagat

SEQ ID NO: 77879 - DNA, 22 bp, Homo sapiens
ggtcttttctgctgcaggttgt

SEQ ID NO: 77880 - DNA, 22 bp, Homo sapiens
gccagatttacagatttgccct

SEQ ID NO: 77881 - DNA, 22 bp, Homo sapiens
tagaagaaagtgaagctgggga

SEQ ID NO: 77882 - DNA, 22 bp, Homo sapiens
tggtggctaccaggtcctgggg

SEQ ID NO: 77883 - DNA, 22 bp, Homo sapiens
ggctgggctccgggagcatgcg

SEQ ID NO: 77884 - DNA, 22 bp, Homo sapiens
tgttcttaggtatttgacagtc

SEQ ID NO: 77885 - DNA, 22 bp, Homo sapiens
cggctcactgcagctccgcctc

SEQ ID NO: 77886 - DNA, 22 bp, Homo sapiens
aatggctctgatgttgttgtga

SEQ ID NO: 77887 - DNA, 22 bp, Homo sapiens
agaatttcctatgagagattcc

SEQ ID NO: 77888 - DNA, 19 bp, Homo sapiens
cgcctggcaggccctgcgc

SEQ ID NO: 77889 - DNA, 22 bp, Homo sapiens
gctcactgcaacctctgcctcc

SEQ ID NO: 77890 - DNA, 22 bp, Homo sapiens
tgcccaggctggagtacagtgg

SEQ ID NO: 77891 - DNA, 22 bp, Homo sapiens
agcaggagtttgatgcttttat

SEQ ID NO: 77892 - DNA, 20 bp, Homo sapiens
gggcagagccagccagtccc

SEQ ID NO: 77893 - DNA, 22 bp, Homo sapiens
aatggtttctgaagttaggcag

SEQ ID NO: 77894 - DNA, 22 bp, Homo sapiens
gaagttctttatagcagtgtga

SEQ ID NO: 77895 - DNA, 22 bp, Homo sapiens
tttggcggggcaattctgaagc

SEQ ID NO: 77896 - DNA, 22 bp, Homo sapiens
aagagggctgcaatcttattgc

SEQ ID NO: 77897 - DNA, 22 bp, Homo sapiens
ctaaaatgtttggggcagaacc

SEQ ID NO: 77898 - DNA, 22 bp, Homo sapiens
tgtttgagttctagcgcattta

SEQ ID NO: 77899 - DNA, 22 bp, Homo sapiens
caatgcattattctcccacttc

SEQ ID NO: 77900 - DNA, 22 bp, Homo sapiens
tcaggctcaggttaggggccaa

SEQ ID NO: 77901 - DNA, 19 bp, Homo sapiens
cggcccctcctctcgcgcc

SEQ ID NO: 77902 - DNA, 22 bp, Homo sapiens
ccaccgccatggcgttgtacag

SEQ ID NO: 77903 - DNA, 22 bp, Homo sapiens
tgcctccctggcaagtctctcc

SEQ ID NO: 77904 - DNA, 22 bp, Homo sapiens
gaaaggagagggttaaggagct

SEQ ID NO: 77905 - DNA, 22 bp, Homo sapiens
agggtcctgggtgcagttgctt

SEQ ID NO: 77906 - DNA, 22 bp, Homo sapiens
cccgcagtcggaatttctcagt

SEQ ID NO: 77907 - DNA, 22 bp, Homo sapiens
tttaatcataagaaggaaaata

SEQ ID NO: 77908 - DNA, 22 bp, Homo sapiens
cttcaggggtgttagttttgtg

SEQ ID NO: 77909 - DNA, 22 bp, Homo sapiens
cctggaaagagaatgaatgagc

SEQ ID NO: 77910 - DNA, 23 bp, Homo sapiens
aggatgtaggatgtatggcagag

SEQ ID NO: 77911 - DNA, 22 bp, Homo sapiens
tacaaaaaattgatactgacga

SEQ ID NO: 77912 - DNA, 22 bp, Homo sapiens
tccacgctgtgtgaccttgggc

SEQ ID NO: 77913 - DNA, 22 bp, Homo sapiens
tggccttggccgtgctggggtc

SEQ ID NO: 77914 - DNA, 22 bp, Homo sapiens
ttaggatttgaaaaggggcaga

SEQ ID NO: 77915 - DNA, 22 bp, Homo sapiens
gacctggtccttgtactttgaa

SEQ ID NO: 77916 - DNA, 22 bp, Homo sapiens
agcccaggtccagttcactgca

SEQ ID NO: 77917 - DNA, 22 bp, Homo sapiens
agcctattccaggatgagctca

SEQ ID NO: 77918 - DNA, 22 bp, Homo sapiens
cagctggtgtcaggcactgcag

SEQ ID NO: 77919 - DNA, 22 bp, Homo sapiens
cggagtcttgctatgttgccca

SEQ ID NO: 77920 - DNA, 22 bp, Homo sapiens
gagagaagggggatatgagcct

SEQ ID NO: 77921 - DNA, 19 bp, Homo sapiens
tcctggggaggggcatggc

SEQ ID NO: 77922 - DNA, 22 bp, Homo sapiens
gagagagctctgtgcctgggat

SEQ ID NO: 77923 - DNA, 22 bp, Homo sapiens
tcccacaggtggagcttgcagt

SEQ ID NO: 77924 - DNA, 22 bp, Homo sapiens
acagttaataagtagtaagtca

SEQ ID NO: 77925 - DNA, 22 bp, Homo sapiens
atgcattgtcaggcaatttcat

SEQ ID NO: 77926 - DNA, 22 bp, Homo sapiens
cgaggcggcggaagtgcccgta

SEQ ID NO: 77927 - DNA, 22 bp, Homo sapiens
gatctcaaagcagtgtgggttg

SEQ ID NO: 77928 - DNA, 22 bp, Homo sapiens
cctgcacatgtgtgcgcctgta

SEQ ID NO: 77929 - DNA, 22 bp, Homo sapiens
cactgcactccagcttgggtga

SEQ ID NO: 77930 - DNA, 22 bp, Homo sapiens
aggcaggaggatcatggatgca

SEQ ID NO: 77931 - DNA, 18 bp, Homo sapiens
ccctcttgcacaaagcaa

SEQ ID NO: 77932 - DNA, 22 bp, Homo sapiens
gtgggggctggaaatcttgcca

SEQ ID NO: 77933 - DNA, 22 bp, Homo sapiens
aggggtgaaagagggccctcaa

SEQ ID NO: 77934 - DNA, 22 bp, Homo sapiens
atgccacttcattccagcctcg

SEQ ID NO: 77935 - DNA, 22 bp, Homo sapiens
tggaaaactttggtggtgaggg

SEQ ID NO: 77936 - DNA, 22 bp, Homo sapiens
cctcggctgggccttggccact

SEQ ID NO: 77937 - DNA, 22 bp, Homo sapiens
gtccacagctctgaggtctccc

SEQ ID NO: 77938 - DNA, 22 bp, Homo sapiens
catctctggcttggattatggt

SEQ ID NO: 77939 - DNA, 22 bp, Homo sapiens
catgtgaattccaaagctaggt

SEQ ID NO: 77940 - DNA, 22 bp, Homo sapiens
ccagaggtgctctttggaagtg

SEQ ID NO: 77941 - DNA, 22 bp, Homo sapiens
aggtcacccgtttgactatcca

SEQ ID NO: 77942 - DNA, 22 bp, Homo sapiens
atgtgccaacgtgcaggtttgt

SEQ ID NO: 77943 - DNA, 22 bp, Homo sapiens
atttcagcagcccatgtttgga

SEQ ID NO: 77944 - DNA, 22 bp, Homo sapiens
gccagggttcgaatccgtatgg

SEQ ID NO: 77945 - DNA, 22 bp, Homo sapiens
aaaatatgtataactcttctgc

SEQ ID NO: 77946 - DNA, 22 bp, Homo sapiens
gcccagctgcaccctggtgggt

SEQ ID NO: 77947 - DNA, 22 bp, Homo sapiens
gttgtgaatagtgccgcaataa

SEQ ID NO: 77948 - DNA, 21 bp, Homo sapiens
agtagtttagcacagggtttg

SEQ ID NO: 77949 - DNA, 22 bp, Homo sapiens
cgggaaggtggaggttgcagtg

SEQ ID NO: 77950 - DNA, 22 bp, Homo sapiens
tgttgattagtgtttagactta

SEQ ID NO: 77951 - DNA, 22 bp, Homo sapiens
gggagctgagctggaagagaat

SEQ ID NO: 77952 - DNA, 22 bp, Homo sapiens
aaagtgctggtattacaggtgt

SEQ ID NO: 77953 - DNA, 22 bp, Homo sapiens
aggtgactggtttatctggcag

SEQ ID NO: 77954 - DNA, 22 bp, Homo sapiens
aagtcagacagctgagctgcct

SEQ ID NO: 77955 - DNA, 22 bp, Homo sapiens
cccacagtgatcgcattcgtac

SEQ ID NO: 77956 - DNA, 22 bp, Homo sapiens
cccaggagttggaggctgcagt

SEQ ID NO: 77957 - DNA, 22 bp, Homo sapiens
caggaggttgagggtgcagtga

SEQ ID NO: 77958 - DNA, 22 bp, Homo sapiens
ccgggctggagtgcaatggctc

SEQ ID NO: 77959 - DNA, 22 bp, Homo sapiens
gggagctggagctggaagactc

SEQ ID NO: 77960 - DNA, 22 bp, Homo sapiens
cagggtttcaccatgttagcag

SEQ ID NO: 77961 - DNA, 22 bp, Homo sapiens
aggctgaggcaagaggatcact

SEQ ID NO: 77962 - DNA, 22 bp, Homo sapiens
cgtgccactgcactctagcctg

SEQ ID NO: 77963 - DNA, 22 bp, Homo sapiens
cccaccagtacagatggtagat

SEQ ID NO: 77964 - DNA, 22 bp, Homo sapiens
ctaggaccactgtaacaaagta

SEQ ID NO: 77965 - DNA, 22 bp, Homo sapiens
tgccgaggctggagtgcagtgg

SEQ ID NO: 77966 - DNA, 22 bp, Homo sapiens
tctaccctgcggtcttggggca

SEQ ID NO: 77967 - DNA, 22 bp, Homo sapiens
gtgctgacaggagcctggcggt

SEQ ID NO: 77968 - DNA, 22 bp, Homo sapiens
gccccaagtccctatgtttcca

SEQ ID NO: 77969 - DNA, 15 bp, Homo sapiens
gcaggcaggtcacct

SEQ ID NO: 77970 - DNA, 22 bp, Homo sapiens
agcagcagtgttctggaattct

SEQ ID NO: 77971 - DNA, 22 bp, Homo sapiens
ccatcacagtccccatcgtgat

SEQ ID NO: 77972 - DNA, 22 bp, Homo sapiens
tgtctgcctgcgggccggcaca

SEQ ID NO: 77973 - DNA, 22 bp, Homo sapiens
atgcagtggcttcagtgtcagt

SEQ ID NO: 77974 - DNA, 17 bp, Homo sapiens
tccttcagtgcctctgc

SEQ ID NO: 77975 - DNA, 22 bp, Homo sapiens
agctgaaacttcccattaattg

SEQ ID NO: 77976 - DNA, 19 bp, Homo sapiens
taccatccaagctggtttg

SEQ ID NO: 77977 - DNA, 22 bp, Homo sapiens
attgtggtgtcagttataggca

SEQ ID NO: 77978 - DNA, 22 bp, Homo sapiens
aagctctttccactaaaccact

SEQ ID NO: 77979 - DNA, 22 bp, Homo sapiens
cccagcgagtttgccggtgaac

SEQ ID NO: 77980 - DNA, 22 bp, Homo sapiens
ttcttttaattgtgggggagtg

SEQ ID NO: 77981 - DNA, 22 bp, Homo sapiens
tgacttcctgcactcaggtgat

SEQ ID NO: 77982 - DNA, 22 bp, Homo sapiens
gaggcaggaggattgcttgagc

SEQ ID NO: 77983 - DNA, 22 bp, Homo sapiens
aagccgggcctgagaaatgaca

SEQ ID NO: 77984 - DNA, 22 bp, Homo sapiens
gtcctggggattatagagtgtt

SEQ ID NO: 77985 - DNA, 22 bp, Homo sapiens
ggaggggatttagtagatgcta

SEQ ID NO: 77986 - DNA, 22 bp, Homo sapiens
aaagtgcttcctttttgagggt

SEQ ID NO: 77987 - DNA, 22 bp, Homo sapiens
gtgcaaacatcatagagtgtac

SEQ ID NO: 77988 - DNA, 22 bp, Homo sapiens
ggtgagaaagggattcctgttc

SEQ ID NO: 77989 - DNA, 22 bp, Homo sapiens
tcttgggcatgtgtttgatttc

SEQ ID NO: 77990 - DNA, 22 bp, Homo sapiens
agtccaaagcagatgagggcca

SEQ ID NO: 77991 - DNA, 22 bp, Homo sapiens
ctctttggatagaattacaaag

SEQ ID NO: 77992 - DNA, 22 bp, Homo sapiens
ggggcagagaataaaaacctaa

SEQ ID NO: 77993 - DNA, 22 bp, Homo sapiens
gccaggctgaggctctggaaga

SEQ ID NO: 77994 - DNA, 22 bp, Homo sapiens
tagctgggactactggccctgc

SEQ ID NO: 77995 - DNA, 22 bp, Homo sapiens
attcactgtgggtcctttggat

SEQ ID NO: 77996 - DNA, 22 bp, Homo sapiens
agccagggacgctgcaggctac

SEQ ID NO: 77997 - DNA, 22 bp, Homo sapiens
ctgaggagaggtggcctgtgtt

SEQ ID NO: 77998 - DNA, 22 bp, Homo sapiens
gagccagactgcctgaagctca

SEQ ID NO: 77999 - DNA, 22 bp, Homo sapiens
tccaggattgcaggtgcacaac

SEQ ID NO: 78000 - DNA, 22 bp, Homo sapiens
gctctagtaggaatgtccctct

SEQ ID NO: 78001 - DNA, 22 bp, Homo sapiens
agaggctgcacttgctcatgat

SEQ ID NO: 78002 - DNA, 22 bp, Homo sapiens
ctattgtttctatgctctgagg

SEQ ID NO: 78003 - DNA, 22 bp, Homo sapiens
tggagggcatgctgtccatggg

SEQ ID NO: 78004 - DNA, 23 bp, Homo sapiens
acagcaagaggaccagatgtgag

SEQ ID NO: 78005 - DNA, 22 bp, Homo sapiens
cagtcaccttgaggactcagac

SEQ ID NO: 78006 - DNA, 22 bp, Homo sapiens
ttgagcaatgtcactgaggctt

SEQ ID NO: 78007 - DNA, 22 bp, Homo sapiens
tgtcatctgcgggtggcactgc

SEQ ID NO: 78008 - DNA, 22 bp, Homo sapiens
actcatgtcctaggagtaaagc

SEQ ID NO: 78009 - DNA, 22 bp, Homo sapiens
ccaggcagcctgctccattctg

SEQ ID NO: 78010 - DNA, 22 bp, Homo sapiens
ttgtcttttgtgggaaatatgg

SEQ ID NO: 78011 - DNA, 22 bp, Homo sapiens
catttacatttaaggttaatat

SEQ ID NO: 78012 - DNA, 22 bp, Homo sapiens
gatataggttcatagtgttaca

SEQ ID NO: 78013 - DNA, 23 bp, Homo sapiens
agagtgcagagatatgcttgtgt

SEQ ID NO: 78014 - DNA, 21 bp, Homo sapiens
tggacttatggagtgtttctt

SEQ ID NO: 78015 - DNA, 22 bp, Homo sapiens
caagtctgacctctgggtgaag

SEQ ID NO: 78016 - DNA, 22 bp, Homo sapiens
agcctgggccctgcctcttctc

SEQ ID NO: 78017 - DNA, 21 bp, Homo sapiens
gctcctggtgctgcgtggcgc

SEQ ID NO: 78018 - DNA, 22 bp, Homo sapiens
cccaaaggttgaggctgcagtg

SEQ ID NO: 78019 - DNA, 22 bp, Homo sapiens
aaatggaagctatttatgattc

SEQ ID NO: 78020 - DNA, 22 bp, Homo sapiens
gcaagacctatctagttgctgt

SEQ ID NO: 78021 - DNA, 22 bp, Homo sapiens
gaaaagagacagggtgggtgat

SEQ ID NO: 78022 - DNA, 22 bp, Homo sapiens
actgcaaagggaagccctttct

SEQ ID NO: 78023 - DNA, 22 bp, Homo sapiens
ctcactgcaagctccacctctt

SEQ ID NO: 78024 - DNA, 20 bp, Homo sapiens
tcagccttgaatgcttgaaa

SEQ ID NO: 78025 - DNA, 22 bp, Homo sapiens
ccatgtggtgggaaggagaatg

SEQ ID NO: 78026 - DNA, 22 bp, Homo sapiens
ctggaggtgcttcgctggccac

SEQ ID NO: 78027 - DNA, 22 bp, Homo sapiens
tgatttacagtagtgtctaaac

SEQ ID NO: 78028 - DNA, 20 bp, Homo sapiens
aagcagtgaggtgaggagtg

SEQ ID NO: 78029 - DNA, 22 bp, Homo sapiens
tcctgggccctccggatcaggt

SEQ ID NO: 78030 - DNA, 22 bp, Homo sapiens
gcctcagtctcccgagtagctg

SEQ ID NO: 78031 - DNA, 22 bp, Homo sapiens
gctcccaccttaaccttcacat

SEQ ID NO: 78032 - DNA, 22 bp, Homo sapiens
ttcaatagaaagtccctagtta

SEQ ID NO: 78033 - DNA, 22 bp, Homo sapiens
ttcacagtggtagtgcatttag

SEQ ID NO: 78034 - DNA, 22 bp, Homo sapiens
tggccttgagagatcaaaaggt

SEQ ID NO: 78035 - DNA, 22 bp, Homo sapiens
actctttgtctgttgccgctta

SEQ ID NO: 78036 - DNA, 22 bp, Homo sapiens
cccagctcttcaagtcaccccc

SEQ ID NO: 78037 - DNA, 22 bp, Homo sapiens
cgctccttgagcgtgtcggcct

SEQ ID NO: 78038 - DNA, 22 bp, Homo sapiens
ctggagcaaaagtgactcctct

SEQ ID NO: 78039 - DNA, 22 bp, Homo sapiens
actgcactcctgcctgggtaac

SEQ ID NO: 78040 - DNA, 18 bp, Homo sapiens
atcccaaaagacaaggaa

SEQ ID NO: 78041 - DNA, 20 bp, Homo sapiens
ctgggtggcaagcaaggggg

SEQ ID NO: 78042 - DNA, 22 bp, Homo sapiens
tttcaccatcttggccaggctg

SEQ ID NO: 78043 - DNA, 22 bp, Homo sapiens
ccaggaggcggaggttgcagcg

SEQ ID NO: 78044 - DNA, 22 bp, Homo sapiens
ggccaattccaggagccggcgg

SEQ ID NO: 78045 - DNA, 22 bp, Homo sapiens
tggaggagaccgcattttattt

SEQ ID NO: 78046 - DNA, 22 bp, Homo sapiens
actgccaatggtagtttgatgg

SEQ ID NO: 78047 - DNA, 22 bp, Homo sapiens
gatagtcacctcccttaacttt

SEQ ID NO: 78048 - DNA, 22 bp, Homo sapiens
gagatacttaagatggggctcc

SEQ ID NO: 78049 - DNA, 22 bp, Homo sapiens
agggcgacaatggagagcgttt

SEQ ID NO: 78050 - DNA, 22 bp, Homo sapiens
cttagagatgggttttacttag

SEQ ID NO: 78051 - DNA, 22 bp, Homo sapiens
agggaattcactggaacgccct

SEQ ID NO: 78052 - DNA, 18 bp, Homo sapiens
taggagagaatttattta

SEQ ID NO: 78053 - DNA, 20 bp, Homo sapiens
aactcctagcctcaagtgat

SEQ ID NO: 78054 - DNA, 22 bp, Homo sapiens
caggctggagtgcagtggggcg

SEQ ID NO: 78055 - DNA, 22 bp, Homo sapiens
cgcaccactgaattccagcctg

SEQ ID NO: 78056 - DNA, 22 bp, Homo sapiens
aaggcaaaagaggtgtcatcac

SEQ ID NO: 78057 - DNA, 22 bp, Homo sapiens
aaagcctcccaggttatgagta

SEQ ID NO: 78058 - DNA, 22 bp, Homo sapiens
tgcgttgcgctcctgcagcagg

SEQ ID NO: 78059 - DNA, 22 bp, Homo sapiens
gagtggggggtccgtctcagtg

SEQ ID NO: 78060 - DNA, 22 bp, Homo sapiens
aaaggtcaaaatcgtgacattg

SEQ ID NO: 78061 - DNA, 22 bp, Homo sapiens
ggctgcaggttggttggcagct

SEQ ID NO: 78062 - DNA, 22 bp, Homo sapiens
ggtgctggacacgtggcactcc

SEQ ID NO: 78063 - DNA, 22 bp, Homo sapiens
gtcagtaggaacctagggtcaa

SEQ ID NO: 78064 - DNA, 22 bp, Homo sapiens
ctgagatggagtttcgctcttc

SEQ ID NO: 78065 - DNA, 22 bp, Homo sapiens
aagcagatctgatagggccctg

SEQ ID NO: 78066 - DNA, 22 bp, Homo sapiens
aggctcagatccttgtgtcctg

SEQ ID NO: 78067 - DNA, 22 bp, Homo sapiens
gtagcccacctggggagggcga

SEQ ID NO: 78068 - DNA, 19 bp, Homo sapiens
ttcacattggaagaagtag

SEQ ID NO: 78069 - DNA, 22 bp, Homo sapiens
tcactgcaacctctgcctcccg

SEQ ID NO: 78070 - DNA, 22 bp, Homo sapiens
aagtggactaatacaaggacta

SEQ ID NO: 78071 - DNA, 22 bp, Homo sapiens
ttgtgcttgccctggaggtgcg

SEQ ID NO: 78072 - DNA, 22 bp, Homo sapiens
cgcccaggctggagagcagtgg

SEQ ID NO: 78073 - DNA, 22 bp, Homo sapiens
tgggcgacagagcaagactccg

SEQ ID NO: 78074 - DNA, 22 bp, Homo sapiens
gaagtattactctgaatgtatt

SEQ ID NO: 78075 - DNA, 22 bp, Homo sapiens
ggaagtcctcatacctgattct

SEQ ID NO: 78076 - DNA, 22 bp, Homo sapiens
ggtcgctgtgtaggttcagcta

SEQ ID NO: 78077 - DNA, 22 bp, Homo sapiens
aagcttcctgcatgggactgct

SEQ ID NO: 78078 - DNA, 22 bp, Homo sapiens
ggggccttggatctgtgccccg

SEQ ID NO: 78079 - DNA, 22 bp, Homo sapiens
attctggacaaggcaagctcct

SEQ ID NO: 78080 - DNA, 23 bp, Homo sapiens
actgagccagggcctgggtcagc

SEQ ID NO: 78081 - DNA, 22 bp, Homo sapiens
aaccaggtgactcatggtgagc

SEQ ID NO: 78082 - DNA, 22 bp, Homo sapiens
gggtccctggaattacttgaca

SEQ ID NO: 78083 - DNA, 22 bp, Homo sapiens
ccaggctggagtatagtggcgc

SEQ ID NO: 78084 - DNA, 22 bp, Homo sapiens
ccggctactcgggaggctgacg

SEQ ID NO: 78085 - DNA, 22 bp, Homo sapiens
ccctcccaggagtggccagaga

SEQ ID NO: 78086 - DNA, 22 bp, Homo sapiens
tccaccatgtaacaagctctgt

SEQ ID NO: 78087 - DNA, 22 bp, Homo sapiens
ttccagagagttattcccctgg

SEQ ID NO: 78088 - DNA, 22 bp, Homo sapiens
ggcctcacccatcggtgccttt

SEQ ID NO: 78089 - DNA, 22 bp, Homo sapiens
tttatagtagcatgatttatag

SEQ ID NO: 78090 - DNA, 23 bp, Homo sapiens
cctgcctccccatcagttataca

SEQ ID NO: 78091 - DNA, 20 bp, Homo sapiens
gggtgtgtgcagggcctggt

SEQ ID NO: 78092 - DNA, 22 bp, Homo sapiens
agatgtgtttctagttcctgca

SEQ ID NO: 78093 - DNA, 22 bp, Homo sapiens
ggccagaagttggaaaagagcc

SEQ ID NO: 78094 - DNA, 22 bp, Homo sapiens
ccaggaggcggaaggtacagtg

SEQ ID NO: 78095 - DNA, 22 bp, Homo sapiens
gttgcagatgtggaactcgtgc

SEQ ID NO: 78096 - DNA, 22 bp, Homo sapiens
tccctctacagggaagcgcttt

SEQ ID NO: 78097 - DNA, 22 bp, Homo sapiens
atgccactgcactccagcctag

SEQ ID NO: 78098 - DNA, 22 bp, Homo sapiens
caggctggagtacaattgtgtg

SEQ ID NO: 78099 - DNA, 22 bp, Homo sapiens
tcactgcaagctctgccttccg

SEQ ID NO: 78100 - DNA, 22 bp, Homo sapiens
gaggtgggcggatcacaaggtc

SEQ ID NO: 78101 - DNA, 22 bp, Homo sapiens
aggtttctttatgctgctagaa

SEQ ID NO: 78102 - DNA, 22 bp, Homo sapiens
accccagaggcggaggctgcag

SEQ ID NO: 78103 - DNA, 22 bp, Homo sapiens
ctccagtgcttctagaaaatac

SEQ ID NO: 78104 - DNA, 22 bp, Homo sapiens
tctcgatctcctgaccttgtga

SEQ ID NO: 78105 - DNA, 23 bp, Homo sapiens
actcgtggaattctctgcgatcg

SEQ ID NO: 78106 - DNA, 22 bp, Homo sapiens
tgcactactgtgatacacagcc

SEQ ID NO: 78107 - DNA, 22 bp, Homo sapiens
catgagataatttttctccagt

SEQ ID NO: 78108 - DNA, 22 bp, Homo sapiens
gctggcagacttcctctggaac

SEQ ID NO: 78109 - DNA, 22 bp, Homo sapiens
tcctttgcttctgtcattctcc

SEQ ID NO: 78110 - DNA, 22 bp, Homo sapiens
ccaggaggtggagattgcagtg

SEQ ID NO: 78111 - DNA, 22 bp, Homo sapiens
ttgagatggagcctcagtcttg

SEQ ID NO: 78112 - DNA, 22 bp, Homo sapiens
acccacgaagatgagcggcatg

SEQ ID NO: 78113 - DNA, 22 bp, Homo sapiens
cacagctgaagtagccatgtgg

SEQ ID NO: 78114 - DNA, 22 bp, Homo sapiens
atgtgctgagtgtgtatataca

SEQ ID NO: 78115 - DNA, 22 bp, Homo sapiens
acccatccagtgtccctgctag

SEQ ID NO: 78116 - DNA, 22 bp, Homo sapiens
aaagtgctgggattacaggctt

SEQ ID NO: 78117 - DNA, 22 bp, Homo sapiens
aatggcaagagccacagaggcg

SEQ ID NO: 78118 - DNA, 22 bp, Homo sapiens
ccaggttggagttcagtggcgc

SEQ ID NO: 78119 - DNA, 22 bp, Homo sapiens
ggaaaggcctgggtgtcctggg

SEQ ID NO: 78120 - DNA, 22 bp, Homo sapiens
tgataaacttagaaagaatgtt

SEQ ID NO: 78121 - DNA, 22 bp, Homo sapiens
acgcctgtaatcccagcacttt

SEQ ID NO: 78122 - DNA, 22 bp, Homo sapiens
tctctagtctcctttaacctga

SEQ ID NO: 78123 - DNA, 22 bp, Homo sapiens
agcctggcctgggcaggcacat

SEQ ID NO: 78124 - DNA, 22 bp, Homo sapiens
ctgagccaaggggacagtgaca

SEQ ID NO: 78125 - DNA, 22 bp, Homo sapiens
gtctgctcatgctaccgcgggc

SEQ ID NO: 78126 - DNA, 22 bp, Homo sapiens
tcattacaagatttccaatttg

SEQ ID NO: 78127 - DNA, 22 bp, Homo sapiens
atacaaaaattagccgggagta

SEQ ID NO: 78128 - DNA, 22 bp, Homo sapiens
tcccgcttcttccgaatcgcga

SEQ ID NO: 78129 - DNA, 22 bp, Homo sapiens
gctgcagctgtaggacacaatt

SEQ ID NO: 78130 - DNA, 22 bp, Homo sapiens
gaggtagacttcttggaagtag

SEQ ID NO: 78131 - DNA, 22 bp, Homo sapiens
cgccaggcttggtagctcatgc

SEQ ID NO: 78132 - DNA, 22 bp, Homo sapiens
ctcgggtaccatgctaggcact

SEQ ID NO: 78133 - DNA, 22 bp, Homo sapiens
ctgctccccagcctgcgccttt

SEQ ID NO: 78134 - DNA, 22 bp, Homo sapiens
tcagcttcgcctgaggtatggg

SEQ ID NO: 78135 - DNA, 22 bp, Homo sapiens
gatgcgggcccgctccactgcc

SEQ ID NO: 78136 - DNA, 22 bp, Homo sapiens
tttgggttcagacatgattaca

SEQ ID NO: 78137 - DNA, 22 bp, Homo sapiens
caggtcttcttcagcacttgga

SEQ ID NO: 78138 - DNA, 22 bp, Homo sapiens
aaagtgctaggattacaagcgt

SEQ ID NO: 78139 - DNA, 22 bp, Homo sapiens
cgtaggtggctcagcacctggg

SEQ ID NO: 78140 - DNA, 22 bp, Homo sapiens
cacttcaacctctgagtcctgg

SEQ ID NO: 78141 - DNA, 22 bp, Homo sapiens
catataaatacaacatgtgtta

SEQ ID NO: 78142 - DNA, 18 bp, Homo sapiens
ccctgccagctcccagca

SEQ ID NO: 78143 - DNA, 22 bp, Homo sapiens
tctgggtccgggactgtggatg

SEQ ID NO: 78144 - DNA, 22 bp, Homo sapiens
ccagaggagttgaggctttggg

SEQ ID NO: 78145 - DNA, 23 bp, Homo sapiens
tcgttgaatagcaatagcacaac

SEQ ID NO: 78146 - DNA, 22 bp, Homo sapiens
tgcctactagtactattttgtg

SEQ ID NO: 78147 - DNA, 22 bp, Homo sapiens
ctgctgagagccccagctgaga

SEQ ID NO: 78148 - DNA, 22 bp, Homo sapiens
ccaggctggagtgcaatggcgt

SEQ ID NO: 78149 - DNA, 22 bp, Homo sapiens
ctagcctgggatttgaacttat

SEQ ID NO: 78150 - DNA, 22 bp, Homo sapiens
aactaatacattaatacatgtg

SEQ ID NO: 78151 - DNA, 22 bp, Homo sapiens
acgaggttggagagttgtttgg

SEQ ID NO: 78152 - DNA, 22 bp, Homo sapiens
tttattctgtgctacatgaaga

SEQ ID NO: 78153 - DNA, 22 bp, Homo sapiens
gttgctcaggcaggagtacagt

SEQ ID NO: 78154 - DNA, 22 bp, Homo sapiens
gcccagcccagaaaggttcgga

SEQ ID NO: 78155 - DNA, 18 bp, Homo sapiens
tccagttttcccagcatc

SEQ ID NO: 78156 - DNA, 22 bp, Homo sapiens
aaacttttttaggttcataggc

SEQ ID NO: 78157 - DNA, 22 bp, Homo sapiens
cttgcagtttaggtcctctgtg

SEQ ID NO: 78158 - DNA, 22 bp, Homo sapiens
tgatctggtcctactgtgggca

SEQ ID NO: 78159 - DNA, 22 bp, Homo sapiens
gcgctgaggctggaggcgcacg

SEQ ID NO: 78160 - DNA, 22 bp, Homo sapiens
ttggatccatctcaggcatagg

SEQ ID NO: 78161 - DNA, 22 bp, Homo sapiens
ggaaaatgggaacctgaagcca

SEQ ID NO: 78162 - DNA, 22 bp, Homo sapiens
actggggtttaggcctgggcaa

SEQ ID NO: 78163 - DNA, 22 bp, Homo sapiens
caaagtgctggaattacaggtg

SEQ ID NO: 78164 - DNA, 19 bp, Homo sapiens
agccccttggtactgtcct

SEQ ID NO: 78165 - DNA, 22 bp, Homo sapiens
tgcagtggcgccatctcagctc

SEQ ID NO: 78166 - DNA, 22 bp, Homo sapiens
catgcctgcctggtgggcgtgg

SEQ ID NO: 78167 - DNA, 22 bp, Homo sapiens
atggtggacgggagacaggact

SEQ ID NO: 78168 - DNA, 22 bp, Homo sapiens
tttgcttcacaagtatggttct

SEQ ID NO: 78169 - DNA, 22 bp, Homo sapiens
ccctgccttgtctgggctaggt

SEQ ID NO: 78170 - DNA, 22 bp, Homo sapiens
atgttggccaggctggtcttga

SEQ ID NO: 78171 - DNA, 22 bp, Homo sapiens
aaaagcaattgcgggttttgcc

SEQ ID NO: 78172 - DNA, 22 bp, Homo sapiens
caaagtgctaggattacaggcg

SEQ ID NO: 78173 - DNA, 22 bp, Homo sapiens
tgctgggctggggcctcagacc

SEQ ID NO: 78174 - DNA, 22 bp, Homo sapiens
aggccagcctcaggcagggacc

SEQ ID NO: 78175 - DNA, 22 bp, Homo sapiens
tgaatgtgatgctaaacatatg

SEQ ID NO: 78176 - DNA, 22 bp, Homo sapiens
gggcggatcacctgaggtcagg

SEQ ID NO: 78177 - DNA, 22 bp, Homo sapiens
ttatttgtggcatatgagacga

SEQ ID NO: 78178 - DNA, 22 bp, Homo sapiens
gcctcctgagtagctgggattg

SEQ ID NO: 78179 - DNA, 22 bp, Homo sapiens
ggcatagcggctcagcgtccag

SEQ ID NO: 78180 - DNA, 22 bp, Homo sapiens
ctccttctgggcctggcagtgg

SEQ ID NO: 78181 - DNA, 22 bp, Homo sapiens
cttatcttacttccccttcatg

SEQ ID NO: 78182 - DNA, 22 bp, Homo sapiens
gagctgagaagcagcgcttgat

SEQ ID NO: 78183 - DNA, 23 bp, Homo sapiens
aaaacagcttcctccagtggctc

SEQ ID NO: 78184 - DNA, 22 bp, Homo sapiens
ttgaaattttaggccttgcaat

SEQ ID NO: 78185 - DNA, 22 bp, Homo sapiens
gtttcaggttggacaacatgcc

SEQ ID NO: 78186 - DNA, 22 bp, Homo sapiens
ttacgcagctgctccaggaagc

SEQ ID NO: 78187 - DNA, 22 bp, Homo sapiens
gagtgcaatggcatgatctggg

SEQ ID NO: 78188 - DNA, 22 bp, Homo sapiens
gggacttaatgcagagagggac

SEQ ID NO: 78189 - DNA, 22 bp, Homo sapiens
tccagcagtccatgtgagacac

SEQ ID NO: 78190 - DNA, 22 bp, Homo sapiens
ttgtggaactcatctgcctggt

SEQ ID NO: 78191 - DNA, 23 bp, Homo sapiens
aggttatgattatagagcgagga

SEQ ID NO: 78192 - DNA, 22 bp, Homo sapiens
gaaggaagtcattagtgcagac

SEQ ID NO: 78193 - DNA, 22 bp, Homo sapiens
ggctcctgggggtgctcctgcc

SEQ ID NO: 78194 - DNA, 22 bp, Homo sapiens
taggctgggaagaaagattctc

SEQ ID NO: 78195 - DNA, 22 bp, Homo sapiens
tacagaggaggggattttaata

SEQ ID NO: 78196 - DNA, 22 bp, Homo sapiens
gcaggatgagtgagtacattta

SEQ ID NO: 78197 - DNA, 16 bp, Homo sapiens
ccacctgcagctctca

SEQ ID NO: 78198 - DNA, 22 bp, Homo sapiens
aggcaggaaaatcgcttgaacc

SEQ ID NO: 78199 - DNA, 22 bp, Homo sapiens
tcccccaggctggagtgcagtg

SEQ ID NO: 78200 - DNA, 22 bp, Homo sapiens
ctttgcttgacactgtgattgt

SEQ ID NO: 78201 - DNA, 22 bp, Homo sapiens
actgcactccagcctgggtgat

SEQ ID NO: 78202 - DNA, 22 bp, Homo sapiens
ttctagtgtccttggacttgct

SEQ ID NO: 78203 - DNA, 22 bp, Homo sapiens
acatctagactcttgccctctt

SEQ ID NO: 78204 - DNA, 22 bp, Homo sapiens
gtgtcaataaatagcggtgtgg

SEQ ID NO: 78205 - DNA, 23 bp, Homo sapiens
aatgggtgcaactatccatgaca

SEQ ID NO: 78206 - DNA, 22 bp, Homo sapiens
aatggcactttataaatgttaa

SEQ ID NO: 78207 - DNA, 22 bp, Homo sapiens
tgaggaaacttacaaggcagaa

SEQ ID NO: 78208 - DNA, 22 bp, Homo sapiens
tgtgtgattgcaggagatgtgg

SEQ ID NO: 78209 - DNA, 18 bp, Homo sapiens
ttcacaagggcttggttt

SEQ ID NO: 78210 - DNA, 22 bp, Homo sapiens
gaccttgtgatctgcccacctt

SEQ ID NO: 78211 - DNA, 22 bp, Homo sapiens
cacattccttacattcatagag

SEQ ID NO: 78212 - DNA, 22 bp, Homo sapiens
gaggcacagagtaggtgcacac

SEQ ID NO: 78213 - DNA, 22 bp, Homo sapiens
actgttttctgtaaagggccag

SEQ ID NO: 78214 - DNA, 22 bp, Homo sapiens
tcatctaagagtcttacattta

SEQ ID NO: 78215 - DNA, 22 bp, Homo sapiens
gaccctctagatggaagcactg

SEQ ID NO: 78216 - DNA, 22 bp, Homo sapiens
tactgtgtgcccagccgagctg

SEQ ID NO: 78217 - DNA, 22 bp, Homo sapiens
atgttgtgtttgactgttaccc

SEQ ID NO: 78218 - DNA, 22 bp, Homo sapiens
ccggtcccaggtgccccggtga

SEQ ID NO: 78219 - DNA, 22 bp, Homo sapiens
tccttgtaaaggagctctaaca

SEQ ID NO: 78220 - DNA, 22 bp, Homo sapiens
tgttgactcaacactgtgggca

SEQ ID NO: 78221 - DNA, 22 bp, Homo sapiens
gagggggctagcgcagtgccca

SEQ ID NO: 78222 - DNA, 22 bp, Homo sapiens
gcagctggaagtgacactctgt

SEQ ID NO: 78223 - DNA, 22 bp, Homo sapiens
ccaaagtgctaggattacaggc

SEQ ID NO: 78224 - DNA, 22 bp, Homo sapiens
aaggctcggcaatgtgcggctc

SEQ ID NO: 78225 - DNA, 22 bp, Homo sapiens
gggcagagagctggaactcctt

SEQ ID NO: 78226 - DNA, 22 bp, Homo sapiens
taggtagctttggcgtttcttg

SEQ ID NO: 78227 - DNA, 22 bp, Homo sapiens
tggagaattctatgttgagggg

SEQ ID NO: 78228 - DNA, 22 bp, Homo sapiens
tacaacctctgcctcccaagtt

SEQ ID NO: 78229 - DNA, 22 bp, Homo sapiens
catagagtgatgtaaggtatgt

SEQ ID NO: 78230 - DNA, 22 bp, Homo sapiens
cccacgtcgaacttgctccaga

SEQ ID NO: 78231 - DNA, 22 bp, Homo sapiens
tctacctggagtccgttgttaa

SEQ ID NO: 78232 - DNA, 22 bp, Homo sapiens
cgggcgcactccgggcagctgt

SEQ ID NO: 78233 - DNA, 22 bp, Homo sapiens
aaaaatcacttttataggcagc

SEQ ID NO: 78234 - DNA, 22 bp, Homo sapiens
gacagctgcatcctcagacaca

SEQ ID NO: 78235 - DNA, 22 bp, Homo sapiens
ctctgcctgtctcatcctgcaa

SEQ ID NO: 78236 - DNA, 22 bp, Homo sapiens
gatttctctgcacccactcagg

SEQ ID NO: 78237 - DNA, 22 bp, Homo sapiens
ctctcagtcctgcgcgcctctg

SEQ ID NO: 78238 - DNA, 22 bp, Homo sapiens
cggctggtgtcgggcacagcaa

SEQ ID NO: 78239 - DNA, 22 bp, Homo sapiens
gactttgctgtgtcagcttcag

SEQ ID NO: 78240 - DNA, 22 bp, Homo sapiens
tccaggattgtcagccagaagg

SEQ ID NO: 78241 - DNA, 22 bp, Homo sapiens
ctgaagcagggagtgatgaagt

SEQ ID NO: 78242 - DNA, 22 bp, Homo sapiens
gcagcctgggcaacagagtgag

SEQ ID NO: 78243 - DNA, 22 bp, Homo sapiens
cccaggaggtcaaggctgcagt

SEQ ID NO: 78244 - DNA, 22 bp, Homo sapiens
agcacctgtcaagtccaggctg

SEQ ID NO: 78245 - DNA, 22 bp, Homo sapiens
gctgaaggcccggaggacaggg

SEQ ID NO: 78246 - DNA, 22 bp, Homo sapiens
tgtatattctgcctaaaagctt

SEQ ID NO: 78247 - DNA, 22 bp, Homo sapiens
ttatagcagcatgatttacaat

SEQ ID NO: 78248 - DNA, 22 bp, Homo sapiens
tcaaaattaaaccaacgtccag

SEQ ID NO: 78249 - DNA, 22 bp, Homo sapiens
catccctgtcgtcaagtctctg

SEQ ID NO: 78250 - DNA, 22 bp, Homo sapiens
tgctgtgaggttgagaaggaag

SEQ ID NO: 78251 - DNA, 22 bp, Homo sapiens
cggaggttgaggctgcagtgag

SEQ ID NO: 78252 - DNA, 22 bp, Homo sapiens
gctcccaccgccgctatgggta

SEQ ID NO: 78253 - DNA, 22 bp, Homo sapiens
gcactttgcccctcctttggca

SEQ ID NO: 78254 - DNA, 19 bp, Homo sapiens
gtgtccatggagcatggag

SEQ ID NO: 78255 - DNA, 22 bp, Homo sapiens
cactgcactccagcctgggtga

SEQ ID NO: 78256 - DNA, 21 bp, Homo sapiens
aggtgctggcgccccaggaga

SEQ ID NO: 78257 - DNA, 22 bp, Homo sapiens
actgtgtgtttgtctagcacag

SEQ ID NO: 78258 - DNA, 22 bp, Homo sapiens
tggctaacaaggtgaaaccccg

SEQ ID NO: 78259 - DNA, 22 bp, Homo sapiens
gaggctggacgtgcatttctac

SEQ ID NO: 78260 - DNA, 22 bp, Homo sapiens
tctggcttccctctgttctggg

SEQ ID NO: 78261 - DNA, 20 bp, Homo sapiens
tgtttgtgtggggccttggc

SEQ ID NO: 78262 - DNA, 22 bp, Homo sapiens
atttaagggatttggagaccaa

SEQ ID NO: 78263 - DNA, 22 bp, Homo sapiens
ttatcacttatgagctttttgc

SEQ ID NO: 78264 - DNA, 22 bp, Homo sapiens
gaccttgtgatccacccgcttt

SEQ ID NO: 78265 - DNA, 19 bp, Homo sapiens
atcccaaggagctgggact

SEQ ID NO: 78266 - DNA, 22 bp, Homo sapiens
gccggggctggggagagacatg

SEQ ID NO: 78267 - DNA, 22 bp, Homo sapiens
cgtctggcttctccacggtaaa

SEQ ID NO: 78268 - DNA, 22 bp, Homo sapiens
gattgtggaagtcagtggttct

SEQ ID NO: 78269 - DNA, 22 bp, Homo sapiens
taggcactgtgtttgtaggagt

SEQ ID NO: 78270 - DNA, 22 bp, Homo sapiens
ttggagagtgatattcagatgc

SEQ ID NO: 78271 - DNA, 22 bp, Homo sapiens
cctgggcctctcaaagtgctgg

SEQ ID NO: 78272 - DNA, 22 bp, Homo sapiens
gaggagggagctggaagctctt

SEQ ID NO: 78273 - DNA, 22 bp, Homo sapiens
tccctagtcgcatctgtggaga

SEQ ID NO: 78274 - DNA, 22 bp, Homo sapiens
aaggtccttttgcagtgtgatc

SEQ ID NO: 78275 - DNA, 22 bp, Homo sapiens
aacagctttgtatacagtaact

SEQ ID NO: 78276 - DNA, 22 bp, Homo sapiens
ggtatactgcatgacattgggg

SEQ ID NO: 78277 - DNA, 22 bp, Homo sapiens
accgggtaggtgtcaactctga

SEQ ID NO: 78278 - DNA, 22 bp, Homo sapiens
ctggcaggagcattcacagagg

SEQ ID NO: 78279 - DNA, 22 bp, Homo sapiens
tcactacaacctccgcctcctg

SEQ ID NO: 78280 - DNA, 22 bp, Homo sapiens
attgagaagaaaatctaatata

SEQ ID NO: 78281 - DNA, 22 bp, Homo sapiens
gttcagaaattaggagaataaa

SEQ ID NO: 78282 - DNA, 22 bp, Homo sapiens
aaagtgctgggattacaggcgt

SEQ ID NO: 78283 - DNA, 22 bp, Homo sapiens
aaagtgctgagattacaagcgt

SEQ ID NO: 78284 - DNA, 22 bp, Homo sapiens
ctggaaggagcccgggcggatc

SEQ ID NO: 78285 - DNA, 22 bp, Homo sapiens
ttctccgctaagttctctgcag

SEQ ID NO: 78286 - DNA, 22 bp, Homo sapiens
ttgtgttaaggtgcatctagtg

SEQ ID NO: 78287 - DNA, 22 bp, Homo sapiens
acagaactgggaaatgcacata

SEQ ID NO: 78288 - DNA, 22 bp, Homo sapiens
gcaggcagaggtggaggagaca

SEQ ID NO: 78289 - DNA, 22 bp, Homo sapiens
tttgaagactactgggagtgaa

SEQ ID NO: 78290 - DNA, 22 bp, Homo sapiens
ctcggaatggaacaacagcggt

SEQ ID NO: 78291 - DNA, 22 bp, Homo sapiens
cccaggcttttctcttgcccca

SEQ ID NO: 78292 - DNA, 20 bp, Homo sapiens
agatacagtggtttctttag

SEQ ID NO: 78293 - DNA, 20 bp, Homo sapiens
tcacatcctctcccaacatg

SEQ ID NO: 78294 - DNA, 22 bp, Homo sapiens
ctgggcaaattgtgccagctat

SEQ ID NO: 78295 - DNA, 22 bp, Homo sapiens
tggcacaggatctcagcggcca

SEQ ID NO: 78296 - DNA, 22 bp, Homo sapiens
atcattatcctcctatttgcct

SEQ ID NO: 78297 - DNA, 23 bp, Homo sapiens
tctacaaagctgtgtcaggaccc

SEQ ID NO: 78298 - DNA, 22 bp, Homo sapiens
ttgcactccagcccgagcaaca

SEQ ID NO: 78299 - DNA, 22 bp, Homo sapiens
ctatacagcagcttactagtta

SEQ ID NO: 78300 - DNA, 19 bp, Homo sapiens
acacagggatcagagggtt

SEQ ID NO: 78301 - DNA, 22 bp, Homo sapiens
cttcctctgtggccagagtgta

SEQ ID NO: 78302 - DNA, 22 bp, Homo sapiens
aggacttagaacattatgtact

SEQ ID NO: 78303 - DNA, 22 bp, Homo sapiens
attgcactccggcctgggtgac

SEQ ID NO: 78304 - DNA, 22 bp, Homo sapiens
cctgtggcgggggccagtgcct

SEQ ID NO: 78305 - DNA, 22 bp, Homo sapiens
gggatctgggacaacaggtggt

SEQ ID NO: 78306 - DNA, 22 bp, Homo sapiens
cattgctttgtgcatatttaaa

SEQ ID NO: 78307 - DNA, 22 bp, Homo sapiens
aatattatacagtcaacctctt

SEQ ID NO: 78308 - DNA, 22 bp, Homo sapiens
agagtactgcctcagttatgaa

SEQ ID NO: 78309 - DNA, 22 bp, Homo sapiens
tagatgaccttgtgttaggcaa

SEQ ID NO: 78310 - DNA, 22 bp, Homo sapiens
ctaggtgatccactgctctctt

SEQ ID NO: 78311 - DNA, 22 bp, Homo sapiens
ttccggaaggttctctagaatt

SEQ ID NO: 78312 - DNA, 22 bp, Homo sapiens
tgaagctttaggatgggttcat

SEQ ID NO: 78313 - DNA, 22 bp, Homo sapiens
cccagcaggtcggtgctgcctg

SEQ ID NO: 78314 - DNA, 22 bp, Homo sapiens
acatttttcacatttgtagggt

SEQ ID NO: 78315 - DNA, 19 bp, Homo sapiens
agtcctggcctgggggacc

SEQ ID NO: 78316 - DNA, 22 bp, Homo sapiens
cgggagcctctgggtcacactg

SEQ ID NO: 78317 - DNA, 19 bp, Homo sapiens
gggcttggggctgaagcct

SEQ ID NO: 78318 - DNA, 22 bp, Homo sapiens
ggaggagacagtaaaaagcacg

SEQ ID NO: 78319 - DNA, 22 bp, Homo sapiens
cacagtcctgccagagggcctt

SEQ ID NO: 78320 - DNA, 22 bp, Homo sapiens
cctttcccgctttgagggcaag

SEQ ID NO: 78321 - DNA, 22 bp, Homo sapiens
gttttgaatactactagaactt

SEQ ID NO: 78322 - DNA, 22 bp, Homo sapiens
agggaaattaatgtgagcaatg

SEQ ID NO: 78323 - DNA, 22 bp, Homo sapiens
caaagtgctgggattacaggtg

SEQ ID NO: 78324 - DNA, 22 bp, Homo sapiens
tccaactttctcctccggcttg

SEQ ID NO: 78325 - DNA, 22 bp, Homo sapiens
gaccaagatacagcatcataga

SEQ ID NO: 78326 - DNA, 22 bp, Homo sapiens
gctcccaggatgaggagccagg

SEQ ID NO: 78327 - DNA, 22 bp, Homo sapiens
gcctgttctccagcatccaggt

SEQ ID NO: 78328 - DNA, 22 bp, Homo sapiens
ggcatggacgtctctgaggcca

SEQ ID NO: 78329 - DNA, 22 bp, Homo sapiens
aggttatcatcagttgagcact

SEQ ID NO: 78330 - DNA, 22 bp, Homo sapiens
cactgcactccagcctgggtca

SEQ ID NO: 78331 - DNA, 20 bp, Homo sapiens
ggccggggagctctccaggg

SEQ ID NO: 78332 - DNA, 22 bp, Homo sapiens
ggctagggatctagaccaggac

SEQ ID NO: 78333 - DNA, 22 bp, Homo sapiens
tagcataggaaagtactgggaa

SEQ ID NO: 78334 - DNA, 22 bp, Homo sapiens
tgagcctgggagatggaggctg

SEQ ID NO: 78335 - DNA, 22 bp, Homo sapiens
aggagctgtcagagtgccagag

SEQ ID NO: 78336 - DNA, 20 bp, Homo sapiens
aagacaccagtggcagcccc

SEQ ID NO: 78337 - DNA, 22 bp, Homo sapiens
tgggggtgtcctggtgcacaca

SEQ ID NO: 78338 - DNA, 22 bp, Homo sapiens
aaggagaggttgtccgtgttgt

SEQ ID NO: 78339 - DNA, 22 bp, Homo sapiens
caggctggagtgcagtggtgcc

SEQ ID NO: 78340 - DNA, 22 bp, Homo sapiens
attgcactccagcctgggtgac

SEQ ID NO: 78341 - DNA, 22 bp, Homo sapiens
attgtcagtttaatatagtcaa

SEQ ID NO: 78342 - DNA, 22 bp, Homo sapiens
gggaagtgatggagccaggatt

SEQ ID NO: 78343 - DNA, 22 bp, Homo sapiens
accactgcccatggtgaaaact

SEQ ID NO: 78344 - DNA, 22 bp, Homo sapiens
gctggggaggcagcagagaaca

SEQ ID NO: 78345 - DNA, 22 bp, Homo sapiens
attgaaaataaggccagaaaca

SEQ ID NO: 78346 - DNA, 22 bp, Homo sapiens
ttattgaaggaactgaaataaa

SEQ ID NO: 78347 - DNA, 22 bp, Homo sapiens
actctggccatcttggaccttg

SEQ ID NO: 78348 - DNA, 23 bp, Homo sapiens
tgttccagatacgccttttcctc

SEQ ID NO: 78349 - DNA, 21 bp, Homo sapiens
tcgtgcagcagctgaggcttg

SEQ ID NO: 78350 - DNA, 22 bp, Homo sapiens
gtgaggtggtacaatattaact

SEQ ID NO: 78351 - DNA, 22 bp, Homo sapiens
tgcaggcctggactgatgtggt

SEQ ID NO: 78352 - DNA, 22 bp, Homo sapiens
agcaacccgtccttgggggact

SEQ ID NO: 78353 - DNA, 22 bp, Homo sapiens
cctggtgctgctatcaggggta

SEQ ID NO: 78354 - DNA, 22 bp, Homo sapiens
agcttgacagacagatggtagc

SEQ ID NO: 78355 - DNA, 22 bp, Homo sapiens
ggcttagcaactcctgaggctc

SEQ ID NO: 78356 - DNA, 22 bp, Homo sapiens
tttggtaagtacccacctgggt

SEQ ID NO: 78357 - DNA, 22 bp, Homo sapiens
tacaggacattgtgcatttgtc

SEQ ID NO: 78358 - DNA, 17 bp, Homo sapiens
gagacccccactacacc

SEQ ID NO: 78359 - DNA, 22 bp, Homo sapiens
cttgctttcagtctcggcctca

SEQ ID NO: 78360 - DNA, 22 bp, Homo sapiens
tttgctttgtttaaaagtggta

SEQ ID NO: 78361 - DNA, 22 bp, Homo sapiens
gaggtggctgcttgctgggaaa

SEQ ID NO: 78362 - DNA, 22 bp, Homo sapiens
ggtcccatgactgacacagcag

SEQ ID NO: 78363 - DNA, 22 bp, Homo sapiens
tatttcttttcgtgacttattg

SEQ ID NO: 78364 - DNA, 22 bp, Homo sapiens
gggggagagacgagcggctctg

SEQ ID NO: 78365 - DNA, 22 bp, Homo sapiens
cctggggccccgagccagaagc

SEQ ID NO: 78366 - DNA, 22 bp, Homo sapiens
tgacagagtgacactcttgtct

SEQ ID NO: 78367 - DNA, 22 bp, Homo sapiens
gggcttggcacatgggctcagc

SEQ ID NO: 78368 - DNA, 22 bp, Homo sapiens
gtcccctgtccagggccagcca

SEQ ID NO: 78369 - DNA, 22 bp, Homo sapiens
aagccctggacggcccttcccc

SEQ ID NO: 78370 - DNA, 22 bp, Homo sapiens
attgcacttcagcctgggtgac

SEQ ID NO: 78371 - DNA, 22 bp, Homo sapiens
caaatgaatatttccatgggtt

SEQ ID NO: 78372 - DNA, 22 bp, Homo sapiens
ggcgtggggccttctgcccgct

SEQ ID NO: 78373 - DNA, 22 bp, Homo sapiens
cctgccagagcagcttgtcctc

SEQ ID NO: 78374 - DNA, 22 bp, Homo sapiens
ttcagcagtgcagacacccagt

SEQ ID NO: 78375 - DNA, 22 bp, Homo sapiens
ggaagaaaggtggacaacaggt

SEQ ID NO: 78376 - DNA, 22 bp, Homo sapiens
cactctgcagctgaagggctgg

SEQ ID NO: 78377 - DNA, 22 bp, Homo sapiens
agggctggagccacagctggga

SEQ ID NO: 78378 - DNA, 22 bp, Homo sapiens
accctactaaatgtggtatgtc

SEQ ID NO: 78379 - DNA, 22 bp, Homo sapiens
cccaggccctggcagagcttgt

SEQ ID NO: 78380 - DNA, 22 bp, Homo sapiens
gccactgtggtcctcccatgat

SEQ ID NO: 78381 - DNA, 22 bp, Homo sapiens
cccaggaggtcgaagctgcagt

SEQ ID NO: 78382 - DNA, 22 bp, Homo sapiens
cccagaaggtcgaggctgcagt

SEQ ID NO: 78383 - DNA, 22 bp, Homo sapiens
gctggaggatggactggaagaa

SEQ ID NO: 78384 - DNA, 22 bp, Homo sapiens
gagtgcagtggcgtgatctctg

SEQ ID NO: 78385 - DNA, 22 bp, Homo sapiens
tcagggattgcaaaattcatcc

SEQ ID NO: 78386 - DNA, 22 bp, Homo sapiens
tctaaattactttgggcagtat

SEQ ID NO: 78387 - DNA, 22 bp, Homo sapiens
agcttgggcaacacagcaagac

SEQ ID NO: 78388 - DNA, 22 bp, Homo sapiens
actgggctcaagtgattgtcct

SEQ ID NO: 78389 - DNA, 22 bp, Homo sapiens
tagggtagtaccatgctgccag

SEQ ID NO: 78390 - DNA, 22 bp, Homo sapiens
tcaccaggctagagtgcagtgg

SEQ ID NO: 78391 - DNA, 23 bp, Homo sapiens
aggtaggttattgctgctacctg

SEQ ID NO: 78392 - DNA, 22 bp, Homo sapiens
tggcaacttgcaacctcattct

SEQ ID NO: 78393 - DNA, 22 bp, Homo sapiens
tcaccaggctggagtgcagtgg

SEQ ID NO: 78394 - DNA, 22 bp, Homo sapiens
cattgcaacttcaaactcctgg

SEQ ID NO: 78395 - DNA, 22 bp, Homo sapiens
taaggcaggaactggctgtttt

SEQ ID NO: 78396 - DNA, 22 bp, Homo sapiens
aagaggcgctcctcacttccta

SEQ ID NO: 78397 - DNA, 22 bp, Homo sapiens
agatgctgctccacaggccagg

SEQ ID NO: 78398 - DNA, 22 bp, Homo sapiens
ctggcctggcgcagtggctcac

SEQ ID NO: 78399 - DNA, 22 bp, Homo sapiens
gtggctgcagcggctgtggaga

SEQ ID NO: 78400 - DNA, 22 bp, Homo sapiens
tgccgcagtgcggggagggccc

SEQ ID NO: 78401 - DNA, 22 bp, Homo sapiens
gcccagtagttcaaggttgcag

SEQ ID NO: 78402 - DNA, 22 bp, Homo sapiens
atacataattacttccgatgtt

SEQ ID NO: 78403 - DNA, 22 bp, Homo sapiens
gcgagggcacgcggttgaaggc

SEQ ID NO: 78404 - DNA, 22 bp, Homo sapiens
aaggagtctgggccattcagag

SEQ ID NO: 78405 - DNA, 22 bp, Homo sapiens
atgggttcaagtgattctcctg

SEQ ID NO: 78406 - DNA, 20 bp, Homo sapiens
aaacgagccatcattctggt

SEQ ID NO: 78407 - DNA, 22 bp, Homo sapiens
acagtctgtcccccaggtgcta

SEQ ID NO: 78408 - DNA, 22 bp, Homo sapiens
ggcaatagttgtgggttcttta

SEQ ID NO: 78409 - DNA, 22 bp, Homo sapiens
ggagactgatctgagtgataac

SEQ ID NO: 78410 - DNA, 22 bp, Homo sapiens
agatgaatccacacatggcaaa

SEQ ID NO: 78411 - DNA, 22 bp, Homo sapiens
cgcgctgcagacagcggaggcc

SEQ ID NO: 78412 - DNA, 22 bp, Homo sapiens
cttctcttcctttgtcaactga

SEQ ID NO: 78413 - DNA, 22 bp, Homo sapiens
tttctataaaaagtgctaggat

SEQ ID NO: 78414 - DNA, 22 bp, Homo sapiens
gttgagtgggttaggatgctga

SEQ ID NO: 78415 - DNA, 22 bp, Homo sapiens
ggagaccagaaggaagcttcga

SEQ ID NO: 78416 - DNA, 22 bp, Homo sapiens
ctacaaaagtaattgtggtttt

SEQ ID NO: 78417 - DNA, 22 bp, Homo sapiens
tctcaacagtgcaagctgctcc

SEQ ID NO: 78418 - DNA, 22 bp, Homo sapiens
aagaagcaggtcacagacaggg

SEQ ID NO: 78419 - DNA, 22 bp, Homo sapiens
agtgaaaacctaatcatgcagt

SEQ ID NO: 78420 - DNA, 22 bp, Homo sapiens
ggccaggcgatgacccctccac

SEQ ID NO: 78421 - DNA, 22 bp, Homo sapiens
aaattagtcatgttgtattact

SEQ ID NO: 78422 - DNA, 22 bp, Homo sapiens
tggccaccaccaatacttgcct

SEQ ID NO: 78423 - DNA, 22 bp, Homo sapiens
agcccaggttgaggctgcagtg

SEQ ID NO: 78424 - DNA, 22 bp, Homo sapiens
agttcagaggcaggagaaggct

SEQ ID NO: 78425 - DNA, 22 bp, Homo sapiens
tggtgctgccaggctcctgcca

SEQ ID NO: 78426 - DNA, 22 bp, Homo sapiens
tagcagcatttttgtagagtat

SEQ ID NO: 78427 - DNA, 22 bp, Homo sapiens
atgcctgtaatcccagcacttt

SEQ ID NO: 78428 - DNA, 22 bp, Homo sapiens
ggctgagttgagaggattactt

SEQ ID NO: 78429 - DNA, 22 bp, Homo sapiens
gtggagagagataagcctggtc

SEQ ID NO: 78430 - DNA, 19 bp, Homo sapiens
atctgccttagtgctgctg

SEQ ID NO: 78431 - DNA, 22 bp, Homo sapiens
ccctgcctacagggttttcttt

SEQ ID NO: 78432 - DNA, 22 bp, Homo sapiens
ttacctaaaatagctcaattta

SEQ ID NO: 78433 - DNA, 22 bp, Homo sapiens
gaggcagaggttgcagtgagct

SEQ ID NO: 78434 - DNA, 21 bp, Homo sapiens
gccatttcacacagacatttg

SEQ ID NO: 78435 - DNA, 22 bp, Homo sapiens
ggagtgaatcactagatgcaga

SEQ ID NO: 78436 - DNA, 22 bp, Homo sapiens
tttcataatactgtacatgaaa

SEQ ID NO: 78437 - DNA, 22 bp, Homo sapiens
gggaggcagtgctggaggctgg

SEQ ID NO: 78438 - DNA, 22 bp, Homo sapiens
gcttcaaactgagcttcaagtg

SEQ ID NO: 78439 - DNA, 22 bp, Homo sapiens
ggatgttctggggttctcttgt

SEQ ID NO: 78440 - DNA, 22 bp, Homo sapiens
attgtgaatagtgccgcagtaa

SEQ ID NO: 78441 - DNA, 22 bp, Homo sapiens
atgatccaaagccacaggggca

SEQ ID NO: 78442 - DNA, 22 bp, Homo sapiens
tgaggcaggagaatcaccggaa

SEQ ID NO: 78443 - DNA, 22 bp, Homo sapiens
tcaaattgtcatcttgataatg

SEQ ID NO: 78444 - DNA, 22 bp, Homo sapiens
tgatatgtaactactccttata

SEQ ID NO: 78445 - DNA, 22 bp, Homo sapiens
acaaacagagttgaaaaatagg

SEQ ID NO: 78446 - DNA, 22 bp, Homo sapiens
acccaggctggagtgcagtggc

SEQ ID NO: 78447 - DNA, 22 bp, Homo sapiens
tgatcaaaacattactccacca

SEQ ID NO: 78448 - DNA, 22 bp, Homo sapiens
gagccaggggtcagctccgagg

SEQ ID NO: 78449 - DNA, 17 bp, Homo sapiens
tctgagaatgctggagg

SEQ ID NO: 78450 - DNA, 22 bp, Homo sapiens
agaaatatgctgattagatgaa

SEQ ID NO: 78451 - DNA, 22 bp, Homo sapiens
cagagctggtgtgtcctggcat

SEQ ID NO: 78452 - DNA, 22 bp, Homo sapiens
aggaatggtgctcagcagaaat

SEQ ID NO: 78453 - DNA, 22 bp, Homo sapiens
ctgggatccacgggctcccaag

SEQ ID NO: 78454 - DNA, 22 bp, Homo sapiens
ggtgttgcagttgaagactggt

SEQ ID NO: 78455 - DNA, 22 bp, Homo sapiens
ttatttttaaaagttcacacag

SEQ ID NO: 78456 - DNA, 22 bp, Homo sapiens
tgagctgtagcagatgctgttg

SEQ ID NO: 78457 - DNA, 22 bp, Homo sapiens
ttttaatactgctattgtagga

SEQ ID NO: 78458 - DNA, 22 bp, Homo sapiens
cacccaggcaaggattctgcaa

SEQ ID NO: 78459 - DNA, 20 bp, Homo sapiens
ggcagagggcctgggagaag

SEQ ID NO: 78460 - DNA, 18 bp, Homo sapiens
gaggtagataagattttc

SEQ ID NO: 78461 - DNA, 22 bp, Homo sapiens
gttcaagaccagcctggccaac

SEQ ID NO: 78462 - DNA, 22 bp, Homo sapiens
tctgtcacccagagtgcagtgg

SEQ ID NO: 78463 - DNA, 20 bp, Homo sapiens
gggcaaggaaacagccccca

SEQ ID NO: 78464 - DNA, 22 bp, Homo sapiens
aaagtgctcggattacaggtat

SEQ ID NO: 78465 - DNA, 22 bp, Homo sapiens
gagccgaggcgcacagctcggg

SEQ ID NO: 78466 - DNA, 22 bp, Homo sapiens
ccctgctgtcaggtgctgggag

SEQ ID NO: 78467 - DNA, 21 bp, Homo sapiens
acctgagctccacctcctgcc

SEQ ID NO: 78468 - DNA, 22 bp, Homo sapiens
ggagaggcttccagagtcgtgc

SEQ ID NO: 78469 - DNA, 22 bp, Homo sapiens
gtcttaagaatgaatgctgaga

SEQ ID NO: 78470 - DNA, 23 bp, Homo sapiens
tgaggcaggcggatcacgaggtc

SEQ ID NO: 78471 - DNA, 22 bp, Homo sapiens
caaccccactacacgttggaga

SEQ ID NO: 78472 - DNA, 22 bp, Homo sapiens
ggatgttgattgaatggccatt

SEQ ID NO: 78473 - DNA, 22 bp, Homo sapiens
cactgcactccagcccgggcaa

SEQ ID NO: 78474 - DNA, 22 bp, Homo sapiens
agatggtagactatggaacgta

SEQ ID NO: 78475 - DNA, 22 bp, Homo sapiens
gttctgggagatcttgagcttc

SEQ ID NO: 78476 - DNA, 22 bp, Homo sapiens
gacgagagactccatccaccac

SEQ ID NO: 78477 - DNA, 22 bp, Homo sapiens
tgtgaatggacaattaaatcta

SEQ ID NO: 78478 - DNA, 21 bp, Homo sapiens
ctggccactgcacctcttcct

SEQ ID NO: 78479 - DNA, 22 bp, Homo sapiens
ggtggctgcaatggctaacttc

SEQ ID NO: 78480 - DNA, 22 bp, Homo sapiens
tgtcttcagcagtcatctgggg

SEQ ID NO: 78481 - DNA, 22 bp, Homo sapiens
tcacttagatggggatcatcac

SEQ ID NO: 78482 - DNA, 22 bp, Homo sapiens
gaggggctgccctggtgtcagg

SEQ ID NO: 78483 - DNA, 22 bp, Homo sapiens
aaaactacatttgacattttgt

SEQ ID NO: 78484 - DNA, 22 bp, Homo sapiens
ccgggcctcgggacaccgggta

SEQ ID NO: 78485 - DNA, 22 bp, Homo sapiens
ttgtgaaacattcatggatttg

SEQ ID NO: 78486 - DNA, 22 bp, Homo sapiens
agggcagagctgtctaaatggc

SEQ ID NO: 78487 - DNA, 22 bp, Homo sapiens
agcaagattgaggcttcctcag

SEQ ID NO: 78488 - DNA, 22 bp, Homo sapiens
tcagagtctgtgcattctgcta

SEQ ID NO: 78489 - DNA, 22 bp, Homo sapiens
tcagtgcacccaattctctcca

SEQ ID NO: 78490 - DNA, 22 bp, Homo sapiens
ttggggtcccacaggctgcctg

SEQ ID NO: 78491 - DNA, 22 bp, Homo sapiens
tcactgcaacctccacctcctg

SEQ ID NO: 78492 - DNA, 22 bp, Homo sapiens
cagtcctgaatactggacggtg

SEQ ID NO: 78493 - DNA, 22 bp, Homo sapiens
aatggaatacctaggtggccca

SEQ ID NO: 78494 - DNA, 22 bp, Homo sapiens
ccctcgtgcatccatcatttag

SEQ ID NO: 78495 - DNA, 22 bp, Homo sapiens
tactgcattatcaaggggaagg

SEQ ID NO: 78496 - DNA, 22 bp, Homo sapiens
tcatggggccacagctgccagc

SEQ ID NO: 78497 - DNA, 22 bp, Homo sapiens
ggcaggaggtgagtggcgggtg

SEQ ID NO: 78498 - DNA, 22 bp, Homo sapiens
ctgggaggcggaggttgtagtg

SEQ ID NO: 78499 - DNA, 22 bp, Homo sapiens
taggtttactgaattagtggaa

SEQ ID NO: 78500 - DNA, 22 bp, Homo sapiens
cccagcagtagagctcatatgg

SEQ ID NO: 78501 - DNA, 22 bp, Homo sapiens
gcaggcaggcttccttgaactg

SEQ ID NO: 78502 - DNA, 22 bp, Homo sapiens
aaggaaagctgtggttctgaga

SEQ ID NO: 78503 - DNA, 22 bp, Homo sapiens
atctggttcttcttaggcatca

SEQ ID NO: 78504 - DNA, 22 bp, Homo sapiens
gcggggcccggacccagcctct

SEQ ID NO: 78505 - DNA, 20 bp, Homo sapiens
ataaaataactgccacaaga

SEQ ID NO: 78506 - DNA, 22 bp, Homo sapiens
tgggagaaagaaccctgagtga

SEQ ID NO: 78507 - DNA, 22 bp, Homo sapiens
gcctccccaagcagcagggatt

SEQ ID NO: 78508 - DNA, 22 bp, Homo sapiens
acccaggccattggcaagagtc

SEQ ID NO: 78509 - DNA, 22 bp, Homo sapiens
agcccaggagtttgaggctgtg

SEQ ID NO: 78510 - DNA, 22 bp, Homo sapiens
gtggttttattcgttcctctgt

SEQ ID NO: 78511 - DNA, 20 bp, Homo sapiens
gctgaggggtctatggcata

SEQ ID NO: 78512 - DNA, 22 bp, Homo sapiens
aggagcagaccgtagtcctgca

SEQ ID NO: 78513 - DNA, 23 bp, Homo sapiens
gggggccgtcctggggattatag

SEQ ID NO: 78514 - DNA, 22 bp, Homo sapiens
caggctggagtgcagtggcgct

SEQ ID NO: 78515 - DNA, 22 bp, Homo sapiens
tggaagacaatttgaaaacatt

SEQ ID NO: 78516 - DNA, 22 bp, Homo sapiens
tttaatcaggcaaagcataata

SEQ ID NO: 78517 - DNA, 22 bp, Homo sapiens
agctggtgctcggggagctggc

SEQ ID NO: 78518 - DNA, 22 bp, Homo sapiens
gagctctgactgctgggtgaca

SEQ ID NO: 78519 - DNA, 22 bp, Homo sapiens
accagcctggccaacatggtga

SEQ ID NO: 78520 - DNA, 22 bp, Homo sapiens
cttctgagatgttgttttacag

SEQ ID NO: 78521 - DNA, 22 bp, Homo sapiens
cccaggctggagtgcagtggcg

SEQ ID NO: 78522 - DNA, 22 bp, Homo sapiens
ggaggcggaggttgcagtgagc

SEQ ID NO: 78523 - DNA, 22 bp, Homo sapiens
tgattcatcagaataggagttt

SEQ ID NO: 78524 - DNA, 22 bp, Homo sapiens
ggaggtggaggttgcagtgagc

SEQ ID NO: 78525 - DNA, 22 bp, Homo sapiens
ggaggcggaggttgcagtgagt

SEQ ID NO: 78526 - DNA, 22 bp, Homo sapiens
cagtggctggttagggacagga

SEQ ID NO: 78527 - DNA, 22 bp, Homo sapiens
tcagccagccagctacaggctt

SEQ ID NO: 78528 - DNA, 22 bp, Homo sapiens
ttgtgaatagtgccgctataaa

SEQ ID NO: 78529 - DNA, 22 bp, Homo sapiens
ttgtgaatagtgctgcaataaa

SEQ ID NO: 78530 - DNA, 22 bp, Homo sapiens
atgaaatgctattttggctaga

SEQ ID NO: 78531 - DNA, 22 bp, Homo sapiens
gagactgtcacttgggacctgt

SEQ ID NO: 78532 - DNA, 23 bp, Homo sapiens
cagagctggcttcatgggtgtgc

SEQ ID NO: 78533 - DNA, 22 bp, Homo sapiens
atacagggacatccagtttttc

SEQ ID NO: 78534 - DNA, 22 bp, Homo sapiens
ctttggagaaaagttcttgggc

SEQ ID NO: 78535 - DNA, 22 bp, Homo sapiens
tgagatggagtctcactctgtt

SEQ ID NO: 78536 - DNA, 22 bp, Homo sapiens
tggcactgagcagccgcggcag

SEQ ID NO: 78537 - DNA, 22 bp, Homo sapiens
tgtagtagcattcacgaagtgt

SEQ ID NO: 78538 - DNA, 21 bp, Homo sapiens
gcagcagtgttctagaatact

SEQ ID NO: 78539 - DNA, 22 bp, Homo sapiens
aacccgggaggtggaggttatg

SEQ ID NO: 78540 - DNA, 22 bp, Homo sapiens
tccagcccaggctggagtgtag

SEQ ID NO: 78541 - DNA, 21 bp, Homo sapiens
gttcaaatcctgacactacac

SEQ ID NO: 78542 - DNA, 22 bp, Homo sapiens
aggggatggagctggaaggcag

SEQ ID NO: 78543 - DNA, 19 bp, Homo sapiens
caggcctcttaccctctct

SEQ ID NO: 78544 - DNA, 22 bp, Homo sapiens
acagagcaataacagggagagg

SEQ ID NO: 78545 - DNA, 22 bp, Homo sapiens
ctgagcctcctgcttctatttc

SEQ ID NO: 78546 - DNA, 22 bp, Homo sapiens
tttggggatgtctgagttgttg

SEQ ID NO: 78547 - DNA, 22 bp, Homo sapiens
ccaggctgctgttggtgtccgc

SEQ ID NO: 78548 - DNA, 22 bp, Homo sapiens
gggttgaggcggatgtcggcgg

SEQ ID NO: 78549 - DNA, 22 bp, Homo sapiens
ttatgggagcaattggggaggt

SEQ ID NO: 78550 - DNA, 22 bp, Homo sapiens
ttattttaccttcctctgagct

SEQ ID NO: 78551 - DNA, 22 bp, Homo sapiens
tctgctctgtggcttcagctaa

SEQ ID NO: 78552 - DNA, 22 bp, Homo sapiens
ggaggctgaggcaggcggatca

SEQ ID NO: 78553 - DNA, 22 bp, Homo sapiens
acccaggctggagtgcagtgat

SEQ ID NO: 78554 - DNA, 22 bp, Homo sapiens
gggtcgcttggagaggcttcct

SEQ ID NO: 78555 - DNA, 22 bp, Homo sapiens
tgccgtggggctgaggctggag

SEQ ID NO: 78556 - DNA, 23 bp, Homo sapiens
ttctgggctgtggaagcctcggg

SEQ ID NO: 78557 - DNA, 22 bp, Homo sapiens
gatgaggcataaacacagtcac

SEQ ID NO: 78558 - DNA, 22 bp, Homo sapiens
tctggctctggagtccacctgc

SEQ ID NO: 78559 - DNA, 22 bp, Homo sapiens
ctcgggcttgaggctgtttacc

SEQ ID NO: 78560 - DNA, 22 bp, Homo sapiens
cacccaggctggagagcagtgg

SEQ ID NO: 78561 - DNA, 22 bp, Homo sapiens
gcagactgtatcaatgtcagta

SEQ ID NO: 78562 - DNA, 22 bp, Homo sapiens
aggcgagaggcttgggctagta

SEQ ID NO: 78563 - DNA, 22 bp, Homo sapiens
acatggcgggagtttcagatac

SEQ ID NO: 78564 - DNA, 22 bp, Homo sapiens
tggattcacaccattctcctgc

SEQ ID NO: 78565 - DNA, 22 bp, Homo sapiens
acagcgccgattctccggggct

SEQ ID NO: 78566 - DNA, 23 bp, Homo sapiens
gcctgccgcctggctgagaactg

SEQ ID NO: 78567 - DNA, 22 bp, Homo sapiens
agcaagattgaggcttcctcag

SEQ ID NO: 78568 - DNA, 22 bp, Homo sapiens
agatggtagactatggaacgta

SEQ ID NO: 78569 - DNA, 22 bp, Homo sapiens
cctgtggcgggggccagtgcct

SEQ ID NO: 78570 - DNA, 22 bp, Homo sapiens
aaaatcttgtgacttaggaagg

SEQ ID NO: 78571 - DNA, 22 bp, Homo sapiens
gatataggttcatagtgttaca

SEQ ID NO: 78572 - DNA, 22 bp, Homo sapiens
ctgctaaacctctctgagagct

SEQ ID NO: 78573 - DNA, 22 bp, Homo sapiens
acgtgctggagaagagctcgcc

SEQ ID NO: 78574 - DNA, 22 bp, Homo sapiens
tgacttgtctctttgggagaca

SEQ ID NO: 78575 - DNA, 22 bp, Homo sapiens
cggggccctggggctgaaggtc

SEQ ID NO: 78576 - DNA, 22 bp, Homo sapiens
tatagtgtgaggtaagggtcca

SEQ ID NO: 78577 - DNA, 21 bp, Homo sapiens
ggtgtgggatggactgaacca

SEQ ID NO: 78578 - DNA, 22 bp, Homo sapiens
taaatgttgtaagtacatctaa

SEQ ID NO: 78579 - DNA, 22 bp, Homo sapiens
cctccctgccggctggactagt

SEQ ID NO: 78580 - DNA, 22 bp, Homo sapiens
tttgaagactactgggagtgaa

SEQ ID NO: 78581 - DNA, 22 bp, Homo sapiens
cctgggcctctcaaagtgctgg

SEQ ID NO: 78582 - DNA, 22 bp, Homo sapiens
tttcataatactgtacatgaaa

SEQ ID NO: 78583 - DNA, 22 bp, Homo sapiens
tagtttcatctccaccctgccc

SEQ ID NO: 78584 - DNA, 22 bp, Homo sapiens
gctgtggcctggcgcagagctg

SEQ ID NO: 78585 - DNA, 19 bp, Homo sapiens
gttctttcatagtaagagc

SEQ ID NO: 78586 - DNA, 22 bp, Homo sapiens
cgggttttccacaggagtcttt

SEQ ID NO: 78587 - DNA, 19 bp, Homo sapiens
gccttcccaccacccgtcc

SEQ ID NO: 78588 - DNA, 22 bp, Homo sapiens
cccaggaggcctgcctggccgg

SEQ ID NO: 78589 - DNA, 22 bp, Homo sapiens
atccaccctgtggtggctttct

SEQ ID NO: 78590 - DNA, 22 bp, Homo sapiens
caaagcccagaggcctcacttt

SEQ ID NO: 78591 - DNA, 22 bp, Homo sapiens
gagtggctattgatccgtgatg

SEQ ID NO: 78592 - DNA, 19 bp, Homo sapiens
gggtcccaaaagatgtgct

SEQ ID NO: 78593 - DNA, 22 bp, Homo sapiens
gttactcttccccggggtctgg

SEQ ID NO: 78594 - DNA, 22 bp, Homo sapiens
gaagcctgtcatgtgacgctga

SEQ ID NO: 78595 - DNA, 22 bp, Homo sapiens
gtgtcaataaatagcggtgtgg

SEQ ID NO: 78596 - DNA, 22 bp, Homo sapiens
ttttctgtttgcttcaagacat

SEQ ID NO: 78597 - DNA, 22 bp, Homo sapiens
tttctcatggaacatcgtttag

SEQ ID NO: 78598 - DNA, 22 bp, Homo sapiens
tttgaaatgtatcagtataggt

SEQ ID NO: 78599 - DNA, 18 bp, Homo sapiens
gctatctctaagatcttt

SEQ ID NO: 78600 - DNA, 22 bp, Homo sapiens
tgggttttgtcctgatccatca

SEQ ID NO: 78601 - DNA, 19 bp, Homo sapiens
gggcttggggctgaagcct

SEQ ID NO: 78602 - DNA, 22 bp, Homo sapiens
taaatgttttgtgggttgagtt

SEQ ID NO: 78603 - DNA, 22 bp, Homo sapiens
ccagcagccaccttctcgaaat

SEQ ID NO: 78604 - DNA, 19 bp, Homo sapiens
ttctggtctggaatcaagg

SEQ ID NO: 78605 - DNA, 22 bp, Homo sapiens
ctgaagagaaagggagctcttc

SEQ ID NO: 78606 - DNA, 22 bp, Homo sapiens
gggttcagtccctcttgctact

SEQ ID NO: 78607 - DNA, 22 bp, Homo sapiens
tgtcaatatgtaataactgaat

SEQ ID NO: 78608 - DNA, 22 bp, Homo sapiens
cagtggcctctggctttgctgt

SEQ ID NO: 78609 - DNA, 22 bp, Homo sapiens
taaagctctgggtttctagatc

SEQ ID NO: 78610 - DNA, 22 bp, Homo sapiens
gggctgggattgcttgctgtga

SEQ ID NO: 78611 - DNA, 22 bp, Homo sapiens
cctcccctcagacagagactgg

SEQ ID NO: 78612 - DNA, 22 bp, Homo sapiens
ctcactgaaacctccgcctccc

SEQ ID NO: 78613 - DNA, 22 bp, Homo sapiens
ttctgattgctgatgaggccca

SEQ ID NO: 78614 - DNA, 22 bp, Homo sapiens
gctgcgccggatcccacgttcc

SEQ ID NO: 78615 - DNA, 22 bp, Homo sapiens
tgaatgtgatgctaaacatatg

SEQ ID NO: 78616 - DNA, 22 bp, Homo sapiens
ttctagtgtccttggacttgct

SEQ ID NO: 78617 - DNA, 22 bp, Homo sapiens
ccctgccttgtctgggctaggt

SEQ ID NO: 78618 - DNA, 22 bp, Homo sapiens
tcataaattctggtgctgtgag

SEQ ID NO: 78619 - DNA, 22 bp, Homo sapiens
tccgggaggcagaggttgcagt

SEQ ID NO: 78620 - DNA, 22 bp, Homo sapiens
gctgcagtgagccaagatcgtg

SEQ ID NO: 78621 - DNA, 22 bp, Homo sapiens
ctgcagtctacctggattttta

SEQ ID NO: 78622 - DNA, 22 bp, Homo sapiens
ctagggtcaggggcctgcgtcg

SEQ ID NO: 78623 - DNA, 22 bp, Homo sapiens
cccaagaggtggaggttgcagt

SEQ ID NO: 78624 - DNA, 22 bp, Homo sapiens
ttttggttgttgggtaagagta

SEQ ID NO: 78625 - DNA, 22 bp, Homo sapiens
atcttcccaggctggggagagg

SEQ ID NO: 78626 - DNA, 22 bp, Homo sapiens
atgctttctcttagttcattga

SEQ ID NO: 78627 - DNA, 22 bp, Homo sapiens
ttcttttaattgtgggggagtg

SEQ ID NO: 78628 - DNA, 22 bp, Homo sapiens
aagatattcaaagatttattag

SEQ ID NO: 78629 - DNA, 22 bp, Homo sapiens
gtgggacaggtcaaatcttaaa

SEQ ID NO: 78630 - DNA, 22 bp, Homo sapiens
tctgtgcctgcttccccaccca

SEQ ID NO: 78631 - DNA, 22 bp, Homo sapiens
ccctcccaggagtggccagaga

SEQ ID NO: 78632 - DNA, 22 bp, Homo sapiens
tcaccaggctagagtgcagtgg

SEQ ID NO: 78633 - DNA, 21 bp, Homo sapiens
tggtacaccttgcctgtcaga

SEQ ID NO: 78634 - DNA, 22 bp, Homo sapiens
caccttactccctctggatgcc

SEQ ID NO: 78635 - DNA, 22 bp, Homo sapiens
aagctctttccactaaaccact

SEQ ID NO: 78636 - DNA, 22 bp, Homo sapiens
tgggtgtgtccatattttgact

SEQ ID NO: 78637 - DNA, 22 bp, Homo sapiens
gaggggagcccccatcctccag

SEQ ID NO: 78638 - DNA, 22 bp, Homo sapiens
cttgcctttgtcttcaaaggct

SEQ ID NO: 78639 - DNA, 20 bp, Homo sapiens
tggtccccatccttgcgatt

SEQ ID NO: 78640 - DNA, 22 bp, Homo sapiens
ggaggggatttagtagatgcta

SEQ ID NO: 78641 - DNA, 22 bp, Homo sapiens
gtgtaagtatctttgtatcttt

SEQ ID NO: 78642 - DNA, 22 bp, Homo sapiens
tctcgctctgtcgcccaggctg

SEQ ID NO: 78643 - DNA, 21 bp, Homo sapiens
ctgtcatgcaaccattctcca

SEQ ID NO: 78644 - DNA, 22 bp, Homo sapiens
ataaagctattcctctcttttt

SEQ ID NO: 78645 - DNA, 22 bp, Homo sapiens
ataaaatttgctactgttaaat

SEQ ID NO: 78646 - DNA, 22 bp, Homo sapiens
tactttaatatatgtgaagttc

SEQ ID NO: 78647 - DNA, 22 bp, Homo sapiens
tctctggactcgagcttactca

SEQ ID NO: 78648 - DNA, 22 bp, Homo sapiens
taggtttcagaggtgccgggaa

SEQ ID NO: 78649 - DNA, 22 bp, Homo sapiens
tcaccgaggctggagtgcagtg

SEQ ID NO: 78650 - DNA, 22 bp, Homo sapiens
tagcataacaggtaagagtgag

SEQ ID NO: 78651 - DNA, 22 bp, Homo sapiens
cctgccctgctcactgtcggta

SEQ ID NO: 78652 - DNA, 22 bp, Homo sapiens
gggaggttgaggctgcagtgag

SEQ ID NO: 78653 - DNA, 22 bp, Homo sapiens
tggggcagttaataaacattct

SEQ ID NO: 78654 - DNA, 22 bp, Homo sapiens
cagtggctggttagggacagga

SEQ ID NO: 78655 - DNA, 22 bp, Homo sapiens
taagaaatttagttatagaatg

SEQ ID NO: 78656 - DNA, 22 bp, Homo sapiens
tctgtggcccaagtgatggctg

SEQ ID NO: 78657 - DNA, 22 bp, Homo sapiens
cacttcattgggaccagggctg

SEQ ID NO: 78658 - DNA, 22 bp, Homo sapiens
cagctgcccctccagggctggg

SEQ ID NO: 78659 - DNA, 22 bp, Homo sapiens
cccctcttggcattgagtgcca

SEQ ID NO: 78660 - DNA, 16 bp, Homo sapiens
ccacctgcagctctca

SEQ ID NO: 78661 - DNA, 22 bp, Homo sapiens
atatatttgagaatattcatga

SEQ ID NO: 78662 - DNA, 22 bp, Homo sapiens
cagtgcccgccgccgttcctgg

SEQ ID NO: 78663 - DNA, 22 bp, Homo sapiens
caatagtgtctgcttgtttcta

SEQ ID NO: 78664 - DNA, 22 bp, Homo sapiens
tgggttttatatgtggtggaca

SEQ ID NO: 78665 - DNA, 22 bp, Homo sapiens
ggcagcactgcagcttgttggg

SEQ ID NO: 78666 - DNA, 22 bp, Homo sapiens
gggagaggttacccgagcaact

SEQ ID NO: 78667 - DNA, 22 bp, Homo sapiens
tcacattttcaaaagctggtgc

SEQ ID NO: 78668 - DNA, 22 bp, Homo sapiens
tcccctggtgccacgatctgct

SEQ ID NO: 78669 - DNA, 22 bp, Homo sapiens
gtggcttgagcaggggcagagg

SEQ ID NO: 78670 - DNA, 22 bp, Homo sapiens
acacttggagcaacacttatgg

SEQ ID NO: 78671 - DNA, 22 bp, Homo sapiens
agaaaatgtgaacttgtgaatt

SEQ ID NO: 78672 - DNA, 22 bp, Homo sapiens
gaggccaactttggagaacagg

SEQ ID NO: 78673 - DNA, 22 bp, Homo sapiens
aaggccttgccgaaggatgcca

SEQ ID NO: 78674 - DNA, 22 bp, Homo sapiens
tggaggccagaggtactgggac

SEQ ID NO: 78675 - DNA, 23 bp, Homo sapiens
tcagaacagttcttggtgcatag

SEQ ID NO: 78676 - DNA, 22 bp, Homo sapiens
acatttttcacatttgtagggt

SEQ ID NO: 78677 - DNA, 22 bp, Homo sapiens
gcttggctttactagggggaca

SEQ ID NO: 78678 - DNA, 22 bp, Homo sapiens
gctccagtgaccatcgttttag

SEQ ID NO: 78679 - DNA, 22 bp, Homo sapiens
tagattcagatatttaggacaa

SEQ ID NO: 78680 - DNA, 22 bp, Homo sapiens
atacagggacatccagtttttc

SEQ ID NO: 78681 - DNA, 22 bp, Homo sapiens
gctcttgtcaaaaattagttga

SEQ ID NO: 78682 - DNA, 22 bp, Homo sapiens
tcacccaggctggagtgcagtg

SEQ ID NO: 78683 - DNA, 22 bp, Homo sapiens
gcttccacctactaaatgccac

SEQ ID NO: 78684 - DNA, 22 bp, Homo sapiens
acgcccagactcccatactttg

SEQ ID NO: 78685 - DNA, 21 bp, Homo sapiens
tggctaaaccctagtaaatta

SEQ ID NO: 78686 - DNA, 22 bp, Homo sapiens
ggggtccctgcaccagcatgtc

SEQ ID NO: 78687 - DNA, 22 bp, Homo sapiens
tggttgcctctcagagattccg

SEQ ID NO: 78688 - DNA, 22 bp, Homo sapiens
gaggacaagctgtgagtggggt

SEQ ID NO: 78689 - DNA, 22 bp, Homo sapiens
atttttctctttccactgagat

SEQ ID NO: 78690 - DNA, 22 bp, Homo sapiens
tgatctggtcctactgtgggca

SEQ ID NO: 78691 - DNA, 22 bp, Homo sapiens
atgggttcaagtgattctcctg

SEQ ID NO: 78692 - DNA, 22 bp, Homo sapiens
cccgggaggaggaagttgcagt

SEQ ID NO: 78693 - DNA, 23 bp, Homo sapiens
ttgcttagagacctcctcatcag

SEQ ID NO: 78694 - DNA, 22 bp, Homo sapiens
tcctttgcttctgtcattctcc

SEQ ID NO: 78695 - DNA, 22 bp, Homo sapiens
ggtgcccaaggaaggttgccgt

SEQ ID NO: 78696 - DNA, 22 bp, Homo sapiens
agtgatccacccgcctcaacct

SEQ ID NO: 78697 - DNA, 22 bp, Homo sapiens
tgaaatgtgtaatgtggatgcc

SEQ ID NO: 78698 - DNA, 22 bp, Homo sapiens
tggagaattctatgttgagggg

SEQ ID NO: 78699 - DNA, 22 bp, Homo sapiens
gccctgccctctcggcactcgc

SEQ ID NO: 78700 - DNA, 22 bp, Homo sapiens
agagggatcaccctgtttctgg

SEQ ID NO: 78701 - DNA, 22 bp, Homo sapiens
ctcctgagctctgaggaagctt

SEQ ID NO: 78702 - DNA, 22 bp, Homo sapiens
gtgagactcgcctttgtgtagc

SEQ ID NO: 78703 - DNA, 22 bp, Homo sapiens
cggtctcccgtgtgtgtgcgct

SEQ ID NO: 78704 - DNA, 22 bp, Homo sapiens
actgtgaacggactgaagccca

SEQ ID NO: 78705 - DNA, 22 bp, Homo sapiens
gggcaacagagcgagggcctgt

SEQ ID NO: 78706 - DNA, 22 bp, Homo sapiens
tttctggcagcgggacaggggt

SEQ ID NO: 78707 - DNA, 22 bp, Homo sapiens
aatgttacgatcaacaacacat

SEQ ID NO: 78708 - DNA, 22 bp, Homo sapiens
cacccaggctggagagcagtgg

SEQ ID NO: 78709 - DNA, 22 bp, Homo sapiens
agctgtcaccaggagccggacc

SEQ ID NO: 78710 - DNA, 22 bp, Homo sapiens
aggtgcccatgagctccatggc

SEQ ID NO: 78711 - DNA, 22 bp, Homo sapiens
aggacaaaggaccagatctgga

SEQ ID NO: 78712 - DNA, 22 bp, Homo sapiens
aatattatcaaaagctttttca

SEQ ID NO: 78713 - DNA, 22 bp, Homo sapiens
taaaatttgtccctgagtgttg

SEQ ID NO: 78714 - DNA, 22 bp, Homo sapiens
agccttcggccagagggtggcc

SEQ ID NO: 78715 - DNA, 22 bp, Homo sapiens
cttctttcaagaatggattagg

SEQ ID NO: 78716 - DNA, 22 bp, Homo sapiens
tcacatctaattccatttctgc

SEQ ID NO: 78717 - DNA, 22 bp, Homo sapiens
aagtaaatatctgtagtcttta

SEQ ID NO: 78718 - DNA, 22 bp, Homo sapiens
cctccccacagcccaggagact

SEQ ID NO: 78719 - DNA, 22 bp, Homo sapiens
tggctgtgtccctgtccagagt

SEQ ID NO: 78720 - DNA, 22 bp, Homo sapiens
aaatggaagctatttatgattc

SEQ ID NO: 78721 - DNA, 22 bp, Homo sapiens
ccctcccggcgtgctgggctcg

SEQ ID NO: 78722 - DNA, 22 bp, Homo sapiens
agtcccaacagcttacaaggaa

SEQ ID NO: 78723 - DNA, 22 bp, Homo sapiens
attgctaggaacaggttgcacc

SEQ ID NO: 78724 - DNA, 22 bp, Homo sapiens
agatttatgtggtcacactcag

SEQ ID NO: 78725 - DNA, 22 bp, Homo sapiens
ctcattgcagctgcattactgt

SEQ ID NO: 78726 - DNA, 22 bp, Homo sapiens
cacatgaaggctggggtcgtga

SEQ ID NO: 78727 - DNA, 22 bp, Homo sapiens
gcctccccaagcagcagggatt

SEQ ID NO: 78728 - DNA, 23 bp, Homo sapiens
agcaatctgtgtttcagcaagcc

SEQ ID NO: 78729 - DNA, 22 bp, Homo sapiens
ccttttatagatcagtgtgtta

SEQ ID NO: 78730 - DNA, 17 bp, Homo sapiens
cccgttctcttcgctgg

SEQ ID NO: 78731 - DNA, 22 bp, Homo sapiens
aagttactggcaagggctgcag

SEQ ID NO: 78732 - DNA, 22 bp, Homo sapiens
aaagcctcccaggttatgagta

SEQ ID NO: 78733 - DNA, 22 bp, Homo sapiens
agaagcattggaccaggggccc

SEQ ID NO: 78734 - DNA, 22 bp, Homo sapiens
aattttctggtgtgtaatgaag

SEQ ID NO: 78735 - DNA, 22 bp, Homo sapiens
gagctgtgtatgcatcattctg

SEQ ID NO: 78736 - DNA, 22 bp, Homo sapiens
tcctccccaaagcccagcctgg

SEQ ID NO: 78737 - DNA, 22 bp, Homo sapiens
tggtggctaccaggtcctgggg

SEQ ID NO: 78738 - DNA, 22 bp, Homo sapiens
cttggtctataggagagattgt

SEQ ID NO: 78739 - DNA, 22 bp, Homo sapiens
gctggctgacagatttggggtg

SEQ ID NO: 78740 - DNA, 22 bp, Homo sapiens
tcccacaggtggagcttgcagt

SEQ ID NO: 78741 - DNA, 22 bp, Homo sapiens
attcgacaaccttgttttgtac

SEQ ID NO: 78742 - DNA, 22 bp, Homo sapiens
gggaggttctgttcgcacttga

SEQ ID NO: 78743 - DNA, 22 bp, Homo sapiens
accctccccaagaggtcgtgcc

SEQ ID NO: 78744 - DNA, 22 bp, Homo sapiens
catctgctgttccttggactca

SEQ ID NO: 78745 - DNA, 22 bp, Homo sapiens
ttttctaacatctagtaatttg

SEQ ID NO: 78746 - DNA, 22 bp, Homo sapiens
ccaagcagagcagcctctctgg

SEQ ID NO: 78747 - DNA, 22 bp, Homo sapiens
aaaaatcacttttataggcagc

SEQ ID NO: 78748 - DNA, 22 bp, Homo sapiens
ccttctagcaaatcaacataaa

SEQ ID NO: 78749 - DNA, 23 bp, Homo sapiens
cagggccctgctcaatttctcca

SEQ ID NO: 78750 - DNA, 22 bp, Homo sapiens
acatgagactgggtttgtaggg

SEQ ID NO: 78751 - DNA, 21 bp, Homo sapiens
agggttttatagatctcttcc

SEQ ID NO: 78752 - DNA, 22 bp, Homo sapiens
tgggagcagcctcagcttcggg

SEQ ID NO: 78753 - DNA, 22 bp, Homo sapiens
cctgcagacacttgtccagcaa

SEQ ID NO: 78754 - DNA, 18 bp, Homo sapiens
atggtctcatactgggag

SEQ ID NO: 78755 - DNA, 22 bp, Homo sapiens
atttctctgcagtgttcggaat

SEQ ID NO: 78756 - DNA, 22 bp, Homo sapiens
aggggaggtgtccccaaatctc

SEQ ID NO: 78757 - DNA, 22 bp, Homo sapiens
ctgtctgaatcctaagcttcct

SEQ ID NO: 78758 - DNA, 22 bp, Homo sapiens
actattagcatatcatgaatgg

SEQ ID NO: 78759 - DNA, 22 bp, Homo sapiens
tgaggcaggagttcaggctgcg

SEQ ID NO: 78760 - DNA, 22 bp, Homo sapiens
tcattgccatggcatttgcaga

SEQ ID NO: 78761 - DNA, 22 bp, Homo sapiens
cacttgttggtggtgaaatcac

SEQ ID NO: 78762 - DNA, 22 bp, Homo sapiens
agggaagtggtctgggaacttg

SEQ ID NO: 78763 - DNA, 22 bp, Homo sapiens
ctgtcatggtttgaatgctcgc

SEQ ID NO: 78764 - DNA, 22 bp, Homo sapiens
acagaagcctttggccatttga

SEQ ID NO: 78765 - DNA, 17 bp, Homo sapiens
acttcccacccctccag

SEQ ID NO: 78766 - DNA, 22 bp, Homo sapiens
gggagagtagctggaaggttct

SEQ ID NO: 78767 - DNA, 22 bp, Homo sapiens
tcaccaggctggagtgcagtgg

SEQ ID NO: 78768 - DNA, 22 bp, Homo sapiens
actggggctgatgcgttcgtgt

SEQ ID NO: 78769 - DNA, 22 bp, Homo sapiens
aaacatctactgtaggctggag

SEQ ID NO: 78770 - DNA, 22 bp, Homo sapiens
gcgagcctctggagtcctctgg

SEQ ID NO: 78771 - DNA, 22 bp, Homo sapiens
gctgctttggaaagcatggaaa

SEQ ID NO: 78772 - DNA, 22 bp, Homo sapiens
agagtgcaaccgaaacaagcag

SEQ ID NO: 78773 - DNA, 22 bp, Homo sapiens
agccttacataaacagccttat

SEQ ID NO: 78774 - DNA, 22 bp, Homo sapiens
gtgggacaaggatgaagatatt

SEQ ID NO: 78775 - DNA, 22 bp, Homo sapiens
tctcacatgcaaacagtccaca

SEQ ID NO: 78776 - DNA, 22 bp, Homo sapiens
agggctgcccagtgtgagagct

SEQ ID NO: 78777 - DNA, 22 bp, Homo sapiens
tcagaacatgtttgagtaagac

SEQ ID NO: 78778 - DNA, 22 bp, Homo sapiens
ggggcccctcggacacgtgcgg

SEQ ID NO: 78779 - DNA, 22 bp, Homo sapiens
tggcctcggcatccagcaagag

SEQ ID NO: 78780 - DNA, 22 bp, Homo sapiens
aaagggaagttgcacatgttcc

SEQ ID NO: 78781 - DNA, 22 bp, Homo sapiens
caggagttttaaatctagcatg

SEQ ID NO: 78782 - DNA, 21 bp, Homo sapiens
aggcttggatctagacaggcc

SEQ ID NO: 78783 - DNA, 22 bp, Homo sapiens
caagggctcaaacggtggttgc

SEQ ID NO: 78784 - DNA, 22 bp, Homo sapiens
tccaccaagccggggccacttc

SEQ ID NO: 78785 - DNA, 22 bp, Homo sapiens
aagagaacagttgctgcccaag

SEQ ID NO: 78786 - DNA, 22 bp, Homo sapiens
tcttcccagaggaggtgccagc

SEQ ID NO: 78787 - DNA, 22 bp, Homo sapiens
gaggggcacagtaaagggtccc

SEQ ID NO: 78788 - DNA, 22 bp, Homo sapiens
actcatgtaagcggaatgtagt

SEQ ID NO: 78789 - DNA, 22 bp, Homo sapiens
actgggtctgaaggacagagca

SEQ ID NO: 78790 - DNA, 22 bp, Homo sapiens
gagtccctgctgtcaggtgctg

SEQ ID NO: 78791 - DNA, 22 bp, Homo sapiens
aaggggtgagcagaggcttcgc

SEQ ID NO: 78792 - DNA, 22 bp, Homo sapiens
ttcctggaaattatgctcacct

SEQ ID NO: 78793 - DNA, 21 bp, Homo sapiens
taaacataaccttgtatggct

SEQ ID NO: 78794 - DNA, 22 bp, Homo sapiens
tccaccatgtaacaagctctgt

SEQ ID NO: 78795 - DNA, 22 bp, Homo sapiens
agttgcagacgcagagatgttg

SEQ ID NO: 78796 - DNA, 22 bp, Homo sapiens
aggggagagttaatgtgaatgt

SEQ ID NO: 78797 - DNA, 22 bp, Homo sapiens
agtccagaaagtgaacagtgtt

SEQ ID NO: 78798 - DNA, 22 bp, Homo sapiens
gtcatggtgctagcgggaatgt

SEQ ID NO: 78799 - DNA, 22 bp, Homo sapiens
ggtgccctggaagctgctgcat

SEQ ID NO: 78800 - DNA, 22 bp, Homo sapiens
atatgggggggcgtgcagagga

SEQ ID NO: 78801 - DNA, 22 bp, Homo sapiens
gagctcattcattcattgcctg

SEQ ID NO: 78802 - DNA, 22 bp, Homo sapiens
gggcttggcacatgggctcagc

SEQ ID NO: 78803 - DNA, 22 bp, Homo sapiens
ttgggacagctgtggtagtgag

SEQ ID NO: 78804 - DNA, 22 bp, Homo sapiens
ctcccgaggagcctcagcgctc

SEQ ID NO: 78805 - DNA, 22 bp, Homo sapiens
ggctgtggcagctggaagtggt

SEQ ID NO: 78806 - DNA, 22 bp, Homo sapiens
ccagaaaaatcctcccttgtcc

SEQ ID NO: 78807 - DNA, 22 bp, Homo sapiens
tctaccctgcggtcttggggca

SEQ ID NO: 78808 - DNA, 22 bp, Homo sapiens
tcccagtttttctccactaagg

SEQ ID NO: 78809 - DNA, 22 bp, Homo sapiens
tgggaaggggagctggaaagga

SEQ ID NO: 78810 - DNA, 22 bp, Homo sapiens
tcttcccccgtgctccagtgca

SEQ ID NO: 78811 - DNA, 22 bp, Homo sapiens
agcttgacagacagatggtagc

SEQ ID NO: 78812 - DNA, 22 bp, Homo sapiens
gcaggaggttgagccaggactg

SEQ ID NO: 78813 - DNA, 22 bp, Homo sapiens
agggctggagccacagctggga

SEQ ID NO: 78814 - DNA, 22 bp, Homo sapiens
aagtggactaatacaaggacta

SEQ ID NO: 78815 - DNA, 22 bp, Homo sapiens
gatttagtggcccttggtacac

SEQ ID NO: 78816 - DNA, 22 bp, Homo sapiens
atatatttgagaatattcatga

SEQ ID NO: 78817 - DNA, 22 bp, Homo sapiens
atcattatcctcctatttgcct

SEQ ID NO: 78818 - DNA, 22 bp, Homo sapiens
ggctgtggcagctggaagtggt

SEQ ID NO: 78819 - DNA, 22 bp, Homo sapiens
ctctggaggtggaggttgcagt

SEQ ID NO: 78820 - DNA, 22 bp, Homo sapiens
ggagaagaggagctggaagcct

SEQ ID NO: 78821 - DNA, 22 bp, Homo sapiens
ctcactgcaacctctgcctccc

SEQ ID NO: 78822 - DNA, 22 bp, Homo sapiens
attgtcgtcaatggacacatag

SEQ ID NO: 78823 - DNA, 22 bp, Homo sapiens
caggaaggggctcactctggcc

SEQ ID NO: 78824 - DNA, 22 bp, Homo sapiens
atgattgaaaatgacattgcca

SEQ ID NO: 78825 - DNA, 22 bp, Homo sapiens
tcctttaaacaaccagctctca

SEQ ID NO: 78826 - DNA, 16 bp, Homo sapiens
aggctcagaggctgga

SEQ ID NO: 78827 - DNA, 22 bp, Homo sapiens
agggaagaaaatccatcgctgc

SEQ ID NO: 78828 - DNA, 23 bp, Homo sapiens
ggctgggagctccgggtgcacgt

SEQ ID NO: 78829 - DNA, 22 bp, Homo sapiens
ctgaagagaaagggagctcttc

SEQ ID NO: 78830 - DNA, 22 bp, Homo sapiens
ctacttgttcactgtaggtcgc

SEQ ID NO: 78831 - DNA, 22 bp, Homo sapiens
ttttctgtttgcttcaagacat

SEQ ID NO: 78832 - DNA, 22 bp, Homo sapiens
gtagaggggtgattctgtgaga

SEQ ID NO: 78833 - DNA, 22 bp, Homo sapiens
gagccagactgcctgaagctca

SEQ ID NO: 78834 - DNA, 22 bp, Homo sapiens
atcaaatacaaagggcataagg

SEQ ID NO: 78835 - DNA, 22 bp, Homo sapiens
atcttctcatgtgtaatgaggt

SEQ ID NO: 78836 - DNA, 22 bp, Homo sapiens
aacttaggaaaataaggcatga

SEQ ID NO: 78837 - DNA, 22 bp, Homo sapiens
ggatgctctgtctcttgctgtt

SEQ ID NO: 78838 - DNA, 22 bp, Homo sapiens
ccaggaggtggaggttgcggtg

SEQ ID NO: 78839 - DNA, 22 bp, Homo sapiens
ttccggaaggttctctagaatt

SEQ ID NO: 78840 - DNA, 22 bp, Homo sapiens
taagagaatgttgtggctaggt

SEQ ID NO: 78841 - DNA, 20 bp, Homo sapiens
caaatccctgctctgtgctg

SEQ ID NO: 78842 - DNA, 22 bp, Homo sapiens
ctgggcagctgtatcagggagt

SEQ ID NO: 78843 - DNA, 22 bp, Homo sapiens
cgtcatcacggcaagcatctcc

SEQ ID NO: 78844 - DNA, 22 bp, Homo sapiens
tgtcatctgcgggtggcactgc

SEQ ID NO: 78845 - DNA, 22 bp, Homo sapiens
tgtggcacatacacaggagggc

SEQ ID NO: 78846 - DNA, 22 bp, Homo sapiens
atcacccaagctggagtgcagt

SEQ ID NO: 78847 - DNA, 22 bp, Homo sapiens
cccagcagtagagctcatatgg

SEQ ID NO: 78848 - DNA, 22 bp, Homo sapiens
gtgtgggctgcagaggcacagc

SEQ ID NO: 78849 - DNA, 20 bp, Homo sapiens
tttcttgtcggctgttgctg

SEQ ID NO: 78850 - DNA, 19 bp, Homo sapiens
ccagagagctaggtacaga

SEQ ID NO: 78851 - DNA, 22 bp, Homo sapiens
aggtggggaggagtgtctcttt

SEQ ID NO: 78852 - DNA, 22 bp, Homo sapiens
tagatgcttgttcagaaatagg

SEQ ID NO: 78853 - DNA, 22 bp, Homo sapiens
tttgtcttatccaatctctcag

SEQ ID NO: 78854 - DNA, 22 bp, Homo sapiens
cgtttagttgtcccttcttaaa

SEQ ID NO: 78855 - DNA, 22 bp, Homo sapiens
gggaggcagtgctggaggctgg

SEQ ID NO: 78856 - DNA, 22 bp, Homo sapiens
agaggaagtaatcaggacctgc

SEQ ID NO: 78857 - DNA, 22 bp, Homo sapiens
ctgggatccacgggctcccaag

SEQ ID NO: 78858 - DNA, 22 bp, Homo sapiens
ctccagttggccccagttggtt

SEQ ID NO: 78859 - DNA, 22 bp, Homo sapiens
gaggtgctgctgtacttcttgc

SEQ ID NO: 78860 - DNA, 22 bp, Homo sapiens
gggaagagggagctggaatgat

SEQ ID NO: 78861 - DNA, 22 bp, Homo sapiens
tactttaatatatgtgaagttc

SEQ ID NO: 78862 - DNA, 22 bp, Homo sapiens
gtggggtagatctttctcagga

SEQ ID NO: 78863 - DNA, 22 bp, Homo sapiens
gagcccaggaagtggaggctga

SEQ ID NO: 78864 - DNA, 22 bp, Homo sapiens
tcgcccaggctggaagtgcagt

SEQ ID NO: 78865 - DNA, 22 bp, Homo sapiens
ccaggaggtggagattgcagtg

SEQ ID NO: 78866 - DNA, 22 bp, Homo sapiens
tggtacacatgtccaaggtcag

SEQ ID NO: 78867 - DNA, 21 bp, Homo sapiens
gcccacagtgaggaggatccc

SEQ ID NO: 78868 - DNA, 21 bp, Homo sapiens
tggacttatggagtgtttctt

SEQ ID NO: 78869 - DNA, 22 bp, Homo sapiens
agatacattgttctaagcattg

SEQ ID NO: 78870 - DNA, 22 bp, Homo sapiens
gatctggaatctgaaggctgag

SEQ ID NO: 78871 - DNA, 22 bp, Homo sapiens
ggccagaagttggaaaagagcc

SEQ ID NO: 78872 - DNA, 22 bp, Homo sapiens
ctcccagccttcgccagtctga

SEQ ID NO: 78873 - DNA, 22 bp, Homo sapiens
agaggaggctctgggatcgtcc

SEQ ID NO: 78874 - DNA, 22 bp, Homo sapiens
ctgtctgaatcctaagcttcct

SEQ ID NO: 78875 - DNA, 22 bp, Homo sapiens
gcttggaagtaggattgggaga

SEQ ID NO: 78876 - DNA, 17 bp, Homo sapiens
tgtagcttctccttctc

SEQ ID NO: 78877 - DNA, 22 bp, Homo sapiens
gcgccccatctacagtactttt

SEQ ID NO: 78878 - DNA, 22 bp, Homo sapiens
caggaggttgagggtgcagtga

SEQ ID NO: 78879 - DNA, 22 bp, Homo sapiens
ctacccttaagtttctgtgggg

SEQ ID NO: 78880 - DNA, 22 bp, Homo sapiens
tcactgcaacctccacctcccg

SEQ ID NO: 78881 - DNA, 22 bp, Homo sapiens
gaggcacagagtaggtgcacac

SEQ ID NO: 78882 - DNA, 22 bp, Homo sapiens
tggaacaagggcgtggcggtcg

SEQ ID NO: 78883 - DNA, 22 bp, Homo sapiens
aaaagtaattgtggtttttgct

SEQ ID NO: 78884 - DNA, 22 bp, Homo sapiens
agggaagaggaccagagtctct

SEQ ID NO: 78885 - DNA, 22 bp, Homo sapiens
aggaggaagggaagacaagtaa

SEQ ID NO: 78886 - DNA, 22 bp, Homo sapiens
attctggacaaggcaagctcct

SEQ ID NO: 78887 - DNA, 22 bp, Homo sapiens
ttattgaaggaactgaaataaa

SEQ ID NO: 78888 - DNA, 22 bp, Homo sapiens
ggagaggcttccagagtcgtgc

SEQ ID NO: 78889 - DNA, 22 bp, Homo sapiens
agactttaacaatgggtatgaa

SEQ ID NO: 78890 - DNA, 22 bp, Homo sapiens
tggtggggccagacttcagctc

SEQ ID NO: 78891 - DNA, 22 bp, Homo sapiens
gtaggtcagacataagaggaca

SEQ ID NO: 78892 - DNA, 22 bp, Homo sapiens
gaagaaggtggcccaggggtag

SEQ ID NO: 78893 - DNA, 22 bp, Homo sapiens
gctggtgagcaaaggagaagga

SEQ ID NO: 78894 - DNA, 22 bp, Homo sapiens
agggaacatttgcactgttggt

SEQ ID NO: 78895 - DNA, 22 bp, Homo sapiens
tagattcagatatttaggacaa

SEQ ID NO: 78896 - DNA, 22 bp, Homo sapiens
ctgagccaaggggacagtgaca

SEQ ID NO: 78897 - DNA, 22 bp, Homo sapiens
acttttaaatgagtttcagttg

SEQ ID NO: 78898 - DNA, 22 bp, Homo sapiens
ctccagattccgtttattcagg

SEQ ID NO: 78899 - DNA, 22 bp, Homo sapiens
gggacttaatgcagagagggac

SEQ ID NO: 78900 - DNA, 22 bp, Homo sapiens
tcactgcaacctccacctcctg

SEQ ID NO: 78901 - DNA, 22 bp, Homo sapiens
ttaaatattatgttgtctgcaa

SEQ ID NO: 78902 - DNA, 22 bp, Homo sapiens
ttggccatctaagcccagccac

SEQ ID NO: 78903 - DNA, 22 bp, Homo sapiens
gacaggaggcagagctcaggtg

SEQ ID NO: 78904 - DNA, 22 bp, Homo sapiens
gctgggttttcttccgggccta

SEQ ID NO: 78905 - DNA, 22 bp, Homo sapiens
ccaggaggttgaggctgcagtg

SEQ ID NO: 78906 - DNA, 22 bp, Homo sapiens
gagggtggtggcttaaggtgct

SEQ ID NO: 78907 - DNA, 20 bp, Homo sapiens
cgcccagtgcggttctgacc

SEQ ID NO: 78908 - DNA, 22 bp, Homo sapiens
actttaattaatgaactgtggc

SEQ ID NO: 78909 - DNA, 22 bp, Homo sapiens
atgaaatatcttgaagaaattc

SEQ ID NO: 78910 - DNA, 22 bp, Homo sapiens
agcattccacactgaagtctgc

SEQ ID NO: 78911 - DNA, 22 bp, Homo sapiens
ccaggaggcggaggttgcagtg

SEQ ID NO: 78912 - DNA, 19 bp, Homo sapiens
tctgaagaattagagagca

SEQ ID NO: 78913 - DNA, 22 bp, Homo sapiens
ttattaggaactcaggattttt

SEQ ID NO: 78914 - DNA, 22 bp, Homo sapiens
tgtggacgtcattaaagcagtg

SEQ ID NO: 78915 - DNA, 22 bp, Homo sapiens
aggacttagaacattatgtact

SEQ ID NO: 78916 - DNA, 22 bp, Homo sapiens
ccaggaggcagaagttgcagtg

SEQ ID NO: 78917 - DNA, 22 bp, Homo sapiens
gaccttgtgatctgcctgcctt

SEQ ID NO: 78918 - DNA, 22 bp, Homo sapiens
acactgatgttggccctggtca

SEQ ID NO: 78919 - DNA, 22 bp, Homo sapiens
ggatgttctggggttctcttgt

SEQ ID NO: 78920 - DNA, 22 bp, Homo sapiens
cttaatctcacctgcaaagtcc

SEQ ID NO: 78921 - DNA, 16 bp, Homo sapiens
atgctgctattagagg

SEQ ID NO: 78922 - DNA, 22 bp, Homo sapiens
tgtaggacatgtacttgtaaca

SEQ ID NO: 78923 - DNA, 22 bp, Homo sapiens
gaatatcccgctatgcaaagta

SEQ ID NO: 78924 - DNA, 22 bp, Homo sapiens
cggtctcccgtgtgtgtgcgct

SEQ ID NO: 78925 - DNA, 22 bp, Homo sapiens
aaaagtaattgcggtttttgct

SEQ ID NO: 78926 - DNA, 22 bp, Homo sapiens
tgggaacagaggacttgactgt

SEQ ID NO: 78927 - DNA, 22 bp, Homo sapiens
agtggtcttagcttgctgggct

SEQ ID NO: 78928 - DNA, 18 bp, Homo sapiens
tgtagagccaggtttgcc

SEQ ID NO: 78929 - DNA, 21 bp, Homo sapiens
gctgctcgagatccagtgctt

SEQ ID NO: 78930 - DNA, 22 bp, Homo sapiens
tcaggaggcggaggttgcagtg

SEQ ID NO: 78931 - DNA, 22 bp, Homo sapiens
atcacccaggctggagtgcagt

SEQ ID NO: 78932 - DNA, 22 bp, Homo sapiens
gttgaaatcctaaccccctagt

SEQ ID NO: 78933 - DNA, 22 bp, Homo sapiens
tttaggttttttcacgtggcta

SEQ ID NO: 78934 - DNA, 22 bp, Homo sapiens
acctggacacctgctgtcatct

SEQ ID NO: 78935 - DNA, 22 bp, Homo sapiens
agccagatgaagaggtccttaa

SEQ ID NO: 78936 - DNA, 22 bp, Homo sapiens
atcctagaatcagcccttgctg

SEQ ID NO: 78937 - DNA, 22 bp, Homo sapiens
gcgttggggaccccgaagctgg

SEQ ID NO: 78938 - DNA, 22 bp, Homo sapiens
gggggctaccgtctctggagct

SEQ ID NO: 78939 - DNA, 22 bp, Homo sapiens
atgttgactcagagtgagggta

SEQ ID NO: 78940 - DNA, 22 bp, Homo sapiens
tcaggaggtccgcccgggaggg

SEQ ID NO: 78941 - DNA, 22 bp, Homo sapiens
ccaggaggcggaaggtacagtg

SEQ ID NO: 78942 - DNA, 22 bp, Homo sapiens
ccagtgtatttttgggacctgc

SEQ ID NO: 78943 - DNA, 22 bp, Homo sapiens
tgatgaccgccaacgtttaggt

SEQ ID NO: 78944 - DNA, 22 bp, Homo sapiens
ttctagtgtccttggacttgct

SEQ ID NO: 78945 - DNA, 22 bp, Homo sapiens
tggaatggaaacaaactgagga

SEQ ID NO: 78946 - DNA, 22 bp, Homo sapiens
cccagttgttgccggctctgga

SEQ ID NO: 78947 - DNA, 22 bp, Homo sapiens
ctgggggcagcaagaagccatg

SEQ ID NO: 78948 - DNA, 22 bp, Homo sapiens
ggaggcagaatagagtgtgggt

SEQ ID NO: 78949 - DNA, 22 bp, Homo sapiens
gtgaccatcatctcagctagtt

SEQ ID NO: 78950 - DNA, 22 bp, Homo sapiens
ctcactgcaagctctgcctccc

SEQ ID NO: 78951 - DNA, 22 bp, Homo sapiens
gcccgcagagatctttaacaaa

SEQ ID NO: 78952 - DNA, 22 bp, Homo sapiens
tctcatggagtcaggagcagaa

SEQ ID NO: 78953 - DNA, 22 bp, Homo sapiens
ctcactgcaagctctgcctcca

SEQ ID NO: 78954 - DNA, 22 bp, Homo sapiens
ggggtgggcgtgcagggacacc

SEQ ID NO: 78955 - DNA, 22 bp, Homo sapiens
ccaggaggcggaggttgcagcg

SEQ ID NO: 78956 - DNA, 20 bp, Homo sapiens
ctttaactggaaggctgctt

SEQ ID NO: 78957 - DNA, 20 bp, Homo sapiens
cattggacttggcttcatgg

SEQ ID NO: 78958 - DNA, 22 bp, Homo sapiens
acaagcatgggctttgacatca

SEQ ID NO: 78959 - DNA, 18 bp, Homo sapiens
ggtgagggagctggaagc

SEQ ID NO: 78960 - DNA, 22 bp, Homo sapiens
tgagatcattgacttgttcctg

SEQ ID NO: 78961 - DNA, 22 bp, Homo sapiens
ggttggacactaggtaggagcg

SEQ ID NO: 78962 - DNA, 22 bp, Homo sapiens
ttgtgttaaggtgcatctagtg

SEQ ID NO: 78963 - DNA, 22 bp, Homo sapiens
tttctggcagcgggacaggggt

SEQ ID NO: 78964 - DNA, 22 bp, Homo sapiens
ctttaattgtagctcccataat

SEQ ID NO: 78965 - DNA, 22 bp, Homo sapiens
ttttttgttgggtagaacggaa

SEQ ID NO: 78966 - DNA, 22 bp, Homo sapiens
ccccatgaagtagggtctctga

SEQ ID NO: 78967 - DNA, 22 bp, Homo sapiens
cccagtttcaactttccagtgg

SEQ ID NO: 78968 - DNA, 22 bp, Homo sapiens
aggctcagatccttgtgtcctg

SEQ ID NO: 78969 - DNA, 22 bp, Homo sapiens
ttagggttacaccagcctcctg

SEQ ID NO: 78970 - DNA, 22 bp, Homo sapiens
gaccttcttgctgtgtcctaac

SEQ ID NO: 78971 - DNA, 22 bp, Homo sapiens
aggggatggagctggaaggcag

SEQ ID NO: 78972 - DNA, 22 bp, Homo sapiens
tggtagtcggcctcggtggctc

SEQ ID NO: 78973 - DNA, 22 bp, Homo sapiens
aggagatggagctcagtgggca

SEQ ID NO: 78974 - DNA, 22 bp, Homo sapiens
tatcactacacctggctaatta

SEQ ID NO: 78975 - DNA, 22 bp, Homo sapiens
ccaccagctgcatatgcacgta

SEQ ID NO: 78976 - DNA, 22 bp, Homo sapiens
aggaggaagggaagacaagtaa

SEQ ID NO: 78977 - DNA, 22 bp, Homo sapiens
tggaatggaaacaaactgagga

SEQ ID NO: 78978 - DNA, 22 bp, Homo sapiens
aagaactgtttacaattttcac

SEQ ID NO: 78979 - DNA, 22 bp, Homo sapiens
attacctatttcattttctgtc

SEQ ID NO: 78980 - DNA, 22 bp, Homo sapiens
ccaggagttggaagctgccatg

SEQ ID NO: 78981 - DNA, 22 bp, Homo sapiens
aaggaggcctggcagatgaaga

SEQ ID NO: 78982 - DNA, 22 bp, Homo sapiens
tcgcttgaacccaggaagtgga

SEQ ID NO: 78983 - DNA, 22 bp, Homo sapiens
ggatgttctggggttctcttgt

SEQ ID NO: 78984 - DNA, 22 bp, Homo sapiens
tcagccccacggggtcagccaa

SEQ ID NO: 78985 - DNA, 22 bp, Homo sapiens
aggaggcagtctgtcccttagc

SEQ ID NO: 78986 - DNA, 22 bp, Homo sapiens
ggctagggatctagaccaggac

SEQ ID NO: 78987 - DNA, 22 bp, Homo sapiens
aagctgttgttcatcctgaatt

SEQ ID NO: 78988 - DNA, 22 bp, Homo sapiens
aagagagtcagtctgagcacca

SEQ ID NO: 78989 - DNA, 22 bp, Homo sapiens
cagccccacacggtctagctct

SEQ ID NO: 78990 - DNA, 22 bp, Homo sapiens
gctgcagtgagccaagatcgtg

SEQ ID NO: 78991 - DNA, 19 bp, Homo sapiens
ccagagagctaggtacaga

SEQ ID NO: 78992 - DNA, 22 bp, Homo sapiens
gactggaaagcctgtcctcaga

SEQ ID NO: 78993 - DNA, 22 bp, Homo sapiens
gcccagagtttgaagatacagt

SEQ ID NO: 78994 - DNA, 22 bp, Homo sapiens
atcagagtagttgttgcccaga

SEQ ID NO: 78995 - DNA, 22 bp, Homo sapiens
gaggcaggcagattgcttgagg

SEQ ID NO: 78996 - DNA, 22 bp, Homo sapiens
acattacctggcatttgatctt

SEQ ID NO: 78997 - DNA, 22 bp, Homo sapiens
gcaggcagaggtggaggagaca

SEQ ID NO: 78998 - DNA, 22 bp, Homo sapiens
gagagcaggaggcagcgggacg

SEQ ID NO: 78999 - DNA, 22 bp, Homo sapiens
ggaggcagaatagagtgtgggt

SEQ ID NO: 79000 - DNA, 20 bp, Homo sapiens
ccagagctgatggctgcccg

SEQ ID NO: 79001 - DNA, 22 bp, Homo sapiens
tcttcctgtcaatgagaattaa

SEQ ID NO: 79002 - DNA, 22 bp, Homo sapiens
gaaaggagagggttaaggagct

SEQ ID NO: 79003 - DNA, 22 bp, Homo sapiens
caggcaggtcagtgaagaagga

SEQ ID NO: 79004 - DNA, 22 bp, Homo sapiens
gaggcaggaggattgcttgagc

SEQ ID NO: 79005 - DNA, 22 bp, Homo sapiens
gaggcagaggttgcagtgagct

SEQ ID NO: 79006 - DNA, 22 bp, Homo sapiens
atttgtgggactataatgcagg

SEQ ID NO: 79007 - DNA, 22 bp, Homo sapiens
agttggagtgaacatgagattg

SEQ ID NO: 79008 - DNA, 22 bp, Homo sapiens
gccagagttgaggcagtttatt

SEQ ID NO: 79009 - DNA, 22 bp, Homo sapiens
aacactgctgctgggttctgtg

SEQ ID NO: 79010 - DNA, 22 bp, Homo sapiens
atgaggcaggtggaggctgcca

SEQ ID NO: 79011 - DNA, 22 bp, Homo sapiens
cagccccatggtgtgctccagc

SEQ ID NO: 79012 - DNA, 22 bp, Homo sapiens
aggccagcctgcccaaagctgc

SEQ ID NO: 79013 - DNA, 22 bp, Homo sapiens
gcagaggacacaggagggcaag

SEQ ID NO: 79014 - DNA, 23 bp, Homo sapiens
gacagagtgagaccttgtcttac

SEQ ID NO: 79015 - DNA, 22 bp, Homo sapiens
atgaaaacggaccagagctatt

SEQ ID NO: 79016 - DNA, 23 bp, Homo sapiens
aggatgtaggatgtatggcagag

SEQ ID NO: 79017 - DNA, 22 bp, Homo sapiens
cccaggaggtcgaagctgcagt

SEQ ID NO: 79018 - DNA, 22 bp, Homo sapiens
atgaggcaggagtgcagtggca

SEQ ID NO: 79019 - DNA, 22 bp, Homo sapiens
gctgaggctcctcgggaggaca

SEQ ID NO: 79020 - DNA, 21 bp, Homo sapiens
caaaagagactgattcttgga

SEQ ID NO: 79021 - DNA, 22 bp, Homo sapiens
gtgaggtggtacaatattaact

SEQ ID NO: 79022 - DNA, 22 bp, Homo sapiens
ccagcagagcatggggaggaag

SEQ ID NO: 79023 - DNA, 22 bp, Homo sapiens
tgaggcaggagaatcacatgaa

SEQ ID NO: 79024 - DNA, 23 bp, Homo sapiens
gttttacaggtgagaaaatggag

SEQ ID NO: 79025 - DNA, 22 bp, Homo sapiens
cttggaggtggaagttgcagtg

SEQ ID NO: 79026 - DNA, 22 bp, Homo sapiens
ttcttctccgaggagggctggt

SEQ ID NO: 79027 - DNA, 22 bp, Homo sapiens
cccaccagtacagatggtagat

SEQ ID NO: 79028 - DNA, 22 bp, Homo sapiens
cccagcaggtcggtgctgcctg

SEQ ID NO: 79029 - DNA, 22 bp, Homo sapiens
tccagcccaggctggagtgtag

SEQ ID NO: 79030 - DNA, 22 bp, Homo sapiens
agatgtgtttctagttcctgca

SEQ ID NO: 79031 - DNA, 22 bp, Homo sapiens
tgaggcaggagttcaggctgcg

SEQ ID NO: 79032 - DNA, 22 bp, Homo sapiens
aatgtgaggccttggtagttat

SEQ ID NO: 79033 - DNA, 17 bp, Homo sapiens
catccgtgagctcggca

SEQ ID NO: 79034 - DNA, 22 bp, Homo sapiens
gagccccaccctagacattctg

SEQ ID NO: 79035 - DNA, 22 bp, Homo sapiens
ctggtagctcctgaatatccct

SEQ ID NO: 79036 - DNA, 22 bp, Homo sapiens
gccccagcctcccgagtagctg

SEQ ID NO: 79037 - DNA, 23 bp, Homo sapiens
tgaggcaggcggatcacgaggtc

SEQ ID NO: 79038 - DNA, 18 bp, Homo sapiens
agagtatacagacaacaa

SEQ ID NO: 79039 - DNA, 22 bp, Homo sapiens
ggaggagacagtaaaaagcacg

SEQ ID NO: 79040 - DNA, 22 bp, Homo sapiens
gttcagtcacgtgcccaagttc

SEQ ID NO: 79041 - DNA, 22 bp, Homo sapiens
agagaagagtcttgtcaaatta

SEQ ID NO: 79042 - DNA, 22 bp, Homo sapiens
ctgggcagctgtatcagggagt

SEQ ID NO: 79043 - DNA, 22 bp, Homo sapiens
gatggaggagatggcagggtgc

SEQ ID NO: 79044 - DNA, 22 bp, Homo sapiens
cccaagaggtggaggttgcagt

SEQ ID NO: 79045 - DNA, 22 bp, Homo sapiens
agaggaggctctgggatcgtcc

SEQ ID NO: 79046 - DNA, 22 bp, Homo sapiens
acccagccatgttcagttctct

SEQ ID NO: 79047 - DNA, 22 bp, Homo sapiens
cgaggaggaaacgcggagaact

SEQ ID NO: 79048 - DNA, 22 bp, Homo sapiens
acttcttcttcagctgggggat

SEQ ID NO: 79049 - DNA, 22 bp, Homo sapiens
tgagcaggcgcagcaggaggtc

SEQ ID NO: 79050 - DNA, 22 bp, Homo sapiens
gctccccaaaagctccaggaaa

SEQ ID NO: 79051 - DNA, 22 bp, Homo sapiens
gcccagagttcaaggctgcagt

SEQ ID NO: 79052 - DNA, 19 bp, Homo sapiens
acccagcccaggagtggca

SEQ ID NO: 79053 - DNA, 22 bp, Homo sapiens
aggtggaaatggctttcctagg

SEQ ID NO: 79054 - DNA, 22 bp, Homo sapiens
tagatgtgttgcctggagttgt

SEQ ID NO: 79055 - DNA, 21 bp, Homo sapiens
gaccccagaccagcagacaca

SEQ ID NO: 79056 - DNA, 22 bp, Homo sapiens
ttccagagagttattcccctgg

SEQ ID NO: 79057 - DNA, 22 bp, Homo sapiens
tgaggcaggaggattgcaggat

SEQ ID NO: 79058 - DNA, 22 bp, Homo sapiens
gggaagatagtgttgagggccc

SEQ ID NO: 79059 - DNA, 22 bp, Homo sapiens
tgaggcaggagaatcaccggaa

SEQ ID NO: 79060 - DNA, 22 bp, Homo sapiens
cccccggttcctgtttgcagag

SEQ ID NO: 79061 - DNA, 22 bp, Homo sapiens
ggtttattgttaataagtttga

SEQ ID NO: 79062 - DNA, 22 bp, Homo sapiens
gagcaacacgcagtagtatacg

SEQ ID NO: 79063 - DNA, 22 bp, Homo sapiens
aggccagcctcaggcagggacc

SEQ ID NO: 79064 - DNA, 22 bp, Homo sapiens
tcaaagatcagatggttgtagg

SEQ ID NO: 79065 - DNA, 22 bp, Homo sapiens
tccccagcttgctacttctgct

SEQ ID NO: 79066 - DNA, 22 bp, Homo sapiens
gaggaggcagcctatcccttag

SEQ ID NO: 79067 - DNA, 22 bp, Homo sapiens
tgagatgaataactcctgctaa

SEQ ID NO: 79068 - DNA, 22 bp, Homo sapiens
caggcagggagctggaaaggat

SEQ ID NO: 79069 - DNA, 22 bp, Homo sapiens
tgagatgtaaggtatgcttact

SEQ ID NO: 79070 - DNA, 22 bp, Homo sapiens
aagaactgagtacgttaataaa

SEQ ID NO: 79071 - DNA, 22 bp, Homo sapiens
tgcgaccctagccccctcactt

SEQ ID NO: 79072 - DNA, 22 bp, Homo sapiens
aagtgatgctacgactttgaca

SEQ ID NO: 79073 - DNA, 22 bp, Homo sapiens
tttaaaaaactagtctgagtct

SEQ ID NO: 79074 - DNA, 22 bp, Homo sapiens
tgaggcaggtggattacaaggt

SEQ ID NO: 79075 - DNA, 22 bp, Homo sapiens
gaggcagaagttgcagtgagca

SEQ ID NO: 79076 - DNA, 22 bp, Homo sapiens
caagcttgtttctcctgggggt

SEQ ID NO: 79077 - DNA, 22 bp, Homo sapiens
agggaacatttgcactgttggt

SEQ ID NO: 79078 - DNA, 22 bp, Homo sapiens
catcatcaaaagtgacagagaa

SEQ ID NO: 79079 - DNA, 22 bp, Homo sapiens
ttatatgtttctgtttggaggc

SEQ ID NO: 79080 - DNA, 21 bp, Homo sapiens
ggagtttttctggaagggact

SEQ ID NO: 79081 - DNA, 22 bp, Homo sapiens
agagtactgcctcagttatgaa

SEQ ID NO: 79082 - DNA, 22 bp, Homo sapiens
agtcccaacagcttacaaggaa

SEQ ID NO: 79083 - DNA, 22 bp, Homo sapiens
tcccccaggctggagtgcagtg

SEQ ID NO: 79084 - DNA, 22 bp, Homo sapiens
gcagcgaggtgatgaaatagct

SEQ ID NO: 79085 - DNA, 22 bp, Homo sapiens
agaagccaccagctgaggaaga

SEQ ID NO: 79086 - DNA, 22 bp, Homo sapiens
ccagaagcagagcctgaggcag

SEQ ID NO: 79087 - DNA, 22 bp, Homo sapiens
aatgtgagccaatgcccgtggg

SEQ ID NO: 79088 - DNA, 22 bp, Homo sapiens
tagtatagattgaagcagatca

SEQ ID NO: 79089 - DNA, 20 bp, Homo sapiens
caaatccctgctctgtgctg

SEQ ID NO: 79090 - DNA, 22 bp, Homo sapiens
tgggcagggagctggaaccaca

SEQ ID NO: 79091 - DNA, 22 bp, Homo sapiens
gcgagaaactaagtgccctttg

SEQ ID NO: 79092 - DNA, 22 bp, Homo sapiens
atatgcagtctcttgcccttct

SEQ ID NO: 79093 - DNA, 22 bp, Homo sapiens
gcagggaggtttgctgacctgg

SEQ ID NO: 79094 - DNA, 23 bp, Homo sapiens
ggagtgcaatggcgccatctcgg

SEQ ID NO: 79095 - DNA, 22 bp, Homo sapiens
aggagctgtcagagtgccagag

SEQ ID NO: 79096 - DNA, 22 bp, Homo sapiens
gaggaggcttccgggaggcacg

SEQ ID NO: 79097 - DNA, 22 bp, Homo sapiens
gacctcgtgatccgccctcctt

SEQ ID NO: 79098 - DNA, 22 bp, Homo sapiens
agtcaaagatgaccgagttcct

SEQ ID NO: 79099 - DNA, 22 bp, Homo sapiens
gcggcaggagtaaaggaggaag

SEQ ID NO: 79100 - DNA, 22 bp, Homo sapiens
agaaaacataggagacaggaaa

SEQ ID NO: 79101 - DNA, 22 bp, Homo sapiens
tgaggcaggacttgcataaagt

SEQ ID NO: 79102 - DNA, 22 bp, Homo sapiens
ctgctttaaaactgatacatga

SEQ ID NO: 79103 - DNA, 22 bp, Homo sapiens
gaagatgttatggagagctcag

SEQ ID NO: 79104 - DNA, 22 bp, Homo sapiens
gaaagacatagttgcaagatgg

SEQ ID NO: 79105 - DNA, 22 bp, Homo sapiens
ggagaagaggagctggaagcct

SEQ ID NO: 79106 - DNA, 22 bp, Homo sapiens
cccaccagacctgcaccggcac

SEQ ID NO: 79107 - DNA, 22 bp, Homo sapiens
aggtacatggggtgtgtgcacg

SEQ ID NO: 79108 - DNA, 22 bp, Homo sapiens
catcagaacgtgagctccttgt

SEQ ID NO: 79109 - DNA, 22 bp, Homo sapiens
ggcagacctctccagccccaca

SEQ ID NO: 79110 - DNA, 22 bp, Homo sapiens
tttgaggttagctagcagatca

SEQ ID NO: 79111 - DNA, 22 bp, Homo sapiens
gttctgagtcctcctttgaagg

SEQ ID NO: 79112 - DNA, 22 bp, Homo sapiens
tacaacaatttccacattagaa

SEQ ID NO: 79113 - DNA, 22 bp, Homo sapiens
aaggaaagctgtggttctgaga

SEQ ID NO: 79114 - DNA, 22 bp, Homo sapiens
agggaagaggaccagagtctct

SEQ ID NO: 79115 - DNA, 22 bp, Homo sapiens
aagaggagaaaggctggctttg

SEQ ID NO: 79116 - DNA, 22 bp, Homo sapiens
gatgaggcataaacacagtcac

SEQ ID NO: 79117 - DNA, 22 bp, Homo sapiens
ggcagggagtggagactcccta

SEQ ID NO: 79118 - DNA, 22 bp, Homo sapiens
cccccagctctgctgggtcccg

SEQ ID NO: 79119 - DNA, 22 bp, Homo sapiens
tgagtgtggggaatgtcatgag

SEQ ID NO: 79120 - DNA, 22 bp, Homo sapiens
tgaggcaggaggttgagaactg

SEQ ID NO: 79121 - DNA, 22 bp, Homo sapiens
tcctccccaaagcccagcctgg

SEQ ID NO: 79122 - DNA, 22 bp, Homo sapiens
tcttttgtgattctttagttac

SEQ ID NO: 79123 - DNA, 22 bp, Homo sapiens
atggagttctgccagcgctgct

SEQ ID NO: 79124 - DNA, 22 bp, Homo sapiens
gggcagagactcagaaacagaa

SEQ ID NO: 79125 - DNA, 22 bp, Homo sapiens
atgaattgaggaaaacagtcgt

SEQ ID NO: 79126 - DNA, 22 bp, Homo sapiens
atatgtggcattatttctgagg

SEQ ID NO: 79127 - DNA, 22 bp, Homo sapiens
actgcaacacctcctgggttca

SEQ ID NO: 79128 - DNA, 22 bp, Homo sapiens
ggccgccctttccacggtttct

SEQ ID NO: 79129 - DNA, 23 bp, Homo sapiens
cagtacaatgtggaaaaggagtg

SEQ ID NO: 79130 - DNA, 19 bp, Homo sapiens
ctgtccttggctgcactgt

SEQ ID NO: 79131 - DNA, 22 bp, Homo sapiens
atgaaatatcttgaagaaattc

SEQ ID NO: 79132 - DNA, 22 bp, Homo sapiens
ttagcttttgagaatgatttct

SEQ ID NO: 79133 - DNA, 20 bp, Homo sapiens
ataaaataactgccacaaga

SEQ ID NO: 79134 - DNA, 22 bp, Homo sapiens
tgctagtgtgtgagatgttcaa

SEQ ID NO: 79135 - DNA, 22 bp, Homo sapiens
tgaatttcacaaggtgaggata

SEQ ID NO: 79136 - DNA, 22 bp, Homo sapiens
tggattcacaccattctcctgc

SEQ ID NO: 79137 - DNA, 22 bp, Homo sapiens
tttaagaagttatgttataaat

SEQ ID NO: 79138 - DNA, 22 bp, Homo sapiens
cttatttgcccatgtttcttta

SEQ ID NO: 79139 - DNA, 22 bp, Homo sapiens
cccagttgttgccggctctgga

SEQ ID NO: 79140 - DNA, 22 bp, Homo sapiens
cgccgcctgctgcagcagctgt

SEQ ID NO: 79141 - DNA, 22 bp, Homo sapiens
tggctagcactctacctttctc

SEQ ID NO: 79142 - DNA, 22 bp, Homo sapiens
ttcagcttgctgactgcggcag

SEQ ID NO: 79143 - DNA, 22 bp, Homo sapiens
ttgagaaccactgagttagata

SEQ ID NO: 79144 - DNA, 22 bp, Homo sapiens
accactgcccatggtgaaaact

SEQ ID NO: 79145 - DNA, 22 bp, Homo sapiens
ccattgtaaattctgtggaagt

SEQ ID NO: 79146 - DNA, 23 bp, Homo sapiens
ccactagcacctgttcaacttct

SEQ ID NO: 79147 - DNA, 22 bp, Homo sapiens
aggtggaaatggctttcctagg

SEQ ID NO: 79148 - DNA, 22 bp, Homo sapiens
tgcctcaagccctccactgcac

SEQ ID NO: 79149 - DNA, 22 bp, Homo sapiens
ccgcaaggcagaggttgcagtg

SEQ ID NO: 79150 - DNA, 22 bp, Homo sapiens
atatatttgagaatattcatga

SEQ ID NO: 79151 - DNA, 22 bp, Homo sapiens
caccaggaggacaggcccctac

SEQ ID NO: 79152 - DNA, 22 bp, Homo sapiens
ttccatttggagctcgcagcct

SEQ ID NO: 79153 - DNA, 22 bp, Homo sapiens
ttttcatttttgtagatgcaag

SEQ ID NO: 79154 - DNA, 22 bp, Homo sapiens
atgttctacagatggaaagggg

SEQ ID NO: 79155 - DNA, 22 bp, Homo sapiens
actgtgaacggactgaagccca

SEQ ID NO: 79156 - DNA, 22 bp, Homo sapiens
agtggctgagtgactgtgactc

SEQ ID NO: 79157 - DNA, 22 bp, Homo sapiens
tcgcccaggctggaagtgcagt

SEQ ID NO: 79158 - DNA, 22 bp, Homo sapiens
gtaatagtctcaaactcctgga

SEQ ID NO: 79159 - DNA, 23 bp, Homo sapiens
caccactttctccttctccttgg

SEQ ID NO: 79160 - DNA, 22 bp, Homo sapiens
tacgcctgtaatcccagcactt

SEQ ID NO: 79161 - DNA, 19 bp, Homo sapiens
gttggcactgaaaatggct

SEQ ID NO: 79162 - DNA, 22 bp, Homo sapiens
aatgtcaaaggctatacattca

SEQ ID NO: 79163 - DNA, 22 bp, Homo sapiens
tgacctattagatttccttgcc

SEQ ID NO: 79164 - DNA, 22 bp, Homo sapiens
cacttgttggtggtgaaatcac

SEQ ID NO: 79165 - DNA, 22 bp, Homo sapiens
taacaatacccattctaattac

SEQ ID NO: 79166 - DNA, 22 bp, Homo sapiens
agtcttagaactacagtgccta

SEQ ID NO: 79167 - DNA, 22 bp, Homo sapiens
ccttttgctctcccatccagaa

SEQ ID NO: 79168 - DNA, 22 bp, Homo sapiens
atgggttcaagtgattctcctg

SEQ ID NO: 79169 - DNA, 22 bp, Homo sapiens
tatgccactgctctccatccta

SEQ ID NO: 79170 - DNA, 22 bp, Homo sapiens
atgccactgcactccagcctgg

SEQ ID NO: 79171 - DNA, 22 bp, Homo sapiens
tatttcttttcgtgacttattg

SEQ ID NO: 79172 - DNA, 22 bp, Homo sapiens
taagaaatttagttatagaatg

SEQ ID NO: 79173 - DNA, 22 bp, Homo sapiens
atgccactgcgctccagcctgg

SEQ ID NO: 79174 - DNA, 20 bp, Homo sapiens
caaatccctgctctgtgctg

SEQ ID NO: 79175 - DNA, 22 bp, Homo sapiens
agtgactggtgtgaagttaaat

SEQ ID NO: 79176 - DNA, 22 bp, Homo sapiens
aataaaatggtcagttttctca

SEQ ID NO: 79177 - DNA, 22 bp, Homo sapiens
attttctctttgtatatgctag

SEQ ID NO: 79178 - DNA, 22 bp, Homo sapiens
cactgcaacctccacctcctgg

SEQ ID NO: 79179 - DNA, 22 bp, Homo sapiens
tttgcattgcattaagtattct

SEQ ID NO: 79180 - DNA, 22 bp, Homo sapiens
ctggcctaaaaatacagaacaa

SEQ ID NO: 79181 - DNA, 22 bp, Homo sapiens
ggcgtgggcgaggtgctctatc

SEQ ID NO: 79182 - DNA, 22 bp, Homo sapiens
gaagccttgaactgcaaacccc

SEQ ID NO: 79183 - DNA, 22 bp, Homo sapiens
ttgtatagcccagagagtgaga

SEQ ID NO: 79184 - DNA, 22 bp, Homo sapiens
actttaaaactgatcatcagag

SEQ ID NO: 79185 - DNA, 22 bp, Homo sapiens
gagtgggaatgttctaagaatt

SEQ ID NO: 79186 - DNA, 22 bp, Homo sapiens
gcctccggagtcacagtgtctt

SEQ ID NO: 79187 - DNA, 22 bp, Homo sapiens
acacggcactttaggaaggggc

SEQ ID NO: 79188 - DNA, 22 bp, Homo sapiens
cgctccttgagcgtgtcggcct

SEQ ID NO: 79189 - DNA, 22 bp, Homo sapiens
ggtcaatgccaagtgtggctta

SEQ ID NO: 79190 - DNA, 22 bp, Homo sapiens
tttcactcagctctcattgtct

SEQ ID NO: 79191 - DNA, 22 bp, Homo sapiens
ccggctcggcgaccaggctgaa

SEQ ID NO: 79192 - DNA, 22 bp, Homo sapiens
gcctccggagttgcagtgtctt

SEQ ID NO: 79193 - DNA, 22 bp, Homo sapiens
aagatacagacagagccaaaat

SEQ ID NO: 79194 - DNA, 22 bp, Homo sapiens
acttttaaatgagtttcagttg

SEQ ID NO: 79195 - DNA, 16 bp, Homo sapiens
aggctcagaggctgga

SEQ ID NO: 79196 - DNA, 22 bp, Homo sapiens
accatgtcatttattggccaaa

SEQ ID NO: 79197 - DNA, 22 bp, Homo sapiens
agaacctcaattatttttgcac

SEQ ID NO: 79198 - DNA, 22 bp, Homo sapiens
atgccactgcactccagcctag

SEQ ID NO: 79199 - DNA, 22 bp, Homo sapiens
atgctaaggcccaggagaaaat

SEQ ID NO: 79200 - DNA, 22 bp, Homo sapiens
attaggtcatggggaggcccta

SEQ ID NO: 79201 - DNA, 22 bp, Homo sapiens
gttggagtgcagcttgtgcgat

SEQ ID NO: 79202 - DNA, 17 bp, Homo sapiens
tgcatgtcctttgttcc

SEQ ID NO: 79203 - DNA, 23 bp, Homo sapiens
ctatttctcatagttcaggtctt

SEQ ID NO: 79204 - DNA, 22 bp, Homo sapiens
acgcccggtctccatagttttt

SEQ ID NO: 79205 - DNA, 22 bp, Homo sapiens
tgatcaaaacattactccacca

SEQ ID NO: 79206 - DNA, 22 bp, Homo sapiens
actgcaacctccacctcctggg

SEQ ID NO: 79207 - DNA, 22 bp, Homo sapiens
gcccccgtagtagatgaggcgc

SEQ ID NO: 79208 - DNA, 22 bp, Homo sapiens
gcatatgatcacgtgtgtcggt

SEQ ID NO: 79209 - DNA, 22 bp, Homo sapiens
ccaggctagagtgcaatggcat

SEQ ID NO: 79210 - DNA, 22 bp, Homo sapiens
gacctcatgatccacctgcctt

SEQ ID NO: 79211 - DNA, 22 bp, Homo sapiens
agttcaacaccagcctgaccaa

SEQ ID NO: 79212 - DNA, 22 bp, Homo sapiens
aattttctggtgtgtaatgaag

SEQ ID NO: 79213 - DNA, 22 bp, Homo sapiens
aatactgcctgtgaggtaactc

SEQ ID NO: 79214 - DNA, 22 bp, Homo sapiens
aggctgagataggtggatcatt

SEQ ID NO: 79215 - DNA, 22 bp, Homo sapiens
agaaatatgctgattagatgaa

SEQ ID NO: 79216 - DNA, 22 bp, Homo sapiens
cctcgacctccccaggctcagg

SEQ ID NO: 79217 - DNA, 22 bp, Homo sapiens
ctagttctagatccctgaggaa

SEQ ID NO: 79218 - DNA, 22 bp, Homo sapiens
taatgtataacaaatactcatc

SEQ ID NO: 79219 - DNA, 22 bp, Homo sapiens
gccaggcgggtctcaaactcct

SEQ ID NO: 79220 - DNA, 22 bp, Homo sapiens
atgccacttcattccagcctcg

SEQ ID NO: 79221 - DNA, 22 bp, Homo sapiens
cgggttcacgccattctcctgc

SEQ ID NO: 79222 - DNA, 22 bp, Homo sapiens
acccggagtcggaggttgcagt

SEQ ID NO: 79223 - DNA, 22 bp, Homo sapiens
cctttaggagtgaggaccgagc

SEQ ID NO: 79224 - DNA, 22 bp, Homo sapiens
gagcaggtgcctgtagctctct

SEQ ID NO: 79225 - DNA, 22 bp, Homo sapiens
ttgtgctctgtgttatttaagg

SEQ ID NO: 79226 - DNA, 22 bp, Homo sapiens
ccacccttgggttcggaggccg

SEQ ID NO: 79227 - DNA, 22 bp, Homo sapiens
ttgacccgagtccttcttgggg

SEQ ID NO: 79228 - DNA, 22 bp, Homo sapiens
tcttttgtgattctttagttac

SEQ ID NO: 79229 - DNA, 22 bp, Homo sapiens
cctggcactgctgaagtcctgg

SEQ ID NO: 79230 - DNA, 22 bp, Homo sapiens
atttagaactttgtttgccaat

SEQ ID NO: 79231 - DNA, 22 bp, Homo sapiens
tgactacaacctccacctcccg

SEQ ID NO: 79232 - DNA, 22 bp, Homo sapiens
attgtaaatagtgccacaataa

SEQ ID NO: 79233 - DNA, 22 bp, Homo sapiens
gccagtggtcactgaggaagaa

SEQ ID NO: 79234 - DNA, 22 bp, Homo sapiens
caaagctggaaaaggaggctgg

SEQ ID NO: 79235 - DNA, 22 bp, Homo sapiens
ccaggaggcggaggttgcagtg

SEQ ID NO: 79236 - DNA, 22 bp, Homo sapiens
agtgaggggcagctgagtgggc

SEQ ID NO: 79237 - DNA, 22 bp, Homo sapiens
tccaggtgggctgcacccaggc

SEQ ID NO: 79238 - DNA, 22 bp, Homo sapiens
caggaggttgagggtgcagtga

SEQ ID NO: 79239 - DNA, 22 bp, Homo sapiens
gaggcaggaggattgcttgagc

SEQ ID NO: 79240 - DNA, 22 bp, Homo sapiens
tctgtggcccaagtgatggctg

SEQ ID NO: 79241 - DNA, 22 bp, Homo sapiens
aggtgactggtttatctggcag

SEQ ID NO: 79242 - DNA, 22 bp, Homo sapiens
catccctgtcgtcaagtctctg

SEQ ID NO: 79243 - DNA, 22 bp, Homo sapiens
gcctcctgtcccaggctgagga

SEQ ID NO: 79244 - DNA, 22 bp, Homo sapiens
ttctggtgggactcaggctttc

SEQ ID NO: 79245 - DNA, 22 bp, Homo sapiens
actgcactccagcctcggggtc

SEQ ID NO: 79246 - DNA, 22 bp, Homo sapiens
gagaacagaagcattcctaatt

SEQ ID NO: 79247 - DNA, 22 bp, Homo sapiens
aaggctgagacagcacaggtcc

SEQ ID NO: 79248 - DNA, 22 bp, Homo sapiens
cggctggtgtcgggcacagcaa

SEQ ID NO: 79249 - DNA, 22 bp, Homo sapiens
ttccatcattaacaccacaagg

SEQ ID NO: 79250 - DNA, 22 bp, Homo sapiens
cgtcatcacggcaagcatctcc

SEQ ID NO: 79251 - DNA, 22 bp, Homo sapiens
gccggggctggggagagacatg

SEQ ID NO: 79252 - DNA, 22 bp, Homo sapiens
actgcatttggtaaagtcaaga

SEQ ID NO: 79253 - DNA, 22 bp, Homo sapiens
tacaggcatgtagcatggtgat

SEQ ID NO: 79254 - DNA, 22 bp, Homo sapiens
gcaggcagaggtggaggagaca

SEQ ID NO: 79255 - DNA, 23 bp, Homo sapiens
tatgaactgcattgctggtgtgt

SEQ ID NO: 79256 - DNA, 22 bp, Homo sapiens
ggcgggaagttcttgcccactt

SEQ ID NO: 79257 - DNA, 22 bp, Homo sapiens
ccggcgaccgctgtcggaggcg

SEQ ID NO: 79258 - DNA, 22 bp, Homo sapiens
cccagcgagtttgccggtgaac

SEQ ID NO: 79259 - DNA, 22 bp, Homo sapiens
gcaaagaatgcagatttgcctc

SEQ ID NO: 79260 - DNA, 22 bp, Homo sapiens
gtccccgacgtttggcttgatg

SEQ ID NO: 79261 - DNA, 22 bp, Homo sapiens
ttccacattccttacattcata

SEQ ID NO: 79262 - DNA, 20 bp, Homo sapiens
ctgggtggcaagcaaggggg

SEQ ID NO: 79263 - DNA, 22 bp, Homo sapiens
gctcgcttagattttcctctga

SEQ ID NO: 79264 - DNA, 22 bp, Homo sapiens
gcagtatctatgtgatgggttg

SEQ ID NO: 79265 - DNA, 22 bp, Homo sapiens
gaaagacatagttgcaagatgg

SEQ ID NO: 79266 - DNA, 22 bp, Homo sapiens
tgaatatgtgactttgatttca

SEQ ID NO: 79267 - DNA, 22 bp, Homo sapiens
catgctgtgtgttttagctcca

SEQ ID NO: 79268 - DNA, 22 bp, Homo sapiens
tggctgtgtccctgtccagagt

SEQ ID NO: 79269 - DNA, 22 bp, Homo sapiens
gccgccgctgtgcaatttagca

SEQ ID NO: 79270 - DNA, 22 bp, Homo sapiens
agcccttggtattttccgatcc

SEQ ID NO: 79271 - DNA, 22 bp, Homo sapiens
tgttcttgagcctttagaccta

SEQ ID NO: 79272 - DNA, 22 bp, Homo sapiens
acctggacacctgctgtcatct

SEQ ID NO: 79273 - DNA, 18 bp, Homo sapiens
tccagttttcccagcatc

SEQ ID NO: 79274 - DNA, 22 bp, Homo sapiens
cttgtagaattgaaatggtctc

SEQ ID NO: 79275 - DNA, 22 bp, Homo sapiens
gggaacagcttgggctctgcca

SEQ ID NO: 79276 - DNA, 22 bp, Homo sapiens
gatgtgtttccaggatttgttt

SEQ ID NO: 79277 - DNA, 22 bp, Homo sapiens
atgaggcaggagtgcagtggca

SEQ ID NO: 79278 - DNA, 22 bp, Homo sapiens
tttacacagaggacactgggct

SEQ ID NO: 79279 - DNA, 22 bp, Homo sapiens
ctgggaagaagggacaacagcg

SEQ ID NO: 79280 - DNA, 21 bp, Homo sapiens
tctcttcctccgcgccgccgc

SEQ ID NO: 79281 - DNA, 18 bp, Homo sapiens
gaaagatgaacttttttc

SEQ ID NO: 79282 - DNA, 22 bp, Homo sapiens
gtctctatcatagctgaaccct

SEQ ID NO: 79283 - DNA, 22 bp, Homo sapiens
agtccccctctgagcccaggga

SEQ ID NO: 79284 - DNA, 22 bp, Homo sapiens
gaaggaccctctggggtctcag

SEQ ID NO: 79285 - DNA, 22 bp, Homo sapiens
agccagggacgctgcaggctac

SEQ ID NO: 79286 - DNA, 22 bp, Homo sapiens
aagattttcagtgcctaaaaca

SEQ ID NO: 79287 - DNA, 22 bp, Homo sapiens
cctgcctatgagacgttttgcc

SEQ ID NO: 79288 - DNA, 19 bp, Homo sapiens
aggaatggaattaattctg

SEQ ID NO: 79289 - DNA, 22 bp, Homo sapiens
tgccgtggggctgaggctggag

SEQ ID NO: 79290 - DNA, 22 bp, Homo sapiens
acgtggcggccgccgtgagcgg

SEQ ID NO: 79291 - DNA, 22 bp, Homo sapiens
tagtggatgggtaaagtatttt

SEQ ID NO: 79292 - DNA, 22 bp, Homo sapiens
tgcgcggctcagtcatctccag

SEQ ID NO: 79293 - DNA, 22 bp, Homo sapiens
aggctagaggcttctggcttca

SEQ ID NO: 79294 - DNA, 22 bp, Homo sapiens
ggctgtggagctgcagagttgg

SEQ ID NO: 79295 - DNA, 22 bp, Homo sapiens
tgggccactgctgcggaaggcg

SEQ ID NO: 79296 - DNA, 22 bp, Homo sapiens
ggtcccaggttgacagggagac

SEQ ID NO: 79297 - DNA, 22 bp, Homo sapiens
ttgcttcagagggagacacttt

SEQ ID NO: 79298 - DNA, 22 bp, Homo sapiens
ccattgtaaattctgtggaagt

SEQ ID NO: 79299 - DNA, 22 bp, Homo sapiens
gcatatgatcacgtgtgtcggt

SEQ ID NO: 79300 - DNA, 22 bp, Homo sapiens
gaggctgaggttgcagtgagct

SEQ ID NO: 79301 - DNA, 22 bp, Homo sapiens
ggcgcagttgagcgtgctgttc

SEQ ID NO: 79302 - DNA, 22 bp, Homo sapiens
ggaggtcccaggcctggcagca

SEQ ID NO: 79303 - DNA, 21 bp, Homo sapiens
tcttttctcagctttgtggtt

SEQ ID NO: 79304 - DNA, 22 bp, Homo sapiens
tcttgccacttcatcccctttc

SEQ ID NO: 79305 - DNA, 22 bp, Homo sapiens
ctggagtagccggacgggtctg

SEQ ID NO: 79306 - DNA, 22 bp, Homo sapiens
ctctgctgtgccgccagggcct

SEQ ID NO: 79307 - DNA, 22 bp, Homo sapiens
gctgcagggagctggaaggctc

SEQ ID NO: 79308 - DNA, 19 bp, Homo sapiens
gcctcatttccacctcccc

SEQ ID NO: 79309 - DNA, 22 bp, Homo sapiens
ctcattgcccagatccccacag

SEQ ID NO: 79310 - DNA, 22 bp, Homo sapiens
cttcagctgcagttatgtttag

SEQ ID NO: 79311 - DNA, 22 bp, Homo sapiens
agtggaccagaagactgaagct

SEQ ID NO: 79312 - DNA, 22 bp, Homo sapiens
tttaatgtagcgtgaaatgatt

SEQ ID NO: 79313 - DNA, 22 bp, Homo sapiens
gtggggtagatctttctcagga

SEQ ID NO: 79314 - DNA, 22 bp, Homo sapiens
gtgtggctgaaatcaaggcagg

SEQ ID NO: 79315 - DNA, 22 bp, Homo sapiens
cccagctcttcaagtcaccccc

SEQ ID NO: 79316 - DNA, 19 bp, Homo sapiens
tcctggggaggggcatggc

SEQ ID NO: 79317 - DNA, 22 bp, Homo sapiens
tgcacgtgtgagcattcacatg

SEQ ID NO: 79318 - DNA, 22 bp, Homo sapiens
agacaaagaaaccgtagaagca

SEQ ID NO: 79319 - DNA, 22 bp, Homo sapiens
tcacatctaattccatttctgc

SEQ ID NO: 79320 - DNA, 22 bp, Homo sapiens
aattacagtcggagcagcactg

SEQ ID NO: 79321 - DNA, 22 bp, Homo sapiens
ccagatgtccctctcaggtttg

SEQ ID NO: 79322 - DNA, 22 bp, Homo sapiens
atcaaatacaaagggcataagg

SEQ ID NO: 79323 - DNA, 22 bp, Homo sapiens
tctccgatcacaggttttcaat

SEQ ID NO: 79324 - DNA, 22 bp, Homo sapiens
gctccccaaaagctccaggaaa

SEQ ID NO: 79325 - DNA, 22 bp, Homo sapiens
gggtattaaaatgaaggagaaa

SEQ ID NO: 79326 - DNA, 22 bp, Homo sapiens
gttggccaggctggtctcaatc

SEQ ID NO: 79327 - DNA, 22 bp, Homo sapiens
tgtccttcttgtcttgcccaaa

SEQ ID NO: 79328 - DNA, 22 bp, Homo sapiens
aaggcaggatgggaaaagattt

SEQ ID NO: 79329 - DNA, 22 bp, Homo sapiens
aaggccctgtctccaaatacag

SEQ ID NO: 79330 - DNA, 22 bp, Homo sapiens
atggaaggctttatgactcaaa

SEQ ID NO: 79331 - DNA, 22 bp, Homo sapiens
caggctggagtgcagtggcgcc

SEQ ID NO: 79332 - DNA, 22 bp, Homo sapiens
actaggggctcaggcccaggga

SEQ ID NO: 79333 - DNA, 22 bp, Homo sapiens
gaggctgaggttgcagtgagcc

SEQ ID NO: 79334 - DNA, 22 bp, Homo sapiens
cgagagatgggttggcaggggc

SEQ ID NO: 79335 - DNA, 22 bp, Homo sapiens
atccatcctgccatctgagtag

SEQ ID NO: 79336 - DNA, 22 bp, Homo sapiens
caccctcaagcagtggcacgtg

SEQ ID NO: 79337 - DNA, 22 bp, Homo sapiens
gcgccccatctacagtactttt

SEQ ID NO: 79338 - DNA, 22 bp, Homo sapiens
agggggctccttggtgtgcaga

SEQ ID NO: 79339 - DNA, 22 bp, Homo sapiens
tactgtgtgcccagccgagctg

SEQ ID NO: 79340 - DNA, 22 bp, Homo sapiens
cccaggatggggctgcagttat

SEQ ID NO: 79341 - DNA, 22 bp, Homo sapiens
gggtggagagaaagaaacgtga

SEQ ID NO: 79342 - DNA, 22 bp, Homo sapiens
agtccaaagcagatgagggcca

SEQ ID NO: 79343 - DNA, 22 bp, Homo sapiens
tctcccaggcaggagtgcagtg

SEQ ID NO: 79344 - DNA, 22 bp, Homo sapiens
tgagtgattaggtttttccttc

SEQ ID NO: 79345 - DNA, 22 bp, Homo sapiens
attctcaaaacataacttcact

SEQ ID NO: 79346 - DNA, 22 bp, Homo sapiens
caggctggagtgcagtggggcg

SEQ ID NO: 79347 - DNA, 20 bp, Homo sapiens
tcaggtgacacacgtggcac

SEQ ID NO: 79348 - DNA, 23 bp, Homo sapiens
tgaatgtttattctcggtgcaga

SEQ ID NO: 79349 - DNA, 22 bp, Homo sapiens
ggctagcaaggtagcagaatgc

SEQ ID NO: 79350 - DNA, 22 bp, Homo sapiens
cgttggtctgtcccctggcacc

SEQ ID NO: 79351 - DNA, 22 bp, Homo sapiens
ccacagaattctgtctccagga

SEQ ID NO: 79352 - DNA, 17 bp, Homo sapiens
gaggccaaggcaggcgg

SEQ ID NO: 79353 - DNA, 22 bp, Homo sapiens
tgaaggggttcagcatgggggt

SEQ ID NO: 79354 - DNA, 22 bp, Homo sapiens
tgtgacctcatcttaactggaa

SEQ ID NO: 79355 - DNA, 22 bp, Homo sapiens
gggctgggattgcttgctgtga

SEQ ID NO: 79356 - DNA, 22 bp, Homo sapiens
tatgctctgagacctttgtgca

SEQ ID NO: 79357 - DNA, 22 bp, Homo sapiens
gccaggaaagggaattccctga

SEQ ID NO: 79358 - DNA, 22 bp, Homo sapiens
actgcactcctgcctgggtaac

SEQ ID NO: 79359 - DNA, 22 bp, Homo sapiens
ccagggatgcagaggttgcagt

SEQ ID NO: 79360 - DNA, 22 bp, Homo sapiens
gggagtgtgcacacatggtata

SEQ ID NO: 79361 - DNA, 22 bp, Homo sapiens
tgtctggatagagcctaggccc

SEQ ID NO: 79362 - DNA, 22 bp, Homo sapiens
aaggtccttttgcagtgtgatc

SEQ ID NO: 79363 - DNA, 22 bp, Homo sapiens
ttatgatttgccacagattggt

SEQ ID NO: 79364 - DNA, 22 bp, Homo sapiens
agaaagtgcttccctttggact

SEQ ID NO: 79365 - DNA, 22 bp, Homo sapiens
acgtgctggagaagagctcgcc

SEQ ID NO: 79366 - DNA, 22 bp, Homo sapiens
atgtttttaaatagacttacag

SEQ ID NO: 79367 - DNA, 22 bp, Homo sapiens
tctgcatattgttaatggaatg

SEQ ID NO: 79368 - DNA, 22 bp, Homo sapiens
ttaagcttcagaacgcaatgat

SEQ ID NO: 79369 - DNA, 22 bp, Homo sapiens
ttgatcaaatcagctactgagg

SEQ ID NO: 79370 - DNA, 20 bp, Homo sapiens
aaactaaaggtgtttggttt

SEQ ID NO: 79371 - DNA, 22 bp, Homo sapiens
gcccaggaggcagaggttgtgg

SEQ ID NO: 79372 - DNA, 22 bp, Homo sapiens
ctggaggtgcttcgctggccac

SEQ ID NO: 79373 - DNA, 22 bp, Homo sapiens
tataaagagtctcaaagaagtt

SEQ ID NO: 79374 - DNA, 22 bp, Homo sapiens
cctgggtttggagcctgcagaa

SEQ ID NO: 79375 - DNA, 22 bp, Homo sapiens
taggctgggaagaaagattctc

SEQ ID NO: 79376 - DNA, 22 bp, Homo sapiens
tctttcttgtgggtgccctttt

SEQ ID NO: 79377 - DNA, 22 bp, Homo sapiens
ggccctgggccctctagcttgt

SEQ ID NO: 79378 - DNA, 22 bp, Homo sapiens
ctggcaggagcattcacagagg

SEQ ID NO: 79379 - DNA, 22 bp, Homo sapiens
ccaggaggcggaggttgcagcg

SEQ ID NO: 79380 - DNA, 22 bp, Homo sapiens
acatttttcacatttgtagggt

SEQ ID NO: 79381 - DNA, 16 bp, Homo sapiens
ttgccgcacaggtcgc

SEQ ID NO: 79382 - DNA, 22 bp, Homo sapiens
cacctcaggcagcaaagtctca

SEQ ID NO: 79383 - DNA, 22 bp, Homo sapiens
atccctgtgacgagcatcccta

SEQ ID NO: 79384 - DNA, 22 bp, Homo sapiens
cgcgctgcagacagcggaggcc

SEQ ID NO: 79385 - DNA, 22 bp, Homo sapiens
ttcttctccgaggagggctggt

SEQ ID NO: 79386 - DNA, 22 bp, Homo sapiens
cttgctttcagtctcggcctca

SEQ ID NO: 79387 - DNA, 22 bp, Homo sapiens
ggtcaggagcccttggccccct

SEQ ID NO: 79388 - DNA, 22 bp, Homo sapiens
ggctggtgttgagtgcctgtag

SEQ ID NO: 79389 - DNA, 18 bp, Homo sapiens
ccctgccagctcccagca

SEQ ID NO: 79390 - DNA, 22 bp, Homo sapiens
aaccaggtgactcatggtgagc

SEQ ID NO: 79391 - DNA, 22 bp, Homo sapiens
ctgggaggcggaggttgcagtg

SEQ ID NO: 79392 - DNA, 22 bp, Homo sapiens
gtgattttctcctcctagaagt

SEQ ID NO: 79393 - DNA, 22 bp, Homo sapiens
tcttttgtgattcttcagttac

SEQ ID NO: 79394 - DNA, 19 bp, Homo sapiens
ggctgccttctgctcatct

SEQ ID NO: 79395 - DNA, 22 bp, Homo sapiens
ttttctgtttgcttcaagacat

SEQ ID NO: 79396 - DNA, 22 bp, Homo sapiens
gttgaaatcctaaccccctagt

SEQ ID NO: 79397 - DNA, 22 bp, Homo sapiens
ctgggcagctgtatcagggagt

SEQ ID NO: 79398 - DNA, 22 bp, Homo sapiens
gaatgtcttcaaaactagactg

SEQ ID NO: 79399 - DNA, 22 bp, Homo sapiens
gggaaagaccttcctggggtgt

SEQ ID NO: 79400 - DNA, 22 bp, Homo sapiens
tagcataacaggtaagagtgag

SEQ ID NO: 79401 - DNA, 19 bp, Homo sapiens
agggttacccgctgccacc

SEQ ID NO: 79402 - DNA, 22 bp, Homo sapiens
catggggcccatgtgctccaag

SEQ ID NO: 79403 - DNA, 22 bp, Homo sapiens
aactatgttaataagtttcatt

SEQ ID NO: 79404 - DNA, 22 bp, Homo sapiens
tgatatgggaaaagggctcgga

SEQ ID NO: 79405 - DNA, 22 bp, Homo sapiens
aagcatttcaggtagagatatt

SEQ ID NO: 79406 - DNA, 22 bp, Homo sapiens
ctgaaatgacggtttggggcaa

SEQ ID NO: 79407 - DNA, 22 bp, Homo sapiens
gaggggtccaggaggcacttac

SEQ ID NO: 79408 - DNA, 22 bp, Homo sapiens
agggtgaatctcacaactctta

SEQ ID NO: 79409 - DNA, 22 bp, Homo sapiens
taggtataggattctaggttgg

SEQ ID NO: 79410 - DNA, 22 bp, Homo sapiens
gggaaggaaagttattagcaga

SEQ ID NO: 79411 - DNA, 22 bp, Homo sapiens
acaactccttcttgggtcctgg

SEQ ID NO: 79412 - DNA, 22 bp, Homo sapiens
ctcgggcaccctggttctggtg

SEQ ID NO: 79413 - DNA, 19 bp, Homo sapiens
tccacagtggttgaactag

SEQ ID NO: 79414 - DNA, 22 bp, Homo sapiens
gcacggctaatttttgtatttt

SEQ ID NO: 79415 - DNA, 22 bp, Homo sapiens
tcagggctgcagaagaggcagg

SEQ ID NO: 79416 - DNA, 22 bp, Homo sapiens
aggtggagaagagatgggcagt

SEQ ID NO: 79417 - DNA, 22 bp, Homo sapiens
tcctgggacaagccgtggaagt

SEQ ID NO: 79418 - DNA, 22 bp, Homo sapiens
ccctgcctacagggttttcttt

SEQ ID NO: 79419 - DNA, 22 bp, Homo sapiens
agccaatctggggagacgggag

SEQ ID NO: 79420 - DNA, 22 bp, Homo sapiens
ggccctggtcctaggggtggaa

SEQ ID NO: 79421 - DNA, 22 bp, Homo sapiens
gaggcacagagtaggtgcacac

SEQ ID NO: 79422 - DNA, 22 bp, Homo sapiens
acatttatataactcactagga

SEQ ID NO: 79423 - DNA, 22 bp, Homo sapiens
ctgtcaggttggtctcagagct

SEQ ID NO: 79424 - DNA, 22 bp, Homo sapiens
ttccaaagaagttcacatttac

SEQ ID NO: 79425 - DNA, 22 bp, Homo sapiens
gagaaatatggctcagttccac

SEQ ID NO: 79426 - DNA, 22 bp, Homo sapiens
cctctgtgtctccaagaggcct

SEQ ID NO: 79427 - DNA, 18 bp, Homo sapiens
agtgtcagctgcagctca

SEQ ID NO: 79428 - DNA, 22 bp, Homo sapiens
actgattgcattcatagggttt

SEQ ID NO: 79429 - DNA, 22 bp, Homo sapiens
caggccagggttgagaagagaa

SEQ ID NO: 79430 - DNA, 22 bp, Homo sapiens
tgagcaggcgcagcaggaggtc

SEQ ID NO: 79431 - DNA, 22 bp, Homo sapiens
taacatttaaatttttcacata

SEQ ID NO: 79432 - DNA, 22 bp, Homo sapiens
tacttttcctggaaccactgct

SEQ ID NO: 79433 - DNA, 22 bp, Homo sapiens
ggagtgcagtggcgtgatctcg

SEQ ID NO: 79434 - DNA, 22 bp, Homo sapiens
cgagagttagctaggagtcaca

SEQ ID NO: 79435 - DNA, 22 bp, Homo sapiens
gtgcgggcctgggggtttctct

SEQ ID NO: 79436 - DNA, 22 bp, Homo sapiens
cgcaccactgaattccagcctg

SEQ ID NO: 79437 - DNA, 22 bp, Homo sapiens
ggccactgctctccagcctggg

SEQ ID NO: 79438 - DNA, 22 bp, Homo sapiens
cgggcgcactccgggcagctgt

SEQ ID NO: 79439 - DNA, 22 bp, Homo sapiens
ctgctcctgtccagcagggcca

SEQ ID NO: 79440 - DNA, 22 bp, Homo sapiens
ggacattgaagctggaaaggga

SEQ ID NO: 79441 - DNA, 22 bp, Homo sapiens
gaagccagtgtttgaagaattt

SEQ ID NO: 79442 - DNA, 23 bp, Homo sapiens
agagtacagtggcgccatctcag

SEQ ID NO: 79443 - DNA, 23 bp, Homo sapiens
ggagtgcaatggcgccatctcgg

SEQ ID NO: 79444 - DNA, 22 bp, Homo sapiens
tgagacaggcttccttcttggg

SEQ ID NO: 79445 - DNA, 22 bp, Homo sapiens
gagcagtaggagaaccctgagc

SEQ ID NO: 79446 - DNA, 22 bp, Homo sapiens
gctgctctccaagcctccttga

SEQ ID NO: 79447 - DNA, 20 bp, Homo sapiens
ttcgctgggagtggccaggc

SEQ ID NO: 79448 - DNA, 22 bp, Homo sapiens
tgaactcctgacctcatgatcc

SEQ ID NO: 79449 - DNA, 22 bp, Homo sapiens
cttccccaggacctctgctaaa

SEQ ID NO: 79450 - DNA, 16 bp, Homo sapiens
atgctgctattagagg

SEQ ID NO: 79451 - DNA, 22 bp, Homo sapiens
gcagctggaagtgacactctgt

SEQ ID NO: 79452 - DNA, 22 bp, Homo sapiens
ggctgggctccgggagcatgcg

SEQ ID NO: 79453 - DNA, 22 bp, Homo sapiens
cccaggctggagtgcagtggcg

SEQ ID NO: 79454 - DNA, 21 bp, Homo sapiens
tcacgtggtcacatgagcttt

SEQ ID NO: 79455 - DNA, 22 bp, Homo sapiens
tggcagtggcgggactcagggc

SEQ ID NO: 79456 - DNA, 22 bp, Homo sapiens
gtggagaggaacccagctctgt

SEQ ID NO: 79457 - DNA, 22 bp, Homo sapiens
tataaactcctcttgcattcct

SEQ ID NO: 79458 - DNA, 23 bp, Homo sapiens
tgaggcaggcggatcacgaggtc

SEQ ID NO: 79459 - DNA, 22 bp, Homo sapiens
ttttaatactgctattgtagga

SEQ ID NO: 79460 - DNA, 22 bp, Homo sapiens
aggtggggaggagtgtctcttt

SEQ ID NO: 79461 - DNA, 22 bp, Homo sapiens
ggcctcgcggcttctggtggct

SEQ ID NO: 79462 - DNA, 22 bp, Homo sapiens
gtgttggacagcttctactgtg

SEQ ID NO: 79463 - DNA, 22 bp, Homo sapiens
catgcctgtaatcccagcactt

SEQ ID NO: 79464 - DNA, 22 bp, Homo sapiens
ggtttattgttaataagtttga

SEQ ID NO: 79465 - DNA, 20 bp, Homo sapiens
cctgtcatcccagcattttg

SEQ ID NO: 79466 - DNA, 18 bp, Homo sapiens
tggaggaaaaatctcatg

SEQ ID NO: 79467 - DNA, 22 bp, Homo sapiens
tctacatgcagcgaggggactt

SEQ ID NO: 79468 - DNA, 22 bp, Homo sapiens
caggagtccatctggcctggtg

SEQ ID NO: 79469 - DNA, 22 bp, Homo sapiens
ggagtgcagtggcgtgagctcg

SEQ ID NO: 79470 - DNA, 22 bp, Homo sapiens
ccaggctggagtgcaatggcat

SEQ ID NO: 79471 - DNA, 20 bp, Homo sapiens
atgctttcttgtgtgctgct

SEQ ID NO: 79472 - DNA, 22 bp, Homo sapiens
gtccagttgtatgtccagtgtc

SEQ ID NO: 79473 - DNA, 22 bp, Homo sapiens
cctcgacctccccaggctcagg

SEQ ID NO: 79474 - DNA, 22 bp, Homo sapiens
ttccactctacacactgctggc

SEQ ID NO: 79475 - DNA, 22 bp, Homo sapiens
atacaaaatatatactggagac

SEQ ID NO: 79476 - DNA, 22 bp, Homo sapiens
taatgtataacaaatactcatc

SEQ ID NO: 79477 - DNA, 22 bp, Homo sapiens
ccaggcagcctgctccattctg

SEQ ID NO: 79478 - DNA, 22 bp, Homo sapiens
tgaacgcaggtccacatggctc

SEQ ID NO: 79479 - DNA, 22 bp, Homo sapiens
ccctgtgggaactcctgagttg

SEQ ID NO: 79480 - DNA, 22 bp, Homo sapiens
agcgccactgcactccagcctg

SEQ ID NO: 79481 - DNA, 22 bp, Homo sapiens
cctgggctctgtcagaattggg

SEQ ID NO: 79482 - DNA, 22 bp, Homo sapiens
ggagaggggaacttgttgcttg

SEQ ID NO: 79483 - DNA, 22 bp, Homo sapiens
aggtgggtgcctatgtatgtat

SEQ ID NO: 79484 - DNA, 22 bp, Homo sapiens
gggagctggagctggaagactc

SEQ ID NO: 79485 - DNA, 22 bp, Homo sapiens
atcacaaaggtctcagagcaca

SEQ ID NO: 79486 - DNA, 22 bp, Homo sapiens
ggccagaagttggaaaagagcc

SEQ ID NO: 79487 - DNA, 22 bp, Homo sapiens
acactctagagggaagcgcttt

SEQ ID NO: 79488 - DNA, 22 bp, Homo sapiens
gagcctcgtggcggccactgcg

SEQ ID NO: 79489 - DNA, 20 bp, Homo sapiens
agatacagtggtttctttag

SEQ ID NO: 79490 - DNA, 22 bp, Homo sapiens
tacaaaaaattgatactgacga

SEQ ID NO: 79491 - DNA, 22 bp, Homo sapiens
cctcatcgtttccagaatgtgg

SEQ ID NO: 79492 - DNA, 22 bp, Homo sapiens
tctgttttgcataatgttcttt

SEQ ID NO: 79493 - DNA, 22 bp, Homo sapiens
acaagcatgggctttgacatca

SEQ ID NO: 79494 - DNA, 21 bp, Homo sapiens
tctgccagctgaagaggtgga

SEQ ID NO: 79495 - DNA, 22 bp, Homo sapiens
ttgtgaatagtgccgcaatgaa

SEQ ID NO: 79496 - DNA, 22 bp, Homo sapiens
cagtgcagccaaggacaggcac

SEQ ID NO: 79497 - DNA, 23 bp, Homo sapiens
aatatcaaggtgatgttcccaga

SEQ ID NO: 79498 - DNA, 22 bp, Homo sapiens
cagagactggagtgcagtggcg

SEQ ID NO: 79499 - DNA, 22 bp, Homo sapiens
ggggccttggatctgtgccccg

SEQ ID NO: 79500 - DNA, 22 bp, Homo sapiens
agagagcagtggatcacctagc

SEQ ID NO: 79501 - DNA, 22 bp, Homo sapiens
tagatgtgttgcctggagttgt

SEQ ID NO: 79502 - DNA, 22 bp, Homo sapiens
ctgctttggacaactattcttg

SEQ ID NO: 79503 - DNA, 22 bp, Homo sapiens
ccgccgtgcaggccgcgacgtg

SEQ ID NO: 79504 - DNA, 22 bp, Homo sapiens
cttcatagtgagtttaatgatg

SEQ ID NO: 79505 - DNA, 22 bp, Homo sapiens
ggaggagacagtaaaaagcacg

SEQ ID NO: 79506 - DNA, 22 bp, Homo sapiens
ccttacctgattgctggcatcc

SEQ ID NO: 79507 - DNA, 22 bp, Homo sapiens
tgctgctccccagcacacagca

SEQ ID NO: 79508 - DNA, 22 bp, Homo sapiens
tcaccaggctagagtgcagtgg

SEQ ID NO: 79509 - DNA, 22 bp, Homo sapiens
ttcaccctggaccagaaattgg

SEQ ID NO: 79510 - DNA, 22 bp, Homo sapiens
cacagctgtgagaagggagcct

SEQ ID NO: 79511 - DNA, 22 bp, Homo sapiens
gagccaggtcgggccgcggcga

SEQ ID NO: 79512 - DNA, 22 bp, Homo sapiens
gacgccgtgtcccggcactctt

SEQ ID NO: 79513 - DNA, 22 bp, Homo sapiens
ttaaattttagaaacagactct

SEQ ID NO: 79514 - DNA, 22 bp, Homo sapiens
agcctctctgttagtcactggg

SEQ ID NO: 79515 - DNA, 22 bp, Homo sapiens
taggttctccacaggttctcca

SEQ ID NO: 79516 - DNA, 22 bp, Homo sapiens
agaacgtggaatgtggctcctt

SEQ ID NO: 79517 - DNA, 22 bp, Homo sapiens
gcccagcacctctctcagggtt

SEQ ID NO: 79518 - DNA, 22 bp, Homo sapiens
attgcactccagcctgggggac

SEQ ID NO: 79519 - DNA, 22 bp, Homo sapiens
gttggccaggctggtctcaaac

SEQ ID NO: 79520 - DNA, 18 bp, Homo sapiens
ctgtaccaccctgagggc

SEQ ID NO: 79521 - DNA, 22 bp, Homo sapiens
ggtttgacagcttggggctgtc

SEQ ID NO: 79522 - DNA, 22 bp, Homo sapiens
agcctctcagagtgctgggatt

SEQ ID NO: 79523 - DNA, 22 bp, Homo sapiens
ctgcatccatgttgctgcaaag

SEQ ID NO: 79524 - DNA, 22 bp, Homo sapiens
gagtcggaggcaggagacctgg

SEQ ID NO: 79525 - DNA, 22 bp, Homo sapiens
ctcctctttagccccagctgga

SEQ ID NO: 79526 - DNA, 22 bp, Homo sapiens
aaggagtggggcatatcacaga

SEQ ID NO: 79527 - DNA, 22 bp, Homo sapiens
ttgggcctctcaaagtgctggg

SEQ ID NO: 79528 - DNA, 22 bp, Homo sapiens
catggcggtcaggatgtaggtg

SEQ ID NO: 79529 - DNA, 22 bp, Homo sapiens
gtccctgataagagccatcgat

SEQ ID NO: 79530 - DNA, 22 bp, Homo sapiens
cccagcaggaggaggttgcagt

SEQ ID NO: 79531 - DNA, 22 bp, Homo sapiens
aagtggactaatacaaggacta

SEQ ID NO: 79532 - DNA, 19 bp, Homo sapiens
catctggatgattctcctg

SEQ ID NO: 79533 - DNA, 22 bp, Homo sapiens
aggccagcagcatgacggcatc

SEQ ID NO: 79534 - DNA, 22 bp, Homo sapiens
cactgcactccagcttgggtga

SEQ ID NO: 79535 - DNA, 22 bp, Homo sapiens
actcatgtaagcggaatgtagt

SEQ ID NO: 79536 - DNA, 22 bp, Homo sapiens
gctgcgccggatcccacgttcc

SEQ ID NO: 79537 - DNA, 22 bp, Homo sapiens
aggaaagcttggcaaactaaat

SEQ ID NO: 79538 - DNA, 22 bp, Homo sapiens
attgtggtgtcagttataggca

SEQ ID NO: 79539 - DNA, 22 bp, Homo sapiens
tgctgtgttactgagatccggc

SEQ ID NO: 79540 - DNA, 22 bp, Homo sapiens
aagctggagtgcagtgcaatgg

SEQ ID NO: 79541 - DNA, 21 bp, Homo sapiens
cactccacttagaacagggtt

SEQ ID NO: 79542 - DNA, 22 bp, Homo sapiens
aaccaccaccgtaatttaccca

SEQ ID NO: 79543 - DNA, 22 bp, Homo sapiens
ggagtgaatcactagatgcaga

SEQ ID NO: 79544 - DNA, 22 bp, Homo sapiens
tccattatacttctgattcaaa

SEQ ID NO: 79545 - DNA, 22 bp, Homo sapiens
acccatccagtgtccctgctag

SEQ ID NO: 79546 - DNA, 22 bp, Homo sapiens
tagaactacaagcattaaaagt

SEQ ID NO: 79547 - DNA, 22 bp, Homo sapiens
aaaatcctgctgactcgagatg

SEQ ID NO: 79548 - DNA, 22 bp, Homo sapiens
ttggcgcccaggacgccgccgc

SEQ ID NO: 79549 - DNA, 22 bp, Homo sapiens
tgtctcttttcaagctaccctt

SEQ ID NO: 79550 - DNA, 22 bp, Homo sapiens
ggatgcacgaaggcgcctcgga

SEQ ID NO: 79551 - DNA, 22 bp, Homo sapiens
cagagctggtgtgtcctggcat

SEQ ID NO: 79552 - DNA, 22 bp, Homo sapiens
cactgctacctctgcctcccgg

SEQ ID NO: 79553 - DNA, 22 bp, Homo sapiens
ctgggcacagcgttgggctctt

SEQ ID NO: 79554 - DNA, 22 bp, Homo sapiens
ccctgctgtcaggtgctgggag

SEQ ID NO: 79555 - DNA, 22 bp, Homo sapiens
accctcaacaaattcactctat

SEQ ID NO: 79556 - DNA, 22 bp, Homo sapiens
cccaggaggttgaggctgcagt

SEQ ID NO: 79557 - DNA, 22 bp, Homo sapiens
tatttcttttcgtgacttattg

SEQ ID NO: 79558 - DNA, 22 bp, Homo sapiens
cagagctgtccaaaccctgaca

SEQ ID NO: 79559 - DNA, 22 bp, Homo sapiens
gaggagggagctggaagctctt

SEQ ID NO: 79560 - DNA, 22 bp, Homo sapiens
agcccaggctggagtgcagtgg

SEQ ID NO: 79561 - DNA, 22 bp, Homo sapiens
ccaggttggagttcagtggcgc

SEQ ID NO: 79562 - DNA, 22 bp, Homo sapiens
agatgctgctccacaggccagg

SEQ ID NO: 79563 - DNA, 22 bp, Homo sapiens
tctctggactcgagcttactca

SEQ ID NO: 79564 - DNA, 18 bp, Homo sapiens
acgtgctgtgccttttgc

SEQ ID NO: 79565 - DNA, 22 bp, Homo sapiens
cccaggccccagggcttgtcag

SEQ ID NO: 79566 - DNA, 22 bp, Homo sapiens
gactttctgatgtaaacattta

SEQ ID NO: 79567 - DNA, 22 bp, Homo sapiens
caggaagctgtgaaggagacgg

SEQ ID NO: 79568 - DNA, 22 bp, Homo sapiens
gtttctctgtctgttacattgg

SEQ ID NO: 79569 - DNA, 21 bp, Homo sapiens
ggccccgcagacccagcacgt

SEQ ID NO: 79570 - DNA, 22 bp, Homo sapiens
acagcagcaatagcagtgacat

SEQ ID NO: 79571 - DNA, 22 bp, Homo sapiens
cggggcgagcagacggcggcaa

SEQ ID NO: 79572 - DNA, 22 bp, Homo sapiens
tcttggattttaatggatcaaa

SEQ ID NO: 79573 - DNA, 22 bp, Homo sapiens
aagtggcagttcaggaagcaga

SEQ ID NO: 79574 - DNA, 22 bp, Homo sapiens
tgttgcccaggttctctcctgc

SEQ ID NO: 79575 - DNA, 22 bp, Homo sapiens
attgtaacagacacatcagatt

SEQ ID NO: 79576 - DNA, 22 bp, Homo sapiens
cccaggaggcagaagttgcagt

SEQ ID NO: 79577 - DNA, 22 bp, Homo sapiens
tatgtgtttgacaccctgcaag

SEQ ID NO: 79578 - DNA, 22 bp, Homo sapiens
ttattgcttatgattaggtgtt

SEQ ID NO: 79579 - DNA, 22 bp, Homo sapiens
cggtcaggtgcagcgttggcac

SEQ ID NO: 79580 - DNA, 22 bp, Homo sapiens
gcactggccgcacgcgtagggc

SEQ ID NO: 79581 - DNA, 22 bp, Homo sapiens
tctctttgcctgctgccatcca

SEQ ID NO: 79582 - DNA, 22 bp, Homo sapiens
cccaggctggagtgtaatggtg

SEQ ID NO: 79583 - DNA, 22 bp, Homo sapiens
gcctgacttgtgtattttacat

SEQ ID NO: 79584 - DNA, 22 bp, Homo sapiens
cccaggaggcctgcctggccgg

SEQ ID NO: 79585 - DNA, 22 bp, Homo sapiens
cttaatctcacctgcaaagtcc

SEQ ID NO: 79586 - DNA, 22 bp, Homo sapiens
caaatactacgattcttgcagt

SEQ ID NO: 79587 - DNA, 19 bp, Homo sapiens
agggaatccggctgaggga

SEQ ID NO: 79588 - DNA, 22 bp, Homo sapiens
ctgtcctgccagtcctggactc

SEQ ID NO: 79589 - DNA, 22 bp, Homo sapiens
ggccgccctttccacggtttct

SEQ ID NO: 79590 - DNA, 22 bp, Homo sapiens
gacaggaggcagagctcaggtg

SEQ ID NO: 79591 - DNA, 22 bp, Homo sapiens
tcacctctactcagcctagttc

SEQ ID NO: 79592 - DNA, 21 bp, Homo sapiens
tgcaatccagcctgggcgaca

SEQ ID NO: 79593 - DNA, 22 bp, Homo sapiens
aagtcagacagctgagctgcct

SEQ ID NO: 79594 - DNA, 21 bp, Homo sapiens
tttcttaggctctaaaatgac

SEQ ID NO: 79595 - DNA, 22 bp, Homo sapiens
ggcaggaacacagatggtgccg

SEQ ID NO: 79596 - DNA, 22 bp, Homo sapiens
agccagatgaagaggtccttaa

SEQ ID NO: 79597 - DNA, 22 bp, Homo sapiens
atgtcgataggagtgccatcgg

SEQ ID NO: 79598 - DNA, 22 bp, Homo sapiens
tagaagaaagtgaagctgggga

SEQ ID NO: 79599 - DNA, 22 bp, Homo sapiens
acagagcaatgcgtgttctcta

SEQ ID NO: 79600 - DNA, 22 bp, Homo sapiens
tccgggaggcagaggttgcagt

SEQ ID NO: 79601 - DNA, 22 bp, Homo sapiens
actgccctccagcctgggtgac

SEQ ID NO: 79602 - DNA, 22 bp, Homo sapiens
atgagttgaagctacaagaggc

SEQ ID NO: 79603 - DNA, 22 bp, Homo sapiens
tcctggcttgtcacatctacgt

SEQ ID NO: 79604 - DNA, 22 bp, Homo sapiens
ccagcagagcatggggaggaag

SEQ ID NO: 79605 - DNA, 22 bp, Homo sapiens
gggctagcctcttccctgctcc

SEQ ID NO: 79606 - DNA, 19 bp, Homo sapiens
agtcctggcctgggggacc

SEQ ID NO: 79607 - DNA, 22 bp, Homo sapiens
ggtgtctatgattcagtttatg

SEQ ID NO: 79608 - DNA, 22 bp, Homo sapiens
cttagctgcgggccctcctcgc

SEQ ID NO: 79609 - DNA, 22 bp, Homo sapiens
cccaggagttggaggctgcagt

SEQ ID NO: 79610 - DNA, 22 bp, Homo sapiens
gtgggacaggtcaaatcttaaa

SEQ ID NO: 79611 - DNA, 22 bp, Homo sapiens
tccaggctttggggcaggagcg

SEQ ID NO: 79612 - DNA, 22 bp, Homo sapiens
gctctctgcagcctccttggag

SEQ ID NO: 79613 - DNA, 22 bp, Homo sapiens
tactaggaagcagctgcattgg

SEQ ID NO: 79614 - DNA, 22 bp, Homo sapiens
atggggctgttctctgccctgc

SEQ ID NO: 79615 - DNA, 18 bp, Homo sapiens
actctttctgcccacagg

SEQ ID NO: 79616 - DNA, 22 bp, Homo sapiens
cagagagaatcttggcagctga

SEQ ID NO: 79617 - DNA, 22 bp, Homo sapiens
gtatccatgggggattggttcc

SEQ ID NO: 79618 - DNA, 22 bp, Homo sapiens
tcactgcaacctctgcctcccg

SEQ ID NO: 79619 - DNA, 22 bp, Homo sapiens
tatgtcactcggctcggcccac

SEQ ID NO: 79620 - DNA, 22 bp, Homo sapiens
tctaccctgcggtcttggggca

SEQ ID NO: 79621 - DNA, 22 bp, Homo sapiens
gtacaaatgcaggtttgttaca

SEQ ID NO: 79622 - DNA, 22 bp, Homo sapiens
tggttgcctctcagagattccg

SEQ ID NO: 79623 - DNA, 22 bp, Homo sapiens
agtggcctggagccccgcctgg

SEQ ID NO: 79624 - DNA, 22 bp, Homo sapiens
gcctccggagttgcagtgtctt

SEQ ID NO: 79625 - DNA, 22 bp, Homo sapiens
ggtcgagtcacttgttgccttt

SEQ ID NO: 79626 - DNA, 22 bp, Homo sapiens
tgcttatatttcattggcccaa

SEQ ID NO: 79627 - DNA, 22 bp, Homo sapiens
cagggtttcaccatgttagcag

SEQ ID NO: 79628 - DNA, 22 bp, Homo sapiens
ccttctcagccccagctcccgc

SEQ ID NO: 79629 - DNA, 17 bp, Homo sapiens
gggcagggactcctggg

SEQ ID NO: 79630 - DNA, 22 bp, Homo sapiens
tggggacttgccttgttgctca

SEQ ID NO: 79631 - DNA, 22 bp, Homo sapiens
gagccagactgcctgaagctca

SEQ ID NO: 79632 - DNA, 22 bp, Homo sapiens
tgcgcatgagtctgtgcataca

SEQ ID NO: 79633 - DNA, 22 bp, Homo sapiens
tacatttataaggcttctctgt

SEQ ID NO: 79634 - DNA, 22 bp, Homo sapiens
attgcactccggcctgggtgac

SEQ ID NO: 79635 - DNA, 22 bp, Homo sapiens
gaggggctgccctggtgtcagg

SEQ ID NO: 79636 - DNA, 22 bp, Homo sapiens
tgtcttcagcagtcatctgggg

SEQ ID NO: 79637 - DNA, 22 bp, Homo sapiens
gtgaaagcactgaacaaagtaa

SEQ ID NO: 79638 - DNA, 22 bp, Homo sapiens
tcttagaaattccccagtggct

SEQ ID NO: 79639 - DNA, 22 bp, Homo sapiens
gtcacctgtgccacatactggg

SEQ ID NO: 79640 - DNA, 22 bp, Homo sapiens
ttatagcagcatgatttataat

SEQ ID NO: 79641 - DNA, 19 bp, Homo sapiens
ttcacattggaagaagtag

SEQ ID NO: 79642 - DNA, 22 bp, Homo sapiens
ggcgcccccttcaaacagagca

SEQ ID NO: 79643 - DNA, 22 bp, Homo sapiens
ctggctgggagcgagctgctca

SEQ ID NO: 79644 - DNA, 22 bp, Homo sapiens
caggctggagtacaattgtgtg

SEQ ID NO: 79645 - DNA, 22 bp, Homo sapiens
atgttgactcagagtgagggta

SEQ ID NO: 79646 - DNA, 22 bp, Homo sapiens
aagccctggcgggtggagggcc

SEQ ID NO: 79647 - DNA, 20 bp, Homo sapiens
tttctgtgagaaacactgtt

SEQ ID NO: 79648 - DNA, 22 bp, Homo sapiens
aactaatacattaatacatgtg

SEQ ID NO: 79649 - DNA, 23 bp, Homo sapiens
tgtcttcgactcctgcgtgcttc

SEQ ID NO: 79650 - DNA, 22 bp, Homo sapiens
gcccaggaggagaggctgcagt

SEQ ID NO: 79651 - DNA, 22 bp, Homo sapiens
cagcaggaggtgagtagcaggt

SEQ ID NO: 79652 - DNA, 16 bp, Homo sapiens
aggctcagaggctgga

SEQ ID NO: 79653 - DNA, 22 bp, Homo sapiens
ccagaggagttgaggctttggg

SEQ ID NO: 79654 - DNA, 22 bp, Homo sapiens
ctttaattgtagctcccataat

SEQ ID NO: 79655 - DNA, 22 bp, Homo sapiens
aggcaatcccctgaggatactt

SEQ ID NO: 79656 - DNA, 22 bp, Homo sapiens
ccggaaggcggaacgtgcagtg

SEQ ID NO: 79657 - DNA, 22 bp, Homo sapiens
ttgtcgggcttacgcagggcca

SEQ ID NO: 79658 - DNA, 22 bp, Homo sapiens
tccacaggtccggcatgaacag

SEQ ID NO: 79659 - DNA, 22 bp, Homo sapiens
gctggtagacctcactgcactc

SEQ ID NO: 79660 - DNA, 22 bp, Homo sapiens
agaggctgcacttgctcatgat

SEQ ID NO: 79661 - DNA, 22 bp, Homo sapiens
atttaagggatttggagaccaa

SEQ ID NO: 79662 - DNA, 22 bp, Homo sapiens
ggctgccttccctgagccccgg

SEQ ID NO: 79663 - DNA, 22 bp, Homo sapiens
catgaaattgtattggcctcaa

SEQ ID NO: 79664 - DNA, 22 bp, Homo sapiens
ttgcttcttagatattcctctc

SEQ ID NO: 79665 - DNA, 22 bp, Homo sapiens
ctgagcctcctgcttctatttc

SEQ ID NO: 79666 - DNA, 22 bp, Homo sapiens
tgagctgtctgaatggtgagga

SEQ ID NO: 79667 - DNA, 22 bp, Homo sapiens
cactgcagcctcgctctcctga

SEQ ID NO: 79668 - DNA, 22 bp, Homo sapiens
gctggccacagatccccaggga

SEQ ID NO: 79669 - DNA, 22 bp, Homo sapiens
tctgcaggtaagcgttcttgga

SEQ ID NO: 79670 - DNA, 22 bp, Homo sapiens
taaaggtctgaacacagtgagg

SEQ ID NO: 79671 - DNA, 22 bp, Homo sapiens
tctcaacagtgcaagctgctcc

SEQ ID NO: 79672 - DNA, 18 bp, Homo sapiens
gcagtgaagaaagagctt

SEQ ID NO: 79673 - DNA, 22 bp, Homo sapiens
ggtgacggggcccaggtttcct

SEQ ID NO: 79674 - DNA, 22 bp, Homo sapiens
ctgtcaggtttcccggctcacg

SEQ ID NO: 79675 - DNA, 22 bp, Homo sapiens
gggccctgggattcagagcaag

SEQ ID NO: 79676 - DNA, 22 bp, Homo sapiens
ggagttccagaccagactggcc

SEQ ID NO: 79677 - DNA, 22 bp, Homo sapiens
cagtgcttttaaaacaacatca

SEQ ID NO: 79678 - DNA, 22 bp, Homo sapiens
gtggatggagctggaagccatt

SEQ ID NO: 79679 - DNA, 22 bp, Homo sapiens
cactgcactccagcccgggcaa

SEQ ID NO: 79680 - DNA, 22 bp, Homo sapiens
ggacaagcctgtgagtgggttt

SEQ ID NO: 79681 - DNA, 22 bp, Homo sapiens
actgcacttcaccctgggtgac

SEQ ID NO: 79682 - DNA, 22 bp, Homo sapiens
tgctgtgaggttgagaaggaag

SEQ ID NO: 79683 - DNA, 17 bp, Homo sapiens
cttcccaccatctcctg

SEQ ID NO: 79684 - DNA, 22 bp, Homo sapiens
ccaggtaggagagtcaacatgt

SEQ ID NO: 79685 - DNA, 22 bp, Homo sapiens
cagctacaaatacttttgtatg

SEQ ID NO: 79686 - DNA, 22 bp, Homo sapiens
caggagctcaagaccaccctgg

SEQ ID NO: 79687 - DNA, 22 bp, Homo sapiens
ctgaggctggagtgcagtggtg

SEQ ID NO: 79688 - DNA, 22 bp, Homo sapiens
ggaggtggaggttgcagtgagc

SEQ ID NO: 79689 - DNA, 22 bp, Homo sapiens
ggaggcggaggttgcagtgagt

SEQ ID NO: 79690 - DNA, 22 bp, Homo sapiens
gggagcctgtggatgtctgact

SEQ ID NO: 79691 - DNA, 22 bp, Homo sapiens
gccaggtatgaattacgcacga

SEQ ID NO: 79692 - DNA, 22 bp, Homo sapiens
cctcggctgggccttggccact

SEQ ID NO: 79693 - DNA, 22 bp, Homo sapiens
gcttcaggctgaattcctccta

SEQ ID NO: 79694 - DNA, 22 bp, Homo sapiens
aacttaggaaaataaggcatga

SEQ ID NO: 79695 - DNA, 22 bp, Homo sapiens
cctggagagctcgggccaggca

SEQ ID NO: 79696 - DNA, 22 bp, Homo sapiens
gccaggcgggtctcaaactcct

SEQ ID NO: 79697 - DNA, 22 bp, Homo sapiens
atccatttgacataatttcagc

SEQ ID NO: 79698 - DNA, 22 bp, Homo sapiens
gtcacccgtttgactatccacc

SEQ ID NO: 79699 - DNA, 22 bp, Homo sapiens
tggagtgcaatagtaataaggt

SEQ ID NO: 79700 - DNA, 22 bp, Homo sapiens
tgtacttgaacttgactgtaga

SEQ ID NO: 79701 - DNA, 22 bp, Homo sapiens
atgccacttcattccagcctcg

SEQ ID NO: 79702 - DNA, 22 bp, Homo sapiens
atagagtgatgtaaggtatgtg

SEQ ID NO: 79703 - DNA, 22 bp, Homo sapiens
tccccagcttgctacttctgct

SEQ ID NO: 79704 - DNA, 22 bp, Homo sapiens
agctgccgatgcccagctgcat

SEQ ID NO: 79705 - DNA, 22 bp, Homo sapiens
tcctttgcttctgtcattctcc

SEQ ID NO: 79706 - DNA, 22 bp, Homo sapiens
tctgacattttgagaatgacat

SEQ ID NO: 79707 - DNA, 22 bp, Homo sapiens
gagcccaggcagaggttgcagt

SEQ ID NO: 79708 - DNA, 22 bp, Homo sapiens
tgggaagaggggtataaagaag

SEQ ID NO: 79709 - DNA, 22 bp, Homo sapiens
tctgtgagaaccagtgccaggg

SEQ ID NO: 79710 - DNA, 22 bp, Homo sapiens
aggcttttctccagaatgtact

SEQ ID NO: 79711 - DNA, 22 bp, Homo sapiens
acagcccagctctttctctgca

SEQ ID NO: 79712 - DNA, 22 bp, Homo sapiens
ctaccacacacacgtcttagga

SEQ ID NO: 79713 - DNA, 22 bp, Homo sapiens
ccaggctggagtgcagtggcac

SEQ ID NO: 79714 - DNA, 23 bp, Homo sapiens
ggctgggagctccgggtgcacgt

SEQ ID NO: 79715 - DNA, 22 bp, Homo sapiens
ccgcccacactaaatatgagcg

SEQ ID NO: 79716 - DNA, 22 bp, Homo sapiens
ctacaaaagtaattgtggtttt

SEQ ID NO: 79717 - DNA, 22 bp, Homo sapiens
tgctgagcgcatccggcggccg

SEQ ID NO: 79718 - DNA, 22 bp, Homo sapiens
tccttaggcaatttgggagagt

SEQ ID NO: 79719 - DNA, 22 bp, Homo sapiens
aggaaggcttctttggtcttct

SEQ ID NO: 79720 - DNA, 22 bp, Homo sapiens
tctggagataagcagcaatgaa

SEQ ID NO: 79721 - DNA, 22 bp, Homo sapiens
ggtagtcggccttgccctgggc

SEQ ID NO: 79722 - DNA, 22 bp, Homo sapiens
ccaggaggtggagattgcagtg

SEQ ID NO: 79723 - DNA, 22 bp, Homo sapiens
gcttcggggtccaagcgcgtgt

SEQ ID NO: 79724 - DNA, 22 bp, Homo sapiens
ccttttgctctcccatccagaa

SEQ ID NO: 79725 - DNA, 22 bp, Homo sapiens
tatgttgcaccaacctaataat

SEQ ID NO: 79726 - DNA, 22 bp, Homo sapiens
gcaccgccttggaccgcccgct

SEQ ID NO: 79727 - DNA, 22 bp, Homo sapiens
ggctgagttgagaggattactt

SEQ ID NO: 79728 - DNA, 22 bp, Homo sapiens
tgcaatttttccatgacctaga

SEQ ID NO: 79729 - DNA, 22 bp, Homo sapiens
cctgttgtttactgcagtgagt

SEQ ID NO: 79730 - DNA, 22 bp, Homo sapiens
agttgttcgtggtggattcgct

SEQ ID NO: 79731 - DNA, 22 bp, Homo sapiens
tcagtggagagcttccaggatt

SEQ ID NO: 79732 - DNA, 22 bp, Homo sapiens
caggaaggcgcggctgtgcctg

SEQ ID NO: 79733 - DNA, 22 bp, Homo sapiens
aactctatttaccctactaaac

SEQ ID NO: 79734 - DNA, 22 bp, Homo sapiens
actggggctgatgcgttcgtgt

SEQ ID NO: 79735 - DNA, 22 bp, Homo sapiens
cctgccagagcagcttgtcctc

SEQ ID NO: 79736 - DNA, 22 bp, Homo sapiens
tggggtcagcaggcctggcctg

SEQ ID NO: 79737 - DNA, 21 bp, Homo sapiens
atatcaatacagcaggacttc

SEQ ID NO: 79738 - DNA, 22 bp, Homo sapiens
cctgcttaacattgccatgaca

SEQ ID NO: 79739 - DNA, 22 bp, Homo sapiens
cagtcactggaatagctgagga

SEQ ID NO: 79740 - DNA, 22 bp, Homo sapiens
gagacctcttggtatcgctagg

SEQ ID NO: 79741 - DNA, 22 bp, Homo sapiens
tcccagattcctgctcttatat

SEQ ID NO: 79742 - DNA, 22 bp, Homo sapiens
aaggctccagtgaatgctggca

SEQ ID NO: 79743 - DNA, 22 bp, Homo sapiens
ccagtgtgcattatcatgtgtc

SEQ ID NO: 79744 - DNA, 22 bp, Homo sapiens
gatggtgcaggtgaagtgctgg

SEQ ID NO: 79745 - DNA, 22 bp, Homo sapiens
tccaggattgcaggtgcacaac

SEQ ID NO: 79746 - DNA, 22 bp, Homo sapiens
tgggcaggggccctgcttccgt

SEQ ID NO: 79747 - DNA, 22 bp, Homo sapiens
aagaactgtttacaattttcac

SEQ ID NO: 79748 - DNA, 22 bp, Homo sapiens
ggagtgactcacagctgggaca

SEQ ID NO: 79749 - DNA, 22 bp, Homo sapiens
tcatctaagagtcttacattta

SEQ ID NO: 79750 - DNA, 22 bp, Homo sapiens
atacctgtgtatccacaagcgt

SEQ ID NO: 79751 - DNA, 22 bp, Homo sapiens
gctcgaccgccagaaacttcct

SEQ ID NO: 79752 - DNA, 14 bp, Homo sapiens
aagatcaccttcct

SEQ ID NO: 79753 - DNA, 21 bp, Homo sapiens
ttgaccaagggtgcgtgctcc

SEQ ID NO: 79754 - DNA, 22 bp, Homo sapiens
gccagggttcgaatccgtatgg

SEQ ID NO: 79755 - DNA, 22 bp, Homo sapiens
attgcactccagcctgggtgac

SEQ ID NO: 79756 - DNA, 22 bp, Homo sapiens
cactgcaacctccacctcctgg

SEQ ID NO: 79757 - DNA, 22 bp, Homo sapiens
tgagatcattgacttgttcctg

SEQ ID NO: 79758 - DNA, 22 bp, Homo sapiens
tcaccagacgcgtgggtctgag

SEQ ID NO: 79759 - DNA, 22 bp, Homo sapiens
aacgcccgtggttgccaaggta

SEQ ID NO: 79760 - DNA, 22 bp, Homo sapiens
actcccagaacatgctcttctt

SEQ ID NO: 79761 - DNA, 22 bp, Homo sapiens
tggagaattctatgttgagggg

SEQ ID NO: 79762 - DNA, 22 bp, Homo sapiens
ctatacagcagcttactagtta

SEQ ID NO: 79763 - DNA, 22 bp, Homo sapiens
ctttggagaaaagttcttgggc

SEQ ID NO: 79764 - DNA, 22 bp, Homo sapiens
cataaaaggtagcagtttgaaa

SEQ ID NO: 79765 - DNA, 22 bp, Homo sapiens
cacagagctggaaaggctgggc

SEQ ID NO: 79766 - DNA, 22 bp, Homo sapiens
ccactgccctgcaaaagctgga

SEQ ID NO: 79767 - DNA, 22 bp, Homo sapiens
catagagtgatgtaaggtatgt

SEQ ID NO: 79768 - DNA, 22 bp, Homo sapiens
tatacactgttgttgggagtct

SEQ ID NO: 79769 - DNA, 22 bp, Homo sapiens
ctggggtcagggatcagagagc

SEQ ID NO: 79770 - DNA, 22 bp, Homo sapiens
tcacagagttaaaagtttcttt

SEQ ID NO: 79771 - DNA, 22 bp, Homo sapiens
ggatgacccgagtctggggaac

SEQ ID NO: 79772 - DNA, 22 bp, Homo sapiens
tgaggcaggaggattgcaggat

SEQ ID NO: 79773 - DNA, 22 bp, Homo sapiens
ggggaccctcaggactgcgtct

SEQ ID NO: 79774 - DNA, 18 bp, Homo sapiens
gaccccgggatctgtcga

SEQ ID NO: 79775 - DNA, 22 bp, Homo sapiens
cccaggaagtggaggttgcagt

SEQ ID NO: 79776 - DNA, 22 bp, Homo sapiens
tacgcctgtaatcccagcactt

SEQ ID NO: 79777 - DNA, 22 bp, Homo sapiens
acacttggagcaacacttatgg

SEQ ID NO: 79778 - DNA, 22 bp, Homo sapiens
ttccggaaggttctctagaatt

SEQ ID NO: 79779 - DNA, 22 bp, Homo sapiens
agtgcaggccccaggccaggcc

SEQ ID NO: 79780 - DNA, 22 bp, Homo sapiens
tccttgcagggtttgataaaga

SEQ ID NO: 79781 - DNA, 22 bp, Homo sapiens
gggctgagacgatggggtcttc

SEQ ID NO: 79782 - DNA, 22 bp, Homo sapiens
ggtgtccacattccctggcagg

SEQ ID NO: 79783 - DNA, 22 bp, Homo sapiens
ttgagcccaggaggcctgggtg

SEQ ID NO: 79784 - DNA, 23 bp, Homo sapiens
ttctgggctgtggaagcctcggg

SEQ ID NO: 79785 - DNA, 22 bp, Homo sapiens
aggtggaaatggctttcctagg

SEQ ID NO: 79786 - DNA, 22 bp, Homo sapiens
aaaaatcacttttataggcagc

SEQ ID NO: 79787 - DNA, 22 bp, Homo sapiens
agtatgggtgtagattctgcaa

SEQ ID NO: 79788 - DNA, 22 bp, Homo sapiens
ctggcaagaaatatatatctta

SEQ ID NO: 79789 - DNA, 22 bp, Homo sapiens
ttgtaagtcacaccagggcagg

SEQ ID NO: 79790 - DNA, 22 bp, Homo sapiens
acaaggcactttatgaagagga

SEQ ID NO: 79791 - DNA, 22 bp, Homo sapiens
cctcgcggcactcgggccggat

SEQ ID NO: 79792 - DNA, 22 bp, Homo sapiens
accactgcccatggtgaaaact

SEQ ID NO: 79793 - DNA, 22 bp, Homo sapiens
agtcaaagatgaccgagttcct

SEQ ID NO: 79794 - DNA, 20 bp, Homo sapiens
tgttgattggtgtcatctca

SEQ ID NO: 79795 - DNA, 18 bp, Homo sapiens
ccgggctttggtgacaca

SEQ ID NO: 79796 - DNA, 22 bp, Homo sapiens
aacccacaaaggatttcagctc

SEQ ID NO: 79797 - DNA, 22 bp, Homo sapiens
ggctccctgcaacctccgcctc

SEQ ID NO: 79798 - DNA, 22 bp, Homo sapiens
cactgcccaccaagtggctggt

SEQ ID NO: 79799 - DNA, 22 bp, Homo sapiens
ctgaagaggctccgcccacaag

SEQ ID NO: 79800 - DNA, 22 bp, Homo sapiens
tagtatagattgaagcagatca

SEQ ID NO: 79801 - DNA, 16 bp, Homo sapiens
gaggagcccctctgcc

SEQ ID NO: 79802 - DNA, 22 bp, Homo sapiens
ctaggctggagtgcagtggcac

SEQ ID NO: 79803 - DNA, 22 bp, Homo sapiens
agtggctgagtgactgtgactc

SEQ ID NO: 79804 - DNA, 22 bp, Homo sapiens
tactgtactgcagttctgcaaa

SEQ ID NO: 79805 - DNA, 22 bp, Homo sapiens
aggtcaccatggcatgctccac

SEQ ID NO: 79806 - DNA, 22 bp, Homo sapiens
gcccggcagtcacacacccagg

SEQ ID NO: 79807 - DNA, 22 bp, Homo sapiens
atgatccaaagccacaggggca

SEQ ID NO: 79808 - DNA, 22 bp, Homo sapiens
ccacgcatccctccacagagag

SEQ ID NO: 79809 - DNA, 22 bp, Homo sapiens
gtatgtctatagtttttaaata

SEQ ID NO: 79810 - DNA, 22 bp, Homo sapiens
gtgggacaaggatgaagatatt

SEQ ID NO: 79811 - DNA, 22 bp, Homo sapiens
tgaaatgtgtaatgtggatgcc

SEQ ID NO: 79812 - DNA, 20 bp, Homo sapiens
tttcttgtcggctgttgctg

SEQ ID NO: 79813 - DNA, 22 bp, Homo sapiens
ctcgcatccaggataccctgag

SEQ ID NO: 79814 - DNA, 22 bp, Homo sapiens
ctggcaggtggaggttgcagtg

SEQ ID NO: 79815 - DNA, 22 bp, Homo sapiens
cattaaacaaccttgaatcaat

SEQ ID NO: 79816 - DNA, 22 bp, Homo sapiens
cgtctggcttctccacggtaaa

SEQ ID NO: 79817 - DNA, 22 bp, Homo sapiens
ggcaggactgatcagtgggatg

SEQ ID NO: 79818 - DNA, 22 bp, Homo sapiens
tccagctgttccatcagctctt

SEQ ID NO: 79819 - DNA, 22 bp, Homo sapiens
ggtgtagctctgtgtcccactg

SEQ ID NO: 79820 - DNA, 22 bp, Homo sapiens
ttcttctcagggtcccacatgg

SEQ ID NO: 79821 - DNA, 22 bp, Homo sapiens
cctgtggcgggggccagtgcct

SEQ ID NO: 79822 - DNA, 22 bp, Homo sapiens
aaagcagaggttgcagtgagct

SEQ ID NO: 79823 - DNA, 22 bp, Homo sapiens
acccgggaggcaggagtcatag

SEQ ID NO: 79824 - DNA, 22 bp, Homo sapiens
aagatattcaaagatttattag

SEQ ID NO: 79825 - DNA, 22 bp, Homo sapiens
gaacttggcctgtctgtctggc

SEQ ID NO: 79826 - DNA, 22 bp, Homo sapiens
acaaacagagttgaaaaatagg

SEQ ID NO: 79827 - DNA, 22 bp, Homo sapiens
ttaaatattatgttgtctgcaa

SEQ ID NO: 79828 - DNA, 22 bp, Homo sapiens
cttggggaagccactgatccct

SEQ ID NO: 79829 - DNA, 22 bp, Homo sapiens
ctgggaggcggagcttgcagtg

SEQ ID NO: 79830 - DNA, 22 bp, Homo sapiens
agcctggcggtcgtcggtcagg

SEQ ID NO: 79831 - DNA, 22 bp, Homo sapiens
ccagggtggcgtagatgctggg

SEQ ID NO: 79832 - DNA, 22 bp, Homo sapiens
tcagtgcacccaattctctcca

SEQ ID NO: 79833 - DNA, 22 bp, Homo sapiens
tctcgacagcctggcacagtgg

SEQ ID NO: 79834 - DNA, 22 bp, Homo sapiens
atacataattacttccgatgtt

SEQ ID NO: 79835 - DNA, 22 bp, Homo sapiens
aaagattaaatcaaattggtca

SEQ ID NO: 79836 - DNA, 22 bp, Homo sapiens
tggagaagattggtcaccattc

SEQ ID NO: 79837 - DNA, 17 bp, Homo sapiens
cgggcatggagggcagg

SEQ ID NO: 79838 - DNA, 22 bp, Homo sapiens
ggaggtagcctcaaaagcagct

SEQ ID NO: 79839 - DNA, 22 bp, Homo sapiens
gctgccaatccagctgtgggag

SEQ ID NO: 79840 - DNA, 17 bp, Homo sapiens
catccgtgagctcggca

SEQ ID NO: 79841 - DNA, 22 bp, Homo sapiens
actgcgctccagcctgggtgac

SEQ ID NO: 79842 - DNA, 22 bp, Homo sapiens
agtccaggcattccagccattc

SEQ ID NO: 79843 - DNA, 22 bp, Homo sapiens
ttccatttggagctcgcagcct

SEQ ID NO: 79844 - DNA, 21 bp, Homo sapiens
tctctttctggaagcttccct

SEQ ID NO: 79845 - DNA, 22 bp, Homo sapiens
tgctgctcagaacccctgggct

SEQ ID NO: 79846 - DNA, 22 bp, Homo sapiens
cccagcaaggccagctcagggc

SEQ ID NO: 79847 - DNA, 22 bp, Homo sapiens
aggaaataggaccagacaaagc

SEQ ID NO: 79848 - DNA, 22 bp, Homo sapiens
agagtggagagaaacaactctg

SEQ ID NO: 79849 - DNA, 22 bp, Homo sapiens
ggctcctgggggtgctcctgcc

SEQ ID NO: 79850 - DNA, 22 bp, Homo sapiens
gagggaaaggttaatacatgat

SEQ ID NO: 79851 - DNA, 22 bp, Homo sapiens
gtaggccatggtggttgtctct

SEQ ID NO: 79852 - DNA, 22 bp, Homo sapiens
actttaaaactgatcatcagag

SEQ ID NO: 79853 - DNA, 22 bp, Homo sapiens
agaggaagtaatcaggacctgc

SEQ ID NO: 79854 - DNA, 22 bp, Homo sapiens
accattgccccctagtgtctgt

SEQ ID NO: 79855 - DNA, 22 bp, Homo sapiens
accccagaggcggaggctgcag

SEQ ID NO: 79856 - DNA, 22 bp, Homo sapiens
cggatcctcagtcgtgcgggag

SEQ ID NO: 79857 - DNA, 22 bp, Homo sapiens
agagcggggatagttaatattc

SEQ ID NO: 79858 - DNA, 22 bp, Homo sapiens
atctggttttggctgtgtccct

SEQ ID NO: 79859 - DNA, 22 bp, Homo sapiens
gcaggtctatcaggctgcaggt

SEQ ID NO: 79860 - DNA, 22 bp, Homo sapiens
atacttctttagcatattgaac

SEQ ID NO: 79861 - DNA, 22 bp, Homo sapiens
agccttacataaacagccttat

SEQ ID NO: 79862 - DNA, 22 bp, Homo sapiens
cccaggaggcagagcttgcagt

SEQ ID NO: 79863 - DNA, 22 bp, Homo sapiens
ggttctctaactttgactggag

SEQ ID NO: 79864 - DNA, 22 bp, Homo sapiens
aagcccggttgggaacgtggtg

SEQ ID NO: 79865 - DNA, 22 bp, Homo sapiens
gcacagccacgtaatgtggtca

SEQ ID NO: 79866 - DNA, 22 bp, Homo sapiens
aggggttggacataagacagaa

SEQ ID NO: 79867 - DNA, 22 bp, Homo sapiens
ggttggtaactccctgtgcagt

SEQ ID NO: 79868 - DNA, 22 bp, Homo sapiens
gcctcaaatgtggagcactatt

SEQ ID NO: 79869 - DNA, 22 bp, Homo sapiens
gttggagtgcagcttgtgcgat

SEQ ID NO: 79870 - DNA, 22 bp, Homo sapiens
ttttcatttttgtagatgcaag

SEQ ID NO: 79871 - DNA, 22 bp, Homo sapiens
ttctaattaaatctacgctagg

SEQ ID NO: 79872 - DNA, 22 bp, Homo sapiens
ccactattactgtgtggcagtc

SEQ ID NO: 79873 - DNA, 22 bp, Homo sapiens
agatcggctttgcagacctcat

SEQ ID NO: 79874 - DNA, 22 bp, Homo sapiens
ggctcaatgcaacttctgcctc

SEQ ID NO: 79875 - DNA, 22 bp, Homo sapiens
ctgtccagcgactaggggatgg

SEQ ID NO: 79876 - DNA, 22 bp, Homo sapiens
cagcctttgggtcagaagattc

SEQ ID NO: 79877 - DNA, 22 bp, Homo sapiens
cccggacagaggggcagagtgt

SEQ ID NO: 79878 - DNA, 22 bp, Homo sapiens
gaatatcccgctatgcaaagta

SEQ ID NO: 79879 - DNA, 22 bp, Homo sapiens
ggccatttgctttattcacttc

SEQ ID NO: 79880 - DNA, 22 bp, Homo sapiens
tcaccaggctggagtgcagtgg

SEQ ID NO: 79881 - DNA, 22 bp, Homo sapiens
tcactggaaagacagcactctt

SEQ ID NO: 79882 - DNA, 22 bp, Homo sapiens
catgatctggtcctactgtggg

SEQ ID NO: 79883 - DNA, 22 bp, Homo sapiens
ttatttttaaaagttcacacag

SEQ ID NO: 79884 - DNA, 22 bp, Homo sapiens
gcccaggctggagttcagtggt

SEQ ID NO: 79885 - DNA, 22 bp, Homo sapiens
tgacagtattgatggcaggatt

SEQ ID NO: 79886 - DNA, 22 bp, Homo sapiens
cagcctgtcggctccttcattc

SEQ ID NO: 79887 - DNA, 22 bp, Homo sapiens
aatggaatacctaggtggccca

SEQ ID NO: 79888 - DNA, 22 bp, Homo sapiens
catagcggtattccacgtggtt

SEQ ID NO: 79889 - DNA, 22 bp, Homo sapiens
acactggttggttgaatttact

SEQ ID NO: 79890 - DNA, 22 bp, Homo sapiens
tctgcaacagtgccctgtaaat

SEQ ID NO: 79891 - DNA, 22 bp, Homo sapiens
caccagcagcggtgtgagggtg

SEQ ID NO: 79892 - DNA, 22 bp, Homo sapiens
tcaggcagtagaattgcttgaa

SEQ ID NO: 79893 - DNA, 22 bp, Homo sapiens
aggctctgtcaggcggagcagc

SEQ ID NO: 79894 - DNA, 22 bp, Homo sapiens
tggttcagttgcacaggctgtt

SEQ ID NO: 79895 - DNA, 22 bp, Homo sapiens
gggacatctttctagtcagggt

SEQ ID NO: 79896 - DNA, 22 bp, Homo sapiens
cccacaggtgtgagcttgctgg

SEQ ID NO: 79897 - DNA, 22 bp, Homo sapiens
gtcggccacgcaggtgcggtag

SEQ ID NO: 79898 - DNA, 22 bp, Homo sapiens
aatctgttgatgcaaacctccc

SEQ ID NO: 79899 - DNA, 22 bp, Homo sapiens
tgactcaagagcctgactcatc

SEQ ID NO: 79900 - DNA, 22 bp, Homo sapiens
agtggagacaggacagtcgata

SEQ ID NO: 79901 - DNA, 22 bp, Homo sapiens
cattccttaacgtggggagtct

SEQ ID NO: 79902 - DNA, 22 bp, Homo sapiens
tgttatcctcagctcacctcta

SEQ ID NO: 79903 - DNA, 22 bp, Homo sapiens
gatggaggagatggcagggtgc

SEQ ID NO: 79904 - DNA, 22 bp, Homo sapiens
ctgaacttattgagtgcttgct

SEQ ID NO: 79905 - DNA, 19 bp, Homo sapiens
ggcttcgaggctggggaag

SEQ ID NO: 79906 - DNA, 22 bp, Homo sapiens
aggaaaatggaccagagttgtt

SEQ ID NO: 79907 - DNA, 22 bp, Homo sapiens
gtctttatttgagattgtcatt

SEQ ID NO: 79908 - DNA, 22 bp, Homo sapiens
aggagatggagctcagtgggca

SEQ ID NO: 79909 - DNA, 22 bp, Homo sapiens
gggaggttctgttcgcacttga

SEQ ID NO: 79910 - DNA, 22 bp, Homo sapiens
gaacttgcagctgtgatttgtg

SEQ ID NO: 79911 - DNA, 22 bp, Homo sapiens
gggccggagctgggtcccgcgc

SEQ ID NO: 79912 - DNA, 22 bp, Homo sapiens
cttctcggccgtgtggatgcgc

SEQ ID NO: 79913 - DNA, 22 bp, Homo sapiens
ttggcttttatgcagcttaggt

SEQ ID NO: 79914 - DNA, 22 bp, Homo sapiens
atgggctgtccattgctggctg

SEQ ID NO: 79915 - DNA, 19 bp, Homo sapiens
ttgacgttgtggaattaac

SEQ ID NO: 79916 - DNA, 23 bp, Homo sapiens
tgacctcatgatccgcccacctc

SEQ ID NO: 79917 - DNA, 22 bp, Homo sapiens
cttctttcaagaatggattagg

SEQ ID NO: 79918 - DNA, 22 bp, Homo sapiens
gctgacccctacaggttgtgtt

SEQ ID NO: 79919 - DNA, 22 bp, Homo sapiens
agggttgcaccatgttggtcag

SEQ ID NO: 79920 - DNA, 22 bp, Homo sapiens
agggagcaaaggtttcagggtt

SEQ ID NO: 79921 - DNA, 22 bp, Homo sapiens
cttgcctacttgtcaaccagca

SEQ ID NO: 79922 - DNA, 22 bp, Homo sapiens
ttgtgaatagtgctgcagtaaa

SEQ ID NO: 79923 - DNA, 22 bp, Homo sapiens
tcattctcacactcgtcaatgt

SEQ ID NO: 79924 - DNA, 22 bp, Homo sapiens
ttagtttataattcatttctgt

SEQ ID NO: 79925 - DNA, 22 bp, Homo sapiens
cttctggcgttggaggtctgag

SEQ ID NO: 79926 - DNA, 22 bp, Homo sapiens
ggaggtggagctggaagttcca

SEQ ID NO: 79927 - DNA, 22 bp, Homo sapiens
ggaagaaaggtggacaacaggt

SEQ ID NO: 79928 - DNA, 22 bp, Homo sapiens
agatttatgtggtcacactcag

SEQ ID NO: 79929 - DNA, 22 bp, Homo sapiens
agcactgtgagcaccagcacgc

SEQ ID NO: 79930 - DNA, 22 bp, Homo sapiens
tcagtgatttctggggtgaggg

SEQ ID NO: 79931 - DNA, 22 bp, Homo sapiens
agaagccaccagctgaggaaga

SEQ ID NO: 79932 - DNA, 22 bp, Homo sapiens
accgggctaatttttgtatctt

SEQ ID NO: 79933 - DNA, 22 bp, Homo sapiens
ccagaagcagagcctgaggcag

SEQ ID NO: 79934 - DNA, 22 bp, Homo sapiens
gtaatctcagctacttgggagg

SEQ ID NO: 79935 - DNA, 23 bp, Homo sapiens
gacattggctgtctgatgcaggg

SEQ ID NO: 79936 - DNA, 19 bp, Homo sapiens
catggtgaaaccccgtctc

SEQ ID NO: 79937 - DNA, 22 bp, Homo sapiens
cactgcagcctctgcctctcag

SEQ ID NO: 79938 - DNA, 22 bp, Homo sapiens
acacccaggctggcgtgcagtg

SEQ ID NO: 79939 - DNA, 19 bp, Homo sapiens
ggagccgccgcccttcatt

SEQ ID NO: 79940 - DNA, 22 bp, Homo sapiens
tctcttggagagtccatcatca

SEQ ID NO: 79941 - DNA, 22 bp, Homo sapiens
ccctgctgtgtagcggaggaac

SEQ ID NO: 79942 - DNA, 22 bp, Homo sapiens
tttgcttgttcaagatttctgt

SEQ ID NO: 79943 - DNA, 22 bp, Homo sapiens
gagctctgactgctgggtgaca

SEQ ID NO: 79944 - DNA, 22 bp, Homo sapiens
cggctgggttcggctgcaggcc

SEQ ID NO: 79945 - DNA, 22 bp, Homo sapiens
actctttgtctgttgccgctta

SEQ ID NO: 79946 - DNA, 22 bp, Homo sapiens
cttagagatgggttttacttag

SEQ ID NO: 79947 - DNA, 21 bp, Homo sapiens
gctgctcgagatccagtgctt

SEQ ID NO: 79948 - DNA, 22 bp, Homo sapiens
ggagtgctttgaagccttcatt

SEQ ID NO: 79949 - DNA, 19 bp, Homo sapiens
acccagcccaggagtggca

SEQ ID NO: 79950 - DNA, 22 bp, Homo sapiens
aaaccgggtccagatcttcagg

SEQ ID NO: 79951 - DNA, 22 bp, Homo sapiens
tactgcgccttcaccaagcggc

SEQ ID NO: 79952 - DNA, 22 bp, Homo sapiens
agcccggcttccccggttgcta

SEQ ID NO: 79953 - DNA, 18 bp, Homo sapiens
catgggtgacaggtggat

SEQ ID NO: 79954 - DNA, 22 bp, Homo sapiens
gctcgcgccgcaccggtccacc

SEQ ID NO: 79955 - DNA, 22 bp, Homo sapiens
atggggggatgaaggagtccaa

SEQ ID NO: 79956 - DNA, 22 bp, Homo sapiens
ctccagttggccccagttggtt

SEQ ID NO: 79957 - DNA, 22 bp, Homo sapiens
aagaactgagtacgttaataaa

SEQ ID NO: 79958 - DNA, 22 bp, Homo sapiens
aggaggggttctcgggtgctga

SEQ ID NO: 79959 - DNA, 22 bp, Homo sapiens
cttccgtgtcagttccaggtgg

SEQ ID NO: 79960 - DNA, 22 bp, Homo sapiens
ccctggaggttgaggctgcagt

SEQ ID NO: 79961 - DNA, 22 bp, Homo sapiens
tctgtgttgagaaggatcatga

SEQ ID NO: 79962 - DNA, 22 bp, Homo sapiens
ttaccaaatgaaatagagattt

SEQ ID NO: 79963 - DNA, 22 bp, Homo sapiens
tgaatgtgatgctaaacatatg

SEQ ID NO: 79964 - DNA, 22 bp, Homo sapiens
cgctccttgagcgtgtcggcct

SEQ ID NO: 79965 - DNA, 22 bp, Homo sapiens
caggctggagtgcagtggcgct

SEQ ID NO: 79966 - DNA, 21 bp, Homo sapiens
ctgtttgcaagcctatgtgtc

SEQ ID NO: 79967 - DNA, 22 bp, Homo sapiens
agcacctgtcaagtccaggctg

SEQ ID NO: 79968 - DNA, 22 bp, Homo sapiens
tctgctttcttactaaaaatga

SEQ ID NO: 79969 - DNA, 22 bp, Homo sapiens
attgcacttcagcctgggtgac

SEQ ID NO: 79970 - DNA, 22 bp, Homo sapiens
ataaaatttgctactgttaaat

SEQ ID NO: 79971 - DNA, 22 bp, Homo sapiens
catctgctgttccttggactca

SEQ ID NO: 79972 - DNA, 22 bp, Homo sapiens
atctggttcttcttaggcatca

SEQ ID NO: 79973 - DNA, 22 bp, Homo sapiens
ttgcccaggctggagtgcagta

SEQ ID NO: 79974 - DNA, 22 bp, Homo sapiens
acattaaacttgcttggctgta

SEQ ID NO: 79975 - DNA, 22 bp, Homo sapiens
gcccagtggtaaaagcaggcct

SEQ ID NO: 79976 - DNA, 22 bp, Homo sapiens
tgggaagggtcaacagctggaa

SEQ ID NO: 79977 - DNA, 22 bp, Homo sapiens
tgtctttgttattgtggacagg

SEQ ID NO: 79978 - DNA, 22 bp, Homo sapiens
ggaggcggaggttgcagtgagc

SEQ ID NO: 79979 - DNA, 22 bp, Homo sapiens
ttctagtgtccttggacttgct

SEQ ID NO: 79980 - DNA, 22 bp, Homo sapiens
ggctgacttttatgcacactaa

SEQ ID NO: 79981 - DNA, 22 bp, Homo sapiens
ttgaaaagttttgaaacactct

SEQ ID NO: 79982 - DNA, 22 bp, Homo sapiens
agtggccctggagtgactcgta

SEQ ID NO: 79983 - DNA, 22 bp, Homo sapiens
ccagtgtgcaatctctggctta

SEQ ID NO: 79984 - DNA, 22 bp, Homo sapiens
agcccttagtacatttctcaag

SEQ ID NO: 79985 - DNA, 22 bp, Homo sapiens
tgagctgtgtcttggtgagagt

SEQ ID NO: 79986 - DNA, 22 bp, Homo sapiens
gaagattgaaggctgggaatta

SEQ ID NO: 79987 - DNA, 18 bp, Homo sapiens
gatatggaaggccatgcc

SEQ ID NO: 79988 - DNA, 22 bp, Homo sapiens
cccaggaggtggaggctgcagt

SEQ ID NO: 79989 - DNA, 22 bp, Homo sapiens
agctggtgtgccagttccagtt

SEQ ID NO: 79990 - DNA, 22 bp, Homo sapiens
tgctgctgaggctaaagtatag

SEQ ID NO: 79991 - DNA, 22 bp, Homo sapiens
tcaggagtgccagtaccttttg

SEQ ID NO: 79992 - DNA, 22 bp, Homo sapiens
ggaggcccagaaggaagcccag

SEQ ID NO: 79993 - DNA, 22 bp, Homo sapiens
ctgggaggcggaggttgtagtg

SEQ ID NO: 79994 - DNA, 22 bp, Homo sapiens
ttcgactctgtgcctgaagagc

SEQ ID NO: 79995 - DNA, 22 bp, Homo sapiens
gggaagtgatggagccaggatt

SEQ ID NO: 79996 - DNA, 22 bp, Homo sapiens
tgcccaggctggagtgcagtgg

SEQ ID NO: 79997 - DNA, 21 bp, Homo sapiens
tactgtagccttgcactgtag

SEQ ID NO: 79998 - DNA, 22 bp, Homo sapiens
atgtcactgttgttattgttat

SEQ ID NO: 79999 - DNA, 22 bp, Homo sapiens
agccacatggacctgatgctag

SEQ ID NO: 80000 - DNA, 22 bp, Homo sapiens
ttggatccatctcaggcatagg

SEQ ID NO: 80001 - DNA, 22 bp, Homo sapiens
gggccatgagaggttcatcaac

SEQ ID NO: 80002 - DNA, 21 bp, Homo sapiens
gttcttgcaggatttccttcc

SEQ ID NO: 80003 - DNA, 22 bp, Homo sapiens
aatgagggagtggggcttgtcc

SEQ ID NO: 80004 - DNA, 22 bp, Homo sapiens
agcataagttggtacagccact

SEQ ID NO: 80005 - DNA, 22 bp, Homo sapiens
tcacagctctgtcaattttata

SEQ ID NO: 80006 - DNA, 20 bp, Homo sapiens
ggggaagtcactgcagtcag

SEQ ID NO: 80007 - DNA, 22 bp, Homo sapiens
ggtcagccttggatttggtagc

SEQ ID NO: 80008 - DNA, 22 bp, Homo sapiens
agggctggagccacagctggga

SEQ ID NO: 80009 - DNA, 22 bp, Homo sapiens
caggctgatcagggctgggatg

SEQ ID NO: 80010 - DNA, 22 bp, Homo sapiens
ttctttcagaacacaagtgatt

SEQ ID NO: 80011 - DNA, 22 bp, Homo sapiens
gggcactcctctggtccagccc

SEQ ID NO: 80012 - DNA, 22 bp, Homo sapiens
gatgatcatctgtaaagttaga

SEQ ID NO: 80013 - DNA, 22 bp, Homo sapiens
taggttttcctaaaattctggt

SEQ ID NO: 80014 - DNA, 22 bp, Homo sapiens
gggtaaatctcttttcatggct

SEQ ID NO: 80015 - DNA, 22 bp, Homo sapiens
tcaaaccagccttgcatcccag

SEQ ID NO: 80016 - DNA, 22 bp, Homo sapiens
caggaaagggatgggctgccac

SEQ ID NO: 80017 - DNA, 22 bp, Homo sapiens
ggctcatatcccggccatcatt

SEQ ID NO: 80018 - DNA, 22 bp, Homo sapiens
tgttgatttgtgggctgcaaaa

SEQ ID NO: 80019 - DNA, 19 bp, Homo sapiens
gatgctcattcaggtggaa

SEQ ID NO: 80020 - DNA, 22 bp, Homo sapiens
aatgtgagccaatgcccgtggg

SEQ ID NO: 80021 - DNA, 22 bp, Homo sapiens
ttccatttggcacttcactgag

SEQ ID NO: 80022 - DNA, 18 bp, Homo sapiens
gcagctagccaggggggc

SEQ ID NO: 80023 - DNA, 22 bp, Homo sapiens
tccaagatctacagcagtttag

SEQ ID NO: 80024 - DNA, 22 bp, Homo sapiens
ccctttagcccctgcagagact

SEQ ID NO: 80025 - DNA, 22 bp, Homo sapiens
ggccgtgctccaaagtcatcgt

SEQ ID NO: 80026 - DNA, 22 bp, Homo sapiens
tcaggaggtccgcccgggaggg

SEQ ID NO: 80027 - DNA, 22 bp, Homo sapiens
gcaaatacatgttgagcaccta

SEQ ID NO: 80028 - DNA, 22 bp, Homo sapiens
ccccatgaagtagggtctctga

SEQ ID NO: 80029 - DNA, 22 bp, Homo sapiens
tcttgggggactttggcatgga

SEQ ID NO: 80030 - DNA, 22 bp, Homo sapiens
cttatagtatgatgttgagaat

SEQ ID NO: 80031 - DNA, 22 bp, Homo sapiens
gtagaccatttatctggggagt

SEQ ID NO: 80032 - DNA, 22 bp, Homo sapiens
ggtggctgcaatggctaacttc

SEQ ID NO: 80033 - DNA, 22 bp, Homo sapiens
agaaatatgctgattagatgaa

SEQ ID NO: 80034 - DNA, 22 bp, Homo sapiens
ttgctcagtggcagggctggta

SEQ ID NO: 80035 - DNA, 23 bp, Homo sapiens
ttggggacaaacatgctactttc

SEQ ID NO: 80036 - DNA, 22 bp, Homo sapiens
atgcaggcagacactgtgggca

SEQ ID NO: 80037 - DNA, 22 bp, Homo sapiens
ctgtggctctttagttgagcac

SEQ ID NO: 80038 - DNA, 22 bp, Homo sapiens
gccccagcctcccgagtagctg

SEQ ID NO: 80039 - DNA, 20 bp, Homo sapiens
gccactgggcaccagcaggg

SEQ ID NO: 80040 - DNA, 22 bp, Homo sapiens
tggacaacatagtgagacctca

SEQ ID NO: 80041 - DNA, 20 bp, Homo sapiens
tttgcgaggccaaggcgggc

SEQ ID NO: 80042 - DNA, 23 bp, Homo sapiens
ggaagctcacgtagtcctgcact

SEQ ID NO: 80043 - DNA, 22 bp, Homo sapiens
gttctgggagatcttgagcttc

SEQ ID NO: 80044 - DNA, 22 bp, Homo sapiens
ctgctgagagccccagctgaga

SEQ ID NO: 80045 - DNA, 22 bp, Homo sapiens
cggggccctggggctgaaggtc

SEQ ID NO: 80046 - DNA, 22 bp, Homo sapiens
cggggttcatccatgctgtggc

SEQ ID NO: 80047 - DNA, 22 bp, Homo sapiens
tctgcaggaagctggcggctga

SEQ ID NO: 80048 - DNA, 18 bp, Homo sapiens
ggcgggtgttttattcac

SEQ ID NO: 80049 - DNA, 22 bp, Homo sapiens
agtacccttttcactgtcacaa

SEQ ID NO: 80050 - DNA, 22 bp, Homo sapiens
ggaaaggcctgggtgtcctggg

SEQ ID NO: 80051 - DNA, 22 bp, Homo sapiens
cccaggaattggaggctgcagt

SEQ ID NO: 80052 - DNA, 18 bp, Homo sapiens
cagggctgtggggtcact

SEQ ID NO: 80053 - DNA, 22 bp, Homo sapiens
cttctcttcctttgtcaactga

SEQ ID NO: 80054 - DNA, 22 bp, Homo sapiens
cgactgtcatacacaagacatg

SEQ ID NO: 80055 - DNA, 22 bp, Homo sapiens
attaggtcatggggaggcccta

SEQ ID NO: 80056 - DNA, 22 bp, Homo sapiens
gatccgaatcattgctctttta

SEQ ID NO: 80057 - DNA, 22 bp, Homo sapiens
aaggtatatctgatccatgagg

SEQ ID NO: 80058 - DNA, 22 bp, Homo sapiens
tcaccagatctctctgtaatgg

SEQ ID NO: 80059 - DNA, 22 bp, Homo sapiens
ctggctctcaggctggtcccca

SEQ ID NO: 80060 - DNA, 22 bp, Homo sapiens
atcctccagctcctgcttctgc

SEQ ID NO: 80061 - DNA, 22 bp, Homo sapiens
cggaggttgaggctgcagtgag

SEQ ID NO: 80062 - DNA, 22 bp, Homo sapiens
ggctcactgcaaactgtgcctc

SEQ ID NO: 80063 - DNA, 23 bp, Homo sapiens
cagtctgcagcccacttgggcag

SEQ ID NO: 80064 - DNA, 22 bp, Homo sapiens
tcaggctcaggttaggggccaa

SEQ ID NO: 80065 - DNA, 19 bp, Homo sapiens
ggcatggggtccggggacc

SEQ ID NO: 80066 - DNA, 22 bp, Homo sapiens
atgattgaccatctgctgggct

SEQ ID NO: 80067 - DNA, 22 bp, Homo sapiens
ctgcagggagaggggacagcct

SEQ ID NO: 80068 - DNA, 22 bp, Homo sapiens
agctggtgctcggggagctggc

SEQ ID NO: 80069 - DNA, 22 bp, Homo sapiens
atagggcctaaaaagtattgct

SEQ ID NO: 80070 - DNA, 22 bp, Homo sapiens
cagcctggtccccggctcaccc

SEQ ID NO: 80071 - DNA, 22 bp, Homo sapiens
tcctcattcttggtgcatcaaa

SEQ ID NO: 80072 - DNA, 22 bp, Homo sapiens
taatggattaacgtccctgtcg

SEQ ID NO: 80073 - DNA, 22 bp, Homo sapiens
gctgtctcatacaaggccctgc

SEQ ID NO: 80074 - DNA, 22 bp, Homo sapiens
tgtcatagtgtggtagcagtgg

SEQ ID NO: 80075 - DNA, 22 bp, Homo sapiens
caggctgctgcctagaatgaca

SEQ ID NO: 80076 - DNA, 22 bp, Homo sapiens
aggacagagggaccagagccca

SEQ ID NO: 80077 - DNA, 22 bp, Homo sapiens
caggaagaccagggctgtggct

SEQ ID NO: 80078 - DNA, 22 bp, Homo sapiens
gggaagagggagctggaatgat

SEQ ID NO: 80079 - DNA, 22 bp, Homo sapiens
caatagtaaattacggaggaga

SEQ ID NO: 80080 - DNA, 22 bp, Homo sapiens
agtccaggactgtttcagctga

SEQ ID NO: 80081 - DNA, 22 bp, Homo sapiens
gaccctgtttctacaaataatt

SEQ ID NO: 80082 - DNA, 22 bp, Homo sapiens
cagccctcctaccctgccaggc

SEQ ID NO: 80083 - DNA, 22 bp, Homo sapiens
taagggttcagaatgcagtggt

SEQ ID NO: 80084 - DNA, 22 bp, Homo sapiens
ctgcagtatgagctacccaggt

SEQ ID NO: 80085 - DNA, 22 bp, Homo sapiens
gagagaagggggatatgagcct

SEQ ID NO: 80086 - DNA, 22 bp, Homo sapiens
gtcagtaggaacctagggtcaa

SEQ ID NO: 80087 - DNA, 22 bp, Homo sapiens
gggatctgggacaacaggtggt

SEQ ID NO: 80088 - DNA, 22 bp, Homo sapiens
gtgggggctggaaatcttgcca

SEQ ID NO: 80089 - DNA, 22 bp, Homo sapiens
taattataacagttacatctta

SEQ ID NO: 80090 - DNA, 22 bp, Homo sapiens
ttcagcttgctgactgcggcag

SEQ ID NO: 80091 - DNA, 23 bp, Homo sapiens
tgagctgggcctgcaggggtctc

SEQ ID NO: 80092 - DNA, 22 bp, Homo sapiens
ttggaagacaatgctgattctc

SEQ ID NO: 80093 - DNA, 22 bp, Homo sapiens
gggtggtggccagcagtgggca

SEQ ID NO: 80094 - DNA, 22 bp, Homo sapiens
cttgtcagccaattgtggattt

SEQ ID NO: 80095 - DNA, 22 bp, Homo sapiens
agccctcgtttctgcatcctgt

SEQ ID NO: 80096 - DNA, 22 bp, Homo sapiens
tagaatgtaaattccaagggca

SEQ ID NO: 80097 - DNA, 22 bp, Homo sapiens
attggccatttgcatgtattat

SEQ ID NO: 80098 - DNA, 22 bp, Homo sapiens
gtatagaaacccagaaagatag

SEQ ID NO: 80099 - DNA, 22 bp, Homo sapiens
atggccaggcacctctggctga

SEQ ID NO: 80100 - DNA, 22 bp, Homo sapiens
gcgagtgccgagagggcagggc

SEQ ID NO: 80101 - DNA, 22 bp, Homo sapiens
gctttgcccctttagtgggtgc

SEQ ID NO: 80102 - DNA, 22 bp, Homo sapiens
tttagattgtgacctcccccca

SEQ ID NO: 80103 - DNA, 22 bp, Homo sapiens
ccaggctgctgttggtgtccgc

SEQ ID NO: 80104 - DNA, 22 bp, Homo sapiens
ctgtggcgccgctgagagcaga

SEQ ID NO: 80105 - DNA, 22 bp, Homo sapiens
cgggcagcggcgtggccatggt

SEQ ID NO: 80106 - DNA, 22 bp, Homo sapiens
taatactgtatactgcaaattt

SEQ ID NO: 80107 - DNA, 22 bp, Homo sapiens
gaccttcttgctgtgtcctaac

SEQ ID NO: 80108 - DNA, 22 bp, Homo sapiens
tctttgctattgtgaatagtgc

SEQ ID NO: 80109 - DNA, 22 bp, Homo sapiens
atgaccagccgagataaacaga

SEQ ID NO: 80110 - DNA, 22 bp, Homo sapiens
gctgggacaacaggtgagcacc

SEQ ID NO: 80111 - DNA, 22 bp, Homo sapiens
cccagggagagcgcggaggcgg

SEQ ID NO: 80112 - DNA, 22 bp, Homo sapiens
aaagtaattgcagtttctgcca

SEQ ID NO: 80113 - DNA, 22 bp, Homo sapiens
agggaagaggaccagagtctct

SEQ ID NO: 80114 - DNA, 22 bp, Homo sapiens
atgccaggaacaaacagtggtg

SEQ ID NO: 80115 - DNA, 22 bp, Homo sapiens
ctccagattccgtttattcagg

SEQ ID NO: 80116 - DNA, 22 bp, Homo sapiens
ggaggaggggtgactgaatgct

SEQ ID NO: 80117 - DNA, 22 bp, Homo sapiens
gccataggcagcgtggccagca

SEQ ID NO: 80118 - DNA, 22 bp, Homo sapiens
aataaaatggtcagttttctca

SEQ ID NO: 80119 - DNA, 22 bp, Homo sapiens
tttctcttcactgtgtgcctca

SEQ ID NO: 80120 - DNA, 22 bp, Homo sapiens
tcactgcaacctctgcctcttg

SEQ ID NO: 80121 - DNA, 22 bp, Homo sapiens
acccaggagacggaggtgcagt

SEQ ID NO: 80122 - DNA, 22 bp, Homo sapiens
aatatgcactctgatttagcag

SEQ ID NO: 80123 - DNA, 22 bp, Homo sapiens
gaaccattgttgaaaagaatag

SEQ ID NO: 80124 - DNA, 22 bp, Homo sapiens
cgccgtcccctaggaaagagct

SEQ ID NO: 80125 - DNA, 22 bp, Homo sapiens
ctgggaggcagaggttgtagtg

SEQ ID NO: 80126 - DNA, 22 bp, Homo sapiens
cttatttgcccatgtttcttta

SEQ ID NO: 80127 - DNA, 22 bp, Homo sapiens
tagagctggccgggacagctgg

SEQ ID NO: 80128 - DNA, 22 bp, Homo sapiens
gaagagctgacagtgtcatcct

SEQ ID NO: 80129 - DNA, 22 bp, Homo sapiens
gtgctccctccttcctcaagga

SEQ ID NO: 80130 - DNA, 22 bp, Homo sapiens
tggcacgacaattggcaccaat

SEQ ID NO: 80131 - DNA, 22 bp, Homo sapiens
ctagggtcaggggcctgcgtcg

SEQ ID NO: 80132 - DNA, 21 bp, Homo sapiens
ctggccactgcacctcttcct

SEQ ID NO: 80133 - DNA, 22 bp, Homo sapiens
tttggtaagtacccacctgggt

SEQ ID NO: 80134 - DNA, 22 bp, Homo sapiens
ccaggctagaaactgaggcaca

SEQ ID NO: 80135 - DNA, 22 bp, Homo sapiens
ctggtgggagataattgaatca

SEQ ID NO: 80136 - DNA, 21 bp, Homo sapiens
aaactgaccttgcctgagaca

SEQ ID NO: 80137 - DNA, 22 bp, Homo sapiens
tctggtgtcagtattctttgaa

SEQ ID NO: 80138 - DNA, 22 bp, Homo sapiens
atgaggcaggtggaggctgcca

SEQ ID NO: 80139 - DNA, 22 bp, Homo sapiens
gggcagatcacctgaggtcagg

SEQ ID NO: 80140 - DNA, 22 bp, Homo sapiens
ctcagctgcagcctggctggca

SEQ ID NO: 80141 - DNA, 22 bp, Homo sapiens
ctgggatccacgggctcccaag

SEQ ID NO: 80142 - DNA, 23 bp, Homo sapiens
acctgtctgcctcccaccatcaa

SEQ ID NO: 80143 - DNA, 19 bp, Homo sapiens
gcagacaggtccagagagg

SEQ ID NO: 80144 - DNA, 22 bp, Homo sapiens
accccttggagtccgcgcccag

SEQ ID NO: 80145 - DNA, 22 bp, Homo sapiens
gagtttcttcatggtgcagagg

SEQ ID NO: 80146 - DNA, 22 bp, Homo sapiens
gcctgcagggcctgggcctacc

SEQ ID NO: 80147 - DNA, 22 bp, Homo sapiens
gcaccgagaaggaagcatgcct

SEQ ID NO: 80148 - DNA, 22 bp, Homo sapiens
gcaggaggttgagccaggactg

SEQ ID NO: 80149 - DNA, 22 bp, Homo sapiens
gtcccctgtccagggccagcca

SEQ ID NO: 80150 - DNA, 22 bp, Homo sapiens
gggtcgcttggagaggcttcct

SEQ ID NO: 80151 - DNA, 22 bp, Homo sapiens
atccccctgtatctggaagaat

SEQ ID NO: 80152 - DNA, 22 bp, Homo sapiens
gcccagtagttcaaggttgcag

SEQ ID NO: 80153 - DNA, 22 bp, Homo sapiens
gctcatgactgtaatcccagca

SEQ ID NO: 80154 - DNA, 22 bp, Homo sapiens
gggttcttatagtatcagagct

SEQ ID NO: 80155 - DNA, 22 bp, Homo sapiens
gccatgggcaaatgcagagctg

SEQ ID NO: 80156 - DNA, 22 bp, Homo sapiens
gtacactccccctgtgaagttg

SEQ ID NO: 80157 - DNA, 22 bp, Homo sapiens
tgagaaacttgccaagcatctc

SEQ ID NO: 80158 - DNA, 22 bp, Homo sapiens
gcccagagtttgaagatacagt

SEQ ID NO: 80159 - DNA, 22 bp, Homo sapiens
ctggctcctgtttaaccagctg

SEQ ID NO: 80160 - DNA, 22 bp, Homo sapiens
ggcttgaagggaggaaagcagg

SEQ ID NO: 80161 - DNA, 22 bp, Homo sapiens
tcggcgctggaacgcagtagct

SEQ ID NO: 80162 - DNA, 19 bp, Homo sapiens
ctctggagtcattgctccc

SEQ ID NO: 80163 - DNA, 22 bp, Homo sapiens
ggtgacctcacctggtcccacc

SEQ ID NO: 80164 - DNA, 18 bp, Homo sapiens
cagctgccagctcatgga

SEQ ID NO: 80165 - DNA, 22 bp, Homo sapiens
ggctgagtctgtgacccatgcg

SEQ ID NO: 80166 - DNA, 22 bp, Homo sapiens
tctaatccttgctacctgggtg

SEQ ID NO: 80167 - DNA, 22 bp, Homo sapiens
aaactcttggtcaacatgagga

SEQ ID NO: 80168 - DNA, 22 bp, Homo sapiens
agatggggtttcatcatgttgg

SEQ ID NO: 80169 - DNA, 22 bp, Homo sapiens
tcaatcacgtgttccatgttct

SEQ ID NO: 80170 - DNA, 22 bp, Homo sapiens
ttgcactccagcccgagcaaca

SEQ ID NO: 80171 - DNA, 22 bp, Homo sapiens
gcctccccaagcagcagggatt

SEQ ID NO: 80172 - DNA, 22 bp, Homo sapiens
ttcagacaggcagctgggctgg

SEQ ID NO: 80173 - DNA, 22 bp, Homo sapiens
tgatcaaaacattactccacca

SEQ ID NO: 80174 - DNA, 22 bp, Homo sapiens
gcccagctgcaccctggtgggt

SEQ ID NO: 80175 - DNA, 22 bp, Homo sapiens
cagtggccaacttcctgcctct

SEQ ID NO: 80176 - DNA, 22 bp, Homo sapiens
atatgcagtctcttgcccttct

SEQ ID NO: 80177 - DNA, 22 bp, Homo sapiens
gtcttgtcccagctctgccact

SEQ ID NO: 80178 - DNA, 22 bp, Homo sapiens
gggggctccaggcgagaatgtg

SEQ ID NO: 80179 - DNA, 22 bp, Homo sapiens
tggtagtcggcctcggtggctc

SEQ ID NO: 80180 - DNA, 22 bp, Homo sapiens
tatgacttttcccaattcagga

SEQ ID NO: 80181 - DNA, 22 bp, Homo sapiens
atatatttgagaatattcatga

SEQ ID NO: 80182 - DNA, 22 bp, Homo sapiens
tagtgccctcccctttgggata

SEQ ID NO: 80183 - DNA, 22 bp, Homo sapiens
gcagctattgtctcctgggccc

SEQ ID NO: 80184 - DNA, 22 bp, Homo sapiens
ggaaatgacttggtgcttcgtt

SEQ ID NO: 80185 - DNA, 22 bp, Homo sapiens
cactgcactccagcctgggcaa

SEQ ID NO: 80186 - DNA, 22 bp, Homo sapiens
tgcatattatgtgtatctgtct

SEQ ID NO: 80187 - DNA, 22 bp, Homo sapiens
tcaccggtgaccctcggctcgc

SEQ ID NO: 80188 - DNA, 22 bp, Homo sapiens
agctggaattacaggcacgcac

SEQ ID NO: 80189 - DNA, 22 bp, Homo sapiens
tccgggagctgaacgtcttgcg

SEQ ID NO: 80190 - DNA, 22 bp, Homo sapiens
gtgcaggacagcacatctcctg

SEQ ID NO: 80191 - DNA, 22 bp, Homo sapiens
aaggggaagagaccgcagagtc

SEQ ID NO: 80192 - DNA, 23 bp, Homo sapiens
ctggggctttcaaatctgggcag

SEQ ID NO: 80193 - DNA, 22 bp, Homo sapiens
ccatgtggtgggaaggagaatg

SEQ ID NO: 80194 - DNA, 22 bp, Homo sapiens
gccactgtggtcctcccatgat

SEQ ID NO: 80195 - DNA, 22 bp, Homo sapiens
gaggctgcagctatcagacatt

SEQ ID NO: 80196 - DNA, 20 bp, Homo sapiens
atggggtgagtgacgccctc

SEQ ID NO: 80197 - DNA, 22 bp, Homo sapiens
aagcagcacagcaatgactcta

SEQ ID NO: 80198 - DNA, 22 bp, Homo sapiens
agcagcagtgttctggaattct

SEQ ID NO: 80199 - DNA, 22 bp, Homo sapiens
cacctagggtttcgcctttctt

SEQ ID NO: 80200 - DNA, 22 bp, Homo sapiens
ctgaggggtcgtgggagcccag

SEQ ID NO: 80201 - DNA, 22 bp, Homo sapiens
ttaggctgttcttgtgttgtta

SEQ ID NO: 80202 - DNA, 22 bp, Homo sapiens
ttttttgttgggtagaacggaa

SEQ ID NO: 80203 - DNA, 22 bp, Homo sapiens
aaaagagcttggttgattttgc

SEQ ID NO: 80204 - DNA, 22 bp, Homo sapiens
tgtcacagtttgtactttatag

SEQ ID NO: 80205 - DNA, 22 bp, Homo sapiens
agtgcaatggtgccatcatagc

SEQ ID NO: 80206 - DNA, 22 bp, Homo sapiens
cccttggggtggaggttgcagt

SEQ ID NO: 80207 - DNA, 22 bp, Homo sapiens
cttgtccgaggagacgcggaag

SEQ ID NO: 80208 - DNA, 22 bp, Homo sapiens
aaagtaattgtggttcttgcca

SEQ ID NO: 80209 - DNA, 23 bp, Homo sapiens
tctgtgtctccacccaaatctca

SEQ ID NO: 80210 - DNA, 23 bp, Homo sapiens
cagagctggctcagagctgcctg

SEQ ID NO: 80211 - DNA, 22 bp, Homo sapiens
gacccggctccaggcccagcag

SEQ ID NO: 80212 - DNA, 22 bp, Homo sapiens
tgccctggctcttcttgttcca

SEQ ID NO: 80213 - DNA, 22 bp, Homo sapiens
gagatcggtaaagagcatgcac

SEQ ID NO: 80214 - DNA, 22 bp, Homo sapiens
tgggtgctctgcgaccgtaggg

SEQ ID NO: 80215 - DNA, 23 bp, Homo sapiens
ggcctcagtgatgatgggttaaa

SEQ ID NO: 80216 - DNA, 21 bp, Homo sapiens
tccctgagcccaaggggctcc

SEQ ID NO: 80217 - DNA, 22 bp, Homo sapiens
tgagaattacaaatgagtcaca

SEQ ID NO: 80218 - DNA, 22 bp, Homo sapiens
tctggcttccctctgttctggg

SEQ ID NO: 80219 - DNA, 22 bp, Homo sapiens
tgtgaatggacaattaaatcta

SEQ ID NO: 80220 - DNA, 22 bp, Homo sapiens
aagaagagaactggcatcctaa

SEQ ID NO: 80221 - DNA, 22 bp, Homo sapiens
gaaggaagtcattagtgcagac

SEQ ID NO: 80222 - DNA, 22 bp, Homo sapiens
ttgctcttgaaaattgatgctg

SEQ ID NO: 80223 - DNA, 22 bp, Homo sapiens
tttattggatatttacaagata

SEQ ID NO: 80224 - DNA, 22 bp, Homo sapiens
gctgctaagcgtttctgttcca

SEQ ID NO: 80225 - DNA, 22 bp, Homo sapiens
tcctggcaaagatgttggtgtt

SEQ ID NO: 80226 - DNA, 22 bp, Homo sapiens
agagagctctgctgctgcccag

SEQ ID NO: 80227 - DNA, 20 bp, Homo sapiens
acgtggccaccagtggctta

SEQ ID NO: 80228 - DNA, 22 bp, Homo sapiens
ctgggcaaattgtgccagctat

SEQ ID NO: 80229 - DNA, 22 bp, Homo sapiens
tccagggagagccgctgctcca

SEQ ID NO: 80230 - DNA, 21 bp, Homo sapiens
cagtggcacgatttcggctca

SEQ ID NO: 80231 - DNA, 22 bp, Homo sapiens
tcctcagcttttatttcacttg

SEQ ID NO: 80232 - DNA, 22 bp, Homo sapiens
gtgggccagcttttctcctggg

SEQ ID NO: 80233 - DNA, 22 bp, Homo sapiens
tagtaagttctcgcattgttat

SEQ ID NO: 80234 - DNA, 23 bp, Homo sapiens
aaataggagtatctggatcatga

SEQ ID NO: 80235 - DNA, 22 bp, Homo sapiens
aaagcttaccttttcagtcttt

SEQ ID NO: 80236 - DNA, 22 bp, Homo sapiens
agagtgcaaccgaaacaagcag

SEQ ID NO: 80237 - DNA, 22 bp, Homo sapiens
agcccaggagtttgaggctgtg

SEQ ID NO: 80238 - DNA, 17 bp, Homo sapiens
tgtagcttctccttctc

SEQ ID NO: 80239 - DNA, 22 bp, Homo sapiens
ggcagcttgtcctggaggatgg

SEQ ID NO: 80240 - DNA, 22 bp, Homo sapiens
tttgaggttagctagcagatca

SEQ ID NO: 80241 - DNA, 22 bp, Homo sapiens
cactgcactccagcctgggtga

SEQ ID NO: 80242 - DNA, 22 bp, Homo sapiens
atgagaaagttaatcatcatga

SEQ ID NO: 80243 - DNA, 22 bp, Homo sapiens
ctgcagtcatctgaagattttg

SEQ ID NO: 80244 - DNA, 19 bp, Homo sapiens
ctctgggcaagtcacttaa

SEQ ID NO: 80245 - DNA, 22 bp, Homo sapiens
ctggtctggctacccagcgaat

SEQ ID NO: 80246 - DNA, 22 bp, Homo sapiens
ggggaaggaaagttattagcag

SEQ ID NO: 80247 - DNA, 22 bp, Homo sapiens
atataatttttggttagctcaa

SEQ ID NO: 80248 - DNA, 22 bp, Homo sapiens
gtagctctgtttaaagttcttt

SEQ ID NO: 80249 - DNA, 22 bp, Homo sapiens
acgcccggtctccatagttttt

SEQ ID NO: 80250 - DNA, 22 bp, Homo sapiens
catataaatacaacatgtgtta

SEQ ID NO: 80251 - DNA, 22 bp, Homo sapiens
ttatgtctcaaccgggcacggt

SEQ ID NO: 80252 - DNA, 22 bp, Homo sapiens
atggggagctcaccacctgttt

SEQ ID NO: 80253 - DNA, 22 bp, Homo sapiens
ttggaaacgtcaccttttcctt

SEQ ID NO: 80254 - DNA, 23 bp, Homo sapiens
gtgtggccccagggcctcctcgc

SEQ ID NO: 80255 - DNA, 22 bp, Homo sapiens
agctcctgaaaatccagactgg

SEQ ID NO: 80256 - DNA, 22 bp, Homo sapiens
agcaacctgccagtcactcagt

SEQ ID NO: 80257 - DNA, 22 bp, Homo sapiens
agggccagcactcctggcagga

SEQ ID NO: 80258 - DNA, 22 bp, Homo sapiens
cagatctgtggtatctctattt

SEQ ID NO: 80259 - DNA, 22 bp, Homo sapiens
ctggcaggttatagagctgccc

SEQ ID NO: 80260 - DNA, 22 bp, Homo sapiens
caggcagggagctggaaaggat

SEQ ID NO: 80261 - DNA, 20 bp, Homo sapiens
aagacaccagtggcagcccc

SEQ ID NO: 80262 - DNA, 22 bp, Homo sapiens
atgcccaatgtcacaatttttg

SEQ ID NO: 80263 - DNA, 22 bp, Homo sapiens
cccgactagctgggattacagg

SEQ ID NO: 80264 - DNA, 22 bp, Homo sapiens
actcagtacatctggagttggc

SEQ ID NO: 80265 - DNA, 22 bp, Homo sapiens
gagcactgagctggaattggag

SEQ ID NO: 80266 - DNA, 22 bp, Homo sapiens
tgcccaggctggagtacagtgg

SEQ ID NO: 80267 - DNA, 22 bp, Homo sapiens
gcaggtctgttgattacagtca

SEQ ID NO: 80268 - DNA, 22 bp, Homo sapiens
tctcctggagcccagatgctgg

SEQ ID NO: 80269 - DNA, 22 bp, Homo sapiens
atgcggagccccaagcttgaag

SEQ ID NO: 80270 - DNA, 22 bp, Homo sapiens
ataatctttcttttccagatag

SEQ ID NO: 80271 - DNA, 22 bp, Homo sapiens
tgacccctatatcctgtttctt

SEQ ID NO: 80272 - DNA, 22 bp, Homo sapiens
ggccagcctggggctcccagac

SEQ ID NO: 80273 - DNA, 22 bp, Homo sapiens
tccgccaggactgagggcccat

SEQ ID NO: 80274 - DNA, 22 bp, Homo sapiens
atttattcctttatggctggag

SEQ ID NO: 80275 - DNA, 18 bp, Homo sapiens
tgtccctgcaaataacat

SEQ ID NO: 80276 - DNA, 22 bp, Homo sapiens
aagaaatgtgaatattgaatag

SEQ ID NO: 80277 - DNA, 22 bp, Homo sapiens
cgggcaaggcgagactaggccc

SEQ ID NO: 80278 - DNA, 22 bp, Homo sapiens
tgagcttccctcctgcactaca

SEQ ID NO: 80279 - DNA, 22 bp, Homo sapiens
cactgcacttcagcctgggtga

SEQ ID NO: 80280 - DNA, 22 bp, Homo sapiens
tagctaaaccagtatgtgaagg

SEQ ID NO: 80281 - DNA, 22 bp, Homo sapiens
cccagtttcaactttccagtgg

SEQ ID NO: 80282 - DNA, 22 bp, Homo sapiens
tgagcctgtcattattcagaga

SEQ ID NO: 80283 - DNA, 22 bp, Homo sapiens
atccccctcttggatggcggca

SEQ ID NO: 80284 - DNA, 22 bp, Homo sapiens
gaagccttgaactgcaaacccc

SEQ ID NO: 80285 - DNA, 22 bp, Homo sapiens
tttctcctcatgactggttgtg

SEQ ID NO: 80286 - DNA, 22 bp, Homo sapiens
tgcctaggctggaatgcagtgg

SEQ ID NO: 80287 - DNA, 22 bp, Homo sapiens
ggactgggaatcagggagatgc

SEQ ID NO: 80288 - DNA, 22 bp, Homo sapiens
tgccctctttctgtacagctcc

SEQ ID NO: 80289 - DNA, 22 bp, Homo sapiens
gtgctttgttaagtctgaaatt

SEQ ID NO: 80290 - DNA, 22 bp, Homo sapiens
tccaggattgtcagccagaagg

SEQ ID NO: 80291 - DNA, 22 bp, Homo sapiens
agcaagattgaggcttcctcag

SEQ ID NO: 80292 - DNA, 23 bp, Homo sapiens
ggggcctgcaccggtctgcgcgg

SEQ ID NO: 80293 - DNA, 22 bp, Homo sapiens
ggtgggagagcttgctttgatg

SEQ ID NO: 80294 - DNA, 22 bp, Homo sapiens
ataaaaactgacccatcctttg

SEQ ID NO: 80295 - DNA, 22 bp, Homo sapiens
attgaggtcccagaaaggactg

SEQ ID NO: 80296 - DNA, 22 bp, Homo sapiens
acccggaggcgggggatgcagt

SEQ ID NO: 80297 - DNA, 22 bp, Homo sapiens
tcttcccagaggaggtgccagc

SEQ ID NO: 80298 - DNA, 22 bp, Homo sapiens
gtgccactgataaatcagaatg

SEQ ID NO: 80299 - DNA, 22 bp, Homo sapiens
ttcttctttccaattacatggt

SEQ ID NO: 80300 - DNA, 22 bp, Homo sapiens
tgtccaggttagcttcaaacac

SEQ ID NO: 80301 - DNA, 22 bp, Homo sapiens
gctgatagactgaatgttggga

SEQ ID NO: 80302 - DNA, 22 bp, Homo sapiens
tgccagaatttgcttccaatgt

SEQ ID NO: 80303 - DNA, 22 bp, Homo sapiens
cagatagctgtaaataaatgga

SEQ ID NO: 80304 - DNA, 22 bp, Homo sapiens
ctctctgggcccagttggcacc

SEQ ID NO: 80305 - DNA, 22 bp, Homo sapiens
aaaagtaattgcggtttttgct

SEQ ID NO: 80306 - DNA, 22 bp, Homo sapiens
gggcccctgggaattctgtgat

SEQ ID NO: 80307 - DNA, 22 bp, Homo sapiens
gggtgctttggctcacgcctgt

SEQ ID NO: 80308 - DNA, 22 bp, Homo sapiens
ttaagtaacttgtccaaatgag

SEQ ID NO: 80309 - DNA, 22 bp, Homo sapiens
atacaaagtattgatcctgagt

SEQ ID NO: 80310 - DNA, 22 bp, Homo sapiens
gacctccgtgtacacctcccag

SEQ ID NO: 80311 - DNA, 21 bp, Homo sapiens
acgggaatgaacatggtggag

SEQ ID NO: 80312 - DNA, 22 bp, Homo sapiens
tgggggacaccagtctctctct

SEQ ID NO: 80313 - DNA, 22 bp, Homo sapiens
aaaggtcaaaatcgtgacattg

SEQ ID NO: 80314 - DNA, 22 bp, Homo sapiens
aagccaggttccatggaggagc

SEQ ID NO: 80315 - DNA, 22 bp, Homo sapiens
ctccaggctcgtccaagatcga

SEQ ID NO: 80316 - DNA, 22 bp, Homo sapiens
aatactgcctgtgaggtaactc

SEQ ID NO: 80317 - DNA, 20 bp, Homo sapiens
agcagagtgcccatcccgga

SEQ ID NO: 80318 - DNA, 22 bp, Homo sapiens
ttaattctgcctttcatgtaac

SEQ ID NO: 80319 - DNA, 22 bp, Homo sapiens
ggtgggaggactgtttgaggca

SEQ ID NO: 80320 - DNA, 19 bp, Homo sapiens
ccagagagctaggtacaga

SEQ ID NO: 80321 - DNA, 21 bp, Homo sapiens
taaacataaccttgtatggct

SEQ ID NO: 80322 - DNA, 18 bp, Homo sapiens
ttgcttcttttctctagg

SEQ ID NO: 80323 - DNA, 22 bp, Homo sapiens
ttcccacattctttacattcat

SEQ ID NO: 80324 - DNA, 22 bp, Homo sapiens
ttgtgctcctatgagaatctaa

SEQ ID NO: 80325 - DNA, 22 bp, Homo sapiens
ctctcgccagcggggctgcgct

SEQ ID NO: 80326 - DNA, 22 bp, Homo sapiens
gagctcatccccatggtccgtc

SEQ ID NO: 80327 - DNA, 22 bp, Homo sapiens
aagaggttgtctgtgatgagtt

SEQ ID NO: 80328 - DNA, 22 bp, Homo sapiens
tgaagctttaggatgggttcat

SEQ ID NO: 80329 - DNA, 22 bp, Homo sapiens
atggactgggaggtcatcttct

SEQ ID NO: 80330 - DNA, 22 bp, Homo sapiens
cagccagtgtgaccgaggagga

SEQ ID NO: 80331 - DNA, 16 bp, Homo sapiens
tgggtgggaggagcgg

SEQ ID NO: 80332 - DNA, 22 bp, Homo sapiens
attaccgctgagtcctatggag

SEQ ID NO: 80333 - DNA, 22 bp, Homo sapiens
atgaaaacggaccagagctatt

SEQ ID NO: 80334 - DNA, 22 bp, Homo sapiens
gccttattacctgcactttgaa

SEQ ID NO: 80335 - DNA, 22 bp, Homo sapiens
actgtgaacggactgaagccca

SEQ ID NO: 80336 - DNA, 22 bp, Homo sapiens
ggtggcagtagcactgggcctg

SEQ ID NO: 80337 - DNA, 22 bp, Homo sapiens
ctgctcttgagggactgcggtc

SEQ ID NO: 80338 - DNA, 23 bp, Homo sapiens
ctcaccaagcgccgccgctgtgt

SEQ ID NO: 80339 - DNA, 22 bp, Homo sapiens
tgatctcctgaccttgtaatcc

SEQ ID NO: 80340 - DNA, 22 bp, Homo sapiens
agagaagagtcttgtcaaatta

SEQ ID NO: 80341 - DNA, 22 bp, Homo sapiens
taggccacagagaggagatttc

SEQ ID NO: 80342 - DNA, 22 bp, Homo sapiens
aagaatgagctcaaagatctta

SEQ ID NO: 80343 - DNA, 22 bp, Homo sapiens
ccgggagcaggcgccaccgcca

SEQ ID NO: 80344 - DNA, 22 bp, Homo sapiens
agcaccgttcaaacccaggtta

SEQ ID NO: 80345 - DNA, 22 bp, Homo sapiens
gaggtggatgttgcagtgagct

SEQ ID NO: 80346 - DNA, 22 bp, Homo sapiens
agtgagagtattaatgtgaact

SEQ ID NO: 80347 - DNA, 22 bp, Homo sapiens
aggagagctggtgtctggaatc

SEQ ID NO: 80348 - DNA, 22 bp, Homo sapiens
gtggccccagggccctgtctgg

SEQ ID NO: 80349 - DNA, 22 bp, Homo sapiens
gctccgccacgcccactcctac

SEQ ID NO: 80350 - DNA, 22 bp, Homo sapiens
ggaggggatttagtagatgcta

SEQ ID NO: 80351 - DNA, 22 bp, Homo sapiens
tccagcccaggctggagtgtag

SEQ ID NO: 80352 - DNA, 23 bp, Homo sapiens
atgggccaagcaagacccatgac

SEQ ID NO: 80353 - DNA, 22 bp, Homo sapiens
gcaggcagatcacctgtcagga

SEQ ID NO: 80354 - DNA, 19 bp, Homo sapiens
ggggcctgtgatggtcaca

SEQ ID NO: 80355 - DNA, 22 bp, Homo sapiens
tggttcctcaagcgctggcggc

SEQ ID NO: 80356 - DNA, 22 bp, Homo sapiens
tctgaaaactccatgagctcgt

SEQ ID NO: 80357 - DNA, 22 bp, Homo sapiens
tgggaggccaaggcaggcggat

SEQ ID NO: 80358 - DNA, 22 bp, Homo sapiens
tgggaagctgcattttaacaag

SEQ ID NO: 80359 - DNA, 22 bp, Homo sapiens
aagccaatgctagcccacatgc

SEQ ID NO: 80360 - DNA, 22 bp, Homo sapiens
tttgagatggagtcttgctctg

SEQ ID NO: 80361 - DNA, 22 bp, Homo sapiens
tacttttagcctatttgattct

SEQ ID NO: 80362 - DNA, 22 bp, Homo sapiens
cttctgagatgttgttttacag

SEQ ID NO: 80363 - DNA, 22 bp, Homo sapiens
aagaggagaaaggctggctttg

SEQ ID NO: 80364 - DNA, 22 bp, Homo sapiens
ccaggaggcggaaggtacagtg

SEQ ID NO: 80365 - DNA, 22 bp, Homo sapiens
tttctgagaaattaaacacttt

SEQ ID NO: 80366 - DNA, 22 bp, Homo sapiens
ggagaagaggagctggaagcct

SEQ ID NO: 80367 - DNA, 22 bp, Homo sapiens
ctaggtgatccactgctctctt

SEQ ID NO: 80368 - DNA, 22 bp, Homo sapiens
cccagcaggtcggtgctgcctg

SEQ ID NO: 80369 - DNA, 22 bp, Homo sapiens
tgacaggaaacatgcagtgatt

SEQ ID NO: 80370 - DNA, 22 bp, Homo sapiens
gtgtgtcccttggaacctcagc

SEQ ID NO: 80371 - DNA, 22 bp, Homo sapiens
aagcagaatagaggcccttccc

SEQ ID NO: 80372 - DNA, 22 bp, Homo sapiens
gctgatggaaggacaggcgccg

SEQ ID NO: 80373 - DNA, 22 bp, Homo sapiens
cccagagcatgtgctgcctttg

SEQ ID NO: 80374 - DNA, 22 bp, Homo sapiens
gaggccaaggtgggcagatcac

SEQ ID NO: 80375 - DNA, 22 bp, Homo sapiens
taatgtaaacacagagacagaa

SEQ ID NO: 80376 - DNA, 22 bp, Homo sapiens
ttttcctttgattcccagatgt

SEQ ID NO: 80377 - DNA, 21 bp, Homo sapiens
agtagtttagcacagggtttg

SEQ ID NO: 80378 - DNA, 22 bp, Homo sapiens
gacccacctcaccaagcatgtg

SEQ ID NO: 80379 - DNA, 22 bp, Homo sapiens
tctgggtccgggactgtggatg

SEQ ID NO: 80380 - DNA, 21 bp, Homo sapiens
acataggcgaatgttcgggag

SEQ ID NO: 80381 - DNA, 22 bp, Homo sapiens
ctgtaatcccagctactcggga

SEQ ID NO: 80382 - DNA, 22 bp, Homo sapiens
aagccggctgggccgaggctgc

SEQ ID NO: 80383 - DNA, 22 bp, Homo sapiens
cacgactgttaccggacccatg

SEQ ID NO: 80384 - DNA, 22 bp, Homo sapiens
cccccaaagtttgcacggataa

SEQ ID NO: 80385 - DNA, 22 bp, Homo sapiens
ggcatagcggctcagcgtccag

SEQ ID NO: 80386 - DNA, 23 bp, Homo sapiens
aggatgtaggatgtatggcagag

SEQ ID NO: 80387 - DNA, 22 bp, Homo sapiens
tggacaggcaagcaagacatac

SEQ ID NO: 80388 - DNA, 19 bp, Homo sapiens
ttctggtctggaatcaagg

SEQ ID NO: 80389 - DNA, 22 bp, Homo sapiens
gctgctgggatcctgggtctca

SEQ ID NO: 80390 - DNA, 22 bp, Homo sapiens
tgaaatgtgttctagtgttttg

SEQ ID NO: 80391 - DNA, 22 bp, Homo sapiens
gtgagactcgcctttgtgtagc

SEQ ID NO: 80392 - DNA, 22 bp, Homo sapiens
gagaggaagccttctgtacttg

SEQ ID NO: 80393 - DNA, 22 bp, Homo sapiens
gcagagctcatgcctgcacctc

SEQ ID NO: 80394 - DNA, 22 bp, Homo sapiens
tgaggcaggtggattacaaggt

SEQ ID NO: 80395 - DNA, 22 bp, Homo sapiens
tcaccggcagacgtggcctgat

SEQ ID NO: 80396 - DNA, 22 bp, Homo sapiens
aatgttacgatcaacaacacat

SEQ ID NO: 80397 - DNA, 22 bp, Homo sapiens
taaaatttgtccctgagtgttg

SEQ ID NO: 80398 - DNA, 22 bp, Homo sapiens
aacccgggaggcagaggttgtg

SEQ ID NO: 80399 - DNA, 22 bp, Homo sapiens
aggagggagcttaagccaggca

SEQ ID NO: 80400 - DNA, 22 bp, Homo sapiens
aaggagtctgggccattcagag

SEQ ID NO: 80401 - DNA, 22 bp, Homo sapiens
tgaggcaggagttcaggctgcg

SEQ ID NO: 80402 - DNA, 22 bp, Homo sapiens
aatgtgaggccttggtagttat

SEQ ID NO: 80403 - DNA, 22 bp, Homo sapiens
gtgtgtccaaggcacggatgac

SEQ ID NO: 80404 - DNA, 22 bp, Homo sapiens
gggtccctggaattacttgaca

SEQ ID NO: 80405 - DNA, 22 bp, Homo sapiens
tgggtactcctattagttcagt

SEQ ID NO: 80406 - DNA, 22 bp, Homo sapiens
cacagcggcctccgatgctgat

SEQ ID NO: 80407 - DNA, 22 bp, Homo sapiens
ctggatgtccaggtagaagttt

SEQ ID NO: 80408 - DNA, 22 bp, Homo sapiens
caattgacaatgacagtgtcaa

SEQ ID NO: 80409 - DNA, 18 bp, Homo sapiens
gaggatggaaggagatgc

SEQ ID NO: 80410 - DNA, 20 bp, Homo sapiens
tgtttgtgtggggccttggc

SEQ ID NO: 80411 - DNA, 21 bp, Homo sapiens
tcgtgcagcagctgaggcttg

SEQ ID NO: 80412 - DNA, 22 bp, Homo sapiens
aatgtcaaaggctatacattca

SEQ ID NO: 80413 - DNA, 22 bp, Homo sapiens
gggctgtgaggtgagaacttac

SEQ ID NO: 80414 - DNA, 22 bp, Homo sapiens
ttgaagaaccatctgtgccact

SEQ ID NO: 80415 - DNA, 22 bp, Homo sapiens
tgagcctgggagatggaggctg

SEQ ID NO: 80416 - DNA, 22 bp, Homo sapiens
tctctcaggctggagtgcagtg

SEQ ID NO: 80417 - DNA, 22 bp, Homo sapiens
aggcctgaggaccagataaatg

SEQ ID NO: 80418 - DNA, 22 bp, Homo sapiens
aaggccttgccgaaggatgcca

SEQ ID NO: 80419 - DNA, 20 bp, Homo sapiens
tagcatgggtgagggtagag

SEQ ID NO: 80420 - DNA, 15 bp, Homo sapiens
aggagtcactgtgct

SEQ ID NO: 80421 - DNA, 19 bp, Homo sapiens
tccaaagaagttcacattt

SEQ ID NO: 80422 - DNA, 22 bp, Homo sapiens
caggagatgacagggaagaacc

SEQ ID NO: 80423 - DNA, 22 bp, Homo sapiens
ttatagcagcatgatttacaat

SEQ ID NO: 80424 - DNA, 22 bp, Homo sapiens
ggcgccccatgatgagggctag

SEQ ID NO: 80425 - DNA, 22 bp, Homo sapiens
tggaggccagaggtactgggac

SEQ ID NO: 80426 - DNA, 22 bp, Homo sapiens
aggtctcttgctgtctctgggc

SEQ ID NO: 80427 - DNA, 22 bp, Homo sapiens
ctggctcgcattatattttggg

SEQ ID NO: 80428 - DNA, 22 bp, Homo sapiens
ccctctctgctgcatagaggaa

SEQ ID NO: 80429 - DNA, 22 bp, Homo sapiens
ggtccccgtggaggctggagcg

SEQ ID NO: 80430 - DNA, 22 bp, Homo sapiens
ggtgctggacacgtggcactcc

SEQ ID NO: 80431 - DNA, 19 bp, Homo sapiens
tttgatagggcataatata

SEQ ID NO: 80432 - DNA, 22 bp, Homo sapiens
gaggttggggctgcagtgagct

SEQ ID NO: 80433 - DNA, 22 bp, Homo sapiens
aaagcagaactgagagagctgg

SEQ ID NO: 80434 - DNA, 22 bp, Homo sapiens
caagtctgacctctgggtgaag

SEQ ID NO: 80435 - DNA, 22 bp, Homo sapiens
caactccctgtggggtactggg

SEQ ID NO: 80436 - DNA, 22 bp, Homo sapiens
agggctgcccagtgtgagagct

SEQ ID NO: 80437 - DNA, 22 bp, Homo sapiens
cccattcttcatacaagtctaa

SEQ ID NO: 80438 - DNA, 22 bp, Homo sapiens
ccacgggcagatgtggttggtt

SEQ ID NO: 80439 - DNA, 22 bp, Homo sapiens
tggattcacaccattctcctgc

SEQ ID NO: 80440 - DNA, 23 bp, Homo sapiens
tgtgggcgcattgtaagggtagc

SEQ ID NO: 80441 - DNA, 22 bp, Homo sapiens
ccgggcgggggctctcgtcacc

SEQ ID NO: 80442 - DNA, 22 bp, Homo sapiens
tcctgggaggcggaggttgcag

SEQ ID NO: 80443 - DNA, 22 bp, Homo sapiens
ggagtgcaatggcgtgatctca

SEQ ID NO: 80444 - DNA, 22 bp, Homo sapiens
cctggcaggtggcgccctcggc

SEQ ID NO: 80445 - DNA, 21 bp, Homo sapiens
cgggaaggaggttctgaccct

SEQ ID NO: 80446 - DNA, 22 bp, Homo sapiens
caggctggagtgcaatgacgcc

SEQ ID NO: 80447 - DNA, 23 bp, Homo sapiens
tgttccagatacgccttttcctc

SEQ ID NO: 80448 - DNA, 22 bp, Homo sapiens
gagagcaggaggcagcgggacg

SEQ ID NO: 80449 - DNA, 22 bp, Homo sapiens
ccggagtgtctggcctgctggg

SEQ ID NO: 80450 - DNA, 22 bp, Homo sapiens
ccttctagcaaatcaacataaa

SEQ ID NO: 80451 - DNA, 22 bp, Homo sapiens
ccctggaggcggagcttgcagt

SEQ ID NO: 80452 - DNA, 22 bp, Homo sapiens
tccagtttccaatcactgcacg

SEQ ID NO: 80453 - DNA, 22 bp, Homo sapiens
gatggcacacagacatccccgc

SEQ ID NO: 80454 - DNA, 22 bp, Homo sapiens
ttgtgaatagtgccgctataaa

SEQ ID NO: 80455 - DNA, 22 bp, Homo sapiens
ccgggcctcgggacaccgggta

SEQ ID NO: 80456 - DNA, 22 bp, Homo sapiens
tcccagtttttctccactaagg

SEQ ID NO: 80457 - DNA, 22 bp, Homo sapiens
cactgcactccagcctgggaga

SEQ ID NO: 80458 - DNA, 22 bp, Homo sapiens
atggccgcctgtccttcccgcc

SEQ ID NO: 80459 - DNA, 22 bp, Homo sapiens
ggaggagcatgagagggtagtg

SEQ ID NO: 80460 - DNA, 22 bp, Homo sapiens
taggggcaggatcctttgagcc

SEQ ID NO: 80461 - DNA, 22 bp, Homo sapiens
aaggaatttgaggctgcagtga

SEQ ID NO: 80462 - DNA, 22 bp, Homo sapiens
cactgcactccatcctgggaaa

SEQ ID NO: 80463 - DNA, 22 bp, Homo sapiens
agcctggtttaagcattttata

SEQ ID NO: 80464 - DNA, 22 bp, Homo sapiens
tcgcccaggctggaagtgcagt

SEQ ID NO: 80465 - DNA, 22 bp, Homo sapiens
tcactgcaagctcctcctcctg

SEQ ID NO: 80466 - DNA, 22 bp, Homo sapiens
ggcttagcaactcctgaggctc

SEQ ID NO: 80467 - DNA, 22 bp, Homo sapiens
aagtagttaggaacattctctc

SEQ ID NO: 80468 - DNA, 22 bp, Homo sapiens
gaaaattattgaaaatggctct

SEQ ID NO: 80469 - DNA, 22 bp, Homo sapiens
gagaaatgcatgcatgtcatca

SEQ ID NO: 80470 - DNA, 22 bp, Homo sapiens
gtgaaatatttaacgtccaggt

SEQ ID NO: 80471 - DNA, 22 bp, Homo sapiens
aacttagtgagccactcttgca

SEQ ID NO: 80472 - DNA, 22 bp, Homo sapiens
aggcaagggggcgccaccttcc

SEQ ID NO: 80473 - DNA, 22 bp, Homo sapiens
cccacgtcgaacttgctccaga

SEQ ID NO: 80474 - DNA, 22 bp, Homo sapiens
gagatgggcgagaaggtggact

SEQ ID NO: 80475 - DNA, 22 bp, Homo sapiens
agagcactttcgagagccggag

SEQ ID NO: 80476 - DNA, 21 bp, Homo sapiens
tgtaagtttcatctgaattgg

SEQ ID NO: 80477 - DNA, 22 bp, Homo sapiens
atgttatgtctgggaaggggta

SEQ ID NO: 80478 - DNA, 22 bp, Homo sapiens
agaaagtgcttccctttggtga

SEQ ID NO: 80479 - DNA, 21 bp, Homo sapiens
tggacttatggagtgtttctt

SEQ ID NO: 80480 - DNA, 22 bp, Homo sapiens
tctagttctagatccctgagga

SEQ ID NO: 80481 - DNA, 22 bp, Homo sapiens
tgtctggtgggttgacaggcag

SEQ ID NO: 80482 - DNA, 22 bp, Homo sapiens
ggttgctgggggtggcagagct

SEQ ID NO: 80483 - DNA, 22 bp, Homo sapiens
aagcctggcacattggagtctg

SEQ ID NO: 80484 - DNA, 22 bp, Homo sapiens
caccagagtgggtgagggtgat

SEQ ID NO: 80485 - DNA, 22 bp, Homo sapiens
cgcatgagacctgccggccatc

SEQ ID NO: 80486 - DNA, 22 bp, Homo sapiens
ggtccccccatggtgagcactg

SEQ ID NO: 80487 - DNA, 22 bp, Homo sapiens
ccctggctgcgtgatggatgaa

SEQ ID NO: 80488 - DNA, 22 bp, Homo sapiens
tgggaatgcaaggaaagctgtt

SEQ ID NO: 80489 - DNA, 22 bp, Homo sapiens
gagggccctggctggctccagc

SEQ ID NO: 80490 - DNA, 22 bp, Homo sapiens
tggagaataggggccactggtg

SEQ ID NO: 80491 - DNA, 22 bp, Homo sapiens
tgcagaaacaagccatcattca

SEQ ID NO: 80492 - DNA, 22 bp, Homo sapiens
cagtgacgtaaactgcatgtgc

SEQ ID NO: 80493 - DNA, 22 bp, Homo sapiens
tgccaggcgtggtggtgcgcac

SEQ ID NO: 80494 - DNA, 22 bp, Homo sapiens
actaaagctcacagagttgaac

SEQ ID NO: 80495 - DNA, 22 bp, Homo sapiens
gaatgcagatggctggtgtatg

SEQ ID NO: 80496 - DNA, 18 bp, Homo sapiens
tgtagagccaggtttgcc

SEQ ID NO: 80497 - DNA, 22 bp, Homo sapiens
gggagtgggtttggcctaggcc

SEQ ID NO: 80498 - DNA, 22 bp, Homo sapiens
ctccccagccctggtattctga

SEQ ID NO: 80499 - DNA, 22 bp, Homo sapiens
gagtgcaatggcatgatctggg

SEQ ID NO: 80500 - DNA, 22 bp, Homo sapiens
ggtgggagagctctgtctccag

SEQ ID NO: 80501 - DNA, 22 bp, Homo sapiens
ccggctactcgggaggctgacg

SEQ ID NO: 80502 - DNA, 22 bp, Homo sapiens
ctctggaccctcctgctgagag

SEQ ID NO: 80503 - DNA, 22 bp, Homo sapiens
tgtccaggctggagtgcagtgg

SEQ ID NO: 80504 - DNA, 22 bp, Homo sapiens
tgcctgtggaaaggctggtgct

SEQ ID NO: 80505 - DNA, 19 bp, Homo sapiens
cggcccctcctctcgcgcc

SEQ ID NO: 80506 - DNA, 22 bp, Homo sapiens
caggctggagtgcagtggtgcc

SEQ ID NO: 80507 - DNA, 20 bp, Homo sapiens
agacagtgtggagattcctt

SEQ ID NO: 80508 - DNA, 22 bp, Homo sapiens
tgacttcctgcactcaggtgat

SEQ ID NO: 80509 - DNA, 22 bp, Homo sapiens
cccaccagtacagatggtagat

SEQ ID NO: 80510 - DNA, 22 bp, Homo sapiens
ctgctcttcacactacacccgt

SEQ ID NO: 80511 - DNA, 22 bp, Homo sapiens
tgtgggagaaggaagcaagctg

SEQ ID NO: 80512 - DNA, 22 bp, Homo sapiens
ggggccgaccgcggttcaggcc

SEQ ID NO: 80513 - DNA, 22 bp, Homo sapiens
agaaaacataggagacaggaaa

SEQ ID NO: 80514 - DNA, 22 bp, Homo sapiens
gcagccagagggggtgtgatca

SEQ ID NO: 80515 - DNA, 22 bp, Homo sapiens
gaggcagaagttgcagtgagca

SEQ ID NO: 80516 - DNA, 22 bp, Homo sapiens
gtgtaagtatctttgtatcttt

SEQ ID NO: 80517 - DNA, 22 bp, Homo sapiens
ccccacaactcatgttgaaact

SEQ ID NO: 80518 - DNA, 20 bp, Homo sapiens
ttgttagaggaatgccatag

SEQ ID NO: 80519 - DNA, 22 bp, Homo sapiens
gccagtgcctcgccgcgctcct

SEQ ID NO: 80520 - DNA, 22 bp, Homo sapiens
ttggaggcaatgggaaggaggc

SEQ ID NO: 80521 - DNA, 22 bp, Homo sapiens
gctggcagacttcctctggaac

SEQ ID NO: 80522 - DNA, 22 bp, Homo sapiens
cctccccacagcccaggagact

SEQ ID NO: 80523 - DNA, 22 bp, Homo sapiens
ggggccttttctgaatgtggaa

SEQ ID NO: 80524 - DNA, 22 bp, Homo sapiens
tgaccaggctggagtgcagtgg

SEQ ID NO: 80525 - DNA, 22 bp, Homo sapiens
ttccagagagttattcccctgg

SEQ ID NO: 80526 - DNA, 19 bp, Homo sapiens
ggcgaagcgcttggagtag

SEQ ID NO: 80527 - DNA, 22 bp, Homo sapiens
tctttggtttctgtctctgtaa

SEQ ID NO: 80528 - DNA, 22 bp, Homo sapiens
tggtggacgatgcccagctgga

SEQ ID NO: 80529 - DNA, 22 bp, Homo sapiens
tgcgttgcgctcctgcagcagg

SEQ ID NO: 80530 - DNA, 22 bp, Homo sapiens
aggccaggaatccttgtcccag

SEQ ID NO: 80531 - DNA, 22 bp, Homo sapiens
ggagtgcggtggcaccatctca

SEQ ID NO: 80532 - DNA, 22 bp, Homo sapiens
ctgggagtggtgacagctctcg

SEQ ID NO: 80533 - DNA, 22 bp, Homo sapiens
tttgaagggcacgacaatagtt

SEQ ID NO: 80534 - DNA, 22 bp, Homo sapiens
ctcctgcttcacgggcaccgcc

SEQ ID NO: 80535 - DNA, 22 bp, Homo sapiens
ggccactgacctacatctgggg

SEQ ID NO: 80536 - DNA, 22 bp, Homo sapiens
tgttgagtatatacctacaagt

SEQ ID NO: 80537 - DNA, 22 bp, Homo sapiens
catgctgggtaaaggtggtgaa

SEQ ID NO: 80538 - DNA, 22 bp, Homo sapiens
aagcccttggcgcacaccgggc

SEQ ID NO: 80539 - DNA, 21 bp, Homo sapiens
cagagctgtccaaaccctgac

SEQ ID NO: 80540 - DNA, 22 bp, Homo sapiens
cccagttgttgccggctctgga

SEQ ID NO: 80541 - DNA, 22 bp, Homo sapiens
tccctctacagggaagcgcttt

SEQ ID NO: 80542 - DNA, 22 bp, Homo sapiens
tgctccatgcgctcggccggcg

SEQ ID NO: 80543 - DNA, 22 bp, Homo sapiens
ttagctcagaaaatttaaactt

SEQ ID NO: 80544 - DNA, 22 bp, Homo sapiens
tagagtgtcataacagtgccca

SEQ ID NO: 80545 - DNA, 22 bp, Homo sapiens
tggatggctgtggtctttgccc

SEQ ID NO: 80546 - DNA, 22 bp, Homo sapiens
aacactctctgttggtaaggct

SEQ ID NO: 80547 - DNA, 22 bp, Homo sapiens
tgggaaggggagctggaaagga

SEQ ID NO: 80548 - DNA, 22 bp, Homo sapiens
ccagagtcccttgcagctcagt

SEQ ID NO: 80549 - DNA, 22 bp, Homo sapiens
gtctcccagcctacatctttct

SEQ ID NO: 80550 - DNA, 22 bp, Homo sapiens
cggcatccccacttcctcctgc

SEQ ID NO: 80551 - DNA, 22 bp, Homo sapiens
tcactgcaacctccacctcctg

SEQ ID NO: 80552 - DNA, 22 bp, Homo sapiens
tggtcttagctggaaggaggga

SEQ ID NO: 80553 - DNA, 22 bp, Homo sapiens
agcccagaggctgggcgtgcat

SEQ ID NO: 80554 - DNA, 22 bp, Homo sapiens
tgcctctgaggaagattgtgtt

SEQ ID NO: 80555 - DNA, 22 bp, Homo sapiens
aaggctgtggttctatacagaa

SEQ ID NO: 80556 - DNA, 22 bp, Homo sapiens
ccagaaaaatcctcccttgtcc

SEQ ID NO: 80557 - DNA, 18 bp, Homo sapiens
tctgccccagccgcactg

SEQ ID NO: 80558 - DNA, 22 bp, Homo sapiens
tggctcctcacgtcctcagagc

SEQ ID NO: 80559 - DNA, 17 bp, Homo sapiens
tggctctgtcctcagct

SEQ ID NO: 80560 - DNA, 22 bp, Homo sapiens
atgcacctgaactccatcagct

SEQ ID NO: 80561 - DNA, 22 bp, Homo sapiens
gagctgagaagcagcgcttgat

SEQ ID NO: 80562 - DNA, 22 bp, Homo sapiens
tgtcttcgctacaatgaaaagg

SEQ ID NO: 80563 - DNA, 22 bp, Homo sapiens
tctctctgcagcccgggacact

SEQ ID NO: 80564 - DNA, 22 bp, Homo sapiens
ctgtccctgagcaactcctgtt

SEQ ID NO: 80565 - DNA, 22 bp, Homo sapiens
tgcatgagcgaatgtgtcctgt

SEQ ID NO: 80566 - DNA, 22 bp, Homo sapiens
cgggttcacgccattctcctgc

SEQ ID NO: 80567 - DNA, 22 bp, Homo sapiens
ttctgccatctgcagaagggga

SEQ ID NO: 80568 - DNA, 22 bp, Homo sapiens
gaaaggagagggttaaggagct

SEQ ID NO: 80569 - DNA, 22 bp, Homo sapiens
tcctgggccctccggatcaggt

SEQ ID NO: 80570 - DNA, 22 bp, Homo sapiens
ggctgcaggttggttggcagct

SEQ ID NO: 80571 - DNA, 22 bp, Homo sapiens
agtatgtcagagtgaaaatggt

SEQ ID NO: 80572 - DNA, 22 bp, Homo sapiens
gtggagggtgattgccggctgt

SEQ ID NO: 80573 - DNA, 22 bp, Homo sapiens
gagggggctagcgcagtgccca

SEQ ID NO: 80574 - DNA, 22 bp, Homo sapiens
acggcttcttgactgtgggttg

SEQ ID NO: 80575 - DNA, 22 bp, Homo sapiens
ggcgccgcactcggtgcagccg

SEQ ID NO: 80576 - DNA, 22 bp, Homo sapiens
atggagttctgccagcgctgct

SEQ ID NO: 80577 - DNA, 22 bp, Homo sapiens
agaccactaaaactttctctat

SEQ ID NO: 80578 - DNA, 22 bp, Homo sapiens
agcttgtagaaggccacgagca

SEQ ID NO: 80579 - DNA, 22 bp, Homo sapiens
tcagccccacggggtcagccaa

SEQ ID NO: 80580 - DNA, 22 bp, Homo sapiens
agtgcactggcaccatctcagc

SEQ ID NO: 80581 - DNA, 22 bp, Homo sapiens
gtcttgatctcctgaccttgtg

SEQ ID NO: 80582 - DNA, 22 bp, Homo sapiens
gtgtgggctgcagaggcacagc

SEQ ID NO: 80583 - DNA, 23 bp, Homo sapiens
tagatgtattaagtgcattttca

SEQ ID NO: 80584 - DNA, 22 bp, Homo sapiens
aacccgggaggcggaggttgtg

SEQ ID NO: 80585 - DNA, 22 bp, Homo sapiens
caactgggataaagagctaaag

SEQ ID NO: 80586 - DNA, 22 bp, Homo sapiens
gcaggagaacaaagcaagctgc

SEQ ID NO: 80587 - DNA, 22 bp, Homo sapiens
aagggcatgagaagcttgaaag

SEQ ID NO: 80588 - DNA, 23 bp, Homo sapiens
ccagtgattgcctggaaggaggt

SEQ ID NO: 80589 - DNA, 22 bp, Homo sapiens
tcacagcctggacagttgcctg

SEQ ID NO: 80590 - DNA, 22 bp, Homo sapiens
caggcaggtcagtgaagaagga

SEQ ID NO: 80591 - DNA, 22 bp, Homo sapiens
aaagtgcttccttttagaggct

SEQ ID NO: 80592 - DNA, 22 bp, Homo sapiens
gcagtggcatgatgtgggctca

SEQ ID NO: 80593 - DNA, 22 bp, Homo sapiens
ttacatgtttatgtggtacatg

SEQ ID NO: 80594 - DNA, 22 bp, Homo sapiens
atgaagcgttcgagataggtag

SEQ ID NO: 80595 - DNA, 22 bp, Homo sapiens
ctgagggtcaacttgattgtat

SEQ ID NO: 80596 - DNA, 22 bp, Homo sapiens
tcctccccaaagcccagcctgg

SEQ ID NO: 80597 - DNA, 20 bp, Homo sapiens
cagagccagggttttgtttt

SEQ ID NO: 80598 - DNA, 22 bp, Homo sapiens
acacggcactttaggaaggggc

SEQ ID NO: 80599 - DNA, 22 bp, Homo sapiens
attgtactacaccatagtactg

SEQ ID NO: 80600 - DNA, 22 bp, Homo sapiens
agatttggtgtctggttgatat

SEQ ID NO: 80601 - DNA, 22 bp, Homo sapiens
gaggaggcttccgggaggcacg

SEQ ID NO: 80602 - DNA, 22 bp, Homo sapiens
aaaagtaattgtggtttttgct

SEQ ID NO: 80603 - DNA, 22 bp, Homo sapiens
ggaactgaatgtctcggtataa

SEQ ID NO: 80604 - DNA, 22 bp, Homo sapiens
cagcgtctcgttgtgggcctcg

SEQ ID NO: 80605 - DNA, 22 bp, Homo sapiens
gcctgctcccagttggcgcctc

SEQ ID NO: 80606 - DNA, 22 bp, Homo sapiens
caggcactgtgctgagctctgc

SEQ ID NO: 80607 - DNA, 22 bp, Homo sapiens
tgcgaccctagccccctcactt

SEQ ID NO: 80608 - DNA, 22 bp, Homo sapiens
ctgccctttgaaagaacgtctt

SEQ ID NO: 80609 - DNA, 22 bp, Homo sapiens
aggccagcctgcccaaagctgc

SEQ ID NO: 80610 - DNA, 20 bp, Homo sapiens
gtgtggccaggagctgcgct

SEQ ID NO: 80611 - DNA, 22 bp, Homo sapiens
gctgcagacttctcatctcatt

SEQ ID NO: 80612 - DNA, 22 bp, Homo sapiens
gtgggccactgggaggcaaggg

SEQ ID NO: 80613 - DNA, 22 bp, Homo sapiens
cagcagcagtggctgcagaaca

SEQ ID NO: 80614 - DNA, 22 bp, Homo sapiens
gatctcaaagcagtgtgggttg

SEQ ID NO: 80615 - DNA, 22 bp, Homo sapiens
gggaggttgaggctgcagtgag

SEQ ID NO: 80616 - DNA, 22 bp, Homo sapiens
acctctgtacctcctctgacag

SEQ ID NO: 80617 - DNA, 22 bp, Homo sapiens
atttagtagagaaattaagaaa

SEQ ID NO: 80618 - DNA, 22 bp, Homo sapiens
aggtttctttatgctgctagaa

SEQ ID NO: 80619 - DNA, 22 bp, Homo sapiens
tgccgcaagtactgctgcctgt

SEQ ID NO: 80620 - DNA, 22 bp, Homo sapiens
cggagcctgcttgttgcagctg

SEQ ID NO: 80621 - DNA, 22 bp, Homo sapiens
ggtggttcacgcctataatccc

SEQ ID NO: 80622 - DNA, 22 bp, Homo sapiens
tcaaaattaaaccaacgtccag

SEQ ID NO: 80623 - DNA, 22 bp, Homo sapiens
tggcccagtatgtataatctta

SEQ ID NO: 80624 - DNA, 22 bp, Homo sapiens
catgcggctctttccaaaccgg

SEQ ID NO: 80625 - DNA, 22 bp, Homo sapiens
tgtaagtagtaatggaaggaca

SEQ ID NO: 80626 - DNA, 22 bp, Homo sapiens
catttctgggagacatgctaga

SEQ ID NO: 80627 - DNA, 20 bp, Homo sapiens
gataatatttactaggtact

SEQ ID NO: 80628 - DNA, 22 bp, Homo sapiens
aatgctctttaacctattctga

SEQ ID NO: 80629 - DNA, 22 bp, Homo sapiens
ctgtgatttctaaagagtagca

SEQ ID NO: 80630 - DNA, 22 bp, Homo sapiens
tttgtcttatccaatctctcag

SEQ ID NO: 80631 - DNA, 22 bp, Homo sapiens
ctggagggctgcagcgaggctg

SEQ ID NO: 80632 - DNA, 22 bp, Homo sapiens
ggcccaggctggagtgcagtgg

SEQ ID NO: 80633 - DNA, 22 bp, Homo sapiens
tgcccagggtggagtgcagtgg

SEQ ID NO: 80634 - DNA, 22 bp, Homo sapiens
aggaaggactccatggtccgtc

SEQ ID NO: 80635 - DNA, 22 bp, Homo sapiens
ctctggagtgtctggccagggt

SEQ ID NO: 80636 - DNA, 22 bp, Homo sapiens
ccattgcactccatcctgggca

SEQ ID NO: 80637 - DNA, 22 bp, Homo sapiens
gctgcagtgagccaagatcgtg

SEQ ID NO: 80638 - DNA, 22 bp, Homo sapiens
gcaagacctatctagttgctgt

SEQ ID NO: 80639 - DNA, 18 bp, Homo sapiens
ggtgagggagctggaagc

SEQ ID NO: 80640 - DNA, 22 bp, Homo sapiens
agaaggggcccaaggatgtcag

SEQ ID NO: 80641 - DNA, 22 bp, Homo sapiens
cccaggcttttctcttgcccca

SEQ ID NO: 80642 - DNA, 22 bp, Homo sapiens
gcagatggatgtggacggcgcc

SEQ ID NO: 80643 - DNA, 21 bp, Homo sapiens
tagcccttctccacctcgccc

SEQ ID NO: 80644 - DNA, 22 bp, Homo sapiens
gctgctttgtctgtaaaatgga

SEQ ID NO: 80645 - DNA, 22 bp, Homo sapiens
gggggtttctgggctgagcaga

SEQ ID NO: 80646 - DNA, 22 bp, Homo sapiens
taggcatgcaaataaatgtgca

SEQ ID NO: 80647 - DNA, 22 bp, Homo sapiens
tcccagagctctggaggttgga

SEQ ID NO: 80648 - DNA, 22 bp, Homo sapiens
ccagcatccatgctccctcggg

SEQ ID NO: 80649 - DNA, 22 bp, Homo sapiens
gcggctgccgagacaagccggt

SEQ ID NO: 80650 - DNA, 22 bp, Homo sapiens
gaggtagacttcttggaagtag

SEQ ID NO: 80651 - DNA, 22 bp, Homo sapiens
aggctgaggcaagaggatcact

SEQ ID NO: 80652 - DNA, 22 bp, Homo sapiens
ggagttgattttggatatatta

SEQ ID NO: 80653 - DNA, 22 bp, Homo sapiens
caccaggctggagtgcagtggc

SEQ ID NO: 80654 - DNA, 22 bp, Homo sapiens
atcttctcatgtgtaatgaggt

SEQ ID NO: 80655 - DNA, 21 bp, Homo sapiens
ggtgacacgtggccccgctct

SEQ ID NO: 80656 - DNA, 22 bp, Homo sapiens
ccacaccatcgtttttacctta

SEQ ID NO: 80657 - DNA, 22 bp, Homo sapiens
cagcagcagtgttctagaatct

SEQ ID NO: 80658 - DNA, 22 bp, Homo sapiens
taattgtaaagtagtagtacag

SEQ ID NO: 80659 - DNA, 22 bp, Homo sapiens
tggaagggagctggaatttgga

SEQ ID NO: 80660 - DNA, 22 bp, Homo sapiens
aggtaaacaggagaaaatgaga

SEQ ID NO: 80661 - DNA, 22 bp, Homo sapiens
agcctgcgatcccacctggcct

SEQ ID NO: 80662 - DNA, 22 bp, Homo sapiens
ccccaggacgtggccctcatag

SEQ ID NO: 80663 - DNA, 17 bp, Homo sapiens
tgcatgtcctttgttcc

SEQ ID NO: 80664 - DNA, 22 bp, Homo sapiens
aaactgtcctcccgaggtttcc

SEQ ID NO: 80665 - DNA, 22 bp, Homo sapiens
gcccccgtagtagatgaggcgc

SEQ ID NO: 80666 - DNA, 22 bp, Homo sapiens
ggcaaagccctgcctggttcaa

SEQ ID NO: 80667 - DNA, 22 bp, Homo sapiens
actgcactccagcctgggtgat

SEQ ID NO: 80668 - DNA, 22 bp, Homo sapiens
tggcactgaagctggaaagcct

SEQ ID NO: 80669 - DNA, 22 bp, Homo sapiens
tgctcgccccacatgccctcat

SEQ ID NO: 80670 - DNA, 22 bp, Homo sapiens
cgctgataaacgtcacgttccc

SEQ ID NO: 80671 - DNA, 22 bp, Homo sapiens
ttatttaaaagtggtaagattc

SEQ ID NO: 80672 - DNA, 22 bp, Homo sapiens
aaaagcaattgcagttcttgcc

SEQ ID NO: 80673 - DNA, 22 bp, Homo sapiens
aatgttgcagagtgattgtcca

SEQ ID NO: 80674 - DNA, 22 bp, Homo sapiens
gccctgccctctcggcactcgc

SEQ ID NO: 80675 - DNA, 21 bp, Homo sapiens
ccgccgctgatagctctgggc

SEQ ID NO: 80676 - DNA, 22 bp, Homo sapiens
actgtaacctcaaactcctggg

SEQ ID NO: 80677 - DNA, 22 bp, Homo sapiens
agcgtgaattagttggtacaca

SEQ ID NO: 80678 - DNA, 22 bp, Homo sapiens
gaggtaggtgtaggaggcctgc

SEQ ID NO: 80679 - DNA, 22 bp, Homo sapiens
ctcctggaggatagtgactggg

SEQ ID NO: 80680 - DNA, 22 bp, Homo sapiens
ctgattgctaacctgttagaat

SEQ ID NO: 80681 - DNA, 22 bp, Homo sapiens
tctctatttgcctaggcttgtg

SEQ ID NO: 80682 - DNA, 22 bp, Homo sapiens
agtgctgtctccttcccccggg

SEQ ID NO: 80683 - DNA, 22 bp, Homo sapiens
gcccagccacagtcactttcat

SEQ ID NO: 80684 - DNA, 22 bp, Homo sapiens
tccaggatggtgacggtggcca

SEQ ID NO: 80685 - DNA, 22 bp, Homo sapiens
aaagatcacgtcccaggactcg

SEQ ID NO: 80686 - DNA, 22 bp, Homo sapiens
ttctgggcacacaggccctggt

SEQ ID NO: 80687 - DNA, 22 bp, Homo sapiens
aggaatggtgctcagcagaaat

SEQ ID NO: 80688 - DNA, 22 bp, Homo sapiens
gaaaaggcctggggcaaagtgt

SEQ ID NO: 80689 - DNA, 22 bp, Homo sapiens
agccagggtctctcgctctgtt

SEQ ID NO: 80690 - DNA, 22 bp, Homo sapiens
aagaaggcggaccagaagggag

SEQ ID NO: 80691 - DNA, 22 bp, Homo sapiens
gcgcaccacctccaggtggccg

SEQ ID NO: 80692 - DNA, 22 bp, Homo sapiens
aagctcaaaccttggggctcag

SEQ ID NO: 80693 - DNA, 22 bp, Homo sapiens
gtatgtgaggttggtttccagg

SEQ ID NO: 80694 - DNA, 22 bp, Homo sapiens
accagggaccgccacactgcaa

SEQ ID NO: 80695 - DNA, 22 bp, Homo sapiens
tcattccctcattgttcactgg

SEQ ID NO: 80696 - DNA, 22 bp, Homo sapiens
tcccacacagcccgctcaccgg

SEQ ID NO: 80697 - DNA, 22 bp, Homo sapiens
taaaggtagtgtgacatattgt

SEQ ID NO: 80698 - DNA, 22 bp, Homo sapiens
ttacctaaaatagctcaattta

SEQ ID NO: 80699 - DNA, 22 bp, Homo sapiens
ccaggagctggagggtgcagtg

SEQ ID NO: 80700 - DNA, 23 bp, Homo sapiens
cagagctggcttcatgggtgtgc

SEQ ID NO: 80701 - DNA, 22 bp, Homo sapiens
cccccagctctgctgggtcccg

SEQ ID NO: 80702 - DNA, 22 bp, Homo sapiens
aaggatacttttagagcctgag

SEQ ID NO: 80703 - DNA, 22 bp, Homo sapiens
cagtgatatttatcctactcac

SEQ ID NO: 80704 - DNA, 22 bp, Homo sapiens
tctgagccagggtctcctccct

SEQ ID NO: 80705 - DNA, 22 bp, Homo sapiens
gagccaggggtcagctccgagg

SEQ ID NO: 80706 - DNA, 22 bp, Homo sapiens
accatgttggccaagctggtct

SEQ ID NO: 80707 - DNA, 22 bp, Homo sapiens
tatattgagatttgagcattgt

SEQ ID NO: 80708 - DNA, 22 bp, Homo sapiens
ttcagcccaggagttggaggct

SEQ ID NO: 80709 - DNA, 22 bp, Homo sapiens
ctgggaggtggaggttgcattg

SEQ ID NO: 80710 - DNA, 22 bp, Homo sapiens
ttggggtcccacaggctgcctg

SEQ ID NO: 80711 - DNA, 22 bp, Homo sapiens
attgaaaataaggccagaaaca

SEQ ID NO: 80712 - DNA, 22 bp, Homo sapiens
tgagctgacacccaatcatact

SEQ ID NO: 80713 - DNA, 22 bp, Homo sapiens
tgacagtgaataagtctcttaa

SEQ ID NO: 80714 - DNA, 22 bp, Homo sapiens
ggctcctggcaatgtaacttta

SEQ ID NO: 80715 - DNA, 22 bp, Homo sapiens
ttcaggaagtgctgcctggtgt

SEQ ID NO: 80716 - DNA, 22 bp, Homo sapiens
ctggctttgatcagagtgacct

SEQ ID NO: 80717 - DNA, 22 bp, Homo sapiens
ctgaggagaggtggcctgtgtt

SEQ ID NO: 80718 - DNA, 19 bp, Homo sapiens
tggctctgtcgaaggcaca

SEQ ID NO: 80719 - DNA, 21 bp, Homo sapiens
gccatttcacacagacatttg

SEQ ID NO: 80720 - DNA, 22 bp, Homo sapiens
taagaaatttagttatagaatg

SEQ ID NO: 80721 - DNA, 19 bp, Homo sapiens
aggctaaagagtcttgcgt

SEQ ID NO: 80722 - DNA, 22 bp, Homo sapiens
taggtagctttggcgtttcttg

SEQ ID NO: 80723 - DNA, 22 bp, Homo sapiens
ttgcccagagtcacccagctca

SEQ ID NO: 80724 - DNA, 22 bp, Homo sapiens
ttattagagtgctttgagaaag

SEQ ID NO: 80725 - DNA, 22 bp, Homo sapiens
aagaaatgctgatgttggatgg

SEQ ID NO: 80726 - DNA, 22 bp, Homo sapiens
ctcccagccttcgccagtctga

SEQ ID NO: 80727 - DNA, 22 bp, Homo sapiens
tgagatgtaaggtatgcttact

SEQ ID NO: 80728 - DNA, 22 bp, Homo sapiens
aggattgtgcctccagtcagaa

SEQ ID NO: 80729 - DNA, 22 bp, Homo sapiens
acctcctccaaggagccatagg

SEQ ID NO: 80730 - DNA, 22 bp, Homo sapiens
gggttgaggcggatgtcggcgg

SEQ ID NO: 80731 - DNA, 22 bp, Homo sapiens
caaatgaatatttccatgggtt

SEQ ID NO: 80732 - DNA, 22 bp, Homo sapiens
atgtttaaagggttgagaaata

SEQ ID NO: 80733 - DNA, 22 bp, Homo sapiens
actgcacttcagcctgggtgtc

SEQ ID NO: 80734 - DNA, 18 bp, Homo sapiens
tcttccaacactgacacc

SEQ ID NO: 80735 - DNA, 22 bp, Homo sapiens
aagcagagaatctgggagcgag

SEQ ID NO: 80736 - DNA, 20 bp, Homo sapiens
ctgcgggctcggccgacccc

SEQ ID NO: 80737 - DNA, 22 bp, Homo sapiens
gaaagagaacctgggcctagat

SEQ ID NO: 80738 - DNA, 22 bp, Homo sapiens
gccaggacctcagatgcagggc

SEQ ID NO: 80739 - DNA, 22 bp, Homo sapiens
tgggggtgtcctggtgcacaca

SEQ ID NO: 80740 - DNA, 22 bp, Homo sapiens
cactgcactccagcctgggtca

SEQ ID NO: 80741 - DNA, 22 bp, Homo sapiens
agccaccaccactgaaaggtta

SEQ ID NO: 80742 - DNA, 22 bp, Homo sapiens
ggcgctcagtgttgccccagag

SEQ ID NO: 80743 - DNA, 22 bp, Homo sapiens
tgatttatgcattatactgttg

SEQ ID NO: 80744 - DNA, 22 bp, Homo sapiens
ccaggaggcagaagttgcagtg

SEQ ID NO: 80745 - DNA, 22 bp, Homo sapiens
ctcaggagttggaggctacagt

SEQ ID NO: 80746 - DNA, 18 bp, Homo sapiens
cccggctaatttttggta

SEQ ID NO: 80747 - DNA, 22 bp, Homo sapiens
gagatatgttggcagctggtat

SEQ ID NO: 80748 - DNA, 22 bp, Homo sapiens
cactgggcgtgtcctgggtgag

SEQ ID NO: 80749 - DNA, 22 bp, Homo sapiens
aaaaagtattggccatggttga

SEQ ID NO: 80750 - DNA, 22 bp, Homo sapiens
tggattgtaacatagagtaaat

SEQ ID NO: 80751 - DNA, 22 bp, Homo sapiens
ccacgacgagtcatcagggcga

SEQ ID NO: 80752 - DNA, 19 bp, Homo sapiens
gccatcccaagcattttgg

SEQ ID NO: 80753 - DNA, 22 bp, Homo sapiens
tagcagcatttttgtagagtat

SEQ ID NO: 80754 - DNA, 22 bp, Homo sapiens
gggcatggtggcaggcacctgt

SEQ ID NO: 80755 - DNA, 22 bp, Homo sapiens
gctgggctgcgtcggggaagcc

SEQ ID NO: 80756 - DNA, 22 bp, Homo sapiens
ccatcacagtccccatcgtgat

SEQ ID NO: 80757 - DNA, 22 bp, Homo sapiens
aaggctgaggcagtgaggcaga

SEQ ID NO: 80758 - DNA, 21 bp, Homo sapiens
ctacttaagtaggggattagg

SEQ ID NO: 80759 - DNA, 22 bp, Homo sapiens
cagcccaggactgcaggtgttt

SEQ ID NO: 80760 - DNA, 22 bp, Homo sapiens
gggcagagagctggaactcctt

SEQ ID NO: 80761 - DNA, 22 bp, Homo sapiens
atattacacacggtatcacggg

SEQ ID NO: 80762 - DNA, 22 bp, Homo sapiens
gggctgtaggagctggaatggg

SEQ ID NO: 80763 - DNA, 22 bp, Homo sapiens
ttcatagtgtttccttccagtg

SEQ ID NO: 80764 - DNA, 21 bp, Homo sapiens
tgactgaggcttcttcacaca

SEQ ID NO: 80765 - DNA, 22 bp, Homo sapiens
acagattcactgcactggccat

SEQ ID NO: 80766 - DNA, 22 bp, Homo sapiens
cctgcacatgtgtgcgcctgta

SEQ ID NO: 80767 - DNA, 22 bp, Homo sapiens
tccaaacgggagccaaatgagc

SEQ ID NO: 80768 - DNA, 22 bp, Homo sapiens
gtctatgatattttgttatagc

SEQ ID NO: 80769 - DNA, 22 bp, Homo sapiens
atgtgctgagtgtgtatataca

SEQ ID NO: 80770 - DNA, 22 bp, Homo sapiens
tggcccttgttcaaatatgtca

SEQ ID NO: 80771 - DNA, 22 bp, Homo sapiens
acccgccgcacgtccaggctga

SEQ ID NO: 80772 - DNA, 22 bp, Homo sapiens
ctcttagtaatgccatgaagca

SEQ ID NO: 80773 - DNA, 22 bp, Homo sapiens
agtgggccggacagcccaggcc

SEQ ID NO: 80774 - DNA, 22 bp, Homo sapiens
caccagtgtttacctgtgacaa

SEQ ID NO: 80775 - DNA, 22 bp, Homo sapiens
acgtgcaggatctggttggcga

SEQ ID NO: 80776 - DNA, 22 bp, Homo sapiens
aagaagcaggtcacagacaggg

SEQ ID NO: 80777 - DNA, 22 bp, Homo sapiens
catgagatttgggaggggccag

SEQ ID NO: 80778 - DNA, 22 bp, Homo sapiens
caggtgcctcaggatgagacaa

SEQ ID NO: 80779 - DNA, 22 bp, Homo sapiens
atgattgaaaatgacattgcca

SEQ ID NO: 80780 - DNA, 16 bp, Homo sapiens
gcaggcagatcacatg

SEQ ID NO: 80781 - DNA, 22 bp, Homo sapiens
tgaggcaggagaatcacatgaa

SEQ ID NO: 80782 - DNA, 23 bp, Homo sapiens
ggggtcttggaacaggtggccct

SEQ ID NO: 80783 - DNA, 22 bp, Homo sapiens
ttttctcttccctctggacctg

SEQ ID NO: 80784 - DNA, 21 bp, Homo sapiens
ctagaaagaatgttgtcgtct

SEQ ID NO: 80785 - DNA, 22 bp, Homo sapiens
tgagctgtatattgttttaata

SEQ ID NO: 80786 - DNA, 22 bp, Homo sapiens
cagggatggcgctggctgcccg

SEQ ID NO: 80787 - DNA, 22 bp, Homo sapiens
ttttggctctgtctgtatcttt

SEQ ID NO: 80788 - DNA, 22 bp, Homo sapiens
gggagaagaatgtgtcaattgt

SEQ ID NO: 80789 - DNA, 22 bp, Homo sapiens
gagagtgagatcctcctgggga

SEQ ID NO: 80790 - DNA, 22 bp, Homo sapiens
gctgtggcctggcgcagagctg

SEQ ID NO: 80791 - DNA, 22 bp, Homo sapiens
gccctcctggcaggcagtgatg

SEQ ID NO: 80792 - DNA, 22 bp, Homo sapiens
ttatatgtttctgtttggaggc

SEQ ID NO: 80793 - DNA, 22 bp, Homo sapiens
cctagagccgcacctcctccac

SEQ ID NO: 80794 - DNA, 19 bp, Homo sapiens
ctgtccttggctgcactgt

SEQ ID NO: 80795 - DNA, 22 bp, Homo sapiens
tgtccagatcaatgcccacatg

SEQ ID NO: 80796 - DNA, 19 bp, Homo sapiens
agccccttggtactgtcct

SEQ ID NO: 80797 - DNA, 22 bp, Homo sapiens
gtcctaccatgaattcactcca

SEQ ID NO: 80798 - DNA, 22 bp, Homo sapiens
accttgatggggctgttggagt

SEQ ID NO: 80799 - DNA, 22 bp, Homo sapiens
tcccggcgctgggaggtgggtc

SEQ ID NO: 80800 - DNA, 22 bp, Homo sapiens
gagacgtggcctttgcctgagc

SEQ ID NO: 80801 - DNA, 22 bp, Homo sapiens
gggagaggttacccgagcaact

SEQ ID NO: 80802 - DNA, 22 bp, Homo sapiens
caagagtgaaactctgtctcaa

SEQ ID NO: 80803 - DNA, 18 bp, Homo sapiens
gctttctatgcgacagta

SEQ ID NO: 80804 - DNA, 23 bp, Homo sapiens
aaaacagcttcctccagtggctc

SEQ ID NO: 80805 - DNA, 17 bp, Homo sapiens
aggtgggtggatcacct

SEQ ID NO: 80806 - DNA, 22 bp, Homo sapiens
ggagagggtaggggtcctgccc

SEQ ID NO: 80807 - DNA, 22 bp, Homo sapiens
ggccctggcagccacgaaagcc

SEQ ID NO: 80808 - DNA, 22 bp, Homo sapiens
tttataatagatttggggcggc

SEQ ID NO: 80809 - DNA, 22 bp, Homo sapiens
tcactgcaacctccacctcccg

SEQ ID NO: 80810 - DNA, 22 bp, Homo sapiens
ttcaatatgatattagctgtgg

SEQ ID NO: 80811 - DNA, 23 bp, Homo sapiens
gcctgggagttgcgatctgcccg

SEQ ID NO: 80812 - DNA, 22 bp, Homo sapiens
tttgtagcagcatgatttataa

SEQ ID NO: 80813 - DNA, 22 bp, Homo sapiens
gtctcttagaaccttgttttgg

SEQ ID NO: 80814 - DNA, 22 bp, Homo sapiens
tgataggtcctcgggcactgga

SEQ ID NO: 80815 - DNA, 22 bp, Homo sapiens
tagcccaggctggagtgcaggg

SEQ ID NO: 80816 - DNA, 21 bp, Homo sapiens
ccaggccaggcctacggggat

SEQ ID NO: 80817 - DNA, 22 bp, Homo sapiens
tcatcagggatattggcctgaa

SEQ ID NO: 80818 - DNA, 22 bp, Homo sapiens
ggctgtgtggccgtgggctcta

SEQ ID NO: 80819 - DNA, 22 bp, Homo sapiens
taaagggtaggttttactgtaa

SEQ ID NO: 80820 - DNA, 22 bp, Homo sapiens
tgggagaaagaaccctgagtga

SEQ ID NO: 80821 - DNA, 22 bp, Homo sapiens
ggttccccaggcggcccttgga

SEQ ID NO: 80822 - DNA, 20 bp, Homo sapiens
ataaaataactgccacaaga

SEQ ID NO: 80823 - DNA, 17 bp, Homo sapiens
gtaaggcttgcagatgc

SEQ ID NO: 80824 - DNA, 20 bp, Homo sapiens
aaacgagccatcattctggt

SEQ ID NO: 80825 - DNA, 22 bp, Homo sapiens
aactcaaagatgcatgacgctt

SEQ ID NO: 80826 - DNA, 22 bp, Homo sapiens
cttccttctcactagcagcgcc

SEQ ID NO: 80827 - DNA, 22 bp, Homo sapiens
cttttcattgtttgtacatgca

SEQ ID NO: 80828 - DNA, 22 bp, Homo sapiens
gccagccagaaacgtcacactg

SEQ ID NO: 80829 - DNA, 22 bp, Homo sapiens
aatattatcaaaagctttttca

SEQ ID NO: 80830 - DNA, 22 bp, Homo sapiens
ttgaccactgaatggttctgaa

SEQ ID NO: 80831 - DNA, 22 bp, Homo sapiens
ggatgttctggggttctcttgt

SEQ ID NO: 80832 - DNA, 22 bp, Homo sapiens
gttgagtgggttaggatgctga

SEQ ID NO: 80833 - DNA, 22 bp, Homo sapiens
gccagcagcttcttctcatcct

SEQ ID NO: 80834 - DNA, 22 bp, Homo sapiens
agcgaggtgagtcctccagctc

SEQ ID NO: 80835 - DNA, 22 bp, Homo sapiens
tggagtgaagggttggcacggt

SEQ ID NO: 80836 - DNA, 19 bp, Homo sapiens
ctgggatgtctcctcccag

SEQ ID NO: 80837 - DNA, 22 bp, Homo sapiens
gaatttcctctaaacccctgag

SEQ ID NO: 80838 - DNA, 22 bp, Homo sapiens
ctgcttgcaaagtgttggtgat

SEQ ID NO: 80839 - DNA, 22 bp, Homo sapiens
gggcagcagccactcatttagc

SEQ ID NO: 80840 - DNA, 22 bp, Homo sapiens
taaagattgctcaaaactgtga

SEQ ID NO: 80841 - DNA, 22 bp, Homo sapiens
gctgtgtccaggtgggggtgac

SEQ ID NO: 80842 - DNA, 22 bp, Homo sapiens
gaatttaagaggatgaatctgt

SEQ ID NO: 80843 - DNA, 22 bp, Homo sapiens
agccaagcactcaactcctgga

SEQ ID NO: 80844 - DNA, 22 bp, Homo sapiens
aatgaattgcagtactgacttg

SEQ ID NO: 80845 - DNA, 22 bp, Homo sapiens
gggccaccccactgcccacgct

SEQ ID NO: 80846 - DNA, 22 bp, Homo sapiens
agttgcagacgcagagatgttg

SEQ ID NO: 80847 - DNA, 21 bp, Homo sapiens
ctcccagggtgactgttcaac

SEQ ID NO: 80848 - DNA, 22 bp, Homo sapiens
ttactggctgggcctgagggct

SEQ ID NO: 80849 - DNA, 22 bp, Homo sapiens
gcctggattccttgtttctcag

SEQ ID NO: 80850 - DNA, 22 bp, Homo sapiens
ttgggacagctgtggtagtgag

SEQ ID NO: 80851 - DNA, 22 bp, Homo sapiens
aggcaaggtgctacagacagtg

SEQ ID NO: 80852 - DNA, 15 bp, Homo sapiens
catatcactgggaat

SEQ ID NO: 80853 - DNA, 22 bp, Homo sapiens
cccaggggttctgagcagcagc

SEQ ID NO: 80854 - DNA, 23 bp, Homo sapiens
gcctgccgcctggctgagaactg

SEQ ID NO: 80855 - DNA, 22 bp, Homo sapiens
gaacttggaactggggctactg

SEQ ID NO: 80856 - DNA, 22 bp, Homo sapiens
ggaggcagaatagagtgtgggt

SEQ ID NO: 80857 - DNA, 22 bp, Homo sapiens
cccatggcttaggagggagtgt

SEQ ID NO: 80858 - DNA, 18 bp, Homo sapiens
cttgttcttctcttggcg

SEQ ID NO: 80859 - DNA, 22 bp, Homo sapiens
aagtgcttccatgtttgagtgt

SEQ ID NO: 80860 - DNA, 22 bp, Homo sapiens
ctgtatctgtgttggatgagtt

SEQ ID NO: 80861 - DNA, 22 bp, Homo sapiens
atgctatgtaactggcagatag

SEQ ID NO: 80862 - DNA, 22 bp, Homo sapiens
gagcccaggaagtggaggctga

SEQ ID NO: 80863 - DNA, 22 bp, Homo sapiens
atgtaattattaacacctgtgc

SEQ ID NO: 80864 - DNA, 22 bp, Homo sapiens
agacagctggtagcacttcctg

SEQ ID NO: 80865 - DNA, 22 bp, Homo sapiens
ctcctgaattgtccctcacagc

SEQ ID NO: 80866 - DNA, 22 bp, Homo sapiens
gagctgggcctgcgagtgctgc

SEQ ID NO: 80867 - DNA, 22 bp, Homo sapiens
acagcagagcctggtacttact

SEQ ID NO: 80868 - DNA, 22 bp, Homo sapiens
tggggagtgatgcctcggataa

SEQ ID NO: 80869 - DNA, 22 bp, Homo sapiens
actgcaacctccgcctgccagg

SEQ ID NO: 80870 - DNA, 22 bp, Homo sapiens
tttgtttgccacacaaaacagt

SEQ ID NO: 80871 - DNA, 22 bp, Homo sapiens
tctctagtctcctttaacctga

SEQ ID NO: 80872 - DNA, 22 bp, Homo sapiens
agcccaggttgaggctgcagtg

SEQ ID NO: 80873 - DNA, 23 bp, Homo sapiens
tttctgatgagggatgtggtatg

SEQ ID NO: 80874 - DNA, 22 bp, Homo sapiens
gtccaaaagagccagccgggcg

SEQ ID NO: 80875 - DNA, 22 bp, Homo sapiens
aggacaaaggaccagatctgga

SEQ ID NO: 80876 - DNA, 22 bp, Homo sapiens
gcagaggacacaggagggcaag

SEQ ID NO: 80877 - DNA, 22 bp, Homo sapiens
tggttacccagtcgctggagtt

SEQ ID NO: 80878 - DNA, 22 bp, Homo sapiens
tccggtccgggtactcctctct

SEQ ID NO: 80879 - DNA, 22 bp, Homo sapiens
ctgggctcaagtgatccaccca

SEQ ID NO: 80880 - DNA, 22 bp, Homo sapiens
cctgtcatatacatacctcctc

SEQ ID NO: 80881 - DNA, 22 bp, Homo sapiens
gctgaaggcccggaggacaggg

SEQ ID NO: 80882 - DNA, 22 bp, Homo sapiens
acggggctagagaaggtttctt

SEQ ID NO: 80883 - DNA, 22 bp, Homo sapiens
ctgacttgcctaggtcattgtg

SEQ ID NO: 80884 - DNA, 22 bp, Homo sapiens
ttctgggtttacatctgacttc

SEQ ID NO: 80885 - DNA, 22 bp, Homo sapiens
ctggagagaatgtggaatgatt

SEQ ID NO: 80886 - DNA, 22 bp, Homo sapiens
gtttacttgtgccttggcttaa

SEQ ID NO: 80887 - DNA, 22 bp, Homo sapiens
ctagttctagatccctgaggaa

SEQ ID NO: 80888 - DNA, 22 bp, Homo sapiens
tcctgccgtcctccggggcctc

SEQ ID NO: 80889 - DNA, 22 bp, Homo sapiens
tggatatccttgttaactttct

SEQ ID NO: 80890 - DNA, 22 bp, Homo sapiens
acccacgaagatgagcggcatg

SEQ ID NO: 80891 - DNA, 22 bp, Homo sapiens
agtcttcccagaggaggtgcca

SEQ ID NO: 80892 - DNA, 22 bp, Homo sapiens
cgccccggacgtctgaccaaac

SEQ ID NO: 80893 - DNA, 22 bp, Homo sapiens
ggaactcctgctccaagcagct

SEQ ID NO: 80894 - DNA, 22 bp, Homo sapiens
agggatggagtgcggcccggac

SEQ ID NO: 80895 - DNA, 22 bp, Homo sapiens
gctggggaggcagcagagaaca

SEQ ID NO: 80896 - DNA, 18 bp, Homo sapiens
acacttcctggtggtgtg

SEQ ID NO: 80897 - DNA, 22 bp, Homo sapiens
gttggctatgagagctttagtg

SEQ ID NO: 80898 - DNA, 21 bp, Homo sapiens
gctcctggtgctgcgtggcgc

SEQ ID NO: 80899 - DNA, 22 bp, Homo sapiens
aatattatacagtcaacctctt

SEQ ID NO: 80900 - DNA, 22 bp, Homo sapiens
ggaggcggaagttgcagtgagc

SEQ ID NO: 80901 - DNA, 22 bp, Homo sapiens
cctcttctaggacgtccttgtg

SEQ ID NO: 80902 - DNA, 22 bp, Homo sapiens
ttctctgcctcacaggtctaag

SEQ ID NO: 80903 - DNA, 22 bp, Homo sapiens
ggttgcaaactcctgggatcaa

SEQ ID NO: 80904 - DNA, 19 bp, Homo sapiens
atgtacccagtgtcaatcc

SEQ ID NO: 80905 - DNA, 22 bp, Homo sapiens
cgccaggcttggtagctcatgc

SEQ ID NO: 80906 - DNA, 22 bp, Homo sapiens
catttacatttaaggttaatat

SEQ ID NO: 80907 - DNA, 22 bp, Homo sapiens
ggggaaagccagccctgcttcc

SEQ ID NO: 80908 - DNA, 22 bp, Homo sapiens
ggctgggcctctccctcagctg

SEQ ID NO: 80909 - DNA, 22 bp, Homo sapiens
atgccactgcactccagcctag

SEQ ID NO: 80910 - DNA, 22 bp, Homo sapiens
agtctagtaggatctctgggct

SEQ ID NO: 80911 - DNA, 16 bp, Homo sapiens
gcagaggaaaggggag

SEQ ID NO: 80912 - DNA, 22 bp, Homo sapiens
gggcctgctgcaggttcaggat

SEQ ID NO: 80913 - DNA, 22 bp, Homo sapiens
attctaaatcagagagctctgt

SEQ ID NO: 80914 - DNA, 22 bp, Homo sapiens
cggggacacactggcagctcct

SEQ ID NO: 80915 - DNA, 22 bp, Homo sapiens
ggtaacttagctcatggctgtg

SEQ ID NO: 80916 - DNA, 22 bp, Homo sapiens
ggtgccctggaagctgctgcat

SEQ ID NO: 80917 - DNA, 22 bp, Homo sapiens
ccctgccttgtctgggctaggt

SEQ ID NO: 80918 - DNA, 22 bp, Homo sapiens
tgcacgtgggctctctgctctt

SEQ ID NO: 80919 - DNA, 22 bp, Homo sapiens
cagggccagggacacgctgtca

SEQ ID NO: 80920 - DNA, 22 bp, Homo sapiens
ggagagcttggagtgcgatttt

SEQ ID NO: 80921 - DNA, 22 bp, Homo sapiens
cctgtctctgcagggccctgcc

SEQ ID NO: 80922 - DNA, 22 bp, Homo sapiens
tgacttgtctctttgggagaca

SEQ ID NO: 80923 - DNA, 22 bp, Homo sapiens
ggatgttgattgaatggccatt

SEQ ID NO: 80924 - DNA, 22 bp, Homo sapiens
actctgctctgtatttcactgt

SEQ ID NO: 80925 - DNA, 22 bp, Homo sapiens
gagctgtgtatgcatcattctg

SEQ ID NO: 80926 - DNA, 21 bp, Homo sapiens
attctttgatgtgcaataagt

SEQ ID NO: 80927 - DNA, 22 bp, Homo sapiens
agagctgtgtttagtagttacg

SEQ ID NO: 80928 - DNA, 22 bp, Homo sapiens
gcggccttgtggcggagcaggc

SEQ ID NO: 80929 - DNA, 22 bp, Homo sapiens
tccagggccatctccatgaggc

SEQ ID NO: 80930 - DNA, 22 bp, Homo sapiens
ggagtgcagtggcgtgatctca

SEQ ID NO: 80931 - DNA, 22 bp, Homo sapiens
gagcagtgtttgtggacctgga

SEQ ID NO: 80932 - DNA, 20 bp, Homo sapiens
aggaaaaatggaaactggag

SEQ ID NO: 80933 - DNA, 22 bp, Homo sapiens
gattgagtctgaggatgctgca

SEQ ID NO: 80934 - DNA, 22 bp, Homo sapiens
tgatctggtcctactgtgggca

SEQ ID NO: 80935 - DNA, 22 bp, Homo sapiens
ttgctttgtttaaaagtggtat

SEQ ID NO: 80936 - DNA, 22 bp, Homo sapiens
aggggctcctttgtgctgcgtc

SEQ ID NO: 80937 - DNA, 22 bp, Homo sapiens
cttggaggtggaagttgcagtg

SEQ ID NO: 80938 - DNA, 22 bp, Homo sapiens
gctgtgtatcagatgccacggg

SEQ ID NO: 80939 - DNA, 22 bp, Homo sapiens
atattgaaccctacagactgta

SEQ ID NO: 80940 - DNA, 22 bp, Homo sapiens
tgatgaccgccaacgtttaggt

SEQ ID NO: 80941 - DNA, 22 bp, Homo sapiens
tatgccactgctctccatccta

SEQ ID NO: 80942 - DNA, 22 bp, Homo sapiens
gtcagcgtgctcagcctattat

SEQ ID NO: 80943 - DNA, 22 bp, Homo sapiens
gaccatcctggccaacgtggta

SEQ ID NO: 80944 - DNA, 22 bp, Homo sapiens
tcggagcgtcactggctggagg

SEQ ID NO: 80945 - DNA, 21 bp, Homo sapiens
ggagtttttctggaagggact

SEQ ID NO: 80946 - DNA, 22 bp, Homo sapiens
ctgctgaggtggagattgcagt

SEQ ID NO: 80947 - DNA, 22 bp, Homo sapiens
gtgctggggagataggaagaga

SEQ ID NO: 80948 - DNA, 22 bp, Homo sapiens
acccaggccattggcaagagtc

SEQ ID NO: 80949 - DNA, 22 bp, Homo sapiens
gcaccactacactccagcctgg

SEQ ID NO: 80950 - DNA, 22 bp, Homo sapiens
cccagggaggcccaggctctgc

SEQ ID NO: 80951 - DNA, 22 bp, Homo sapiens
acaattctgatggtttcccagt

SEQ ID NO: 80952 - DNA, 22 bp, Homo sapiens
ttgacacagtcaacttgatttt

SEQ ID NO: 80953 - DNA, 22 bp, Homo sapiens
caattgtcagtgctgtttaaat

SEQ ID NO: 80954 - DNA, 22 bp, Homo sapiens
actgcaaagggaagccctttct

SEQ ID NO: 80955 - DNA, 22 bp, Homo sapiens
atgaaatatcttgaagaaattc

SEQ ID NO: 80956 - DNA, 22 bp, Homo sapiens
atgccactgcgctccagcctgg

SEQ ID NO: 80957 - DNA, 22 bp, Homo sapiens
agagggtgggcacgtgatggat

SEQ ID NO: 80958 - DNA, 22 bp, Homo sapiens
ataggtccaaggagaggtcttt

SEQ ID NO: 80959 - DNA, 22 bp, Homo sapiens
tagcccctgcctttgaacctgg

SEQ ID NO: 80960 - DNA, 22 bp, Homo sapiens
gcccaggagttcaagtctagtg

SEQ ID NO: 80961 - DNA, 22 bp, Homo sapiens
agctggggctgtggttgtgatt

SEQ ID NO: 80962 - DNA, 23 bp, Homo sapiens
cgcccagcctcagtgacctgggc

SEQ ID NO: 80963 - DNA, 22 bp, Homo sapiens
gcctggagaaaggaaggtggga

SEQ ID NO: 80964 - DNA, 22 bp, Homo sapiens
tacagcctggcactaccctggg

SEQ ID NO: 80965 - DNA, 22 bp, Homo sapiens
ctgaagagaaagggagctcttc

SEQ ID NO: 80966 - DNA, 22 bp, Homo sapiens
gtggaggagaggcgccttgcgg

SEQ ID NO: 80967 - DNA, 22 bp, Homo sapiens
ctggagcaaaagtgactcctct

SEQ ID NO: 80968 - DNA, 22 bp, Homo sapiens
ttattgaaggaactgaaataaa

SEQ ID NO: 80969 - DNA, 22 bp, Homo sapiens
tagatctgatacaattcatctg

SEQ ID NO: 80970 - DNA, 22 bp, Homo sapiens
aaatgtaagtctttgtttctta

SEQ ID NO: 80971 - DNA, 23 bp, Homo sapiens
tctctgcatgtcctgagcacatc

SEQ ID NO: 80972 - DNA, 22 bp, Homo sapiens
gaagcctcaacatctctgcgtc

SEQ ID NO: 80973 - DNA, 22 bp, Homo sapiens
aattgaaaatattgtagaccat

SEQ ID NO: 80974 - DNA, 22 bp, Homo sapiens
tgtatagttgagtcaagtttca

SEQ ID NO: 80975 - DNA, 22 bp, Homo sapiens
ctcctgggaaaggctggacaca

SEQ ID NO: 80976 - DNA, 22 bp, Homo sapiens
aaaagcaattgcgggttttgcc

SEQ ID NO: 80977 - DNA, 22 bp, Homo sapiens
atgccactgcacttcagcttgg

SEQ ID NO: 80978 - DNA, 22 bp, Homo sapiens
gagcacagtaaagcagtgtcac

SEQ ID NO: 80979 - DNA, 22 bp, Homo sapiens
ctgggctagaaggaccaggatg

SEQ ID NO: 80980 - DNA, 22 bp, Homo sapiens
aacactgctgctgggttctgtg

SEQ ID NO: 80981 - DNA, 19 bp, Homo sapiens
tgttgtctaccatgaagtc

SEQ ID NO: 80982 - DNA, 22 bp, Homo sapiens
aaccaccattctctcctcttcc

SEQ ID NO: 80983 - DNA, 22 bp, Homo sapiens
ttgccgccgtctgctcgccccg

SEQ ID NO: 80984 - DNA, 22 bp, Homo sapiens
aggccctattcaatggggccca

SEQ ID NO: 80985 - DNA, 22 bp, Homo sapiens
gactggtaaggaaattcactaa

SEQ ID NO: 80986 - DNA, 22 bp, Homo sapiens
cctccctgccggctggactagt

SEQ ID NO: 80987 - DNA, 22 bp, Homo sapiens
gaagaaggtggcccaggggtag

SEQ ID NO: 80988 - DNA, 22 bp, Homo sapiens
aggaaaacagaccaaggagctc

SEQ ID NO: 80989 - DNA, 22 bp, Homo sapiens
ctgggatgcggaggttgcggtg

SEQ ID NO: 80990 - DNA, 22 bp, Homo sapiens
catgtaaagaatttcacacaag

SEQ ID NO: 80991 - DNA, 22 bp, Homo sapiens
cctagatgggatggcggccggg

SEQ ID NO: 80992 - DNA, 22 bp, Homo sapiens
ggccaggcgatgacccctccac

SEQ ID NO: 80993 - DNA, 22 bp, Homo sapiens
agtgctatcgagttctaatgct

SEQ ID NO: 80994 - DNA, 19 bp, Homo sapiens
tcctgcccaccagccaggg

SEQ ID NO: 80995 - DNA, 22 bp, Homo sapiens
gctgtcttgctcactcttgcag

SEQ ID NO: 80996 - DNA, 22 bp, Homo sapiens
ggcagacctctccagccccaca

SEQ ID NO: 80997 - DNA, 22 bp, Homo sapiens
ggtgaggggctcctctgcccgg

SEQ ID NO: 80998 - DNA, 22 bp, Homo sapiens
atacaaaaattagccgggagta

SEQ ID NO: 80999 - DNA, 22 bp, Homo sapiens
gagggagggactagcattctct

SEQ ID NO: 81000 - DNA, 22 bp, Homo sapiens
cctagagctctgctttatctaa

SEQ ID NO: 81001 - DNA, 22 bp, Homo sapiens
catctgtctgcatgctctgggt

SEQ ID NO: 81002 - DNA, 22 bp, Homo sapiens
gtagggttggagagcacaacca

SEQ ID NO: 81003 - DNA, 22 bp, Homo sapiens
aggggaatgggtagactgttga

SEQ ID NO: 81004 - DNA, 22 bp, Homo sapiens
gcagcctgggcaacagagtgag

SEQ ID NO: 81005 - DNA, 22 bp, Homo sapiens
cactgcatggctgtgaggcagc

SEQ ID NO: 81006 - DNA, 22 bp, Homo sapiens
tgtagctctccagccagcaagg

SEQ ID NO: 81007 - DNA, 22 bp, Homo sapiens
tgctcttcacagtttcagcatc

SEQ ID NO: 81008 - DNA, 22 bp, Homo sapiens
ctgcttctagcaccaagtccct

SEQ ID NO: 81009 - DNA, 22 bp, Homo sapiens
ttgcatagtgctgaggttcggg

SEQ ID NO: 81010 - DNA, 22 bp, Homo sapiens
gtagttctgcagtgtcacctga

SEQ ID NO: 81011 - DNA, 22 bp, Homo sapiens
gcgaatctcagctggtgctgcg

SEQ ID NO: 81012 - DNA, 22 bp, Homo sapiens
atgccactgacatggacaattt

SEQ ID NO: 81013 - DNA, 22 bp, Homo sapiens
gtggcttggaccagtcacagtg

SEQ ID NO: 81014 - DNA, 22 bp, Homo sapiens
catgagataatttttctccagt

SEQ ID NO: 81015 - DNA, 22 bp, Homo sapiens
attaagtgactaaagtaatgct

SEQ ID NO: 81016 - DNA, 22 bp, Homo sapiens
aacgcccagccttgatcaaatg

SEQ ID NO: 81017 - DNA, 22 bp, Homo sapiens
agagtccctcttcccaggaggc

SEQ ID NO: 81018 - DNA, 22 bp, Homo sapiens
aagagggaaattgttggctgct

SEQ ID NO: 81019 - DNA, 22 bp, Homo sapiens
tgacaggcaggacagaggtgtg

SEQ ID NO: 81020 - DNA, 22 bp, Homo sapiens
gttcaagaccagcctggccaac

SEQ ID NO: 81021 - DNA, 22 bp, Homo sapiens
ggacttgagccgctcggagttc

SEQ ID NO: 81022 - DNA, 22 bp, Homo sapiens
gggcaggggtcagtggccccaa

SEQ ID NO: 81023 - DNA, 22 bp, Homo sapiens
aacatgatttcatgcatttaga

SEQ ID NO: 81024 - DNA, 22 bp, Homo sapiens
ggcaagagggcagatggagtgc

SEQ ID NO: 81025 - DNA, 22 bp, Homo sapiens
cttgcagtttaggtcctctgtg

SEQ ID NO: 81026 - DNA, 22 bp, Homo sapiens
gccaggctgaggctctggaaga

SEQ ID NO: 81027 - DNA, 22 bp, Homo sapiens
aaggtcagagtgagctgtggcc

SEQ ID NO: 81028 - DNA, 22 bp, Homo sapiens
gaggcaggcagattgcttgagg

SEQ ID NO: 81029 - DNA, 22 bp, Homo sapiens
aggggatgcctagtggagtctc

SEQ ID NO: 81030 - DNA, 22 bp, Homo sapiens
gggcgccgtgggaaacagccgg

SEQ ID NO: 81031 - DNA, 22 bp, Homo sapiens
ctgtatttcttggacagttgct

SEQ ID NO: 81032 - DNA, 22 bp, Homo sapiens
accctctagagggaagcacttt

SEQ ID NO: 81033 - DNA, 22 bp, Homo sapiens
acccgcgagtctcactgccgct

SEQ ID NO: 81034 - DNA, 22 bp, Homo sapiens
agcctgggccctgcctcttctc

SEQ ID NO: 81035 - DNA, 22 bp, Homo sapiens
aacggctgtggctggcggcagc

SEQ ID NO: 81036 - DNA, 22 bp, Homo sapiens
gaggtaacactgttcagtgggc

SEQ ID NO: 81037 - DNA, 22 bp, Homo sapiens
cagggccagcgtctcgggctat

SEQ ID NO: 81038 - DNA, 22 bp, Homo sapiens
ctctccattccctacagttttc

SEQ ID NO: 81039 - DNA, 22 bp, Homo sapiens
gcctccagcccacgcaggcctg

SEQ ID NO: 81040 - DNA, 22 bp, Homo sapiens
tttaatcataagaaggaaaata

SEQ ID NO: 81041 - DNA, 22 bp, Homo sapiens
gaggctgaggcggatggatcac

SEQ ID NO: 81042 - DNA, 22 bp, Homo sapiens
ttgagcaggatggctatgcaca

SEQ ID NO: 81043 - DNA, 22 bp, Homo sapiens
aaacttttttaggttcataggc

SEQ ID NO: 81044 - DNA, 22 bp, Homo sapiens
aaggaaagctgtggttctgaga

SEQ ID NO: 81045 - DNA, 22 bp, Homo sapiens
acggtgctgggtattggggttc

SEQ ID NO: 81046 - DNA, 22 bp, Homo sapiens
gagtcgagcagaaagccgtcgg

SEQ ID NO: 81047 - DNA, 22 bp, Homo sapiens
tgcgggatgacagtggccaaca

SEQ ID NO: 81048 - DNA, 22 bp, Homo sapiens
gggcgcatcacctgaggtcagg

SEQ ID NO: 81049 - DNA, 22 bp, Homo sapiens
actttatttcctattgcatcca

SEQ ID NO: 81050 - DNA, 22 bp, Homo sapiens
taaatgttgtaagtacatctaa

SEQ ID NO: 81051 - DNA, 22 bp, Homo sapiens
ccttcccatgcagcctgtctga

SEQ ID NO: 81052 - DNA, 22 bp, Homo sapiens
cccagttttctgattgaagagc

SEQ ID NO: 81053 - DNA, 22 bp, Homo sapiens
gggcagagactcagaaacagaa

SEQ ID NO: 81054 - DNA, 22 bp, Homo sapiens
ccttgctcaagctagtgacggg

SEQ ID NO: 81055 - DNA, 22 bp, Homo sapiens
tcttgggcaatttctctagagg

SEQ ID NO: 81056 - DNA, 22 bp, Homo sapiens
ggcctcacccatcggtgccttt

SEQ ID NO: 81057 - DNA, 22 bp, Homo sapiens
tcttacccggcaacgtgtgtcg

SEQ ID NO: 81058 - DNA, 21 bp, Homo sapiens
ctgtcatgcaaccattctcca

SEQ ID NO: 81059 - DNA, 22 bp, Homo sapiens
actgccaatggtagtttgatgg

SEQ ID NO: 81060 - DNA, 22 bp, Homo sapiens
taaatacttagttttgtgtcta

SEQ ID NO: 81061 - DNA, 22 bp, Homo sapiens
cgcggtggcggcctccagcgcc

SEQ ID NO: 81062 - DNA, 22 bp, Homo sapiens
gctccctggtagccatgctctc

SEQ ID NO: 81063 - DNA, 23 bp, Homo sapiens
aacgacagctacaggcatcccac

SEQ ID NO: 81064 - DNA, 22 bp, Homo sapiens
aaggagaaatggtagatgtgca

SEQ ID NO: 81065 - DNA, 22 bp, Homo sapiens
ttcagcagtgcagacacccagt

SEQ ID NO: 81066 - DNA, 22 bp, Homo sapiens
tgggggagctcagtccagccca

SEQ ID NO: 81067 - DNA, 22 bp, Homo sapiens
tgtatattctgcctaaaagctt

SEQ ID NO: 81068 - DNA, 22 bp, Homo sapiens
gagtaaatgtcactgttgctgt

SEQ ID NO: 81069 - DNA, 22 bp, Homo sapiens
gcttacaggtgaggcagcaaga

SEQ ID NO: 81070 - DNA, 22 bp, Homo sapiens
gggaggctctgctcagcccccg

SEQ ID NO: 81071 - DNA, 22 bp, Homo sapiens
cctgagtagctggaattaaagg

SEQ ID NO: 81072 - DNA, 22 bp, Homo sapiens
ggcagcactgcagcttgttggg

SEQ ID NO: 81073 - DNA, 22 bp, Homo sapiens
ggaagggcaaaagagatgaact

SEQ ID NO: 81074 - DNA, 22 bp, Homo sapiens
ttcccttaaattatggcatcta

SEQ ID NO: 81075 - DNA, 22 bp, Homo sapiens
gccctgggcaaggttctggcca

SEQ ID NO: 81076 - DNA, 22 bp, Homo sapiens
ccgcaaggcagaggttgcagtg

SEQ ID NO: 81077 - DNA, 22 bp, Homo sapiens
tcttgcacttcatgaatatgtt

SEQ ID NO: 81078 - DNA, 22 bp, Homo sapiens
ctgccgttgtgaagctcttaga

SEQ ID NO: 81079 - DNA, 22 bp, Homo sapiens
ggtcgctgtgtaggttcagcta

SEQ ID NO: 81080 - DNA, 22 bp, Homo sapiens
tgaagactcagaagctaagata

SEQ ID NO: 81081 - DNA, 22 bp, Homo sapiens
accatgtcatttattggccaaa

SEQ ID NO: 81082 - DNA, 22 bp, Homo sapiens
aggtaaagacagtgaaagaggg

SEQ ID NO: 81083 - DNA, 22 bp, Homo sapiens
gcccagagttcaaggctgcagt

SEQ ID NO: 81084 - DNA, 22 bp, Homo sapiens
agtgactggtgtgaagttaaat

SEQ ID NO: 81085 - DNA, 22 bp, Homo sapiens
cccaggaggcggaggttgcagt

SEQ ID NO: 81086 - DNA, 22 bp, Homo sapiens
tctgttgcaatgtgcatggtga

SEQ ID NO: 81087 - DNA, 22 bp, Homo sapiens
cctgaggatgccagcatgggtg

SEQ ID NO: 81088 - DNA, 20 bp, Homo sapiens
aactcctagcctcaagtgat

SEQ ID NO: 81089 - DNA, 22 bp, Homo sapiens
tcacccctccattctctcatgt

SEQ ID NO: 81090 - DNA, 22 bp, Homo sapiens
tttgttttcaatgtgtcattca

SEQ ID NO: 81091 - DNA, 22 bp, Homo sapiens
ttctcttttcaccagttgctaa

SEQ ID NO: 81092 - DNA, 22 bp, Homo sapiens
tctcatgttgcttaactctatg

SEQ ID NO: 81093 - DNA, 22 bp, Homo sapiens
ccagagctgattcctgggactt

SEQ ID NO: 81094 - DNA, 22 bp, Homo sapiens
tttgaaatatgtgtcttttgaa

SEQ ID NO: 81095 - DNA, 22 bp, Homo sapiens
gaatgctaagcatgtgggagtt

SEQ ID NO: 81096 - DNA, 19 bp, Homo sapiens
gatttaaacgtggctctat

SEQ ID NO: 81097 - DNA, 22 bp, Homo sapiens
agagggatcaccctgtttctgg

SEQ ID NO: 81098 - DNA, 22 bp, Homo sapiens
gccctgtgcaggtgtgcagcag

SEQ ID NO: 81099 - DNA, 22 bp, Homo sapiens
ctgcttctccctgagatagtgt

SEQ ID NO: 81100 - DNA, 22 bp, Homo sapiens
gtaaaaaggccaagcccttgtg

SEQ ID NO: 81101 - DNA, 22 bp, Homo sapiens
ggacctgaacataaaacgaggc

SEQ ID NO: 81102 - DNA, 22 bp, Homo sapiens
actgtgtgtttgtctagcacag

SEQ ID NO: 81103 - DNA, 20 bp, Homo sapiens
attagagctacatggctaca

SEQ ID NO: 81104 - DNA, 22 bp, Homo sapiens
tgttgattagtgtttagactta

SEQ ID NO: 81105 - DNA, 22 bp, Homo sapiens
gagccaggttggaggctgcagt

SEQ ID NO: 81106 - DNA, 22 bp, Homo sapiens
tgatatgtaactactccttata

SEQ ID NO: 81107 - DNA, 22 bp, Homo sapiens
aaactgaggctcccgagggtgt

SEQ ID NO: 81108 - DNA, 22 bp, Homo sapiens
tcactgcaagctctgccttccg

SEQ ID NO: 81109 - DNA, 22 bp, Homo sapiens
ctttcaggagaggattataaca

SEQ ID NO: 81110 - DNA, 22 bp, Homo sapiens
ctctttggatagaattacaaag

SEQ ID NO: 81111 - DNA, 22 bp, Homo sapiens
tgctcatcaacatgatgatcat

SEQ ID NO: 81112 - DNA, 21 bp, Homo sapiens
agtttcaggaagttcagctgc

SEQ ID NO: 81113 - DNA, 22 bp, Homo sapiens
aggccttaccatagctgtagca

SEQ ID NO: 81114 - DNA, 22 bp, Homo sapiens
attgtgtcctcattgaccttca

SEQ ID NO: 81115 - DNA, 22 bp, Homo sapiens
cggccgcagcagtgtcggccca

SEQ ID NO: 81116 - DNA, 22 bp, Homo sapiens
cacagcctcctctggctcacgg

SEQ ID NO: 81117 - DNA, 22 bp, Homo sapiens
agcaagatttttcaggttagta

SEQ ID NO: 81118 - DNA, 22 bp, Homo sapiens
cctcctgcacctccaggaactc

SEQ ID NO: 81119 - DNA, 22 bp, Homo sapiens
ctggtagctcctgaatatccct

SEQ ID NO: 81120 - DNA, 22 bp, Homo sapiens
aggaattcaagaccagctgggc

SEQ ID NO: 81121 - DNA, 22 bp, Homo sapiens
tgctggacagggcacggcccat

SEQ ID NO: 81122 - DNA, 22 bp, Homo sapiens
tagatgaccttgtgttaggcaa

SEQ ID NO: 81123 - DNA, 22 bp, Homo sapiens
agaacactgatagctgagggga

SEQ ID NO: 81124 - DNA, 22 bp, Homo sapiens
tgggaggccgaggcaggtggat

SEQ ID NO: 81125 - DNA, 22 bp, Homo sapiens
tcctgagataaatctcatgtga

SEQ ID NO: 81126 - DNA, 22 bp, Homo sapiens
cccacacacatttatgatagga

SEQ ID NO: 81127 - DNA, 22 bp, Homo sapiens
agagctaagaaacagaattgct

SEQ ID NO: 81128 - DNA, 22 bp, Homo sapiens
cgccggcttgaggcaggcggca

SEQ ID NO: 81129 - DNA, 22 bp, Homo sapiens
ccaggtgtgctctgcagtggat

SEQ ID NO: 81130 - DNA, 22 bp, Homo sapiens
ggagtgaagtggcgcgatctcg

SEQ ID NO: 81131 - DNA, 22 bp, Homo sapiens
tcagggattgcaaaattcatcc

SEQ ID NO: 81132 - DNA, 22 bp, Homo sapiens
gtccacagctctgaggtctccc

SEQ ID NO: 81133 - DNA, 22 bp, Homo sapiens
ttgcccaggctggagtgcagtg

SEQ ID NO: 81134 - DNA, 22 bp, Homo sapiens
aggttatcatcagttgagcact

SEQ ID NO: 81135 - DNA, 22 bp, Homo sapiens
tttcaacagatctgtcttcagg

SEQ ID NO: 81136 - DNA, 22 bp, Homo sapiens
tctcgctctgtcgcccaggctg

SEQ ID NO: 81137 - DNA, 22 bp, Homo sapiens
ggctgtggcagctggaagtggt

SEQ ID NO: 81138 - DNA, 22 bp, Homo sapiens
gggcggggggagctggaatgaa

SEQ ID NO: 81139 - DNA, 22 bp, Homo sapiens
agttattactctttaacatatt

SEQ ID NO: 81140 - DNA, 22 bp, Homo sapiens
tatccaattcaccattgatggg

SEQ ID NO: 81141 - DNA, 22 bp, Homo sapiens
acttgccccagaattgctgctg

SEQ ID NO: 81142 - DNA, 22 bp, Homo sapiens
agaggaggctctgggatcgtcc

SEQ ID NO: 81143 - DNA, 22 bp, Homo sapiens
tctgtcttagccatctcaggct

SEQ ID NO: 81144 - DNA, 17 bp, Homo sapiens
tccttcagtgcctctgc

SEQ ID NO: 81145 - DNA, 22 bp, Homo sapiens
agagcagctcgctacctctcta

SEQ ID NO: 81146 - DNA, 22 bp, Homo sapiens
ctggagggtggagagaagtctc

SEQ ID NO: 81147 - DNA, 22 bp, Homo sapiens
tcgcaccattgcactccagcca

SEQ ID NO: 81148 - DNA, 22 bp, Homo sapiens
gggaaatctcgtcctctattta

SEQ ID NO: 81149 - DNA, 22 bp, Homo sapiens
aagatacagacagagccaaaat

SEQ ID NO: 81150 - DNA, 22 bp, Homo sapiens
aggaaataagggacaagacaaa

SEQ ID NO: 81151 - DNA, 22 bp, Homo sapiens
gaggcaaagcatgtggctcagg

SEQ ID NO: 81152 - DNA, 23 bp, Homo sapiens
ttgcatagacatcctcatagatt

SEQ ID NO: 81153 - DNA, 22 bp, Homo sapiens
atgggttcaagtgattctcctg

SEQ ID NO: 81154 - DNA, 22 bp, Homo sapiens
gttactcttgagaggctgaggt

SEQ ID NO: 81155 - DNA, 22 bp, Homo sapiens
cccaggggttcaaggctgcagt

SEQ ID NO: 81156 - DNA, 22 bp, Homo sapiens
ccaggaggttgaggctgcagtg

SEQ ID NO: 81157 - DNA, 22 bp, Homo sapiens
gccatcatatcccctgtgacct

SEQ ID NO: 81158 - DNA, 22 bp, Homo sapiens
actggggtttaggcctgggcaa

SEQ ID NO: 81159 - DNA, 22 bp, Homo sapiens
ctgtggctctcagaggctgctg

SEQ ID NO: 81160 - DNA, 22 bp, Homo sapiens
agagctgggtggacttgtagtt

SEQ ID NO: 81161 - DNA, 22 bp, Homo sapiens
accactgcactccagtctgggc

SEQ ID NO: 81162 - DNA, 22 bp, Homo sapiens
accccaggaagtggaggtcatg

SEQ ID NO: 81163 - DNA, 22 bp, Homo sapiens
caggctgaagtgcagtggtgtg

SEQ ID NO: 81164 - DNA, 22 bp, Homo sapiens
cccaggaggtggagcttgcagt

SEQ ID NO: 81165 - DNA, 22 bp, Homo sapiens
tctgacattagattaattggaa

SEQ ID NO: 81166 - DNA, 22 bp, Homo sapiens
taacaatacccattctaattac

SEQ ID NO: 81167 - DNA, 22 bp, Homo sapiens
gcagggaggtttgctgacctgg

SEQ ID NO: 81168 - DNA, 22 bp, Homo sapiens
acgttttctagagaatatgcag

SEQ ID NO: 81169 - DNA, 22 bp, Homo sapiens
gcggtagctcaagcttgtaatc

SEQ ID NO: 81170 - DNA, 22 bp, Homo sapiens
ctctgcctgtctcatcctgcaa

SEQ ID NO: 81171 - DNA, 22 bp, Homo sapiens
gtagaggggtgattctgtgaga

SEQ ID NO: 81172 - DNA, 22 bp, Homo sapiens
atttctctgcagtgttcggaat

SEQ ID NO: 81173 - DNA, 22 bp, Homo sapiens
ttaataaagtatgaattggaaa

SEQ ID NO: 81174 - DNA, 22 bp, Homo sapiens
ataatacatggttgatcttttc

SEQ ID NO: 81175 - DNA, 22 bp, Homo sapiens
aggtacatggggtgtgtgcacg

SEQ ID NO: 81176 - DNA, 22 bp, Homo sapiens
gaccctctagatggaagcactg

SEQ ID NO: 81177 - DNA, 21 bp, Homo sapiens
cccgtgccttcagcagtcctg

SEQ ID NO: 81178 - DNA, 22 bp, Homo sapiens
taattataacatgctttctggc

SEQ ID NO: 81179 - DNA, 22 bp, Homo sapiens
cagttccctccgccagcacttc

SEQ ID NO: 81180 - DNA, 22 bp, Homo sapiens
gtcttagatttcaccgataatg

SEQ ID NO: 81181 - DNA, 22 bp, Homo sapiens
tctgagtggactgtcctgcagg

SEQ ID NO: 81182 - DNA, 22 bp, Homo sapiens
tccttgaaaggggctgcagggc

SEQ ID NO: 81183 - DNA, 23 bp, Homo sapiens
attttttgtctttgtaactagat

SEQ ID NO: 81184 - DNA, 22 bp, Homo sapiens
aaaccggggcctttccacaatg

SEQ ID NO: 81185 - DNA, 17 bp, Homo sapiens
ttgaatgcattacttgg

SEQ ID NO: 81186 - DNA, 22 bp, Homo sapiens
ctggggtccttgccatgtgtca

SEQ ID NO: 81187 - DNA, 22 bp, Homo sapiens
gaccagtcattactcatgccct

SEQ ID NO: 81188 - DNA, 22 bp, Homo sapiens
tcccagctactctagaggctga

SEQ ID NO: 81189 - DNA, 22 bp, Homo sapiens
tggtatgtaaattgtaactcaa

SEQ ID NO: 81190 - DNA, 22 bp, Homo sapiens
aggctgagataggtggatcatt

SEQ ID NO: 81191 - DNA, 22 bp, Homo sapiens
gcggggggaggaacatcttgca

SEQ ID NO: 81192 - DNA, 22 bp, Homo sapiens
gtccctgagcctggcatttccc

SEQ ID NO: 81193 - DNA, 22 bp, Homo sapiens
gggtctcctaatggaggatgac

SEQ ID NO: 81194 - DNA, 17 bp, Homo sapiens
aggaggccctggcgttt

SEQ ID NO: 81195 - DNA, 22 bp, Homo sapiens
aacagctttgtatacagtaact

SEQ ID NO: 81196 - DNA, 22 bp, Homo sapiens
tttcttctatgtgtgatatttt

SEQ ID NO: 81197 - DNA, 22 bp, Homo sapiens
gatggcctcatggctgcaggcc

SEQ ID NO: 81198 - DNA, 23 bp, Homo sapiens
cctgcctccccatcagttataca

SEQ ID NO: 81199 - DNA, 22 bp, Homo sapiens
cagtggaggccttgggaccttt

SEQ ID NO: 81200 - DNA, 22 bp, Homo sapiens
ttggaacatgccggggtccagg

SEQ ID NO: 81201 - DNA, 22 bp, Homo sapiens
ggctcacgcaattatcccggcc

SEQ ID NO: 81202 - DNA, 22 bp, Homo sapiens
tgctcattggcgatctgaggga

SEQ ID NO: 81203 - DNA, 22 bp, Homo sapiens
aggggcgtgctcttccccgacg

SEQ ID NO: 81204 - DNA, 22 bp, Homo sapiens
tagcacagcttcttgatgtcac

SEQ ID NO: 81205 - DNA, 20 bp, Homo sapiens
ttcatgggagcaaagaggcc

SEQ ID NO: 81206 - DNA, 22 bp, Homo sapiens
attgattttcagactatgcgag

SEQ ID NO: 81207 - DNA, 22 bp, Homo sapiens
ctgtaatcccagctacctggga

SEQ ID NO: 81208 - DNA, 22 bp, Homo sapiens
agggcgacaatggagagcgttt

SEQ ID NO: 81209 - DNA, 22 bp, Homo sapiens
tggcctctcctggctgagtttc

SEQ ID NO: 81210 - DNA, 22 bp, Homo sapiens
ctcagcagtatactctgaagat

SEQ ID NO: 81211 - DNA, 22 bp, Homo sapiens
ccaggaggtggaggttgcggtg

SEQ ID NO: 81212 - DNA, 21 bp, Homo sapiens
gcccacagtgaggaggatccc

SEQ ID NO: 81213 - DNA, 22 bp, Homo sapiens
ttattttaccttcctctgagct

SEQ ID NO: 81214 - DNA, 22 bp, Homo sapiens
gaacactgctgttgggttctga

SEQ ID NO: 81215 - DNA, 22 bp, Homo sapiens
cccctcttggcattgagtgcca

SEQ ID NO: 81216 - DNA, 22 bp, Homo sapiens
ggcaagaacctcaattaccttt

SEQ ID NO: 81217 - DNA, 22 bp, Homo sapiens
tctaatcctatggtggggaggg

SEQ ID NO: 81218 - DNA, 22 bp, Homo sapiens
gaccactggggtgagggccatc

SEQ ID NO: 81219 - DNA, 22 bp, Homo sapiens
tgtgtgagtaaggctgagagag

SEQ ID NO: 81220 - DNA, 22 bp, Homo sapiens
aggcgcctgcgggatccttgcc

SEQ ID NO: 81221 - DNA, 22 bp, Homo sapiens
gtggggtctgtcctcttctggg

SEQ ID NO: 81222 - DNA, 22 bp, Homo sapiens
cctggggtcacttgcagccgca

SEQ ID NO: 81223 - DNA, 22 bp, Homo sapiens
aggagaagccaagttgtgagca

SEQ ID NO: 81224 - DNA, 22 bp, Homo sapiens
ttatcacttatgagctttttgc

SEQ ID NO: 81225 - DNA, 18 bp, Homo sapiens
ggagactaaactgttgac

SEQ ID NO: 81226 - DNA, 22 bp, Homo sapiens
cagtggctggttagggacagga

SEQ ID NO: 81227 - DNA, 23 bp, Homo sapiens
ggcactcggccgtgaactcgtgc

SEQ ID NO: 81228 - DNA, 22 bp, Homo sapiens
actctggccatcttggaccttg

SEQ ID NO: 81229 - DNA, 22 bp, Homo sapiens
gaggccactgtccctgccttcc

SEQ ID NO: 81230 - DNA, 22 bp, Homo sapiens
tggttaagtccagaaaggaagc

SEQ ID NO: 81231 - DNA, 22 bp, Homo sapiens
tttcccaggctggaatgcagtg

SEQ ID NO: 81232 - DNA, 22 bp, Homo sapiens
taggcaagtggaccagaggttt

SEQ ID NO: 81233 - DNA, 22 bp, Homo sapiens
agggaattcactggaacgccct

SEQ ID NO: 81234 - DNA, 21 bp, Homo sapiens
ggccgccgccttgtgctctgc

SEQ ID NO: 81235 - DNA, 22 bp, Homo sapiens
ggggcccctcggacacgtgcgg

SEQ ID NO: 81236 - DNA, 22 bp, Homo sapiens
tgtctgggagactgatcacccg

SEQ ID NO: 81237 - DNA, 21 bp, Homo sapiens
gggcctggctgcgcaggacgg

SEQ ID NO: 81238 - DNA, 22 bp, Homo sapiens
actgcactccagcctgggtgac

SEQ ID NO: 81239 - DNA, 20 bp, Homo sapiens
gtctccactgggggttaacc

SEQ ID NO: 81240 - DNA, 22 bp, Homo sapiens
actgcactccaacctgggtgac

SEQ ID NO: 81241 - DNA, 22 bp, Homo sapiens
actgcactccagcctgggtaac

SEQ ID NO: 81242 - DNA, 22 bp, Homo sapiens
ggagacagggttgaaccacgca

SEQ ID NO: 81243 - DNA, 22 bp, Homo sapiens
cacagggcttctcatggggtgc

SEQ ID NO: 81244 - DNA, 22 bp, Homo sapiens
tcagtgcagggtgggagagaga

SEQ ID NO: 81245 - DNA, 22 bp, Homo sapiens
acccacaacagctctaggaagt

SEQ ID NO: 81246 - DNA, 21 bp, Homo sapiens
gggcagaggggcctcctgggt

SEQ ID NO: 81247 - DNA, 22 bp, Homo sapiens
agctgaaacttcccattaattg

SEQ ID NO: 81248 - DNA, 22 bp, Homo sapiens
aagccctggacggcccttcccc

SEQ ID NO: 81249 - DNA, 22 bp, Homo sapiens
gtagagcagggagcaggaagct

SEQ ID NO: 81250 - DNA, 22 bp, Homo sapiens
gagcctcagggttttgttgaca

SEQ ID NO: 81251 - DNA, 22 bp, Homo sapiens
aagactgtgtctatggctactc

SEQ ID NO: 81252 - DNA, 22 bp, Homo sapiens
tgagccgtggtctctgagggtg

SEQ ID NO: 81253 - DNA, 22 bp, Homo sapiens
gcccagcccagaaaggttcgga

SEQ ID NO: 81254 - DNA, 22 bp, Homo sapiens
ccaggctggagtgcaatggcgt

SEQ ID NO: 81255 - DNA, 23 bp, Homo sapiens
ggatggacgtgatgccttagcca

SEQ ID NO: 81256 - DNA, 22 bp, Homo sapiens
ttttccttcatatcccttatgt

SEQ ID NO: 81257 - DNA, 22 bp, Homo sapiens
gagccaggaggcagagactgca

SEQ ID NO: 81258 - DNA, 22 bp, Homo sapiens
cttcttatcaagtggcaaatct

SEQ ID NO: 81259 - DNA, 22 bp, Homo sapiens
tgggactcactcttttggccag

SEQ ID NO: 81260 - DNA, 23 bp, Homo sapiens
cggatttgactgaggtcctgcca

SEQ ID NO: 81261 - DNA, 22 bp, Homo sapiens
agaatagaattctcatagaatt

SEQ ID NO: 81262 - DNA, 22 bp, Homo sapiens
aggagcagaccgtagtcctgca

SEQ ID NO: 81263 - DNA, 18 bp, Homo sapiens
tgagaggctattttttgc

SEQ ID NO: 81264 - DNA, 18 bp, Homo sapiens
cagcctctgattggttgc

SEQ ID NO: 81265 - DNA, 22 bp, Homo sapiens
tactaattgttcacacttgttt

SEQ ID NO: 81266 - DNA, 22 bp, Homo sapiens
tccagcagtccatgtgagacac

SEQ ID NO: 81267 - DNA, 19 bp, Homo sapiens
tctcaattctccccactgc

SEQ ID NO: 81268 - DNA, 22 bp, Homo sapiens
tgagatgaataactcctgctaa

SEQ ID NO: 81269 - DNA, 22 bp, Homo sapiens
aaatactcatcccaggaactgg

SEQ ID NO: 81270 - DNA, 22 bp, Homo sapiens
cttcctctgtggccagagtgta

SEQ ID NO: 81271 - DNA, 22 bp, Homo sapiens
gagagtctaggaacctcatata

SEQ ID NO: 81272 - DNA, 22 bp, Homo sapiens
gctgctgcttgaaggctcggag

SEQ ID NO: 81273 - DNA, 22 bp, Homo sapiens
ccctagtccacaggttcctgga

SEQ ID NO: 81274 - DNA, 22 bp, Homo sapiens
tggcacagactgggccaaggaa

SEQ ID NO: 81275 - DNA, 22 bp, Homo sapiens
ttctgattgctgatgaggccca

SEQ ID NO: 81276 - DNA, 21 bp, Homo sapiens
ccaccaggtcttctgctcggg

SEQ ID NO: 81277 - DNA, 22 bp, Homo sapiens
tggctaacaaggtgaaaccccg

SEQ ID NO: 81278 - DNA, 22 bp, Homo sapiens
atgccactgcacttcagcctgg

SEQ ID NO: 81279 - DNA, 22 bp, Homo sapiens
atgccactgcgctctagcctgg

SEQ ID NO: 81280 - DNA, 22 bp, Homo sapiens
tgagtggacacctgcttcttta

SEQ ID NO: 81281 - DNA, 22 bp, Homo sapiens
cttgaagtggagcttttgaaat

SEQ ID NO: 81282 - DNA, 22 bp, Homo sapiens
ctttttcctcgtagagcctaat

SEQ ID NO: 81283 - DNA, 22 bp, Homo sapiens
gatgcgggcccgctccactgcc

SEQ ID NO: 81284 - DNA, 22 bp, Homo sapiens
tcgaactcatagtcgtagctgt

SEQ ID NO: 81285 - DNA, 22 bp, Homo sapiens
tccctgaggatggttgtattta

SEQ ID NO: 81286 - DNA, 23 bp, Homo sapiens
caccactttctccttctccttgg

SEQ ID NO: 81287 - DNA, 22 bp, Homo sapiens
ggagcatgcgctctgtgaccga

SEQ ID NO: 81288 - DNA, 22 bp, Homo sapiens
cagcctgtagtctggtccaggt

SEQ ID NO: 81289 - DNA, 22 bp, Homo sapiens
tggaatggaaacaaactgagga

SEQ ID NO: 81290 - DNA, 22 bp, Homo sapiens
gtcagatctttggggatgctgt

SEQ ID NO: 81291 - DNA, 22 bp, Homo sapiens
tggggagaaatgtctttgttcc

SEQ ID NO: 81292 - DNA, 22 bp, Homo sapiens
tgtctcatctcttaaccccact

SEQ ID NO: 81293 - DNA, 22 bp, Homo sapiens
tttcataatactgtacatgaaa

SEQ ID NO: 81294 - DNA, 22 bp, Homo sapiens
aggggagccagggctgcgagtt

SEQ ID NO: 81295 - DNA, 22 bp, Homo sapiens
gaaaaggcagagttccggggaa

SEQ ID NO: 81296 - DNA, 22 bp, Homo sapiens
tccttgccctaaatgtctgtgt

SEQ ID NO: 81297 - DNA, 22 bp, Homo sapiens
tggtccgctcctattcgccgca

SEQ ID NO: 81298 - DNA, 22 bp, Homo sapiens
ctgctccccagcctgcgccttt

SEQ ID NO: 81299 - DNA, 22 bp, Homo sapiens
gaagaaagatcaaatagtttcc

SEQ ID NO: 81300 - DNA, 22 bp, Homo sapiens
tgaaatgattatatggtgtttg

SEQ ID NO: 81301 - DNA, 22 bp, Homo sapiens
acatgtttaagtttgttatatg

SEQ ID NO: 81302 - DNA, 22 bp, Homo sapiens
aaaagggacgacaacaggccac

SEQ ID NO: 81303 - DNA, 22 bp, Homo sapiens
ggaggtgggctaaggactctct

SEQ ID NO: 81304 - DNA, 23 bp, Homo sapiens
agcagccagagatcctcggccct

SEQ ID NO: 81305 - DNA, 22 bp, Homo sapiens
agctttggttgccatgatctga

SEQ ID NO: 81306 - DNA, 22 bp, Homo sapiens
tgagctgtagcagatgctgttg

SEQ ID NO: 81307 - DNA, 22 bp, Homo sapiens
gcggcggcggtcattgagcatg

SEQ ID NO: 81308 - DNA, 22 bp, Homo sapiens
atgtgccaacgtgcaggtttgt

SEQ ID NO: 81309 - DNA, 22 bp, Homo sapiens
tgagccaagttcacaccattgc

SEQ ID NO: 81310 - DNA, 22 bp, Homo sapiens
agaggccggccgagcccatggg

SEQ ID NO: 81311 - DNA, 22 bp, Homo sapiens
gctcaagccttctgcccacctc

SEQ ID NO: 81312 - DNA, 22 bp, Homo sapiens
ctctggaggtggaggttgcagt

SEQ ID NO: 81313 - DNA, 19 bp, Homo sapiens
gcctatgtcttcaaatcat

SEQ ID NO: 81314 - DNA, 22 bp, Homo sapiens
tcctcagaatcacctggcagct

SEQ ID NO: 81315 - DNA, 20 bp, Homo sapiens
tgatatggtttggctgtgtt

SEQ ID NO: 81316 - DNA, 22 bp, Homo sapiens
aggagctcagctaagttggaga

SEQ ID NO: 81317 - DNA, 22 bp, Homo sapiens
cttgcctttgtcttcaaaggct

SEQ ID NO: 81318 - DNA, 19 bp, Homo sapiens
tgaacgatgtctcagggca

SEQ ID NO: 81319 - DNA, 22 bp, Homo sapiens
ctcattgcaacctccgcctccc

SEQ ID NO: 81320 - DNA, 22 bp, Homo sapiens
tcctcagtcacggtagcacatt

SEQ ID NO: 81321 - DNA, 22 bp, Homo sapiens
ttctcctttcattccctgtaga

SEQ ID NO: 81322 - DNA, 22 bp, Homo sapiens
gggtcgctgccgctgctggacc

SEQ ID NO: 81323 - DNA, 22 bp, Homo sapiens
gcgggccaccttggagagcgct

SEQ ID NO: 81324 - DNA, 22 bp, Homo sapiens
ggggtgtggacggctgtgccag

SEQ ID NO: 81325 - DNA, 22 bp, Homo sapiens
cctggctctgccacttactgcc

SEQ ID NO: 81326 - DNA, 22 bp, Homo sapiens
taagggaacagcttcaaactca

SEQ ID NO: 81327 - DNA, 22 bp, Homo sapiens
gcgactgtacagaattgcccct

SEQ ID NO: 81328 - DNA, 22 bp, Homo sapiens
acccagggctcaagcgtaggca

SEQ ID NO: 81329 - DNA, 22 bp, Homo sapiens
ggggcaggagcccttcttcagc

SEQ ID NO: 81330 - DNA, 22 bp, Homo sapiens
gggaagatagtgttgagggccc

SEQ ID NO: 81331 - DNA, 22 bp, Homo sapiens
atgccactgcactccagcctgg

SEQ ID NO: 81332 - DNA, 22 bp, Homo sapiens
tggccaccaccaatacttgcct

SEQ ID NO: 81333 - DNA, 22 bp, Homo sapiens
tttttccacataccctaggcca

SEQ ID NO: 81334 - DNA, 22 bp, Homo sapiens
gtccaggcctgcctctgaggag

SEQ ID NO: 81335 - DNA, 22 bp, Homo sapiens
cctgtgcttggccagagaggtt

SEQ ID NO: 81336 - DNA, 22 bp, Homo sapiens
tcaagagttggtcaaatccaaa

SEQ ID NO: 81337 - DNA, 22 bp, Homo sapiens
tggaagaatatgggggtacaga

SEQ ID NO: 81338 - DNA, 22 bp, Homo sapiens
ggaaggggtgggtgagcctcag

SEQ ID NO: 81339 - DNA, 22 bp, Homo sapiens
ccggtcccaggtgccccggtga

SEQ ID NO: 81340 - DNA, 22 bp, Homo sapiens
cttctcggggttcccgcgccct

SEQ ID NO: 81341 - DNA, 22 bp, Homo sapiens
actattagcatatcatgaatgg

SEQ ID NO: 81342 - DNA, 22 bp, Homo sapiens
cacagctgaagtagccatgtgg

SEQ ID NO: 81343 - DNA, 22 bp, Homo sapiens
gatctggaatctgaaggctgag

SEQ ID NO: 81344 - DNA, 22 bp, Homo sapiens
ggctcactgcaacttccgcctc

SEQ ID NO: 81345 - DNA, 22 bp, Homo sapiens
aatatttccaaggcctgtcagg

SEQ ID NO: 81346 - DNA, 20 bp, Homo sapiens
ttctccagtgcggtagccat

SEQ ID NO: 81347 - DNA, 22 bp, Homo sapiens
acctggaggcagaggttgcagt

SEQ ID NO: 81348 - DNA, 22 bp, Homo sapiens
ggcctcttatctggctcctgca

SEQ ID NO: 81349 - DNA, 22 bp, Homo sapiens
catcatcaaaagtgacagagaa

SEQ ID NO: 81350 - DNA, 22 bp, Homo sapiens
ggaaggcagaggtgtcgtgggg

SEQ ID NO: 81351 - DNA, 22 bp, Homo sapiens
ttgtaacaggtactaaataact

SEQ ID NO: 81352 - DNA, 22 bp, Homo sapiens
ctgaggaggctaatttgaggat

SEQ ID NO: 81353 - DNA, 23 bp, Homo sapiens
tcggtgggcgtggaggccgaggc

SEQ ID NO: 81354 - DNA, 22 bp, Homo sapiens
gttgggttaaccaggatgtcaa

SEQ ID NO: 81355 - DNA, 22 bp, Homo sapiens
ttagcacaattatttcagttgt

SEQ ID NO: 81356 - DNA, 22 bp, Homo sapiens
tggaaaactttggtggtgaggg

SEQ ID NO: 81357 - DNA, 22 bp, Homo sapiens
acctgcaggcacaggtgtgcgc

SEQ ID NO: 81358 - DNA, 22 bp, Homo sapiens
gccaatgacagtctcagttctg

SEQ ID NO: 81359 - DNA, 22 bp, Homo sapiens
gtgaagttggccagtttagttt

SEQ ID NO: 81360 - DNA, 22 bp, Homo sapiens
cccactgcatgagttggtatta

SEQ ID NO: 81361 - DNA, 22 bp, Homo sapiens
atatttgcattttaaacaggca

SEQ ID NO: 81362 - DNA, 22 bp, Homo sapiens
ctgggggcagcaagaagccatg

SEQ ID NO: 81363 - DNA, 22 bp, Homo sapiens
gagctactgaaatattgatttt

SEQ ID NO: 81364 - DNA, 22 bp, Homo sapiens
ttgggctcaggagtttgagacc

SEQ ID NO: 81365 - DNA, 22 bp, Homo sapiens
tcctccagttccttggtttcag

SEQ ID NO: 81366 - DNA, 22 bp, Homo sapiens
cttaattggcttatttcctcaa

SEQ ID NO: 81367 - DNA, 22 bp, Homo sapiens
gcctgtcccgcaccggagcccg

SEQ ID NO: 81368 - DNA, 22 bp, Homo sapiens
tgtctgttattggtgtataaga

SEQ ID NO: 81369 - DNA, 22 bp, Homo sapiens
cacttcattgggaccagggctg

SEQ ID NO: 81370 - DNA, 22 bp, Homo sapiens
tgctcccaaacctgacaggctc

SEQ ID NO: 81371 - DNA, 22 bp, Homo sapiens
gtctttcttaaacaacagaaca

SEQ ID NO: 81372 - DNA, 19 bp, Homo sapiens
gggaatgatggaagacttc

SEQ ID NO: 81373 - DNA, 22 bp, Homo sapiens
tttctcatggaacatcgtttag

SEQ ID NO: 81374 - DNA, 22 bp, Homo sapiens
ttggatttgtctaccagggaat

SEQ ID NO: 81375 - DNA, 22 bp, Homo sapiens
ggagctgaggacactacatttt

SEQ ID NO: 81376 - DNA, 22 bp, Homo sapiens
atagcagggatgtcagcaagta

SEQ ID NO: 81377 - DNA, 22 bp, Homo sapiens
aggggatggagctggaaggcag

SEQ ID NO: 81378 - DNA, 22 bp, Homo sapiens
atgtccttcctgagatccctgt

SEQ ID NO: 81379 - DNA, 22 bp, Homo sapiens
tcaggaggcggaggttgcagtg

SEQ ID NO: 81380 - DNA, 22 bp, Homo sapiens
aggaggaagggaagacaagtaa

SEQ ID NO: 81381 - DNA, 22 bp, Homo sapiens
tccagctctgctgtgcgccggt

SEQ ID NO: 81382 - DNA, 22 bp, Homo sapiens
aaagaaggtagggctggtgact

SEQ ID NO: 81383 - DNA, 22 bp, Homo sapiens
atatattttttgagacagagtc

SEQ ID NO: 81384 - DNA, 22 bp, Homo sapiens
gattccacagcttcgaggtctt

SEQ ID NO: 81385 - DNA, 22 bp, Homo sapiens
cagatgtacatgaagggcaatg

SEQ ID NO: 81386 - DNA, 22 bp, Homo sapiens
gctcctttattttctctcgtgt

SEQ ID NO: 81387 - DNA, 22 bp, Homo sapiens
atttcccagggcctgggatttg

SEQ ID NO: 81388 - DNA, 22 bp, Homo sapiens
tttgtggcaggagcggagaccg

SEQ ID NO: 81389 - DNA, 22 bp, Homo sapiens
ggagtagctgcattccgagcac

SEQ ID NO: 81390 - DNA, 22 bp, Homo sapiens
gctcccaggatgaggagccagg

SEQ ID NO: 81391 - DNA, 22 bp, Homo sapiens
gcggggacagaaggcggttctc

SEQ ID NO: 81392 - DNA, 22 bp, Homo sapiens
tggatctcggcaatgcgggact

SEQ ID NO: 81393 - DNA, 22 bp, Homo sapiens
acccagccatgttcagttctct

SEQ ID NO: 81394 - DNA, 22 bp, Homo sapiens
gcctccggagtcacagtgtctt

SEQ ID NO: 81395 - DNA, 22 bp, Homo sapiens
accgggaagtcctgcactgggc

SEQ ID NO: 81396 - DNA, 22 bp, Homo sapiens
cagagcttcctgctgggcttct

SEQ ID NO: 81397 - DNA, 22 bp, Homo sapiens
ctatgaccccagcatgaataag

SEQ ID NO: 81398 - DNA, 22 bp, Homo sapiens
ggcagggcaggaaagtcaggaa

SEQ ID NO: 81399 - DNA, 22 bp, Homo sapiens
gagtggggggtccgtctcagtg

SEQ ID NO: 81400 - DNA, 22 bp, Homo sapiens
ctccaggccatggctgcggagg

SEQ ID NO: 81401 - DNA, 22 bp, Homo sapiens
ggcaaggggtcaggctgagaca

SEQ ID NO: 81402 - DNA, 22 bp, Homo sapiens
tctagggtgtataaggaagcct

SEQ ID NO: 81403 - DNA, 22 bp, Homo sapiens
atgttggagtcgtaaggcatgg

SEQ ID NO: 81404 - DNA, 22 bp, Homo sapiens
tccagctgaggtggcctctgtg

SEQ ID NO: 81405 - DNA, 22 bp, Homo sapiens
gacgagagactccatccaccac

SEQ ID NO: 81406 - DNA, 22 bp, Homo sapiens
tagctcaaaggttaagtgtgga

SEQ ID NO: 81407 - DNA, 22 bp, Homo sapiens
ggaggctgaggcaggcggatca

SEQ ID NO: 81408 - DNA, 22 bp, Homo sapiens
tctggctctggagtccacctgc

SEQ ID NO: 81409 - DNA, 22 bp, Homo sapiens
gtgcacatcgtgcaggtttgtt

SEQ ID NO: 81410 - DNA, 22 bp, Homo sapiens
ctgggaggcagaggttgcagtg

SEQ ID NO: 81411 - DNA, 22 bp, Homo sapiens
gcgagggcacgcggttgaaggc

SEQ ID NO: 81412 - DNA, 22 bp, Homo sapiens
aggggaggtgtccccaaatctc

SEQ ID NO: 81413 - DNA, 22 bp, Homo sapiens
atcttcccaggctggggagagg

SEQ ID NO: 81414 - DNA, 22 bp, Homo sapiens
tctcatggagtcaggagcagaa

SEQ ID NO: 81415 - DNA, 23 bp, Homo sapiens
aaacttgctatggctgaaatcat

SEQ ID NO: 81416 - DNA, 22 bp, Homo sapiens
tagtttcatctccaccctgccc

SEQ ID NO: 81417 - DNA, 22 bp, Homo sapiens
tgtccaggctaaagtgcagtgg

SEQ ID NO: 81418 - DNA, 22 bp, Homo sapiens
ttggcataccttagtggtggag

SEQ ID NO: 81419 - DNA, 22 bp, Homo sapiens
cacttgttggtggtgaaatcac

SEQ ID NO: 81420 - DNA, 19 bp, Homo sapiens
taccatccaagctggtttg

SEQ ID NO: 81421 - DNA, 22 bp, Homo sapiens
gaggcagaggttgcagtgagct

SEQ ID NO: 81422 - DNA, 22 bp, Homo sapiens
tcggagctgtagatgaaaccct

SEQ ID NO: 81423 - DNA, 22 bp, Homo sapiens
tggtatgaccgtggtgcaagca

SEQ ID NO: 81424 - DNA, 22 bp, Homo sapiens
tcactgcagcctctgcctcccg

SEQ ID NO: 81425 - DNA, 22 bp, Homo sapiens
agagtggctctgctgggcacag

SEQ ID NO: 81426 - DNA, 21 bp, Homo sapiens
cgcagagcgaacttgcggcgc

SEQ ID NO: 81427 - DNA, 22 bp, Homo sapiens
caggaggacatactggctcaca

SEQ ID NO: 81428 - DNA, 22 bp, Homo sapiens
gaggggcacagtaaagggtccc

SEQ ID NO: 81429 - DNA, 19 bp, Homo sapiens
gagcagtgaggaccaccag

SEQ ID NO: 81430 - DNA, 22 bp, Homo sapiens
actgcacttcagcctgggtgac

SEQ ID NO: 81431 - DNA, 22 bp, Homo sapiens
tggggcagttaataaacattct

SEQ ID NO: 81432 - DNA, 22 bp, Homo sapiens
agctttggcatctgactagccg

SEQ ID NO: 81433 - DNA, 22 bp, Homo sapiens
tagaggctttcagcggtaggtc

SEQ ID NO: 81434 - DNA, 22 bp, Homo sapiens
gcctcctgagtagctgggattg

SEQ ID NO: 81435 - DNA, 22 bp, Homo sapiens
tacataggtacagcctttttta

SEQ ID NO: 81436 - DNA, 22 bp, Homo sapiens
agatgtgtttctagttcctgca

SEQ ID NO: 81437 - DNA, 22 bp, Homo sapiens
atgagctagaaaaccatgtgga

SEQ ID NO: 81438 - DNA, 22 bp, Homo sapiens
aggagctgtcagagtgccagag

SEQ ID NO: 81439 - DNA, 22 bp, Homo sapiens
ccaggggggcgtagatgctggg

SEQ ID NO: 81440 - DNA, 21 bp, Homo sapiens
ctggaggcaggtggtgccagg

SEQ ID NO: 81441 - DNA, 22 bp, Homo sapiens
ctggcttttttcccattatgca

SEQ ID NO: 81442 - DNA, 20 bp, Homo sapiens
ttgagcttttagtacagaca

SEQ ID NO: 81443 - DNA, 22 bp, Homo sapiens
gtgcaattcactgttatgtctg

SEQ ID NO: 81444 - DNA, 22 bp, Homo sapiens
aggggtgaaagagggccctcaa

SEQ ID NO: 81445 - DNA, 20 bp, Homo sapiens
cagcagtggatgagagtttt

SEQ ID NO: 81446 - DNA, 22 bp, Homo sapiens
agagcacagccaccatttacaa

SEQ ID NO: 81447 - DNA, 22 bp, Homo sapiens
ctgctaaacctctctgagagct

SEQ ID NO: 81448 - DNA, 22 bp, Homo sapiens
agccaggatggtctcgatcggc

SEQ ID NO: 81449 - DNA, 22 bp, Homo sapiens
tcattgccatggcatttgcaga

SEQ ID NO: 81450 - DNA, 22 bp, Homo sapiens
actcccttggtggagaatgcaa

SEQ ID NO: 81451 - DNA, 22 bp, Homo sapiens
gaggggagcccccatcctccag

SEQ ID NO: 81452 - DNA, 23 bp, Homo sapiens
cagggccctgctcaatttctcca

SEQ ID NO: 81453 - DNA, 22 bp, Homo sapiens
gaccggttctgccgtggactgg

SEQ ID NO: 81454 - DNA, 22 bp, Homo sapiens
tttctttatcatagcatctttg

SEQ ID NO: 81455 - DNA, 18 bp, Homo sapiens
acggatccgcgggaccgc

SEQ ID NO: 81456 - DNA, 22 bp, Homo sapiens
agctgattccactttttcccca

SEQ ID NO: 81457 - DNA, 22 bp, Homo sapiens
tctgaggaactggcaaagatgg

SEQ ID NO: 81458 - DNA, 22 bp, Homo sapiens
cgggcagtgtggctccagagtc

SEQ ID NO: 81459 - DNA, 22 bp, Homo sapiens
tgcctcaagccctccactgcac

SEQ ID NO: 81460 - DNA, 22 bp, Homo sapiens
acatggcgggagtttcagatac

SEQ ID NO: 81461 - DNA, 22 bp, Homo sapiens
tgtgtggattcatctcaaagag

SEQ ID NO: 81462 - DNA, 22 bp, Homo sapiens
ggattgaaggcccttaactgat

SEQ ID NO: 81463 - DNA, 22 bp, Homo sapiens
ggccaattccaggagccggcgg

SEQ ID NO: 81464 - DNA, 22 bp, Homo sapiens
ccaggcaggcgatggtgcagtg

SEQ ID NO: 81465 - DNA, 22 bp, Homo sapiens
tgggcagggagctggaaccaca

SEQ ID NO: 81466 - DNA, 22 bp, Homo sapiens
agtgctgtcagttttatagata

SEQ ID NO: 81467 - DNA, 22 bp, Homo sapiens
gaaactctcgcatcctgggaac

SEQ ID NO: 81468 - DNA, 22 bp, Homo sapiens
caggaggattgcttgaggccag

SEQ ID NO: 81469 - DNA, 22 bp, Homo sapiens
ggagaagcagcttcttgatgaa

SEQ ID NO: 81470 - DNA, 22 bp, Homo sapiens
cccaggaggtcaaggctgcagt

SEQ ID NO: 81471 - DNA, 22 bp, Homo sapiens
agaaaatttaaagagacacaca

SEQ ID NO: 81472 - DNA, 22 bp, Homo sapiens
gttctgagtcctcctttgaagg

SEQ ID NO: 81473 - DNA, 22 bp, Homo sapiens
aaaatcttgtgacttaggaagg

SEQ ID NO: 81474 - DNA, 22 bp, Homo sapiens
ggcatagatttctttaggttta

SEQ ID NO: 81475 - DNA, 22 bp, Homo sapiens
tacttttctataggtttgaaat

SEQ ID NO: 81476 - DNA, 23 bp, Homo sapiens
aatgggtgcaactatccatgaca

SEQ ID NO: 81477 - DNA, 22 bp, Homo sapiens
acccggagtcggaggttgcagt

SEQ ID NO: 81478 - DNA, 22 bp, Homo sapiens
agctgccccgaggcggcgggaa

SEQ ID NO: 81479 - DNA, 22 bp, Homo sapiens
gagtcacatactatgtaataga

SEQ ID NO: 81480 - DNA, 17 bp, Homo sapiens
gagacccccactacacc

SEQ ID NO: 81481 - DNA, 21 bp, Homo sapiens
caatggcgagatcttggctca

SEQ ID NO: 81482 - DNA, 22 bp, Homo sapiens
actgttttctgtaaagggccag

SEQ ID NO: 81483 - DNA, 22 bp, Homo sapiens
atgcccctggcctggggaacat

SEQ ID NO: 81484 - DNA, 22 bp, Homo sapiens
aaactgctttccacagtggcta

SEQ ID NO: 81485 - DNA, 22 bp, Homo sapiens
agaggcaggaggttgacttgag

SEQ ID NO: 81486 - DNA, 22 bp, Homo sapiens
ctggctggagtgcaggtgagtg

SEQ ID NO: 81487 - DNA, 22 bp, Homo sapiens
cctcattctcgcgtgtgtttct

SEQ ID NO: 81488 - DNA, 22 bp, Homo sapiens
gtagtcccagctaccccggagg

SEQ ID NO: 81489 - DNA, 22 bp, Homo sapiens
caggggcgggtaaaaggcctcc

SEQ ID NO: 81490 - DNA, 22 bp, Homo sapiens
tcacagctcactgtagcctcga

SEQ ID NO: 81491 - DNA, 23 bp, Homo sapiens
gctcatcaggcttagagtcaagg

SEQ ID NO: 81492 - DNA, 22 bp, Homo sapiens
caggctggagttcagtggtgtg

SEQ ID NO: 81493 - DNA, 22 bp, Homo sapiens
caatttctaacattccatggat

SEQ ID NO: 81494 - DNA, 22 bp, Homo sapiens
aagtccaggtcctcattccatc

SEQ ID NO: 81495 - DNA, 23 bp, Homo sapiens
acagcaagaggaccagatgtgag

SEQ ID NO: 81496 - DNA, 22 bp, Homo sapiens
gacactctttcctcttctggaa

SEQ ID NO: 81497 - DNA, 22 bp, Homo sapiens
ggagaggcttccagagtcgtgc

SEQ ID NO: 81498 - DNA, 22 bp, Homo sapiens
cctgcctactgagttttatatt

SEQ ID NO: 81499 - DNA, 22 bp, Homo sapiens
caggagctcagatgacatctca

SEQ ID NO: 81500 - DNA, 22 bp, Homo sapiens
gatataggttcatagtgttaca

SEQ ID NO: 81501 - DNA, 22 bp, Homo sapiens
agccccttgtgggcgcacagca

SEQ ID NO: 81502 - DNA, 20 bp, Homo sapiens
agtaggtgtccttcaggata

SEQ ID NO: 81503 - DNA, 22 bp, Homo sapiens
ctgtggctcaggcctgtaagcc

SEQ ID NO: 81504 - DNA, 22 bp, Homo sapiens
aagctgttgttcatcctgaatt

SEQ ID NO: 81505 - DNA, 23 bp, Homo sapiens
atgtttgcagtaacccatcctgg

SEQ ID NO: 81506 - DNA, 22 bp, Homo sapiens
aaaggacacacaggaggtgtct

SEQ ID NO: 81507 - DNA, 22 bp, Homo sapiens
atacaaagtattaatcctggat

SEQ ID NO: 81508 - DNA, 22 bp, Homo sapiens
ggcaggaggtgagtggcgggtg

SEQ ID NO: 81509 - DNA, 20 bp, Homo sapiens
gccaacgcgctggggctgcc

SEQ ID NO: 81510 - DNA, 22 bp, Homo sapiens
gaattttattactagtcaactg

SEQ ID NO: 81511 - DNA, 22 bp, Homo sapiens
tatcactacacctggctaatta

SEQ ID NO: 81512 - DNA, 22 bp, Homo sapiens
ggagctgttcaggactgcttca

SEQ ID NO: 81513 - DNA, 22 bp, Homo sapiens
aaagaaatagatggcatttaaa

SEQ ID NO: 81514 - DNA, 22 bp, Homo sapiens
tcaccttgtgatccgcccacct

SEQ ID NO: 81515 - DNA, 22 bp, Homo sapiens
cctgagagcattccacactgaa

SEQ ID NO: 81516 - DNA, 22 bp, Homo sapiens
gttgtgaatagtgccgcaataa

SEQ ID NO: 81517 - DNA, 22 bp, Homo sapiens
gggagccccacctcggtgcccg

SEQ ID NO: 81518 - DNA, 22 bp, Homo sapiens
tgtcaatatgtaataactgaat

SEQ ID NO: 81519 - DNA, 22 bp, Homo sapiens
gcctcagtctcccgagtagctg

SEQ ID NO: 81520 - DNA, 22 bp, Homo sapiens
gcttggccagcagccgggatgc

SEQ ID NO: 81521 - DNA, 22 bp, Homo sapiens
gagagtctagtgcacctagttt

SEQ ID NO: 81522 - DNA, 22 bp, Homo sapiens
ccaaagaaacccaagctcaggg

SEQ ID NO: 81523 - DNA, 22 bp, Homo sapiens
cggccaagccggggccccgaag

SEQ ID NO: 81524 - DNA, 21 bp, Homo sapiens
tcctgtaagcttgggtggctc

SEQ ID NO: 81525 - DNA, 22 bp, Homo sapiens
gcagagctgggatatgaaccca

SEQ ID NO: 81526 - DNA, 22 bp, Homo sapiens
cagctcacccatcacgtctgct

SEQ ID NO: 81527 - DNA, 22 bp, Homo sapiens
cctggaggcggaggttgcagtg

SEQ ID NO: 81528 - DNA, 22 bp, Homo sapiens
ggcagggagtggagactcccta

SEQ ID NO: 81529 - DNA, 22 bp, Homo sapiens
tctggcttcgcagctcccagcc

SEQ ID NO: 81530 - DNA, 22 bp, Homo sapiens
tgtggggatcttctagcttttc

SEQ ID NO: 81531 - DNA, 22 bp, Homo sapiens
gggagctgagctggaagagaat

SEQ ID NO: 81532 - DNA, 22 bp, Homo sapiens
ttaagggccattatggatgggt

SEQ ID NO: 81533 - DNA, 22 bp, Homo sapiens
gagatttccatattttgtaaca

SEQ ID NO: 81534 - DNA, 22 bp, Homo sapiens
aagtgtgtgagcctgtcaggct

SEQ ID NO: 81535 - DNA, 22 bp, Homo sapiens
ggctcaggcctgtaatcctagc

SEQ ID NO: 81536 - DNA, 22 bp, Homo sapiens
acactgcagatgaaagcataag

SEQ ID NO: 81537 - DNA, 19 bp, Homo sapiens
gggcaaagtgatcgtcctg

SEQ ID NO: 81538 - DNA, 22 bp, Homo sapiens
agacgcggtggtgcatgcctgt

SEQ ID NO: 81539 - DNA, 22 bp, Homo sapiens
ttaggcctttgattggggtgct

SEQ ID NO: 81540 - DNA, 22 bp, Homo sapiens
tcaagggcaaatgctacctata

SEQ ID NO: 81541 - DNA, 22 bp, Homo sapiens
tagatttgtttccttctctcca

SEQ ID NO: 81542 - DNA, 22 bp, Homo sapiens
gctcccagtctgatggaggaga

SEQ ID NO: 81543 - DNA, 22 bp, Homo sapiens
ggaatgaatttccagctgggtc

SEQ ID NO: 81544 - DNA, 22 bp, Homo sapiens
acacagagccaaaccatatcac

SEQ ID NO: 81545 - DNA, 22 bp, Homo sapiens
tacctcaagttccaggaaagcg

SEQ ID NO: 81546 - DNA, 22 bp, Homo sapiens
cctggaagttggaggttgcagt

SEQ ID NO: 81547 - DNA, 22 bp, Homo sapiens
tgaaggacagcagtggctccaa

SEQ ID NO: 81548 - DNA, 22 bp, Homo sapiens
gagatggagtctttttctgtca

SEQ ID NO: 81549 - DNA, 22 bp, Homo sapiens
tcccctttgtcttcctgtgggt

SEQ ID NO: 81550 - DNA, 22 bp, Homo sapiens
agacagggtgatcgcttgagcc

SEQ ID NO: 81551 - DNA, 22 bp, Homo sapiens
tgaggcaggacttgcataaagt

SEQ ID NO: 81552 - DNA, 22 bp, Homo sapiens
gcagagatctgagaaggctgcc

SEQ ID NO: 81553 - DNA, 22 bp, Homo sapiens
actccacaccacgggggccgcc

SEQ ID NO: 81554 - DNA, 20 bp, Homo sapiens
ggcagagggcctgggagaag

SEQ ID NO: 81555 - DNA, 22 bp, Homo sapiens
gagcccaggagtttgatgctgc

SEQ ID NO: 81556 - DNA, 22 bp, Homo sapiens
ggagttgacggccgacacccag

SEQ ID NO: 81557 - DNA, 22 bp, Homo sapiens
ggggcattgtgtctgggttcct

SEQ ID NO: 81558 - DNA, 22 bp, Homo sapiens
agcagcagtatccttccccggc

SEQ ID NO: 81559 - DNA, 23 bp, Homo sapiens
actcgtggaattctctgcgatcg

SEQ ID NO: 81560 - DNA, 22 bp, Homo sapiens
cagaaaccaaatgggatgggga

SEQ ID NO: 81561 - DNA, 22 bp, Homo sapiens
taggtttcagaggtgccgggaa

SEQ ID NO: 81562 - DNA, 20 bp, Homo sapiens
aggccccaggtggacactag

SEQ ID NO: 81563 - DNA, 22 bp, Homo sapiens
gtgggctgcccttgaggtcagc

SEQ ID NO: 81564 - DNA, 23 bp, Homo sapiens
gcagaggagcaagctggacacca

SEQ ID NO: 81565 - DNA, 22 bp, Homo sapiens
aagaataagaggatttagaaca

SEQ ID NO: 81566 - DNA, 22 bp, Homo sapiens
agctacctgatccttcttctga

SEQ ID NO: 81567 - DNA, 22 bp, Homo sapiens
tttcagaacataatgtgagcat

SEQ ID NO: 81568 - DNA, 22 bp, Homo sapiens
ggtgggccacggcataacgggc

SEQ ID NO: 81569 - DNA, 22 bp, Homo sapiens
aggtgggcggattcatgaggtc

SEQ ID NO: 81570 - DNA, 22 bp, Homo sapiens
catccgcatgcaagtgctgtcc

SEQ ID NO: 81571 - DNA, 22 bp, Homo sapiens
gtgtatgttctacttaatatta

SEQ ID NO: 81572 - DNA, 20 bp, Homo sapiens
ccagagctgatggctgcccg

SEQ ID NO: 81573 - DNA, 22 bp, Homo sapiens
acgtcttcgttggcagagattt

SEQ ID NO: 81574 - DNA, 22 bp, Homo sapiens
tttattctgtgctacatgaaga

SEQ ID NO: 81575 - DNA, 22 bp, Homo sapiens
gaataatcatgaaattcagtga

SEQ ID NO: 81576 - DNA, 19 bp, Homo sapiens
tctgaagaattagagagca

SEQ ID NO: 81577 - DNA, 22 bp, Homo sapiens
actcttgattgatttagtcttt

SEQ ID NO: 81578 - DNA, 19 bp, Homo sapiens
gagaaagcaggcacagcac

SEQ ID NO: 81579 - DNA, 22 bp, Homo sapiens
ggtgccaggctgtagtcagggt

SEQ ID NO: 81580 - DNA, 22 bp, Homo sapiens
tggcacaggatctcagcggcca

SEQ ID NO: 81581 - DNA, 20 bp, Homo sapiens
tcagccattccttacctttc

SEQ ID NO: 81582 - DNA, 22 bp, Homo sapiens
gcccaggctggagtgcagtggt

SEQ ID NO: 81583 - DNA, 22 bp, Homo sapiens
gagcaccgcctccacgatgccc

SEQ ID NO: 81584 - DNA, 22 bp, Homo sapiens
actgggctcaagtgattgtcct

SEQ ID NO: 81585 - DNA, 22 bp, Homo sapiens
atgtgggccgtgcgggtgtcct

SEQ ID NO: 81586 - DNA, 22 bp, Homo sapiens
gccccgcgcctggctccaggtg

SEQ ID NO: 81587 - DNA, 17 bp, Homo sapiens
ggctgcagtccaggagg

SEQ ID NO: 81588 - DNA, 22 bp, Homo sapiens
gaggcagaggttgttgcagtga

SEQ ID NO: 81589 - DNA, 22 bp, Homo sapiens
ctgctttgcatagctgccagag

SEQ ID NO: 81590 - DNA, 22 bp, Homo sapiens
gctgtatgtttatttgggaatt

SEQ ID NO: 81591 - DNA, 22 bp, Homo sapiens
agtaatcaatttttcggtggat

SEQ ID NO: 81592 - DNA, 22 bp, Homo sapiens
ctgcaccgtgtctcgggctgcc

SEQ ID NO: 81593 - DNA, 22 bp, Homo sapiens
tgctgggggtagctctgcgtag

SEQ ID NO: 81594 - DNA, 22 bp, Homo sapiens
cggctcactgcagctccgcctc

SEQ ID NO: 81595 - DNA, 22 bp, Homo sapiens
gcagggcacaaggacgcacagg

SEQ ID NO: 81596 - DNA, 22 bp, Homo sapiens
tgttttaagggtcaactgtcac

SEQ ID NO: 81597 - DNA, 22 bp, Homo sapiens
cgagcatgatgacggctgtggc

SEQ ID NO: 81598 - DNA, 22 bp, Homo sapiens
tgcccagagcctgagaggatta

SEQ ID NO: 81599 - DNA, 20 bp, Homo sapiens
gggcagagccagccagtccc

SEQ ID NO: 81600 - DNA, 22 bp, Homo sapiens
atgcagttccacaggcgcatgg

SEQ ID NO: 81601 - DNA, 22 bp, Homo sapiens
tggctccacaggccagggtgtg

SEQ ID NO: 81602 - DNA, 22 bp, Homo sapiens
agttggcactgagctgtgattg

SEQ ID NO: 81603 - DNA, 22 bp, Homo sapiens
gtgaggtggtacaatattaact

SEQ ID NO: 81604 - DNA, 22 bp, Homo sapiens
aaattgtaatgacttcacttga

SEQ ID NO: 81605 - DNA, 22 bp, Homo sapiens
cagtttcttcctcccccagaga

SEQ ID NO: 81606 - DNA, 22 bp, Homo sapiens
ggctttgggggtgtccaagaaa

SEQ ID NO: 81607 - DNA, 22 bp, Homo sapiens
ttatagcagcatgatttatagt

SEQ ID NO: 81608 - DNA, 22 bp, Homo sapiens
cccaggaggcagagatagcagt

SEQ ID NO: 81609 - DNA, 22 bp, Homo sapiens
agggtcctgggtgcagttgctt

SEQ ID NO: 81610 - DNA, 22 bp, Homo sapiens
gctgctctcagagctcatgctg

SEQ ID NO: 81611 - DNA, 19 bp, Homo sapiens
taggaccctggtggccccc

SEQ ID NO: 81612 - DNA, 22 bp, Homo sapiens
acgcctgtaatcccagcacttt

SEQ ID NO: 81613 - DNA, 21 bp, Homo sapiens
cagggccaatcctgacctcta

SEQ ID NO: 81614 - DNA, 22 bp, Homo sapiens
agagcacggccaccatttacaa

SEQ ID NO: 81615 - DNA, 22 bp, Homo sapiens
ttgtcttttgtgggaaatatgg

SEQ ID NO: 81616 - DNA, 22 bp, Homo sapiens
cccagcagtagagctcatatgg

SEQ ID NO: 81617 - DNA, 22 bp, Homo sapiens
gaggctgaggcaggaggatcac

SEQ ID NO: 81618 - DNA, 22 bp, Homo sapiens
ggagagtggattccagctgtat

SEQ ID NO: 81619 - DNA, 21 bp, Homo sapiens
tgaaggggtggcagtgtgctt

SEQ ID NO: 81620 - DNA, 22 bp, Homo sapiens
tccttgtaaaggagctctaaca

SEQ ID NO: 81621 - DNA, 22 bp, Homo sapiens
tggagccagcggcctgctgagg

SEQ ID NO: 81622 - DNA, 22 bp, Homo sapiens
gggtacagttcttccagtgtca

SEQ ID NO: 81623 - DNA, 22 bp, Homo sapiens
ggggtgggcgtgcagggacacc

SEQ ID NO: 81624 - DNA, 22 bp, Homo sapiens
ttgcaattgctatggagagcgt

SEQ ID NO: 81625 - DNA, 22 bp, Homo sapiens
cggcatgggcgtccccctcact

SEQ ID NO: 81626 - DNA, 22 bp, Homo sapiens
tcaggcaatctgacagctggag

SEQ ID NO: 81627 - DNA, 22 bp, Homo sapiens
gcaggctgtctaaagttagagt

SEQ ID NO: 81628 - DNA, 22 bp, Homo sapiens
caaggtgccatgctgggcgggg

SEQ ID NO: 81629 - DNA, 22 bp, Homo sapiens
cagcagagaaattacatatttg

SEQ ID NO: 81630 - DNA, 22 bp, Homo sapiens
tgcaaatgtgttttaaaccaaa

SEQ ID NO: 81631 - DNA, 22 bp, Homo sapiens
tgggccacacacagaagaatca

SEQ ID NO: 81632 - DNA, 22 bp, Homo sapiens
ccaagctacttaggagtctgag

SEQ ID NO: 81633 - DNA, 22 bp, Homo sapiens
cagaggctggcggccgccccga

SEQ ID NO: 81634 - DNA, 22 bp, Homo sapiens
gacagacacaattgatccatga

SEQ ID NO: 81635 - DNA, 20 bp, Homo sapiens
tatgtgattttctcatcaat

SEQ ID NO: 81636 - DNA, 22 bp, Homo sapiens
caggaaggggctcactctggcc

SEQ ID NO: 81637 - DNA, 22 bp, Homo sapiens
cgtgattggcttctgcattgga

SEQ ID NO: 81638 - DNA, 22 bp, Homo sapiens
aaaaaattatcatagttcctga

SEQ ID NO: 81639 - DNA, 22 bp, Homo sapiens
gaggtgggcggatcacaaggtc

SEQ ID NO: 81640 - DNA, 22 bp, Homo sapiens
cctgggaggctgaggctgcagt

SEQ ID NO: 81641 - DNA, 22 bp, Homo sapiens
atttcatactaaggctcaaaaa

SEQ ID NO: 81642 - DNA, 22 bp, Homo sapiens
cctgacgaaaggcgtgctggag

SEQ ID NO: 81643 - DNA, 22 bp, Homo sapiens
gagcaggaaggccagaagggtc

SEQ ID NO: 81644 - DNA, 22 bp, Homo sapiens
cctcccctcagacagagactgg

SEQ ID NO: 81645 - DNA, 20 bp, Homo sapiens
ctgccgaccacagccatgga

SEQ ID NO: 81646 - DNA, 22 bp, Homo sapiens
aaatgcctcattttctctcact

SEQ ID NO: 81647 - DNA, 22 bp, Homo sapiens
ctacattaaattggcttactta

SEQ ID NO: 81648 - DNA, 22 bp, Homo sapiens
caaatgtataaatgtactttct

SEQ ID NO: 81649 - DNA, 22 bp, Homo sapiens
ctctgcctcagtgatttcttta

SEQ ID NO: 81650 - DNA, 20 bp, Homo sapiens
agagtgagactccatctcag

SEQ ID NO: 81651 - DNA, 23 bp, Homo sapiens
ttttgcaataagtcactggaata

SEQ ID NO: 81652 - DNA, 22 bp, Homo sapiens
gagatgcagaaccctcaggagc

SEQ ID NO: 81653 - DNA, 22 bp, Homo sapiens
gataatccactctgctgacttt

SEQ ID NO: 81654 - DNA, 22 bp, Homo sapiens
cctggggccccgagccagaagc

SEQ ID NO: 81655 - DNA, 22 bp, Homo sapiens
gactggaaagcctgtcctcaga

SEQ ID NO: 81656 - DNA, 22 bp, Homo sapiens
atccaccctgtggtggctttct

SEQ ID NO: 81657 - DNA, 22 bp, Homo sapiens
cccaggaggtcgaagctgcagt

SEQ ID NO: 81658 - DNA, 22 bp, Homo sapiens
cccagaaggtcgaggctgcagt

SEQ ID NO: 81659 - DNA, 22 bp, Homo sapiens
gcccaggctggagtgcagtggc

SEQ ID NO: 81660 - DNA, 22 bp, Homo sapiens
acattacctggcatttgatctt

SEQ ID NO: 81661 - DNA, 22 bp, Homo sapiens
gccaggttgctgacgacgatct

SEQ ID NO: 81662 - DNA, 22 bp, Homo sapiens
agtgaatgtccccgcgggtcag

SEQ ID NO: 81663 - DNA, 22 bp, Homo sapiens
ctttggcaatgtcattttcaat

SEQ ID NO: 81664 - DNA, 22 bp, Homo sapiens
actgcaacctccacctcctggg

SEQ ID NO: 81665 - DNA, 22 bp, Homo sapiens
gtgggggcaggcagtgctagga

SEQ ID NO: 81666 - DNA, 22 bp, Homo sapiens
cccactgctgcgccgggcgccg

SEQ ID NO: 81667 - DNA, 22 bp, Homo sapiens
tggctgagttacgaacagagca

SEQ ID NO: 81668 - DNA, 22 bp, Homo sapiens
tcacttcccagacggggtggca

SEQ ID NO: 81669 - DNA, 22 bp, Homo sapiens
atggatttgcttatacacatgt

SEQ ID NO: 81670 - DNA, 18 bp, Homo sapiens
tctggaacaacttcatgt

SEQ ID NO: 81671 - DNA, 22 bp, Homo sapiens
ttccagctaactcacatccctt

SEQ ID NO: 81672 - DNA, 22 bp, Homo sapiens
gggggaagaaagaacatggcat

SEQ ID NO: 81673 - DNA, 22 bp, Homo sapiens
ggaggcggaggctgcagtgagc

SEQ ID NO: 81674 - DNA, 22 bp, Homo sapiens
tggtggcgggcagggccgtcac

SEQ ID NO: 81675 - DNA, 22 bp, Homo sapiens
ctggcctggcgcagtggctcac

SEQ ID NO: 81676 - DNA, 22 bp, Homo sapiens
gcagttagtgaagcagcttaga

SEQ ID NO: 81677 - DNA, 22 bp, Homo sapiens
gaggccacggaagggagctgtg

SEQ ID NO: 81678 - DNA, 18 bp, Homo sapiens
tcctttctccctcatctt

SEQ ID NO: 81679 - DNA, 22 bp, Homo sapiens
attttctatgttgtaattgtta

SEQ ID NO: 81680 - DNA, 22 bp, Homo sapiens
cctgccctgctcactgtcggta

SEQ ID NO: 81681 - DNA, 19 bp, Homo sapiens
acacagggatcagagggtt

SEQ ID NO: 81682 - DNA, 22 bp, Homo sapiens
ttgtgctcctgtgagaatctag

SEQ ID NO: 81683 - DNA, 22 bp, Homo sapiens
tccaccatgtaacaagctctgt

SEQ ID NO: 81684 - DNA, 20 bp, Homo sapiens
ggccggggagctctccaggg

SEQ ID NO: 81685 - DNA, 22 bp, Homo sapiens
agtcaaggtggaccagaaaaat

SEQ ID NO: 81686 - DNA, 20 bp, Homo sapiens
aaaatatgtataactcttct

SEQ ID NO: 81687 - DNA, 22 bp, Homo sapiens
gttgaggtgatgccagccctgc

SEQ ID NO: 81688 - DNA, 22 bp, Homo sapiens
tcaccttgtgatctccctgcct

SEQ ID NO: 81689 - DNA, 22 bp, Homo sapiens
ggaccggtggcttcctcgggtc

SEQ ID NO: 81690 - DNA, 22 bp, Homo sapiens
ggctagggatctagaccaggac

SEQ ID NO: 81691 - DNA, 22 bp, Homo sapiens
gctgggttttcttccgggccta

SEQ ID NO: 81692 - DNA, 22 bp, Homo sapiens
cctactctgagcgcctccgcat

SEQ ID NO: 81693 - DNA, 22 bp, Homo sapiens
aaggcaaaagaggtgtcatcac

SEQ ID NO: 81694 - DNA, 22 bp, Homo sapiens
tttaaaaaactagtctgagtct

SEQ ID NO: 81695 - DNA, 22 bp, Homo sapiens
gcaggcaggcttccttgaactg

SEQ ID NO: 81696 - DNA, 22 bp, Homo sapiens
tcgcttgaacccaggaagtgga

SEQ ID NO: 81697 - DNA, 22 bp, Homo sapiens
tctcttgagctcagttctgatg

SEQ ID NO: 81698 - DNA, 22 bp, Homo sapiens
acttttaaatgagtttcagttg

SEQ ID NO: 81699 - DNA, 22 bp, Homo sapiens
gttgggaatttattccttttct

SEQ ID NO: 81700 - DNA, 22 bp, Homo sapiens
tacgggcacgcaccacgatgcc

SEQ ID NO: 81701 - DNA, 22 bp, Homo sapiens
cacatgaaggctggggtcgtga

SEQ ID NO: 81702 - DNA, 22 bp, Homo sapiens
tggaagctcaaggcagggtgag

SEQ ID NO: 81703 - DNA, 22 bp, Homo sapiens
gcggcggagacagcaggaagcc

SEQ ID NO: 81704 - DNA, 22 bp, Homo sapiens
gggacaatggaggcctctctcc

SEQ ID NO: 81705 - DNA, 22 bp, Homo sapiens
tgaggaaacttacaaggcagaa

SEQ ID NO: 81706 - DNA, 22 bp, Homo sapiens
acaggtcctcaagtcagctggg

SEQ ID NO: 81707 - DNA, 22 bp, Homo sapiens
ttgaggcctgctggaaggtgtt

SEQ ID NO: 81708 - DNA, 22 bp, Homo sapiens
tgagtagagaattcagctaagg

SEQ ID NO: 81709 - DNA, 22 bp, Homo sapiens
gaacgggtgcagccatgggccc

SEQ ID NO: 81710 - DNA, 22 bp, Homo sapiens
agggaagcagcagccgcctgtc

SEQ ID NO: 81711 - DNA, 22 bp, Homo sapiens
ttgtgttaaggtgcatctagtg

SEQ ID NO: 81712 - DNA, 22 bp, Homo sapiens
tttgattgtcacctaccttgca

SEQ ID NO: 81713 - DNA, 22 bp, Homo sapiens
aataaacaaatccttccttccc

SEQ ID NO: 81714 - DNA, 22 bp, Homo sapiens
tgcctaggctggagtgtagtgg

SEQ ID NO: 81715 - DNA, 22 bp, Homo sapiens
cagtggcgtgatctctgctcac

SEQ ID NO: 81716 - DNA, 22 bp, Homo sapiens
gcttccacctactaaatgccac

SEQ ID NO: 81717 - DNA, 22 bp, Homo sapiens
acgcccagactcccatactttg

SEQ ID NO: 81718 - DNA, 22 bp, Homo sapiens
caggtgtgccgggagcagtttg

SEQ ID NO: 81719 - DNA, 22 bp, Homo sapiens
acaggatcgccctgttgcccag

SEQ ID NO: 81720 - DNA, 22 bp, Homo sapiens
ctaggtgatccactgctctctt

SEQ ID NO: 81721 - DNA, 22 bp, Homo sapiens
taggattccagaacagtgctgc

SEQ ID NO: 81722 - DNA, 22 bp, Homo sapiens
atgcacctgaactccatcagct

SEQ ID NO: 81723 - DNA, 22 bp, Homo sapiens
ttctttcagaacacaagtgatt

SEQ ID NO: 81724 - DNA, 22 bp, Homo sapiens
taatgtataacaaatactcatc

SEQ ID NO: 81725 - DNA, 22 bp, Homo sapiens
gggccatgagaggttcatcaac

SEQ ID NO: 81726 - DNA, 22 bp, Homo sapiens
agttggcactgagctgtgattg

SEQ ID NO: 81727 - DNA, 21 bp, Homo sapiens
ggagtttttctggaagggact

SEQ ID NO: 81728 - DNA, 22 bp, Homo sapiens
tgttgactcaacactgtgggca

SEQ ID NO: 81729 - DNA, 22 bp, Homo sapiens
taaaatttgtccctgagtgttg

SEQ ID NO: 81730 - DNA, 22 bp, Homo sapiens
gagagattaccacgcttcctga

SEQ ID NO: 81731 - DNA, 22 bp, Homo sapiens
caggagatgacagggaagaacc

SEQ ID NO: 81732 - DNA, 22 bp, Homo sapiens
gaggttggggctgcagtgagct

SEQ ID NO: 81733 - DNA, 22 bp, Homo sapiens
accatgttggccaagctggtct

SEQ ID NO: 81734 - DNA, 22 bp, Homo sapiens
tttgtgaataggttggcttcca

SEQ ID NO: 81735 - DNA, 22 bp, Homo sapiens
ccggctactcgggaggctgacg

SEQ ID NO: 81736 - DNA, 22 bp, Homo sapiens
tgctgggctggggcctcagacc

SEQ ID NO: 81737 - DNA, 20 bp, Homo sapiens
aaattactgccacacatttc

SEQ ID NO: 81738 - DNA, 16 bp, Homo sapiens
gatctgaaggtgctgg

SEQ ID NO: 81739 - DNA, 22 bp, Homo sapiens
accatgtcatttattggccaaa

SEQ ID NO: 81740 - DNA, 22 bp, Homo sapiens
gaaagacatagttgcaagatgg

SEQ ID NO: 81741 - DNA, 22 bp, Homo sapiens
tggagaattctatgttgagggg

SEQ ID NO: 81742 - DNA, 22 bp, Homo sapiens
acaaagtgctgacattacaggc

SEQ ID NO: 81743 - DNA, 22 bp, Homo sapiens
cagctgttcattgttgccaccc

SEQ ID NO: 81744 - DNA, 22 bp, Homo sapiens
acgcctgtaatcccagcacttt

SEQ ID NO: 81745 - DNA, 22 bp, Homo sapiens
tctgtagtaggttgtagttctt

SEQ ID NO: 81746 - DNA, 22 bp, Homo sapiens
ctgctaaacctctctgagagct

SEQ ID NO: 81747 - DNA, 22 bp, Homo sapiens
agtgaggggcagctgagtgggc

SEQ ID NO: 81748 - DNA, 22 bp, Homo sapiens
ctggagtagccggacgggtctg

SEQ ID NO: 81749 - DNA, 22 bp, Homo sapiens
agattctaccagagctagtttg

SEQ ID NO: 81750 - DNA, 22 bp, Homo sapiens
attgttcaatgtaataattttg

SEQ ID NO: 81751 - DNA, 19 bp, Homo sapiens
gcctcatttccacctcccc

SEQ ID NO: 81752 - DNA, 22 bp, Homo sapiens
tcccagattcctgctcttatat

SEQ ID NO: 81753 - DNA, 22 bp, Homo sapiens
agaacagaggccttatgtttca

SEQ ID NO: 81754 - DNA, 21 bp, Homo sapiens
tctctttctggaagcttccct

SEQ ID NO: 81755 - DNA, 22 bp, Homo sapiens
atgccactgcgctccagcctgg

SEQ ID NO: 81756 - DNA, 22 bp, Homo sapiens
tcgaaggaggcactcagacatg

SEQ ID NO: 81757 - DNA, 22 bp, Homo sapiens
gaagccttgaactgcaaacccc

SEQ ID NO: 81758 - DNA, 21 bp, Homo sapiens
agctgcctccacttctgaggc

SEQ ID NO: 81759 - DNA, 23 bp, Homo sapiens
ccaagactgttaggagtggggag

SEQ ID NO: 81760 - DNA, 22 bp, Homo sapiens
ttcaccatgttggccaggctgg

SEQ ID NO: 81761 - DNA, 22 bp, Homo sapiens
gaatttcctctaaacccctgag

SEQ ID NO: 81762 - DNA, 18 bp, Homo sapiens
gaggatggaaggagatgc

SEQ ID NO: 81763 - DNA, 22 bp, Homo sapiens
tgcgccatgtgctctcggccct

SEQ ID NO: 81764 - DNA, 22 bp, Homo sapiens
tccaagatctacagcagtttag

SEQ ID NO: 81765 - DNA, 22 bp, Homo sapiens
caggctggagtgcaatgacgcc

SEQ ID NO: 81766 - DNA, 22 bp, Homo sapiens
acagaactgggaaatgcacata

SEQ ID NO: 81767 - DNA, 22 bp, Homo sapiens
gaagaaagatcaaatagtttcc

SEQ ID NO: 81768 - DNA, 22 bp, Homo sapiens
gctgaaggcccggaggacaggg

SEQ ID NO: 81769 - DNA, 22 bp, Homo sapiens
tttcaccatcttggccaggctg

SEQ ID NO: 81770 - DNA, 22 bp, Homo sapiens
tgatttatgcattatactgttg

SEQ ID NO: 81771 - DNA, 22 bp, Homo sapiens
gaccttgtgatccacccgcttt

SEQ ID NO: 81772 - DNA, 23 bp, Homo sapiens
ggttccaggaacacagcctgatg

SEQ ID NO: 81773 - DNA, 22 bp, Homo sapiens
ttgacctatgtttcttcatctg

SEQ ID NO: 81774 - DNA, 22 bp, Homo sapiens
atcatcctagaaggaagctagg

SEQ ID NO: 81775 - DNA, 22 bp, Homo sapiens
gtcctaccatgaattcactcca

SEQ ID NO: 81776 - DNA, 22 bp, Homo sapiens
tctttctacatcatttgcttct

SEQ ID NO: 81777 - DNA, 20 bp, Homo sapiens
tttcaccatcttggccaggc

SEQ ID NO: 81778 - DNA, 22 bp, Homo sapiens
attttctatgttgtaattgtta

SEQ ID NO: 81779 - DNA, 22 bp, Homo sapiens
gaaacactcaatttagtaattc

SEQ ID NO: 81780 - DNA, 18 bp, Homo sapiens
tcaagccattctcctgcc

SEQ ID NO: 81781 - DNA, 22 bp, Homo sapiens
aaagaaatagatggcatttaaa

SEQ ID NO: 81782 - DNA, 22 bp, Homo sapiens
cttccttctcactagcagcgcc

SEQ ID NO: 81783 - DNA, 22 bp, Homo sapiens
tcacttcccagacggggtggca

SEQ ID NO: 81784 - DNA, 22 bp, Homo sapiens
gtctccccagggccctcttcat

SEQ ID NO: 81785 - DNA, 22 bp, Homo sapiens
tcgttatagaacattcttgggt

SEQ ID NO: 81786 - DNA, 22 bp, Homo sapiens
tgccacctgtacatgctatctg

SEQ ID NO: 81787 - DNA, 22 bp, Homo sapiens
caggaaggggctcactctggcc

SEQ ID NO: 81788 - DNA, 22 bp, Homo sapiens
tgccatctcctggtcaactggt

SEQ ID NO: 81789 - DNA, 22 bp, Homo sapiens
tgtcaatatgtaataactgaat

SEQ ID NO: 81790 - DNA, 22 bp, Homo sapiens
caggctggagtgcagtggcgcc

SEQ ID NO: 81791 - DNA, 22 bp, Homo sapiens
aagggaatgttgtggctggttt

SEQ ID NO: 81792 - DNA, 22 bp, Homo sapiens
atcacaaaggtctcagagcaca

SEQ ID NO: 81793 - DNA, 22 bp, Homo sapiens
atgccactgcactccagcctgg

SEQ ID NO: 81794 - DNA, 22 bp, Homo sapiens
tttagcgtagctgacagctaat

SEQ ID NO: 81795 - DNA, 22 bp, Homo sapiens
ctgggaggcggaggttgcagtg

SEQ ID NO: 81796 - DNA, 22 bp, Homo sapiens
taccagggaacagggatattaa

SEQ ID NO: 81797 - DNA, 22 bp, Homo sapiens
aagtaaatatctgtagtcttta

SEQ ID NO: 81798 - DNA, 22 bp, Homo sapiens
ttatttttaaaagttcacacag

SEQ ID NO: 81799 - DNA, 22 bp, Homo sapiens
tgtatgaggcatacatcaggca

SEQ ID NO: 81800 - DNA, 22 bp, Homo sapiens
gccccagcctcccgagtagctg

SEQ ID NO: 81801 - DNA, 22 bp, Homo sapiens
ctgatcctcctttaagtagctg

SEQ ID NO: 81802 - DNA, 22 bp, Homo sapiens
cttaatctcacctgcaaagtcc

SEQ ID NO: 81803 - DNA, 22 bp, Homo sapiens
ggagctgaggacactacatttt

SEQ ID NO: 81804 - DNA, 22 bp, Homo sapiens
ccccacaactcatgttgaaact

SEQ ID NO: 81805 - DNA, 22 bp, Homo sapiens
actgattgcattcatagggttt

SEQ ID NO: 81806 - DNA, 22 bp, Homo sapiens
ttgagatggagcttcactcttg

SEQ ID NO: 81807 - DNA, 22 bp, Homo sapiens
gcctcactgcagccccaggaag

SEQ ID NO: 81808 - DNA, 22 bp, Homo sapiens
acccggagtcggaggttgcagt

SEQ ID NO: 81809 - DNA, 22 bp, Homo sapiens
tggcaatgttagcaaagcattt

SEQ ID NO: 81810 - DNA, 20 bp, Homo sapiens
aaaatatgtataactcttct

SEQ ID NO: 81811 - DNA, 22 bp, Homo sapiens
tgcagcctggcttcgcgcctcc

SEQ ID NO: 81812 - DNA, 22 bp, Homo sapiens
caggaaggcgcggctgtgcctg

SEQ ID NO: 81813 - DNA, 22 bp, Homo sapiens
gcctcatcgctgctcggcccgg

SEQ ID NO: 81814 - DNA, 22 bp, Homo sapiens
ttggcttttatgcagcttaggt

SEQ ID NO: 81815 - DNA, 22 bp, Homo sapiens
ggctcactgcaacttccgcctc

SEQ ID NO: 81816 - DNA, 22 bp, Homo sapiens
tgaactcctgacctcatgatcc

SEQ ID NO: 81817 - DNA, 22 bp, Homo sapiens
caggctggagtgcagtggtgcc

SEQ ID NO: 81818 - DNA, 22 bp, Homo sapiens
agggaagaggaccagagtctct

SEQ ID NO: 81819 - DNA, 21 bp, Homo sapiens
tgttttccaccttgaggcaag

SEQ ID NO: 81820 - DNA, 22 bp, Homo sapiens
aaaactacatttgacattttgt

SEQ ID NO: 81821 - DNA, 22 bp, Homo sapiens
tcagtgatttctggggtgaggg

SEQ ID NO: 81822 - DNA, 23 bp, Homo sapiens
gattcaggattagttgtccagag

SEQ ID NO: 81823 - DNA, 22 bp, Homo sapiens
tgtggcacatacacaggagggc

SEQ ID NO: 81824 - DNA, 22 bp, Homo sapiens
aacccgggaggcagaggttgtg

SEQ ID NO: 81825 - DNA, 22 bp, Homo sapiens
cggaggttgaggctgcagtgag

SEQ ID NO: 81826 - DNA, 22 bp, Homo sapiens
cccaggcttttctcttgcccca

SEQ ID NO: 81827 - DNA, 22 bp, Homo sapiens
tgcaccctcatcagtcaaatgg

SEQ ID NO: 81828 - DNA, 22 bp, Homo sapiens
atgccacttcattccagcctcg

SEQ ID NO: 81829 - DNA, 22 bp, Homo sapiens
ttgagggtctggatctgctgct

SEQ ID NO: 81830 - DNA, 22 bp, Homo sapiens
ttttaatactgctattgtagga

SEQ ID NO: 81831 - DNA, 22 bp, Homo sapiens
ttgtccttcttcattcagtccc

SEQ ID NO: 81832 - DNA, 22 bp, Homo sapiens
ttaggcctttgattggggtgct

SEQ ID NO: 81833 - DNA, 22 bp, Homo sapiens
gaattcttttctttctgaaagt

SEQ ID NO: 81834 - DNA, 22 bp, Homo sapiens
gaatttcacaaggtgaggataa

SEQ ID NO: 81835 - DNA, 22 bp, Homo sapiens
gagatggagtctttttctgtca

SEQ ID NO: 81836 - DNA, 22 bp, Homo sapiens
attgctaggaacaggttgcacc

SEQ ID NO: 81837 - DNA, 22 bp, Homo sapiens
tccaaatgagctctgccttcca

SEQ ID NO: 81838 - DNA, 22 bp, Homo sapiens
gctactgattgaccttggagag

SEQ ID NO: 81839 - DNA, 21 bp, Homo sapiens
gccatttcacacagacatttg

SEQ ID NO: 81840 - DNA, 22 bp, Homo sapiens
aggaaggactccatggtccgtc

SEQ ID NO: 81841 - DNA, 22 bp, Homo sapiens
aatggaatacctaggtggccca

SEQ ID NO: 81842 - DNA, 22 bp, Homo sapiens
caggctggagtgcagtggggcg

SEQ ID NO: 81843 - DNA, 22 bp, Homo sapiens
acacagagccaaaccatatcac

SEQ ID NO: 81844 - DNA, 22 bp, Homo sapiens
cagcagcagtgttctagaatct

SEQ ID NO: 81845 - DNA, 22 bp, Homo sapiens
tcagcctccgaaagtgctggga

SEQ ID NO: 81846 - DNA, 22 bp, Homo sapiens
tgtctcatctcttaaccccact

SEQ ID NO: 81847 - DNA, 22 bp, Homo sapiens
tggctaacaaggtgaaaccccg

SEQ ID NO: 81848 - DNA, 22 bp, Homo sapiens
ttaataaagtatgaattggaaa

SEQ ID NO: 81849 - DNA, 22 bp, Homo sapiens
aaattctgatttaataagtgta

SEQ ID NO: 81850 - DNA, 22 bp, Homo sapiens
gactcgctcccttttgtcttat

SEQ ID NO: 81851 - DNA, 22 bp, Homo sapiens
cttgtagaattgaaatggtctc

SEQ ID NO: 81852 - DNA, 22 bp, Homo sapiens
aggaaataagggacaagacaaa

SEQ ID NO: 81853 - DNA, 22 bp, Homo sapiens
agctggagatgagtgacgtgcc

SEQ ID NO: 81854 - DNA, 22 bp, Homo sapiens
cactgcaagctctgccacctgg

SEQ ID NO: 81855 - DNA, 22 bp, Homo sapiens
cacatgaaggctggggtcgtga

SEQ ID NO: 81856 - DNA, 22 bp, Homo sapiens
cctccccacagcccaggagact

SEQ ID NO: 81857 - DNA, 23 bp, Homo sapiens
ccagtgattgcctggaaggaggt

SEQ ID NO: 81858 - DNA, 22 bp, Homo sapiens
atgaaaacggaccagagctatt

SEQ ID NO: 81859 - DNA, 22 bp, Homo sapiens
atgccactgcactccagcctag

SEQ ID NO: 81860 - DNA, 22 bp, Homo sapiens
ggctgggcaggtctgcacaggg

SEQ ID NO: 81861 - DNA, 22 bp, Homo sapiens
ataatacatggttgatcttttc

SEQ ID NO: 81862 - DNA, 22 bp, Homo sapiens
tgcagcactgttcacaatagcc

SEQ ID NO: 81863 - DNA, 19 bp, Homo sapiens
gagtattttccaacttggt

SEQ ID NO: 81864 - DNA, 22 bp, Homo sapiens
aagccaggttccatggaggagc

SEQ ID NO: 81865 - DNA, 22 bp, Homo sapiens
tactgtgtgcccagccgagctg

SEQ ID NO: 81866 - DNA, 22 bp, Homo sapiens
ttcaatatgatattagctgtgg

SEQ ID NO: 81867 - DNA, 22 bp, Homo sapiens
gatctcagacaggtggacaggg

SEQ ID NO: 81868 - DNA, 22 bp, Homo sapiens
tgtattctaaatacatcttacc

SEQ ID NO: 81869 - DNA, 22 bp, Homo sapiens
cgtgccactgcactctagcctg

SEQ ID NO: 81870 - DNA, 22 bp, Homo sapiens
tggagtgcaatagtaataaggt

SEQ ID NO: 81871 - DNA, 22 bp, Homo sapiens
gggaaggaaagttattagcaga

SEQ ID NO: 81872 - DNA, 22 bp, Homo sapiens
cgtgtgttgaaagatgtacatc

SEQ ID NO: 81873 - DNA, 22 bp, Homo sapiens
atgtatacgtgcaagtcacagg

SEQ ID NO: 81874 - DNA, 22 bp, Homo sapiens
gcaggctgtctaaagttagagt

SEQ ID NO: 81875 - DNA, 22 bp, Homo sapiens
acaagcatgggctttgacatca

SEQ ID NO: 81876 - DNA, 22 bp, Homo sapiens
tccaccatgtaacaagctctgt

SEQ ID NO: 81877 - DNA, 22 bp, Homo sapiens
cgggttcacgccattctcctgc

SEQ ID NO: 81878 - DNA, 22 bp, Homo sapiens
tttcataatactgtacatgaaa

SEQ ID NO: 81879 - DNA, 22 bp, Homo sapiens
ggaggtggaggttgcagtgagc

SEQ ID NO: 81880 - DNA, 22 bp, Homo sapiens
gaaggaagtcattagtgcagac

SEQ ID NO: 81881 - DNA, 22 bp, Homo sapiens
tgctgtgttactgagatccggc

SEQ ID NO: 81882 - DNA, 22 bp, Homo sapiens
ttgcttcctctagtttcttgaa

SEQ ID NO: 81883 - DNA, 22 bp, Homo sapiens
ttgggctcaggagtttgagacc

SEQ ID NO: 81884 - DNA, 22 bp, Homo sapiens
aaacactcatgtgttactctcc

SEQ ID NO: 81885 - DNA, 22 bp, Homo sapiens
tatgccactgctctccatccta

SEQ ID NO: 81886 - DNA, 22 bp, Homo sapiens
tttccatgtgtactggccagaa

SEQ ID NO: 81887 - DNA, 22 bp, Homo sapiens
ttcccacagtgactccagagaa

SEQ ID NO: 81888 - DNA, 22 bp, Homo sapiens
gcacctgcctgggactgaagat

SEQ ID NO: 81889 - DNA, 21 bp, Homo sapiens
acagcctccatctcctgggct

SEQ ID NO: 81890 - DNA, 22 bp, Homo sapiens
tgtcatagtgtggtagcagtgg

SEQ ID NO: 81891 - DNA, 22 bp, Homo sapiens
cttttcattgtttgtacatgca

SEQ ID NO: 81892 - DNA, 22 bp, Homo sapiens
atgcggagccccaagcttgaag

SEQ ID NO: 81893 - DNA, 22 bp, Homo sapiens
ttcctttctctggactgcagcc

SEQ ID NO: 81894 - DNA, 18 bp, Homo sapiens
ccatcaccctaactagtg

SEQ ID NO: 81895 - DNA, 22 bp, Homo sapiens
ccatccttgtcatcttcatgtt

SEQ ID NO: 81896 - DNA, 22 bp, Homo sapiens
agaaaacataggagacaggaaa

SEQ ID NO: 81897 - DNA, 22 bp, Homo sapiens
cagggtttcaccatgttagcag

SEQ ID NO: 81898 - DNA, 22 bp, Homo sapiens
cagaatcaagtccaattagcac

SEQ ID NO: 81899 - DNA, 22 bp, Homo sapiens
actgtgaacggactgaagccca

SEQ ID NO: 81900 - DNA, 22 bp, Homo sapiens
taacatttaaatttttcacata

SEQ ID NO: 81901 - DNA, 22 bp, Homo sapiens
aactcctctctggtggttcgtc

SEQ ID NO: 81902 - DNA, 22 bp, Homo sapiens
tagactggtgaattagggggaa

SEQ ID NO: 81903 - DNA, 22 bp, Homo sapiens
attataggcttgagccaccgtg

SEQ ID NO: 81904 - DNA, 22 bp, Homo sapiens
atagagtgatgtaaggtatgtg

SEQ ID NO: 81905 - DNA, 22 bp, Homo sapiens
ctacattaaattggcttactta

SEQ ID NO: 81906 - DNA, 22 bp, Homo sapiens
ctgtaatcccagctacctggga

SEQ ID NO: 81907 - DNA, 22 bp, Homo sapiens
aatgcaatgcagcacctccttg

SEQ ID NO: 81908 - DNA, 22 bp, Homo sapiens
aacccgggaggtggaggttatg

SEQ ID NO: 81909 - DNA, 22 bp, Homo sapiens
gtgagccgagtatagttcatag

SEQ ID NO: 81910 - DNA, 22 bp, Homo sapiens
agagggtgggcacgtgatggat

SEQ ID NO: 81911 - DNA, 22 bp, Homo sapiens
gtggggtagatctttctcagga

SEQ ID NO: 81912 - DNA, 22 bp, Homo sapiens
ctgagggtcaacttgattgtat

SEQ ID NO: 81913 - DNA, 23 bp, Homo sapiens
ttggcaaagcctatgaagtcctc

SEQ ID NO: 81914 - DNA, 22 bp, Homo sapiens
tctccccagtatggattctctg

SEQ ID NO: 81915 - DNA, 22 bp, Homo sapiens
tggaatggaaacaaactgagga

SEQ ID NO: 81916 - DNA, 22 bp, Homo sapiens
aggctctcaccctctgaccaga

SEQ ID NO: 81917 - DNA, 22 bp, Homo sapiens
agggaagaaaatccatcgctgc

SEQ ID NO: 81918 - DNA, 19 bp, Homo sapiens
ttctggtctggaatcaagg

SEQ ID NO: 81919 - DNA, 22 bp, Homo sapiens
gctccccaaaagctccaggaaa

SEQ ID NO: 81920 - DNA, 22 bp, Homo sapiens
aaacttttttaggttcataggc

SEQ ID NO: 81921 - DNA, 22 bp, Homo sapiens
agatttatgtggtcacactcag

SEQ ID NO: 81922 - DNA, 22 bp, Homo sapiens
ctgggaggcagaggttgcagtg

SEQ ID NO: 81923 - DNA, 19 bp, Homo sapiens
ctgtccttggctgcactgt

SEQ ID NO: 81924 - DNA, 22 bp, Homo sapiens
tagatctgatacaattcatctg

SEQ ID NO: 81925 - DNA, 22 bp, Homo sapiens
ttcttcagcctaccttgacctc

SEQ ID NO: 81926 - DNA, 22 bp, Homo sapiens
tttaagaagttatgttataaat

SEQ ID NO: 81927 - DNA, 20 bp, Homo sapiens
atcggcttgcctggaaacaa

SEQ ID NO: 81928 - DNA, 22 bp, Homo sapiens
ttgagatggagtctcactctgt

SEQ ID NO: 81929 - DNA, 22 bp, Homo sapiens
agtactgtcagcagggtgttga

SEQ ID NO: 81930 - DNA, 22 bp, Homo sapiens
ctcattgcagctgcattactgt

SEQ ID NO: 81931 - DNA, 22 bp, Homo sapiens
agggaattcactggaacgccct

SEQ ID NO: 81932 - DNA, 22 bp, Homo sapiens
ggctgggctccgggagcatgcg

SEQ ID NO: 81933 - DNA, 22 bp, Homo sapiens
caggctggagtgcagtggcgct

SEQ ID NO: 81934 - DNA, 22 bp, Homo sapiens
cagccccatggtgtgctccagc

SEQ ID NO: 81935 - DNA, 22 bp, Homo sapiens
gctgcagctcgccttccggcct

SEQ ID NO: 81936 - DNA, 22 bp, Homo sapiens
agatctgagggtccaagggagg

SEQ ID NO: 81937 - DNA, 21 bp, Homo sapiens
tctgatggtagatgagatgtg

SEQ ID NO: 81938 - DNA, 22 bp, Homo sapiens
ccaggctggagtatagtggcgc

SEQ ID NO: 81939 - DNA, 22 bp, Homo sapiens
agtcaaagatgaccgagttcct

SEQ ID NO: 81940 - DNA, 22 bp, Homo sapiens
actattagcatatcatgaatgg

SEQ ID NO: 81941 - DNA, 22 bp, Homo sapiens
ttgttcttgtctttgccttcac

SEQ ID NO: 81942 - DNA, 22 bp, Homo sapiens
tgttgcccaggttctctcctgc

SEQ ID NO: 81943 - DNA, 22 bp, Homo sapiens
gatatcattgagcccaggagtt

SEQ ID NO: 81944 - DNA, 22 bp, Homo sapiens
atatatttgagaatattcatga

SEQ ID NO: 81945 - DNA, 22 bp, Homo sapiens
attctaaatcagagagctctgt

SEQ ID NO: 81946 - DNA, 22 bp, Homo sapiens
tttgaagactactgggagtgaa

SEQ ID NO: 81947 - DNA, 22 bp, Homo sapiens
actttcttggtcccatgtttga

SEQ ID NO: 81948 - DNA, 22 bp, Homo sapiens
atttactttgctgagatccatc

SEQ ID NO: 81949 - DNA, 16 bp, Homo sapiens
ccacctgcagctctca

SEQ ID NO: 81950 - DNA, 22 bp, Homo sapiens
caggctggagttcagtggtgtg

SEQ ID NO: 81951 - DNA, 22 bp, Homo sapiens
gcagcctcaaactccccagctc

SEQ ID NO: 81952 - DNA, 21 bp, Homo sapiens
ctgtcatgcaaccattctcca

SEQ ID NO: 81953 - DNA, 22 bp, Homo sapiens
ctttggcaatgtcattttcaat

SEQ ID NO: 81954 - DNA, 22 bp, Homo sapiens
acccgatgttggtgctctagta

SEQ ID NO: 81955 - DNA, 22 bp, Homo sapiens
ttccagctaactcacatccctt

SEQ ID NO: 81956 - DNA, 22 bp, Homo sapiens
caggctggagtacaattgtgtg

SEQ ID NO: 81957 - DNA, 23 bp, Homo sapiens
tgctggagaagcaaagttctgag

SEQ ID NO: 81958 - DNA, 22 bp, Homo sapiens
gccatcatatcccctgtgacct

SEQ ID NO: 81959 - DNA, 22 bp, Homo sapiens
gggcggatcatttgaggtcagg

SEQ ID NO: 81960 - DNA, 18 bp, Homo sapiens
actctttctgcccacagg

SEQ ID NO: 81961 - DNA, 22 bp, Homo sapiens
gttcagatttgactggtttctc

SEQ ID NO: 81962 - DNA, 22 bp, Homo sapiens
atgccactgcgctctagcctgg

SEQ ID NO: 81963 - DNA, 22 bp, Homo sapiens
accatgttggccaagctggtct

SEQ ID NO: 81964 - DNA, 22 bp, Homo sapiens
tcaccagatctctctgtaatgg

SEQ ID NO: 81965 - DNA, 23 bp, Homo sapiens
gttttacaggtgagaaaatggag

SEQ ID NO: 81966 - DNA, 22 bp, Homo sapiens
atgttgtgtttgactgttaccc

SEQ ID NO: 81967 - DNA, 22 bp, Homo sapiens
gttactcttgagaggctgaggt

SEQ ID NO: 81968 - DNA, 22 bp, Homo sapiens
taatttcagtgcaagctcacgg

SEQ ID NO: 81969 - DNA, 22 bp, Homo sapiens
ggctgggcctctccctcagctg

SEQ ID NO: 81970 - DNA, 22 bp, Homo sapiens
aacccgggaggcggaggttgtg

SEQ ID NO: 81971 - DNA, 22 bp, Homo sapiens
ctcgcatgccctgcctcatcca

SEQ ID NO: 81972 - DNA, 22 bp, Homo sapiens
gctgtagtgaatggccgcgttc

SEQ ID NO: 81973 - DNA, 22 bp, Homo sapiens
gatgatcatctgtaaagttaga

SEQ ID NO: 81974 - DNA, 22 bp, Homo sapiens
ggaggggatttagtagatgcta

SEQ ID NO: 81975 - DNA, 22 bp, Homo sapiens
agaaacgcctgtgaaattatct

SEQ ID NO: 81976 - DNA, 22 bp, Homo sapiens
tatctattatgttctatgtgtc

SEQ ID NO: 81977 - DNA, 22 bp, Homo sapiens
ttttcatttttgtagatgcaag

SEQ ID NO: 81978 - DNA, 22 bp, Homo sapiens
atggatttgcttatacacatgt

SEQ ID NO: 81979 - DNA, 22 bp, Homo sapiens
ccctgcctacagggttttcttt

SEQ ID NO: 81980 - DNA, 22 bp, Homo sapiens
gctcatgactgtaatcccagca

SEQ ID NO: 81981 - DNA, 22 bp, Homo sapiens
cagcatgaatgtgttcgtaggg

SEQ ID NO: 81982 - DNA, 22 bp, Homo sapiens
gggcggatcacctgaggtcagg

SEQ ID NO: 81983 - DNA, 22 bp, Homo sapiens
tcttcacgccaagtgcccctca

SEQ ID NO: 81984 - DNA, 22 bp, Homo sapiens
atatattttttgagacagagtc

SEQ ID NO: 81985 - DNA, 22 bp, Homo sapiens
ggcttttgtttcagctctgcta

SEQ ID NO: 81986 - DNA, 22 bp, Homo sapiens
gagatgggcgagaaggtggact

SEQ ID NO: 81987 - DNA, 22 bp, Homo sapiens
tgagatggagccactgcactct

SEQ ID NO: 81988 - DNA, 22 bp, Homo sapiens
gggaaagaccttcctggggtgt

SEQ ID NO: 81989 - DNA, 19 bp, Homo sapiens
gggcaaagtgatcgtcctg

SEQ ID NO: 81990 - DNA, 22 bp, Homo sapiens
ttgccttcctgcccagcttctg

SEQ ID NO: 81991 - DNA, 22 bp, Homo sapiens
tatgacagtttcgtaggggttg

SEQ ID NO: 81992 - DNA, 22 bp, Homo sapiens
gtggagacctcctaggatgtgt

SEQ ID NO: 81993 - DNA, 19 bp, Homo sapiens
tccagatgatatggattac

SEQ ID NO: 81994 - DNA, 22 bp, Homo sapiens
taaagggtaggttttactgtaa

SEQ ID NO: 81995 - DNA, 22 bp, Homo sapiens
ccatgaattcactccatgctag

SEQ ID NO: 81996 - DNA, 22 bp, Homo sapiens
aagaatgagctcaaagatctta

SEQ ID NO: 81997 - DNA, 19 bp, Homo sapiens
catggtgaaaccccgtctc

SEQ ID NO: 81998 - DNA, 22 bp, Homo sapiens
gacctcatgatccacctgcctt

SEQ ID NO: 81999 - DNA, 22 bp, Homo sapiens
aggaaataggaccagacaaagc

SEQ ID NO: 82000 - DNA, 22 bp, Homo sapiens
gggcgcatcacctgaggtcagg

SEQ ID NO: 82001 - DNA, 22 bp, Homo sapiens
tagattccattggcccagagaa

SEQ ID NO: 82002 - DNA, 22 bp, Homo sapiens
gcgtctcaaggcccccaggcca

SEQ ID NO: 82003 - DNA, 22 bp, Homo sapiens
cctgattcagtggtgcccagag

SEQ ID NO: 82004 - DNA, 22 bp, Homo sapiens
tttccagagggtgctcagggcg

SEQ ID NO: 82005 - DNA, 22 bp, Homo sapiens
aggctcagatccttgtgtcctg

SEQ ID NO: 82006 - DNA, 22 bp, Homo sapiens
ccaggctggagtgcagtggcac

SEQ ID NO: 82007 - DNA, 22 bp, Homo sapiens
ggagaagaggagctggaagcct

SEQ ID NO: 82008 - DNA, 22 bp, Homo sapiens
ttttggctctgtctgtatcttt

SEQ ID NO: 82009 - DNA, 22 bp, Homo sapiens
ccaggcaggcgatggtgcagtg

SEQ ID NO: 82010 - DNA, 22 bp, Homo sapiens
ggaggcggaagttgcagtgagc

SEQ ID NO: 82011 - DNA, 22 bp, Homo sapiens
ccaggctggagtatagtggcgc

SEQ ID NO: 82012 - DNA, 22 bp, Homo sapiens
aggctggagtgcagttgcatga

SEQ ID NO: 82013 - DNA, 22 bp, Homo sapiens
ccaggaggttgaggctgcagtg

SEQ ID NO: 82014 - DNA, 22 bp, Homo sapiens
ccaggctgctgttggtgtccgc

SEQ ID NO: 82015 - DNA, 22 bp, Homo sapiens
ttggccatctaagcccagccac

SEQ ID NO: 82016 - DNA, 22 bp, Homo sapiens
ggaactgaggaacgaactggga

SEQ ID NO: 82017 - DNA, 22 bp, Homo sapiens
ccaggaggcggaggttgcagtg

SEQ ID NO: 82018 - DNA, 22 bp, Homo sapiens
gcagaggacacaggagggcaag

SEQ ID NO: 82019 - DNA, 22 bp, Homo sapiens
aggagaagccaagttgtgagca

SEQ ID NO: 82020 - DNA, 22 bp, Homo sapiens
gcaggctgtctaaagttagagt

SEQ ID NO: 82021 - DNA, 22 bp, Homo sapiens
tgagggaatattgatagatccg

SEQ ID NO: 82022 - DNA, 22 bp, Homo sapiens
gggttcagtccctcttgctact

SEQ ID NO: 82023 - DNA, 22 bp, Homo sapiens
gaggagggagctggaagctctt

SEQ ID NO: 82024 - DNA, 22 bp, Homo sapiens
agtgagagtattaatgtgaact

SEQ ID NO: 82025 - DNA, 22 bp, Homo sapiens
aagaagagaactggcatcctaa

SEQ ID NO: 82026 - DNA, 22 bp, Homo sapiens
gcccaggctggagtgcagtggc

SEQ ID NO: 82027 - DNA, 22 bp, Homo sapiens
gcccaggctggagtgcagtggt

SEQ ID NO: 82028 - DNA, 22 bp, Homo sapiens
ccaggaggtggagattgcagtg

SEQ ID NO: 82029 - DNA, 22 bp, Homo sapiens
tttgtcttatccaatctctcag

SEQ ID NO: 82030 - DNA, 22 bp, Homo sapiens
ggaggcggaggctgcagtgagc

SEQ ID NO: 82031 - DNA, 22 bp, Homo sapiens
aggagggagcttaagccaggca

SEQ ID NO: 82032 - DNA, 22 bp, Homo sapiens
aaacttgagccaagggcttggg

SEQ ID NO: 82033 - DNA, 22 bp, Homo sapiens
ggaggcggaggttgcagtgagt

SEQ ID NO: 82034 - DNA, 22 bp, Homo sapiens
ccaggctggagtgcaatggcat

SEQ ID NO: 82035 - DNA, 22 bp, Homo sapiens
aggaggaagggaagacaagtaa

SEQ ID NO: 82036 - DNA, 22 bp, Homo sapiens
gccaggctgaggctctggaaga

SEQ ID NO: 82037 - DNA, 22 bp, Homo sapiens
ccaggaggcggaggttgcagcg

SEQ ID NO: 82038 - DNA, 22 bp, Homo sapiens
ggaggcggaggttgcagtgagc

SEQ ID NO: 82039 - DNA, 22 bp, Homo sapiens
tccaggctttggggcaggagcg

SEQ ID NO: 82040 - DNA, 22 bp, Homo sapiens
cccaggctggagtgtaatggtg

SEQ ID NO: 82041 - DNA, 22 bp, Homo sapiens
ttttctgtttgcttcaagacat

SEQ ID NO: 82042 - DNA, 22 bp, Homo sapiens
ccaggaggcagaagttgcagtg

SEQ ID NO: 82043 - DNA, 22 bp, Homo sapiens
cctcgacctccccaggctcagg

SEQ ID NO: 82044 - DNA, 22 bp, Homo sapiens
ggagtgactcacagctgggaca

SEQ ID NO: 82045 - DNA, 19 bp, Homo sapiens
agggaatccggctgaggga

SEQ ID NO: 82046 - DNA, 22 bp, Homo sapiens
aaggaaagctgtggttctgaga

SEQ ID NO: 82047 - DNA, 22 bp, Homo sapiens
caggctgctgcctagaatgaca

SEQ ID NO: 82048 - DNA, 22 bp, Homo sapiens
gagcaggaaggccagaagggtc

SEQ ID NO: 82049 - DNA, 22 bp, Homo sapiens
ggctcctgggggtgctcctgcc

SEQ ID NO: 82050 - DNA, 22 bp, Homo sapiens
ccattgtaaattctgtggaagt

SEQ ID NO: 82051 - DNA, 22 bp, Homo sapiens
tgccaggcgtggtggtgcgcac

SEQ ID NO: 82052 - DNA, 22 bp, Homo sapiens
cccaggaggcagaagttgcagt

SEQ ID NO: 82053 - DNA, 22 bp, Homo sapiens
gaaaggagagggttaaggagct

SEQ ID NO: 82054 - DNA, 22 bp, Homo sapiens
ctcaggagttggaggctacagt

SEQ ID NO: 82055 - DNA, 22 bp, Homo sapiens
agcaggaaggggatgatgggca

SEQ ID NO: 82056 - DNA, 21 bp, Homo sapiens
gctgctcgagatccagtgctt

SEQ ID NO: 82057 - DNA, 19 bp, Homo sapiens
gcagacaggtccagagagg

SEQ ID NO: 82058 - DNA, 22 bp, Homo sapiens
caggcagggagctggaaaggat

SEQ ID NO: 82059 - DNA, 22 bp, Homo sapiens
gggagaggttacccgagcaact

SEQ ID NO: 82060 - DNA, 22 bp, Homo sapiens
ctggcctaaaaatacagaacaa

SEQ ID NO: 82061 - DNA, 22 bp, Homo sapiens
tcagtgatttctggggtgaggg

SEQ ID NO: 82062 - DNA, 23 bp, Homo sapiens
tgctggagaagcaaagttctgag

SEQ ID NO: 82063 - DNA, 22 bp, Homo sapiens
cacctagggtttcgcctttctt

SEQ ID NO: 82064 - DNA, 22 bp, Homo sapiens
caggctgtccaggctcctttgg

SEQ ID NO: 82065 - DNA, 22 bp, Homo sapiens
caggaaagggatgggctgccac

SEQ ID NO: 82066 - DNA, 22 bp, Homo sapiens
gagacacaggcacagaagaggc

SEQ ID NO: 82067 - DNA, 22 bp, Homo sapiens
catggcattgcataacggggct

SEQ ID NO: 82068 - DNA, 22 bp, Homo sapiens
cagctgctgttcagttttgttt

SEQ ID NO: 82069 - DNA, 22 bp, Homo sapiens
tagtggatgttcagagatttga

SEQ ID NO: 82070 - DNA, 22 bp, Homo sapiens
attggccatttgcatgtattat

SEQ ID NO: 82071 - DNA, 22 bp, Homo sapiens
cccaggctggagtgcagtggcg

SEQ ID NO: 82072 - DNA, 22 bp, Homo sapiens
aatgtgagccaatgcccgtggg

SEQ ID NO: 82073 - DNA, 22 bp, Homo sapiens
ccaggctggagtgcaatggcgt

SEQ ID NO: 82074 - DNA, 22 bp, Homo sapiens
cccaggcttttctcttgcccca

SEQ ID NO: 82075 - DNA, 22 bp, Homo sapiens
tgaatgtgatgctaaacatatg

SEQ ID NO: 82076 - DNA, 22 bp, Homo sapiens
aggcaaggtgctacagacagtg

SEQ ID NO: 82077 - DNA, 22 bp, Homo sapiens
gcaggcagaggtggaggagaca

SEQ ID NO: 82078 - DNA, 22 bp, Homo sapiens
ggggtgggcgtgcagggacacc

SEQ ID NO: 82079 - DNA, 22 bp, Homo sapiens
gcagcctgggcaacagagtgag

SEQ ID NO: 82080 - DNA, 22 bp, Homo sapiens
ctgggcaaattgtgccagctat

SEQ ID NO: 82081 - DNA, 21 bp, Homo sapiens
cagagctgtccaaaccctgac

SEQ ID NO: 82082 - DNA, 22 bp, Homo sapiens
tctgagctccatgcaggaggct

SEQ ID NO: 82083 - DNA, 22 bp, Homo sapiens
gaggagggagctggaagctctt

SEQ ID NO: 82084 - DNA, 22 bp, Homo sapiens
tggcctcggcatccagcaagag

SEQ ID NO: 82085 - DNA, 22 bp, Homo sapiens
aatggcactttataaatgttaa

SEQ ID NO: 82086 - DNA, 22 bp, Homo sapiens
agtgctgggctatctactgcta

SEQ ID NO: 82087 - DNA, 22 bp, Homo sapiens
ccaaagtgctgggattacaggt

SEQ ID NO: 82088 - DNA, 22 bp, Homo sapiens
atatatttgagaatattcatga

SEQ ID NO: 82089 - DNA, 22 bp, Homo sapiens
ggcctctcttgggacagctgtc

SEQ ID NO: 82090 - DNA, 22 bp, Homo sapiens
acagtctgtcccccaggtgcta

SEQ ID NO: 82091 - DNA, 22 bp, Homo sapiens
tttattctgtgctacatgaaga

SEQ ID NO: 82092 - DNA, 22 bp, Homo sapiens
ctggcctggcgcagtggctcac

SEQ ID NO: 82093 - DNA, 22 bp, Homo sapiens
ctctccattccctacagttttc

SEQ ID NO: 82094 - DNA, 22 bp, Homo sapiens
acccaggccattggcaagagtc

SEQ ID NO: 82095 - DNA, 22 bp, Homo sapiens
cagcccaggactgcaggtgttt

SEQ ID NO: 82096 - DNA, 22 bp, Homo sapiens
atgaaatatcttgaagaaattc

SEQ ID NO: 82097 - DNA, 22 bp, Homo sapiens
gctcatgactgtaatcccagca

SEQ ID NO: 82098 - DNA, 22 bp, Homo sapiens
actgcacttcaccctgggtgac

SEQ ID NO: 82099 - DNA, 22 bp, Homo sapiens
gttccaggtggtcacagagctc

SEQ ID NO: 82100 - DNA, 22 bp, Homo sapiens
catagagtgatgtaaggtatgt

SEQ ID NO: 82101 - DNA, 22 bp, Homo sapiens
cccacgtcgaacttgctccaga

SEQ ID NO: 82102 - DNA, 23 bp, Homo sapiens
aggttatgattatagagcgagga

SEQ ID NO: 82103 - DNA, 22 bp, Homo sapiens
ctggaaggagcccgggcggatc

SEQ ID NO: 82104 - DNA, 22 bp, Homo sapiens
tgttgattagtgtttagactta

SEQ ID NO: 82105 - DNA, 22 bp, Homo sapiens
cactgcactccagcttgggcaa

SEQ ID NO: 82106 - DNA, 22 bp, Homo sapiens
cgccaggcttggtagctcatgc

SEQ ID NO: 82107 - DNA, 22 bp, Homo sapiens
tcttcctgtcaatgagaattaa

SEQ ID NO: 82108 - DNA, 22 bp, Homo sapiens
cggtcaggtgcagcgttggcac

SEQ ID NO: 82109 - DNA, 22 bp, Homo sapiens
caggaggattgcttgaggccag

SEQ ID NO: 82110 - DNA, 22 bp, Homo sapiens
tcccgcccttgtacttgccgag

SEQ ID NO: 82111 - DNA, 22 bp, Homo sapiens
cctcggctgggccttggccact

SEQ ID NO: 82112 - DNA, 22 bp, Homo sapiens
agcccaggttgaggctgcagtg

SEQ ID NO: 82113 - DNA, 22 bp, Homo sapiens
tataaagagtctcaaagaagtt

SEQ ID NO: 82114 - DNA, 22 bp, Homo sapiens
ccacccttgggttcggaggccg

SEQ ID NO: 82115 - DNA, 22 bp, Homo sapiens
ctgggcagctgtatcagggagt

SEQ ID NO: 82116 - DNA, 23 bp, Homo sapiens
ccagtgattgcctggaaggaggt

SEQ ID NO: 82117 - DNA, 22 bp, Homo sapiens
cgtaggtggctcagcacctggg

SEQ ID NO: 82118 - DNA, 22 bp, Homo sapiens
actgccctccagcctgggtgac

SEQ ID NO: 82119 - DNA, 22 bp, Homo sapiens
ctctgcctgtctcatcctgcaa

SEQ ID NO: 82120 - DNA, 22 bp, Homo sapiens
ccgtggtcacctgagctccttg

SEQ ID NO: 82121 - DNA, 22 bp, Homo sapiens
agccccttgtgggcgcacagca

SEQ ID NO: 82122 - DNA, 22 bp, Homo sapiens
tctggcttccctctgttctggg

SEQ ID NO: 82123 - DNA, 22 bp, Homo sapiens
ctgtaatcccagctactcggga

SEQ ID NO: 82124 - DNA, 22 bp, Homo sapiens
ccctgccttgtctgggctaggt

SEQ ID NO: 82125 - DNA, 22 bp, Homo sapiens
cacatttttactgccaacttaa

SEQ ID NO: 82126 - DNA, 22 bp, Homo sapiens
agctggaattacaggagcccat

SEQ ID NO: 82127 - DNA, 22 bp, Homo sapiens
tcacagagaaatgtggcacaaa

SEQ ID NO: 82128 - DNA, 22 bp, Homo sapiens
ggcttcagtggccagagatgat

SEQ ID NO: 82129 - DNA, 22 bp, Homo sapiens
caggaaggcgcggctgtgcctg

SEQ ID NO: 82130 - DNA, 22 bp, Homo sapiens
gagaaagctaaataagttgatt

SEQ ID NO: 82131 - DNA, 22 bp, Homo sapiens
ttccccttgggctgtggaggag

SEQ ID NO: 82132 - DNA, 22 bp, Homo sapiens
cagtcactggaatagctgagga

SEQ ID NO: 82133 - DNA, 22 bp, Homo sapiens
ggaggtggagctggaagttcca

SEQ ID NO: 82134 - DNA, 21 bp, Homo sapiens
ttggtagatgcagcaccagta

SEQ ID NO: 82135 - DNA, 22 bp, Homo sapiens
cagcagcagtggctgcagaaca

SEQ ID NO: 82136 - DNA, 22 bp, Homo sapiens
tgccatagcaatggtaagctga

SEQ ID NO: 82137 - DNA, 22 bp, Homo sapiens
agtggcctggagccccgcctgg

SEQ ID NO: 82138 - DNA, 22 bp, Homo sapiens
gggaggcagtgctggaggctgg

SEQ ID NO: 82139 - DNA, 22 bp, Homo sapiens
ccagactgcttgcttcccagcc

SEQ ID NO: 82140 - DNA, 22 bp, Homo sapiens
tagatgaccttgtgttaggcaa

SEQ ID NO: 82141 - DNA, 22 bp, Homo sapiens
cctgcagacacttgtccagcaa

SEQ ID NO: 82142 - DNA, 22 bp, Homo sapiens
cagtgcccgccgccgttcctgg

SEQ ID NO: 82143 - DNA, 22 bp, Homo sapiens
gaggttggggctgcagtgagct

SEQ ID NO: 82144 - DNA, 22 bp, Homo sapiens
atccatttgacataatttcagc

SEQ ID NO: 82145 - DNA, 22 bp, Homo sapiens
cagggggctcaaaggagagtgc

SEQ ID NO: 82146 - DNA, 18 bp, Homo sapiens
ggagactaaactgttgac

SEQ ID NO: 82147 - DNA, 22 bp, Homo sapiens
agtccaggactgtttcagctga

SEQ ID NO: 82148 - DNA, 22 bp, Homo sapiens
ggctagggatctagaccaggac

SEQ ID NO: 82149 - DNA, 22 bp, Homo sapiens
ggccactgctctccagcctggg

SEQ ID NO: 82150 - DNA, 22 bp, Homo sapiens
cacgcacgctgggtggaggcgc

SEQ ID NO: 82151 - DNA, 22 bp, Homo sapiens
tgtccaggctaaagtgcagtgg

SEQ ID NO: 82152 - DNA, 22 bp, Homo sapiens
aagaggagaaaggctggctttg

SEQ ID NO: 82153 - DNA, 22 bp, Homo sapiens
atgttgtgtttgactgttaccc

SEQ ID NO: 82154 - DNA, 22 bp, Homo sapiens
ttctccgctaagttctctgcag

SEQ ID NO: 82155 - DNA, 22 bp, Homo sapiens
tggagccagcggcctgctgagg

SEQ ID NO: 82156 - DNA, 22 bp, Homo sapiens
attgaaaataaggccagaaaca

SEQ ID NO: 82157 - DNA, 22 bp, Homo sapiens
agaggcaggaggttgacttgag

SEQ ID NO: 82158 - DNA, 22 bp, Homo sapiens
ctggcccaggtggtcgttgagg

SEQ ID NO: 82159 - DNA, 22 bp, Homo sapiens
tccacgtgagcttcgtgtgcag

SEQ ID NO: 82160 - DNA, 22 bp, Homo sapiens
gtaatagtctcaaactcctgga

SEQ ID NO: 82161 - DNA, 22 bp, Homo sapiens
ctgatctcaagtgatccaccca

SEQ ID NO: 82162 - DNA, 22 bp, Homo sapiens
atgccacttcattccagcctcg

SEQ ID NO: 82163 - DNA, 22 bp, Homo sapiens
aatttaagaacatttcaggact

SEQ ID NO: 82164 - DNA, 22 bp, Homo sapiens
gagcccaggcagaggttgcagt

SEQ ID NO: 82165 - DNA, 22 bp, Homo sapiens
ctcattgcccagatccccacag

SEQ ID NO: 82166 - DNA, 22 bp, Homo sapiens
gaaatctttgccttagctgtgt

SEQ ID NO: 82167 - DNA, 22 bp, Homo sapiens
gggtggtggccagcagtgggca

SEQ ID NO: 82168 - DNA, 22 bp, Homo sapiens
ttttgacaatgctaatctcaat

SEQ ID NO: 82169 - DNA, 22 bp, Homo sapiens
gggccggagctgggtcccgcgc

SEQ ID NO: 82170 - DNA, 22 bp, Homo sapiens
ttgtgttaaggtgcatctagtg

SEQ ID NO: 82171 - DNA, 22 bp, Homo sapiens
actgcactccagcctgggtaac

SEQ ID NO: 82172 - DNA, 22 bp, Homo sapiens
actgcactccaacctgggtgac

SEQ ID NO: 82173 - DNA, 22 bp, Homo sapiens
tgcactccaggctgggtgacag

SEQ ID NO: 82174 - DNA, 22 bp, Homo sapiens
ctgagatctttatacgaggcac

SEQ ID NO: 82175 - DNA, 22 bp, Homo sapiens
agaggaggctctgggatcgtcc

SEQ ID NO: 82176 - DNA, 22 bp, Homo sapiens
gagaggtggaggttgcagtgag

SEQ ID NO: 82177 - DNA, 22 bp, Homo sapiens
ggcctcttatctggctcctgca

SEQ ID NO: 82178 - DNA, 22 bp, Homo sapiens
ctggtctggctacccagcgaat

SEQ ID NO: 82179 - DNA, 22 bp, Homo sapiens
cagcaagtcatccaggatgatg

SEQ ID NO: 82180 - DNA, 22 bp, Homo sapiens
tttgtgaataggttggcttcca

SEQ ID NO: 82181 - DNA, 22 bp, Homo sapiens
gatgcacggtcatgtcttttca

SEQ ID NO: 82182 - DNA, 22 bp, Homo sapiens
gccatgactctccataccaaag

SEQ ID NO: 82183 - DNA, 22 bp, Homo sapiens
ccagggtggcgtagatgctggg

SEQ ID NO: 82184 - DNA, 22 bp, Homo sapiens
agggccagcactcctggcagga

SEQ ID NO: 82185 - DNA, 22 bp, Homo sapiens
caggctggagttcagtggtgtg

SEQ ID NO: 82186 - DNA, 22 bp, Homo sapiens
actgcactccagcccgagcaac

SEQ ID NO: 82187 - DNA, 21 bp, Homo sapiens
tgtaagtttcatctgaattgg

SEQ ID NO: 82188 - DNA, 22 bp, Homo sapiens
agcgccactgcactccagcctg

SEQ ID NO: 82189 - DNA, 22 bp, Homo sapiens
ccaaagaaacccaagctcaggg

SEQ ID NO: 82190 - DNA, 23 bp, Homo sapiens
acagtcgtaggtatccttttcct

SEQ ID NO: 82191 - DNA, 22 bp, Homo sapiens
cccaggaggcggaggttgcagt

SEQ ID NO: 82192 - DNA, 22 bp, Homo sapiens
cagcatgttcttgtctcactgg

SEQ ID NO: 82193 - DNA, 22 bp, Homo sapiens
ggcaaagccctgcctggttcaa

SEQ ID NO: 82194 - DNA, 22 bp, Homo sapiens
ggcccaggctggagtgcagtgg

SEQ ID NO: 82195 - DNA, 22 bp, Homo sapiens
tgggccacacacagaagaatca

SEQ ID NO: 82196 - DNA, 22 bp, Homo sapiens
aggagtcccactgtcaatgcta

SEQ ID NO: 82197 - DNA, 22 bp, Homo sapiens
tgcctccaacagcccatcctag

SEQ ID NO: 82198 - DNA, 22 bp, Homo sapiens
gcctcagtctcccgagtagctg

SEQ ID NO: 82199 - DNA, 17 bp, Homo sapiens
tactgaggggtctggag

SEQ ID NO: 82200 - DNA, 22 bp, Homo sapiens
tcagtgcacccaattctctcca

SEQ ID NO: 82201 - DNA, 22 bp, Homo sapiens
gaggctgaggttgcagtgagcc

SEQ ID NO: 82202 - DNA, 22 bp, Homo sapiens
ttttcatttttgtagatgcaag

SEQ ID NO: 82203 - DNA, 22 bp, Homo sapiens
acttgccccagaattgctgctg

SEQ ID NO: 82204 - DNA, 22 bp, Homo sapiens
caagcttgtttctcctgggggt

SEQ ID NO: 82205 - DNA, 22 bp, Homo sapiens
ggccactgacctacatctgggg

SEQ ID NO: 82206 - DNA, 22 bp, Homo sapiens
ggacctgaacataaaacgaggc

SEQ ID NO: 82207 - DNA, 22 bp, Homo sapiens
tcttgggcatgtgtttgatttc

SEQ ID NO: 82208 - DNA, 22 bp, Homo sapiens
accagcctggccaacatggtga

SEQ ID NO: 82209 - DNA, 22 bp, Homo sapiens
atgaccagccgagataaacaga

SEQ ID NO: 82210 - DNA, 20 bp, Homo sapiens
ggcagagggcctgggagaag

SEQ ID NO: 82211 - DNA, 22 bp, Homo sapiens
gctgtgtatcagatgccacggg

SEQ ID NO: 82212 - DNA, 22 bp, Homo sapiens
aaggctgaggcagtgaggcaga

SEQ ID NO: 82213 - DNA, 22 bp, Homo sapiens
atgccactgcactccagcctag

SEQ ID NO: 82214 - DNA, 22 bp, Homo sapiens
aacagtgtttttcttcagcact

SEQ ID NO: 82215 - DNA, 22 bp, Homo sapiens
caggcgggcaggtgcggcccct

SEQ ID NO: 82216 - DNA, 22 bp, Homo sapiens
acgggccttctcttcaggcgag

SEQ ID NO: 82217 - DNA, 22 bp, Homo sapiens
gtggatggccctgcacacaggt

SEQ ID NO: 82218 - DNA, 22 bp, Homo sapiens
cgcccccagggcctcgagcatg

SEQ ID NO: 82219 - DNA, 22 bp, Homo sapiens
cctcacctcagtctgggcctca

SEQ ID NO: 82220 - DNA, 22 bp, Homo sapiens
gctccctggtagccatgctctc

SEQ ID NO: 82221 - DNA, 22 bp, Homo sapiens
agaagccaccagctgaggaaga

SEQ ID NO: 82222 - DNA, 22 bp, Homo sapiens
actctggccatcttggaccttg

SEQ ID NO: 82223 - DNA, 22 bp, Homo sapiens
tcaccggcagacgtggcctgat

SEQ ID NO: 82224 - DNA, 22 bp, Homo sapiens
ggtgggagagctctgtctccag

SEQ ID NO: 82225 - DNA, 22 bp, Homo sapiens
acacggcactttaggaaggggc

SEQ ID NO: 82226 - DNA, 22 bp, Homo sapiens
cttggggaagccactgatccct

SEQ ID NO: 82227 - DNA, 21 bp, Homo sapiens
ctacttaagtaggggattagg

SEQ ID NO: 82228 - DNA, 22 bp, Homo sapiens
gcctcatcgctgctcggcccgg

SEQ ID NO: 82229 - DNA, 22 bp, Homo sapiens
tgagccgtggtctctgagggtg

SEQ ID NO: 82230 - DNA, 22 bp, Homo sapiens
ccagcctggttcagaattggct

SEQ ID NO: 82231 - DNA, 22 bp, Homo sapiens
actgtgaacggactgaagccca

SEQ ID NO: 82232 - DNA, 22 bp, Homo sapiens
aaaagcaattgcagttcttgcc

SEQ ID NO: 82233 - DNA, 22 bp, Homo sapiens
cgtgccactgcactctagcctg

SEQ ID NO: 82234 - DNA, 22 bp, Homo sapiens
tcctcagcttttatttcacttg

SEQ ID NO: 82235 - DNA, 22 bp, Homo sapiens
ccctttagcccctgcagagact

SEQ ID NO: 82236 - DNA, 22 bp, Homo sapiens
gctgacccctacaggttgtgtt

SEQ ID NO: 82237 - DNA, 22 bp, Homo sapiens
ccaggtagccaaggggtctggg

SEQ ID NO: 82238 - DNA, 19 bp, Homo sapiens
ctccttgccatttcttttc

SEQ ID NO: 82239 - DNA, 22 bp, Homo sapiens
ttccgagggctcggcggccgcc

SEQ ID NO: 82240 - DNA, 22 bp, Homo sapiens
ccaggcaggcgatggtgcagtg

SEQ ID NO: 82241 - DNA, 22 bp, Homo sapiens
aggctagaggcttctggcttca

SEQ ID NO: 82242 - DNA, 23 bp, Homo sapiens
tgttccagatacgccttttcctc

SEQ ID NO: 82243 - DNA, 22 bp, Homo sapiens
ctgggctcaagtgatccaccca

SEQ ID NO: 82244 - DNA, 22 bp, Homo sapiens
gcgagggcacgcggttgaaggc

SEQ ID NO: 82245 - DNA, 22 bp, Homo sapiens
aaggctgagacagcacaggtcc

SEQ ID NO: 82246 - DNA, 22 bp, Homo sapiens
cccaggaggtggaggctgcagt

SEQ ID NO: 82247 - DNA, 22 bp, Homo sapiens
aaagtgctgggattataggcat

SEQ ID NO: 82248 - DNA, 22 bp, Homo sapiens
gtagctctgtttaaagttcttt

SEQ ID NO: 82249 - DNA, 22 bp, Homo sapiens
gaggtaacactgttcagtgggc

SEQ ID NO: 82250 - DNA, 22 bp, Homo sapiens
atgagaaagttaatcatcatga

SEQ ID NO: 82251 - DNA, 22 bp, Homo sapiens
cctagagctctgctttatctaa

SEQ ID NO: 82252 - DNA, 22 bp, Homo sapiens
ggtccccccatggtgagcactg

SEQ ID NO: 82253 - DNA, 22 bp, Homo sapiens
gttctgagtcctcctttgaagg

SEQ ID NO: 82254 - DNA, 22 bp, Homo sapiens
actccacaccacgggggccgcc

SEQ ID NO: 82255 - DNA, 22 bp, Homo sapiens
gagcactgatttatttttgtct

SEQ ID NO: 82256 - DNA, 22 bp, Homo sapiens
tgtaatattgtagtgacagtac

SEQ ID NO: 82257 - DNA, 22 bp, Homo sapiens
gaggtggatgttgcagtgagct

SEQ ID NO: 82258 - DNA, 22 bp, Homo sapiens
tagcataacaggtaagagtgag

SEQ ID NO: 82259 - DNA, 22 bp, Homo sapiens
gagcaggaaggccagaagggtc

SEQ ID NO: 82260 - DNA, 22 bp, Homo sapiens
gtggcagagccaaggctggagc

SEQ ID NO: 82261 - DNA, 22 bp, Homo sapiens
gaaactctcgcatcctgggaac

SEQ ID NO: 82262 - DNA, 22 bp, Homo sapiens
atacaaaatatatactggagac

SEQ ID NO: 82263 - DNA, 22 bp, Homo sapiens
tggtatttctgtgcccagctca

SEQ ID NO: 82264 - DNA, 22 bp, Homo sapiens
cttgctttcagtctcggcctca

SEQ ID NO: 82265 - DNA, 22 bp, Homo sapiens
tggagtgcaatagtaataaggt

SEQ ID NO: 82266 - DNA, 22 bp, Homo sapiens
aagaatgagctcaaagatctta

SEQ ID NO: 82267 - DNA, 22 bp, Homo sapiens
tgatttacagtagtgtctaaac

SEQ ID NO: 82268 - DNA, 22 bp, Homo sapiens
ctcaggacccggtccaggtggg

SEQ ID NO: 82269 - DNA, 22 bp, Homo sapiens
ctgggaggcggagcttgcagtg

SEQ ID NO: 82270 - DNA, 22 bp, Homo sapiens
tatgtttggcctggcaatttca

SEQ ID NO: 82271 - DNA, 22 bp, Homo sapiens
tgggcgacagagcaagactccg

SEQ ID NO: 82272 - DNA, 22 bp, Homo sapiens
gccctcctggcaggcagtgatg

SEQ ID NO: 82273 - DNA, 23 bp, Homo sapiens
atgggccaagcaagacccatgac

SEQ ID NO: 82274 - DNA, 22 bp, Homo sapiens
gattgtggaagtcagtggttct

SEQ ID NO: 82275 - DNA, 22 bp, Homo sapiens
ggatctgggctgcagtctaggc

SEQ ID NO: 82276 - DNA, 22 bp, Homo sapiens
agaaatatgctgattagatgaa

SEQ ID NO: 82277 - DNA, 22 bp, Homo sapiens
aatggtttctgaagttaggcag

SEQ ID NO: 82278 - DNA, 23 bp, Homo sapiens
aaacttgctatggctgaaatcat

SEQ ID NO: 82279 - DNA, 22 bp, Homo sapiens
ggcagcactgcagcttgttggg

SEQ ID NO: 82280 - DNA, 22 bp, Homo sapiens
tcagccagccagctacaggctt

SEQ ID NO: 82281 - DNA, 22 bp, Homo sapiens
ctgctcagtaatagtcctatct

SEQ ID NO: 82282 - DNA, 22 bp, Homo sapiens
ggtgaggggctcctctgcccgg

SEQ ID NO: 82283 - DNA, 22 bp, Homo sapiens
tctgaaaactccatgagctcgt

SEQ ID NO: 82284 - DNA, 22 bp, Homo sapiens
cccaggaggtcaaggctgcagt

SEQ ID NO: 82285 - DNA, 22 bp, Homo sapiens
aagagggctgcaatcttattgc

SEQ ID NO: 82286 - DNA, 22 bp, Homo sapiens
ctgtaatcccagctacctggga

SEQ ID NO: 82287 - DNA, 22 bp, Homo sapiens
cactgcactccagcactccagc

SEQ ID NO: 82288 - DNA, 22 bp, Homo sapiens
gatgtgtttccaggatttgttt

SEQ ID NO: 82289 - DNA, 22 bp, Homo sapiens
tcactgcaacctccacctcctg

SEQ ID NO: 82290 - DNA, 22 bp, Homo sapiens
ttatagcagcatgatttacaat

SEQ ID NO: 82291 - DNA, 22 bp, Homo sapiens
gggagctgagctggaagagaat

SEQ ID NO: 82292 - DNA, 22 bp, Homo sapiens
tttctcttcactgtgtgcctca

SEQ ID NO: 82293 - DNA, 22 bp, Homo sapiens
gaggctgaggttgcagtgagct

SEQ ID NO: 82294 - DNA, 22 bp, Homo sapiens
aaactgaggctcccgagggtgt

SEQ ID NO: 82295 - DNA, 22 bp, Homo sapiens
ctccttctgggcctggcagtgg

SEQ ID NO: 82296 - DNA, 22 bp, Homo sapiens
tagtcccggaactccttcaggt

SEQ ID NO: 82297 - DNA, 22 bp, Homo sapiens
tttgcttgttcaagatttctgt

SEQ ID NO: 82298 - DNA, 22 bp, Homo sapiens
ccaggctggagtgcagtggcac

SEQ ID NO: 82299 - DNA, 22 bp, Homo sapiens
gcctgtgacccagggcccagga

SEQ ID NO: 82300 - DNA, 22 bp, Homo sapiens
tgacttcctgcactcaggtgat

SEQ ID NO: 82301 - DNA, 22 bp, Homo sapiens
tgacagaggagctggaatgatt

SEQ ID NO: 82302 - DNA, 19 bp, Homo sapiens
gggcttggggctgaagcct

SEQ ID NO: 82303 - DNA, 22 bp, Homo sapiens
tttgcttcacaagtatggttct

SEQ ID NO: 82304 - DNA, 22 bp, Homo sapiens
ctctggagtgtctggccagggt

SEQ ID NO: 82305 - DNA, 22 bp, Homo sapiens
aaacatctactgtaggctggag

SEQ ID NO: 82306 - DNA, 22 bp, Homo sapiens
gaggccacggaagggagctgtg

SEQ ID NO: 82307 - DNA, 22 bp, Homo sapiens
acccagggctcaagcgtaggca

SEQ ID NO: 82308 - DNA, 20 bp, Homo sapiens
gtgcaatggcaccatctcag

SEQ ID NO: 82309 - DNA, 19 bp, Homo sapiens
gatttaaacgtggctctat

SEQ ID NO: 82310 - DNA, 22 bp, Homo sapiens
ccctcaggtgaaaggaaaaatt

SEQ ID NO: 82311 - DNA, 17 bp, Homo sapiens
aggaggccctggcgttt

SEQ ID NO: 82312 - DNA, 22 bp, Homo sapiens
ttaaattttagaaacagactct

SEQ ID NO: 82313 - DNA, 22 bp, Homo sapiens
tgctgctgaggctaaagtatag

SEQ ID NO: 82314 - DNA, 22 bp, Homo sapiens
ccaggagctggagggtgcagtg

SEQ ID NO: 82315 - DNA, 22 bp, Homo sapiens
agagagcccgggccagggcaca

SEQ ID NO: 82316 - DNA, 22 bp, Homo sapiens
aggatttctgtgcctggaaaat

SEQ ID NO: 82317 - DNA, 22 bp, Homo sapiens
caggctgctgcctagaatgaca

SEQ ID NO: 82318 - DNA, 22 bp, Homo sapiens
accaggcccgctgctatggtgg

SEQ ID NO: 82319 - DNA, 22 bp, Homo sapiens
cccagagcatgtgctgcctttg

SEQ ID NO: 82320 - DNA, 22 bp, Homo sapiens
ccttttgctctcccatccagaa

SEQ ID NO: 82321 - DNA, 22 bp, Homo sapiens
cactgcactccagcccgggcaa

SEQ ID NO: 82322 - DNA, 22 bp, Homo sapiens
ggctcagatggtttgttctaga

SEQ ID NO: 82323 - DNA, 22 bp, Homo sapiens
aggactgggtgcagagggcatc

SEQ ID NO: 82324 - DNA, 22 bp, Homo sapiens
gaggtgggtgtatcacaggtca

SEQ ID NO: 82325 - DNA, 22 bp, Homo sapiens
tggcccttgttcaaatatgtca

SEQ ID NO: 82326 - DNA, 19 bp, Homo sapiens
gagaaagcaggcacagcac

SEQ ID NO: 82327 - DNA, 22 bp, Homo sapiens
ttctgtgaatcttttttcccac

SEQ ID NO: 82328 - DNA, 22 bp, Homo sapiens
gccagggttcgaatccgtatgg

SEQ ID NO: 82329 - DNA, 22 bp, Homo sapiens
aggctcccaagcactgacccca

SEQ ID NO: 82330 - DNA, 22 bp, Homo sapiens
aggagggagcttaagccaggca

SEQ ID NO: 82331 - DNA, 22 bp, Homo sapiens
cactgcaacctctgcctcctgg

SEQ ID NO: 82332 - DNA, 22 bp, Homo sapiens
tggaagggagctggaatttgga

SEQ ID NO: 82333 - DNA, 22 bp, Homo sapiens
aggggaggtgtccccaaatctc

SEQ ID NO: 82334 - DNA, 22 bp, Homo sapiens
aagtggcagttcaggaagcaga

SEQ ID NO: 82335 - DNA, 22 bp, Homo sapiens
gtgctccctccttcctcaagga

SEQ ID NO: 82336 - DNA, 22 bp, Homo sapiens
agcctggtttaagcattttata

SEQ ID NO: 82337 - DNA, 22 bp, Homo sapiens
gcccgcgccagcctctccatct

SEQ ID NO: 82338 - DNA, 22 bp, Homo sapiens
tcactgcaacctccacctcccg

SEQ ID NO: 82339 - DNA, 22 bp, Homo sapiens
gcgcaccacctccaggtggccg

SEQ ID NO: 82340 - DNA, 22 bp, Homo sapiens
tgaggcaggagttcaggctgcg

SEQ ID NO: 82341 - DNA, 22 bp, Homo sapiens
aaagattaaatcaaattggtca

SEQ ID NO: 82342 - DNA, 18 bp, Homo sapiens
tttctcagactctctttc

SEQ ID NO: 82343 - DNA, 22 bp, Homo sapiens
ttcagacatgcaggctgaggct

SEQ ID NO: 82344 - DNA, 22 bp, Homo sapiens
tttgaagggcacgacaatagtt

SEQ ID NO: 82345 - DNA, 22 bp, Homo sapiens
tatccaattcaccattgatggg

SEQ ID NO: 82346 - DNA, 22 bp, Homo sapiens
cactgcactccagcctgggcaa

SEQ ID NO: 82347 - DNA, 22 bp, Homo sapiens
cctgagagcattccacactgaa

SEQ ID NO: 82348 - DNA, 22 bp, Homo sapiens
gacaggaggcagagctcaggtg

SEQ ID NO: 82349 - DNA, 22 bp, Homo sapiens
gcagggaggtttgctgacctgg

SEQ ID NO: 82350 - DNA, 22 bp, Homo sapiens
taggcaagtggaccagaggttt

SEQ ID NO: 82351 - DNA, 22 bp, Homo sapiens
ttgcactccagcccgagcaaca

SEQ ID NO: 82352 - DNA, 22 bp, Homo sapiens
ttgcttcttagatattcctctc

SEQ ID NO: 82353 - DNA, 22 bp, Homo sapiens
agccagggtctctcgctctgtt

SEQ ID NO: 82354 - DNA, 22 bp, Homo sapiens
gcgagaaactaagtgccctttg

SEQ ID NO: 82355 - DNA, 22 bp, Homo sapiens
gaggccaactttggagaacagg

SEQ ID NO: 82356 - DNA, 22 bp, Homo sapiens
cagctttgccaagtaaggtctt

SEQ ID NO: 82357 - DNA, 22 bp, Homo sapiens
ctgggaggcagaggttgtagtg

SEQ ID NO: 82358 - DNA, 22 bp, Homo sapiens
ggaggtgggctaaggactctct

SEQ ID NO: 82359 - DNA, 22 bp, Homo sapiens
agctgattccactttttcccca

SEQ ID NO: 82360 - DNA, 22 bp, Homo sapiens
ggcaggaggtgagtggcgggtg

SEQ ID NO: 82361 - DNA, 22 bp, Homo sapiens
cacaaaccttctgcagcctgta

SEQ ID NO: 82362 - DNA, 22 bp, Homo sapiens
atgcctgtaatcccagcacttt

SEQ ID NO: 82363 - DNA, 22 bp, Homo sapiens
ggcgtgggcgaggtgctctatc

SEQ ID NO: 82364 - DNA, 22 bp, Homo sapiens
cccagcaggtcggtgctgcctg

SEQ ID NO: 82365 - DNA, 22 bp, Homo sapiens
acccaggctggcgtgcagtggc

SEQ ID NO: 82366 - DNA, 22 bp, Homo sapiens
ttacatgtggtgtgaagaagag

SEQ ID NO: 82367 - DNA, 22 bp, Homo sapiens
cccagcgagtttgccggtgaac

SEQ ID NO: 82368 - DNA, 22 bp, Homo sapiens
gcccttacagggtggtcagcca

SEQ ID NO: 82369 - DNA, 22 bp, Homo sapiens
cttgatctacatagtgaaaccc

SEQ ID NO: 82370 - DNA, 22 bp, Homo sapiens
ctcctgggaaaggctggacaca

SEQ ID NO: 82371 - DNA, 22 bp, Homo sapiens
tggtggctcacacctgtaatcc

SEQ ID NO: 82372 - DNA, 22 bp, Homo sapiens
acaggcttacaggctgcaagta

SEQ ID NO: 82373 - DNA, 22 bp, Homo sapiens
ggaaggcagaggtgtcgtgggg

SEQ ID NO: 82374 - DNA, 22 bp, Homo sapiens
caggcagaagaagtggaaggac

SEQ ID NO: 82375 - DNA, 22 bp, Homo sapiens
tctcgctctgtcgcccaggctg

SEQ ID NO: 82376 - DNA, 22 bp, Homo sapiens
gagcccaggaagtggaggctga

SEQ ID NO: 82377 - DNA, 22 bp, Homo sapiens
tcattacaagatttccaatttg

SEQ ID NO: 82378 - DNA, 22 bp, Homo sapiens
cggcatccccacttcctcctgc

SEQ ID NO: 82379 - DNA, 22 bp, Homo sapiens
ccaggaggcggaaggtacagtg

SEQ ID NO: 82380 - DNA, 22 bp, Homo sapiens
tggtgccatcatagctcactgc

SEQ ID NO: 82381 - DNA, 22 bp, Homo sapiens
tggtcgaccagttggaaagtaa

SEQ ID NO: 82382 - DNA, 22 bp, Homo sapiens
gtagtcccagctaccccggagg

SEQ ID NO: 82383 - DNA, 22 bp, Homo sapiens
atgttcctattgcagaggatga

SEQ ID NO: 82384 - DNA, 22 bp, Homo sapiens
gctgcagggagctggaaggctc

SEQ ID NO: 82385 - DNA, 22 bp, Homo sapiens
gtggggtagatctttctcagga

SEQ ID NO: 82386 - DNA, 22 bp, Homo sapiens
gagctcattcattcattgcctg

SEQ ID NO: 82387 - DNA, 21 bp, Homo sapiens
gctcctggtgctgcgtggcgc

SEQ ID NO: 82388 - DNA, 22 bp, Homo sapiens
aaattagtcatgttgtattact

SEQ ID NO: 82389 - DNA, 22 bp, Homo sapiens
ggctttgacatgctgaattaaa

SEQ ID NO: 82390 - DNA, 22 bp, Homo sapiens
ggagaagaggagctggaagcct

SEQ ID NO: 82391 - DNA, 19 bp, Homo sapiens
actgcactccagcctgggt

SEQ ID NO: 82392 - DNA, 22 bp, Homo sapiens
tgacctattagatttccttgcc

SEQ ID NO: 82393 - DNA, 22 bp, Homo sapiens
tcactcaggctggagtgcagtg

SEQ ID NO: 82394 - DNA, 22 bp, Homo sapiens
cggggccctggggctgaaggtc

SEQ ID NO: 82395 - DNA, 22 bp, Homo sapiens
tgtgttgtgacattcttggatg

SEQ ID NO: 82396 - DNA, 21 bp, Homo sapiens
tctgccagctgaagaggtgga

SEQ ID NO: 82397 - DNA, 22 bp, Homo sapiens
tagtgccctcccctttgggata

SEQ ID NO: 82398 - DNA, 22 bp, Homo sapiens
tcttcccagaggaggtgccagc

SEQ ID NO: 82399 - DNA, 22 bp, Homo sapiens
ctgaggctggagtgcagtggtg

SEQ ID NO: 82400 - DNA, 22 bp, Homo sapiens
cggagtcttgctatgttgccca

SEQ ID NO: 82401 - DNA, 22 bp, Homo sapiens
tttgaagactactgggagtgaa

SEQ ID NO: 82402 - DNA, 23 bp, Homo sapiens
agagcaaggaaatgaggtgtgat

SEQ ID NO: 82403 - DNA, 17 bp, Homo sapiens
ggctgcagtccaggagg

SEQ ID NO: 82404 - DNA, 22 bp, Homo sapiens
tggtgctgccaggctcctgcca

SEQ ID NO: 82405 - DNA, 22 bp, Homo sapiens
atgggttcaagtgattctcctg

SEQ ID NO: 82406 - DNA, 23 bp, Homo sapiens
caggagatggctgctgtgtcagc

SEQ ID NO: 82407 - DNA, 22 bp, Homo sapiens
tgggccactgctgcggaaggcg

SEQ ID NO: 82408 - DNA, 22 bp, Homo sapiens
aataaacaaaggacaaggaggt

SEQ ID NO: 82409 - DNA, 19 bp, Homo sapiens
ccagagagctaggtacaga

SEQ ID NO: 82410 - DNA, 22 bp, Homo sapiens
cctgcctatgagacgttttgcc

SEQ ID NO: 82411 - DNA, 22 bp, Homo sapiens
agtgggccggacagcccaggcc

SEQ ID NO: 82412 - DNA, 22 bp, Homo sapiens
caaatactacgattcttgcagt

SEQ ID NO: 82413 - DNA, 22 bp, Homo sapiens
caggccagggttgagaagagaa

SEQ ID NO: 82414 - DNA, 22 bp, Homo sapiens
acttaccagagaggatccgccc

SEQ ID NO: 82415 - DNA, 22 bp, Homo sapiens
tccctagtcgcatctgtggaga

SEQ ID NO: 82416 - DNA, 22 bp, Homo sapiens
tcccccaggctggagtgcagtg

SEQ ID NO: 82417 - DNA, 23 bp, Homo sapiens
caccactttctccttctccttgg

SEQ ID NO: 82418 - DNA, 22 bp, Homo sapiens
cctgcctactgagttttatatt

SEQ ID NO: 82419 - DNA, 22 bp, Homo sapiens
gttgagtgggttaggatgctga

SEQ ID NO: 82420 - DNA, 22 bp, Homo sapiens
tcagtgcagggtgggagagaga

SEQ ID NO: 82421 - DNA, 22 bp, Homo sapiens
tccgccaggactgagggcccat

SEQ ID NO: 82422 - DNA, 22 bp, Homo sapiens
gagagtctagtgcacctagttt

SEQ ID NO: 82423 - DNA, 22 bp, Homo sapiens
gggccctgggattcagagcaag

SEQ ID NO: 82424 - DNA, 22 bp, Homo sapiens
ggtgccaggctgtagtcagggt

SEQ ID NO: 82425 - DNA, 22 bp, Homo sapiens
gcctggattccttgtttctcag

SEQ ID NO: 82426 - DNA, 22 bp, Homo sapiens
ctacaaaagtaattgtggtttt

SEQ ID NO: 82427 - DNA, 22 bp, Homo sapiens
ggaggcggaggctgcagtgagc

SEQ ID NO: 82428 - DNA, 22 bp, Homo sapiens
gtctccttgtggatctcaagga

SEQ ID NO: 82429 - DNA, 22 bp, Homo sapiens
attttctatgttgtaattgtta

SEQ ID NO: 82430 - DNA, 22 bp, Homo sapiens
ccaggagttggaggctgcagtg

SEQ ID NO: 82431 - DNA, 22 bp, Homo sapiens
gggcatggtggcaggcacctgt

SEQ ID NO: 82432 - DNA, 22 bp, Homo sapiens
gaaaattattgaaaatggctct

SEQ ID NO: 82433 - DNA, 22 bp, Homo sapiens
gaggcagaggttgcagtgagct

SEQ ID NO: 82434 - DNA, 22 bp, Homo sapiens
tctgcaacattcctctccccac

SEQ ID NO: 82435 - DNA, 19 bp, Homo sapiens
ccatggcaatgatctgatg

SEQ ID NO: 82436 - DNA, 22 bp, Homo sapiens
cccaggaggtcgaagctgcagt

SEQ ID NO: 82437 - DNA, 22 bp, Homo sapiens
ggtaccaccaattcagctgcca

SEQ ID NO: 82438 - DNA, 22 bp, Homo sapiens
ttccccttgataagcagggttg

SEQ ID NO: 82439 - DNA, 22 bp, Homo sapiens
tgatctggtcctactgtgggca

SEQ ID NO: 82440 - DNA, 22 bp, Homo sapiens
ggcttagcaactcctgaggctc

SEQ ID NO: 82441 - DNA, 22 bp, Homo sapiens
aataaaatggtcagttttctca

SEQ ID NO: 82442 - DNA, 22 bp, Homo sapiens
gcagcctcaaactccccagctc

SEQ ID NO: 82443 - DNA, 20 bp, Homo sapiens
tgcagcacgggccctttcca

SEQ ID NO: 82444 - DNA, 22 bp, Homo sapiens
aagactgagtggcttaagaaaa

SEQ ID NO: 82445 - DNA, 22 bp, Homo sapiens
ctcactgcaagctcagcctccc

SEQ ID NO: 82446 - DNA, 22 bp, Homo sapiens
agcattccacactgaagtctgc

SEQ ID NO: 82447 - DNA, 22 bp, Homo sapiens
cggagcctgcttgttgcagctg

SEQ ID NO: 82448 - DNA, 22 bp, Homo sapiens
ggctcaatgcaacttctgcctc

SEQ ID NO: 82449 - DNA, 22 bp, Homo sapiens
caggagctcaagaccaccctgg

SEQ ID NO: 82450 - DNA, 22 bp, Homo sapiens
gagtggggggtccgtctcagtg

SEQ ID NO: 82451 - DNA, 22 bp, Homo sapiens
gcagtggcatgatgtgggctca

SEQ ID NO: 82452 - DNA, 22 bp, Homo sapiens
cctgacaggcggaggctgcagt

SEQ ID NO: 82453 - DNA, 22 bp, Homo sapiens
ggcagggagtggagactcccta

SEQ ID NO: 82454 - DNA, 22 bp, Homo sapiens
gcccagagttcaaggctgcagt

SEQ ID NO: 82455 - DNA, 22 bp, Homo sapiens
ccaggaggcggaggttgcagcg

SEQ ID NO: 82456 - DNA, 20 bp, Homo sapiens
ttgttagaggaatgccatag

SEQ ID NO: 82457 - DNA, 15 bp, Homo sapiens
tggcccacccgttga

SEQ ID NO: 82458 - DNA, 22 bp, Homo sapiens
tgaaatgtgttctagtgttttg

SEQ ID NO: 82459 - DNA, 22 bp, Homo sapiens
tgtggcacatacacaggagggc

SEQ ID NO: 82460 - DNA, 20 bp, Homo sapiens
ttcatgggagcaaagaggcc

SEQ ID NO: 82461 - DNA, 22 bp, Homo sapiens
tgggcaggggccctgcttccgt

SEQ ID NO: 82462 - DNA, 22 bp, Homo sapiens
tcttcccccgtgctccagtgca

SEQ ID NO: 82463 - DNA, 22 bp, Homo sapiens
ttgtgaaacattcatggatttg

SEQ ID NO: 82464 - DNA, 19 bp, Homo sapiens
agccccttggtactgtcct

SEQ ID NO: 82465 - DNA, 22 bp, Homo sapiens
tgccacagacaggacagaacag

SEQ ID NO: 82466 - DNA, 22 bp, Homo sapiens
atacagggacatccagtttttc

SEQ ID NO: 82467 - DNA, 22 bp, Homo sapiens
cacagctgaagtagccatgtgg

SEQ ID NO: 82468 - DNA, 22 bp, Homo sapiens
gaggccactgtccctgccttcc

SEQ ID NO: 82469 - DNA, 22 bp, Homo sapiens
cctcgacctccccaggctcagg

SEQ ID NO: 82470 - DNA, 22 bp, Homo sapiens
gtagcccacctggggagggcga

SEQ ID NO: 82471 - DNA, 22 bp, Homo sapiens
cacccaggctggagtgcagtga

SEQ ID NO: 82472 - DNA, 22 bp, Homo sapiens
gagcctcagggttttgttgaca

SEQ ID NO: 82473 - DNA, 22 bp, Homo sapiens
cggccaagccggggccccgaag

SEQ ID NO: 82474 - DNA, 22 bp, Homo sapiens
gaggcaggaggattgcttgagc

SEQ ID NO: 82475 - DNA, 22 bp, Homo sapiens
ggaggtcccaggcctggcagca

SEQ ID NO: 82476 - DNA, 22 bp, Homo sapiens
cgccgcctgctgcagcagctgt

SEQ ID NO: 82477 - DNA, 22 bp, Homo sapiens
gaccaagatacagcatcataga

SEQ ID NO: 82478 - DNA, 20 bp, Homo sapiens
atgctttcttgtgtgctgct

SEQ ID NO: 82479 - DNA, 21 bp, Homo sapiens
gcccacagtgaggaggatccc

SEQ ID NO: 82480 - DNA, 22 bp, Homo sapiens
gccatgcttggtatgctgtgag

SEQ ID NO: 82481 - DNA, 22 bp, Homo sapiens
tggcacaggatctcagcggcca

SEQ ID NO: 82482 - DNA, 22 bp, Homo sapiens
ttgggctcaggagtttgagacc

SEQ ID NO: 82483 - DNA, 22 bp, Homo sapiens
tgttttaagggtcaactgtcac

SEQ ID NO: 82484 - DNA, 22 bp, Homo sapiens
cactgcaacctccgcctcctgg

SEQ ID NO: 82485 - DNA, 22 bp, Homo sapiens
ttggttttgaaatagcttattg

SEQ ID NO: 82486 - DNA, 22 bp, Homo sapiens
gggccccaagaacctcctcctg

SEQ ID NO: 82487 - DNA, 21 bp, Homo sapiens
acacaggcagtgtcccgaggt

SEQ ID NO: 82488 - DNA, 22 bp, Homo sapiens
tttggtaagtacccacctgggt

SEQ ID NO: 82489 - DNA, 22 bp, Homo sapiens
taagaaatttagttatagaatg

SEQ ID NO: 82490 - DNA, 22 bp, Homo sapiens
gggagaggttacccgagcaact

SEQ ID NO: 82491 - DNA, 21 bp, Homo sapiens
tggtaggtactggcttcaggc

SEQ ID NO: 82492 - DNA, 22 bp, Homo sapiens
ccatgaattcactccatgctag

SEQ ID NO: 82493 - DNA, 22 bp, Homo sapiens
tcatggcttttattatgttgag

SEQ ID NO: 82494 - DNA, 22 bp, Homo sapiens
gtggcatctcagaggccaagaa

SEQ ID NO: 82495 - DNA, 22 bp, Homo sapiens
accagcctggccaacatggcaa

SEQ ID NO: 82496 - DNA, 22 bp, Homo sapiens
ttttctcttccctctggacctg

SEQ ID NO: 82497 - DNA, 22 bp, Homo sapiens
gctcccaccgccgctatgggta

SEQ ID NO: 82498 - DNA, 22 bp, Homo sapiens
tggagaagattggtcaccattc

SEQ ID NO: 82499 - DNA, 22 bp, Homo sapiens
tgtgtgattgcaggagatgtgg

SEQ ID NO: 82500 - DNA, 22 bp, Homo sapiens
ttagtctctttgcattgccata

SEQ ID NO: 82501 - DNA, 22 bp, Homo sapiens
gagatggagtctttttctgtca

SEQ ID NO: 82502 - DNA, 22 bp, Homo sapiens
tgaagactcagaagctaagata

SEQ ID NO: 82503 - DNA, 23 bp, Homo sapiens
tcctcgcaggagggagatgatgc

SEQ ID NO: 82504 - DNA, 22 bp, Homo sapiens
tggcatctttgtcccagaagct

SEQ ID NO: 82505 - DNA, 22 bp, Homo sapiens
aggtggggaggagtgtctcttt

SEQ ID NO: 82506 - DNA, 22 bp, Homo sapiens
tggcactgaagctggaaagcct

SEQ ID NO: 82507 - DNA, 22 bp, Homo sapiens
ccaggtgtgctctgcagtggat

SEQ ID NO: 82508 - DNA, 22 bp, Homo sapiens
ctgagccaaggggacagtgaca

SEQ ID NO: 82509 - DNA, 22 bp, Homo sapiens
atgccactgcgctccagcctgg

SEQ ID NO: 82510 - DNA, 22 bp, Homo sapiens
aggattgtgcctccagtcagaa

SEQ ID NO: 82511 - DNA, 22 bp, Homo sapiens
aaggagtctgggccattcagag

SEQ ID NO: 82512 - DNA, 22 bp, Homo sapiens
actgcacttcagcctgggtgtc

SEQ ID NO: 82513 - DNA, 22 bp, Homo sapiens
attgggatgccggctgataaga

SEQ ID NO: 82514 - DNA, 22 bp, Homo sapiens
gcaggatgagtgagtacattta

SEQ ID NO: 82515 - DNA, 22 bp, Homo sapiens
tcactacaacctccgcctcctg

SEQ ID NO: 82516 - DNA, 22 bp, Homo sapiens
gcaggcaggcttccttgaactg

SEQ ID NO: 82517 - DNA, 22 bp, Homo sapiens
agccaggatggtctcgatcggc

SEQ ID NO: 82518 - DNA, 23 bp, Homo sapiens
agagtgcagagatatgcttgtgt

SEQ ID NO: 82519 - DNA, 22 bp, Homo sapiens
agtggagcttttcctatcagag

SEQ ID NO: 82520 - DNA, 22 bp, Homo sapiens
ggtggttcacgcctataatccc

SEQ ID NO: 82521 - DNA, 22 bp, Homo sapiens
cttgtcagccaattgtggattt

SEQ ID NO: 82522 - DNA, 22 bp, Homo sapiens
gaatatcccgctatgcaaagta

SEQ ID NO: 82523 - DNA, 22 bp, Homo sapiens
aggacagagggaccagagccca

SEQ ID NO: 82524 - DNA, 22 bp, Homo sapiens
tgaaggggttcagcatgggggt

SEQ ID NO: 82525 - DNA, 22 bp, Homo sapiens
tggtattacttctagacacaag

SEQ ID NO: 82526 - DNA, 23 bp, Homo sapiens
attttttgtctttgtaactagat

SEQ ID NO: 82527 - DNA, 22 bp, Homo sapiens
gcagctgacatctggctgggcc

SEQ ID NO: 82528 - DNA, 22 bp, Homo sapiens
cactgcaagctccgcctcctgg

SEQ ID NO: 82529 - DNA, 22 bp, Homo sapiens
gctgctaagcgtttctgttcca

SEQ ID NO: 82530 - DNA, 22 bp, Homo sapiens
cctagatgggatggcggccggg

SEQ ID NO: 82531 - DNA, 22 bp, Homo sapiens
cactgcaacctccacctcctgg

SEQ ID NO: 82532 - DNA, 22 bp, Homo sapiens
tgaggaaacttacaaggcagaa

SEQ ID NO: 82533 - DNA, 22 bp, Homo sapiens
tttgttttcaatgtgtcattca

SEQ ID NO: 82534 - DNA, 22 bp, Homo sapiens
taggccacagagaggagatttc

SEQ ID NO: 82535 - DNA, 22 bp, Homo sapiens
cctcccctcagacagagactgg

SEQ ID NO: 82536 - DNA, 22 bp, Homo sapiens
gttcaagaccagcctggccaac

SEQ ID NO: 82537 - DNA, 22 bp, Homo sapiens
cctggagagctcgggccaggca

SEQ ID NO: 82538 - DNA, 22 bp, Homo sapiens
aagagggaaattgttggctgct

SEQ ID NO: 82539 - DNA, 22 bp, Homo sapiens
ggcgctcagtgttgccccagag

SEQ ID NO: 82540 - DNA, 22 bp, Homo sapiens
ttgcagatatttccgatgctat

SEQ ID NO: 82541 - DNA, 21 bp, Homo sapiens
ttagaagctaatgcagctggt

SEQ ID NO: 82542 - DNA, 22 bp, Homo sapiens
acgcctgtaatcccagcacttt

SEQ ID NO: 82543 - DNA, 22 bp, Homo sapiens
aatgtcaaaggctatacattca

SEQ ID NO: 82544 - DNA, 22 bp, Homo sapiens
tttctggcagcgggacaggggt

SEQ ID NO: 82545 - DNA, 22 bp, Homo sapiens
caggaggagggcagccgcctcc

SEQ ID NO: 82546 - DNA, 22 bp, Homo sapiens
actggccagccaacaacaatag

SEQ ID NO: 82547 - DNA, 22 bp, Homo sapiens
atttagaactttgtttgccaat

SEQ ID NO: 82548 - DNA, 22 bp, Homo sapiens
acagtcaaatgtctatcttctt

SEQ ID NO: 82549 - DNA, 22 bp, Homo sapiens
tcacagcctggacagttgcctg

SEQ ID NO: 82550 - DNA, 22 bp, Homo sapiens
tactgcgccttcaccaagcggc

SEQ ID NO: 82551 - DNA, 22 bp, Homo sapiens
gaagcctcaacatctctgcgtc

SEQ ID NO: 82552 - DNA, 22 bp, Homo sapiens
gcctcctggggtgccatcatct

SEQ ID NO: 82553 - DNA, 21 bp, Homo sapiens
tggcggggacttgtggctgcc

SEQ ID NO: 82554 - DNA, 22 bp, Homo sapiens
ctcagggccaaggatgctgttg

SEQ ID NO: 82555 - DNA, 22 bp, Homo sapiens
ctcttcctagtgtgcagcgtgg

SEQ ID NO: 82556 - DNA, 22 bp, Homo sapiens
tgcctctgaggaagattgtgtt

SEQ ID NO: 82557 - DNA, 22 bp, Homo sapiens
ttagccaggggagcagcttgtc

SEQ ID NO: 82558 - DNA, 22 bp, Homo sapiens
gagagaagggggatatgagcct

SEQ ID NO: 82559 - DNA, 22 bp, Homo sapiens
tggtacacatgtccaaggtcag

SEQ ID NO: 82560 - DNA, 22 bp, Homo sapiens
gaccctctagatggaagcactg

SEQ ID NO: 82561 - DNA, 22 bp, Homo sapiens
ctagggtcaggggcctgcgtcg

SEQ ID NO: 82562 - DNA, 22 bp, Homo sapiens
gttgaggtgatgccagccctgc

SEQ ID NO: 82563 - DNA, 22 bp, Homo sapiens
cttccgtgtcagttccaggtgg

SEQ ID NO: 82564 - DNA, 20 bp, Homo sapiens
tcagccattccttacctttc

SEQ ID NO: 82565 - DNA, 22 bp, Homo sapiens
tcaaattgtcatcttgataatg

SEQ ID NO: 82566 - DNA, 22 bp, Homo sapiens
atggccgcctgtccttcccgcc

SEQ ID NO: 82567 - DNA, 22 bp, Homo sapiens
caaagggaaaagccatgtgggc

SEQ ID NO: 82568 - DNA, 22 bp, Homo sapiens
cagaccagaaggaagccgacaa

SEQ ID NO: 82569 - DNA, 22 bp, Homo sapiens
gggccctgcgactcgcggcgga

SEQ ID NO: 82570 - DNA, 22 bp, Homo sapiens
gaggtaggtgtaggaggcctgc

SEQ ID NO: 82571 - DNA, 19 bp, Homo sapiens
tcctgcctggggccgcctg

SEQ ID NO: 82572 - DNA, 23 bp, Homo sapiens
ggctgggagctccgggtgcacgt

SEQ ID NO: 82573 - DNA, 22 bp, Homo sapiens
cacagcctcctctggctcacgg

SEQ ID NO: 82574 - DNA, 22 bp, Homo sapiens
cccaggcttttctcttgcccca

SEQ ID NO: 82575 - DNA, 22 bp, Homo sapiens
cctgggaggctgaggctgcagt

SEQ ID NO: 82576 - DNA, 22 bp, Homo sapiens
agcataagttggtacagccact

SEQ ID NO: 82577 - DNA, 22 bp, Homo sapiens
tgggggtgtcctggtgcacaca

SEQ ID NO: 82578 - DNA, 23 bp, Homo sapiens
tcgttgaatagcaatagcacaac

SEQ ID NO: 82579 - DNA, 22 bp, Homo sapiens
agtccaggcattccagccattc

SEQ ID NO: 82580 - DNA, 22 bp, Homo sapiens
accatgtcatttattggccaaa

SEQ ID NO: 82581 - DNA, 22 bp, Homo sapiens
tctgccttgtttgagctttgac

SEQ ID NO: 82582 - DNA, 18 bp, Homo sapiens
cccggctaatttttggta

SEQ ID NO: 82583 - DNA, 22 bp, Homo sapiens
gagaaagcttctttcccacagg

SEQ ID NO: 82584 - DNA, 22 bp, Homo sapiens
ggagtgactctcggggccacta

SEQ ID NO: 82585 - DNA, 22 bp, Homo sapiens
acctggacacctgctgtcatct

SEQ ID NO: 82586 - DNA, 22 bp, Homo sapiens
cactgcactccagcttgggtga

SEQ ID NO: 82587 - DNA, 22 bp, Homo sapiens
tgcagtcttccagctgcacaaa

SEQ ID NO: 82588 - DNA, 22 bp, Homo sapiens
accctcaacaaattcactctat

SEQ ID NO: 82589 - DNA, 22 bp, Homo sapiens
ccaggctggagtgcaatggcat

SEQ ID NO: 82590 - DNA, 22 bp, Homo sapiens
cgggttcacgccattctcctgc

SEQ ID NO: 82591 - DNA, 20 bp, Homo sapiens
ttcgctgggagtggccaggc

SEQ ID NO: 82592 - DNA, 22 bp, Homo sapiens
aggtcaagggagctgagggcca

SEQ ID NO: 82593 - DNA, 22 bp, Homo sapiens
gctggaggatggactggaagaa

SEQ ID NO: 82594 - DNA, 22 bp, Homo sapiens
ggcaatagttgtgggttcttta

SEQ ID NO: 82595 - DNA, 22 bp, Homo sapiens
tcactgcgcttcagcctgggtg

SEQ ID NO: 82596 - DNA, 22 bp, Homo sapiens
aggctaggaacagcccggccct

SEQ ID NO: 82597 - DNA, 22 bp, Homo sapiens
cacccaggcaaggattctgcaa

SEQ ID NO: 82598 - DNA, 22 bp, Homo sapiens
ccctgcctacagggttttcttt

SEQ ID NO: 82599 - DNA, 22 bp, Homo sapiens
cttcttgctgggggcctcagtg

SEQ ID NO: 82600 - DNA, 22 bp, Homo sapiens
tggcacagcctccatgtcgtcc

SEQ ID NO: 82601 - DNA, 22 bp, Homo sapiens
tcatggggccacagctgccagc

SEQ ID NO: 82602 - DNA, 22 bp, Homo sapiens
tggaacgtcgtaatgttggtta

SEQ ID NO: 82603 - DNA, 22 bp, Homo sapiens
cgtgagcaaaatggacactccc

SEQ ID NO: 82604 - DNA, 22 bp, Homo sapiens
cagtgcacgggccagtcctgcc

SEQ ID NO: 82605 - DNA, 22 bp, Homo sapiens
ggccggggcctgctcgcctgtg

SEQ ID NO: 82606 - DNA, 22 bp, Homo sapiens
tgagcttccctcctgcactaca

SEQ ID NO: 82607 - DNA, 22 bp, Homo sapiens
tctgcaacagtgccctgtaaat

SEQ ID NO: 82608 - DNA, 22 bp, Homo sapiens
ttatttaaaagtggtaagattc

SEQ ID NO: 82609 - DNA, 22 bp, Homo sapiens
tagcccaggctggagtgcaggg

SEQ ID NO: 82610 - DNA, 22 bp, Homo sapiens
aagttactggcaagggctgcag

SEQ ID NO: 82611 - DNA, 22 bp, Homo sapiens
ggctgtggcagctggaagtggt

SEQ ID NO: 82612 - DNA, 22 bp, Homo sapiens
tttcataatactgtacatgaaa

SEQ ID NO: 82613 - DNA, 19 bp, Homo sapiens
ctgctgccggagactcgtc

SEQ ID NO: 82614 - DNA, 22 bp, Homo sapiens
ctctctgggcccagttggcacc

SEQ ID NO: 82615 - DNA, 22 bp, Homo sapiens
gatgcgggcccgctccactgcc

SEQ ID NO: 82616 - DNA, 19 bp, Homo sapiens
ggctgccttctgctcatct

SEQ ID NO: 82617 - DNA, 22 bp, Homo sapiens
agtgaatgtccccgcgggtcag

SEQ ID NO: 82618 - DNA, 22 bp, Homo sapiens
ttagggttacaccagcctcctg

SEQ ID NO: 82619 - DNA, 22 bp, Homo sapiens
cccaggatggggctgcagttat

SEQ ID NO: 82620 - DNA, 21 bp, Homo sapiens
atgtagggtttgccttctcta

SEQ ID NO: 82621 - DNA, 22 bp, Homo sapiens
tccagcagtccatgtgagacac

SEQ ID NO: 82622 - DNA, 22 bp, Homo sapiens
gctgagactgacatgaagaggt

SEQ ID NO: 82623 - DNA, 22 bp, Homo sapiens
ggcctgcctcacagtcagcacc

SEQ ID NO: 82624 - DNA, 22 bp, Homo sapiens
actgcactccagcctgggtgat

SEQ ID NO: 82625 - DNA, 22 bp, Homo sapiens
cagggtttcaccatgttagcag

SEQ ID NO: 82626 - DNA, 22 bp, Homo sapiens
tgggcagggagctggaaccaca

SEQ ID NO: 82627 - DNA, 22 bp, Homo sapiens
agcccaggctggagtgcagtgg

SEQ ID NO: 82628 - DNA, 22 bp, Homo sapiens
agaggccggccgagcccatggg

SEQ ID NO: 82629 - DNA, 22 bp, Homo sapiens
tagcagtgtctaggtaggccat

SEQ ID NO: 82630 - DNA, 22 bp, Homo sapiens
caggagatgacagggaagaacc

SEQ ID NO: 82631 - DNA, 22 bp, Homo sapiens
tggaaacacccacgcatgcata

SEQ ID NO: 82632 - DNA, 22 bp, Homo sapiens
ctattgtttctatgctctgagg

SEQ ID NO: 82633 - DNA, 22 bp, Homo sapiens
tccaggatggtgacggtggcca

SEQ ID NO: 82634 - DNA, 22 bp, Homo sapiens
gtgggggcaggcagtgctagga

SEQ ID NO: 82635 - DNA, 22 bp, Homo sapiens
tcccaagtagatgggaatacag

SEQ ID NO: 82636 - DNA, 22 bp, Homo sapiens
gaaggaccctctggggtctcag

SEQ ID NO: 82637 - DNA, 22 bp, Homo sapiens
ttttcctttgattcccagatgt

SEQ ID NO: 82638 - DNA, 22 bp, Homo sapiens
caggctggagtgcaatgacgcc

SEQ ID NO: 82639 - DNA, 22 bp, Homo sapiens
gatggaggagatggcagggtgc

SEQ ID NO: 82640 - DNA, 20 bp, Homo sapiens
ctgggtggcaagcaaggggg

SEQ ID NO: 82641 - DNA, 22 bp, Homo sapiens
tccagctgttccatcagctctt

SEQ ID NO: 82642 - DNA, 22 bp, Homo sapiens
ctcccagccttcgccagtctga

SEQ ID NO: 82643 - DNA, 22 bp, Homo sapiens
accactgcccatggtgaaaact

SEQ ID NO: 82644 - DNA, 22 bp, Homo sapiens
tcctgggccctccggatcaggt

SEQ ID NO: 82645 - DNA, 22 bp, Homo sapiens
aaggagcacacaatctagaacc

SEQ ID NO: 82646 - DNA, 22 bp, Homo sapiens
gcccagtggtaaaagcaggcct

SEQ ID NO: 82647 - DNA, 22 bp, Homo sapiens
aacccaggagttggaggctgtg

SEQ ID NO: 82648 - DNA, 22 bp, Homo sapiens
acccaggctggagtgcagtgat

SEQ ID NO: 82649 - DNA, 22 bp, Homo sapiens
tgagatgaataactcctgctaa

SEQ ID NO: 82650 - DNA, 22 bp, Homo sapiens
tggttacccagtcgctggagtt

SEQ ID NO: 82651 - DNA, 22 bp, Homo sapiens
atcggcaagccccacaccgtcc

SEQ ID NO: 82652 - DNA, 22 bp, Homo sapiens
ctgggctagaaggaccaggatg

SEQ ID NO: 82653 - DNA, 22 bp, Homo sapiens
tgaggcaggacttgcataaagt

SEQ ID NO: 82654 - DNA, 22 bp, Homo sapiens
tacatttataaggcttctctgt

SEQ ID NO: 82655 - DNA, 23 bp, Homo sapiens
gggggccgtcctggggattatag

SEQ ID NO: 82656 - DNA, 22 bp, Homo sapiens
actgcactccagcctcggggtc

SEQ ID NO: 82657 - DNA, 18 bp, Homo sapiens
ccatcaccctaactagtg

SEQ ID NO: 82658 - DNA, 22 bp, Homo sapiens
tgagccatgggactccaaggga

SEQ ID NO: 82659 - DNA, 22 bp, Homo sapiens
caggctggagtgcagtggcgcc

SEQ ID NO: 82660 - DNA, 22 bp, Homo sapiens
ccacagaattctgtctccagga

SEQ ID NO: 82661 - DNA, 22 bp, Homo sapiens
ccaaagtgctgagattacaggt

SEQ ID NO: 82662 - DNA, 22 bp, Homo sapiens
tctttgctccacactctagaga

SEQ ID NO: 82663 - DNA, 22 bp, Homo sapiens
ctggagcaaaagtgactcctct

SEQ ID NO: 82664 - DNA, 22 bp, Homo sapiens
aggcaggaaaatcgcttgaacc

SEQ ID NO: 82665 - DNA, 22 bp, Homo sapiens
agtgaggggcagctgagtgggc

SEQ ID NO: 82666 - DNA, 22 bp, Homo sapiens
aagcttcctgcatgggactgct

SEQ ID NO: 82667 - DNA, 22 bp, Homo sapiens
tcgaactcatagtcgtagctgt

SEQ ID NO: 82668 - DNA, 22 bp, Homo sapiens
aggccagcagcatgacggcatc

SEQ ID NO: 82669 - DNA, 22 bp, Homo sapiens
gaagctgagctgaggcatgttg

SEQ ID NO: 82670 - DNA, 22 bp, Homo sapiens
acatttttcacatttgtagggt

SEQ ID NO: 82671 - DNA, 22 bp, Homo sapiens
ccgggcctcgggacaccgggta

SEQ ID NO: 82672 - DNA, 22 bp, Homo sapiens
taggcatgcaaataaatgtgca

SEQ ID NO: 82673 - DNA, 22 bp, Homo sapiens
cttcactttaagccaatcatga

SEQ ID NO: 82674 - DNA, 22 bp, Homo sapiens
cagagcttcctgctgggcttct

SEQ ID NO: 82675 - DNA, 22 bp, Homo sapiens
gccagccagaaacgtcacactg

SEQ ID NO: 82676 - DNA, 22 bp, Homo sapiens
tctgtagtaggttgtagttctt

SEQ ID NO: 82677 - DNA, 21 bp, Homo sapiens
aggcatgagccctgcatggac

SEQ ID NO: 82678 - DNA, 22 bp, Homo sapiens
cagtggctggttagggacagga

SEQ ID NO: 82679 - DNA, 22 bp, Homo sapiens
gggggaagaaagaacatggcat

SEQ ID NO: 82680 - DNA, 22 bp, Homo sapiens
acagtatagggcttatattgta

SEQ ID NO: 82681 - DNA, 22 bp, Homo sapiens
ccagcttgaagatgtgctggtt

SEQ ID NO: 82682 - DNA, 22 bp, Homo sapiens
agggtcctgggtgcagttgctt

SEQ ID NO: 82683 - DNA, 22 bp, Homo sapiens
aatgtgaggccttggtagttat

SEQ ID NO: 82684 - DNA, 22 bp, Homo sapiens
aagaggttgtctgtgatgagtt

SEQ ID NO: 82685 - DNA, 22 bp, Homo sapiens
gacagctgcatcctcagacaca

SEQ ID NO: 82686 - DNA, 22 bp, Homo sapiens
ccgggagcaggcgccaccgcca

SEQ ID NO: 82687 - DNA, 22 bp, Homo sapiens
caggaagctgtgaaggagacgg

SEQ ID NO: 82688 - DNA, 22 bp, Homo sapiens
acccaggctggagtgcagtggc

SEQ ID NO: 82689 - DNA, 22 bp, Homo sapiens
cagaaaccaaatgggatgggga

SEQ ID NO: 82690 - DNA, 22 bp, Homo sapiens
tggtggctaccaggtcctgggg

SEQ ID NO: 82691 - DNA, 22 bp, Homo sapiens
acgcctctgcagctgccgggcc

SEQ ID NO: 82692 - DNA, 22 bp, Homo sapiens
tttaatcataagaaggaaaata

SEQ ID NO: 82693 - DNA, 22 bp, Homo sapiens
agggcagagctgtctaaatggc

SEQ ID NO: 82694 - DNA, 22 bp, Homo sapiens
ttaaatattatgttgtctgcaa

SEQ ID NO: 82695 - DNA, 22 bp, Homo sapiens
tccctgcaggtgtgcaagctga

SEQ ID NO: 82696 - DNA, 22 bp, Homo sapiens
tggggagtgatgcctcggataa

SEQ ID NO: 82697 - DNA, 22 bp, Homo sapiens
aagccctggcgggtggagggcc

SEQ ID NO: 82698 - DNA, 22 bp, Homo sapiens
tgagcctgagttcaaggctgca

SEQ ID NO: 82699 - DNA, 19 bp, Homo sapiens
ggagccgccgcccttcatt

SEQ ID NO: 82700 - DNA, 22 bp, Homo sapiens
gccgggttcaagccattctcct

SEQ ID NO: 82701 - DNA, 22 bp, Homo sapiens
aggaaataggaccagacaaagc

SEQ ID NO: 82702 - DNA, 22 bp, Homo sapiens
agatttggtgtctggttgatat

SEQ ID NO: 82703 - DNA, 21 bp, Homo sapiens
gtggttctagagaaacagaat

SEQ ID NO: 82704 - DNA, 22 bp, Homo sapiens
tttcaccatcttggccaggctg

SEQ ID NO: 82705 - DNA, 19 bp, Homo sapiens
tcctggggaggggcatggc

SEQ ID NO: 82706 - DNA, 22 bp, Homo sapiens
atggagttctgccagcgctgct

SEQ ID NO: 82707 - DNA, 22 bp, Homo sapiens
ttgtgtgtactggttatgggca

SEQ ID NO: 82708 - DNA, 22 bp, Homo sapiens
gagaggaagccttctgtacttg

SEQ ID NO: 82709 - DNA, 22 bp, Homo sapiens
cacagctgtgagaagggagcct

SEQ ID NO: 82710 - DNA, 22 bp, Homo sapiens
gtcctaccatgaattcactcca

SEQ ID NO: 82711 - DNA, 22 bp, Homo sapiens
gccatcatatcccctgtgacct

SEQ ID NO: 82712 - DNA, 22 bp, Homo sapiens
ggaaactagaagaatactagtc

SEQ ID NO: 82713 - DNA, 22 bp, Homo sapiens
tctagctctgcttatcatggct

SEQ ID NO: 82714 - DNA, 22 bp, Homo sapiens
tcaccttgtgatctccctgcct

SEQ ID NO: 82715 - DNA, 22 bp, Homo sapiens
gaggcagaagttgcagtgagca

SEQ ID NO: 82716 - DNA, 22 bp, Homo sapiens
ctgcactgacttccccggctgc

SEQ ID NO: 82717 - DNA, 22 bp, Homo sapiens
cagctgctgttcagttttgttt

SEQ ID NO: 82718 - DNA, 22 bp, Homo sapiens
cactgcactccagcctgggtga

SEQ ID NO: 82719 - DNA, 22 bp, Homo sapiens
gaggcaggcagattgcttgagg

SEQ ID NO: 82720 - DNA, 22 bp, Homo sapiens
ccctgctgtcaggtgctgggag

SEQ ID NO: 82721 - DNA, 22 bp, Homo sapiens
gaagccttgaactgcaaacccc

SEQ ID NO: 82722 - DNA, 22 bp, Homo sapiens
caggtgagaggcggtcctgcat

SEQ ID NO: 82723 - DNA, 22 bp, Homo sapiens
gtctatgatattttgttatagc

SEQ ID NO: 82724 - DNA, 22 bp, Homo sapiens
cgcccaggctggagtgcagtgg

SEQ ID NO: 82725 - DNA, 22 bp, Homo sapiens
cctcagacccctgctgagcttc

SEQ ID NO: 82726 - DNA, 22 bp, Homo sapiens
gagcagtaggagaaccctgagc

SEQ ID NO: 82727 - DNA, 22 bp, Homo sapiens
aggggatggagctggaaggcag

SEQ ID NO: 82728 - DNA, 22 bp, Homo sapiens
ccaaagtgctaggattacaggc

SEQ ID NO: 82729 - DNA, 22 bp, Homo sapiens
tggaaccctcctactccagggc

SEQ ID NO: 82730 - DNA, 22 bp, Homo sapiens
gagagtctaggaacctcatata

SEQ ID NO: 82731 - DNA, 22 bp, Homo sapiens
tgctggaggccagaagtctgag

SEQ ID NO: 82732 - DNA, 22 bp, Homo sapiens
gtggccccagggccctgtctgg

SEQ ID NO: 82733 - DNA, 22 bp, Homo sapiens
gggaagatagtgttgagggccc

SEQ ID NO: 82734 - DNA, 22 bp, Homo sapiens
gtggcttggaccagtcacagtg

SEQ ID NO: 82735 - DNA, 17 bp, Homo sapiens
tcggtttgccaggcttc

SEQ ID NO: 82736 - DNA, 22 bp, Homo sapiens
cttcatcagctggcttactgtt

SEQ ID NO: 82737 - DNA, 22 bp, Homo sapiens
acagttaataagtagtaagtca

SEQ ID NO: 82738 - DNA, 22 bp, Homo sapiens
aggcgggttcagggctgccatg

SEQ ID NO: 82739 - DNA, 22 bp, Homo sapiens
tcgaaataatttagaatataga

SEQ ID NO: 82740 - DNA, 22 bp, Homo sapiens
accatgttggccaagctggtct

SEQ ID NO: 82741 - DNA, 22 bp, Homo sapiens
tgctcgaggtccccaccggctc

SEQ ID NO: 82742 - DNA, 22 bp, Homo sapiens
catttacatttaaggttaatat

SEQ ID NO: 82743 - DNA, 16 bp, Homo sapiens
gaggagcccctctgcc

SEQ ID NO: 82744 - DNA, 22 bp, Homo sapiens
gctcagacctgtaatcttagca

SEQ ID NO: 82745 - DNA, 22 bp, Homo sapiens
tctcgacagcctggcacagtgg

SEQ ID NO: 82746 - DNA, 22 bp, Homo sapiens
gacccaggggcagggagaaagt

SEQ ID NO: 82747 - DNA, 22 bp, Homo sapiens
ctctcgccagcggggctgcgct

SEQ ID NO: 82748 - DNA, 22 bp, Homo sapiens
ttttctaacatctagtaatttg

SEQ ID NO: 82749 - DNA, 22 bp, Homo sapiens
tacatagctcctagtgatgcat

SEQ ID NO: 82750 - DNA, 22 bp, Homo sapiens
gcttccggagccaaaaggcccc

SEQ ID NO: 82751 - DNA, 22 bp, Homo sapiens
cttctgagatgttgttttacag

SEQ ID NO: 82752 - DNA, 22 bp, Homo sapiens
gcaggctgtctaaagttagagt

SEQ ID NO: 82753 - DNA, 22 bp, Homo sapiens
ccaaagtgctaggattacaggt

SEQ ID NO: 82754 - DNA, 22 bp, Homo sapiens
ctatgaccccagcatgaataag

SEQ ID NO: 82755 - DNA, 22 bp, Homo sapiens
tagatctgatacaattcatctg

SEQ ID NO: 82756 - DNA, 22 bp, Homo sapiens
aggccttaccatagctgtagca

SEQ ID NO: 82757 - DNA, 22 bp, Homo sapiens
cccaggccctggcagagcttgt

SEQ ID NO: 82758 - DNA, 22 bp, Homo sapiens
atgaaaacggaccagagctatt

SEQ ID NO: 82759 - DNA, 22 bp, Homo sapiens
tgcgttgcgctcctgcagcagg

SEQ ID NO: 82760 - DNA, 19 bp, Homo sapiens
taaaacgtgcatggcagca

SEQ ID NO: 82761 - DNA, 19 bp, Homo sapiens
gccatcccaagcattttgg

SEQ ID NO: 82762 - DNA, 22 bp, Homo sapiens
cagtgcagccaaggacaggcac

SEQ ID NO: 82763 - DNA, 22 bp, Homo sapiens
aacagctttgtatacagtaact

SEQ ID NO: 82764 - DNA, 22 bp, Homo sapiens
ggcagggcaggaaagtcaggaa

SEQ ID NO: 82765 - DNA, 21 bp, Homo sapiens
tctgatggtagatgagatgtg

SEQ ID NO: 82766 - DNA, 22 bp, Homo sapiens
ttgccttcctgcccagcttctg

SEQ ID NO: 82767 - DNA, 22 bp, Homo sapiens
tcctgccttgcctgggacatca

SEQ ID NO: 82768 - DNA, 22 bp, Homo sapiens
tgcctgcctaggaagctgtgaa

SEQ ID NO: 82769 - DNA, 22 bp, Homo sapiens
ccaggctagaaactgaggcaca

SEQ ID NO: 82770 - DNA, 22 bp, Homo sapiens
ggagctcctggcagtgacagag

SEQ ID NO: 82771 - DNA, 22 bp, Homo sapiens
agtgctatcgagttctaatgct

SEQ ID NO: 82772 - DNA, 22 bp, Homo sapiens
ggagtagctgcattccgagcac

SEQ ID NO: 82773 - DNA, 22 bp, Homo sapiens
aggctccctgaatcgcccgttc

SEQ ID NO: 82774 - DNA, 22 bp, Homo sapiens
gagctactgaaatattgatttt

SEQ ID NO: 82775 - DNA, 22 bp, Homo sapiens
ctggcaggagcattcacagagg

SEQ ID NO: 82776 - DNA, 22 bp, Homo sapiens
ggaggcggaggttgcagtgagc

SEQ ID NO: 82777 - DNA, 19 bp, Homo sapiens
agagtattgaatttgccct

SEQ ID NO: 82778 - DNA, 22 bp, Homo sapiens
atgtgggccgtgcgggtgtcct

SEQ ID NO: 82779 - DNA, 22 bp, Homo sapiens
cacctagggtttcgcctttctt

SEQ ID NO: 82780 - DNA, 22 bp, Homo sapiens
gggctgtgaggtgagaacttac

SEQ ID NO: 82781 - DNA, 16 bp, Homo sapiens
aggtggagaagttcac

SEQ ID NO: 82782 - DNA, 22 bp, Homo sapiens
aggggtgaaagagggccctcaa

SEQ ID NO: 82783 - DNA, 22 bp, Homo sapiens
cacccaggctggagagcagtgg

SEQ ID NO: 82784 - DNA, 22 bp, Homo sapiens
tgctccatctagagctctgcag

SEQ ID NO: 82785 - DNA, 22 bp, Homo sapiens
tgtgggagaaggaagcaagctg

SEQ ID NO: 82786 - DNA, 22 bp, Homo sapiens
ctgccttttaaagccagtgtta

SEQ ID NO: 82787 - DNA, 22 bp, Homo sapiens
gctcccaccttaaccttcacat

SEQ ID NO: 82788 - DNA, 22 bp, Homo sapiens
gagcaccgcctccacgatgccc

SEQ ID NO: 82789 - DNA, 19 bp, Homo sapiens
actgcactttagcctgggc

SEQ ID NO: 82790 - DNA, 22 bp, Homo sapiens
tctggtgtcagtattctttgaa

SEQ ID NO: 82791 - DNA, 22 bp, Homo sapiens
tctgggtccgggactgtggatg

SEQ ID NO: 82792 - DNA, 18 bp, Homo sapiens
tcttccaacactgacacc

SEQ ID NO: 82793 - DNA, 22 bp, Homo sapiens
caaagtgctgggattacaggct

SEQ ID NO: 82794 - DNA, 22 bp, Homo sapiens
catagcggtattccacgtggtt

SEQ ID NO: 82795 - DNA, 22 bp, Homo sapiens
tctcatggagtcaggagcagaa

SEQ ID NO: 82796 - DNA, 22 bp, Homo sapiens
tgttgcccaggttctctcctgc

SEQ ID NO: 82797 - DNA, 22 bp, Homo sapiens
gggttcttatagtatcagagct

SEQ ID NO: 82798 - DNA, 22 bp, Homo sapiens
gcgggccaccttggagagcgct

SEQ ID NO: 82799 - DNA, 22 bp, Homo sapiens
tccacaaggcagctcctccagg

SEQ ID NO: 82800 - DNA, 22 bp, Homo sapiens
aaggcaaggcttccagctcccc

SEQ ID NO: 82801 - DNA, 22 bp, Homo sapiens
tgaacgcaggtccacatggctc

SEQ ID NO: 82802 - DNA, 22 bp, Homo sapiens
ctccagattccgtttattcagg

SEQ ID NO: 82803 - DNA, 22 bp, Homo sapiens
tggcacttttcccagttttggt

SEQ ID NO: 82804 - DNA, 22 bp, Homo sapiens
tcccgcttcttccgaatcgcga

SEQ ID NO: 82805 - DNA, 22 bp, Homo sapiens
tcaggggcttgaggtgcatgtc

SEQ ID NO: 82806 - DNA, 22 bp, Homo sapiens
ctgggaggcggaggttgtagtg

SEQ ID NO: 82807 - DNA, 22 bp, Homo sapiens
tgcctaggctggaatgcagtgg

SEQ ID NO: 82808 - DNA, 22 bp, Homo sapiens
tggaaccatcaaagagatcctg

SEQ ID NO: 82809 - DNA, 22 bp, Homo sapiens
gaccactggggtgagggccatc

SEQ ID NO: 82810 - DNA, 22 bp, Homo sapiens
aaaaagtattggccatggttga

SEQ ID NO: 82811 - DNA, 16 bp, Homo sapiens
tgggtgggaggagcgg

SEQ ID NO: 82812 - DNA, 22 bp, Homo sapiens
gctcaagccttctgcccacctc

SEQ ID NO: 82813 - DNA, 22 bp, Homo sapiens
aggctgaggcaagaggatcact

SEQ ID NO: 82814 - DNA, 22 bp, Homo sapiens
aaggagaaatggtagatgtgca

SEQ ID NO: 82815 - DNA, 22 bp, Homo sapiens
tctaccctgcggtcttggggca

SEQ ID NO: 82816 - DNA, 22 bp, Homo sapiens
actgcaaagggaagccctttct

SEQ ID NO: 82817 - DNA, 22 bp, Homo sapiens
caaagtgctggaattacaggtg

SEQ ID NO: 82818 - DNA, 22 bp, Homo sapiens
gtggagggtgattgccggctgt

SEQ ID NO: 82819 - DNA, 21 bp, Homo sapiens
ccgccacctctaagctgggtc

SEQ ID NO: 82820 - DNA, 20 bp, Homo sapiens
tttcaccatcttggccaggc

SEQ ID NO: 82821 - DNA, 22 bp, Homo sapiens
agccctcttccagccagcacag

SEQ ID NO: 82822 - DNA, 23 bp, Homo sapiens
gcagaggagcaagctggacacca

SEQ ID NO: 82823 - DNA, 22 bp, Homo sapiens
gggaggttgaggctgcagtgag

SEQ ID NO: 82824 - DNA, 22 bp, Homo sapiens
gcccagcacctctctcagggtt

SEQ ID NO: 82825 - DNA, 22 bp, Homo sapiens
caggctggagtgcagtggtgcc

SEQ ID NO: 82826 - DNA, 22 bp, Homo sapiens
gcagtggggcaatcatagctca

SEQ ID NO: 82827 - DNA, 22 bp, Homo sapiens
ggggcaggagcccttcttcagc

SEQ ID NO: 82828 - DNA, 16 bp, Homo sapiens
gcaggcagatcacatg

SEQ ID NO: 82829 - DNA, 22 bp, Homo sapiens
gggcagagagctggaactcctt

SEQ ID NO: 82830 - DNA, 22 bp, Homo sapiens
cccatgcaccctctaagaagga

SEQ ID NO: 82831 - DNA, 22 bp, Homo sapiens
tcccacaggtggagcttgcagt

SEQ ID NO: 82832 - DNA, 22 bp, Homo sapiens
gttccggaagtgactgatccgc

SEQ ID NO: 82833 - DNA, 22 bp, Homo sapiens
ggggaaagccagccctgcttcc

SEQ ID NO: 82834 - DNA, 22 bp, Homo sapiens
tcctgaagaaggcagatatttg

SEQ ID NO: 82835 - DNA, 22 bp, Homo sapiens
tgccctctttctgtacagctcc

SEQ ID NO: 82836 - DNA, 22 bp, Homo sapiens
gggagctggagctggaagactc

SEQ ID NO: 82837 - DNA, 22 bp, Homo sapiens
gccaggcgggtctcaaactcct

SEQ ID NO: 82838 - DNA, 22 bp, Homo sapiens
gccccagcctcccgagtagctg

SEQ ID NO: 82839 - DNA, 22 bp, Homo sapiens
gggctgggattgcttgctgtga

SEQ ID NO: 82840 - DNA, 22 bp, Homo sapiens
cctcctgcacctccaggaactc

SEQ ID NO: 82841 - DNA, 22 bp, Homo sapiens
gagccccaccctagacattctg

SEQ ID NO: 82842 - DNA, 22 bp, Homo sapiens
ctgaggcctctcccactccagc

SEQ ID NO: 82843 - DNA, 22 bp, Homo sapiens
aggctatttccactcttctcat

SEQ ID NO: 82844 - DNA, 22 bp, Homo sapiens
gtccacagctctgaggtctccc

SEQ ID NO: 82845 - DNA, 22 bp, Homo sapiens
gcagatggatgtggacggcgcc

SEQ ID NO: 82846 - DNA, 22 bp, Homo sapiens
tcagacaactctggaggctggc

SEQ ID NO: 82847 - DNA, 22 bp, Homo sapiens
ggagcagggaattacagcgcag

SEQ ID NO: 82848 - DNA, 22 bp, Homo sapiens
ttgagggtctggatctgctgct

SEQ ID NO: 82849 - DNA, 22 bp, Homo sapiens
tcacccaggctggactgcagtg

SEQ ID NO: 82850 - DNA, 22 bp, Homo sapiens
gatataggttcatagtgttaca

SEQ ID NO: 82851 - DNA, 22 bp, Homo sapiens
gtagcagagggcccaggtaact

SEQ ID NO: 82852 - DNA, 22 bp, Homo sapiens
tcccgttgatgacggtgcatcc

SEQ ID NO: 82853 - DNA, 22 bp, Homo sapiens
aataaacaaatccttccttccc

SEQ ID NO: 82854 - DNA, 22 bp, Homo sapiens
cctgagtagctggaattaaagg

SEQ ID NO: 82855 - DNA, 22 bp, Homo sapiens
tcagtgttaatcagtggtacct

SEQ ID NO: 82856 - DNA, 22 bp, Homo sapiens
gcgagcctctggagtcctctgg

SEQ ID NO: 82857 - DNA, 22 bp, Homo sapiens
tcttaagcagagaagaagttga

SEQ ID NO: 82858 - DNA, 22 bp, Homo sapiens
agcctggcctgggcaggcacat

SEQ ID NO: 82859 - DNA, 22 bp, Homo sapiens
cactgcactccagcctgggaga

SEQ ID NO: 82860 - DNA, 22 bp, Homo sapiens
catccaggctgaagtgcagtgg

SEQ ID NO: 82861 - DNA, 22 bp, Homo sapiens
ggatgttgattgaatggccatt

SEQ ID NO: 82862 - DNA, 22 bp, Homo sapiens
cccaggaggttgaggctgcagt

SEQ ID NO: 82863 - DNA, 22 bp, Homo sapiens
aggagatggagctcagtgggca

SEQ ID NO: 82864 - DNA, 22 bp, Homo sapiens
actttatttcctattgcatcca

SEQ ID NO: 82865 - DNA, 22 bp, Homo sapiens
tcctggcttgtcacatctacgt

SEQ ID NO: 82866 - DNA, 22 bp, Homo sapiens
ctggcaggttatagagctgccc

SEQ ID NO: 82867 - DNA, 22 bp, Homo sapiens
aaaagcaattgcgggttttgcc

SEQ ID NO: 82868 - DNA, 22 bp, Homo sapiens
ggtgacctcacctggtcccacc

SEQ ID NO: 82869 - DNA, 22 bp, Homo sapiens
agaggaagtaatcaggacctgc

SEQ ID NO: 82870 - DNA, 22 bp, Homo sapiens
catgatctggtcctactgtggg

SEQ ID NO: 82871 - DNA, 22 bp, Homo sapiens
tggattcacaccattctcctgc

SEQ ID NO: 82872 - DNA, 22 bp, Homo sapiens
aacagcgacgtcctccccaaca

SEQ ID NO: 82873 - DNA, 19 bp, Homo sapiens
ctctgggcaagtcacttaa

SEQ ID NO: 82874 - DNA, 22 bp, Homo sapiens
gcagaggacacaggagggcaag

SEQ ID NO: 82875 - DNA, 22 bp, Homo sapiens
agaaggggcccaaggatgtcag

SEQ ID NO: 82876 - DNA, 22 bp, Homo sapiens
aatgccttggagagcctagagg

SEQ ID NO: 82877 - DNA, 22 bp, Homo sapiens
tctgttgcaatgtgcatggtga

SEQ ID NO: 82878 - DNA, 22 bp, Homo sapiens
ccaggctggagtgcaatggcgt

SEQ ID NO: 82879 - DNA, 22 bp, Homo sapiens
cggggaagcggttctggcggta

SEQ ID NO: 82880 - DNA, 22 bp, Homo sapiens
taggtttcagaggtgccgggaa

SEQ ID NO: 82881 - DNA, 21 bp, Homo sapiens
ctggccactgcacctcttcct

SEQ ID NO: 82882 - DNA, 22 bp, Homo sapiens
ttctcttttcaccagttgctaa

SEQ ID NO: 82883 - DNA, 22 bp, Homo sapiens
agagcccctgggtcacacagcc

SEQ ID NO: 82884 - DNA, 22 bp, Homo sapiens
tggtggctcacgtctgtaatct

SEQ ID NO: 82885 - DNA, 22 bp, Homo sapiens
tgccgcagtgcggggagggccc

SEQ ID NO: 82886 - DNA, 22 bp, Homo sapiens
ggcagacctctccagccccaca

SEQ ID NO: 82887 - DNA, 22 bp, Homo sapiens
tcgccccgaggcagccctatgc

SEQ ID NO: 82888 - DNA, 22 bp, Homo sapiens
cactctgcagctgaagggctgg

SEQ ID NO: 82889 - DNA, 22 bp, Homo sapiens
agtgcaggccccaggccaggcc

SEQ ID NO: 82890 - DNA, 22 bp, Homo sapiens
ccttctagcaaatcaacataaa

SEQ ID NO: 82891 - DNA, 22 bp, Homo sapiens
tcaggaggcggaggttgcagtg

SEQ ID NO: 82892 - DNA, 22 bp, Homo sapiens
aggaaaacagaccaaggagctc

SEQ ID NO: 82893 - DNA, 22 bp, Homo sapiens
gggcgcatcacctgaggtcagg

SEQ ID NO: 82894 - DNA, 22 bp, Homo sapiens
tgcctcagctgaggccgctcca

SEQ ID NO: 82895 - DNA, 22 bp, Homo sapiens
tggtacaatcacagctcactgt

SEQ ID NO: 82896 - DNA, 22 bp, Homo sapiens
caggctggagtgcagtggcgct

SEQ ID NO: 82897 - DNA, 22 bp, Homo sapiens
actgcactcctgcctgggtaac

SEQ ID NO: 82898 - DNA, 22 bp, Homo sapiens
ggctgggcaggtctgcacaggg

SEQ ID NO: 82899 - DNA, 22 bp, Homo sapiens
gcccagtagttcaaggttgcag

SEQ ID NO: 82900 - DNA, 22 bp, Homo sapiens
acaattctgatggtttcccagt

SEQ ID NO: 82901 - DNA, 22 bp, Homo sapiens
cgcccaggctggagtgcagtga

SEQ ID NO: 82902 - DNA, 22 bp, Homo sapiens
gagagagctctgtgcctgggat

SEQ ID NO: 82903 - DNA, 22 bp, Homo sapiens
agggactatttacccatctcac

SEQ ID NO: 82904 - DNA, 22 bp, Homo sapiens
caagggaattgtgtgtgagagg

SEQ ID NO: 82905 - DNA, 22 bp, Homo sapiens
ctccagttggccccagttggtt

SEQ ID NO: 82906 - DNA, 22 bp, Homo sapiens
ggcggtctcagcaccctcttgg

SEQ ID NO: 82907 - DNA, 22 bp, Homo sapiens
tgaggcaggaggttgagaactg

SEQ ID NO: 82908 - DNA, 22 bp, Homo sapiens
gaatttaagaggatgaatctgt

SEQ ID NO: 82909 - DNA, 22 bp, Homo sapiens
aaagaaatagatggcatttaaa

SEQ ID NO: 82910 - DNA, 22 bp, Homo sapiens
gtcaggactctgacccgtcccg

SEQ ID NO: 82911 - DNA, 22 bp, Homo sapiens
tgaggcaggaggattgcaggat

SEQ ID NO: 82912 - DNA, 22 bp, Homo sapiens
tccgaggccaaagctgtgaata

SEQ ID NO: 82913 - DNA, 22 bp, Homo sapiens
aagataagagggaggtgcctca

SEQ ID NO: 82914 - DNA, 22 bp, Homo sapiens
ctggacacactggagtctggca

SEQ ID NO: 82915 - DNA, 22 bp, Homo sapiens
cactgcactccatcctgggaaa

SEQ ID NO: 82916 - DNA, 22 bp, Homo sapiens
cccaggaggcagaagttgcagt

SEQ ID NO: 82917 - DNA, 22 bp, Homo sapiens
tggcacagactgggccaaggaa

SEQ ID NO: 82918 - DNA, 22 bp, Homo sapiens
cactgcaagctccgcctcccgg

SEQ ID NO: 82919 - DNA, 22 bp, Homo sapiens
ttcctagggcagagccgctggg

SEQ ID NO: 82920 - DNA, 22 bp, Homo sapiens
ctgggaggcggaggttgcagtg

SEQ ID NO: 82921 - DNA, 22 bp, Homo sapiens
caggctgatcagggctgggatg

SEQ ID NO: 82922 - DNA, 22 bp, Homo sapiens
agagtccctcttcccaggaggc

SEQ ID NO: 82923 - DNA, 22 bp, Homo sapiens
caaagtgctaggattacaggcg

SEQ ID NO: 82924 - DNA, 22 bp, Homo sapiens
acaggcacctgccaccacatct

SEQ ID NO: 82925 - DNA, 22 bp, Homo sapiens
cctacagttatattcttgattg

SEQ ID NO: 82926 - DNA, 22 bp, Homo sapiens
tgggaagggtcaacagctggaa

SEQ ID NO: 82927 - DNA, 22 bp, Homo sapiens
tatgcacaacatgcaggtttgt

SEQ ID NO: 82928 - DNA, 21 bp, Homo sapiens
tagcccttctccacctcgccc

SEQ ID NO: 82929 - DNA, 22 bp, Homo sapiens
ccaggctggagtatagtggcgc

SEQ ID NO: 82930 - DNA, 22 bp, Homo sapiens
ccaccgccatggcgttgtacag

SEQ ID NO: 82931 - DNA, 22 bp, Homo sapiens
agatggggtttcatcatgttgg

SEQ ID NO: 82932 - DNA, 22 bp, Homo sapiens
tggaaaactttggtggtgaggg

SEQ ID NO: 82933 - DNA, 22 bp, Homo sapiens
aactctatttaccctactaaac

SEQ ID NO: 82934 - DNA, 21 bp, Homo sapiens
ctggaggcaggtggtgccagg

SEQ ID NO: 82935 - DNA, 22 bp, Homo sapiens
ctgggggcagcaagaagccatg

SEQ ID NO: 82936 - DNA, 20 bp, Homo sapiens
caagggtttgcattggcttt

SEQ ID NO: 82937 - DNA, 22 bp, Homo sapiens
tgtccaggctggagtgcagtgg

SEQ ID NO: 82938 - DNA, 22 bp, Homo sapiens
gcaagacctatctagttgctgt

SEQ ID NO: 82939 - DNA, 22 bp, Homo sapiens
attgcacatctgcactacagcc

SEQ ID NO: 82940 - DNA, 22 bp, Homo sapiens
gttatataagacaaatcagagt

SEQ ID NO: 82941 - DNA, 23 bp, Homo sapiens
tctctgcatgtcctgagcacatc

SEQ ID NO: 82942 - DNA, 22 bp, Homo sapiens
gccaggctgaggctctggaaga

SEQ ID NO: 82943 - DNA, 22 bp, Homo sapiens
cctgtggcgggggccagtgcct

SEQ ID NO: 82944 - DNA, 22 bp, Homo sapiens
aagaagcaggtcacagacaggg

SEQ ID NO: 82945 - DNA, 22 bp, Homo sapiens
actgcaacacctcctgggttca

SEQ ID NO: 82946 - DNA, 22 bp, Homo sapiens
gcagagctcatgcctgcacctc

SEQ ID NO: 82947 - DNA, 22 bp, Homo sapiens
ctggctgggagcgagctgctca

SEQ ID NO: 82948 - DNA, 22 bp, Homo sapiens
gatagtcacctcccttaacttt

SEQ ID NO: 82949 - DNA, 22 bp, Homo sapiens
gcaggtctgttgattacagtca

SEQ ID NO: 82950 - DNA, 22 bp, Homo sapiens
cacagagctggaaaggctgggc

SEQ ID NO: 82951 - DNA, 22 bp, Homo sapiens
ccccagtggaggtgagggtcct

SEQ ID NO: 82952 - DNA, 22 bp, Homo sapiens
gaggccaaggtgggcagatcac

SEQ ID NO: 82953 - DNA, 21 bp, Homo sapiens
gggcctggctgcgcaggacgg

SEQ ID NO: 82954 - DNA, 22 bp, Homo sapiens
tgcctccctggcaagtctctcc

SEQ ID NO: 82955 - DNA, 22 bp, Homo sapiens
tcaggtagttgacagaacttag

SEQ ID NO: 82956 - DNA, 22 bp, Homo sapiens
gcctccccaagcagcagggatt

SEQ ID NO: 82957 - DNA, 19 bp, Homo sapiens
catggtgaaaccccgtctc

SEQ ID NO: 82958 - DNA, 22 bp, Homo sapiens
agggctggagccacagctggga

SEQ ID NO: 82959 - DNA, 22 bp, Homo sapiens
gcaggtctatcaggctgcaggt

SEQ ID NO: 82960 - DNA, 22 bp, Homo sapiens
ccacctgagataagagagctca

SEQ ID NO: 82961 - DNA, 22 bp, Homo sapiens
gggcccctgggaattctgtgat

SEQ ID NO: 82962 - DNA, 22 bp, Homo sapiens
tctcaagcttgttggtatgttt

SEQ ID NO: 82963 - DNA, 22 bp, Homo sapiens
agggaagaggaccagagtctct

SEQ ID NO: 82964 - DNA, 21 bp, Homo sapiens
aggcttggatctagacaggcc

SEQ ID NO: 82965 - DNA, 22 bp, Homo sapiens
ctccccattatgcagtcattat

SEQ ID NO: 82966 - DNA, 22 bp, Homo sapiens
catgttggtgtgctgcacccgt

SEQ ID NO: 82967 - DNA, 22 bp, Homo sapiens
gccctgggcaaggttctggcca

SEQ ID NO: 82968 - DNA, 22 bp, Homo sapiens
ggaggggatttagtagatgcta

SEQ ID NO: 82969 - DNA, 22 bp, Homo sapiens
tgaccaatactgtggatgccag

SEQ ID NO: 82970 - DNA, 23 bp, Homo sapiens
ctggggctttcaaatctgggcag

SEQ ID NO: 82971 - DNA, 22 bp, Homo sapiens
caggaggacatactggctcaca

SEQ ID NO: 82972 - DNA, 22 bp, Homo sapiens
cccaggctggagtgcagtggcg

SEQ ID NO: 82973 - DNA, 23 bp, Homo sapiens
gctcatcaggcttagagtcaagg

SEQ ID NO: 82974 - DNA, 22 bp, Homo sapiens
tgaactcctgacctcatgatcc

SEQ ID NO: 82975 - DNA, 22 bp, Homo sapiens
attataggcttgagccaccgtg

SEQ ID NO: 82976 - DNA, 22 bp, Homo sapiens
gctccccaaaagctccaggaaa

SEQ ID NO: 82977 - DNA, 22 bp, Homo sapiens
cagcttggaggaggatctaaga

SEQ ID NO: 82978 - DNA, 22 bp, Homo sapiens
agttcaacaccagcctgaccaa

SEQ ID NO: 82979 - DNA, 22 bp, Homo sapiens
agctggagatgagtgacgtgcc

SEQ ID NO: 82980 - DNA, 22 bp, Homo sapiens
tggctgtgtccctgtccagagt

SEQ ID NO: 82981 - DNA, 22 bp, Homo sapiens
gggatctgggacaacaggtggt

SEQ ID NO: 82982 - DNA, 22 bp, Homo sapiens
atgagctagaaaaccatgtgga

SEQ ID NO: 82983 - DNA, 22 bp, Homo sapiens
agtcccaacagcttacaaggaa

SEQ ID NO: 82984 - DNA, 21 bp, Homo sapiens
cagaggcctatcacagactcc

SEQ ID NO: 82985 - DNA, 23 bp, Homo sapiens
ggagtgcaatggcgccatctcgg

SEQ ID NO: 82986 - DNA, 22 bp, Homo sapiens
cagcctggtccccggctcaccc

SEQ ID NO: 82987 - DNA, 22 bp, Homo sapiens
ttggagtgacagatgaggaaac

SEQ ID NO: 82988 - DNA, 22 bp, Homo sapiens
gctgggctgcgtcggggaagcc

SEQ ID NO: 82989 - DNA, 22 bp, Homo sapiens
aaccaccattctctcctcttcc

SEQ ID NO: 82990 - DNA, 22 bp, Homo sapiens
ctggcctaaaaatacagaacaa

SEQ ID NO: 82991 - DNA, 22 bp, Homo sapiens
ctggaaggcagaggttgcagtg

SEQ ID NO: 82992 - DNA, 22 bp, Homo sapiens
cactgctacctctgcctcccgg

SEQ ID NO: 82993 - DNA, 21 bp, Homo sapiens
gggcagaggggcctcctgggt

SEQ ID NO: 82994 - DNA, 22 bp, Homo sapiens
gtgaggtggtacaatattaact

SEQ ID NO: 82995 - DNA, 22 bp, Homo sapiens
gcccaggctggagtgcagtggc

SEQ ID NO: 82996 - DNA, 22 bp, Homo sapiens
cttctggcgttggaggtctgag

SEQ ID NO: 82997 - DNA, 22 bp, Homo sapiens
tcccaggccacacttggggaac

SEQ ID NO: 82998 - DNA, 22 bp, Homo sapiens
actttaaaactgatcatcagag

SEQ ID NO: 82999 - DNA, 22 bp, Homo sapiens
actgttgaagtgccagcttgat

SEQ ID NO: 83000 - DNA, 22 bp, Homo sapiens
agtccctctgggagcaggactg

SEQ ID NO: 83001 - DNA, 22 bp, Homo sapiens
attgtggtgtcagttataggca

SEQ ID NO: 83002 - DNA, 22 bp, Homo sapiens
tgcctgttgcccacctgataaa

SEQ ID NO: 83003 - DNA, 22 bp, Homo sapiens
aactcctctctggtggttcgtc

SEQ ID NO: 83004 - DNA, 23 bp, Homo sapiens
cctgcctccccatcagttataca

SEQ ID NO: 83005 - DNA, 22 bp, Homo sapiens
cccaggagttggaggctgcagt

SEQ ID NO: 83006 - DNA, 22 bp, Homo sapiens
ctgcgtgagcgtgcccgtcttg

SEQ ID NO: 83007 - DNA, 22 bp, Homo sapiens
atgccccagtgtgtgcttcctt

SEQ ID NO: 83008 - DNA, 22 bp, Homo sapiens
ctgggaggtggaggttgcattg

SEQ ID NO: 83009 - DNA, 22 bp, Homo sapiens
ccctcccaggagtggccagaga

SEQ ID NO: 83010 - DNA, 22 bp, Homo sapiens
ggctgccttccctgagccccgg

SEQ ID NO: 83011 - DNA, 22 bp, Homo sapiens
agaatacttgggaatgggttaa

SEQ ID NO: 83012 - DNA, 22 bp, Homo sapiens
ccaggtaggagagtcaacatgt

SEQ ID NO: 83013 - DNA, 22 bp, Homo sapiens
agaaaatgtgaacttgtgaatt

SEQ ID NO: 83014 - DNA, 22 bp, Homo sapiens
aggagctgtcagagtgccagag

SEQ ID NO: 83015 - DNA, 22 bp, Homo sapiens
ctgccaggattctgtgaacccc

SEQ ID NO: 83016 - DNA, 22 bp, Homo sapiens
taaaatttgtccctgagtgttg

SEQ ID NO: 83017 - DNA, 22 bp, Homo sapiens
ttccatttggcacttcactgag

SEQ ID NO: 83018 - DNA, 22 bp, Homo sapiens
cgcccaggctggagagcagtgg

SEQ ID NO: 83019 - DNA, 21 bp, Homo sapiens
cctcaagtgcctcctgctgct

SEQ ID NO: 83020 - DNA, 22 bp, Homo sapiens
cggcatgggcgtccccctcact

SEQ ID NO: 83021 - DNA, 22 bp, Homo sapiens
ccggctactcgggaggctgacg

SEQ ID NO: 83022 - DNA, 22 bp, Homo sapiens
tgcttctgactaagctgcatga

SEQ ID NO: 83023 - DNA, 22 bp, Homo sapiens
tccaggctttggggcaggagcg

SEQ ID NO: 83024 - DNA, 22 bp, Homo sapiens
ttctgggcacacaggccctggt

SEQ ID NO: 83025 - DNA, 22 bp, Homo sapiens
cgtctggcttctccacggtaaa

SEQ ID NO: 83026 - DNA, 22 bp, Homo sapiens
tcgtgatctgtccacctcggcc

SEQ ID NO: 83027 - DNA, 22 bp, Homo sapiens
tggtggggccagacttcagctc

SEQ ID NO: 83028 - DNA, 22 bp, Homo sapiens
gtgcgcaccctcccggcatccc

SEQ ID NO: 83029 - DNA, 22 bp, Homo sapiens
gcttctgagttcttgcttaata

SEQ ID NO: 83030 - DNA, 22 bp, Homo sapiens
gagcctcgtggcggccactgcg

SEQ ID NO: 83031 - DNA, 22 bp, Homo sapiens
tgggaaggggagctggaaagga

SEQ ID NO: 83032 - DNA, 16 bp, Homo sapiens
ccacctgcagctctca

SEQ ID NO: 83033 - DNA, 22 bp, Homo sapiens
tcactgcaagctccacctcccg

SEQ ID NO: 83034 - DNA, 22 bp, Homo sapiens
tataccatgtgtgcacactccc

SEQ ID NO: 83035 - DNA, 22 bp, Homo sapiens
tctgcatattgttaatggaatg

SEQ ID NO: 83036 - DNA, 22 bp, Homo sapiens
ggaggcggaagttgcagtgagc

SEQ ID NO: 83037 - DNA, 23 bp, Homo sapiens
tgaggcaggcggatcacgaggtc

SEQ ID NO: 83038 - DNA, 22 bp, Homo sapiens
cagcaggaggtgagtagcaggt

SEQ ID NO: 83039 - DNA, 22 bp, Homo sapiens
attttttgttaactcaggatag

SEQ ID NO: 83040 - DNA, 22 bp, Homo sapiens
ggtgagcagctgtctgtatgga

SEQ ID NO: 83041 - DNA, 22 bp, Homo sapiens
gtgggccagcttttctcctggg

SEQ ID NO: 83042 - DNA, 22 bp, Homo sapiens
atgtcttctctgtaggtaaatt

SEQ ID NO: 83043 - DNA, 22 bp, Homo sapiens
gggaaagaccttcctggggtgt

SEQ ID NO: 83044 - DNA, 22 bp, Homo sapiens
aacagcttgctgcaccttaata

SEQ ID NO: 83045 - DNA, 22 bp, Homo sapiens
ctgtgatttctaaagagtagca

SEQ ID NO: 83046 - DNA, 22 bp, Homo sapiens
aggagcaccattgtgctggtgt

SEQ ID NO: 83047 - DNA, 22 bp, Homo sapiens
aggaaaatggaccagagttgtt

SEQ ID NO: 83048 - DNA, 22 bp, Homo sapiens
cccattcatcctcgcttccttc

SEQ ID NO: 83049 - DNA, 22 bp, Homo sapiens
cccctcttggcattgagtgcca

SEQ ID NO: 83050 - DNA, 20 bp, Homo sapiens
aactcctagcctcaagtgat

SEQ ID NO: 83051 - DNA, 22 bp, Homo sapiens
gcttcaggctgaattcctccta

SEQ ID NO: 83052 - DNA, 22 bp, Homo sapiens
gagatgggcgagaaggtggact

SEQ ID NO: 83053 - DNA, 22 bp, Homo sapiens
ggccttggcctagccctccagg

SEQ ID NO: 83054 - DNA, 22 bp, Homo sapiens
ttgtctctggaaggaaaaagca

SEQ ID NO: 83055 - DNA, 22 bp, Homo sapiens
aaagcctcccaggttatgagta

SEQ ID NO: 83056 - DNA, 22 bp, Homo sapiens
cccagctcttcaagtcaccccc

SEQ ID NO: 83057 - DNA, 23 bp, Homo sapiens
tgagctgggcctgcaggggtctc

SEQ ID NO: 83058 - DNA, 20 bp, Homo sapiens
gggcagtggcgctatctcag

SEQ ID NO: 83059 - DNA, 22 bp, Homo sapiens
cactgcactccagcctgggtca

SEQ ID NO: 83060 - DNA, 22 bp, Homo sapiens
ccatcacagtccccatcgtgat

SEQ ID NO: 83061 - DNA, 22 bp, Homo sapiens
ctgggaggcagaggttgcagtg

SEQ ID NO: 83062 - DNA, 23 bp, Homo sapiens
gtgccgacgctccagcaccatcc

SEQ ID NO: 83063 - DNA, 22 bp, Homo sapiens
ggcctttgcgtccacgccgctt

SEQ ID NO: 83064 - DNA, 22 bp, Homo sapiens
cagagagaatcttggcagctga

SEQ ID NO: 83065 - DNA, 22 bp, Homo sapiens
acccgggaggcaggagtcatag

SEQ ID NO: 83066 - DNA, 18 bp, Homo sapiens
ccctcttgcacaaagcaa

SEQ ID NO: 83067 - DNA, 22 bp, Homo sapiens
ggcctcgcggcttctggtggct

SEQ ID NO: 83068 - DNA, 22 bp, Homo sapiens
tcttgggcaatttctctagagg

SEQ ID NO: 83069 - DNA, 22 bp, Homo sapiens
atgcacacgtaccctacaaggc

SEQ ID NO: 83070 - DNA, 22 bp, Homo sapiens
tgttcagaacaaaggtaaatga

SEQ ID NO: 83071 - DNA, 22 bp, Homo sapiens
gtggtgtaggtcacagttagga

SEQ ID NO: 83072 - DNA, 22 bp, Homo sapiens
aaaactacatttgacattttgt

SEQ ID NO: 83073 - DNA, 22 bp, Homo sapiens
tcttggattttaatggatcaaa

SEQ ID NO: 83074 - DNA, 22 bp, Homo sapiens
ggacaagcctgtgagtgggttt

SEQ ID NO: 83075 - DNA, 22 bp, Homo sapiens
tcctcagaatcacctggcagct

SEQ ID NO: 83076 - DNA, 22 bp, Homo sapiens
gaggggagcccccatcctccag

SEQ ID NO: 83077 - DNA, 22 bp, Homo sapiens
gggagccccacctcggtgcccg

SEQ ID NO: 83078 - DNA, 18 bp, Homo sapiens
gcactgaggaaaacctct

SEQ ID NO: 83079 - DNA, 22 bp, Homo sapiens
atattgttagtaatatttcgaa

SEQ ID NO: 83080 - DNA, 22 bp, Homo sapiens
ggaggcagaatagagtgtgggt

SEQ ID NO: 83081 - DNA, 22 bp, Homo sapiens
ggctccctgcaacctccgcctc

SEQ ID NO: 83082 - DNA, 22 bp, Homo sapiens
accccaggaagtggaggtcatg

SEQ ID NO: 83083 - DNA, 22 bp, Homo sapiens
ccctcccagatgggcttgaggt

SEQ ID NO: 83084 - DNA, 22 bp, Homo sapiens
cccatggcttaggagggagtgt

SEQ ID NO: 83085 - DNA, 22 bp, Homo sapiens
gcacttgtggatttgatataca

SEQ ID NO: 83086 - DNA, 22 bp, Homo sapiens
atgctatgtaactggcagatag

SEQ ID NO: 83087 - DNA, 22 bp, Homo sapiens
cagtggcgtgatctctgctcac

SEQ ID NO: 83088 - DNA, 22 bp, Homo sapiens
actgcacttcagcctgggtgac

SEQ ID NO: 83089 - DNA, 22 bp, Homo sapiens
aatggagattccaagttccttt

SEQ ID NO: 83090 - DNA, 21 bp, Homo sapiens
aaactgaccttgcctgagaca

SEQ ID NO: 83091 - DNA, 19 bp, Homo sapiens
cggcccctcctctcgcgcc

SEQ ID NO: 83092 - DNA, 22 bp, Homo sapiens
ttgtaacaggtactaaataact

SEQ ID NO: 83093 - DNA, 22 bp, Homo sapiens
gctcccaggatgaggagccagg

SEQ ID NO: 83094 - DNA, 22 bp, Homo sapiens
gtatcacttttgagagtgagaa

SEQ ID NO: 83095 - DNA, 22 bp, Homo sapiens
gctgggttttcttccgggccta

SEQ ID NO: 83096 - DNA, 22 bp, Homo sapiens
aagagaattctggttttcctat

SEQ ID NO: 83097 - DNA, 22 bp, Homo sapiens
ccaggaggcagaagttgcagtg

SEQ ID NO: 83098 - DNA, 22 bp, Homo sapiens
cagagatgtgatccagctgtct

SEQ ID NO: 83099 - DNA, 22 bp, Homo sapiens
cactgcacttcagcctgggtga

SEQ ID NO: 83100 - DNA, 22 bp, Homo sapiens
ttatttaatgtgatctgaagag

SEQ ID NO: 83101 - DNA, 22 bp, Homo sapiens
gtgacaatattagctcaggggc

SEQ ID NO: 83102 - DNA, 22 bp, Homo sapiens
tcatgcctggaatctcaccact

SEQ ID NO: 83103 - DNA, 22 bp, Homo sapiens
gttgctcaggcaggagtacagt

SEQ ID NO: 83104 - DNA, 22 bp, Homo sapiens
atttttctctttccactgagat

SEQ ID NO: 83105 - DNA, 22 bp, Homo sapiens
ggccagcctggggctcccagac

SEQ ID NO: 83106 - DNA, 22 bp, Homo sapiens
tcacttagatggggatcatcac

SEQ ID NO: 83107 - DNA, 23 bp, Homo sapiens
atgtttgcagtaacccatcctgg

SEQ ID NO: 83108 - DNA, 22 bp, Homo sapiens
aggggctcctttgtgctgcgtc

SEQ ID NO: 83109 - DNA, 22 bp, Homo sapiens
cgtcacttcttagtctattttc

SEQ ID NO: 83110 - DNA, 22 bp, Homo sapiens
ctgtccctgagcaactcctgtt

SEQ ID NO: 83111 - DNA, 20 bp, Homo sapiens
gccactgggcaccagcaggg

SEQ ID NO: 83112 - DNA, 22 bp, Homo sapiens
ttggaacatgccggggtccagg

SEQ ID NO: 83113 - DNA, 22 bp, Homo sapiens
caaagtgctaggattacaggcc

SEQ ID NO: 83114 - DNA, 22 bp, Homo sapiens
tttgggcaggcttttccctaga

SEQ ID NO: 83115 - DNA, 18 bp, Homo sapiens
tgtccctgcaaataacat

SEQ ID NO: 83116 - DNA, 22 bp, Homo sapiens
gtcccgcattgggcattcctgg

SEQ ID NO: 83117 - DNA, 23 bp, Homo sapiens
acagcaagaggaccagatgtgag

SEQ ID NO: 83118 - DNA, 22 bp, Homo sapiens
caggctgctgacaggcttggag

SEQ ID NO: 83119 - DNA, 22 bp, Homo sapiens
aggccaggaatccttgtcccag

SEQ ID NO: 83120 - DNA, 22 bp, Homo sapiens
cccaggctggagtgtaatggtg

SEQ ID NO: 83121 - DNA, 22 bp, Homo sapiens
tcaccgaggctggagtgcagtg

SEQ ID NO: 83122 - DNA, 22 bp, Homo sapiens
tcctccccaaagcccagcctgg

SEQ ID NO: 83123 - DNA, 22 bp, Homo sapiens
aagaggcgccgggtacgtggcg

SEQ ID NO: 83124 - DNA, 22 bp, Homo sapiens
tgcgggttggtggcatatgcag

SEQ ID NO: 83125 - DNA, 21 bp, Homo sapiens
agctgcctccacttctgaggc

SEQ ID NO: 83126 - DNA, 22 bp, Homo sapiens
gtgctggggagataggaagaga

SEQ ID NO: 83127 - DNA, 22 bp, Homo sapiens
tgtctggtgggttgacaggcag

SEQ ID NO: 83128 - DNA, 22 bp, Homo sapiens
ctggcaagaaatatatatctta

SEQ ID NO: 83129 - DNA, 22 bp, Homo sapiens
tctgtcttagccatctcaggct

SEQ ID NO: 83130 - DNA, 22 bp, Homo sapiens
gggaaggaaagttattagcaga

SEQ ID NO: 83131 - DNA, 22 bp, Homo sapiens
aacactctctgttggtaaggct

SEQ ID NO: 83132 - DNA, 22 bp, Homo sapiens
tccagctgaggtggcctctgtg

SEQ ID NO: 83133 - DNA, 22 bp, Homo sapiens
ggaggtggaggttgcagtgagc

SEQ ID NO: 83134 - DNA, 22 bp, Homo sapiens
ggaggcggaggttgcagtgagt

SEQ ID NO: 83135 - DNA, 22 bp, Homo sapiens
ctttggcaatgtcattttcaat

SEQ ID NO: 83136 - DNA, 22 bp, Homo sapiens
gcaggcagatcacctgtcagga

SEQ ID NO: 83137 - DNA, 22 bp, Homo sapiens
tgacagcctcactttgttaatt

SEQ ID NO: 83138 - DNA, 22 bp, Homo sapiens
tccaggattgtcagccagaagg

SEQ ID NO: 83139 - DNA, 22 bp, Homo sapiens
gctgtctgtcttcacatctcgc

SEQ ID NO: 83140 - DNA, 23 bp, Homo sapiens
aggtaggttattgctgctacctg

SEQ ID NO: 83141 - DNA, 22 bp, Homo sapiens
gtcagatctttggggatgctgt

SEQ ID NO: 83142 - DNA, 22 bp, Homo sapiens
gctggccacagatccccaggga

SEQ ID NO: 83143 - DNA, 21 bp, Homo sapiens
tgaaggggtggcagtgtgctt

SEQ ID NO: 83144 - DNA, 22 bp, Homo sapiens
ggaaggggtgggtgagcctcag

SEQ ID NO: 83145 - DNA, 22 bp, Homo sapiens
ttgaggcctgctggaaggtgtt

SEQ ID NO: 83146 - DNA, 22 bp, Homo sapiens
attggtggtgaggacatgccag

SEQ ID NO: 83147 - DNA, 22 bp, Homo sapiens
ggcatcttgttgctcaaatcta

SEQ ID NO: 83148 - DNA, 22 bp, Homo sapiens
cctcttctaggacgtccttgtg

SEQ ID NO: 83149 - DNA, 22 bp, Homo sapiens
ctggcagatagtaagtgatcaa

SEQ ID NO: 83150 - DNA, 22 bp, Homo sapiens
ggcaaaaaccataattactttt

SEQ ID NO: 83151 - DNA, 22 bp, Homo sapiens
cccactgtttccctgaggctct

SEQ ID NO: 83152 - DNA, 22 bp, Homo sapiens
ggccctgggccctctagcttgt

SEQ ID NO: 83153 - DNA, 22 bp, Homo sapiens
tgatgggaggtgctgcaggacc

SEQ ID NO: 83154 - DNA, 22 bp, Homo sapiens
agccagggacgctgcaggctac

SEQ ID NO: 83155 - DNA, 22 bp, Homo sapiens
gggcagagactcagaaacagaa

SEQ ID NO: 83156 - DNA, 22 bp, Homo sapiens
agctacagtcggaaggacagac

SEQ ID NO: 83157 - DNA, 22 bp, Homo sapiens
atcagagtgtaagttctttcct

SEQ ID NO: 83158 - DNA, 21 bp, Homo sapiens
tgcaatccagcctgggcgaca

SEQ ID NO: 83159 - DNA, 22 bp, Homo sapiens
ggttctctaactttgactggag

SEQ ID NO: 83160 - DNA, 22 bp, Homo sapiens
cttagatgaagtcacagaaccc

SEQ ID NO: 83161 - DNA, 22 bp, Homo sapiens
ggctgggctccgggagcatgcg

SEQ ID NO: 83162 - DNA, 22 bp, Homo sapiens
aatgttacgatcaacaacacat

SEQ ID NO: 83163 - DNA, 22 bp, Homo sapiens
tcccctctttctggaaacacaa

SEQ ID NO: 83164 - DNA, 22 bp, Homo sapiens
aggtggagaagagatgggcagt

SEQ ID NO: 83165 - DNA, 22 bp, Homo sapiens
gcactgcaggtgggtggagagg

SEQ ID NO: 83166 - DNA, 22 bp, Homo sapiens
gccacctcggctttctctgctc

SEQ ID NO: 83167 - DNA, 22 bp, Homo sapiens
caggcagggagctggaaaggat

SEQ ID NO: 83168 - DNA, 22 bp, Homo sapiens
gcagaagcacaggtgacgggcc

SEQ ID NO: 83169 - DNA, 22 bp, Homo sapiens
ttcctaagtcctgccagcagtc

SEQ ID NO: 83170 - DNA, 22 bp, Homo sapiens
agggaattcactggaacgccct

SEQ ID NO: 83171 - DNA, 22 bp, Homo sapiens
agagctgggtggacttgtagtt

SEQ ID NO: 83172 - DNA, 22 bp, Homo sapiens
cagagctggtgtgtcctggcat

SEQ ID NO: 83173 - DNA, 22 bp, Homo sapiens
caccaggctggagtgcagtggc

SEQ ID NO: 83174 - DNA, 22 bp, Homo sapiens
tgctgggctggggcctcagacc

SEQ ID NO: 83175 - DNA, 22 bp, Homo sapiens
tgtcttcgctacaatgaaaagg

SEQ ID NO: 83176 - DNA, 22 bp, Homo sapiens
tttaaaaaactagtctgagtct

SEQ ID NO: 83177 - DNA, 22 bp, Homo sapiens
cctgggctctgtcagaattggg

SEQ ID NO: 83178 - DNA, 22 bp, Homo sapiens
gccagggtcctgaagaccaagt

SEQ ID NO: 83179 - DNA, 17 bp, Homo sapiens
tctgagaatgctggagg

SEQ ID NO: 83180 - DNA, 22 bp, Homo sapiens
gagggagggactagcattctct

SEQ ID NO: 83181 - DNA, 22 bp, Homo sapiens
gtggcagaccttcccttctcct

SEQ ID NO: 83182 - DNA, 22 bp, Homo sapiens
atgccactgcactccagcctgg

SEQ ID NO: 83183 - DNA, 22 bp, Homo sapiens
gcgagtgccgagagggcagggc

SEQ ID NO: 83184 - DNA, 19 bp, Homo sapiens
taggaccctggtggccccc

SEQ ID NO: 83185 - DNA, 22 bp, Homo sapiens
ccgcccacactaaatatgagcg

SEQ ID NO: 83186 - DNA, 22 bp, Homo sapiens
cagagcccctcgtctccaccac

SEQ ID NO: 83187 - DNA, 22 bp, Homo sapiens
aaggtgggtggatcacgaggtc

SEQ ID NO: 83188 - DNA, 22 bp, Homo sapiens
ctaggctggagtgcagtggcac

SEQ ID NO: 83189 - DNA, 22 bp, Homo sapiens
tggctgagttacgaacagagca

SEQ ID NO: 83190 - DNA, 17 bp, Homo sapiens
aatctgtttacagtcag

SEQ ID NO: 83191 - DNA, 22 bp, Homo sapiens
gcccaggctggagtgcagtggt

SEQ ID NO: 83192 - DNA, 22 bp, Homo sapiens
cgggcgcactccgggcagctgt

SEQ ID NO: 83193 - DNA, 22 bp, Homo sapiens
ctgtatctgtgttggatgagtt

SEQ ID NO: 83194 - DNA, 22 bp, Homo sapiens
gtgggggctggaaatcttgcca

SEQ ID NO: 83195 - DNA, 22 bp, Homo sapiens
aaagcagaggttgcagtgagct

SEQ ID NO: 83196 - DNA, 22 bp, Homo sapiens
tttgagtgcccatgtttcccag

SEQ ID NO: 83197 - DNA, 22 bp, Homo sapiens
ccaagctacttaggagtctgag

SEQ ID NO: 83198 - DNA, 22 bp, Homo sapiens
caggctggagtacaattgtgtg

SEQ ID NO: 83199 - DNA, 22 bp, Homo sapiens
cccagttgttgccggctctgga

SEQ ID NO: 83200 - DNA, 22 bp, Homo sapiens
acggggctagagaaggtttctt

SEQ ID NO: 83201 - DNA, 22 bp, Homo sapiens
gaccttcttgctgtgtcctaac

SEQ ID NO: 83202 - DNA, 22 bp, Homo sapiens
atgttggccaggctggtcttga

SEQ ID NO: 83203 - DNA, 22 bp, Homo sapiens
gggccaccccactgcccacgct

SEQ ID NO: 83204 - DNA, 22 bp, Homo sapiens
ggtcagccttggatttggtagc

SEQ ID NO: 83205 - DNA, 22 bp, Homo sapiens
tggaatggaaacaaactgagga

SEQ ID NO: 83206 - DNA, 22 bp, Homo sapiens
ccaggttggagttcagtggcgc

SEQ ID NO: 83207 - DNA, 22 bp, Homo sapiens
agggctgcccagtgtgagagct

SEQ ID NO: 83208 - DNA, 22 bp, Homo sapiens
ccactgcacttcagcctgggtg

SEQ ID NO: 83209 - DNA, 22 bp, Homo sapiens
tagctaccattattgagcacct

SEQ ID NO: 83210 - DNA, 22 bp, Homo sapiens
tcttggccactaccacctggag

SEQ ID NO: 83211 - DNA, 18 bp, Homo sapiens
ccctgccagctcccagca

SEQ ID NO: 83212 - DNA, 22 bp, Homo sapiens
aggagcagaccgtagtcctgca

SEQ ID NO: 83213 - DNA, 22 bp, Homo sapiens
cccaggaggcctgcctggccgg

SEQ ID NO: 83214 - DNA, 19 bp, Homo sapiens
gctgttaaggaccctcgga

SEQ ID NO: 83215 - DNA, 22 bp, Homo sapiens
tccttcagcctcccagctcaaa

SEQ ID NO: 83216 - DNA, 22 bp, Homo sapiens
cggctcactgcagctccgcctc

SEQ ID NO: 83217 - DNA, 22 bp, Homo sapiens
gagcactgagctggaattggag

SEQ ID NO: 83218 - DNA, 22 bp, Homo sapiens
cttccccaggacctctgctaaa

SEQ ID NO: 83219 - DNA, 22 bp, Homo sapiens
caaagtgctgggattacaggtg

SEQ ID NO: 83220 - DNA, 22 bp, Homo sapiens
cacccaggctggagtgcagtgg

SEQ ID NO: 83221 - DNA, 22 bp, Homo sapiens
cggggttcatccatgctgtggc

SEQ ID NO: 83222 - DNA, 22 bp, Homo sapiens
gaggctgaggcggatggatcac

SEQ ID NO: 83223 - DNA, 22 bp, Homo sapiens
acctctgtacctcctctgacag

SEQ ID NO: 83224 - DNA, 19 bp, Homo sapiens
catctggatgattctcctg

SEQ ID NO: 83225 - DNA, 22 bp, Homo sapiens
gccagggttcaagctattctcc

SEQ ID NO: 83226 - DNA, 22 bp, Homo sapiens
tccaccatgtaacaagctctgt

SEQ ID NO: 83227 - DNA, 22 bp, Homo sapiens
aaaaaattatcatagttcctga

SEQ ID NO: 83228 - DNA, 18 bp, Homo sapiens
cagggctgtggggtcact

SEQ ID NO: 83229 - DNA, 22 bp, Homo sapiens
ttatgggagcaattggggaggt

SEQ ID NO: 83230 - DNA, 22 bp, Homo sapiens
ggcaaggggtcaggctgagaca

SEQ ID NO: 83231 - DNA, 22 bp, Homo sapiens
gggaagtgatggagccaggatt

SEQ ID NO: 83232 - DNA, 22 bp, Homo sapiens
gccagggttgccaatgggggca

SEQ ID NO: 83233 - DNA, 22 bp, Homo sapiens
cagccacttgtgatgctgggga

SEQ ID NO: 83234 - DNA, 22 bp, Homo sapiens
ttaccaaatgaaatagagattt

SEQ ID NO: 83235 - DNA, 22 bp, Homo sapiens
acccaggctggagtgcagtggg

SEQ ID NO: 83236 - DNA, 22 bp, Homo sapiens
tgtcatagtgtggtagcagtgg

SEQ ID NO: 83237 - DNA, 22 bp, Homo sapiens
tggtattctttctgtagatcat

SEQ ID NO: 83238 - DNA, 22 bp, Homo sapiens
gtcagtaggaacctagggtcaa

SEQ ID NO: 83239 - DNA, 22 bp, Homo sapiens
ccagcttgctcctctgcaatgg

SEQ ID NO: 83240 - DNA, 22 bp, Homo sapiens
ctgcactgagcatctaacctta

SEQ ID NO: 83241 - DNA, 23 bp, Homo sapiens
ttctgggctgtggaagcctcggg

SEQ ID NO: 83242 - DNA, 22 bp, Homo sapiens
tgcttttagctagtaactagta

SEQ ID NO: 83243 - DNA, 22 bp, Homo sapiens
aagtcagacagctgagctgcct

SEQ ID NO: 83244 - DNA, 22 bp, Homo sapiens
caggagtgtctccacacagcaa

SEQ ID NO: 83245 - DNA, 22 bp, Homo sapiens
ggggatggaggcgtgtggtcct

SEQ ID NO: 83246 - DNA, 22 bp, Homo sapiens
tggctaacaaggtgaaaccccg

SEQ ID NO: 83247 - DNA, 21 bp, Homo sapiens
agaaggcaaaagcagacatct

SEQ ID NO: 83248 - DNA, 20 bp, Homo sapiens
tgttctgtcgtctttcttca

SEQ ID NO: 83249 - DNA, 22 bp, Homo sapiens
tccctctacagggaagcgcttt

SEQ ID NO: 83250 - DNA, 22 bp, Homo sapiens
tgaggcactccaggatgctgtt

SEQ ID NO: 83251 - DNA, 22 bp, Homo sapiens
taagggttcagaatgcagtggt

SEQ ID NO: 83252 - DNA, 22 bp, Homo sapiens
tgctccagcaccaagagctcca

SEQ ID NO: 83253 - DNA, 20 bp, Homo sapiens
acgtggccaccagtggctta

SEQ ID NO: 83254 - DNA, 22 bp, Homo sapiens
cattgcaacttcaaactcctgg

SEQ ID NO: 83255 - DNA, 22 bp, Homo sapiens
acccacgaagatgagcggcatg

SEQ ID NO: 83256 - DNA, 22 bp, Homo sapiens
tatgaggtaggtattatactta

SEQ ID NO: 83257 - DNA, 22 bp, Homo sapiens
tagctttgtttatcaaggggca

SEQ ID NO: 83258 - DNA, 22 bp, Homo sapiens
gccgtccacctcgatggccact

SEQ ID NO: 83259 - DNA, 22 bp, Homo sapiens
ggtcccatgactgacacagcag

SEQ ID NO: 83260 - DNA, 22 bp, Homo sapiens
gggtggagagaaagaaacgtga

SEQ ID NO: 83261 - DNA, 22 bp, Homo sapiens
gggtacagttcttccagtgtca

SEQ ID NO: 83262 - DNA, 22 bp, Homo sapiens
tcaggcaatctgacagctggag

SEQ ID NO: 83263 - DNA, 22 bp, Homo sapiens
actgttttctgtaaagggccag

SEQ ID NO: 83264 - DNA, 22 bp, Homo sapiens
tgggagaaagaaccctgagtga

SEQ ID NO: 83265 - DNA, 22 bp, Homo sapiens
aggagctcagctaagttggaga

SEQ ID NO: 83266 - DNA, 22 bp, Homo sapiens
ttccagctaactcacatccctt

SEQ ID NO: 83267 - DNA, 22 bp, Homo sapiens
caaggtgccatgctgggcgggg

SEQ ID NO: 83268 - DNA, 22 bp, Homo sapiens
ccccatgaagtagggtctctga

SEQ ID NO: 83269 - DNA, 22 bp, Homo sapiens
gggacaatggaggcctctctcc

SEQ ID NO: 83270 - DNA, 22 bp, Homo sapiens
acatcctcccgatctactggct

SEQ ID NO: 83271 - DNA, 22 bp, Homo sapiens
ggaggaggggtgactgaatgct

SEQ ID NO: 83272 - DNA, 22 bp, Homo sapiens
ggggccgaccgcggttcaggcc

SEQ ID NO: 83273 - DNA, 22 bp, Homo sapiens
cctgccagagcagcttgtcctc

SEQ ID NO: 83274 - DNA, 22 bp, Homo sapiens
tgggaggccgaggcaggtggat

SEQ ID NO: 83275 - DNA, 22 bp, Homo sapiens
ttcaccctggaccagaaattgg

SEQ ID NO: 83276 - DNA, 22 bp, Homo sapiens
agtgaaaacctaatcatgcagt

SEQ ID NO: 83277 - DNA, 22 bp, Homo sapiens
tctgttgactcctagcagccat

SEQ ID NO: 83278 - DNA, 20 bp, Homo sapiens
gtgtggccaggagctgcgct

SEQ ID NO: 83279 - DNA, 22 bp, Homo sapiens
tcagcctgctccaagtgctgcc

SEQ ID NO: 83280 - DNA, 22 bp, Homo sapiens
catggcggtcaggatgtaggtg

SEQ ID NO: 83281 - DNA, 22 bp, Homo sapiens
caggaagaccagggctgtggct

SEQ ID NO: 83282 - DNA, 22 bp, Homo sapiens
tttagattgtgacctcccccca

SEQ ID NO: 83283 - DNA, 22 bp, Homo sapiens
caggctggagtgcagtggggcg

SEQ ID NO: 83284 - DNA, 22 bp, Homo sapiens
ttatttttaaaagttcacacag

SEQ ID NO: 83285 - DNA, 22 bp, Homo sapiens
agatcacagtggcaactccctt

SEQ ID NO: 83286 - DNA, 22 bp, Homo sapiens
tccgggggtggtagatttcctt

SEQ ID NO: 83287 - DNA, 22 bp, Homo sapiens
ggaactcctgctccaagcagct

SEQ ID NO: 83288 - DNA, 22 bp, Homo sapiens
tccaggattgcaggtgcacaac

SEQ ID NO: 83289 - DNA, 22 bp, Homo sapiens
tgctcatcaacatgatgatcat

SEQ ID NO: 83290 - DNA, 22 bp, Homo sapiens
ggagaagcagcttcttgatgaa

SEQ ID NO: 83291 - DNA, 18 bp, Homo sapiens
ttgcttcttttctctagg

SEQ ID NO: 83292 - DNA, 22 bp, Homo sapiens
ccaggctgctgttggtgtccgc

SEQ ID NO: 83293 - DNA, 22 bp, Homo sapiens
ccagcagagcatggggaggaag

SEQ ID NO: 83294 - DNA, 22 bp, Homo sapiens
aattacagtcggagcagcactg

SEQ ID NO: 83295 - DNA, 22 bp, Homo sapiens
gttcagaaattaggagaataaa

SEQ ID NO: 83296 - DNA, 22 bp, Homo sapiens
tacaaaaaattgatactgacga

SEQ ID NO: 83297 - DNA, 22 bp, Homo sapiens
tctaaattactttgggcagtat

SEQ ID NO: 83298 - DNA, 22 bp, Homo sapiens
tggctccacaggccagggtgtg

SEQ ID NO: 83299 - DNA, 22 bp, Homo sapiens
ctacccttaagtttctgtgggg

SEQ ID NO: 83300 - DNA, 22 bp, Homo sapiens
tgccaggcgtggtggtgcgcac

SEQ ID NO: 83301 - DNA, 22 bp, Homo sapiens
actgggctcaagtgattgtcct

SEQ ID NO: 83302 - DNA, 22 bp, Homo sapiens
gaggtgggcggatcacaaggtc

SEQ ID NO: 83303 - DNA, 22 bp, Homo sapiens
gggaagagggagctggaatgat

SEQ ID NO: 83304 - DNA, 22 bp, Homo sapiens
cacccaggttggagtgcagtgg

SEQ ID NO: 83305 - DNA, 22 bp, Homo sapiens
gcttccacctactaaatgccac

SEQ ID NO: 83306 - DNA, 22 bp, Homo sapiens
aaggcaggatgggaaaagattt

SEQ ID NO: 83307 - DNA, 22 bp, Homo sapiens
ccctctctgctgcatagaggaa

SEQ ID NO: 83308 - DNA, 22 bp, Homo sapiens
aggtcaccatggcatgctccac

SEQ ID NO: 83309 - DNA, 22 bp, Homo sapiens
cctagagccgcacctcctccac

SEQ ID NO: 83310 - DNA, 20 bp, Homo sapiens
ccagagctgatggctgcccg

SEQ ID NO: 83311 - DNA, 22 bp, Homo sapiens
ttcagacaggcagctgggctgg

SEQ ID NO: 83312 - DNA, 22 bp, Homo sapiens
ctggcaggtggaggttgcagtg

SEQ ID NO: 83313 - DNA, 22 bp, Homo sapiens
cctccccacagcccaggagact

SEQ ID NO: 83314 - DNA, 22 bp, Homo sapiens
ggcgccgcactcggtgcagccg

SEQ ID NO: 83315 - DNA, 22 bp, Homo sapiens
gctcccagtctgatggaggaga

SEQ ID NO: 83316 - DNA, 22 bp, Homo sapiens
ggttggtaactccctgtgcagt

SEQ ID NO: 83317 - DNA, 22 bp, Homo sapiens
tccagcttataggtagatttaa

SEQ ID NO: 83318 - DNA, 22 bp, Homo sapiens
ccaaagtgctgggattacaggc

SEQ ID NO: 83319 - DNA, 22 bp, Homo sapiens
aaagaggcaatcaatgtagcaa

SEQ ID NO: 83320 - DNA, 22 bp, Homo sapiens
ataaaatttgctactgttaaat

SEQ ID NO: 83321 - DNA, 22 bp, Homo sapiens
gctgcagtgagccaagatcgtg

SEQ ID NO: 83322 - DNA, 22 bp, Homo sapiens
gtcactgtatccaggttccagc

SEQ ID NO: 83323 - DNA, 22 bp, Homo sapiens
aagaggttgtacctaaagtgtt

SEQ ID NO: 83324 - DNA, 22 bp, Homo sapiens
atataatttttggttagctcaa

SEQ ID NO: 83325 - DNA, 22 bp, Homo sapiens
tgggactcactcttttggccag

SEQ ID NO: 83326 - DNA, 22 bp, Homo sapiens
caggtagaggctgccatcagct

SEQ ID NO: 83327 - DNA, 22 bp, Homo sapiens
ttttcagaattagcataccatt

SEQ ID NO: 83328 - DNA, 22 bp, Homo sapiens
cttcctctgtggccagagtgta

SEQ ID NO: 83329 - DNA, 22 bp, Homo sapiens
cgctccttgagcgtgtcggcct

SEQ ID NO: 83330 - DNA, 22 bp, Homo sapiens
attgtcagtttaatatagtcaa

SEQ ID NO: 83331 - DNA, 22 bp, Homo sapiens
ggactgggaatcagggagatgc

SEQ ID NO: 83332 - DNA, 22 bp, Homo sapiens
atttggcagtataaattctggc

SEQ ID NO: 83333 - DNA, 22 bp, Homo sapiens
catgctgggtaaaggtggtgaa

SEQ ID NO: 83334 - DNA, 22 bp, Homo sapiens
tgggaagctgcattttaacaag

SEQ ID NO: 83335 - DNA, 22 bp, Homo sapiens
actgcactccagcctgggtgac

SEQ ID NO: 83336 - DNA, 22 bp, Homo sapiens
gcactttgcccctcctttggca

SEQ ID NO: 83337 - DNA, 22 bp, Homo sapiens
agtgcagtggttaggagccagg

SEQ ID NO: 83338 - DNA, 22 bp, Homo sapiens
ctgatcctcctttaagtagctg

SEQ ID NO: 83339 - DNA, 22 bp, Homo sapiens
ctggccagatgttacgtccaat

SEQ ID NO: 83340 - DNA, 22 bp, Homo sapiens
cggccgcagcagtgtcggccca

SEQ ID NO: 83341 - DNA, 20 bp, Homo sapiens
gttaggaggttggacatgga

SEQ ID NO: 83342 - DNA, 22 bp, Homo sapiens
ccaggaggcggaggttgcagtg

SEQ ID NO: 83343 - DNA, 23 bp, Homo sapiens
cagagctggctcagagctgcctg

SEQ ID NO: 83344 - DNA, 22 bp, Homo sapiens
caatttgccctgttaaattttc

SEQ ID NO: 83345 - DNA, 22 bp, Homo sapiens
agggcgacaatggagagcgttt

SEQ ID NO: 83346 - DNA, 22 bp, Homo sapiens
actaaagctcacagagttgaac

SEQ ID NO: 83347 - DNA, 22 bp, Homo sapiens
ggatgcacgaaggcgcctcgga

SEQ ID NO: 83348 - DNA, 22 bp, Homo sapiens
acaaacagagttgaaaaatagg

SEQ ID NO: 83349 - DNA, 22 bp, Homo sapiens
cattgctttgtgcatatttaaa

SEQ ID NO: 83350 - DNA, 22 bp, Homo sapiens
atgtatacgtgcaagtcacagg

SEQ ID NO: 83351 - DNA, 22 bp, Homo sapiens
taacatttaaatttttcacata

SEQ ID NO: 83352 - DNA, 22 bp, Homo sapiens
gcccccgtagtagatgaggcgc

SEQ ID NO: 83353 - DNA, 22 bp, Homo sapiens
aaactgtcctcccgaggtttcc

SEQ ID NO: 83354 - DNA, 22 bp, Homo sapiens
atctggttcttcttaggcatca

SEQ ID NO: 83355 - DNA, 22 bp, Homo sapiens
aatgccagtgtgttgattccag

SEQ ID NO: 83356 - DNA, 22 bp, Homo sapiens
ccagcatccatgctccctcggg

SEQ ID NO: 83357 - DNA, 22 bp, Homo sapiens
tctcagggctcagagctcaggc

SEQ ID NO: 83358 - DNA, 21 bp, Homo sapiens
agcctcaggttgttggttctt

SEQ ID NO: 83359 - DNA, 22 bp, Homo sapiens
agatgtgtttctagttcctgca

SEQ ID NO: 83360 - DNA, 22 bp, Homo sapiens
cctggaggcggaggttgcagtg

SEQ ID NO: 83361 - DNA, 22 bp, Homo sapiens
ggctgcaggttggttggcagct

SEQ ID NO: 83362 - DNA, 22 bp, Homo sapiens
agcccaggagtttgaggctgtg

SEQ ID NO: 83363 - DNA, 22 bp, Homo sapiens
caggctgaagtgcagtggtgtg

SEQ ID NO: 83364 - DNA, 22 bp, Homo sapiens
tgagccaggagtttgaggctgt

SEQ ID NO: 83365 - DNA, 22 bp, Homo sapiens
ttcaggaagtgctgcctggtgt

SEQ ID NO: 83366 - DNA, 21 bp, Homo sapiens
cttccccaggctggtctgtat

SEQ ID NO: 83367 - DNA, 22 bp, Homo sapiens
ccaaagtgctggggttacaggc

SEQ ID NO: 83368 - DNA, 22 bp, Homo sapiens
gacctcatgatccacctgcctt

SEQ ID NO: 83369 - DNA, 22 bp, Homo sapiens
ccaggaggttgaggctgcagtg

SEQ ID NO: 83370 - DNA, 22 bp, Homo sapiens
aggcaggaggatcatggatgca

SEQ ID NO: 83371 - DNA, 18 bp, Homo sapiens
acacttcctggtggtgtg

SEQ ID NO: 83372 - DNA, 22 bp, Homo sapiens
agcctggcggtcgtcggtcagg

SEQ ID NO: 83373 - DNA, 22 bp, Homo sapiens
gccaccctggacgcactgttcg

SEQ ID NO: 83374 - DNA, 22 bp, Homo sapiens
gaggctgaggcaggaggatcac

SEQ ID NO: 83375 - DNA, 22 bp, Homo sapiens
ttcctggtctatttagaattgc

SEQ ID NO: 83376 - DNA, 22 bp, Homo sapiens
actgcaacctccacctcctggg

SEQ ID NO: 83377 - DNA, 22 bp, Homo sapiens
ttgcctgtgtcagcaggtggaa

SEQ ID NO: 83378 - DNA, 22 bp, Homo sapiens
attggccatttgcatgtattat

SEQ ID NO: 83379 - DNA, 22 bp, Homo sapiens
ctcattgcaacctccgcctccc

SEQ ID NO: 83380 - DNA, 22 bp, Homo sapiens
gagggtggtggcttaaggtgct

SEQ ID NO: 83381 - DNA, 22 bp, Homo sapiens
aagcacaatgaacatcttagat

SEQ ID NO: 83382 - DNA, 22 bp, Homo sapiens
gttacagtcaggagatattttg

SEQ ID NO: 83383 - DNA, 17 bp, Homo sapiens
ccctcactcctgccggg

SEQ ID NO: 83384 - DNA, 22 bp, Homo sapiens
accacccagccagcttctccct

SEQ ID NO: 83385 - DNA, 22 bp, Homo sapiens
cactgcactccagcctggcgac

SEQ ID NO: 83386 - DNA, 22 bp, Homo sapiens
tgtctcatctcttaaccccact

SEQ ID NO: 83387 - DNA, 22 bp, Homo sapiens
atgctaaggcccaggagaaaat

SEQ ID NO: 83388 - DNA, 22 bp, Homo sapiens
gagcctggagctggaacgaagc

SEQ ID NO: 83389 - DNA, 22 bp, Homo sapiens
ctgggtggcagagcctgcagtg

SEQ ID NO: 83390 - DNA, 19 bp, Homo sapiens
ccctcttgcacaaagcaaa

SEQ ID NO: 83391 - DNA, 22 bp, Homo sapiens
agcaggaaggggatgatgggca

SEQ ID NO: 83392 - DNA, 22 bp, Homo sapiens
atggggggatgaaggagtccaa

SEQ ID NO: 83393 - DNA, 22 bp, Homo sapiens
ttcagcagtgcagacacccagt

SEQ ID NO: 83394 - DNA, 22 bp, Homo sapiens
gaaccacaatgtgaagaaggag

SEQ ID NO: 83395 - DNA, 22 bp, Homo sapiens
ctgaagagaaagggagctcttc

SEQ ID NO: 83396 - DNA, 22 bp, Homo sapiens
gtggagggtgattgccggctgt

SEQ ID NO: 83397 - DNA, 21 bp, Homo sapiens
tcactagtgccttctgtcatt

SEQ ID NO: 83398 - DNA, 22 bp, Homo sapiens
tcagggattgcaaaattcatcc

SEQ ID NO: 83399 - DNA, 22 bp, Homo sapiens
cacactgtctttatgagctgta

SEQ ID NO: 83400 - DNA, 22 bp, Homo sapiens
agaaaacataggagacaggaaa

SEQ ID NO: 83401 - DNA, 22 bp, Homo sapiens
atcctcagagaacgaacacaat

SEQ ID NO: 83402 - DNA, 22 bp, Homo sapiens
tgaagactcagaagctaagata

SEQ ID NO: 83403 - DNA, 22 bp, Homo sapiens
ctgggaggcggaggttgcagtg

SEQ ID NO: 83404 - DNA, 22 bp, Homo sapiens
agagcgcactgtctgcaggcaa

SEQ ID NO: 83405 - DNA, 22 bp, Homo sapiens
actgcaacacctcctgggttca

SEQ ID NO: 83406 - DNA, 22 bp, Homo sapiens
gtcaggactctgacccgtcccg

SEQ ID NO: 83407 - DNA, 22 bp, Homo sapiens
ctttatgaaaacctgaattatg

SEQ ID NO: 83408 - DNA, 22 bp, Homo sapiens
catggcattgcataacggggct

SEQ ID NO: 83409 - DNA, 22 bp, Homo sapiens
atatattttttgagacagagtc

SEQ ID NO: 83410 - DNA, 22 bp, Homo sapiens
tgttttaagggtcaactgtcac

SEQ ID NO: 83411 - DNA, 22 bp, Homo sapiens
taagcctgcatgaaccatgaga

SEQ ID NO: 83412 - DNA, 22 bp, Homo sapiens
ggtgccaggctgtagtcagggt

SEQ ID NO: 83413 - DNA, 22 bp, Homo sapiens
gagagtgagatcctcctgggga

SEQ ID NO: 83414 - DNA, 22 bp, Homo sapiens
acaatgctccctgtagtcagga

SEQ ID NO: 83415 - DNA, 19 bp, Homo sapiens
gccttgaagcaactcttgt

SEQ ID NO: 83416 - DNA, 22 bp, Homo sapiens
gtgacaggccactgcggctctg

SEQ ID NO: 83417 - DNA, 22 bp, Homo sapiens
ctggcccaggtggtcgttgagg

SEQ ID NO: 83418 - DNA, 22 bp, Homo sapiens
cacttcattgggaccagggctg

SEQ ID NO: 83419 - DNA, 22 bp, Homo sapiens
tgtcagtgtctatgaagaattt

SEQ ID NO: 83420 - DNA, 22 bp, Homo sapiens
gaagctgagctgaggcatgttg

SEQ ID NO: 83421 - DNA, 22 bp, Homo sapiens
cctgcagacacttgtccagcaa

SEQ ID NO: 83422 - DNA, 22 bp, Homo sapiens
taaatgttttgtgggttgagtt

SEQ ID NO: 83423 - DNA, 22 bp, Homo sapiens
ggggcagagaataaaaacctaa

SEQ ID NO: 83424 - DNA, 22 bp, Homo sapiens
tgggcagggagctggaaccaca

SEQ ID NO: 83425 - DNA, 22 bp, Homo sapiens
cacggccagggctgtgggtgcg

SEQ ID NO: 83426 - DNA, 22 bp, Homo sapiens
tggaggctggagtgcagtggcg

SEQ ID NO: 83427 - DNA, 22 bp, Homo sapiens
ggaggggatttagtagatgcta

SEQ ID NO: 83428 - DNA, 22 bp, Homo sapiens
aaggagaaatggtagatgtgca

SEQ ID NO: 83429 - DNA, 22 bp, Homo sapiens
gcgagggcacgcggttgaaggc

SEQ ID NO: 83430 - DNA, 22 bp, Homo sapiens
tgagctgtctgaatggtgagga

SEQ ID NO: 83431 - DNA, 22 bp, Homo sapiens
tgggattcaccatgggcttcag

SEQ ID NO: 83432 - DNA, 22 bp, Homo sapiens
tttattctgtgctacatgaaga

SEQ ID NO: 83433 - DNA, 22 bp, Homo sapiens
tttgttttcaatgtgtcattca

SEQ ID NO: 83434 - DNA, 22 bp, Homo sapiens
ctcactgcaagttccacctacc

SEQ ID NO: 83435 - DNA, 22 bp, Homo sapiens
gccggggctggggagagacatg

SEQ ID NO: 83436 - DNA, 22 bp, Homo sapiens
aggtaaagacagtgaaagaggg

SEQ ID NO: 83437 - DNA, 22 bp, Homo sapiens
cctactctgagcgcctccgcat

SEQ ID NO: 83438 - DNA, 22 bp, Homo sapiens
tcccagctactctagaggctga

SEQ ID NO: 83439 - DNA, 22 bp, Homo sapiens
acaggggcaagggctcacggcc

SEQ ID NO: 83440 - DNA, 22 bp, Homo sapiens
cttctttcaagaatggattagg

SEQ ID NO: 83441 - DNA, 18 bp, Homo sapiens
tcactgggtgtatgtggc

SEQ ID NO: 83442 - DNA, 22 bp, Homo sapiens
cctgggaggctgaggctgcagt

SEQ ID NO: 83443 - DNA, 22 bp, Homo sapiens
cccagcaggtcggtgctgcctg

SEQ ID NO: 83444 - DNA, 20 bp, Homo sapiens
caagggtttgcattggcttt

SEQ ID NO: 83445 - DNA, 22 bp, Homo sapiens
tggtggctcacacctgtaatcc

SEQ ID NO: 83446 - DNA, 22 bp, Homo sapiens
accccagaggcggaggctgcag

SEQ ID NO: 83447 - DNA, 22 bp, Homo sapiens
agcaggagtttgatgcttttat

SEQ ID NO: 83448 - DNA, 22 bp, Homo sapiens
ccagagctgattcctgggactt

SEQ ID NO: 83449 - DNA, 22 bp, Homo sapiens
aatgccagtgtgttgattccag

SEQ ID NO: 83450 - DNA, 22 bp, Homo sapiens
aatatcatctctcttttctgca

SEQ ID NO: 83451 - DNA, 22 bp, Homo sapiens
attggccagacttatccttcag

SEQ ID NO: 83452 - DNA, 22 bp, Homo sapiens
tccaactttctcctccggcttg

SEQ ID NO: 83453 - DNA, 22 bp, Homo sapiens
ggagctgttcaggactgcttca

SEQ ID NO: 83454 - DNA, 22 bp, Homo sapiens
actgcacttcagcctgggtgtc

SEQ ID NO: 83455 - DNA, 22 bp, Homo sapiens
ccaggctggagtgcagtggcac

SEQ ID NO: 83456 - DNA, 22 bp, Homo sapiens
gcaggagaacaaagcaagctgc

SEQ ID NO: 83457 - DNA, 22 bp, Homo sapiens
ttagtttataattcatttctgt

SEQ ID NO: 83458 - DNA, 22 bp, Homo sapiens
cagtagatttggtaaactagga

SEQ ID NO: 83459 - DNA, 16 bp, Homo sapiens
ccacctgcagctctca

SEQ ID NO: 83460 - DNA, 22 bp, Homo sapiens
aaggcaggatgggaaaagattt

SEQ ID NO: 83461 - DNA, 22 bp, Homo sapiens
atgcacctgaactccatcagct

SEQ ID NO: 83462 - DNA, 22 bp, Homo sapiens
ttttggccacatccttttgagt

SEQ ID NO: 83463 - DNA, 22 bp, Homo sapiens
tcacatctaattccatttctgc

SEQ ID NO: 83464 - DNA, 22 bp, Homo sapiens
cagggtttcaccatgttagcag

SEQ ID NO: 83465 - DNA, 22 bp, Homo sapiens
tattgtccaataggatgttcct

SEQ ID NO: 83466 - DNA, 20 bp, Homo sapiens
gctgaggggtctatggcata

SEQ ID NO: 83467 - DNA, 22 bp, Homo sapiens
aggtaaatgtcagagcctttaa

SEQ ID NO: 83468 - DNA, 22 bp, Homo sapiens
ctgctgggatagaagtatctca

SEQ ID NO: 83469 - DNA, 22 bp, Homo sapiens
caagggaattgtgtgtgagagg

SEQ ID NO: 83470 - DNA, 22 bp, Homo sapiens
tccagcttataggtagatttaa

SEQ ID NO: 83471 - DNA, 21 bp, Homo sapiens
aaactgaccttgcctgagaca

SEQ ID NO: 83472 - DNA, 22 bp, Homo sapiens
tgtagatatagaaaaagactga

SEQ ID NO: 83473 - DNA, 22 bp, Homo sapiens
atgaggcaggtggaggctgcca

SEQ ID NO: 83474 - DNA, 22 bp, Homo sapiens
attctcataggagcgtgaacct

SEQ ID NO: 83475 - DNA, 22 bp, Homo sapiens
gcaggcaggcttccttgaactg

SEQ ID NO: 83476 - DNA, 18 bp, Homo sapiens
tcctttctccctcatctt

SEQ ID NO: 83477 - DNA, 22 bp, Homo sapiens
tctgctctgtggcttcagctaa

SEQ ID NO: 83478 - DNA, 22 bp, Homo sapiens
actgggcagcagctcgagccgc

SEQ ID NO: 83479 - DNA, 21 bp, Homo sapiens
gtggttctagagaaacagaat

SEQ ID NO: 83480 - DNA, 22 bp, Homo sapiens
atgccactgcactccagcctag

SEQ ID NO: 83481 - DNA, 21 bp, Homo sapiens
gaccccagaccagcagacaca

SEQ ID NO: 83482 - DNA, 22 bp, Homo sapiens
cttatagtatgatgttgagaat

SEQ ID NO: 83483 - DNA, 22 bp, Homo sapiens
gcctcaaatgtggagcactatt

SEQ ID NO: 83484 - DNA, 22 bp, Homo sapiens
cagcagtgtacaaggtgtcaga

SEQ ID NO: 83485 - DNA, 22 bp, Homo sapiens
aggttatatgactgtcatgcct

SEQ ID NO: 83486 - DNA, 22 bp, Homo sapiens
ggctgggcctctccctcagctg

SEQ ID NO: 83487 - DNA, 22 bp, Homo sapiens
gtgccgcgacgcagtcggtgcc

SEQ ID NO: 83488 - DNA, 22 bp, Homo sapiens
aacccaggagttggaggctgtg

SEQ ID NO: 83489 - DNA, 22 bp, Homo sapiens
agtgcactggcaccatctcagc

SEQ ID NO: 83490 - DNA, 22 bp, Homo sapiens
ggaggtggagctggaagttcca

SEQ ID NO: 83491 - DNA, 22 bp, Homo sapiens
cttgtagacccctggactcacg

SEQ ID NO: 83492 - DNA, 23 bp, Homo sapiens
actgattcttgaagttgacaagt

SEQ ID NO: 83493 - DNA, 22 bp, Homo sapiens
tgtctgcctgcgggccggcaca

SEQ ID NO: 83494 - DNA, 22 bp, Homo sapiens
aagaatgagctcaaagatctta

SEQ ID NO: 83495 - DNA, 22 bp, Homo sapiens
tgatatgtaactactccttata

SEQ ID NO: 83496 - DNA, 22 bp, Homo sapiens
gttggctatgagagctttagtg

SEQ ID NO: 83497 - DNA, 22 bp, Homo sapiens
cgcccaggctggagtgcagtga

SEQ ID NO: 83498 - DNA, 22 bp, Homo sapiens
aggctgaggcaagaggatcact

SEQ ID NO: 83499 - DNA, 22 bp, Homo sapiens
aagaggttgtctgtgatgagtt

SEQ ID NO: 83500 - DNA, 22 bp, Homo sapiens
actggacagaggaaatatggag

SEQ ID NO: 83501 - DNA, 22 bp, Homo sapiens
tggtgcaaaactaattgcggtt

SEQ ID NO: 83502 - DNA, 22 bp, Homo sapiens
agagtggagagaaacaactctg

SEQ ID NO: 83503 - DNA, 22 bp, Homo sapiens
agaggccgggtgcctgctcaga

SEQ ID NO: 83504 - DNA, 22 bp, Homo sapiens
tgcttctgactaagctgcatga

SEQ ID NO: 83505 - DNA, 22 bp, Homo sapiens
aaagaggcaatcaatgtagcaa

SEQ ID NO: 83506 - DNA, 22 bp, Homo sapiens
tgcctaggctggagtgcaatgg

SEQ ID NO: 83507 - DNA, 22 bp, Homo sapiens
ggcaaggggtcaggctgagaca

SEQ ID NO: 83508 - DNA, 22 bp, Homo sapiens
tctttgctattgtgaatagtgc

SEQ ID NO: 83509 - DNA, 22 bp, Homo sapiens
cagcaggaggtgagtagcaggt

SEQ ID NO: 83510 - DNA, 22 bp, Homo sapiens
gatgtagacacttggaggctta

SEQ ID NO: 83511 - DNA, 22 bp, Homo sapiens
ggcagggagtggagactcccta

SEQ ID NO: 83512 - DNA, 22 bp, Homo sapiens
acttgccccagaattgctgctg

SEQ ID NO: 83513 - DNA, 22 bp, Homo sapiens
cattaaacaaccttgaatcaat

SEQ ID NO: 83514 - DNA, 22 bp, Homo sapiens
tagatttgtttccttctctcca

SEQ ID NO: 83515 - DNA, 19 bp, Homo sapiens
tggctctgtcgaaggcaca

SEQ ID NO: 83516 - DNA, 22 bp, Homo sapiens
aagagggctgcaatcttattgc

SEQ ID NO: 83517 - DNA, 22 bp, Homo sapiens
tgagcaggcgcagcaggaggtc

SEQ ID NO: 83518 - DNA, 22 bp, Homo sapiens
agaaatatgctgattagatgaa

SEQ ID NO: 83519 - DNA, 22 bp, Homo sapiens
tggcccgaagatccgagggtca

SEQ ID NO: 83520 - DNA, 22 bp, Homo sapiens
tttctcggcagagatgatgggc

SEQ ID NO: 83521 - DNA, 22 bp, Homo sapiens
tctcctggagcccagatgctgg

SEQ ID NO: 83522 - DNA, 21 bp, Homo sapiens
caatggcgagatcttggctca

SEQ ID NO: 83523 - DNA, 22 bp, Homo sapiens
agaggctgcacttgctcatgat

SEQ ID NO: 83524 - DNA, 22 bp, Homo sapiens
cttgtctgctataaaaatccag

SEQ ID NO: 83525 - DNA, 22 bp, Homo sapiens
gttggtgagtttctgatcacaa

SEQ ID NO: 83526 - DNA, 22 bp, Homo sapiens
tttgagtgcccatgtttcccag

SEQ ID NO: 83527 - DNA, 21 bp, Homo sapiens
cgcagagcgaacttgcggcgc

SEQ ID NO: 83528 - DNA, 22 bp, Homo sapiens
actgatcaagggtttaatttta

SEQ ID NO: 83529 - DNA, 23 bp, Homo sapiens
ggcctcagtgatgatgggttaaa

SEQ ID NO: 83530 - DNA, 22 bp, Homo sapiens
cttccgtgtcagttccaggtgg

SEQ ID NO: 83531 - DNA, 22 bp, Homo sapiens
agcccttggtattttccgatcc

SEQ ID NO: 83532 - DNA, 22 bp, Homo sapiens
gaatgcttggaacctgaagttc

SEQ ID NO: 83533 - DNA, 21 bp, Homo sapiens
gttgtggttggggctgcagct

SEQ ID NO: 83534 - DNA, 22 bp, Homo sapiens
agagctaagaaacagaattgct

SEQ ID NO: 83535 - DNA, 22 bp, Homo sapiens
tggagtgcaatagtaataaggt

SEQ ID NO: 83536 - DNA, 22 bp, Homo sapiens
tggcacgacaattggcaccaat

SEQ ID NO: 83537 - DNA, 22 bp, Homo sapiens
cactgctacctctgcctcccgg

SEQ ID NO: 83538 - DNA, 22 bp, Homo sapiens
acactgcagatgaaagcataag

SEQ ID NO: 83539 - DNA, 18 bp, Homo sapiens
ccctcttgcacaaagcaa

SEQ ID NO: 83540 - DNA, 22 bp, Homo sapiens
gtagtcccagctaccccggagg

SEQ ID NO: 83541 - DNA, 22 bp, Homo sapiens
cagagctggtgtgtcctggcat

SEQ ID NO: 83542 - DNA, 22 bp, Homo sapiens
tgatttacagtagtgtctaaac

SEQ ID NO: 83543 - DNA, 22 bp, Homo sapiens
tttcttcctgctttgtcccatg

SEQ ID NO: 83544 - DNA, 22 bp, Homo sapiens
ctgaggtgtgaaatggtggcaa

SEQ ID NO: 83545 - DNA, 22 bp, Homo sapiens
gaggctgaggcaggaggatcac

SEQ ID NO: 83546 - DNA, 22 bp, Homo sapiens
ccaggaggcagaagttgcagtg

SEQ ID NO: 83547 - DNA, 22 bp, Homo sapiens
gtgggccactgggaggcaaggg

SEQ ID NO: 83548 - DNA, 22 bp, Homo sapiens
gcactttgcccctcctttggca

SEQ ID NO: 83549 - DNA, 22 bp, Homo sapiens
ctgcgttctgcctggcggccta

SEQ ID NO: 83550 - DNA, 22 bp, Homo sapiens
gagatggagtctttttctgtca

SEQ ID NO: 83551 - DNA, 22 bp, Homo sapiens
attctaatggcagagactcctg

SEQ ID NO: 83552 - DNA, 22 bp, Homo sapiens
aggtgcttggctcgtgcacaca

SEQ ID NO: 83553 - DNA, 22 bp, Homo sapiens
tgagcctgggagatggaggctg

SEQ ID NO: 83554 - DNA, 22 bp, Homo sapiens
ggaggaggggtgactgaatgct

SEQ ID NO: 83555 - DNA, 22 bp, Homo sapiens
tcttgaattgtactcccataag

SEQ ID NO: 83556 - DNA, 22 bp, Homo sapiens
acaattctgatggtttcccagt

SEQ ID NO: 83557 - DNA, 22 bp, Homo sapiens
tctgagctccatgcaggaggct

SEQ ID NO: 83558 - DNA, 22 bp, Homo sapiens
tcttcccccgtgctccagtgca

SEQ ID NO: 83559 - DNA, 22 bp, Homo sapiens
tgctggtaccgcgcctccgcca

SEQ ID NO: 83560 - DNA, 22 bp, Homo sapiens
tgtgctctgactttctcctggt

SEQ ID NO: 83561 - DNA, 22 bp, Homo sapiens
gacaggcttccactatgttgcc

SEQ ID NO: 83562 - DNA, 22 bp, Homo sapiens
aaggctgagacagcacaggtcc

SEQ ID NO: 83563 - DNA, 22 bp, Homo sapiens
ccagtggctacaggggggttga

SEQ ID NO: 83564 - DNA, 22 bp, Homo sapiens
cttatcttacttccccttcatg

SEQ ID NO: 83565 - DNA, 22 bp, Homo sapiens
agtgttgtcaaacggctcagca

SEQ ID NO: 83566 - DNA, 22 bp, Homo sapiens
gaccttgtgatccacctgcctt

SEQ ID NO: 83567 - DNA, 22 bp, Homo sapiens
aatgcaccttggcagggattca

SEQ ID NO: 83568 - DNA, 22 bp, Homo sapiens
attaagactgcccatgttttta

SEQ ID NO: 83569 - DNA, 22 bp, Homo sapiens
tgggactcactcttttggccag

SEQ ID NO: 83570 - DNA, 22 bp, Homo sapiens
gcaactgaacatgtgtgtggcc

SEQ ID NO: 83571 - DNA, 22 bp, Homo sapiens
tgggaggccgaggcaggtggat

SEQ ID NO: 83572 - DNA, 22 bp, Homo sapiens
tcctggtcttcaggttgcaaaa

SEQ ID NO: 83573 - DNA, 22 bp, Homo sapiens
aggccaggaatccttgtcccag

SEQ ID NO: 83574 - DNA, 22 bp, Homo sapiens
ttcagcttgctgactgcggcag

SEQ ID NO: 83575 - DNA, 22 bp, Homo sapiens
tttgcttgttcaagatttctgt

SEQ ID NO: 83576 - DNA, 22 bp, Homo sapiens
tgctgggattacagtcatgagc

SEQ ID NO: 83577 - DNA, 22 bp, Homo sapiens
acagagcaataacagggagagg

SEQ ID NO: 83578 - DNA, 22 bp, Homo sapiens
tgccatagcaatggtaagctga

SEQ ID NO: 83579 - DNA, 21 bp, Homo sapiens
tacaatgcacaggagagcctc

SEQ ID NO: 83580 - DNA, 22 bp, Homo sapiens
gaccttgtgatctgcccacctt

SEQ ID NO: 83581 - DNA, 22 bp, Homo sapiens
tcccagaaccctgccaggtcct

SEQ ID NO: 83582 - DNA, 22 bp, Homo sapiens
attgagaagaaaatctaatata

SEQ ID NO: 83583 - DNA, 22 bp, Homo sapiens
taaagttggacctgattttatt

SEQ ID NO: 83584 - DNA, 18 bp, Homo sapiens
ttcacaagggcttggttt

SEQ ID NO: 83585 - DNA, 20 bp, Homo sapiens
gacatgtctttctcacacaa

SEQ ID NO: 83586 - DNA, 22 bp, Homo sapiens
gcccccgaggaggtgatgtcgc

SEQ ID NO: 83587 - DNA, 22 bp, Homo sapiens
ctgggcctggggctgttgagag

SEQ ID NO: 83588 - DNA, 22 bp, Homo sapiens
gggattacagatgtgagccatt

SEQ ID NO: 83589 - DNA, 22 bp, Homo sapiens
acagattcactgcactggccat

SEQ ID NO: 83590 - DNA, 22 bp, Homo sapiens
gaccctctagatggaagcactg

SEQ ID NO: 83591 - DNA, 22 bp, Homo sapiens
ctggcctggcgcagtggctcac

SEQ ID NO: 83592 - DNA, 22 bp, Homo sapiens
tgatgaccgccaacgtttaggt

SEQ ID NO: 83593 - DNA, 22 bp, Homo sapiens
gtagatgagctcacatgacctt

SEQ ID NO: 83594 - DNA, 22 bp, Homo sapiens
ggctgagtctgtgacccatgcg

SEQ ID NO: 83595 - DNA, 22 bp, Homo sapiens
caaagctggaaaaggaggctgg

SEQ ID NO: 83596 - DNA, 22 bp, Homo sapiens
caagaatcaacattatttagtg

SEQ ID NO: 83597 - DNA, 22 bp, Homo sapiens
gcggcggagacagcaggaagcc

SEQ ID NO: 83598 - DNA, 20 bp, Homo sapiens
aactcctagcctcaagtgat

SEQ ID NO: 83599 - DNA, 22 bp, Homo sapiens
acccgggaggcaggagtcatag

SEQ ID NO: 83600 - DNA, 22 bp, Homo sapiens
caggctggagttcagtggtgtg

SEQ ID NO: 83601 - DNA, 22 bp, Homo sapiens
ttgtcttttgtgggaaatatgg

SEQ ID NO: 83602 - DNA, 22 bp, Homo sapiens
cactgcactccagcttgggcaa

SEQ ID NO: 83603 - DNA, 22 bp, Homo sapiens
agggtggcactggtggctctat

SEQ ID NO: 83604 - DNA, 22 bp, Homo sapiens
ggcagacctctccagccccaca

SEQ ID NO: 83605 - DNA, 22 bp, Homo sapiens
gccaggctgaggctctggaaga

SEQ ID NO: 83606 - DNA, 22 bp, Homo sapiens
ttaccaaatgaaatagagattt

SEQ ID NO: 83607 - DNA, 22 bp, Homo sapiens
tccccagcttgctacttctgct

SEQ ID NO: 83608 - DNA, 22 bp, Homo sapiens
cggctggtgtcgggcacagcaa

SEQ ID NO: 83609 - DNA, 22 bp, Homo sapiens
aacatgatttcatgcatttaga

SEQ ID NO: 83610 - DNA, 22 bp, Homo sapiens
tttcaacagatctgtcttcagg

SEQ ID NO: 83611 - DNA, 22 bp, Homo sapiens
atcattatcctcctatttgcct

SEQ ID NO: 83612 - DNA, 22 bp, Homo sapiens
ttgggctcaggagtttgagacc

SEQ ID NO: 83613 - DNA, 22 bp, Homo sapiens
tagctaccattattgagcacct

SEQ ID NO: 83614 - DNA, 22 bp, Homo sapiens
gggcggatcatttgaggtcagg

SEQ ID NO: 83615 - DNA, 22 bp, Homo sapiens
cgggcgcactccgggcagctgt

SEQ ID NO: 83616 - DNA, 22 bp, Homo sapiens
gttcaagaccagcctggccaac

SEQ ID NO: 83617 - DNA, 22 bp, Homo sapiens
cccaggaggcctgcctggccgg

SEQ ID NO: 83618 - DNA, 22 bp, Homo sapiens
ggtgaggggctcctctgcccgg

SEQ ID NO: 83619 - DNA, 22 bp, Homo sapiens
ctgcagggagaggggacagcct

SEQ ID NO: 83620 - DNA, 22 bp, Homo sapiens
gtggctcacgcctgtaatccca

SEQ ID NO: 83621 - DNA, 22 bp, Homo sapiens
tttgcattgcattaagtattct

SEQ ID NO: 83622 - DNA, 22 bp, Homo sapiens
gtgctccctccttcctcaagga

SEQ ID NO: 83623 - DNA, 22 bp, Homo sapiens
agacagggtgatcgcttgagcc

SEQ ID NO: 83624 - DNA, 22 bp, Homo sapiens
tgggagaaagaaccctgagtga

SEQ ID NO: 83625 - DNA, 22 bp, Homo sapiens
tcactgcactccagcctgggtg

SEQ ID NO: 83626 - DNA, 22 bp, Homo sapiens
ctgggcagctgtatcagggagt

SEQ ID NO: 83627 - DNA, 22 bp, Homo sapiens
cccattcatcctcgcttccttc

SEQ ID NO: 83628 - DNA, 22 bp, Homo sapiens
ttgtgaatggtgccgcaataaa

SEQ ID NO: 83629 - DNA, 22 bp, Homo sapiens
gcagggaggtttgctgacctgg

SEQ ID NO: 83630 - DNA, 22 bp, Homo sapiens
gctgtctcatacaaggccctgc

SEQ ID NO: 83631 - DNA, 22 bp, Homo sapiens
tgcagtttaaacttggcaactt

SEQ ID NO: 83632 - DNA, 22 bp, Homo sapiens
aggctatttccactcttctcat

SEQ ID NO: 83633 - DNA, 22 bp, Homo sapiens
ctgaggcctctcccactccagc

SEQ ID NO: 83634 - DNA, 22 bp, Homo sapiens
cagggcctcctaaggcatctaa

SEQ ID NO: 83635 - DNA, 22 bp, Homo sapiens
tgtcatctgcgggtggcactgc

SEQ ID NO: 83636 - DNA, 20 bp, Homo sapiens
cagcctgcatcatctgcagc

SEQ ID NO: 83637 - DNA, 22 bp, Homo sapiens
aagaagcattctttcattggtt

SEQ ID NO: 83638 - DNA, 23 bp, Homo sapiens
ccaagactgttaggagtggggag

SEQ ID NO: 83639 - DNA, 22 bp, Homo sapiens
ccaccagctgcatatgcacgta

SEQ ID NO: 83640 - DNA, 22 bp, Homo sapiens
tttctgagaaattaaacacttt

SEQ ID NO: 83641 - DNA, 22 bp, Homo sapiens
acgcctgtaatcccagcacttt

SEQ ID NO: 83642 - DNA, 22 bp, Homo sapiens
ggctcatatcccggccatcatt

SEQ ID NO: 83643 - DNA, 21 bp, Homo sapiens
ctctgtttgcctgctgccatc

SEQ ID NO: 83644 - DNA, 20 bp, Homo sapiens
tcacatcctctcccaacatg

SEQ ID NO: 83645 - DNA, 22 bp, Homo sapiens
tagtttaggatccaatctaaga

SEQ ID NO: 83646 - DNA, 22 bp, Homo sapiens
ttgcttcttagatattcctctc

SEQ ID NO: 83647 - DNA, 22 bp, Homo sapiens
cacactgtctttcagaatggtt

SEQ ID NO: 83648 - DNA, 22 bp, Homo sapiens
tgctgagcccagaacggcctgg

SEQ ID NO: 83649 - DNA, 22 bp, Homo sapiens
tcactgcaagctcagcctcccg

SEQ ID NO: 83650 - DNA, 22 bp, Homo sapiens
cccaggaggcagagatagcagt

SEQ ID NO: 83651 - DNA, 22 bp, Homo sapiens
gctgcagacttctcatctcatt

SEQ ID NO: 83652 - DNA, 22 bp, Homo sapiens
ggttttatcctacccacacagc

SEQ ID NO: 83653 - DNA, 22 bp, Homo sapiens
ctgagccaaggggacagtgaca

SEQ ID NO: 83654 - DNA, 22 bp, Homo sapiens
gagctcattcattcattgcctg

SEQ ID NO: 83655 - DNA, 22 bp, Homo sapiens
atacctgtgtatccacaagcgt

SEQ ID NO: 83656 - DNA, 22 bp, Homo sapiens
ggagagcagggaggctgctctg

SEQ ID NO: 83657 - DNA, 22 bp, Homo sapiens
gatgcagtgcttaaatcatttg

SEQ ID NO: 83658 - DNA, 22 bp, Homo sapiens
gttaggtagaagtttactttga

SEQ ID NO: 83659 - DNA, 22 bp, Homo sapiens
tctggcttccctctgttctggg

SEQ ID NO: 83660 - DNA, 22 bp, Homo sapiens
caagtagaacagagctaccttg

SEQ ID NO: 83661 - DNA, 22 bp, Homo sapiens
agtccaaagcagatgagggcca

SEQ ID NO: 83662 - DNA, 22 bp, Homo sapiens
tcctcagcttttatttcacttg

SEQ ID NO: 83663 - DNA, 22 bp, Homo sapiens
agggaattcactggaacgccct

SEQ ID NO: 83664 - DNA, 22 bp, Homo sapiens
ccagaaaaatcctcccttgtcc

SEQ ID NO: 83665 - DNA, 22 bp, Homo sapiens
aaacttttttaggttcataggc

SEQ ID NO: 83666 - DNA, 19 bp, Homo sapiens
tcctgcctggggccgcctg

SEQ ID NO: 83667 - DNA, 22 bp, Homo sapiens
gaaaggagagggttaaggagct

SEQ ID NO: 83668 - DNA, 22 bp, Homo sapiens
gctgtagtgaatggccgcgttc

SEQ ID NO: 83669 - DNA, 22 bp, Homo sapiens
tcaccaggctagagtgcagtgg

SEQ ID NO: 83670 - DNA, 22 bp, Homo sapiens
cacgggagacgtgatcttggac

SEQ ID NO: 83671 - DNA, 22 bp, Homo sapiens
cttgtagaattgaaatggtctc

SEQ ID NO: 83672 - DNA, 22 bp, Homo sapiens
tacctcaagttccaggaaagcg

SEQ ID NO: 83673 - DNA, 22 bp, Homo sapiens
gctcactgcaagctccgcctcc

SEQ ID NO: 83674 - DNA, 22 bp, Homo sapiens
gaggctgaggcggatggatcac

SEQ ID NO: 83675 - DNA, 22 bp, Homo sapiens
gccgggttcaagccattctcct

SEQ ID NO: 83676 - DNA, 22 bp, Homo sapiens
ctgtggccagagcgccgttgac

SEQ ID NO: 83677 - DNA, 22 bp, Homo sapiens
accatgttggccaagctggtct

SEQ ID NO: 83678 - DNA, 22 bp, Homo sapiens
aagggggcggcagccagtggaa

SEQ ID NO: 83679 - DNA, 22 bp, Homo sapiens
ccaggcaggcgatggtgcagtg

SEQ ID NO: 83680 - DNA, 22 bp, Homo sapiens
cggagtcttgctatgttgccca

SEQ ID NO: 83681 - DNA, 22 bp, Homo sapiens
gcagcgaggtgatgaaatagct

SEQ ID NO: 83682 - DNA, 22 bp, Homo sapiens
tagggggctttgctgcttgaca

SEQ ID NO: 83683 - DNA, 22 bp, Homo sapiens
tctagctctgcttatcatggct

SEQ ID NO: 83684 - DNA, 22 bp, Homo sapiens
gatctggaatctgaaggctgag

SEQ ID NO: 83685 - DNA, 22 bp, Homo sapiens
gagagcaggaggcagcgggacg

SEQ ID NO: 83686 - DNA, 22 bp, Homo sapiens
tttgtagcagcatgatttataa

SEQ ID NO: 83687 - DNA, 22 bp, Homo sapiens
tcgtctgtgaaattgggataag

SEQ ID NO: 83688 - DNA, 23 bp, Homo sapiens
ttgcttagagacctcctcatcag

SEQ ID NO: 83689 - DNA, 22 bp, Homo sapiens
tgcagtcttccagctgcacaaa

SEQ ID NO: 83690 - DNA, 22 bp, Homo sapiens
cttgctttcagtctcggcctca

SEQ ID NO: 83691 - DNA, 22 bp, Homo sapiens
ccagggatgcagaggttgcagt

SEQ ID NO: 83692 - DNA, 22 bp, Homo sapiens
tgcactactgtgatacacagcc

SEQ ID NO: 83693 - DNA, 22 bp, Homo sapiens
atgagttgaagctacaagaggc

SEQ ID NO: 83694 - DNA, 22 bp, Homo sapiens
tcactgcactccagcctgggca

SEQ ID NO: 83695 - DNA, 22 bp, Homo sapiens
tgagccagaggaggctgtgtgg

SEQ ID NO: 83696 - DNA, 22 bp, Homo sapiens
gggagaagaatgtgtcaattgt

SEQ ID NO: 83697 - DNA, 22 bp, Homo sapiens
tgaagtgtcatttacatttcta

SEQ ID NO: 83698 - DNA, 22 bp, Homo sapiens
cgccaggcttggtagctcatgc

SEQ ID NO: 83699 - DNA, 22 bp, Homo sapiens
atgcagttccacaggcgcatgg

SEQ ID NO: 83700 - DNA, 23 bp, Homo sapiens
gacagagtgagaccttgtcttac

SEQ ID NO: 83701 - DNA, 22 bp, Homo sapiens
tttgtgaataggttggcttcca

SEQ ID NO: 83702 - DNA, 22 bp, Homo sapiens
ccgcgccacccattcccactga

SEQ ID NO: 83703 - DNA, 22 bp, Homo sapiens
ggtggcagtagcactgggcctg

SEQ ID NO: 83704 - DNA, 22 bp, Homo sapiens
gagatgcagaaccctcaggagc

SEQ ID NO: 83705 - DNA, 22 bp, Homo sapiens
caggcagaagaagtggaaggac

SEQ ID NO: 83706 - DNA, 22 bp, Homo sapiens
gagggaaaggttaatacatgat

SEQ ID NO: 83707 - DNA, 23 bp, Homo sapiens
ggctgggagctccgggtgcacgt

SEQ ID NO: 83708 - DNA, 22 bp, Homo sapiens
caaagtgctaggattacaggcc

SEQ ID NO: 83709 - DNA, 22 bp, Homo sapiens
gtcctggggattatagagtgtt

SEQ ID NO: 83710 - DNA, 22 bp, Homo sapiens
ctccccattatgcagtcattat

SEQ ID NO: 83711 - DNA, 22 bp, Homo sapiens
ttttacctgaaccacacagtat

SEQ ID NO: 83712 - DNA, 22 bp, Homo sapiens
tggctaacaaggtgaaaccccg

SEQ ID NO: 83713 - DNA, 22 bp, Homo sapiens
cctgcctatgagacgttttgcc

SEQ ID NO: 83714 - DNA, 22 bp, Homo sapiens
ttgggctgaaccctgcagctga

SEQ ID NO: 83715 - DNA, 22 bp, Homo sapiens
actgtgtgtttgtctagcacag

SEQ ID NO: 83716 - DNA, 22 bp, Homo sapiens
gaggtgggtgtatcacaggtca

SEQ ID NO: 83717 - DNA, 22 bp, Homo sapiens
aggcaatcccctgaggatactt

SEQ ID NO: 83718 - DNA, 22 bp, Homo sapiens
cactaggctggagtgcagtggc

SEQ ID NO: 83719 - DNA, 22 bp, Homo sapiens
tctcagaacctcagtttgctct

SEQ ID NO: 83720 - DNA, 22 bp, Homo sapiens
ctacattaaattggcttactta

SEQ ID NO: 83721 - DNA, 22 bp, Homo sapiens
gctgtggcctggcgcagagctg

SEQ ID NO: 83722 - DNA, 22 bp, Homo sapiens
gttgctcaggcaggagtacagt

SEQ ID NO: 83723 - DNA, 22 bp, Homo sapiens
gaggggagcccccatcctccag

SEQ ID NO: 83724 - DNA, 22 bp, Homo sapiens
cagcctgccgtcagccaggtag

SEQ ID NO: 83725 - DNA, 22 bp, Homo sapiens
ggtgcagaggagccagctgggg

SEQ ID NO: 83726 - DNA, 20 bp, Homo sapiens
attagagctacatggctaca

SEQ ID NO: 83727 - DNA, 22 bp, Homo sapiens
catgtgaattccaaagctaggt

SEQ ID NO: 83728 - DNA, 22 bp, Homo sapiens
ccctgcctacagggttttcttt

SEQ ID NO: 83729 - DNA, 22 bp, Homo sapiens
tctgagaatggtggatgtggtg

SEQ ID NO: 83730 - DNA, 22 bp, Homo sapiens
ggcttggaccagtcacagtggt

SEQ ID NO: 83731 - DNA, 22 bp, Homo sapiens
ccctcccagatgggcttgaggt

SEQ ID NO: 83732 - DNA, 22 bp, Homo sapiens
cgatggtatcggccagccccgg

SEQ ID NO: 83733 - DNA, 22 bp, Homo sapiens
cagtggcgtgatctctgctcac

SEQ ID NO: 83734 - DNA, 22 bp, Homo sapiens
agagtactgcctcagttatgaa

SEQ ID NO: 83735 - DNA, 22 bp, Homo sapiens
tcaccttgtgatctccctgcct

SEQ ID NO: 83736 - DNA, 16 bp, Homo sapiens
cttgtctgttgctcat

SEQ ID NO: 83737 - DNA, 22 bp, Homo sapiens
tggagaagattggtcaccattc

SEQ ID NO: 83738 - DNA, 22 bp, Homo sapiens
tggttcctcaagcgctggcggc

SEQ ID NO: 83739 - DNA, 22 bp, Homo sapiens
cctgagagcattccacactgaa

SEQ ID NO: 83740 - DNA, 22 bp, Homo sapiens
tgtctcatctcttaaccccact

SEQ ID NO: 83741 - DNA, 22 bp, Homo sapiens
aaagaaatagatggcatttaaa

SEQ ID NO: 83742 - DNA, 22 bp, Homo sapiens
aagaggtttaactgactcacag

SEQ ID NO: 83743 - DNA, 22 bp, Homo sapiens
aaattagtgcaccaggttgaag

SEQ ID NO: 83744 - DNA, 22 bp, Homo sapiens
aagtcattggtagcttgatagg

SEQ ID NO: 83745 - DNA, 22 bp, Homo sapiens
catctgtaaagtaggaatattg

SEQ ID NO: 83746 - DNA, 22 bp, Homo sapiens
ggatgttctggggttctcttgt

SEQ ID NO: 83747 - DNA, 22 bp, Homo sapiens
cagcccaggactgcaggtgttt

SEQ ID NO: 83748 - DNA, 22 bp, Homo sapiens
gctggccacagatccccaggga

SEQ ID NO: 83749 - DNA, 21 bp, Homo sapiens
ggtgacacgtggccccgctct

SEQ ID NO: 83750 - DNA, 22 bp, Homo sapiens
tggggcagttaataaacattct

SEQ ID NO: 83751 - DNA, 22 bp, Homo sapiens
attgaaaataaggccagaaaca

SEQ ID NO: 83752 - DNA, 22 bp, Homo sapiens
gcccagctgcaccctggtgggt

SEQ ID NO: 83753 - DNA, 22 bp, Homo sapiens
ggtcccaggttgacagggagac

SEQ ID NO: 83754 - DNA, 20 bp, Homo sapiens
tgaggcccagcagagtcggg

SEQ ID NO: 83755 - DNA, 21 bp, Homo sapiens
cagaggcctatcacagactcc

SEQ ID NO: 83756 - DNA, 22 bp, Homo sapiens
aatcacacaaaggcaacttttg

SEQ ID NO: 83757 - DNA, 22 bp, Homo sapiens
taggattccagaacagtgctgc

SEQ ID NO: 83758 - DNA, 22 bp, Homo sapiens
aaagaaggtagggctggtgact

SEQ ID NO: 83759 - DNA, 22 bp, Homo sapiens
actctccttttgatcttcagaa

SEQ ID NO: 83760 - DNA, 22 bp, Homo sapiens
gaggctgaggttgcagtgagct

SEQ ID NO: 83761 - DNA, 22 bp, Homo sapiens
cctgagtagctggaattaaagg

SEQ ID NO: 83762 - DNA, 22 bp, Homo sapiens
ggcttcagtggccagagatgat

SEQ ID NO: 83763 - DNA, 22 bp, Homo sapiens
agtgctatcgagttctaatgct

SEQ ID NO: 83764 - DNA, 22 bp, Homo sapiens
ttttctaacatctagtaatttg

SEQ ID NO: 83765 - DNA, 22 bp, Homo sapiens
cttttcattgtttgtacatgca

SEQ ID NO: 83766 - DNA, 22 bp, Homo sapiens
gggcaggggtcagtggccccaa

SEQ ID NO: 83767 - DNA, 22 bp, Homo sapiens
attggtggtgaggacatgccag

SEQ ID NO: 83768 - DNA, 22 bp, Homo sapiens
ccctcccaggagtggccagaga

SEQ ID NO: 83769 - DNA, 22 bp, Homo sapiens
gggacgacaggctctgtggtag

SEQ ID NO: 83770 - DNA, 22 bp, Homo sapiens
gaaaattattgaaaatggctct

SEQ ID NO: 83771 - DNA, 22 bp, Homo sapiens
ccttttgctctcccatccagaa

SEQ ID NO: 83772 - DNA, 22 bp, Homo sapiens
aggagctgtcagagtgccagag

SEQ ID NO: 83773 - DNA, 22 bp, Homo sapiens
ttaggctgttcttgtgttgtta

SEQ ID NO: 83774 - DNA, 22 bp, Homo sapiens
gtggagagagataagcctggtc

SEQ ID NO: 83775 - DNA, 22 bp, Homo sapiens
catagcggtattccacgtggtt

SEQ ID NO: 83776 - DNA, 22 bp, Homo sapiens
taacaaagtattgtttgtgtat

SEQ ID NO: 83777 - DNA, 22 bp, Homo sapiens
tgaactcctgacctcatgatcc

SEQ ID NO: 83778 - DNA, 22 bp, Homo sapiens
gagaaatatggctcagttccac

SEQ ID NO: 83779 - DNA, 22 bp, Homo sapiens
cgggcaaggcgagactaggccc

SEQ ID NO: 83780 - DNA, 22 bp, Homo sapiens
gtttcgtcaggcttattctatc

SEQ ID NO: 83781 - DNA, 22 bp, Homo sapiens
gagagtctagtgcacctagttt

SEQ ID NO: 83782 - DNA, 22 bp, Homo sapiens
aggtgggcggattcatgaggtc

SEQ ID NO: 83783 - DNA, 22 bp, Homo sapiens
gcctccggagtcacagtgtctt

SEQ ID NO: 83784 - DNA, 22 bp, Homo sapiens
cccaggggttctgagcagcagc

SEQ ID NO: 83785 - DNA, 20 bp, Homo sapiens
gaaatgtacacattaccaca

SEQ ID NO: 83786 - DNA, 22 bp, Homo sapiens
aggagggagcttaagccaggca

SEQ ID NO: 83787 - DNA, 22 bp, Homo sapiens
ctccagattccgtttattcagg

SEQ ID NO: 83788 - DNA, 22 bp, Homo sapiens
gtgcatgtgtctttatagtagc

SEQ ID NO: 83789 - DNA, 22 bp, Homo sapiens
cagaggctggcggccgccccga

SEQ ID NO: 83790 - DNA, 22 bp, Homo sapiens
gactggaaagcctgtcctcaga

SEQ ID NO: 83791 - DNA, 22 bp, Homo sapiens
caaatgaatatttccatgggtt

SEQ ID NO: 83792 - DNA, 22 bp, Homo sapiens
ccaagtgttttataagggacag

SEQ ID NO: 83793 - DNA, 22 bp, Homo sapiens
cacagacagtgtccctttgttg

SEQ ID NO: 83794 - DNA, 22 bp, Homo sapiens
gggcggggtggctcatgcctgt

SEQ ID NO: 83795 - DNA, 22 bp, Homo sapiens
aagaggtaaccatagcaaccac

SEQ ID NO: 83796 - DNA, 21 bp, Homo sapiens
acagcctccatctcctgggct

SEQ ID NO: 83797 - DNA, 22 bp, Homo sapiens
tgtgagcagagacatgaaaagc

SEQ ID NO: 83798 - DNA, 21 bp, Homo sapiens
tgactgaggcttcttcacaca

SEQ ID NO: 83799 - DNA, 22 bp, Homo sapiens
cttgcagtttaggtcctctgtg

SEQ ID NO: 83800 - DNA, 22 bp, Homo sapiens
tcactgcaacctccgcctgctg

SEQ ID NO: 83801 - DNA, 22 bp, Homo sapiens
ttacaattacttgatctcagct

SEQ ID NO: 83802 - DNA, 22 bp, Homo sapiens
ggccaattccaggagccggcgg

SEQ ID NO: 83803 - DNA, 22 bp, Homo sapiens
gacggagctggttgctgcggct

SEQ ID NO: 83804 - DNA, 22 bp, Homo sapiens
tctgaaaactccatgagctcgt

SEQ ID NO: 83805 - DNA, 22 bp, Homo sapiens
gcagaagcacaggtgacgggcc

SEQ ID NO: 83806 - DNA, 22 bp, Homo sapiens
tccagggccatctccatgaggc

SEQ ID NO: 83807 - DNA, 22 bp, Homo sapiens
ctgggaggtggaggttgcattg

SEQ ID NO: 83808 - DNA, 23 bp, Homo sapiens
aaataggagtatctggatcatga

SEQ ID NO: 83809 - DNA, 22 bp, Homo sapiens
ccatcacagtccccatcgtgat

SEQ ID NO: 83810 - DNA, 22 bp, Homo sapiens
ggcaagagggcagatggagtgc

SEQ ID NO: 83811 - DNA, 21 bp, Homo sapiens
ccaccaggtcttctgctcggg

SEQ ID NO: 83812 - DNA, 22 bp, Homo sapiens
ccaggaggttgaggctgcagtg

SEQ ID NO: 83813 - DNA, 22 bp, Homo sapiens
gacctccgtgtacacctcccag

SEQ ID NO: 83814 - DNA, 22 bp, Homo sapiens
tgaggcaggtggattacaaggt

SEQ ID NO: 83815 - DNA, 22 bp, Homo sapiens
tcttctatcctcagcccctgcc

SEQ ID NO: 83816 - DNA, 22 bp, Homo sapiens
taaatgttgtaagtacatctaa

SEQ ID NO: 83817 - DNA, 17 bp, Homo sapiens
cgggcatggagggcagg

SEQ ID NO: 83818 - DNA, 22 bp, Homo sapiens
gagagtctaggaacctcatata

SEQ ID NO: 83819 - DNA, 22 bp, Homo sapiens
caggagctcagatgacatctca

SEQ ID NO: 83820 - DNA, 22 bp, Homo sapiens
aataaaatggtcagttttctca

SEQ ID NO: 83821 - DNA, 22 bp, Homo sapiens
cccaggagttagaggttgtggt

SEQ ID NO: 83822 - DNA, 22 bp, Homo sapiens
ttttctcttccctctggacctg

SEQ ID NO: 83823 - DNA, 22 bp, Homo sapiens
cactgcaacctccacctcctgg

SEQ ID NO: 83824 - DNA, 22 bp, Homo sapiens
aacagtgtttttcttcagcact

SEQ ID NO: 83825 - DNA, 22 bp, Homo sapiens
gacagacacaattgatccatga

SEQ ID NO: 83826 - DNA, 22 bp, Homo sapiens
gaggcagaggttgcagtgagct

SEQ ID NO: 83827 - DNA, 18 bp, Homo sapiens
cccggctaatttttggta

SEQ ID NO: 83828 - DNA, 22 bp, Homo sapiens
atttactttgctgagatccatc

SEQ ID NO: 83829 - DNA, 22 bp, Homo sapiens
gcgaggaggggtgctgggcccc

SEQ ID NO: 83830 - DNA, 22 bp, Homo sapiens
acaggatcgccctgttgcccag

SEQ ID NO: 83831 - DNA, 23 bp, Homo sapiens
gggtccagccaattccaaggaaa

SEQ ID NO: 83832 - DNA, 22 bp, Homo sapiens
ggcggaggttgcagtaagccga

SEQ ID NO: 83833 - DNA, 23 bp, Homo sapiens
actcgtggaattctctgcgatcg

SEQ ID NO: 83834 - DNA, 22 bp, Homo sapiens
ctgaggaggctaatttgaggat

SEQ ID NO: 83835 - DNA, 22 bp, Homo sapiens
cttcatgctgatatcctcgatg

SEQ ID NO: 83836 - DNA, 22 bp, Homo sapiens
aggggttggacataagacagaa

SEQ ID NO: 83837 - DNA, 22 bp, Homo sapiens
taactaggattacaagcgtgcg

SEQ ID NO: 83838 - DNA, 22 bp, Homo sapiens
taacatttaaatttttcacata

SEQ ID NO: 83839 - DNA, 22 bp, Homo sapiens
ccagaagcagagcctgaggcag

SEQ ID NO: 83840 - DNA, 22 bp, Homo sapiens
gagtgcagtggcgtgatctctg

SEQ ID NO: 83841 - DNA, 22 bp, Homo sapiens
ggaaggggtgggtgagcctcag

SEQ ID NO: 83842 - DNA, 22 bp, Homo sapiens
agtgaaaacctaatcatgcagt

SEQ ID NO: 83843 - DNA, 22 bp, Homo sapiens
ctctgcaacttctagcagtgtc

SEQ ID NO: 83844 - DNA, 22 bp, Homo sapiens
aggtggggaggagtgtctcttt

SEQ ID NO: 83845 - DNA, 22 bp, Homo sapiens
gctcactgcaagctctgcctcc

SEQ ID NO: 83846 - DNA, 22 bp, Homo sapiens
ggggccttttctgaatgtggaa

SEQ ID NO: 83847 - DNA, 22 bp, Homo sapiens
aaattgcaaaagtacttttagg

SEQ ID NO: 83848 - DNA, 22 bp, Homo sapiens
tgctgaataagacgtggcttgt

SEQ ID NO: 83849 - DNA, 22 bp, Homo sapiens
atacagggacatccagtttttc

SEQ ID NO: 83850 - DNA, 19 bp, Homo sapiens
ttctggtctggaatcaagg

SEQ ID NO: 83851 - DNA, 22 bp, Homo sapiens
tgcaagtaattccagctactga

SEQ ID NO: 83852 - DNA, 22 bp, Homo sapiens
tcctgccttgcctgggacatca

SEQ ID NO: 83853 - DNA, 21 bp, Homo sapiens
tctgatggtagatgagatgtg

SEQ ID NO: 83854 - DNA, 22 bp, Homo sapiens
aatattatcaaaagctttttca

SEQ ID NO: 83855 - DNA, 22 bp, Homo sapiens
gacctcgtgatccgccctcctt

SEQ ID NO: 83856 - DNA, 22 bp, Homo sapiens
cccaggctggagtgcagtggcg

SEQ ID NO: 83857 - DNA, 22 bp, Homo sapiens
tgcactccaggctgggtgacag

SEQ ID NO: 83858 - DNA, 21 bp, Homo sapiens
tgttttccaccttgaggcaag

SEQ ID NO: 83859 - DNA, 22 bp, Homo sapiens
ggccggggcctgctcgcctgtg

SEQ ID NO: 83860 - DNA, 22 bp, Homo sapiens
gctcaagccttctgcccacctc

SEQ ID NO: 83861 - DNA, 22 bp, Homo sapiens
tggggagtgatgcctcggataa

SEQ ID NO: 83862 - DNA, 22 bp, Homo sapiens
gtggagaggaacccagctctgt

SEQ ID NO: 83863 - DNA, 22 bp, Homo sapiens
tagaggctttcagcggtaggtc

SEQ ID NO: 83864 - DNA, 22 bp, Homo sapiens
ttgtgctcctatgagaatctaa

SEQ ID NO: 83865 - DNA, 22 bp, Homo sapiens
gggaggttgaggctgcagtgag

SEQ ID NO: 83866 - DNA, 22 bp, Homo sapiens
ttgagcaatgtcactgaggctt

SEQ ID NO: 83867 - DNA, 22 bp, Homo sapiens
ttttcctttgattcccagatgt

SEQ ID NO: 83868 - DNA, 22 bp, Homo sapiens
taggatttaataaaagaataga

SEQ ID NO: 83869 - DNA, 22 bp, Homo sapiens
atgccacttcattccagcctcg

SEQ ID NO: 83870 - DNA, 22 bp, Homo sapiens
aaggctgaggcagtgaggcaga

SEQ ID NO: 83871 - DNA, 22 bp, Homo sapiens
atgaggcaggagtgcagtggca

SEQ ID NO: 83872 - DNA, 22 bp, Homo sapiens
atatgggggggcgtgcagagga

SEQ ID NO: 83873 - DNA, 22 bp, Homo sapiens
agatggtagactatggaacgta

SEQ ID NO: 83874 - DNA, 14 bp, Homo sapiens
aagatcaccttcct

SEQ ID NO: 83875 - DNA, 23 bp, Homo sapiens
aaaacagcttcctccagtggctc

SEQ ID NO: 83876 - DNA, 19 bp, Homo sapiens
agccccttggtactgtcct

SEQ ID NO: 83877 - DNA, 22 bp, Homo sapiens
tttaaaaaactagtctgagtct

SEQ ID NO: 83878 - DNA, 22 bp, Homo sapiens
gccagatttacagatttgccct

SEQ ID NO: 83879 - DNA, 22 bp, Homo sapiens
gcaggcagatcacctgtcagga

SEQ ID NO: 83880 - DNA, 22 bp, Homo sapiens
tgagaacggatactaagggctg

SEQ ID NO: 83881 - DNA, 22 bp, Homo sapiens
gagccaggaggcagagactgca

SEQ ID NO: 83882 - DNA, 22 bp, Homo sapiens
gcccagagttcaaggctgcagt

SEQ ID NO: 83883 - DNA, 22 bp, Homo sapiens
attgataaattgcaatggggct

SEQ ID NO: 83884 - DNA, 22 bp, Homo sapiens
tgcgttgcgctcctgcagcagg

SEQ ID NO: 83885 - DNA, 22 bp, Homo sapiens
tcctgggatcaagtgatcctcc

SEQ ID NO: 83886 - DNA, 22 bp, Homo sapiens
atgctaaggcccaggagaaaat

SEQ ID NO: 83887 - DNA, 22 bp, Homo sapiens
tcctgagataaatctcatgtga

SEQ ID NO: 83888 - DNA, 22 bp, Homo sapiens
agagcacagccaccatttacaa

SEQ ID NO: 83889 - DNA, 22 bp, Homo sapiens
ccgggcctcgggacaccgggta

SEQ ID NO: 83890 - DNA, 22 bp, Homo sapiens
gcgctgcgcctcctcttccgca

SEQ ID NO: 83891 - DNA, 19 bp, Homo sapiens
ggcttcgaggctggggaag

SEQ ID NO: 83892 - DNA, 22 bp, Homo sapiens
caggtgcctcaggatgagacaa

SEQ ID NO: 83893 - DNA, 19 bp, Homo sapiens
ggagtttccaatgggtaaa

SEQ ID NO: 83894 - DNA, 19 bp, Homo sapiens
ctctgggcaagtcacttaa

SEQ ID NO: 83895 - DNA, 22 bp, Homo sapiens
cagtgggtcctgcgtctgccag

SEQ ID NO: 83896 - DNA, 22 bp, Homo sapiens
gaggcagaagttgcagtgagca

SEQ ID NO: 83897 - DNA, 22 bp, Homo sapiens
tggtatgaccgtggtgcaagca

SEQ ID NO: 83898 - DNA, 22 bp, Homo sapiens
acatttttcacatttgtagggt

SEQ ID NO: 83899 - DNA, 22 bp, Homo sapiens
gcttcggggtccaagcgcgtgt

SEQ ID NO: 83900 - DNA, 22 bp, Homo sapiens
ggtcagccttggatttggtagc

SEQ ID NO: 83901 - DNA, 22 bp, Homo sapiens
attataggcttgagccaccgtg

SEQ ID NO: 83902 - DNA, 22 bp, Homo sapiens
ttttccttcatatcccttatgt

SEQ ID NO: 83903 - DNA, 22 bp, Homo sapiens
atgctatgtaactggcagatag

SEQ ID NO: 83904 - DNA, 22 bp, Homo sapiens
gaccagtcattactcatgccct

SEQ ID NO: 83905 - DNA, 22 bp, Homo sapiens
tgcctctgaggaagattgtgtt

SEQ ID NO: 83906 - DNA, 22 bp, Homo sapiens
ttctttcagaacacaagtgatt

SEQ ID NO: 83907 - DNA, 22 bp, Homo sapiens
caaagtgctggaattacaggtg

SEQ ID NO: 83908 - DNA, 22 bp, Homo sapiens
tgcagtggcgccatctcagctc

SEQ ID NO: 83909 - DNA, 22 bp, Homo sapiens
atgggctgtccattgctggctg

SEQ ID NO: 83910 - DNA, 22 bp, Homo sapiens
tgacttcctgcactcaggtgat

SEQ ID NO: 83911 - DNA, 22 bp, Homo sapiens
tgacagtgcgggtacatcatag

SEQ ID NO: 83912 - DNA, 22 bp, Homo sapiens
ttcctagggcagagccgctggg

SEQ ID NO: 83913 - DNA, 22 bp, Homo sapiens
cagggatggcgctggctgcccg

SEQ ID NO: 83914 - DNA, 22 bp, Homo sapiens
ccaggaggcggaggttgcagcg

SEQ ID NO: 83915 - DNA, 22 bp, Homo sapiens
agctgctgagccaggctgatgt

SEQ ID NO: 83916 - DNA, 22 bp, Homo sapiens
cgggcagcggcgtggccatggt

SEQ ID NO: 83917 - DNA, 22 bp, Homo sapiens
caatttctaacattccatggat

SEQ ID NO: 83918 - DNA, 22 bp, Homo sapiens
tcctggtgctgacacccatagc

SEQ ID NO: 83919 - DNA, 22 bp, Homo sapiens
aagaaggcggaccagaagggag

SEQ ID NO: 83920 - DNA, 22 bp, Homo sapiens
tatttaataaaactatggcatg

SEQ ID NO: 83921 - DNA, 22 bp, Homo sapiens
ctgcatccatgttgctgcaaag

SEQ ID NO: 83922 - DNA, 22 bp, Homo sapiens
cttgtgcatttcattcctcagg

SEQ ID NO: 83923 - DNA, 22 bp, Homo sapiens
gcagtggggcaatcatagctca

SEQ ID NO: 83924 - DNA, 22 bp, Homo sapiens
ttctcttttcaccagttgctaa

SEQ ID NO: 83925 - DNA, 22 bp, Homo sapiens
tgaagcaaattgtttagcctga

SEQ ID NO: 83926 - DNA, 22 bp, Homo sapiens
ctgccttttaaagccagtgtta

SEQ ID NO: 83927 - DNA, 22 bp, Homo sapiens
aacttaggaaaataaggcatga

SEQ ID NO: 83928 - DNA, 21 bp, Homo sapiens
tgaaggggtggcagtgtgctt

SEQ ID NO: 83929 - DNA, 22 bp, Homo sapiens
tctttcttgtgggtgccctttt

SEQ ID NO: 83930 - DNA, 22 bp, Homo sapiens
gttgcctaggctggagtgcagt

SEQ ID NO: 83931 - DNA, 19 bp, Homo sapiens
aggaatggaattaattctg

SEQ ID NO: 83932 - DNA, 22 bp, Homo sapiens
actgcactccaacctgggtgac

SEQ ID NO: 83933 - DNA, 22 bp, Homo sapiens
ttatttgtggcatatgagacga

SEQ ID NO: 83934 - DNA, 22 bp, Homo sapiens
ggcagggcaggaaagtcaggaa

SEQ ID NO: 83935 - DNA, 22 bp, Homo sapiens
aaggagcgcttagggggcagaa

SEQ ID NO: 83936 - DNA, 22 bp, Homo sapiens
cagaggaacgtttggattgatt

SEQ ID NO: 83937 - DNA, 22 bp, Homo sapiens
agtgggtgtagtcttcctcctg

SEQ ID NO: 83938 - DNA, 22 bp, Homo sapiens
ggctagggatctagaccaggac

SEQ ID NO: 83939 - DNA, 17 bp, Homo sapiens
tggctctgtcctcagct

SEQ ID NO: 83940 - DNA, 22 bp, Homo sapiens
agcccttagtacatttctcaag

SEQ ID NO: 83941 - DNA, 22 bp, Homo sapiens
aaggtgggtggatcacgaggtc

SEQ ID NO: 83942 - DNA, 20 bp, Homo sapiens
ttcatgggagcaaagaggcc

SEQ ID NO: 83943 - DNA, 22 bp, Homo sapiens
ccctcaggtgaaaggaaaaatt

SEQ ID NO: 83944 - DNA, 21 bp, Homo sapiens
gggcagaggggcctcctgggt

SEQ ID NO: 83945 - DNA, 22 bp, Homo sapiens
ccaggagttggaggttgcagtg

SEQ ID NO: 83946 - DNA, 22 bp, Homo sapiens
ctgtccctgagcaactcctgtt

SEQ ID NO: 83947 - DNA, 22 bp, Homo sapiens
caggaaggcgcggctgtgcctg

SEQ ID NO: 83948 - DNA, 22 bp, Homo sapiens
gaaagacatagttgcaagatgg

SEQ ID NO: 83949 - DNA, 22 bp, Homo sapiens
ttctagtgtccttggacttgct

SEQ ID NO: 83950 - DNA, 22 bp, Homo sapiens
ggggtctgggcttagctggaat

SEQ ID NO: 83951 - DNA, 22 bp, Homo sapiens
ttgtgctcctgtgagaatctag

SEQ ID NO: 83952 - DNA, 22 bp, Homo sapiens
agcccagaggctgggcgtgcat

SEQ ID NO: 83953 - DNA, 22 bp, Homo sapiens
gagcccaggaagtggaggctga

SEQ ID NO: 83954 - DNA, 22 bp, Homo sapiens
agatgtgtttctagttcctgca

SEQ ID NO: 83955 - DNA, 22 bp, Homo sapiens
ccaggaggcggaggttgcagtg

SEQ ID NO: 83956 - DNA, 22 bp, Homo sapiens
tggcctcggcatccagcaagag

SEQ ID NO: 83957 - DNA, 22 bp, Homo sapiens
tgtgtttctgagaatcccacct

SEQ ID NO: 83958 - DNA, 22 bp, Homo sapiens
tcgtgatctgtccacctcggcc

SEQ ID NO: 83959 - DNA, 22 bp, Homo sapiens
actttaaaactgatcatcagag

SEQ ID NO: 83960 - DNA, 22 bp, Homo sapiens
gtgaggtggtacaatattaact

SEQ ID NO: 83961 - DNA, 22 bp, Homo sapiens
agggcgacaatggagagcgttt

SEQ ID NO: 83962 - DNA, 22 bp, Homo sapiens
tgtcaccatgcgaggctaattt

SEQ ID NO: 83963 - DNA, 22 bp, Homo sapiens
aacattgaacttggcacaccca

SEQ ID NO: 83964 - DNA, 22 bp, Homo sapiens
tacaaaggaggtgcatagaaca

SEQ ID NO: 83965 - DNA, 22 bp, Homo sapiens
agccaagcactcaactcctgga

SEQ ID NO: 83966 - DNA, 22 bp, Homo sapiens
gggggaagaaagaacatggcat

SEQ ID NO: 83967 - DNA, 22 bp, Homo sapiens
cactaggcgccgggtggctgtg

SEQ ID NO: 83968 - DNA, 22 bp, Homo sapiens
ttattttaccttcctctgagct

SEQ ID NO: 83969 - DNA, 22 bp, Homo sapiens
tcactgcagcctctgcctcccg

SEQ ID NO: 83970 - DNA, 22 bp, Homo sapiens
aagtgatgctacgactttgaca

SEQ ID NO: 83971 - DNA, 22 bp, Homo sapiens
cccgactagctgggattacagg

SEQ ID NO: 83972 - DNA, 22 bp, Homo sapiens
atgtgagtgctatgatagacag

SEQ ID NO: 83973 - DNA, 22 bp, Homo sapiens
tgtctggtgggttgacaggcag

SEQ ID NO: 83974 - DNA, 22 bp, Homo sapiens
agtcaaagatgaccgagttcct

SEQ ID NO: 83975 - DNA, 22 bp, Homo sapiens
tctgagacaggaagtggagggt

SEQ ID NO: 83976 - DNA, 20 bp, Homo sapiens
aaaatatgtataactcttct

SEQ ID NO: 83977 - DNA, 22 bp, Homo sapiens
ctatgaccccagcatgaataag

SEQ ID NO: 83978 - DNA, 21 bp, Homo sapiens
tcacgtggtcacatgagcttt

SEQ ID NO: 83979 - DNA, 22 bp, Homo sapiens
gcctgtgtggatgcgccggtgc

SEQ ID NO: 83980 - DNA, 22 bp, Homo sapiens
ctctccattccctacagttttc

SEQ ID NO: 83981 - DNA, 22 bp, Homo sapiens
gaggctgcagctatcagacatt

SEQ ID NO: 83982 - DNA, 22 bp, Homo sapiens
gccagggttgccaatgggggca

SEQ ID NO: 83983 - DNA, 22 bp, Homo sapiens
gctgacccctacaggttgtgtt

SEQ ID NO: 83984 - DNA, 22 bp, Homo sapiens
tcccagagctctggaggttgga

SEQ ID NO: 83985 - DNA, 22 bp, Homo sapiens
ttcccttaaattatggcatcta

SEQ ID NO: 83986 - DNA, 22 bp, Homo sapiens
aggctgagataggtggatcatt

SEQ ID NO: 83987 - DNA, 22 bp, Homo sapiens
aacagcttgctgcaccttaata

SEQ ID NO: 83988 - DNA, 22 bp, Homo sapiens
caggctggagtgcagtggcgct

SEQ ID NO: 83989 - DNA, 22 bp, Homo sapiens
tctcagggctcagagctcaggc

SEQ ID NO: 83990 - DNA, 22 bp, Homo sapiens
tgaggtgccacccaagagcctt

SEQ ID NO: 83991 - DNA, 22 bp, Homo sapiens
atgccactgcgctctagcctgg

SEQ ID NO: 83992 - DNA, 22 bp, Homo sapiens
gctgaaggcccggaggacaggg

SEQ ID NO: 83993 - DNA, 22 bp, Homo sapiens
cccaggagttggaggctgcagt

SEQ ID NO: 83994 - DNA, 22 bp, Homo sapiens
atacatgcgccatgttggtgtg

SEQ ID NO: 83995 - DNA, 22 bp, Homo sapiens
ttgacctatgtttcttcatctg

SEQ ID NO: 83996 - DNA, 22 bp, Homo sapiens
ccagaccctccattcaagctcc

SEQ ID NO: 83997 - DNA, 22 bp, Homo sapiens
atctggttcttcttaggcatca

SEQ ID NO: 83998 - DNA, 22 bp, Homo sapiens
taggtttactgaattagtggaa

SEQ ID NO: 83999 - DNA, 22 bp, Homo sapiens
agagctgtgtttagtagttacg

SEQ ID NO: 84000 - DNA, 22 bp, Homo sapiens
tcaccgaggctggagtgcagtg

SEQ ID NO: 84001 - DNA, 22 bp, Homo sapiens
ggttgctgggggtggcagagct

SEQ ID NO: 84002 - DNA, 22 bp, Homo sapiens
acacttggagcaacacttatgg

SEQ ID NO: 84003 - DNA, 20 bp, Homo sapiens
ctgggtggcaagcaaggggg

SEQ ID NO: 84004 - DNA, 22 bp, Homo sapiens
gaggctgaggttgcagtgagcc

SEQ ID NO: 84005 - DNA, 22 bp, Homo sapiens
cttagagatgggttttacttag

SEQ ID NO: 84006 - DNA, 22 bp, Homo sapiens
gcctccagcccacgcaggcctg

SEQ ID NO: 84007 - DNA, 21 bp, Homo sapiens
agcctcaggttgttggttctt

SEQ ID NO: 84008 - DNA, 19 bp, Homo sapiens
catctggatgattctcctg

SEQ ID NO: 84009 - DNA, 22 bp, Homo sapiens
tctcctggtacccttcctagca

SEQ ID NO: 84010 - DNA, 22 bp, Homo sapiens
acggggctagagaaggtttctt

SEQ ID NO: 84011 - DNA, 22 bp, Homo sapiens
tgagcctgggtggtcgaggctg

SEQ ID NO: 84012 - DNA, 22 bp, Homo sapiens
aggggagagttaatgtgaatgt

SEQ ID NO: 84013 - DNA, 22 bp, Homo sapiens
tcacccaggctggactgcagtg

SEQ ID NO: 84014 - DNA, 18 bp, Homo sapiens
acttcccagatgagggga

SEQ ID NO: 84015 - DNA, 22 bp, Homo sapiens
gctcccagtctgatggaggaga

SEQ ID NO: 84016 - DNA, 22 bp, Homo sapiens
ggaagaaaggtggacaacaggt

SEQ ID NO: 84017 - DNA, 22 bp, Homo sapiens
gcccagtggtaaaagcaggcct

SEQ ID NO: 84018 - DNA, 22 bp, Homo sapiens
caggctggagtgcagtggcgcc

SEQ ID NO: 84019 - DNA, 22 bp, Homo sapiens
cctggaggcggaggttgcagtg

SEQ ID NO: 84020 - DNA, 22 bp, Homo sapiens
gtcctgacggctgattggcctg

SEQ ID NO: 84021 - DNA, 22 bp, Homo sapiens
ctggggaacgcagcgagcagcg

SEQ ID NO: 84022 - DNA, 22 bp, Homo sapiens
ggttggacactaggtaggagcg

SEQ ID NO: 84023 - DNA, 22 bp, Homo sapiens
tcaggggcttgaggtgcatgtc

SEQ ID NO: 84024 - DNA, 22 bp, Homo sapiens
tgcctaggctggaatgcagtgg

SEQ ID NO: 84025 - DNA, 22 bp, Homo sapiens
tctttctacatcatttgcttct

SEQ ID NO: 84026 - DNA, 22 bp, Homo sapiens
ctgggaggcggaggttgtagtg

SEQ ID NO: 84027 - DNA, 22 bp, Homo sapiens
atgaaatatcttgaagaaattc

SEQ ID NO: 84028 - DNA, 22 bp, Homo sapiens
acgcccggtctccatagttttt

SEQ ID NO: 84029 - DNA, 22 bp, Homo sapiens
gggcctgtgtgttcaggagcct

SEQ ID NO: 84030 - DNA, 22 bp, Homo sapiens
aataaacaaaggacaaggaggt

SEQ ID NO: 84031 - DNA, 22 bp, Homo sapiens
ctgagggtcaacttgattgtat

SEQ ID NO: 84032 - DNA, 22 bp, Homo sapiens
ctggggtcagggatcagagagc

SEQ ID NO: 84033 - DNA, 22 bp, Homo sapiens
gacccaggggcagggagaaagt

SEQ ID NO: 84034 - DNA, 22 bp, Homo sapiens
aaccaccattctctcctcttcc

SEQ ID NO: 84035 - DNA, 22 bp, Homo sapiens
ataaaatttgctactgttaaat

SEQ ID NO: 84036 - DNA, 20 bp, Homo sapiens
gtttctgattcagtaggtct

SEQ ID NO: 84037 - DNA, 22 bp, Homo sapiens
cactgcaatgtctacctcctgg

SEQ ID NO: 84038 - DNA, 22 bp, Homo sapiens
aggcaggaggatcatggatgca

SEQ ID NO: 84039 - DNA, 22 bp, Homo sapiens
ccagatgtccctctcaggtttg

SEQ ID NO: 84040 - DNA, 22 bp, Homo sapiens
ggcctcgcggcttctggtggct

SEQ ID NO: 84041 - DNA, 22 bp, Homo sapiens
cttgatctacatagtgaaaccc

SEQ ID NO: 84042 - DNA, 22 bp, Homo sapiens
ggccaggcgatgacccctccac

SEQ ID NO: 84043 - DNA, 22 bp, Homo sapiens
aatcagaaattgagggtctggt

SEQ ID NO: 84044 - DNA, 22 bp, Homo sapiens
gtagtctgaacagtaattttgt

SEQ ID NO: 84045 - DNA, 22 bp, Homo sapiens
gcccaggaggagaggctgcagt

SEQ ID NO: 84046 - DNA, 22 bp, Homo sapiens
gggcggggggagctggaatgaa

SEQ ID NO: 84047 - DNA, 22 bp, Homo sapiens
ggagaggcttccagagtcgtgc

SEQ ID NO: 84048 - DNA, 22 bp, Homo sapiens
ttactttaagggtgtcttatta

SEQ ID NO: 84049 - DNA, 22 bp, Homo sapiens
tccacgtgagcttcgtgtgcag

SEQ ID NO: 84050 - DNA, 22 bp, Homo sapiens
caaagtgctgggattacaggtg

SEQ ID NO: 84051 - DNA, 22 bp, Homo sapiens
ggagtgaagtggcgcgatctcg

SEQ ID NO: 84052 - DNA, 22 bp, Homo sapiens
cagaggtagcatgctgtggctt

SEQ ID NO: 84053 - DNA, 22 bp, Homo sapiens
ctttgcttgacactgtgattgt

SEQ ID NO: 84054 - DNA, 22 bp, Homo sapiens
tatccaattcaccattgatggg

SEQ ID NO: 84055 - DNA, 22 bp, Homo sapiens
agtcccaacagcttacaaggaa

SEQ ID NO: 84056 - DNA, 22 bp, Homo sapiens
gaaggaagtcattagtgcagac

SEQ ID NO: 84057 - DNA, 22 bp, Homo sapiens
tctgtggcccaagtgatggctg

SEQ ID NO: 84058 - DNA, 22 bp, Homo sapiens
gggtggtggccagcagtgggca

SEQ ID NO: 84059 - DNA, 19 bp, Homo sapiens
aggctaaagagtcttgcgt

SEQ ID NO: 84060 - DNA, 22 bp, Homo sapiens
gtagttctgcagtgtcacctga

SEQ ID NO: 84061 - DNA, 22 bp, Homo sapiens
aggtcacgtcctgtgatgtcat

SEQ ID NO: 84062 - DNA, 22 bp, Homo sapiens
aatctgagggaacttgaactcc

SEQ ID NO: 84063 - DNA, 22 bp, Homo sapiens
tctttgctccacactctagaga

SEQ ID NO: 84064 - DNA, 22 bp, Homo sapiens
tcactgcaacctctgcctcccg

SEQ ID NO: 84065 - DNA, 22 bp, Homo sapiens
acccagtctggagtgcagtgac

SEQ ID NO: 84066 - DNA, 22 bp, Homo sapiens
tcagaacatgtttgagtaagac

SEQ ID NO: 84067 - DNA, 22 bp, Homo sapiens
cttgacactgtcactcaggcca

SEQ ID NO: 84068 - DNA, 22 bp, Homo sapiens
ggaggacaggggctgcagcaca

SEQ ID NO: 84069 - DNA, 22 bp, Homo sapiens
gagcccaggcagaggttgcagt

SEQ ID NO: 84070 - DNA, 22 bp, Homo sapiens
ggacctgaacataaaacgaggc

SEQ ID NO: 84071 - DNA, 19 bp, Homo sapiens
ccatggcaatgatctgatg

SEQ ID NO: 84072 - DNA, 22 bp, Homo sapiens
tgcagaaacaagccatcattca

SEQ ID NO: 84073 - DNA, 22 bp, Homo sapiens
agggctggagccacagctggga

SEQ ID NO: 84074 - DNA, 22 bp, Homo sapiens
ggggcccctcggacacgtgcgg

SEQ ID NO: 84075 - DNA, 22 bp, Homo sapiens
ctcactgcaagctccacctctt

SEQ ID NO: 84076 - DNA, 22 bp, Homo sapiens
tcgcgggttgcacatggccatc

SEQ ID NO: 84077 - DNA, 22 bp, Homo sapiens
gtcccctgtccagggccagcca

SEQ ID NO: 84078 - DNA, 22 bp, Homo sapiens
aatgtgagccaatgcccgtggg

SEQ ID NO: 84079 - DNA, 20 bp, Homo sapiens
tgtcattcttctttcacagg

SEQ ID NO: 84080 - DNA, 22 bp, Homo sapiens
gtgcagttgtggacatgacaac

SEQ ID NO: 84081 - DNA, 22 bp, Homo sapiens
tatactctgagaaacgtgtcac

SEQ ID NO: 84082 - DNA, 22 bp, Homo sapiens
ggccctggcagccacgaaagcc

SEQ ID NO: 84083 - DNA, 22 bp, Homo sapiens
gggtcgggcaggcgccctcgtc

SEQ ID NO: 84084 - DNA, 22 bp, Homo sapiens
gatgctgagaggtggagggaac

SEQ ID NO: 84085 - DNA, 22 bp, Homo sapiens
cagctttgccaagtaaggtctt

SEQ ID NO: 84086 - DNA, 22 bp, Homo sapiens
tcattaatcccggggtccaggg

SEQ ID NO: 84087 - DNA, 21 bp, Homo sapiens
gctgctcgagatccagtgctt

SEQ ID NO: 84088 - DNA, 22 bp, Homo sapiens
atgtttaaagggttgagaaata

SEQ ID NO: 84089 - DNA, 22 bp, Homo sapiens
ttagtattaggatcatatttga

SEQ ID NO: 84090 - DNA, 21 bp, Homo sapiens
gtgcggatgccgtcattgtca

SEQ ID NO: 84091 - DNA, 22 bp, Homo sapiens
actgcactccagcctgggtgat

SEQ ID NO: 84092 - DNA, 22 bp, Homo sapiens
cccagttgttgccggctctgga

SEQ ID NO: 84093 - DNA, 22 bp, Homo sapiens
cccacgttgaaccgcttacaga

SEQ ID NO: 84094 - DNA, 22 bp, Homo sapiens
agaaggggcccaaggatgtcag

SEQ ID NO: 84095 - DNA, 22 bp, Homo sapiens
gcttccacctactaaatgccac

SEQ ID NO: 84096 - DNA, 22 bp, Homo sapiens
aggagcagaccgtagtcctgca

SEQ ID NO: 84097 - DNA, 22 bp, Homo sapiens
ttttcatttttgtagatgcaag

SEQ ID NO: 84098 - DNA, 22 bp, Homo sapiens
ttcagcactgactgagtggtta

SEQ ID NO: 84099 - DNA, 22 bp, Homo sapiens
tcattgagttgcacttttacta

SEQ ID NO: 84100 - DNA, 22 bp, Homo sapiens
gaggtgggcggatcacaaggtc

SEQ ID NO: 84101 - DNA, 21 bp, Homo sapiens
gggcctggctgcgcaggacgg

SEQ ID NO: 84102 - DNA, 22 bp, Homo sapiens
tttgggcaggcttttccctaga

SEQ ID NO: 84103 - DNA, 22 bp, Homo sapiens
acacagagccaaaccatatcac

SEQ ID NO: 84104 - DNA, 23 bp, Homo sapiens
ccagtgattgcctggaaggaggt

SEQ ID NO: 84105 - DNA, 22 bp, Homo sapiens
tctgcgttgctcacgctgggag

SEQ ID NO: 84106 - DNA, 22 bp, Homo sapiens
gtgcaaaagtaattgtggtttt

SEQ ID NO: 84107 - DNA, 22 bp, Homo sapiens
ggagttgattttggatatatta

SEQ ID NO: 84108 - DNA, 22 bp, Homo sapiens
tcaagagttggtcaaatccaaa

SEQ ID NO: 84109 - DNA, 22 bp, Homo sapiens
tgggggagctcagtccagccca

SEQ ID NO: 84110 - DNA, 22 bp, Homo sapiens
ctcagcactttggaaggctgat

SEQ ID NO: 84111 - DNA, 22 bp, Homo sapiens
catataaatacaacatgtgtta

SEQ ID NO: 84112 - DNA, 22 bp, Homo sapiens
ctctgtggtggagtgggtcacc

SEQ ID NO: 84113 - DNA, 22 bp, Homo sapiens
cccaggaggcagagcttgcagt

SEQ ID NO: 84114 - DNA, 17 bp, Homo sapiens
gagattttcgtcctgaa

SEQ ID NO: 84115 - DNA, 22 bp, Homo sapiens
ggagtagctgcattccgagcac

SEQ ID NO: 84116 - DNA, 22 bp, Homo sapiens
ttgaggtccccagtacccactg

SEQ ID NO: 84117 - DNA, 22 bp, Homo sapiens
ctgatattctattttgcttgct

SEQ ID NO: 84118 - DNA, 22 bp, Homo sapiens
agagggtgggcacgtgatggat

SEQ ID NO: 84119 - DNA, 22 bp, Homo sapiens
taacaatacccattctaattac

SEQ ID NO: 84120 - DNA, 22 bp, Homo sapiens
gacctcgtgatctgccagcctt

SEQ ID NO: 84121 - DNA, 22 bp, Homo sapiens
ctgtaatcccagctactcggga

SEQ ID NO: 84122 - DNA, 22 bp, Homo sapiens
cctgtggcgggggccagtgcct

SEQ ID NO: 84123 - DNA, 22 bp, Homo sapiens
ttaccacagtgcctgtctaatg

SEQ ID NO: 84124 - DNA, 22 bp, Homo sapiens
ggcccagacccaagagtggtgg

SEQ ID NO: 84125 - DNA, 22 bp, Homo sapiens
gtgggggcaggcagtgctagga

SEQ ID NO: 84126 - DNA, 22 bp, Homo sapiens
tgaagaaacgcagagaggtagg

SEQ ID NO: 84127 - DNA, 22 bp, Homo sapiens
ttatttaaaagtggtaagattc

SEQ ID NO: 84128 - DNA, 22 bp, Homo sapiens
ctcctgggaaaggctggacaca

SEQ ID NO: 84129 - DNA, 23 bp, Homo sapiens
aggttatgattatagagcgagga

SEQ ID NO: 84130 - DNA, 18 bp, Homo sapiens
gatatggaaggccatgcc

SEQ ID NO: 84131 - DNA, 22 bp, Homo sapiens
gggcagagagctggaactcctt

SEQ ID NO: 84132 - DNA, 22 bp, Homo sapiens
gctgctgcttgaaggctcggag

SEQ ID NO: 84133 - DNA, 22 bp, Homo sapiens
gggaagatagtgttgagggccc

SEQ ID NO: 84134 - DNA, 21 bp, Homo sapiens
gctcctggtgctgcgtggcgc

SEQ ID NO: 84135 - DNA, 22 bp, Homo sapiens
atacaaaatatatactggagac

SEQ ID NO: 84136 - DNA, 22 bp, Homo sapiens
tcagcctccgaaagtgctggga

SEQ ID NO: 84137 - DNA, 22 bp, Homo sapiens
gcccaggagttcaagtctagtg

SEQ ID NO: 84138 - DNA, 22 bp, Homo sapiens
aaaaagtattggccatggttga

SEQ ID NO: 84139 - DNA, 22 bp, Homo sapiens
ttgcagttttgacagaccaaat

SEQ ID NO: 84140 - DNA, 22 bp, Homo sapiens
cccccaaagtttgcacggataa

SEQ ID NO: 84141 - DNA, 22 bp, Homo sapiens
gctggaggatggactggaagaa

SEQ ID NO: 84142 - DNA, 22 bp, Homo sapiens
ccagcctggttcagaattggct

SEQ ID NO: 84143 - DNA, 22 bp, Homo sapiens
tcacaatatttatcttccaatt

SEQ ID NO: 84144 - DNA, 22 bp, Homo sapiens
agaggcaggaggttgacttgag

SEQ ID NO: 84145 - DNA, 22 bp, Homo sapiens
gaggcaggaggattgcttgagc

SEQ ID NO: 84146 - DNA, 22 bp, Homo sapiens
agctcaagctacacacagagtc

SEQ ID NO: 84147 - DNA, 22 bp, Homo sapiens
cttagtgacatgtattcttcat

SEQ ID NO: 84148 - DNA, 22 bp, Homo sapiens
tcactgcaagctctgccttccg

SEQ ID NO: 84149 - DNA, 22 bp, Homo sapiens
ggctgtggagctgcagagttgg

SEQ ID NO: 84150 - DNA, 22 bp, Homo sapiens
ttctatttttgtggaactgtag

SEQ ID NO: 84151 - DNA, 22 bp, Homo sapiens
atttttctctttccactgagat

SEQ ID NO: 84152 - DNA, 22 bp, Homo sapiens
agcattccacactgaagtctgc

SEQ ID NO: 84153 - DNA, 22 bp, Homo sapiens
ccaaagtgctggggttacaggc

SEQ ID NO: 84154 - DNA, 22 bp, Homo sapiens
acatcctcccgatctactggct

SEQ ID NO: 84155 - DNA, 22 bp, Homo sapiens
ctcagctcattgtggatccggt

SEQ ID NO: 84156 - DNA, 22 bp, Homo sapiens
agggaaattaatgtgagcaatg

SEQ ID NO: 84157 - DNA, 22 bp, Homo sapiens
gtgtgggctgcagaggcacagc

SEQ ID NO: 84158 - DNA, 22 bp, Homo sapiens
caggagtgttgattgctcagga

SEQ ID NO: 84159 - DNA, 22 bp, Homo sapiens
agcctagggttctgatgtcact

SEQ ID NO: 84160 - DNA, 22 bp, Homo sapiens
tagtatagattgaagcagatca

SEQ ID NO: 84161 - DNA, 22 bp, Homo sapiens
ttataagactgtagtgagtatt

SEQ ID NO: 84162 - DNA, 22 bp, Homo sapiens
ggtgagaaagggattcctgttc

SEQ ID NO: 84163 - DNA, 22 bp, Homo sapiens
agtggaccagaagactgaagct

SEQ ID NO: 84164 - DNA, 22 bp, Homo sapiens
tcagccccacggggtcagccaa

SEQ ID NO: 84165 - DNA, 22 bp, Homo sapiens
ggaggtgggctaaggactctct

SEQ ID NO: 84166 - DNA, 18 bp, Homo sapiens
acacttcctggtggtgtg

SEQ ID NO: 84167 - DNA, 22 bp, Homo sapiens
tacatttataaggcttctctgt

SEQ ID NO: 84168 - DNA, 22 bp, Homo sapiens
acacggcactttaggaaggggc

SEQ ID NO: 84169 - DNA, 22 bp, Homo sapiens
ctgagatggagttttgctcttg

SEQ ID NO: 84170 - DNA, 22 bp, Homo sapiens
atacaaagtattgatcctgagt

SEQ ID NO: 84171 - DNA, 22 bp, Homo sapiens
ttttttgttgggtagaacggaa

SEQ ID NO: 84172 - DNA, 22 bp, Homo sapiens
ttcttcatgggttcttttagga

SEQ ID NO: 84173 - DNA, 22 bp, Homo sapiens
gggttggatcctggtggctgcc

SEQ ID NO: 84174 - DNA, 22 bp, Homo sapiens
cattgctttgtgcatatttaaa

SEQ ID NO: 84175 - DNA, 22 bp, Homo sapiens
aagaggagaaaggctggctttg

SEQ ID NO: 84176 - DNA, 22 bp, Homo sapiens
ctctcgccagcggggctgcgct

SEQ ID NO: 84177 - DNA, 22 bp, Homo sapiens
tccctagtcgcatctgtggaga

SEQ ID NO: 84178 - DNA, 22 bp, Homo sapiens
agcctggtttaagcattttata

SEQ ID NO: 84179 - DNA, 22 bp, Homo sapiens
tctgctttcttactaaaaatga

SEQ ID NO: 84180 - DNA, 22 bp, Homo sapiens
catcatcaaaagtgacagagaa

SEQ ID NO: 84181 - DNA, 22 bp, Homo sapiens
ctcattgcccagatccccacag

SEQ ID NO: 84182 - DNA, 22 bp, Homo sapiens
agcctattccaggatgagctca

SEQ ID NO: 84183 - DNA, 20 bp, Homo sapiens
agcagagtgcccatcccgga

SEQ ID NO: 84184 - DNA, 23 bp, Homo sapiens
aaactacaacgccaggcactgag

SEQ ID NO: 84185 - DNA, 22 bp, Homo sapiens
gggatgcagactacagggctta

SEQ ID NO: 84186 - DNA, 22 bp, Homo sapiens
agctttgtttgctcacccgccg

SEQ ID NO: 84187 - DNA, 22 bp, Homo sapiens
ctggccagatgttacgtccaat

SEQ ID NO: 84188 - DNA, 22 bp, Homo sapiens
tgcccaggctggagtacagtgg

SEQ ID NO: 84189 - DNA, 22 bp, Homo sapiens
agtgactggtgtgaagttaaat

SEQ ID NO: 84190 - DNA, 22 bp, Homo sapiens
tgaggctccttgtagagagtgg

SEQ ID NO: 84191 - DNA, 22 bp, Homo sapiens
tgggaaggggagctggaaagga

SEQ ID NO: 84192 - DNA, 22 bp, Homo sapiens
gcagactgtatcaatgtcagta

SEQ ID NO: 84193 - DNA, 22 bp, Homo sapiens
ttgagcccaggaggcctgggtg

SEQ ID NO: 84194 - DNA, 22 bp, Homo sapiens
cccaggaggtggagcttgcagt

SEQ ID NO: 84195 - DNA, 22 bp, Homo sapiens
cagcagcccacgcgtgctgtcc

SEQ ID NO: 84196 - DNA, 22 bp, Homo sapiens
ctagttctagatccctgaggaa

SEQ ID NO: 84197 - DNA, 22 bp, Homo sapiens
tccttaggcaatttgggagagt

SEQ ID NO: 84198 - DNA, 22 bp, Homo sapiens
tgatattttatgagctttcata

SEQ ID NO: 84199 - DNA, 22 bp, Homo sapiens
cccaggaggttgaggctgcagt

SEQ ID NO: 84200 - DNA, 18 bp, Homo sapiens
gaggtagataagattttc

SEQ ID NO: 84201 - DNA, 22 bp, Homo sapiens
gcttggccagcagccgggatgc

SEQ ID NO: 84202 - DNA, 22 bp, Homo sapiens
cctgggcctctcaaagtgctgg

SEQ ID NO: 84203 - DNA, 22 bp, Homo sapiens
attcatcaactgatagccatag

SEQ ID NO: 84204 - DNA, 22 bp, Homo sapiens
ccaaagaaacccaagctcaggg

SEQ ID NO: 84205 - DNA, 22 bp, Homo sapiens
tgaggcactccaggatgctgtt

SEQ ID NO: 84206 - DNA, 22 bp, Homo sapiens
gtgaaatatttaacgtccaggt

SEQ ID NO: 84207 - DNA, 22 bp, Homo sapiens
agcctggcctgggcaggcacat

SEQ ID NO: 84208 - DNA, 22 bp, Homo sapiens
ctgcagtatgagctacccaggt

SEQ ID NO: 84209 - DNA, 22 bp, Homo sapiens
cctcttctaggacgtccttgtg

SEQ ID NO: 84210 - DNA, 22 bp, Homo sapiens
gcctggattccttgtttctcag

SEQ ID NO: 84211 - DNA, 22 bp, Homo sapiens
ttgagcaggatggctatgcaca

SEQ ID NO: 84212 - DNA, 22 bp, Homo sapiens
ctttaattgtagctcccataat

SEQ ID NO: 84213 - DNA, 22 bp, Homo sapiens
gggaggcagtgctggaggctgg

SEQ ID NO: 84214 - DNA, 22 bp, Homo sapiens
atcacagggtgaggattagacc

SEQ ID NO: 84215 - DNA, 22 bp, Homo sapiens
ggctccctgcaacctccgcctc

SEQ ID NO: 84216 - DNA, 22 bp, Homo sapiens
agggtgaatctcacaactctta

SEQ ID NO: 84217 - DNA, 19 bp, Homo sapiens
ggggcctgtgatggtcaca

SEQ ID NO: 84218 - DNA, 22 bp, Homo sapiens
cccaggaggcgcaggttgcggt

SEQ ID NO: 84219 - DNA, 22 bp, Homo sapiens
tgtgtgattgcaggagatgtgg

SEQ ID NO: 84220 - DNA, 22 bp, Homo sapiens
tccgggggtggtagatttcctt

SEQ ID NO: 84221 - DNA, 22 bp, Homo sapiens
tcagggctgcagaagaggcagg

SEQ ID NO: 84222 - DNA, 22 bp, Homo sapiens
ctccaacgaggctggggtacaa

SEQ ID NO: 84223 - DNA, 22 bp, Homo sapiens
gggtctcctaatggaggatgac

SEQ ID NO: 84224 - DNA, 22 bp, Homo sapiens
atcatcctagaaggaagctagg

SEQ ID NO: 84225 - DNA, 22 bp, Homo sapiens
ctcagcactgacccaggagatg

SEQ ID NO: 84226 - DNA, 22 bp, Homo sapiens
ttcaatatgatattagctgtgg

SEQ ID NO: 84227 - DNA, 22 bp, Homo sapiens
aaaagtaattgtggttttggcc

SEQ ID NO: 84228 - DNA, 22 bp, Homo sapiens
gggcgccgtgggaaacagccgg

SEQ ID NO: 84229 - DNA, 21 bp, Homo sapiens
tcgtgcagcagctgaggcttg

SEQ ID NO: 84230 - DNA, 22 bp, Homo sapiens
tgggagcagttgcatctccagt

SEQ ID NO: 84231 - DNA, 22 bp, Homo sapiens
catggcactgagcaggtatgca

SEQ ID NO: 84232 - DNA, 22 bp, Homo sapiens
aagtgctgggattacaggtgtg

SEQ ID NO: 84233 - DNA, 22 bp, Homo sapiens
ctgaggcaggagagttgcttga

SEQ ID NO: 84234 - DNA, 20 bp, Homo sapiens
acgtggccaccagtggctta

SEQ ID NO: 84235 - DNA, 22 bp, Homo sapiens
ttgagtgtactttagtcatctg

SEQ ID NO: 84236 - DNA, 22 bp, Homo sapiens
aagagggctcgatttggcaaaa

SEQ ID NO: 84237 - DNA, 22 bp, Homo sapiens
ccagtgtgcaatctctggctta

SEQ ID NO: 84238 - DNA, 22 bp, Homo sapiens
tcattccctcattgttcactgg

SEQ ID NO: 84239 - DNA, 18 bp, Homo sapiens
cagctgccagctcatgga

SEQ ID NO: 84240 - DNA, 22 bp, Homo sapiens
gctcggtggccagcctgaggcc

SEQ ID NO: 84241 - DNA, 22 bp, Homo sapiens
tattgacagtgactattggtag

SEQ ID NO: 84242 - DNA, 22 bp, Homo sapiens
gggccatgagaggttcatcaac

SEQ ID NO: 84243 - DNA, 22 bp, Homo sapiens
ctgagatggagtttcgctcttc

SEQ ID NO: 84244 - DNA, 22 bp, Homo sapiens
agccccttgtgggcgcacagca

SEQ ID NO: 84245 - DNA, 22 bp, Homo sapiens
ttacctaaaatagctcaattta

SEQ ID NO: 84246 - DNA, 22 bp, Homo sapiens
aagatattcaaagatttattag

SEQ ID NO: 84247 - DNA, 22 bp, Homo sapiens
tgagctgtgtcttggtgagagt

SEQ ID NO: 84248 - DNA, 22 bp, Homo sapiens
aggactgggtgcagagggcatc

SEQ ID NO: 84249 - DNA, 22 bp, Homo sapiens
cttctcggccgtgtggatgcgc

SEQ ID NO: 84250 - DNA, 22 bp, Homo sapiens
ggaggctgaggcaggcggatca

SEQ ID NO: 84251 - DNA, 22 bp, Homo sapiens
gggagagtagctggaaggttct

SEQ ID NO: 84252 - DNA, 22 bp, Homo sapiens
tcaagcaaagtttagctggtta

SEQ ID NO: 84253 - DNA, 22 bp, Homo sapiens
cagcacatgctcatcagggaag

SEQ ID NO: 84254 - DNA, 22 bp, Homo sapiens
gctccgtgggcattgctaggtg

SEQ ID NO: 84255 - DNA, 22 bp, Homo sapiens
attgttcaatgtaataattttg

SEQ ID NO: 84256 - DNA, 22 bp, Homo sapiens
ggagagtgggagcaactgttgc

SEQ ID NO: 84257 - DNA, 22 bp, Homo sapiens
caggagtgtctccacacagcaa

SEQ ID NO: 84258 - DNA, 22 bp, Homo sapiens
tcgaactcatagtcgtagctgt

SEQ ID NO: 84259 - DNA, 23 bp, Homo sapiens
cttcacaggttcaggggattaag

SEQ ID NO: 84260 - DNA, 22 bp, Homo sapiens
aatgttgcagagtgattgtcca

SEQ ID NO: 84261 - DNA, 22 bp, Homo sapiens
tggcactgaagctggaaagcct

SEQ ID NO: 84262 - DNA, 22 bp, Homo sapiens
agatcggctttgcagacctcat

SEQ ID NO: 84263 - DNA, 22 bp, Homo sapiens
acggcttcttgactgtgggttg

SEQ ID NO: 84264 - DNA, 22 bp, Homo sapiens
actttatttcctattgcatcca

SEQ ID NO: 84265 - DNA, 22 bp, Homo sapiens
gcagctgacatctggctgggcc

SEQ ID NO: 84266 - DNA, 22 bp, Homo sapiens
ggagagggtaggggtcctgccc

SEQ ID NO: 84267 - DNA, 22 bp, Homo sapiens
atgtttttaaatagacttacag

SEQ ID NO: 84268 - DNA, 22 bp, Homo sapiens
cctccccacagcccaggagact

SEQ ID NO: 84269 - DNA, 23 bp, Homo sapiens
cagggccctgctcaatttctcca

SEQ ID NO: 84270 - DNA, 22 bp, Homo sapiens
agattcaggcatgtcttcattt

SEQ ID NO: 84271 - DNA, 20 bp, Homo sapiens
ttgttagaggaatgccatag

SEQ ID NO: 84272 - DNA, 21 bp, Homo sapiens
cttccccaggctggtctgtat

SEQ ID NO: 84273 - DNA, 22 bp, Homo sapiens
gattgagtctgaggatgctgca

SEQ ID NO: 84274 - DNA, 22 bp, Homo sapiens
gctgcagtgagccaagatcgtg

SEQ ID NO: 84275 - DNA, 22 bp, Homo sapiens
agagtgtaccaaatatcctaca

SEQ ID NO: 84276 - DNA, 23 bp, Homo sapiens
acagtcgtaggtatccttttcct

SEQ ID NO: 84277 - DNA, 22 bp, Homo sapiens
acccaggctggagtgcagtgat

SEQ ID NO: 84278 - DNA, 22 bp, Homo sapiens
taattataacatgctttctggc

SEQ ID NO: 84279 - DNA, 22 bp, Homo sapiens
agtgctgggctatctactgcta

SEQ ID NO: 84280 - DNA, 22 bp, Homo sapiens
ctgtaatcccagctacctggga

SEQ ID NO: 84281 - DNA, 22 bp, Homo sapiens
aggggatggagctggaaggcag

SEQ ID NO: 84282 - DNA, 22 bp, Homo sapiens
ttagatttacaagcactgttta

SEQ ID NO: 84283 - DNA, 22 bp, Homo sapiens
ggcctctcttgggacagctgtc

SEQ ID NO: 84284 - DNA, 22 bp, Homo sapiens
tcactgcaatctcagcctcctg

SEQ ID NO: 84285 - DNA, 22 bp, Homo sapiens
ttggaggcaatgggaaggaggc

SEQ ID NO: 84286 - DNA, 22 bp, Homo sapiens
ctgtcctgccagtcctggactc

SEQ ID NO: 84287 - DNA, 18 bp, Homo sapiens
ccctgccagctcccagca

SEQ ID NO: 84288 - DNA, 22 bp, Homo sapiens
gaccttgtgatccagccacctt

SEQ ID NO: 84289 - DNA, 22 bp, Homo sapiens
ccccacaactcatgttgaaact

SEQ ID NO: 84290 - DNA, 22 bp, Homo sapiens
tgtgagttcttagaaagtcagt

SEQ ID NO: 84291 - DNA, 22 bp, Homo sapiens
tcctagttctctgccagtcgct

SEQ ID NO: 84292 - DNA, 22 bp, Homo sapiens
atgagcacactgataagcccct

SEQ ID NO: 84293 - DNA, 22 bp, Homo sapiens
cctgcttaacattgccatgaca

SEQ ID NO: 84294 - DNA, 22 bp, Homo sapiens
tgagacaggcttccttcttggg

SEQ ID NO: 84295 - DNA, 22 bp, Homo sapiens
tccttgactgtgaggaactagc

SEQ ID NO: 84296 - DNA, 22 bp, Homo sapiens
accttcaggtgagcacacagat

SEQ ID NO: 84297 - DNA, 22 bp, Homo sapiens
ccggagtgtctggcctgctggg

SEQ ID NO: 84298 - DNA, 19 bp, Homo sapiens
ctgtccttggctgcactgt

SEQ ID NO: 84299 - DNA, 22 bp, Homo sapiens
gagatgggcgagaaggtggact

SEQ ID NO: 84300 - DNA, 20 bp, Homo sapiens
ccagagctgatggctgcccg

SEQ ID NO: 84301 - DNA, 22 bp, Homo sapiens
ccactgcactccagccttggca

SEQ ID NO: 84302 - DNA, 22 bp, Homo sapiens
tagctttgtttatcaaggggca

SEQ ID NO: 84303 - DNA, 19 bp, Homo sapiens
cccaggaagcggaggttgc

SEQ ID NO: 84304 - DNA, 22 bp, Homo sapiens
tggtatgtaaattgtaactcaa

SEQ ID NO: 84305 - DNA, 22 bp, Homo sapiens
gtggtgtaggtcacagttagga

SEQ ID NO: 84306 - DNA, 22 bp, Homo sapiens
ttttctagggtgctaaatgaac

SEQ ID NO: 84307 - DNA, 22 bp, Homo sapiens
ctcactgcaacctctgcctccc

SEQ ID NO: 84308 - DNA, 20 bp, Homo sapiens
gctctgtggtttgagtctcc

SEQ ID NO: 84309 - DNA, 22 bp, Homo sapiens
aggtcaagagtaaatttgggta

SEQ ID NO: 84310 - DNA, 22 bp, Homo sapiens
tttaatgtagcgtgaaatgatt

SEQ ID NO: 84311 - DNA, 22 bp, Homo sapiens
tagagatggggtcttgctatga

SEQ ID NO: 84312 - DNA, 22 bp, Homo sapiens
gactacaggccggcatcagaga

SEQ ID NO: 84313 - DNA, 22 bp, Homo sapiens
ttaataaagtatgaattggaaa

SEQ ID NO: 84314 - DNA, 22 bp, Homo sapiens
ccggctactcgggaggctgacg

SEQ ID NO: 84315 - DNA, 22 bp, Homo sapiens
acagtgcttagcacagagtaga

SEQ ID NO: 84316 - DNA, 22 bp, Homo sapiens
atttcacttagtgtaatgtctt

SEQ ID NO: 84317 - DNA, 22 bp, Homo sapiens
gcaggatgagtgagtacattta

SEQ ID NO: 84318 - DNA, 22 bp, Homo sapiens
cactgcactccatcctgggaaa

SEQ ID NO: 84319 - DNA, 22 bp, Homo sapiens
cctgccagagcagcttgtcctc

SEQ ID NO: 84320 - DNA, 22 bp, Homo sapiens
tggaatggaaacaaactgagga

SEQ ID NO: 84321 - DNA, 22 bp, Homo sapiens
gcctcctggggtgccatcatct

SEQ ID NO: 84322 - DNA, 22 bp, Homo sapiens
ggggatggaggcgtgtggtcct

SEQ ID NO: 84323 - DNA, 22 bp, Homo sapiens
gaccttcttgctgtgtcctaac

SEQ ID NO: 84324 - DNA, 22 bp, Homo sapiens
agcgccactgcactccagcctg

SEQ ID NO: 84325 - DNA, 22 bp, Homo sapiens
ggcagcactgcagcttgttggg

SEQ ID NO: 84326 - DNA, 22 bp, Homo sapiens
aaggggtgagcagaggcttcgc

SEQ ID NO: 84327 - DNA, 22 bp, Homo sapiens
gaattcttttctttctgaaagt

SEQ ID NO: 84328 - DNA, 22 bp, Homo sapiens
gggaagagggagctggaatgat

SEQ ID NO: 84329 - DNA, 21 bp, Homo sapiens
tccttcagtctagatgattgt

SEQ ID NO: 84330 - DNA, 22 bp, Homo sapiens
agggccagcactcctggcagga

SEQ ID NO: 84331 - DNA, 22 bp, Homo sapiens
cagcagcagtggctgcagaaca

SEQ ID NO: 84332 - DNA, 21 bp, Homo sapiens
ggagtttttctggaagggact

SEQ ID NO: 84333 - DNA, 22 bp, Homo sapiens
cactgcactccagcctgggtca

SEQ ID NO: 84334 - DNA, 22 bp, Homo sapiens
aaatgtaagtctttgtttctta

SEQ ID NO: 84335 - DNA, 22 bp, Homo sapiens
cccaggccccagggcttgtcag

SEQ ID NO: 84336 - DNA, 22 bp, Homo sapiens
gatatcatgggaaggtgtactt

SEQ ID NO: 84337 - DNA, 22 bp, Homo sapiens
tcactgcacttcagcttgggca

SEQ ID NO: 84338 - DNA, 17 bp, Homo sapiens
aatctgtttacagtcag

SEQ ID NO: 84339 - DNA, 22 bp, Homo sapiens
gaatgcagatggctggtgtatg

SEQ ID NO: 84340 - DNA, 22 bp, Homo sapiens
gtttggggagttcctttaggcc

SEQ ID NO: 84341 - DNA, 22 bp, Homo sapiens
acacccaggctggcgtgcagtg

SEQ ID NO: 84342 - DNA, 22 bp, Homo sapiens
ccgcccacactaaatatgagcg

SEQ ID NO: 84343 - DNA, 22 bp, Homo sapiens
gccagaagcacatgagaggtga

SEQ ID NO: 84344 - DNA, 22 bp, Homo sapiens
taaatcttctacatcatcataa

SEQ ID NO: 84345 - DNA, 22 bp, Homo sapiens
ggtcaggagcccttggccccct

SEQ ID NO: 84346 - DNA, 22 bp, Homo sapiens
ggaggctgagaggtcgcagtgg

SEQ ID NO: 84347 - DNA, 22 bp, Homo sapiens
attgtggtgtcagttataggca

SEQ ID NO: 84348 - DNA, 22 bp, Homo sapiens
ccccgaggctggagtgcagtgg

SEQ ID NO: 84349 - DNA, 22 bp, Homo sapiens
accgggaagtcctgcactgggc

SEQ ID NO: 84350 - DNA, 22 bp, Homo sapiens
tacaacaatttccacattagaa

SEQ ID NO: 84351 - DNA, 22 bp, Homo sapiens
tcccccaggctggagtgcagtg

SEQ ID NO: 84352 - DNA, 22 bp, Homo sapiens
tcactgcaacctctgcctcttg

SEQ ID NO: 84353 - DNA, 22 bp, Homo sapiens
ggcgtgggcgaggtgctctatc

SEQ ID NO: 84354 - DNA, 22 bp, Homo sapiens
ggccactgctctccagcctggg

SEQ ID NO: 84355 - DNA, 22 bp, Homo sapiens
gctcttgtcaaaaattagttga

SEQ ID NO: 84356 - DNA, 22 bp, Homo sapiens
ctgctaaacctctctgagagct

SEQ ID NO: 84357 - DNA, 22 bp, Homo sapiens
cgcgctgcagacagcggaggcc

SEQ ID NO: 84358 - DNA, 22 bp, Homo sapiens
actgcacttcagcctgggtgac

SEQ ID NO: 84359 - DNA, 22 bp, Homo sapiens
atagaatatgacttttagatcc

SEQ ID NO: 84360 - DNA, 22 bp, Homo sapiens
agagagcccgggccagggcaca

SEQ ID NO: 84361 - DNA, 22 bp, Homo sapiens
gaaggtggcgagcggattgctg

SEQ ID NO: 84362 - DNA, 22 bp, Homo sapiens
atgattgaccatctgctgggct

SEQ ID NO: 84363 - DNA, 21 bp, Homo sapiens
ctacttaagtaggggattagg

SEQ ID NO: 84364 - DNA, 22 bp, Homo sapiens
ttgtgtgtactggttatgggca

SEQ ID NO: 84365 - DNA, 22 bp, Homo sapiens
attgtcgtcaatggacacatag

SEQ ID NO: 84366 - DNA, 22 bp, Homo sapiens
cctcggctgggccttggccact

SEQ ID NO: 84367 - DNA, 22 bp, Homo sapiens
aagttgttgttgaggtgggtaa

SEQ ID NO: 84368 - DNA, 22 bp, Homo sapiens
ctagggtcaggggcctgcgtcg

SEQ ID NO: 84369 - DNA, 22 bp, Homo sapiens
ttgtgaatagtgccgcaataaa

SEQ ID NO: 84370 - DNA, 21 bp, Homo sapiens
ggcaagaaacacaatcaagta

SEQ ID NO: 84371 - DNA, 22 bp, Homo sapiens
aaatgcacaaagattttgcact

SEQ ID NO: 84372 - DNA, 22 bp, Homo sapiens
gctgggacaacaggtgagcacc

SEQ ID NO: 84373 - DNA, 22 bp, Homo sapiens
atgccaggaacaaacagtggtg

SEQ ID NO: 84374 - DNA, 22 bp, Homo sapiens
acatctagactcttgccctctt

SEQ ID NO: 84375 - DNA, 23 bp, Homo sapiens
acagcaagaggaccagatgtgag

SEQ ID NO: 84376 - DNA, 22 bp, Homo sapiens
aggtacatggggtgtgtgcacg

SEQ ID NO: 84377 - DNA, 22 bp, Homo sapiens
tgaggaaacttacaaggcagaa

SEQ ID NO: 84378 - DNA, 21 bp, Homo sapiens
aaggacgaggttttgattaca

SEQ ID NO: 84379 - DNA, 22 bp, Homo sapiens
cacatgaaggctggggtcgtga

SEQ ID NO: 84380 - DNA, 22 bp, Homo sapiens
ggcaggaggtgagtggcgggtg

SEQ ID NO: 84381 - DNA, 22 bp, Homo sapiens
cggctcactgcagctccgcctc

SEQ ID NO: 84382 - DNA, 22 bp, Homo sapiens
gcctggagaaaggaaggtggga

SEQ ID NO: 84383 - DNA, 22 bp, Homo sapiens
aattacagtcggagcagcactg

SEQ ID NO: 84384 - DNA, 22 bp, Homo sapiens
ccccaggacgtggccctcatag

SEQ ID NO: 84385 - DNA, 22 bp, Homo sapiens
ggagacagggttgaaccacgca

SEQ ID NO: 84386 - DNA, 18 bp, Homo sapiens
tgggaagaaattcttctc

SEQ ID NO: 84387 - DNA, 23 bp, Homo sapiens
tctacaaagctgtgtcaggaccc

SEQ ID NO: 84388 - DNA, 22 bp, Homo sapiens
aggggagccagggctgcgagtt

SEQ ID NO: 84389 - DNA, 19 bp, Homo sapiens
tccaggggctccacctcct

SEQ ID NO: 84390 - DNA, 22 bp, Homo sapiens
gccgggaccaaggccacggagc

SEQ ID NO: 84391 - DNA, 22 bp, Homo sapiens
ctccttctgggcctggcagtgg

SEQ ID NO: 84392 - DNA, 22 bp, Homo sapiens
cacctgtacagggccgggctgg

SEQ ID NO: 84393 - DNA, 18 bp, Homo sapiens
tgagaggctattttttgc

SEQ ID NO: 84394 - DNA, 22 bp, Homo sapiens
ctgaggaaggctgggggcatcc

SEQ ID NO: 84395 - DNA, 22 bp, Homo sapiens
atgtatatgcatgcattcaaag

SEQ ID NO: 84396 - DNA, 22 bp, Homo sapiens
tggagaattctatgttgagggg

SEQ ID NO: 84397 - DNA, 22 bp, Homo sapiens
tgtgacaagcattgtatattgg

SEQ ID NO: 84398 - DNA, 22 bp, Homo sapiens
tgcctgttgcccacctgataaa

SEQ ID NO: 84399 - DNA, 22 bp, Homo sapiens
ccctttagcccctgcagagact

SEQ ID NO: 84400 - DNA, 22 bp, Homo sapiens
cctagagctctgctttatctaa

SEQ ID NO: 84401 - DNA, 22 bp, Homo sapiens
aactcactttgtggcttctgaa

SEQ ID NO: 84402 - DNA, 22 bp, Homo sapiens
gaggccacggaagggagctgtg

SEQ ID NO: 84403 - DNA, 22 bp, Homo sapiens
caggagctcaagaccaccctgg

SEQ ID NO: 84404 - DNA, 22 bp, Homo sapiens
agcactgatttaaactggattt

SEQ ID NO: 84405 - DNA, 22 bp, Homo sapiens
gcacggctaatttttgtatttt

SEQ ID NO: 84406 - DNA, 22 bp, Homo sapiens
caggctggagtgcagtggtgcc

SEQ ID NO: 84407 - DNA, 22 bp, Homo sapiens
attcgcgggcctggagggtggg

SEQ ID NO: 84408 - DNA, 22 bp, Homo sapiens
ctcctctttagccccagctgga

SEQ ID NO: 84409 - DNA, 22 bp, Homo sapiens
tgcgggtcccagggtcacaggc

SEQ ID NO: 84410 - DNA, 22 bp, Homo sapiens
ccaaagtgctgggattacaggc

SEQ ID NO: 84411 - DNA, 22 bp, Homo sapiens
ttctccgctaagttctctgcag

SEQ ID NO: 84412 - DNA, 22 bp, Homo sapiens
ttagggttacaccagcctcctg

SEQ ID NO: 84413 - DNA, 22 bp, Homo sapiens
gctcactgcaacctccgccttc

SEQ ID NO: 84414 - DNA, 22 bp, Homo sapiens
gacaggaggcagagctcaggtg

SEQ ID NO: 84415 - DNA, 20 bp, Homo sapiens
gctgaggtggaggaaggaga

SEQ ID NO: 84416 - DNA, 22 bp, Homo sapiens
tgtgactggttgtcccgctttc

SEQ ID NO: 84417 - DNA, 22 bp, Homo sapiens
tctctatttgcctaggcttgtg

SEQ ID NO: 84418 - DNA, 22 bp, Homo sapiens
tgatctcctgaccttgtaatcc

SEQ ID NO: 84419 - DNA, 22 bp, Homo sapiens
gcccttacagggtggtcagcca

SEQ ID NO: 84420 - DNA, 22 bp, Homo sapiens
gatggaggagatggcagggtgc

SEQ ID NO: 84421 - DNA, 22 bp, Homo sapiens
tcagtgttaatcagtggtacct

SEQ ID NO: 84422 - DNA, 22 bp, Homo sapiens
ccagaggagttgaggctttggg

SEQ ID NO: 84423 - DNA, 22 bp, Homo sapiens
gggccccaagaacctcctcctg

SEQ ID NO: 84424 - DNA, 22 bp, Homo sapiens
gtggcagagccaaggctggagc

SEQ ID NO: 84425 - DNA, 22 bp, Homo sapiens
cactgcccaccaagtggctggt

SEQ ID NO: 84426 - DNA, 21 bp, Homo sapiens
gaacccagcagcagtgctctg

SEQ ID NO: 84427 - DNA, 22 bp, Homo sapiens
tttctttatcatagcatctttg

SEQ ID NO: 84428 - DNA, 22 bp, Homo sapiens
tcatggggccacagctgccagc

SEQ ID NO: 84429 - DNA, 22 bp, Homo sapiens
gagcaggaaggccagaagggtc

SEQ ID NO: 84430 - DNA, 22 bp, Homo sapiens
tggtcttagctggaaggaggga

SEQ ID NO: 84431 - DNA, 22 bp, Homo sapiens
gttgtgaatagtgccgcaataa

SEQ ID NO: 84432 - DNA, 22 bp, Homo sapiens
cagtgcagccaaggacaggcac

SEQ ID NO: 84433 - DNA, 22 bp, Homo sapiens
tcgcaccattgcactccagcca

SEQ ID NO: 84434 - DNA, 22 bp, Homo sapiens
atctgagtcaaatatttcattt

SEQ ID NO: 84435 - DNA, 22 bp, Homo sapiens
tgttcagaacaaaggtaaatga

SEQ ID NO: 84436 - DNA, 22 bp, Homo sapiens
aggaatgacagatgtccgcacc

SEQ ID NO: 84437 - DNA, 22 bp, Homo sapiens
gtggcaggagggcatcacttgg

SEQ ID NO: 84438 - DNA, 22 bp, Homo sapiens
tgggtgagcggctgcacacccg

SEQ ID NO: 84439 - DNA, 22 bp, Homo sapiens
ggtgacggggcccaggtttcct

SEQ ID NO: 84440 - DNA, 22 bp, Homo sapiens
tgtccccacccaaatctcatct

SEQ ID NO: 84441 - DNA, 19 bp, Homo sapiens
agagtattgaatttgccct

SEQ ID NO: 84442 - DNA, 22 bp, Homo sapiens
aagatgcggttgaccatggtgt

SEQ ID NO: 84443 - DNA, 17 bp, Homo sapiens
gtaaggcttgcagatgc

SEQ ID NO: 84444 - DNA, 22 bp, Homo sapiens
tgatcaaaacattactccacca

SEQ ID NO: 84445 - DNA, 22 bp, Homo sapiens
ttttcctggagatggagttgtt

SEQ ID NO: 84446 - DNA, 22 bp, Homo sapiens
agccagggacgctgcaggctac

SEQ ID NO: 84447 - DNA, 22 bp, Homo sapiens
tgcccaggctggagtgcagtgg

SEQ ID NO: 84448 - DNA, 22 bp, Homo sapiens
ggaggagcatgagagggtagtg

SEQ ID NO: 84449 - DNA, 22 bp, Homo sapiens
gagggtggtggcttaaggtgct

SEQ ID NO: 84450 - DNA, 22 bp, Homo sapiens
ttccgctgtttagttgaagttt

SEQ ID NO: 84451 - DNA, 22 bp, Homo sapiens
gggcccttcagcttcctctgca

SEQ ID NO: 84452 - DNA, 22 bp, Homo sapiens
gtacaaatgcaggtttgttaca

SEQ ID NO: 84453 - DNA, 22 bp, Homo sapiens
taaagggtaggttttactgtaa

SEQ ID NO: 84454 - DNA, 22 bp, Homo sapiens
tccttcactccctctgcatcca

SEQ ID NO: 84455 - DNA, 22 bp, Homo sapiens
atgcccaatgtcacaatttttg

SEQ ID NO: 84456 - DNA, 22 bp, Homo sapiens
tgttttaagctctagaagggga

SEQ ID NO: 84457 - DNA, 18 bp, Homo sapiens
gcagctagccaggggggc

SEQ ID NO: 84458 - DNA, 22 bp, Homo sapiens
ctgggatgcggaggttgcggtg

SEQ ID NO: 84459 - DNA, 22 bp, Homo sapiens
aaggatacttttagagcctgag

SEQ ID NO: 84460 - DNA, 22 bp, Homo sapiens
atgtacataaaatgtataatga

SEQ ID NO: 84461 - DNA, 22 bp, Homo sapiens
tacagtgcttggtatctagtaa

SEQ ID NO: 84462 - DNA, 22 bp, Homo sapiens
tctgtcttagccatctcaggct

SEQ ID NO: 84463 - DNA, 22 bp, Homo sapiens
ttcaaatgatggcagtcctggc

SEQ ID NO: 84464 - DNA, 22 bp, Homo sapiens
aaaaatcacttttataggcagc

SEQ ID NO: 84465 - DNA, 22 bp, Homo sapiens
acaggtgcatgctaccatgtct

SEQ ID NO: 84466 - DNA, 22 bp, Homo sapiens
ttgtatagcccagagagtgaga

SEQ ID NO: 84467 - DNA, 22 bp, Homo sapiens
gctcccaccgccgctatgggta

SEQ ID NO: 84468 - DNA, 22 bp, Homo sapiens
cgtcacttcttagtctattttc

SEQ ID NO: 84469 - DNA, 16 bp, Homo sapiens
aggtggagaagttcac

SEQ ID NO: 84470 - DNA, 22 bp, Homo sapiens
gccagggttcgaatccgtatgg

SEQ ID NO: 84471 - DNA, 22 bp, Homo sapiens
gggagaggttacccgagcaact

SEQ ID NO: 84472 - DNA, 22 bp, Homo sapiens
gggtaaatctcttttcatggct

SEQ ID NO: 84473 - DNA, 22 bp, Homo sapiens
tgttcttgagcctttagaccta

SEQ ID NO: 84474 - DNA, 22 bp, Homo sapiens
ctgctctgctgatcagtgtctc

SEQ ID NO: 84475 - DNA, 22 bp, Homo sapiens
ttgatgagaccattgccgcgtc

SEQ ID NO: 84476 - DNA, 22 bp, Homo sapiens
ccccatgaagtagggtctctga

SEQ ID NO: 84477 - DNA, 22 bp, Homo sapiens
ttcattttctttcacgctgctg

SEQ ID NO: 84478 - DNA, 22 bp, Homo sapiens
taaattgagattattagggtaa

SEQ ID NO: 84479 - DNA, 22 bp, Homo sapiens
ggaaacttggatgccagcactc

SEQ ID NO: 84480 - DNA, 22 bp, Homo sapiens
aagtgctgggattacaggtgtc

SEQ ID NO: 84481 - DNA, 20 bp, Homo sapiens
tgtccccaccaaaatttcat

SEQ ID NO: 84482 - DNA, 22 bp, Homo sapiens
tcactgcaagctcctcctcctg

SEQ ID NO: 84483 - DNA, 22 bp, Homo sapiens
gaggagggagctggaagctctt

SEQ ID NO: 84484 - DNA, 22 bp, Homo sapiens
ttcctttctctggactgcagcc

SEQ ID NO: 84485 - DNA, 22 bp, Homo sapiens
gggttgaggcggatgtcggcgg

SEQ ID NO: 84486 - DNA, 22 bp, Homo sapiens
tggatgctgtaggacacgctct

SEQ ID NO: 84487 - DNA, 22 bp, Homo sapiens
cgagcatgatgacggctgtggc

SEQ ID NO: 84488 - DNA, 22 bp, Homo sapiens
cagctgctgttcagttttgttt

SEQ ID NO: 84489 - DNA, 22 bp, Homo sapiens
gaggcaggcagattgcttgagg

SEQ ID NO: 84490 - DNA, 22 bp, Homo sapiens
gagcccaggagtttgatgctgc

SEQ ID NO: 84491 - DNA, 22 bp, Homo sapiens
ttggatccatctcaggcatagg

SEQ ID NO: 84492 - DNA, 22 bp, Homo sapiens
tgaccacattgatttctcatcc

SEQ ID NO: 84493 - DNA, 22 bp, Homo sapiens
ggaggcggaggttgcagtgagc

SEQ ID NO: 84494 - DNA, 22 bp, Homo sapiens
ttccagctaactcacatccctt

SEQ ID NO: 84495 - DNA, 21 bp, Homo sapiens
gcagcagtgttctagaatact

SEQ ID NO: 84496 - DNA, 22 bp, Homo sapiens
ttagtctctttgcattgccata

SEQ ID NO: 84497 - DNA, 23 bp, Homo sapiens
aatgggtgcaactatccatgaca

SEQ ID NO: 84498 - DNA, 23 bp, Homo sapiens
gcctgggagttgcgatctgcccg

SEQ ID NO: 84499 - DNA, 22 bp, Homo sapiens
taatggattaacgtccctgtcg

SEQ ID NO: 84500 - DNA, 23 bp, Homo sapiens
tatgaactgcattgctggtgtgt

SEQ ID NO: 84501 - DNA, 22 bp, Homo sapiens
gaggcagaggttgttgcagtga

SEQ ID NO: 84502 - DNA, 22 bp, Homo sapiens
ctacttgttcactgtaggtcgc

SEQ ID NO: 84503 - DNA, 22 bp, Homo sapiens
caggaggacatactggctcaca

SEQ ID NO: 84504 - DNA, 22 bp, Homo sapiens
cagtcacaagcgtacctaattt

SEQ ID NO: 84505 - DNA, 22 bp, Homo sapiens
gtgcggatcggtgtcctccaaa

SEQ ID NO: 84506 - DNA, 22 bp, Homo sapiens
tggctccacaggccagggtgtg

SEQ ID NO: 84507 - DNA, 22 bp, Homo sapiens
catagagtgatgtaaggtatgt

SEQ ID NO: 84508 - DNA, 22 bp, Homo sapiens
tcaggcagtagaattgcttgaa

SEQ ID NO: 84509 - DNA, 22 bp, Homo sapiens
tcatgttgaattatcgttccca

SEQ ID NO: 84510 - DNA, 22 bp, Homo sapiens
agacgctattttgaggggtcta

SEQ ID NO: 84511 - DNA, 22 bp, Homo sapiens
cccgagcctcggtttcttttct

SEQ ID NO: 84512 - DNA, 22 bp, Homo sapiens
gtgagccgagtatagttcatag

SEQ ID NO: 84513 - DNA, 22 bp, Homo sapiens
taggtagctttggcgtttcttg

SEQ ID NO: 84514 - DNA, 22 bp, Homo sapiens
gcccaggctggagtgcagtggt

SEQ ID NO: 84515 - DNA, 22 bp, Homo sapiens
ctgatctcaagtgatccaccca

SEQ ID NO: 84516 - DNA, 22 bp, Homo sapiens
aggcactgtgcagtcccaagca

SEQ ID NO: 84517 - DNA, 22 bp, Homo sapiens
taattgtaaagtagtagtacag

SEQ ID NO: 84518 - DNA, 22 bp, Homo sapiens
aagtgctgggattacaggcatg

SEQ ID NO: 84519 - DNA, 22 bp, Homo sapiens
tgtgaagatagctgttacatct

SEQ ID NO: 84520 - DNA, 23 bp, Homo sapiens
cagagctggctcagagctgcctg

SEQ ID NO: 84521 - DNA, 22 bp, Homo sapiens
gaaagcatccgcctggaggtgg

SEQ ID NO: 84522 - DNA, 22 bp, Homo sapiens
ccaggggggcgtagatgctggg

SEQ ID NO: 84523 - DNA, 22 bp, Homo sapiens
ggtaacttagctcatggctgtg

SEQ ID NO: 84524 - DNA, 18 bp, Homo sapiens
tgtccctgcaaataacat

SEQ ID NO: 84525 - DNA, 22 bp, Homo sapiens
agaagcattggaccaggggccc

SEQ ID NO: 84526 - DNA, 21 bp, Homo sapiens
gttcaaatcctgacactacac

SEQ ID NO: 84527 - DNA, 22 bp, Homo sapiens
gattccacagcttcgaggtctt

SEQ ID NO: 84528 - DNA, 22 bp, Homo sapiens
tgccgcagtgcggggagggccc

SEQ ID NO: 84529 - DNA, 22 bp, Homo sapiens
cagccagtgtgaccgaggagga

SEQ ID NO: 84530 - DNA, 22 bp, Homo sapiens
gatttttatataaagtgagaaa

SEQ ID NO: 84531 - DNA, 22 bp, Homo sapiens
cactgcactccagcccgggcaa

SEQ ID NO: 84532 - DNA, 22 bp, Homo sapiens
ccctggctgataccggaaaggc

SEQ ID NO: 84533 - DNA, 22 bp, Homo sapiens
ttgcctgtgtcagcaggtggaa

SEQ ID NO: 84534 - DNA, 22 bp, Homo sapiens
tcattgccatggcatttgcaga

SEQ ID NO: 84535 - DNA, 22 bp, Homo sapiens
gtgcatgtcggggtgcatgtca

SEQ ID NO: 84536 - DNA, 22 bp, Homo sapiens
aagcccttggcgcacaccgggc

SEQ ID NO: 84537 - DNA, 22 bp, Homo sapiens
caggccagggttgagaagagaa

SEQ ID NO: 84538 - DNA, 21 bp, Homo sapiens
agctgcctccacttctgaggc

SEQ ID NO: 84539 - DNA, 22 bp, Homo sapiens
tagatctgatacaattcatctg

SEQ ID NO: 84540 - DNA, 22 bp, Homo sapiens
ccaggagctggagggtgcagtg

SEQ ID NO: 84541 - DNA, 22 bp, Homo sapiens
gacccttagaatgtgatcttat

SEQ ID NO: 84542 - DNA, 22 bp, Homo sapiens
tgctgtgaggttgagaaggaag

SEQ ID NO: 84543 - DNA, 22 bp, Homo sapiens
aggggctcctttgtgctgcgtc

SEQ ID NO: 84544 - DNA, 22 bp, Homo sapiens
tcatcagggatattggcctgaa

SEQ ID NO: 84545 - DNA, 22 bp, Homo sapiens
cccaggaggtcgaagctgcagt

SEQ ID NO: 84546 - DNA, 22 bp, Homo sapiens
cccagaaggtcgaggctgcagt

SEQ ID NO: 84547 - DNA, 22 bp, Homo sapiens
ctaggtgatccactgctctctt

SEQ ID NO: 84548 - DNA, 22 bp, Homo sapiens
gctccctggtagccatgctctc

SEQ ID NO: 84549 - DNA, 22 bp, Homo sapiens
ctcgtgatccgcccacctcagc

SEQ ID NO: 84550 - DNA, 22 bp, Homo sapiens
cccagggagagcgcggaggcgg

SEQ ID NO: 84551 - DNA, 22 bp, Homo sapiens
gggagtgggtttggcctaggcc

SEQ ID NO: 84552 - DNA, 22 bp, Homo sapiens
cttatcagattatctgggctgt

SEQ ID NO: 84553 - DNA, 22 bp, Homo sapiens
tcttggtatacgcatggcattg

SEQ ID NO: 84554 - DNA, 22 bp, Homo sapiens
tgtgtcccttggaacctcagct

SEQ ID NO: 84555 - DNA, 22 bp, Homo sapiens
cagggaaagtcccaccccacac

SEQ ID NO: 84556 - DNA, 22 bp, Homo sapiens
tgtaagtagtaatggaaggaca

SEQ ID NO: 84557 - DNA, 22 bp, Homo sapiens
caccgcggagtgatggagaaac

SEQ ID NO: 84558 - DNA, 22 bp, Homo sapiens
tgaacgcaggtccacatggctc

SEQ ID NO: 84559 - DNA, 22 bp, Homo sapiens
ctgccgttgtgaagctcttaga

SEQ ID NO: 84560 - DNA, 22 bp, Homo sapiens
gaggggcacagtaaagggtccc

SEQ ID NO: 84561 - DNA, 22 bp, Homo sapiens
aatgttacgatcaacaacacat

SEQ ID NO: 84562 - DNA, 22 bp, Homo sapiens
gagaactttctgtgtttttatc

SEQ ID NO: 84563 - DNA, 22 bp, Homo sapiens
cactgcagcctcgctctcctga

SEQ ID NO: 84564 - DNA, 22 bp, Homo sapiens
tcctccccaaagcccagcctgg

SEQ ID NO: 84565 - DNA, 22 bp, Homo sapiens
gagaaatgcatgcatgtcatca

SEQ ID NO: 84566 - DNA, 23 bp, Homo sapiens
ggagtgcaatggcgccatctcgg

SEQ ID NO: 84567 - DNA, 22 bp, Homo sapiens
tagagctggccgggacagctgg

SEQ ID NO: 84568 - DNA, 22 bp, Homo sapiens
tcagtgatttctggggtgaggg

SEQ ID NO: 84569 - DNA, 22 bp, Homo sapiens
cccaggaggcagatgttgcagt

SEQ ID NO: 84570 - DNA, 22 bp, Homo sapiens
gccagccagaaacgtcacactg

SEQ ID NO: 84571 - DNA, 22 bp, Homo sapiens
ggctcaatgcaacttctgcctc

SEQ ID NO: 84572 - DNA, 22 bp, Homo sapiens
gtggctcacgtctgtcatctca

SEQ ID NO: 84573 - DNA, 22 bp, Homo sapiens
tacaggcatgtagcatggtgat

SEQ ID NO: 84574 - DNA, 22 bp, Homo sapiens
agagttaagctttgcctaaaga

SEQ ID NO: 84575 - DNA, 22 bp, Homo sapiens
ctactttaacatggaggcactt

SEQ ID NO: 84576 - DNA, 22 bp, Homo sapiens
tttttgggtccaggctgtatct

SEQ ID NO: 84577 - DNA, 22 bp, Homo sapiens
tgtgtgagtaaggctgagagag

SEQ ID NO: 84578 - DNA, 22 bp, Homo sapiens
tggctgagttacgaacagagca

SEQ ID NO: 84579 - DNA, 23 bp, Homo sapiens
cctgcctccccatcagttataca

SEQ ID NO: 84580 - DNA, 22 bp, Homo sapiens
gtaatagtctcaaactcctgga

SEQ ID NO: 84581 - DNA, 22 bp, Homo sapiens
cagaccagaaggaagccgacaa

SEQ ID NO: 84582 - DNA, 22 bp, Homo sapiens
tcgcccaggatggagtgcagta

SEQ ID NO: 84583 - DNA, 22 bp, Homo sapiens
cccaggaggcagaagttgcagt

SEQ ID NO: 84584 - DNA, 22 bp, Homo sapiens
tgtgaagaattaatgtgaatca

SEQ ID NO: 84585 - DNA, 22 bp, Homo sapiens
ttctccacccactcttttgttg

SEQ ID NO: 84586 - DNA, 22 bp, Homo sapiens
ctctgcaagtccagcccctggc

SEQ ID NO: 84587 - DNA, 22 bp, Homo sapiens
taaaggtagtgtgacatattgt

SEQ ID NO: 84588 - DNA, 22 bp, Homo sapiens
ctgccctggggggcctccttgc

SEQ ID NO: 84589 - DNA, 22 bp, Homo sapiens
gtcagatctttggggatgctgt

SEQ ID NO: 84590 - DNA, 22 bp, Homo sapiens
tgcgggttggtggcatatgcag

SEQ ID NO: 84591 - DNA, 22 bp, Homo sapiens
acatcccttgctcggggcccct

SEQ ID NO: 84592 - DNA, 22 bp, Homo sapiens
cctctgtgtgatgcgcaaagta

SEQ ID NO: 84593 - DNA, 22 bp, Homo sapiens
agtctagtaggatctctgggct

SEQ ID NO: 84594 - DNA, 22 bp, Homo sapiens
cactctgcagctgaagggctgg

SEQ ID NO: 84595 - DNA, 23 bp, Homo sapiens
acctgtctgcctcccaccatcaa

SEQ ID NO: 84596 - DNA, 22 bp, Homo sapiens
atctccgccatcgcgaacgcct

SEQ ID NO: 84597 - DNA, 17 bp, Homo sapiens
aggaggccctggcgttt

SEQ ID NO: 84598 - DNA, 22 bp, Homo sapiens
tggtggggccagacttcagctc

SEQ ID NO: 84599 - DNA, 22 bp, Homo sapiens
ggagaggggaacttgttgcttg

SEQ ID NO: 84600 - DNA, 22 bp, Homo sapiens
ctcattgcaacctccgcctccc

SEQ ID NO: 84601 - DNA, 22 bp, Homo sapiens
ctgctcctgtccagcagggcca

SEQ ID NO: 84602 - DNA, 22 bp, Homo sapiens
tactttgtccatttgcaggcag

SEQ ID NO: 84603 - DNA, 22 bp, Homo sapiens
gagaaagcttctttcccacagg

SEQ ID NO: 84604 - DNA, 22 bp, Homo sapiens
agcccggcttccccggttgcta

SEQ ID NO: 84605 - DNA, 22 bp, Homo sapiens
tgaacatgctgttgatggcctg

SEQ ID NO: 84606 - DNA, 22 bp, Homo sapiens
gtagggttggagagcacaacca

SEQ ID NO: 84607 - DNA, 22 bp, Homo sapiens
ccacccttgggttcggaggccg

SEQ ID NO: 84608 - DNA, 22 bp, Homo sapiens
caaggtgccatgctgggcgggg

SEQ ID NO: 84609 - DNA, 22 bp, Homo sapiens
cttctcttcctttgtcaactga

SEQ ID NO: 84610 - DNA, 22 bp, Homo sapiens
tgtgggagaaggaagcaagctg

SEQ ID NO: 84611 - DNA, 22 bp, Homo sapiens
ttatatgtttctgtttggaggc

SEQ ID NO: 84612 - DNA, 22 bp, Homo sapiens
ctacaaaagtaattgtggtttt

SEQ ID NO: 84613 - DNA, 22 bp, Homo sapiens
gcaggctgtctaaagttagagt

SEQ ID NO: 84614 - DNA, 22 bp, Homo sapiens
tcgcccaggctggaagtgcagt

SEQ ID NO: 84615 - DNA, 23 bp, Homo sapiens
aatggtcttcctccacccctctg

SEQ ID NO: 84616 - DNA, 19 bp, Homo sapiens
gttttgcaggcagagggga

SEQ ID NO: 84617 - DNA, 17 bp, Homo sapiens
ccctcactcctgccggg

SEQ ID NO: 84618 - DNA, 22 bp, Homo sapiens
attaagtgactaaagtaatgct

SEQ ID NO: 84619 - DNA, 22 bp, Homo sapiens
ctcactgcaagctccgcctccc

SEQ ID NO: 84620 - DNA, 22 bp, Homo sapiens
attaaagctatccagtcatgaa

SEQ ID NO: 84621 - DNA, 22 bp, Homo sapiens
acatttatataactcactagga

SEQ ID NO: 84622 - DNA, 22 bp, Homo sapiens
tggcatctttgtcccagaagct

SEQ ID NO: 84623 - DNA, 22 bp, Homo sapiens
gaaagagaacctgggcctagat

SEQ ID NO: 84624 - DNA, 22 bp, Homo sapiens
gagccccaccctagacattctg

SEQ ID NO: 84625 - DNA, 22 bp, Homo sapiens
gggaaatctcgtcctctattta

SEQ ID NO: 84626 - DNA, 22 bp, Homo sapiens
aaacccagggttttgtcttccc

SEQ ID NO: 84627 - DNA, 22 bp, Homo sapiens
tttaagaagttatgttataaat

SEQ ID NO: 84628 - DNA, 22 bp, Homo sapiens
ttatgatttgccacagattggt

SEQ ID NO: 84629 - DNA, 22 bp, Homo sapiens
caggtggcagtgcctgcattct

SEQ ID NO: 84630 - DNA, 22 bp, Homo sapiens
tgagccaggagtttgaggctgt

SEQ ID NO: 84631 - DNA, 22 bp, Homo sapiens
aggtttctttatgctgctagaa

SEQ ID NO: 84632 - DNA, 22 bp, Homo sapiens
tgctttgtgacagattagtttt

SEQ ID NO: 84633 - DNA, 22 bp, Homo sapiens
atacaaaaattagccgggagta

SEQ ID NO: 84634 - DNA, 22 bp, Homo sapiens
gccctcctggcaggcagtgatg

SEQ ID NO: 84635 - DNA, 22 bp, Homo sapiens
gctgctttgtctgtaaaatgga

SEQ ID NO: 84636 - DNA, 22 bp, Homo sapiens
tgacttgtctctttgggagaca

SEQ ID NO: 84637 - DNA, 22 bp, Homo sapiens
tcctccagttccttggtttcag

SEQ ID NO: 84638 - DNA, 22 bp, Homo sapiens
acctagaatttaaaacattgct

SEQ ID NO: 84639 - DNA, 22 bp, Homo sapiens
tggtggctcacgtctgtaatct

SEQ ID NO: 84640 - DNA, 22 bp, Homo sapiens
agggaagcagcagccgcctgtc

SEQ ID NO: 84641 - DNA, 20 bp, Homo sapiens
aaacgagccatcattctggt

SEQ ID NO: 84642 - DNA, 22 bp, Homo sapiens
gaggcgggcagatcacctgagg

SEQ ID NO: 84643 - DNA, 22 bp, Homo sapiens
aggctctgtcaggcggagcagc

SEQ ID NO: 84644 - DNA, 22 bp, Homo sapiens
tgagtagagaattcagctaagg

SEQ ID NO: 84645 - DNA, 22 bp, Homo sapiens
aggaggggttctcgggtgctga

SEQ ID NO: 84646 - DNA, 22 bp, Homo sapiens
tggctcatttctaaacccagct

SEQ ID NO: 84647 - DNA, 22 bp, Homo sapiens
ctgggctcaagtgatccaccca

SEQ ID NO: 84648 - DNA, 22 bp, Homo sapiens
taattataacagttacatctta

SEQ ID NO: 84649 - DNA, 22 bp, Homo sapiens
tgagctgtatattgttttaata

SEQ ID NO: 84650 - DNA, 22 bp, Homo sapiens
ttccagttctgggctggctgct

SEQ ID NO: 84651 - DNA, 22 bp, Homo sapiens
cttaatctcacctgcaaagtcc

SEQ ID NO: 84652 - DNA, 22 bp, Homo sapiens
atatgcagtctcttgcccttct

SEQ ID NO: 84653 - DNA, 22 bp, Homo sapiens
ctgggtggcagagcctgcagtg

SEQ ID NO: 84654 - DNA, 22 bp, Homo sapiens
gcagagctcatgcctgcacctc

SEQ ID NO: 84655 - DNA, 22 bp, Homo sapiens
gataccagacagggagggagaa

SEQ ID NO: 84656 - DNA, 22 bp, Homo sapiens
tctcatttacttccacaggctg

SEQ ID NO: 84657 - DNA, 22 bp, Homo sapiens
tctagttctagatccctgagga

SEQ ID NO: 84658 - DNA, 22 bp, Homo sapiens
ggggccgaccgcggttcaggcc

SEQ ID NO: 84659 - DNA, 22 bp, Homo sapiens
gggacatctttctagtcagggt

SEQ ID NO: 84660 - DNA, 17 bp, Homo sapiens
gggcagggactcctggg

SEQ ID NO: 84661 - DNA, 22 bp, Homo sapiens
agcccaggagtttgaggctgtg

SEQ ID NO: 84662 - DNA, 22 bp, Homo sapiens
tccaggtgggctgcacccaggc

SEQ ID NO: 84663 - DNA, 22 bp, Homo sapiens
acagcacttgggttttcctgtt

SEQ ID NO: 84664 - DNA, 22 bp, Homo sapiens
gaggaggcttccgggaggcacg

SEQ ID NO: 84665 - DNA, 22 bp, Homo sapiens
ctctggagtgtctggccagggt

SEQ ID NO: 84666 - DNA, 22 bp, Homo sapiens
ttatgggagcaattggggaggt

SEQ ID NO: 84667 - DNA, 22 bp, Homo sapiens
cccacacacatttatgatagga

SEQ ID NO: 84668 - DNA, 22 bp, Homo sapiens
agcataagttggtacagccact

SEQ ID NO: 84669 - DNA, 22 bp, Homo sapiens
ctcggcaggtggaggttgtagt

SEQ ID NO: 84670 - DNA, 22 bp, Homo sapiens
tttgctattgtgaatagtgcca

SEQ ID NO: 84671 - DNA, 22 bp, Homo sapiens
gcagtggcatgatgtgggctca

SEQ ID NO: 84672 - DNA, 22 bp, Homo sapiens
cactgcagcctcaaattcctgg

SEQ ID NO: 84673 - DNA, 22 bp, Homo sapiens
aggctagaggcttctggcttca

SEQ ID NO: 84674 - DNA, 22 bp, Homo sapiens
ggggtcggggcatagccactta

SEQ ID NO: 84675 - DNA, 22 bp, Homo sapiens
atggcaccttccccagagctca

SEQ ID NO: 84676 - DNA, 22 bp, Homo sapiens
attgtactacaccatagtactg

SEQ ID NO: 84677 - DNA, 22 bp, Homo sapiens
ttacaaagtttaaggtggcact

SEQ ID NO: 84678 - DNA, 22 bp, Homo sapiens
accactgcccatggtgaaaact

SEQ ID NO: 84679 - DNA, 22 bp, Homo sapiens
agcccaggctggagtgcagtgg

SEQ ID NO: 84680 - DNA, 22 bp, Homo sapiens
ggggcaggagcccttcttcagc

SEQ ID NO: 84681 - DNA, 22 bp, Homo sapiens
gagagaagggggatatgagcct

SEQ ID NO: 84682 - DNA, 22 bp, Homo sapiens
gaagtttttgtagagacagggt

SEQ ID NO: 84683 - DNA, 22 bp, Homo sapiens
ctcactgcaacctccgcctcct

SEQ ID NO: 84684 - DNA, 22 bp, Homo sapiens
cagctgcccctccagggctggg

SEQ ID NO: 84685 - DNA, 22 bp, Homo sapiens
ggactgggaatcagggagatgc

SEQ ID NO: 84686 - DNA, 22 bp, Homo sapiens
tactgtgtgcccagccgagctg

SEQ ID NO: 84687 - DNA, 22 bp, Homo sapiens
ttattgaaggaactgaaataaa

SEQ ID NO: 84688 - DNA, 22 bp, Homo sapiens
ctggagcaaaagtgactcctct

SEQ ID NO: 84689 - DNA, 22 bp, Homo sapiens
gaggctggacgtgcatttctac

SEQ ID NO: 84690 - DNA, 22 bp, Homo sapiens
cagcagcattgctctggattcc

SEQ ID NO: 84691 - DNA, 22 bp, Homo sapiens
cctggtgcaggtgtgttgccag

SEQ ID NO: 84692 - DNA, 22 bp, Homo sapiens
agcctggcggtcgtcggtcagg

SEQ ID NO: 84693 - DNA, 22 bp, Homo sapiens
atgaattgaggaaaacagtcgt

SEQ ID NO: 84694 - DNA, 22 bp, Homo sapiens
ggcatagatttctttaggttta

SEQ ID NO: 84695 - DNA, 22 bp, Homo sapiens
ttaggatttgaaaaggggcaga

SEQ ID NO: 84696 - DNA, 22 bp, Homo sapiens
agagctgggtggacttgtagtt

SEQ ID NO: 84697 - DNA, 22 bp, Homo sapiens
tgagccgtggtctctgagggtg

SEQ ID NO: 84698 - DNA, 22 bp, Homo sapiens
cacccaggctggagtgcagtgg

SEQ ID NO: 84699 - DNA, 22 bp, Homo sapiens
tttacacagaggacactgggct

SEQ ID NO: 84700 - DNA, 22 bp, Homo sapiens
aaaatatgtataactcttctgc

SEQ ID NO: 84701 - DNA, 22 bp, Homo sapiens
cagaaaccaaatgggatgggga

SEQ ID NO: 84702 - DNA, 22 bp, Homo sapiens
agtatgtcagagtgaaaatggt

SEQ ID NO: 84703 - DNA, 19 bp, Homo sapiens
ccctcttgcacaaagcaaa

SEQ ID NO: 84704 - DNA, 22 bp, Homo sapiens
cagcttggaggaggatctaaga

SEQ ID NO: 84705 - DNA, 22 bp, Homo sapiens
ctgggaggcggagcttgcagtg

SEQ ID NO: 84706 - DNA, 22 bp, Homo sapiens
ccaaagtgctgagattacaggt

SEQ ID NO: 84707 - DNA, 22 bp, Homo sapiens
tctccgatcacaggttttcaat

SEQ ID NO: 84708 - DNA, 22 bp, Homo sapiens
tggaatgtcagctacaagaggg

SEQ ID NO: 84709 - DNA, 19 bp, Homo sapiens
tcctggggaggggcatggc

SEQ ID NO: 84710 - DNA, 22 bp, Homo sapiens
ttggaaacgtcaccttttcctt

SEQ ID NO: 84711 - DNA, 22 bp, Homo sapiens
gttattgaggtggagtctcact

SEQ ID NO: 84712 - DNA, 22 bp, Homo sapiens
tgatttatgcattatactgttg

SEQ ID NO: 84713 - DNA, 18 bp, Homo sapiens
tggcgatggtcatttttc

SEQ ID NO: 84714 - DNA, 22 bp, Homo sapiens
tggaagctcaaggcagggtgag

SEQ ID NO: 84715 - DNA, 22 bp, Homo sapiens
gagtggggggtccgtctcagtg

SEQ ID NO: 84716 - DNA, 23 bp, Homo sapiens
actgagccagggcctgggtcagc

SEQ ID NO: 84717 - DNA, 22 bp, Homo sapiens
aggtggaaatggctttcctagg

SEQ ID NO: 84718 - DNA, 22 bp, Homo sapiens
aaagattaaatcaaattggtca

SEQ ID NO: 84719 - DNA, 22 bp, Homo sapiens
gaatgaacaaatgtggtggaga

SEQ ID NO: 84720 - DNA, 22 bp, Homo sapiens
ctgggcacagcgttgggctctt

SEQ ID NO: 84721 - DNA, 22 bp, Homo sapiens
tgctcttcacagtttcagcatc

SEQ ID NO: 84722 - DNA, 18 bp, Homo sapiens
cagggctgtggggtcact

SEQ ID NO: 84723 - DNA, 22 bp, Homo sapiens
aacactgctgctgggttctgtg

SEQ ID NO: 84724 - DNA, 23 bp, Homo sapiens
tgaggcaggcggatcacgaggtc

SEQ ID NO: 84725 - DNA, 22 bp, Homo sapiens
tcccagattcctgctcttatat

SEQ ID NO: 84726 - DNA, 22 bp, Homo sapiens
ccctgccttgtctgggctaggt

SEQ ID NO: 84727 - DNA, 22 bp, Homo sapiens
aggtggcagatgggggtgctcg

SEQ ID NO: 84728 - DNA, 22 bp, Homo sapiens
gcgtctcaaggcccccaggcca

SEQ ID NO: 84729 - DNA, 22 bp, Homo sapiens
tccaggtgacagagacaggata

SEQ ID NO: 84730 - DNA, 22 bp, Homo sapiens
accacctcatcaagctggattg

SEQ ID NO: 84731 - DNA, 22 bp, Homo sapiens
ggtttgttggggtccaggccca

SEQ ID NO: 84732 - DNA, 22 bp, Homo sapiens
cttccccaggacctctgctaaa

SEQ ID NO: 84733 - DNA, 22 bp, Homo sapiens
aagacttgaccaggttgaaggc

SEQ ID NO: 84734 - DNA, 22 bp, Homo sapiens
gcttaattctggctcagtttcc

SEQ ID NO: 84735 - DNA, 22 bp, Homo sapiens
ggctcacgcaattatcccggcc

SEQ ID NO: 84736 - DNA, 22 bp, Homo sapiens
tagattcagatatttaggacaa

SEQ ID NO: 84737 - DNA, 22 bp, Homo sapiens
gccacctcggctttctctgctc

SEQ ID NO: 84738 - DNA, 22 bp, Homo sapiens
tgaaggggttcagcatgggggt

SEQ ID NO: 84739 - DNA, 22 bp, Homo sapiens
actcccagaacatgctcttctt

SEQ ID NO: 84740 - DNA, 22 bp, Homo sapiens
aggccctattcaatggggccca

SEQ ID NO: 84741 - DNA, 22 bp, Homo sapiens
caactgggataaagagctaaag

SEQ ID NO: 84742 - DNA, 20 bp, Homo sapiens
aaactaaaggtgtttggttt

SEQ ID NO: 84743 - DNA, 22 bp, Homo sapiens
tcactacaacctccgcctcctg

SEQ ID NO: 84744 - DNA, 22 bp, Homo sapiens
ttcctgttcaggaaagttgtgt

SEQ ID NO: 84745 - DNA, 22 bp, Homo sapiens
ttgaggcctgctggaaggtgtt

SEQ ID NO: 84746 - DNA, 22 bp, Homo sapiens
agggctgcccagtgtgagagct

SEQ ID NO: 84747 - DNA, 22 bp, Homo sapiens
ttcaatttgtgctaaggcaccg

SEQ ID NO: 84748 - DNA, 22 bp, Homo sapiens
ctcactgcaagctctgcctccc

SEQ ID NO: 84749 - DNA, 22 bp, Homo sapiens
catgcggctctttccaaaccgg

SEQ ID NO: 84750 - DNA, 22 bp, Homo sapiens
actgcaaagggaagccctttct

SEQ ID NO: 84751 - DNA, 22 bp, Homo sapiens
cttcctctgtggccagagtgta

SEQ ID NO: 84752 - DNA, 22 bp, Homo sapiens
atggatcagaatcccgggaggg

SEQ ID NO: 84753 - DNA, 21 bp, Homo sapiens
gggcactgaaagggaatagca

SEQ ID NO: 84754 - DNA, 21 bp, Homo sapiens
cggaaaggactagggctcaga

SEQ ID NO: 84755 - DNA, 22 bp, Homo sapiens
ggtggttcacgcctataatccc

SEQ ID NO: 84756 - DNA, 22 bp, Homo sapiens
cccaactactctcaggcagctt

SEQ ID NO: 84757 - DNA, 22 bp, Homo sapiens
cacctcaggcagcaaagtctca

SEQ ID NO: 84758 - DNA, 22 bp, Homo sapiens
ggttccccaggcggcccttgga

SEQ ID NO: 84759 - DNA, 22 bp, Homo sapiens
gaattttattactagtcaactg

SEQ ID NO: 84760 - DNA, 16 bp, Homo sapiens
tgggtgggaggagcgg

SEQ ID NO: 84761 - DNA, 22 bp, Homo sapiens
catttctgggagacatgctaga

SEQ ID NO: 84762 - DNA, 15 bp, Homo sapiens
tggcccacccgttga

SEQ ID NO: 84763 - DNA, 22 bp, Homo sapiens
taagggttcagaatgcagtggt

SEQ ID NO: 84764 - DNA, 22 bp, Homo sapiens
aggctgtagtgcatgtgctatg

SEQ ID NO: 84765 - DNA, 22 bp, Homo sapiens
aggggatgcctagtggagtctc

SEQ ID NO: 84766 - DNA, 22 bp, Homo sapiens
cacgcacgctgggtggaggcgc

SEQ ID NO: 84767 - DNA, 22 bp, Homo sapiens
catgagataatttttctccagt

SEQ ID NO: 84768 - DNA, 22 bp, Homo sapiens
aaggtgggcagatcacaaggtc

SEQ ID NO: 84769 - DNA, 22 bp, Homo sapiens
tagcaaaggatgactatgtacc

SEQ ID NO: 84770 - DNA, 22 bp, Homo sapiens
aatcaactgagccctggttctc

SEQ ID NO: 84771 - DNA, 22 bp, Homo sapiens
tggacaggcaagcaagacatac

SEQ ID NO: 84772 - DNA, 22 bp, Homo sapiens
tgcctccctggcaagtctctcc

SEQ ID NO: 84773 - DNA, 22 bp, Homo sapiens
cagtggaggccttgggaccttt

SEQ ID NO: 84774 - DNA, 22 bp, Homo sapiens
tcagcctggcaggatggcctgg

SEQ ID NO: 84775 - DNA, 22 bp, Homo sapiens
gccactgagcccggccattgtt

SEQ ID NO: 84776 - DNA, 22 bp, Homo sapiens
atattgttagtaatatttcgaa

SEQ ID NO: 84777 - DNA, 22 bp, Homo sapiens
gctggcagacttcctctggaac

SEQ ID NO: 84778 - DNA, 22 bp, Homo sapiens
agatttatgtggtcacactcag

SEQ ID NO: 84779 - DNA, 22 bp, Homo sapiens
tgtgagttattttcaggagttt

SEQ ID NO: 84780 - DNA, 22 bp, Homo sapiens
ctcactgcaacctctgccccca

SEQ ID NO: 84781 - DNA, 22 bp, Homo sapiens
gattcactcatattttacgttt

SEQ ID NO: 84782 - DNA, 22 bp, Homo sapiens
agctggtgtgccagttccagtt

SEQ ID NO: 84783 - DNA, 22 bp, Homo sapiens
gcaggcagaggtggaggagaca

SEQ ID NO: 84784 - DNA, 22 bp, Homo sapiens
gcctccagggatgattccttcc

SEQ ID NO: 84785 - DNA, 23 bp, Homo sapiens
gctcatcaggcttagagtcaagg

SEQ ID NO: 84786 - DNA, 22 bp, Homo sapiens
tccagggagagccgctgctcca

SEQ ID NO: 84787 - DNA, 22 bp, Homo sapiens
gttcatcactcagagacctccc

SEQ ID NO: 84788 - DNA, 22 bp, Homo sapiens
gcagcagtgctttggaatcctg

SEQ ID NO: 84789 - DNA, 22 bp, Homo sapiens
taattcttcaggccttttgtct

SEQ ID NO: 84790 - DNA, 22 bp, Homo sapiens
cattccttaacgtggggagtct

SEQ ID NO: 84791 - DNA, 22 bp, Homo sapiens
agagcccctgggtcacacagcc

SEQ ID NO: 84792 - DNA, 19 bp, Homo sapiens
tccaaagaagttcacattt

SEQ ID NO: 84793 - DNA, 20 bp, Homo sapiens
tttgagaccagtctgcccaa

SEQ ID NO: 84794 - DNA, 22 bp, Homo sapiens
cctgggctctgtcagaattggg

SEQ ID NO: 84795 - DNA, 22 bp, Homo sapiens
atgttatgtctgggaaggggta

SEQ ID NO: 84796 - DNA, 22 bp, Homo sapiens
tcgaatggcaaggaaagaggct

SEQ ID NO: 84797 - DNA, 22 bp, Homo sapiens
ctggctgggagcgagctgctca

SEQ ID NO: 84798 - DNA, 22 bp, Homo sapiens
tgttgatttgtgggctgcaaaa

SEQ ID NO: 84799 - DNA, 22 bp, Homo sapiens
ttttaatactgctattgtagga

SEQ ID NO: 84800 - DNA, 22 bp, Homo sapiens
tatgttgcaccaacctaataat

SEQ ID NO: 84801 - DNA, 22 bp, Homo sapiens
cccaggaattggaggctgcagt

SEQ ID NO: 84802 - DNA, 22 bp, Homo sapiens
gcctgcagggcctgggcctacc

SEQ ID NO: 84803 - DNA, 22 bp, Homo sapiens
ccacgtccagctaattttcgta

SEQ ID NO: 84804 - DNA, 22 bp, Homo sapiens
gaagagtggttatccctgctgt

SEQ ID NO: 84805 - DNA, 22 bp, Homo sapiens
acagcagagcctggtacttact

SEQ ID NO: 84806 - DNA, 22 bp, Homo sapiens
acaaacagagttgaaaaatagg

SEQ ID NO: 84807 - DNA, 22 bp, Homo sapiens
tgtctgttattggtgtataaga

SEQ ID NO: 84808 - DNA, 22 bp, Homo sapiens
tgagcccagagatctgagctat

SEQ ID NO: 84809 - DNA, 22 bp, Homo sapiens
aggggaatgggtagactgttga

SEQ ID NO: 84810 - DNA, 22 bp, Homo sapiens
aggaattcaagaccagctgggc

SEQ ID NO: 84811 - DNA, 22 bp, Homo sapiens
tctgttgactcctagcagccat

SEQ ID NO: 84812 - DNA, 22 bp, Homo sapiens
acaatgaagctccactgagctt

SEQ ID NO: 84813 - DNA, 22 bp, Homo sapiens
ggcatctggatctgcttctccc

SEQ ID NO: 84814 - DNA, 22 bp, Homo sapiens
gggcgcatcacctgaggtcagg

SEQ ID NO: 84815 - DNA, 22 bp, Homo sapiens
accctcaacaaattcactctat

SEQ ID NO: 84816 - DNA, 22 bp, Homo sapiens
tgaaatgtgttctagtgttttg

SEQ ID NO: 84817 - DNA, 22 bp, Homo sapiens
cagagcccctcgtctccaccac

SEQ ID NO: 84818 - DNA, 22 bp, Homo sapiens
aacccagggtggaggttgcagt

SEQ ID NO: 84819 - DNA, 22 bp, Homo sapiens
cggcatccccacttcctcctgc

SEQ ID NO: 84820 - DNA, 22 bp, Homo sapiens
aagattttcagtgcctaaaaca

SEQ ID NO: 84821 - DNA, 22 bp, Homo sapiens
gccccagcctcccgagtagctg

SEQ ID NO: 84822 - DNA, 22 bp, Homo sapiens
ccagatatcactgccgtgttgt

SEQ ID NO: 84823 - DNA, 22 bp, Homo sapiens
ctggagggctgcagcgaggctg

SEQ ID NO: 84824 - DNA, 22 bp, Homo sapiens
agaggcagtatacaatccgagc

SEQ ID NO: 84825 - DNA, 22 bp, Homo sapiens
gctttatccgcttgacccttac

SEQ ID NO: 84826 - DNA, 22 bp, Homo sapiens
atgaaaacggaccagagctatt

SEQ ID NO: 84827 - DNA, 22 bp, Homo sapiens
cttgcctttgtcttcaaaggct

SEQ ID NO: 84828 - DNA, 22 bp, Homo sapiens
ggggtactggctggagccccac

SEQ ID NO: 84829 - DNA, 22 bp, Homo sapiens
gcctcactgcagccccaggaag

SEQ ID NO: 84830 - DNA, 22 bp, Homo sapiens
tgcgatggcgtagacaaatccc

SEQ ID NO: 84831 - DNA, 22 bp, Homo sapiens
aagttactggcaagggctgcag

SEQ ID NO: 84832 - DNA, 22 bp, Homo sapiens
ggtgagcagctgtctgtatgga

SEQ ID NO: 84833 - DNA, 22 bp, Homo sapiens
acggtgctgggtattggggttc

SEQ ID NO: 84834 - DNA, 22 bp, Homo sapiens
aaactgaggctcccgagggtgt

SEQ ID NO: 84835 - DNA, 22 bp, Homo sapiens
atgcaggcagacactgtgggca

SEQ ID NO: 84836 - DNA, 22 bp, Homo sapiens
agctcaatgcaacctccgcctc

SEQ ID NO: 84837 - DNA, 23 bp, Homo sapiens
tcggtgggcgtggaggccgaggc

SEQ ID NO: 84838 - DNA, 22 bp, Homo sapiens
ggaggcggaagttgcagtgagc

SEQ ID NO: 84839 - DNA, 22 bp, Homo sapiens
taagaaatttagttatagaatg

SEQ ID NO: 84840 - DNA, 22 bp, Homo sapiens
ttgaggtcttcaggatcaggct

SEQ ID NO: 84841 - DNA, 22 bp, Homo sapiens
catgtgtgtctccaccagctgc

SEQ ID NO: 84842 - DNA, 22 bp, Homo sapiens
tatttcttttcgtgacttattg

SEQ ID NO: 84843 - DNA, 22 bp, Homo sapiens
tagccgggtgttgtgtcatgca

SEQ ID NO: 84844 - DNA, 22 bp, Homo sapiens
tgcacgtgggctctctgctctt

SEQ ID NO: 84845 - DNA, 22 bp, Homo sapiens
accagcacttccagaggtcagg

SEQ ID NO: 84846 - DNA, 17 bp, Homo sapiens
ttaaggtggatcagcac

SEQ ID NO: 84847 - DNA, 22 bp, Homo sapiens
taggttttcctaaaattctggt

SEQ ID NO: 84848 - DNA, 22 bp, Homo sapiens
acaagcatgggctttgacatca

SEQ ID NO: 84849 - DNA, 23 bp, Homo sapiens
aggatgtaggatgtatggcagag

SEQ ID NO: 84850 - DNA, 22 bp, Homo sapiens
tgagatggagtctcgctctgtt

SEQ ID NO: 84851 - DNA, 22 bp, Homo sapiens
ggtcgctgtgtaggttcagcta

SEQ ID NO: 84852 - DNA, 22 bp, Homo sapiens
gctgaggctcctcgggaggaca

SEQ ID NO: 84853 - DNA, 22 bp, Homo sapiens
tgagccatgggactccaaggga

SEQ ID NO: 84854 - DNA, 22 bp, Homo sapiens
cttgtattaggaagaatgcttt

SEQ ID NO: 84855 - DNA, 19 bp, Homo sapiens
gcctcatttccacctcccc

SEQ ID NO: 84856 - DNA, 22 bp, Homo sapiens
gaagaaggtggcccaggggtag

SEQ ID NO: 84857 - DNA, 22 bp, Homo sapiens
attgtgaatagtgccgcagtaa

SEQ ID NO: 84858 - DNA, 22 bp, Homo sapiens
tgacatttcctagtgctttgtg

SEQ ID NO: 84859 - DNA, 22 bp, Homo sapiens
aataaacaaatccttccttccc

SEQ ID NO: 84860 - DNA, 22 bp, Homo sapiens
ctgctgagagccccagctgaga

SEQ ID NO: 84861 - DNA, 22 bp, Homo sapiens
gaatatcccgctatgcaaagta

SEQ ID NO: 84862 - DNA, 22 bp, Homo sapiens
tatgaggtaggtattatactta

SEQ ID NO: 84863 - DNA, 22 bp, Homo sapiens
gagctactgaaatattgatttt

SEQ ID NO: 84864 - DNA, 22 bp, Homo sapiens
gtttctctgtctgttacattgg

SEQ ID NO: 84865 - DNA, 22 bp, Homo sapiens
gttgagtgggttaggatgctga

SEQ ID NO: 84866 - DNA, 21 bp, Homo sapiens
tgctccaggagggggcagtcc

SEQ ID NO: 84867 - DNA, 22 bp, Homo sapiens
ggagagtggattccagctgtat

SEQ ID NO: 84868 - DNA, 17 bp, Homo sapiens
ggctgcagtccaggagg

SEQ ID NO: 84869 - DNA, 22 bp, Homo sapiens
atagagtgatgtaaggtatgtg

SEQ ID NO: 84870 - DNA, 22 bp, Homo sapiens
cttctgagatgttgttttacag

SEQ ID NO: 84871 - DNA, 22 bp, Homo sapiens
tttacttcatttccagtgagga

SEQ ID NO: 84872 - DNA, 22 bp, Homo sapiens
tatctatgtgctctgacctctc

SEQ ID NO: 84873 - DNA, 22 bp, Homo sapiens
ctgctcttcacactacacccgt

SEQ ID NO: 84874 - DNA, 22 bp, Homo sapiens
tcagtgcagggtgggagagaga

SEQ ID NO: 84875 - DNA, 22 bp, Homo sapiens
tgtgtggattcatctcaaagag

SEQ ID NO: 84876 - DNA, 22 bp, Homo sapiens
agacccaggattggggctgccg

SEQ ID NO: 84877 - DNA, 22 bp, Homo sapiens
gcttagtcaattataaataggc

SEQ ID NO: 84878 - DNA, 22 bp, Homo sapiens
ggctgggcaggtctgcacaggg

SEQ ID NO: 84879 - DNA, 22 bp, Homo sapiens
tgagagttctctcttcaggtgg

SEQ ID NO: 84880 - DNA, 22 bp, Homo sapiens
ggacaagcctgtgagtgggttt

SEQ ID NO: 84881 - DNA, 22 bp, Homo sapiens
ctgggaggcagaggttgcagtg

SEQ ID NO: 84882 - DNA, 16 bp, Homo sapiens
tggggatggggaagag

SEQ ID NO: 84883 - DNA, 22 bp, Homo sapiens
cgagagttagctaggagtcaca

SEQ ID NO: 84884 - DNA, 22 bp, Homo sapiens
tcagcctgctccaagtgctgcc

SEQ ID NO: 84885 - DNA, 22 bp, Homo sapiens
ctgagctcacgccattctcctt

SEQ ID NO: 84886 - DNA, 22 bp, Homo sapiens
ctgaggcaggatggcctggctg

SEQ ID NO: 84887 - DNA, 22 bp, Homo sapiens
tataaagagtctcaaagaagtt

SEQ ID NO: 84888 - DNA, 22 bp, Homo sapiens
tcttggccactaccacctggag

SEQ ID NO: 84889 - DNA, 22 bp, Homo sapiens
ttgtcgggcttacgcagggcca

SEQ ID NO: 84890 - DNA, 22 bp, Homo sapiens
caggaaggggctcactctggcc

SEQ ID NO: 84891 - DNA, 22 bp, Homo sapiens
agaggaagtaatcaggacctgc

SEQ ID NO: 84892 - DNA, 22 bp, Homo sapiens
ccaaagtgctgggattacaggt

SEQ ID NO: 84893 - DNA, 22 bp, Homo sapiens
agcccaggttgaggctgcagtg

SEQ ID NO: 84894 - DNA, 22 bp, Homo sapiens
aaaaaattatcatagttcctga

SEQ ID NO: 84895 - DNA, 22 bp, Homo sapiens
atatatttgagaatattcatga

SEQ ID NO: 84896 - DNA, 22 bp, Homo sapiens
gagagattaccacgcttcctga

SEQ ID NO: 84897 - DNA, 22 bp, Homo sapiens
tgaatgtgatgctaaacatatg

SEQ ID NO: 84898 - DNA, 22 bp, Homo sapiens
gacctcgtgatctgccggcctt

SEQ ID NO: 84899 - DNA, 19 bp, Homo sapiens
aggcttcaggccacatgct

SEQ ID NO: 84900 - DNA, 21 bp, Homo sapiens
aagaggaagcattatggcata

SEQ ID NO: 84901 - DNA, 22 bp, Homo sapiens
tacaccattcccaggtggattt

SEQ ID NO: 84902 - DNA, 22 bp, Homo sapiens
aagtgctgagactacaggcatg

SEQ ID NO: 84903 - DNA, 22 bp, Homo sapiens
gaccctgtttctacaaataatt

SEQ ID NO: 84904 - DNA, 22 bp, Homo sapiens
agtgtggagcatcgagggcaga

SEQ ID NO: 84905 - DNA, 22 bp, Homo sapiens
agggactatttacccatctcac

SEQ ID NO: 84906 - DNA, 22 bp, Homo sapiens
atgggatgatcacctgagctca

SEQ ID NO: 84907 - DNA, 19 bp, Homo sapiens
gctgaggtggaggaaggag

SEQ ID NO: 84908 - DNA, 22 bp, Homo sapiens
gctctctgcagcctccttggag

SEQ ID NO: 84909 - DNA, 22 bp, Homo sapiens
tccttgaaaggggctgcagggc

SEQ ID NO: 84910 - DNA, 22 bp, Homo sapiens
ggcagagcttgcagtgagccga

SEQ ID NO: 84911 - DNA, 22 bp, Homo sapiens
caccaggctggagtgcagtggc

SEQ ID NO: 84912 - DNA, 22 bp, Homo sapiens
cggtcaggtgcagcgttggcac

SEQ ID NO: 84913 - DNA, 22 bp, Homo sapiens
tctcaagcttgttggtatgttt

SEQ ID NO: 84914 - DNA, 22 bp, Homo sapiens
ttatttttaaaagttcacacag

SEQ ID NO: 84915 - DNA, 22 bp, Homo sapiens
gcagaggacacaggagggcaag

SEQ ID NO: 84916 - DNA, 22 bp, Homo sapiens
atttctctgcagtgttcggaat

SEQ ID NO: 84917 - DNA, 22 bp, Homo sapiens
aacccaggagacaggttgcagt

SEQ ID NO: 84918 - DNA, 22 bp, Homo sapiens
agatcacagtggcaactccctt

SEQ ID NO: 84919 - DNA, 22 bp, Homo sapiens
tcacgtgagggacctgtgtctg

SEQ ID NO: 84920 - DNA, 22 bp, Homo sapiens
ttcttgggaatttttccaacac

SEQ ID NO: 84921 - DNA, 22 bp, Homo sapiens
gcgtggcttagagtggggtacc

SEQ ID NO: 84922 - DNA, 22 bp, Homo sapiens
attgctaggaacaggttgcacc

SEQ ID NO: 84923 - DNA, 22 bp, Homo sapiens
ccacctgagataagagagctca

SEQ ID NO: 84924 - DNA, 22 bp, Homo sapiens
gacaggtgctaagggacctggc

SEQ ID NO: 84925 - DNA, 20 bp, Homo sapiens
tgagacccgctgacaagttc

SEQ ID NO: 84926 - DNA, 22 bp, Homo sapiens
taacagtatatttaccaaacct

SEQ ID NO: 84927 - DNA, 21 bp, Homo sapiens
ctgtttgcaagcctatgtgtc

SEQ ID NO: 84928 - DNA, 22 bp, Homo sapiens
tcttgggcatgtgtttgatttc

SEQ ID NO: 84929 - DNA, 22 bp, Homo sapiens
agaggggcccggttctccgtct

SEQ ID NO: 84930 - DNA, 22 bp, Homo sapiens
agtgcagtggttaggagccagg

SEQ ID NO: 84931 - DNA, 20 bp, Homo sapiens
tgttctgtcgtctttcttca

SEQ ID NO: 84932 - DNA, 22 bp, Homo sapiens
ccaggctggagtgcaatggcgt

SEQ ID NO: 84933 - DNA, 22 bp, Homo sapiens
tctaatcctatggtggggaggg

SEQ ID NO: 84934 - DNA, 22 bp, Homo sapiens
ttgaccactgaatggttctgaa

SEQ ID NO: 84935 - DNA, 22 bp, Homo sapiens
gggctgggattgcttgctgtga

SEQ ID NO: 84936 - DNA, 20 bp, Homo sapiens
agagatggggtatcaccgta

SEQ ID NO: 84937 - DNA, 19 bp, Homo sapiens
gactcacaccttccgctgt

SEQ ID NO: 84938 - DNA, 22 bp, Homo sapiens
ccctggaggcggagcttgcagt

SEQ ID NO: 84939 - DNA, 22 bp, Homo sapiens
gtggctgcagcggctgtggaga

SEQ ID NO: 84940 - DNA, 22 bp, Homo sapiens
ttttaagttggattgctaagta

SEQ ID NO: 84941 - DNA, 22 bp, Homo sapiens
tggtcgaccagttggaaagtaa

SEQ ID NO: 84942 - DNA, 23 bp, Homo sapiens
tgagctgggcctgcaggggtctc

SEQ ID NO: 84943 - DNA, 22 bp, Homo sapiens
tggcccagtatgtataatctta

SEQ ID NO: 84944 - DNA, 22 bp, Homo sapiens
acgcccagactcccatactttg

SEQ ID NO: 84945 - DNA, 22 bp, Homo sapiens
tcctgggtccatggcagccgaa

SEQ ID NO: 84946 - DNA, 22 bp, Homo sapiens
aagtgctgggattataggcatg

SEQ ID NO: 84947 - DNA, 22 bp, Homo sapiens
caggagatgacagggaagaacc

SEQ ID NO: 84948 - DNA, 22 bp, Homo sapiens
attgggatgccggctgataaga

SEQ ID NO: 84949 - DNA, 22 bp, Homo sapiens
tatgccactgctctccatccta

SEQ ID NO: 84950 - DNA, 22 bp, Homo sapiens
tggctcactgtagccttgacct

SEQ ID NO: 84951 - DNA, 22 bp, Homo sapiens
tctaatccttgctacctgggtg

SEQ ID NO: 84952 - DNA, 22 bp, Homo sapiens
ttcaccctggaccagaaattgg

SEQ ID NO: 84953 - DNA, 22 bp, Homo sapiens
aagcagagaatctgggagcgag

SEQ ID NO: 84954 - DNA, 22 bp, Homo sapiens
accccaggaagtggaggtcatg

SEQ ID NO: 84955 - DNA, 22 bp, Homo sapiens
ggagagcttggagtgcgatttt

SEQ ID NO: 84956 - DNA, 22 bp, Homo sapiens
cacccaggctggattgcagtgg

SEQ ID NO: 84957 - DNA, 22 bp, Homo sapiens
cccaggggttcaaggctgcagt

SEQ ID NO: 84958 - DNA, 22 bp, Homo sapiens
cttgtcttgcacacggttgcca

SEQ ID NO: 84959 - DNA, 22 bp, Homo sapiens
tgagatggagccactgcactct

SEQ ID NO: 84960 - DNA, 22 bp, Homo sapiens
aactaatacattaatacatgtg

SEQ ID NO: 84961 - DNA, 22 bp, Homo sapiens
actcagtacatctggagttggc

SEQ ID NO: 84962 - DNA, 22 bp, Homo sapiens
acccaggctggagtgcagtggg

SEQ ID NO: 84963 - DNA, 22 bp, Homo sapiens
acagtctgtcccccaggtgcta

SEQ ID NO: 84964 - DNA, 22 bp, Homo sapiens
tgaagtcagggattccatgaag

SEQ ID NO: 84965 - DNA, 23 bp, Homo sapiens
aggtaggttattgctgctacctg

SEQ ID NO: 84966 - DNA, 22 bp, Homo sapiens
agtcggaagctgtgcgtaaatc

SEQ ID NO: 84967 - DNA, 22 bp, Homo sapiens
tgatctggtcctactgtgggca

SEQ ID NO: 84968 - DNA, 22 bp, Homo sapiens
aggctccctgaatcgcccgttc

SEQ ID NO: 84969 - DNA, 22 bp, Homo sapiens
cgcaggtgaaagaggctgggca

SEQ ID NO: 84970 - DNA, 22 bp, Homo sapiens
tgtctcctcggctgtccagcca

SEQ ID NO: 84971 - DNA, 22 bp, Homo sapiens
gcctccggagttgcagtgtctt

SEQ ID NO: 84972 - DNA, 22 bp, Homo sapiens
acacttctttgtcacctgcttc

SEQ ID NO: 84973 - DNA, 22 bp, Homo sapiens
ctgctttaaaactgatacatga

SEQ ID NO: 84974 - DNA, 22 bp, Homo sapiens
gcccaggaggcagaggttgtgg

SEQ ID NO: 84975 - DNA, 22 bp, Homo sapiens
cacccaggttggagtgcagtgg

SEQ ID NO: 84976 - DNA, 22 bp, Homo sapiens
atgccactgcgctccagcctgg

SEQ ID NO: 84977 - DNA, 23 bp, Homo sapiens
ttctgggctgtggaagcctcggg

SEQ ID NO: 84978 - DNA, 22 bp, Homo sapiens
ctgcagtcatctgaagattttg

SEQ ID NO: 84979 - DNA, 22 bp, Homo sapiens
ctcactgcaagctcagcctccc

SEQ ID NO: 84980 - DNA, 22 bp, Homo sapiens
tggaacaagggcgtggcggtcg

SEQ ID NO: 84981 - DNA, 22 bp, Homo sapiens
tgcctaggctggagtgtagtgg

SEQ ID NO: 84982 - DNA, 22 bp, Homo sapiens
ctccagttggccccagttggtt

SEQ ID NO: 84983 - DNA, 22 bp, Homo sapiens
gggaggctctgctcagcccccg

SEQ ID NO: 84984 - DNA, 22 bp, Homo sapiens
aaaagcaattgcgggttttgcc

SEQ ID NO: 84985 - DNA, 22 bp, Homo sapiens
ctcctgagctctgaggaagctt

SEQ ID NO: 84986 - DNA, 20 bp, Homo sapiens
tccaaagaagttcacattta

SEQ ID NO: 84987 - DNA, 22 bp, Homo sapiens
ccaggctggagtatagtggcgc

SEQ ID NO: 84988 - DNA, 22 bp, Homo sapiens
gagcctcgtggcggccactgcg

SEQ ID NO: 84989 - DNA, 22 bp, Homo sapiens
ccaggagtgcagggatggtatc

SEQ ID NO: 84990 - DNA, 22 bp, Homo sapiens
acccacgaagatgagcggcatg

SEQ ID NO: 84991 - DNA, 22 bp, Homo sapiens
tggattcacaccattctcctgc

SEQ ID NO: 84992 - DNA, 22 bp, Homo sapiens
aaaagtcttggggaaggccagg

SEQ ID NO: 84993 - DNA, 22 bp, Homo sapiens
tgaagctttaggatgggttcat

SEQ ID NO: 84994 - DNA, 22 bp, Homo sapiens
cagggggctcaaaggagagtgc

SEQ ID NO: 84995 - DNA, 22 bp, Homo sapiens
cggcatgggcgtccccctcact

SEQ ID NO: 84996 - DNA, 22 bp, Homo sapiens
agcctgggcaacagagcaaaac

SEQ ID NO: 84997 - DNA, 22 bp, Homo sapiens
ggttgcaaactcctgggatcaa

SEQ ID NO: 84998 - DNA, 22 bp, Homo sapiens
tgtggactcgcatggctgaggc

SEQ ID NO: 84999 - DNA, 22 bp, Homo sapiens
gcccagcacctctctcagggtt

SEQ ID NO: 85000 - DNA, 22 bp, Homo sapiens
ttggaacatgccggggtccagg

SEQ ID NO: 85001 - DNA, 20 bp, Homo sapiens
cttctggctggtcaaggact

SEQ ID NO: 85002 - DNA, 22 bp, Homo sapiens
agccaccaccactgaaaggtta

SEQ ID NO: 85003 - DNA, 22 bp, Homo sapiens
tccgggagctgaacgtcttgcg

SEQ ID NO: 85004 - DNA, 22 bp, Homo sapiens
tggcacaggatctcagcggcca

SEQ ID NO: 85005 - DNA, 22 bp, Homo sapiens
gaggtaggtgtaggaggcctgc

SEQ ID NO: 85006 - DNA, 22 bp, Homo sapiens
tgccaggcgtggtggtgcgcac

SEQ ID NO: 85007 - DNA, 22 bp, Homo sapiens
ccaggctgctgttggtgtccgc

SEQ ID NO: 85008 - DNA, 22 bp, Homo sapiens
cgcaccactgaattccagcctg

SEQ ID NO: 85009 - DNA, 22 bp, Homo sapiens
cccagggaggcccaggctctgc

SEQ ID NO: 85010 - DNA, 22 bp, Homo sapiens
aggtggagaagagatgggcagt

SEQ ID NO: 85011 - DNA, 22 bp, Homo sapiens
agctggtgctcggggagctggc

SEQ ID NO: 85012 - DNA, 22 bp, Homo sapiens
tttgtcttatccaatctctcag

SEQ ID NO: 85013 - DNA, 21 bp, Homo sapiens
ctggaggcaggtggtgccagg

SEQ ID NO: 85014 - DNA, 22 bp, Homo sapiens
tgcccagggtggagtgcagtgg

SEQ ID NO: 85015 - DNA, 22 bp, Homo sapiens
gcctggccgggtcttggatttt

SEQ ID NO: 85016 - DNA, 22 bp, Homo sapiens
tgtagtagcattcacgaagtgt

SEQ ID NO: 85017 - DNA, 22 bp, Homo sapiens
tcgctgaggctgcacggctgcc

SEQ ID NO: 85018 - DNA, 22 bp, Homo sapiens
ctggcaagaaatatatatctta

SEQ ID NO: 85019 - DNA, 20 bp, Homo sapiens
ataaaataactgccacaaga

SEQ ID NO: 85020 - DNA, 22 bp, Homo sapiens
gaggttggggctgcagtgagct

SEQ ID NO: 85021 - DNA, 20 bp, Homo sapiens
aaattactgccacacatttc

SEQ ID NO: 85022 - DNA, 22 bp, Homo sapiens
ttgagggtctggatctgctgct

SEQ ID NO: 85023 - DNA, 22 bp, Homo sapiens
gccagtggtcactgaggaagaa

SEQ ID NO: 85024 - DNA, 22 bp, Homo sapiens
gctgtgtatcagatgccacggg

SEQ ID NO: 85025 - DNA, 22 bp, Homo sapiens
gggcttggcacatgggctcagc

SEQ ID NO: 85026 - DNA, 19 bp, Homo sapiens
ggtatatgggcctcacttg

SEQ ID NO: 85027 - DNA, 22 bp, Homo sapiens
tcactgcaacctccacctcccg

SEQ ID NO: 85028 - DNA, 22 bp, Homo sapiens
acaggcttacaggctgcaagta

SEQ ID NO: 85029 - DNA, 22 bp, Homo sapiens
tgcacgtgtgagcattcacatg

SEQ ID NO: 85030 - DNA, 22 bp, Homo sapiens
ttcctcaggctgctttcacata

SEQ ID NO: 85031 - DNA, 22 bp, Homo sapiens
cgtcccgggttcacgccattct

SEQ ID NO: 85032 - DNA, 22 bp, Homo sapiens
ttcagcagtgcagacacccagt

SEQ ID NO: 85033 - DNA, 22 bp, Homo sapiens
ggtttattgttaataagtttga

SEQ ID NO: 85034 - DNA, 22 bp, Homo sapiens
gctgccaatccagctgtgggag

SEQ ID NO: 85035 - DNA, 16 bp, Homo sapiens
gcagaggaaaggggag

SEQ ID NO: 85036 - DNA, 18 bp, Homo sapiens
actctttctgcccacagg

SEQ ID NO: 85037 - DNA, 18 bp, Homo sapiens
ggtgagggagctggaagc

SEQ ID NO: 85038 - DNA, 23 bp, Homo sapiens
ctggggctttcaaatctgggcag

SEQ ID NO: 85039 - DNA, 22 bp, Homo sapiens
attctacatgatagaagggaga

SEQ ID NO: 85040 - DNA, 22 bp, Homo sapiens
ttaaatattatgttgtctgcaa

SEQ ID NO: 85041 - DNA, 22 bp, Homo sapiens
gtgctggggagataggaagaga

SEQ ID NO: 85042 - DNA, 22 bp, Homo sapiens
ccaaagtgctaggattacaggt

SEQ ID NO: 85043 - DNA, 22 bp, Homo sapiens
actgcactccagcctgggtgac

SEQ ID NO: 85044 - DNA, 22 bp, Homo sapiens
aattcacatccgaccaggtcaa

SEQ ID NO: 85045 - DNA, 22 bp, Homo sapiens
ctcgttgctgaagccaaagtca

SEQ ID NO: 85046 - DNA, 22 bp, Homo sapiens
ttgtgaatagtgccgctataaa

SEQ ID NO: 85047 - DNA, 22 bp, Homo sapiens
gccttattacctgcactttgaa

SEQ ID NO: 85048 - DNA, 22 bp, Homo sapiens
gtgcacatcgtgcaggtttgtt

SEQ ID NO: 85049 - DNA, 22 bp, Homo sapiens
ccagtgtgcattatcatgtgtc

SEQ ID NO: 85050 - DNA, 22 bp, Homo sapiens
tttcataatactgtacatgaaa

SEQ ID NO: 85051 - DNA, 16 bp, Homo sapiens
gcaggcagatcacatg

SEQ ID NO: 85052 - DNA, 22 bp, Homo sapiens
accgcagtgacgtgggacttcc

SEQ ID NO: 85053 - DNA, 22 bp, Homo sapiens
cactgcacttcagcctgggtga

SEQ ID NO: 85054 - DNA, 22 bp, Homo sapiens
gatgcgggcccgctccactgcc

SEQ ID NO: 85055 - DNA, 22 bp, Homo sapiens
tgtttgagttctagcgcattta

SEQ ID NO: 85056 - DNA, 22 bp, Homo sapiens
cagagagaatcttggcagctga

SEQ ID NO: 85057 - DNA, 22 bp, Homo sapiens
taatgcacatagaagtacttag

SEQ ID NO: 85058 - DNA, 22 bp, Homo sapiens
tccaccatgtaacaagctctgt

SEQ ID NO: 85059 - DNA, 22 bp, Homo sapiens
agacactgttctcacatgcttg

SEQ ID NO: 85060 - DNA, 22 bp, Homo sapiens
tcacttcccagacggggtggca

SEQ ID NO: 85061 - DNA, 22 bp, Homo sapiens
gttctgagtcctcctttgaagg

SEQ ID NO: 85062 - DNA, 22 bp, Homo sapiens
tcctcagaatcacctggcagct

SEQ ID NO: 85063 - DNA, 22 bp, Homo sapiens
cactgcactccagcttgggtga

SEQ ID NO: 85064 - DNA, 22 bp, Homo sapiens
gagccaggggtcagctccgagg

SEQ ID NO: 85065 - DNA, 22 bp, Homo sapiens
gccatcatatcccctgtgacct

SEQ ID NO: 85066 - DNA, 22 bp, Homo sapiens
ttctcatgaaactcgcttcctc

SEQ ID NO: 85067 - DNA, 22 bp, Homo sapiens
tgaccctgagagctgaatggct

SEQ ID NO: 85068 - DNA, 22 bp, Homo sapiens
gcaccaggtgcagccgggcccc

SEQ ID NO: 85069 - DNA, 22 bp, Homo sapiens
caggctggagtacaattgtgtg

SEQ ID NO: 85070 - DNA, 22 bp, Homo sapiens
tttctcctcatgactggttgtg

SEQ ID NO: 85071 - DNA, 22 bp, Homo sapiens
aacagaatgcaggggatgctgc

SEQ ID NO: 85072 - DNA, 22 bp, Homo sapiens
aaaatcttgtgacttaggaagg

SEQ ID NO: 85073 - DNA, 22 bp, Homo sapiens
gctgcagggagctggaaggctc

SEQ ID NO: 85074 - DNA, 22 bp, Homo sapiens
gtgttgatgacattttagaaac

SEQ ID NO: 85075 - DNA, 23 bp, Homo sapiens
ctcctggtgctgctatcaggggt

SEQ ID NO: 85076 - DNA, 22 bp, Homo sapiens
aattatggtcactgttcctggg

SEQ ID NO: 85077 - DNA, 22 bp, Homo sapiens
gcaggtggatcacctgaggtca

SEQ ID NO: 85078 - DNA, 22 bp, Homo sapiens
cgtcatcacggcaagcatctcc

SEQ ID NO: 85079 - DNA, 22 bp, Homo sapiens
tctagtcattcatgctatgatt

SEQ ID NO: 85080 - DNA, 22 bp, Homo sapiens
accctccccaagaggtcgtgcc

SEQ ID NO: 85081 - DNA, 22 bp, Homo sapiens
gggagcttaagacagttccaat

SEQ ID NO: 85082 - DNA, 22 bp, Homo sapiens
acagcagcaatagcagtgacat

SEQ ID NO: 85083 - DNA, 23 bp, Homo sapiens
ctcaccaagcgccgccgctgtgt

SEQ ID NO: 85084 - DNA, 22 bp, Homo sapiens
cggggccctggggctgaaggtc

SEQ ID NO: 85085 - DNA, 22 bp, Homo sapiens
tgagacgaagtcttgctctgtt

SEQ ID NO: 85086 - DNA, 18 bp, Homo sapiens
gcagtgaagaaagagctt

SEQ ID NO: 85087 - DNA, 22 bp, Homo sapiens
tgttgcccaggttctctcctgc

SEQ ID NO: 85088 - DNA, 21 bp, Homo sapiens
ctgtggtacagctgggacgga

SEQ ID NO: 85089 - DNA, 22 bp, Homo sapiens
tctgcaacagtgccctgtaaat

SEQ ID NO: 85090 - DNA, 22 bp, Homo sapiens
agggatggagtgcggcccggac

SEQ ID NO: 85091 - DNA, 22 bp, Homo sapiens
tcctgaagaaggcagatatttg

SEQ ID NO: 85092 - DNA, 22 bp, Homo sapiens
cggaggttgaggctgcagtgag

SEQ ID NO: 85093 - DNA, 22 bp, Homo sapiens
ctgccgtgtttttcatgttaaa

SEQ ID NO: 85094 - DNA, 22 bp, Homo sapiens
ttgttcttgtctttgccttcac

SEQ ID NO: 85095 - DNA, 22 bp, Homo sapiens
agccagggtctctcgctctgtt

SEQ ID NO: 85096 - DNA, 22 bp, Homo sapiens
gggctgagacgatggggtcttc

SEQ ID NO: 85097 - DNA, 22 bp, Homo sapiens
ggctgatgggcatgagctgtca

SEQ ID NO: 85098 - DNA, 22 bp, Homo sapiens
gagcactgatttatttttgtct

SEQ ID NO: 85099 - DNA, 22 bp, Homo sapiens
aacagctttgtatacagtaact

SEQ ID NO: 85100 - DNA, 22 bp, Homo sapiens
tattgagaccagtgcttgctta

SEQ ID NO: 85101 - DNA, 22 bp, Homo sapiens
gaaatctttgccttagctgtgt

SEQ ID NO: 85102 - DNA, 22 bp, Homo sapiens
ctctgtagaaagagcccaggtg

SEQ ID NO: 85103 - DNA, 22 bp, Homo sapiens
gggggagagacgagcggctctg

SEQ ID NO: 85104 - DNA, 22 bp, Homo sapiens
ctcctgaattgtccctcacagc

SEQ ID NO: 85105 - DNA, 22 bp, Homo sapiens
agctgtcaccaggagccggacc

SEQ ID NO: 85106 - DNA, 22 bp, Homo sapiens
atgccactgcactccagcctgg

SEQ ID NO: 85107 - DNA, 22 bp, Homo sapiens
gaatttaagaggatgaatctgt

SEQ ID NO: 85108 - DNA, 22 bp, Homo sapiens
tgctgagcgcatccggcggccg

SEQ ID NO: 85109 - DNA, 22 bp, Homo sapiens
cagctgttcattgttgccaccc

SEQ ID NO: 85110 - DNA, 22 bp, Homo sapiens
caggtgagaggcggtcctgcat

SEQ ID NO: 85111 - DNA, 22 bp, Homo sapiens
actgcaacctccacctcctggg

SEQ ID NO: 85112 - DNA, 22 bp, Homo sapiens
gggccctgggattcagagcaag

SEQ ID NO: 85113 - DNA, 22 bp, Homo sapiens
ctagggtgtgcagattttgcct

SEQ ID NO: 85114 - DNA, 19 bp, Homo sapiens
atcccaaggagctgggact

SEQ ID NO: 85115 - DNA, 22 bp, Homo sapiens
actccacatttgaacacagttc

SEQ ID NO: 85116 - DNA, 22 bp, Homo sapiens
ctgaggcaggcagatcacttga

SEQ ID NO: 85117 - DNA, 22 bp, Homo sapiens
tcaaattgtcatcttgataatg

SEQ ID NO: 85118 - DNA, 22 bp, Homo sapiens
atcttcccaggctggggagagg

SEQ ID NO: 85119 - DNA, 22 bp, Homo sapiens
catgtaaagaatttcacacaag

SEQ ID NO: 85120 - DNA, 22 bp, Homo sapiens
tttctggcagcgggacaggggt

SEQ ID NO: 85121 - DNA, 22 bp, Homo sapiens
tggcactgagcagccgcggcag

SEQ ID NO: 85122 - DNA, 22 bp, Homo sapiens
ggggtggatttcaggcggtgtc

SEQ ID NO: 85123 - DNA, 22 bp, Homo sapiens
gtccctgagcctggcatttccc

SEQ ID NO: 85124 - DNA, 22 bp, Homo sapiens
attgtaaatagtgccacaataa

SEQ ID NO: 85125 - DNA, 22 bp, Homo sapiens
caaagtgctgggattacaggct

SEQ ID NO: 85126 - DNA, 22 bp, Homo sapiens
ttatcacttatgagctttttgc

SEQ ID NO: 85127 - DNA, 22 bp, Homo sapiens
ggctgagttgagaggattactt

SEQ ID NO: 85128 - DNA, 22 bp, Homo sapiens
aggcgcctgcgggatccttgcc

SEQ ID NO: 85129 - DNA, 22 bp, Homo sapiens
tgtctcttttcaagctaccctt

SEQ ID NO: 85130 - DNA, 22 bp, Homo sapiens
gaatcccaatctgttattgaca

SEQ ID NO: 85131 - DNA, 22 bp, Homo sapiens
agaaaatttaaagagacacaca

SEQ ID NO: 85132 - DNA, 22 bp, Homo sapiens
gcaaatacatgttgagcaccta

SEQ ID NO: 85133 - DNA, 18 bp, Homo sapiens
atgagaggtgtcagaaga

SEQ ID NO: 85134 - DNA, 22 bp, Homo sapiens
cattctctctacttgttttcaa

SEQ ID NO: 85135 - DNA, 22 bp, Homo sapiens
gtctccttgtggatctcaagga

SEQ ID NO: 85136 - DNA, 22 bp, Homo sapiens
tgacctattagatttccttgcc

SEQ ID NO: 85137 - DNA, 22 bp, Homo sapiens
gggaggttctgttcgcacttga

SEQ ID NO: 85138 - DNA, 22 bp, Homo sapiens
aatgctgagtcctgtgagtctt

SEQ ID NO: 85139 - DNA, 22 bp, Homo sapiens
gagcatcgctgagatcccagac

SEQ ID NO: 85140 - DNA, 22 bp, Homo sapiens
tttgaagactactgggagtgaa

SEQ ID NO: 85141 - DNA, 22 bp, Homo sapiens
ggaggtggaggttgcagtgagc

SEQ ID NO: 85142 - DNA, 22 bp, Homo sapiens
ggaggcggaggttgcagtgagt

SEQ ID NO: 85143 - DNA, 22 bp, Homo sapiens
ttgtaacaggtactaaataact

SEQ ID NO: 85144 - DNA, 22 bp, Homo sapiens
gagtctctgaccagggtgccaa

SEQ ID NO: 85145 - DNA, 23 bp, Homo sapiens
ggaagctcacgtagtcctgcact

SEQ ID NO: 85146 - DNA, 22 bp, Homo sapiens
gctcactgcaacctctgcctcc

SEQ ID NO: 85147 - DNA, 22 bp, Homo sapiens
atgggttcaagtgattctcctg

SEQ ID NO: 85148 - DNA, 22 bp, Homo sapiens
tgatgggaggtgctgcaggacc

SEQ ID NO: 85149 - DNA, 22 bp, Homo sapiens
gggaaactttcacaatgtccag

SEQ ID NO: 85150 - DNA, 22 bp, Homo sapiens
cccaggaggtggagttcacagt

SEQ ID NO: 85151 - DNA, 22 bp, Homo sapiens
gctcatgactgtaatcccagca

SEQ ID NO: 85152 - DNA, 22 bp, Homo sapiens
tgggatgccctgaccctctgga

SEQ ID NO: 85153 - DNA, 23 bp, Homo sapiens
tcagaacagttcttggtgcatag

SEQ ID NO: 85154 - DNA, 22 bp, Homo sapiens
cccaggctggagtgtaatggtg

SEQ ID NO: 85155 - DNA, 22 bp, Homo sapiens
tgatctaggttggcttcaactg

SEQ ID NO: 85156 - DNA, 23 bp, Homo sapiens
atgggccaagcaagacccatgac

SEQ ID NO: 85157 - DNA, 19 bp, Homo sapiens
acacagggatcagagggtt

SEQ ID NO: 85158 - DNA, 22 bp, Homo sapiens
ctgccaggattctgtgaacccc

SEQ ID NO: 85159 - DNA, 22 bp, Homo sapiens
tggtttgtctaaatgagtaata

SEQ ID NO: 85160 - DNA, 22 bp, Homo sapiens
aggctcccaagcactgacccca

SEQ ID NO: 85161 - DNA, 22 bp, Homo sapiens
aggtcacccgtttgactatcca

SEQ ID NO: 85162 - DNA, 22 bp, Homo sapiens
atgtgggccgtgcgggtgtcct

SEQ ID NO: 85163 - DNA, 22 bp, Homo sapiens
gggctgtaggagctggaatggg

SEQ ID NO: 85164 - DNA, 22 bp, Homo sapiens
tacttttagcctatttgattct

SEQ ID NO: 85165 - DNA, 22 bp, Homo sapiens
gccatgggcaaatgcagagctg

SEQ ID NO: 85166 - DNA, 22 bp, Homo sapiens
tgctccagcaccaagagctcca

SEQ ID NO: 85167 - DNA, 22 bp, Homo sapiens
gctgtatgtgaggccacagtga

SEQ ID NO: 85168 - DNA, 22 bp, Homo sapiens
tcgcccaggctggagtgcagtg

SEQ ID NO: 85169 - DNA, 22 bp, Homo sapiens
ccaggaggtggagattgcagtg

SEQ ID NO: 85170 - DNA, 22 bp, Homo sapiens
tctcgctctgtcgcccaggctg

SEQ ID NO: 85171 - DNA, 22 bp, Homo sapiens
aagtcgtggcaggcttgcacga

SEQ ID NO: 85172 - DNA, 22 bp, Homo sapiens
ataaagctattcctctcttttt

SEQ ID NO: 85173 - DNA, 19 bp, Homo sapiens
ccagagagctaggtacaga

SEQ ID NO: 85174 - DNA, 22 bp, Homo sapiens
aattgcactttagcaatggtga

SEQ ID NO: 85175 - DNA, 22 bp, Homo sapiens
actacagtgtgataagaggggc

SEQ ID NO: 85176 - DNA, 22 bp, Homo sapiens
ggctgggctccgggagcatgcg

SEQ ID NO: 85177 - DNA, 22 bp, Homo sapiens
gttgaggtgatgccagccctgc

SEQ ID NO: 85178 - DNA, 22 bp, Homo sapiens
gaggccactgtccctgccttcc

SEQ ID NO: 85179 - DNA, 22 bp, Homo sapiens
ttcatcttgatggcttcctaat

SEQ ID NO: 85180 - DNA, 19 bp, Homo sapiens
tctgaagaattagagagca

SEQ ID NO: 85181 - DNA, 23 bp, Homo sapiens
gttttacaggtgagaaaatggag

SEQ ID NO: 85182 - DNA, 22 bp, Homo sapiens
tgtgcctactgatagagccaag

SEQ ID NO: 85183 - DNA, 22 bp, Homo sapiens
tgtccttatctccaaacaatca

SEQ ID NO: 85184 - DNA, 22 bp, Homo sapiens
aggtgactggtttatctggcag

SEQ ID NO: 85185 - DNA, 22 bp, Homo sapiens
cgctgcagaagcgtgttcagga

SEQ ID NO: 85186 - DNA, 22 bp, Homo sapiens
tagcccctgcctttgaacctgg

SEQ ID NO: 85187 - DNA, 22 bp, Homo sapiens
acttcttcttcagctgggggat

SEQ ID NO: 85188 - DNA, 22 bp, Homo sapiens
tatgtgtttgacaccctgcaag

SEQ ID NO: 85189 - DNA, 22 bp, Homo sapiens
atattgaaccctacagactgta

SEQ ID NO: 85190 - DNA, 22 bp, Homo sapiens
gaagaggttcaacgtggtcatc

SEQ ID NO: 85191 - DNA, 22 bp, Homo sapiens
ttttctgtttgcttcaagacat

SEQ ID NO: 85192 - DNA, 22 bp, Homo sapiens
tgaggcaggaggattgcaggat

SEQ ID NO: 85193 - DNA, 22 bp, Homo sapiens
aagagactgtaaaggcgtgagt

SEQ ID NO: 85194 - DNA, 22 bp, Homo sapiens
attctcaaaacataacttcact

SEQ ID NO: 85195 - DNA, 20 bp, Homo sapiens
ggggcccaagccctcttgcc

SEQ ID NO: 85196 - DNA, 22 bp, Homo sapiens
agaggaggctctgggatcgtcc

SEQ ID NO: 85197 - DNA, 22 bp, Homo sapiens
tacactgtttgaactgtggtcg

SEQ ID NO: 85198 - DNA, 22 bp, Homo sapiens
cagtctctaaatcaatctgaat

SEQ ID NO: 85199 - DNA, 22 bp, Homo sapiens
aagaggtagcagtcacaaaaga

SEQ ID NO: 85200 - DNA, 22 bp, Homo sapiens
tgggtgctctgcgaccgtaggg

SEQ ID NO: 85201 - DNA, 17 bp, Homo sapiens
tggtccaggtggagcca

SEQ ID NO: 85202 - DNA, 22 bp, Homo sapiens
cccagcgagtttgccggtgaac

SEQ ID NO: 85203 - DNA, 22 bp, Homo sapiens
actgcacttcaccctgggtgac

SEQ ID NO: 85204 - DNA, 22 bp, Homo sapiens
tcccggcgctgggaggtgggtc

SEQ ID NO: 85205 - DNA, 22 bp, Homo sapiens
ctctctgggcccagttggcacc

SEQ ID NO: 85206 - DNA, 22 bp, Homo sapiens
acactgatgttggccctggtca

SEQ ID NO: 85207 - DNA, 22 bp, Homo sapiens
ggaactcctgctccaagcagct

SEQ ID NO: 85208 - DNA, 22 bp, Homo sapiens
actccacaccacgggggccgcc

SEQ ID NO: 85209 - DNA, 22 bp, Homo sapiens
cctgcacagccggacccctgct

SEQ ID NO: 85210 - DNA, 22 bp, Homo sapiens
cagcagagaaattacatatttg

SEQ ID NO: 85211 - DNA, 22 bp, Homo sapiens
atacacgtgccatgttggtgtg

SEQ ID NO: 85212 - DNA, 22 bp, Homo sapiens
gtccaagagtcaagaagggggc

SEQ ID NO: 85213 - DNA, 22 bp, Homo sapiens
ggttggtaactccctgtgcagt

SEQ ID NO: 85214 - DNA, 22 bp, Homo sapiens
cgtgagcaaaatggacactccc

SEQ ID NO: 85215 - DNA, 20 bp, Homo sapiens
cggtgcagacagcccctcgt

SEQ ID NO: 85216 - DNA, 22 bp, Homo sapiens
tgctcgccccacatgccctcat

SEQ ID NO: 85217 - DNA, 22 bp, Homo sapiens
gactacaggtgtgtgccaccat

SEQ ID NO: 85218 - DNA, 22 bp, Homo sapiens
cctcgacctccccaggctcagg

SEQ ID NO: 85219 - DNA, 22 bp, Homo sapiens
tgagatgaataactcctgctaa

SEQ ID NO: 85220 - DNA, 22 bp, Homo sapiens
gagcacagtaaagcagtgtcac

SEQ ID NO: 85221 - DNA, 22 bp, Homo sapiens
ctgggaggcagaggttgtagtg

SEQ ID NO: 85222 - DNA, 22 bp, Homo sapiens
gaggtggatgttgcagtgagct

SEQ ID NO: 85223 - DNA, 21 bp, Homo sapiens
gccatttcacacagacatttg

SEQ ID NO: 85224 - DNA, 23 bp, Homo sapiens
gcagaggagcaagctggacacca

SEQ ID NO: 85225 - DNA, 22 bp, Homo sapiens
tgggaagggtcaacagctggaa

SEQ ID NO: 85226 - DNA, 22 bp, Homo sapiens
gcagttaaaaataaaccttcat

SEQ ID NO: 85227 - DNA, 22 bp, Homo sapiens
ccctggaggttgaggctgcagt

SEQ ID NO: 85228 - DNA, 22 bp, Homo sapiens
tcactgcaacctctgcctgcca

SEQ ID NO: 85229 - DNA, 22 bp, Homo sapiens
tgaccaatactgtggatgccag

SEQ ID NO: 85230 - DNA, 22 bp, Homo sapiens
acccaggagacggaggtgcagt

SEQ ID NO: 85231 - DNA, 22 bp, Homo sapiens
tcaccaggctggagtgcagtgg

SEQ ID NO: 85232 - DNA, 22 bp, Homo sapiens
gcagcctcaaactccccagctc

SEQ ID NO: 85233 - DNA, 22 bp, Homo sapiens
gcgagaaactaagtgccctttg

SEQ ID NO: 85234 - DNA, 22 bp, Homo sapiens
gaggggctgccctggtgtcagg

SEQ ID NO: 85235 - DNA, 22 bp, Homo sapiens
ggctgtggcagctggaagtggt

SEQ ID NO: 85236 - DNA, 22 bp, Homo sapiens
gctctagtaggaatgtccctct

SEQ ID NO: 85237 - DNA, 22 bp, Homo sapiens
gagctgggcctgcgagtgctgc

SEQ ID NO: 85238 - DNA, 22 bp, Homo sapiens
tctgtcacccagagtgcagtgg

SEQ ID NO: 85239 - DNA, 22 bp, Homo sapiens
tgaggcaggagttcaggctgcg

SEQ ID NO: 85240 - DNA, 23 bp, Homo sapiens
aaacttgctatggctgaaatcat

SEQ ID NO: 85241 - DNA, 22 bp, Homo sapiens
tgagcttccctcctgcactaca

SEQ ID NO: 85242 - DNA, 22 bp, Homo sapiens
tcagtgcacccaattctctcca

SEQ ID NO: 85243 - DNA, 22 bp, Homo sapiens
caggctggagtgcaatgacgcc

SEQ ID NO: 85244 - DNA, 22 bp, Homo sapiens
ttggagtgacagatgaggaaac

SEQ ID NO: 85245 - DNA, 22 bp, Homo sapiens
tgggggtgtcctggtgcacaca

SEQ ID NO: 85246 - DNA, 22 bp, Homo sapiens
agcgagtgggtcagcgttgcag

SEQ ID NO: 85247 - DNA, 22 bp, Homo sapiens
ccaggagttggaggctgcagtg

SEQ ID NO: 85248 - DNA, 21 bp, Homo sapiens
tctgccagctgaagaggtgga

SEQ ID NO: 85249 - DNA, 22 bp, Homo sapiens
aggacaaaggaccagatctgga

SEQ ID NO: 85250 - DNA, 22 bp, Homo sapiens
tttgaggttagctagcagatca

SEQ ID NO: 85251 - DNA, 22 bp, Homo sapiens
atgccactgcacttcagcttgg

SEQ ID NO: 85252 - DNA, 22 bp, Homo sapiens
taggctgggggtaggaattgag

SEQ ID NO: 85253 - DNA, 22 bp, Homo sapiens
accagcctggccaacatggtga

SEQ ID NO: 85254 - DNA, 22 bp, Homo sapiens
aaacttgagccaagggcttggg

SEQ ID NO: 85255 - DNA, 22 bp, Homo sapiens
tcacagagaaatgtggcacaaa

SEQ ID NO: 85256 - DNA, 22 bp, Homo sapiens
ttcatagtgtttccttccagtg

SEQ ID NO: 85257 - DNA, 22 bp, Homo sapiens
tgatttcaagccagggggcgtt

SEQ ID NO: 85258 - DNA, 19 bp, Homo sapiens
gagaaagcaggcacagcac

SEQ ID NO: 85259 - DNA, 22 bp, Homo sapiens
tcaccttgtgatccgcccacct

SEQ ID NO: 85260 - DNA, 22 bp, Homo sapiens
ctgaagcagggagtgatgaagt

SEQ ID NO: 85261 - DNA, 22 bp, Homo sapiens
cactgcaatctccatctcctgg

SEQ ID NO: 85262 - DNA, 22 bp, Homo sapiens
cggggaagcggttctggcggta

SEQ ID NO: 85263 - DNA, 22 bp, Homo sapiens
cccccagctctgctgggtcccg

SEQ ID NO: 85264 - DNA, 22 bp, Homo sapiens
tggcacagactgggccaaggaa

SEQ ID NO: 85265 - DNA, 22 bp, Homo sapiens
gtggatggagctggaagccatt

SEQ ID NO: 85266 - DNA, 22 bp, Homo sapiens
cgtgtggtcccggcaaggcaag

SEQ ID NO: 85267 - DNA, 22 bp, Homo sapiens
tcagccagccagctacaggctt

SEQ ID NO: 85268 - DNA, 22 bp, Homo sapiens
aagaagcaggtcacagacaggg

SEQ ID NO: 85269 - DNA, 22 bp, Homo sapiens
cataatttctaccagggccata

SEQ ID NO: 85270 - DNA, 20 bp, Homo sapiens
gccactgggcaccagcaggg

SEQ ID NO: 85271 - DNA, 22 bp, Homo sapiens
gctaatcaatgttaaggctgtg

SEQ ID NO: 85272 - DNA, 22 bp, Homo sapiens
aggcaagggggcgccaccttcc

SEQ ID NO: 85273 - DNA, 22 bp, Homo sapiens
cccaggaggtcaaggctgcagt

SEQ ID NO: 85274 - DNA, 22 bp, Homo sapiens
tgtgttgtgacattcttggatg

SEQ ID NO: 85275 - DNA, 22 bp, Homo sapiens
tgactcagtacatctggagttg

SEQ ID NO: 85276 - DNA, 22 bp, Homo sapiens
gggaaggaaagttattagcaga

SEQ ID NO: 85277 - DNA, 22 bp, Homo sapiens
aggtcaccatggcatgctccac

SEQ ID NO: 85278 - DNA, 22 bp, Homo sapiens
aggggtgacacatatcagtgca

SEQ ID NO: 85279 - DNA, 22 bp, Homo sapiens
ctcactgcaagctctgcctcca

SEQ ID NO: 85280 - DNA, 22 bp, Homo sapiens
tctgcaacattcctctccccac

SEQ ID NO: 85281 - DNA, 22 bp, Homo sapiens
aacactctctgttggtaaggct

SEQ ID NO: 85282 - DNA, 22 bp, Homo sapiens
tgaggcaggaggttgagaactg

SEQ ID NO: 85283 - DNA, 22 bp, Homo sapiens
tgaggcaggagaatcacatgaa

SEQ ID NO: 85284 - DNA, 22 bp, Homo sapiens
ggcgctcagtgttgccccagag

SEQ ID NO: 85285 - DNA, 22 bp, Homo sapiens
ctgattgagaaggaaggggatc

SEQ ID NO: 85286 - DNA, 22 bp, Homo sapiens
acctgcaggcacaggtgtgcgc

SEQ ID NO: 85287 - DNA, 22 bp, Homo sapiens
gggcagagactcagaaacagaa

SEQ ID NO: 85288 - DNA, 22 bp, Homo sapiens
gtacccagtgattccttcttca

SEQ ID NO: 85289 - DNA, 22 bp, Homo sapiens
cctgcctactgagttttatatt

SEQ ID NO: 85290 - DNA, 22 bp, Homo sapiens
aggggaggtgtccccaaatctc

SEQ ID NO: 85291 - DNA, 22 bp, Homo sapiens
ctgtccccacccaaatctcatc

SEQ ID NO: 85292 - DNA, 22 bp, Homo sapiens
agatacattgttctaagcattg

SEQ ID NO: 85293 - DNA, 22 bp, Homo sapiens
tctaccctgcggtcttggggca

SEQ ID NO: 85294 - DNA, 22 bp, Homo sapiens
acaaagtgctgacattacaggc

SEQ ID NO: 85295 - DNA, 22 bp, Homo sapiens
aaccagctaacatgtggaatga

SEQ ID NO: 85296 - DNA, 22 bp, Homo sapiens
gggccagtgaacaatgagggaa

SEQ ID NO: 85297 - DNA, 22 bp, Homo sapiens
tggccaccaccaatacttgcct

SEQ ID NO: 85298 - DNA, 23 bp, Homo sapiens
gtgcatgtgtctttacagtagca

SEQ ID NO: 85299 - DNA, 22 bp, Homo sapiens
tcctcctgtctaccagttcctg

SEQ ID NO: 85300 - DNA, 17 bp, Homo sapiens
aatgtccttggaccaca

SEQ ID NO: 85301 - DNA, 22 bp, Homo sapiens
tctgttttgcataatgttcttt

SEQ ID NO: 85302 - DNA, 22 bp, Homo sapiens
tttgcttcacaagtatggttct

SEQ ID NO: 85303 - DNA, 22 bp, Homo sapiens
cactgcaacaacctctacctcc

SEQ ID NO: 85304 - DNA, 22 bp, Homo sapiens
tggagacacaggaccagactgc

SEQ ID NO: 85305 - DNA, 22 bp, Homo sapiens
agattctaccagagctagtttg

SEQ ID NO: 85306 - DNA, 22 bp, Homo sapiens
cggccaagccggggccccgaag

SEQ ID NO: 85307 - DNA, 22 bp, Homo sapiens
aatatttccaaggcctgtcagg

SEQ ID NO: 85308 - DNA, 22 bp, Homo sapiens
tgggcttaggtcggaggcggcc

SEQ ID NO: 85309 - DNA, 22 bp, Homo sapiens
cacagctgaagtagccatgtgg

SEQ ID NO: 85310 - DNA, 19 bp, Homo sapiens
gggcttggggctgaagcct

SEQ ID NO: 85311 - DNA, 22 bp, Homo sapiens
tggacaacatagtgagacctca

SEQ ID NO: 85312 - DNA, 22 bp, Homo sapiens
atgcgagtgatgcagagtggct

SEQ ID NO: 85313 - DNA, 22 bp, Homo sapiens
ccaggaggcggaaggtacagtg

SEQ ID NO: 85314 - DNA, 22 bp, Homo sapiens
ccaaagtgctaggattacaggc

SEQ ID NO: 85315 - DNA, 22 bp, Homo sapiens
gggttggcatcagggttctgtg

SEQ ID NO: 85316 - DNA, 22 bp, Homo sapiens
gatggcacacagacatccccgc

SEQ ID NO: 85317 - DNA, 22 bp, Homo sapiens
cccaggcttttctcttgcccca

SEQ ID NO: 85318 - DNA, 22 bp, Homo sapiens
gggtccctggaattacttgaca

SEQ ID NO: 85319 - DNA, 22 bp, Homo sapiens
tgcatattatgtgtatctgtct

SEQ ID NO: 85320 - DNA, 22 bp, Homo sapiens
aatggcaaggaaaccgttacca

SEQ ID NO: 85321 - DNA, 21 bp, Homo sapiens
aggcttggatctagacaggcc

SEQ ID NO: 85322 - DNA, 22 bp, Homo sapiens
tcttcccagaggaggtgccagc

SEQ ID NO: 85323 - DNA, 22 bp, Homo sapiens
atggggagctcaccacctgttt

SEQ ID NO: 85324 - DNA, 22 bp, Homo sapiens
gggcggatcacctgaggtcagg

SEQ ID NO: 85325 - DNA, 22 bp, Homo sapiens
gctggtagacctcactgcactc

SEQ ID NO: 85326 - DNA, 22 bp, Homo sapiens
ttcctggaaattatgctcacct

SEQ ID NO: 85327 - DNA, 22 bp, Homo sapiens
aagccgggcctgagaaatgaca

SEQ ID NO: 85328 - DNA, 22 bp, Homo sapiens
agatgcagtggttaacaataca

SEQ ID NO: 85329 - DNA, 22 bp, Homo sapiens
gggtaggcaaagcaatgacgtt

SEQ ID NO: 85330 - DNA, 22 bp, Homo sapiens
gcttggaagtaggattgggaga

SEQ ID NO: 85331 - DNA, 22 bp, Homo sapiens
attggccatttgcatgtattat

SEQ ID NO: 85332 - DNA, 23 bp, Homo sapiens
cagtctgcagcccacttgggcag

SEQ ID NO: 85333 - DNA, 22 bp, Homo sapiens
tcacccaggctggagtgcagtg

SEQ ID NO: 85334 - DNA, 22 bp, Homo sapiens
tctcccaggcaggagtgcagtg

SEQ ID NO: 85335 - DNA, 22 bp, Homo sapiens
ttgcgcgcggctaggtctcggt

SEQ ID NO: 85336 - DNA, 23 bp, Homo sapiens
gtgtgttcccggagtagctcccg

SEQ ID NO: 85337 - DNA, 22 bp, Homo sapiens
agtcacagggggcccctgcaac

SEQ ID NO: 85338 - DNA, 20 bp, Homo sapiens
cagcagtggatgagagtttt

SEQ ID NO: 85339 - DNA, 22 bp, Homo sapiens
aacctcaaactcttgggcttaa

SEQ ID NO: 85340 - DNA, 19 bp, Homo sapiens
gcataaatacactattgtc

SEQ ID NO: 85341 - DNA, 22 bp, Homo sapiens
tagcacagcttcttgatgtcac

SEQ ID NO: 85342 - DNA, 22 bp, Homo sapiens
agggaagaaaatccatcgctgc

SEQ ID NO: 85343 - DNA, 22 bp, Homo sapiens
acgggccttctcttcaggcgag

SEQ ID NO: 85344 - DNA, 22 bp, Homo sapiens
tgcctcagctgaggccgctcca

SEQ ID NO: 85345 - DNA, 22 bp, Homo sapiens
gaagattgaaggctgggaatta

SEQ ID NO: 85346 - DNA, 22 bp, Homo sapiens
aactctatttaccctactaaac

SEQ ID NO: 85347 - DNA, 22 bp, Homo sapiens
tctggtgtcagtattctttgaa

SEQ ID NO: 85348 - DNA, 22 bp, Homo sapiens
ctgggctagaaggaccaggatg

SEQ ID NO: 85349 - DNA, 22 bp, Homo sapiens
agttggcactgagctgtgattg

SEQ ID NO: 85350 - DNA, 22 bp, Homo sapiens
taggctgggaagaaagattctc

SEQ ID NO: 85351 - DNA, 22 bp, Homo sapiens
cactgcactccagcctgggtga

SEQ ID NO: 85352 - DNA, 22 bp, Homo sapiens
ttatttaatgtgatctgaagag

SEQ ID NO: 85353 - DNA, 22 bp, Homo sapiens
ttgaggcaggtccgggtccttc

SEQ ID NO: 85354 - DNA, 22 bp, Homo sapiens
caggaggattgcttgaggccag

SEQ ID NO: 85355 - DNA, 22 bp, Homo sapiens
tacgcgaagaaggacctgatgg

SEQ ID NO: 85356 - DNA, 20 bp, Homo sapiens
gggcagagccagccagtccc

SEQ ID NO: 85357 - DNA, 22 bp, Homo sapiens
attttctatgttgtaattgtta

SEQ ID NO: 85358 - DNA, 22 bp, Homo sapiens
aaggagtctgggccattcagag

SEQ ID NO: 85359 - DNA, 22 bp, Homo sapiens
tgtcttcaggagtaaatatcat

SEQ ID NO: 85360 - DNA, 22 bp, Homo sapiens
cagtcactggaatagctgagga

SEQ ID NO: 85361 - DNA, 22 bp, Homo sapiens
gaggccaaggtgggcagatcac

SEQ ID NO: 85362 - DNA, 23 bp, Homo sapiens
actctcaggttctttccagcagg

SEQ ID NO: 85363 - DNA, 22 bp, Homo sapiens
tgggaagctgcattttaacaag

SEQ ID NO: 85364 - DNA, 23 bp, Homo sapiens
tgtgggcgcattgtaagggtagc

SEQ ID NO: 85365 - DNA, 19 bp, Homo sapiens
gatttaaacgtggctctat

SEQ ID NO: 85366 - DNA, 22 bp, Homo sapiens
acatatgcgatcataggatgca

SEQ ID NO: 85367 - DNA, 22 bp, Homo sapiens
gctgaggtggaggaaggagacc

SEQ ID NO: 85368 - DNA, 22 bp, Homo sapiens
ttagccaggggagcagcttgtc

SEQ ID NO: 85369 - DNA, 22 bp, Homo sapiens
tcttgcacttcatgaatatgtt

SEQ ID NO: 85370 - DNA, 22 bp, Homo sapiens
gtgtttgttcgtgactccaaag

SEQ ID NO: 85371 - DNA, 22 bp, Homo sapiens
gtgctgacaggagcctggcggt

SEQ ID NO: 85372 - DNA, 22 bp, Homo sapiens
aggagaagccaagttgtgagca

SEQ ID NO: 85373 - DNA, 22 bp, Homo sapiens
tgcctgcctaggaagctgtgaa

SEQ ID NO: 85374 - DNA, 22 bp, Homo sapiens
gctcactgcaacctccacctcc

SEQ ID NO: 85375 - DNA, 22 bp, Homo sapiens
tccttgtaacgttgggctgggg

SEQ ID NO: 85376 - DNA, 22 bp, Homo sapiens
caggaagaccagggctgtggct

SEQ ID NO: 85377 - DNA, 22 bp, Homo sapiens
caggtgtgccgggagcagtttg

SEQ ID NO: 85378 - DNA, 22 bp, Homo sapiens
cagagctgtccaaaccctgaca

SEQ ID NO: 85379 - DNA, 22 bp, Homo sapiens
tccacgctgtgtgaccttgggc

SEQ ID NO: 85380 - DNA, 22 bp, Homo sapiens
acagagacacggaagctaaaga

SEQ ID NO: 85381 - DNA, 22 bp, Homo sapiens
agttaagaatacacatcataat

SEQ ID NO: 85382 - DNA, 22 bp, Homo sapiens
ggaagggcaaaagagatgaact

SEQ ID NO: 85383 - DNA, 22 bp, Homo sapiens
tgcatgagcgaatgtgtcctgt

SEQ ID NO: 85384 - DNA, 22 bp, Homo sapiens
aatgcaatgcagcacctccttg

SEQ ID NO: 85385 - DNA, 22 bp, Homo sapiens
agtggagcttttcctatcagag

SEQ ID NO: 85386 - DNA, 22 bp, Homo sapiens
ttgcatagtgctgaggttcggg

SEQ ID NO: 85387 - DNA, 22 bp, Homo sapiens
tattagttgcaaaacattgact

SEQ ID NO: 85388 - DNA, 22 bp, Homo sapiens
gagctgagaagcagcgcttgat

SEQ ID NO: 85389 - DNA, 22 bp, Homo sapiens
gctggtgagcaaaggagaagga

SEQ ID NO: 85390 - DNA, 22 bp, Homo sapiens
ggcctgcctcacagtcagcacc

SEQ ID NO: 85391 - DNA, 22 bp, Homo sapiens
ccaggctggagtgcaatggcat

SEQ ID NO: 85392 - DNA, 22 bp, Homo sapiens
tggaaagaaagtaaaggcgtat

SEQ ID NO: 85393 - DNA, 20 bp, Homo sapiens
tatttctgggcaaccattta

SEQ ID NO: 85394 - DNA, 22 bp, Homo sapiens
ccagcttgaagatgtgctggtt

SEQ ID NO: 85395 - DNA, 22 bp, Homo sapiens
cgttttcatgggtagaggttct

SEQ ID NO: 85396 - DNA, 22 bp, Homo sapiens
tgttgattagtgtttagactta

SEQ ID NO: 85397 - DNA, 22 bp, Homo sapiens
ttccatttggcacttcactgag

SEQ ID NO: 85398 - DNA, 22 bp, Homo sapiens
cacccaggctggaatgcagtgg

SEQ ID NO: 85399 - DNA, 22 bp, Homo sapiens
cacccaggctggagtgcagtga

SEQ ID NO: 85400 - DNA, 22 bp, Homo sapiens
ctatacagcagcttactagtta

SEQ ID NO: 85401 - DNA, 22 bp, Homo sapiens
acccaggctggcgtgcagtggc

SEQ ID NO: 85402 - DNA, 22 bp, Homo sapiens
tagatgaccttgtgttaggcaa

SEQ ID NO: 85403 - DNA, 22 bp, Homo sapiens
agggagcaaaggtttcagggtt

SEQ ID NO: 85404 - DNA, 22 bp, Homo sapiens
aaacactcatgtgttactctcc

SEQ ID NO: 85405 - DNA, 22 bp, Homo sapiens
ttgtgttaaggtgcatctagtg

SEQ ID NO: 85406 - DNA, 22 bp, Homo sapiens
actgcactccagcctcggggtc

SEQ ID NO: 85407 - DNA, 22 bp, Homo sapiens
tacccaaggccctttcaatttc

SEQ ID NO: 85408 - DNA, 22 bp, Homo sapiens
ctgaatccacacaaggtgatgg

SEQ ID NO: 85409 - DNA, 22 bp, Homo sapiens
ctggtgtggactccgcgcggag

SEQ ID NO: 85410 - DNA, 22 bp, Homo sapiens
acgtgcaggatctggttggcga

SEQ ID NO: 85411 - DNA, 22 bp, Homo sapiens
ctctttggatagaattacaaag

SEQ ID NO: 85412 - DNA, 22 bp, Homo sapiens
actgccaatggtagtttgatgg

SEQ ID NO: 85413 - DNA, 22 bp, Homo sapiens
ccagggtggcgtagatgctggg

SEQ ID NO: 85414 - DNA, 22 bp, Homo sapiens
gcagagtgctgtcgtacgcccc

SEQ ID NO: 85415 - DNA, 21 bp, Homo sapiens
tgtaagtttcatctgaattgg

SEQ ID NO: 85416 - DNA, 22 bp, Homo sapiens
gtccaaaagagccagccgggcg

SEQ ID NO: 85417 - DNA, 22 bp, Homo sapiens
cacccaggctggagagcagtgg

SEQ ID NO: 85418 - DNA, 22 bp, Homo sapiens
ctgaggctggagtgcagtggtg

SEQ ID NO: 85419 - DNA, 22 bp, Homo sapiens
agggaagaggaccagagtctct

SEQ ID NO: 85420 - DNA, 22 bp, Homo sapiens
ggaggcagaatagagtgtgggt

SEQ ID NO: 85421 - DNA, 22 bp, Homo sapiens
tccattatacttctgattcaaa

SEQ ID NO: 85422 - DNA, 22 bp, Homo sapiens
gcactgcaggtgggtggagagg

SEQ ID NO: 85423 - DNA, 22 bp, Homo sapiens
agctcctgaaaatccagactgg

SEQ ID NO: 85424 - DNA, 22 bp, Homo sapiens
caatttgccctgttaaattttc

SEQ ID NO: 85425 - DNA, 22 bp, Homo sapiens
cccaggaggtggaggctgcagt

SEQ ID NO: 85426 - DNA, 22 bp, Homo sapiens
tctctcaggctggagtgcagtg

SEQ ID NO: 85427 - DNA, 22 bp, Homo sapiens
tcttgggggactttggcatgga

SEQ ID NO: 85428 - DNA, 17 bp, Homo sapiens
tccttcagtgcctctgc

SEQ ID NO: 85429 - DNA, 21 bp, Homo sapiens
ttagaagctaatgcagctggt

SEQ ID NO: 85430 - DNA, 22 bp, Homo sapiens
gatataggttcatagtgttaca

SEQ ID NO: 85431 - DNA, 22 bp, Homo sapiens
tatctattatgttctatgtgtc

SEQ ID NO: 85432 - DNA, 22 bp, Homo sapiens
tgtaggagtccaatcaggagac

SEQ ID NO: 85433 - DNA, 22 bp, Homo sapiens
cctggtgctgctatcaggggta

SEQ ID NO: 85434 - DNA, 22 bp, Homo sapiens
ttagctcagaaaatttaaactt

SEQ ID NO: 85435 - DNA, 22 bp, Homo sapiens
gagcctggagctggaacgaagc

SEQ ID NO: 85436 - DNA, 22 bp, Homo sapiens
ggagaagcagcttcttgatgaa

SEQ ID NO: 85437 - DNA, 22 bp, Homo sapiens
tctcgatctcctgaccttgtga

SEQ ID NO: 85438 - DNA, 22 bp, Homo sapiens
gaccttgtgatccgcccgcctt

SEQ ID NO: 85439 - DNA, 22 bp, Homo sapiens
gtggctcacacctgtaatccca

SEQ ID NO: 85440 - DNA, 22 bp, Homo sapiens
tcacccaggctggagtgtagtg

SEQ ID NO: 85441 - DNA, 22 bp, Homo sapiens
gctgctctccaagcctccttga

SEQ ID NO: 85442 - DNA, 22 bp, Homo sapiens
ccctgtgggaactcctgagttg

SEQ ID NO: 85443 - DNA, 22 bp, Homo sapiens
tactttaatatatgtgaagttc

SEQ ID NO: 85444 - DNA, 20 bp, Homo sapiens
caaatccctgctctgtgctg

SEQ ID NO: 85445 - DNA, 22 bp, Homo sapiens
aatgagatggaattcccgccta

SEQ ID NO: 85446 - DNA, 22 bp, Homo sapiens
gacctcatgatccacctgcctt

SEQ ID NO: 85447 - DNA, 22 bp, Homo sapiens
accatgtcatttattggccaaa

SEQ ID NO: 85448 - DNA, 22 bp, Homo sapiens
tcactgcaacctccacctcctg

SEQ ID NO: 85449 - DNA, 20 bp, Homo sapiens
ggcagagggcctgggagaag

SEQ ID NO: 85450 - DNA, 22 bp, Homo sapiens
acggcaggctcagagctggaat

SEQ ID NO: 85451 - DNA, 22 bp, Homo sapiens
acatccgcaggttataaagccc

SEQ ID NO: 85452 - DNA, 22 bp, Homo sapiens
tctgccgtgcgaggtcccacca

SEQ ID NO: 85453 - DNA, 22 bp, Homo sapiens
gagggagggactagcattctct

SEQ ID NO: 85454 - DNA, 22 bp, Homo sapiens
tgcaataactactttaatgttg

SEQ ID NO: 85455 - DNA, 22 bp, Homo sapiens
ccacagtctatgcaacaaggtc

SEQ ID NO: 85456 - DNA, 23 bp, Homo sapiens
ccactagcacctgttcaacttct

SEQ ID NO: 85457 - DNA, 22 bp, Homo sapiens
catcagaacgtgagctccttgt

SEQ ID NO: 85458 - DNA, 20 bp, Homo sapiens
gttaggaggttggacatgga

SEQ ID NO: 85459 - DNA, 22 bp, Homo sapiens
tgcagattcaaatgaaatgcaa

SEQ ID NO: 85460 - DNA, 22 bp, Homo sapiens
tatgcagtgagcactatttata

SEQ ID NO: 85461 - DNA, 22 bp, Homo sapiens
tgcctgatgcaggagtatcaga

SEQ ID NO: 85462 - DNA, 22 bp, Homo sapiens
tgtcctcatcctccagtctgtc

SEQ ID NO: 85463 - DNA, 22 bp, Homo sapiens
gttgaaatcctaaccccctagt

SEQ ID NO: 85464 - DNA, 22 bp, Homo sapiens
ggcccaggctggagtgcagtgg

SEQ ID NO: 85465 - DNA, 22 bp, Homo sapiens
tagggcaatatttcccagaaaa

SEQ ID NO: 85466 - DNA, 20 bp, Homo sapiens
tttcttgtcggctgttgctg

SEQ ID NO: 85467 - DNA, 22 bp, Homo sapiens
accattgccccctagtgtctgt

SEQ ID NO: 85468 - DNA, 22 bp, Homo sapiens
taatgtataacaaatactcatc

SEQ ID NO: 85469 - DNA, 22 bp, Homo sapiens
aagacactcattatcactggtt

SEQ ID NO: 85470 - DNA, 22 bp, Homo sapiens
ggcgtttcaccatgttgaccag

SEQ ID NO: 85471 - DNA, 22 bp, Homo sapiens
aacgcccgtggttgccaaggta

SEQ ID NO: 85472 - DNA, 22 bp, Homo sapiens
taaaatttgtccctgagtgttg

SEQ ID NO: 85473 - DNA, 22 bp, Homo sapiens
ctatggtgatagaaatcagaat

SEQ ID NO: 85474 - DNA, 22 bp, Homo sapiens
ggaggactcaggtctggccatg

SEQ ID NO: 85475 - DNA, 22 bp, Homo sapiens
atcctccagctcctgcttctgc

SEQ ID NO: 85476 - DNA, 22 bp, Homo sapiens
ggcctgtaatcccagctactca

SEQ ID NO: 85477 - DNA, 22 bp, Homo sapiens
tgtattctaaatacatcttacc

SEQ ID NO: 85478 - DNA, 22 bp, Homo sapiens
gttaaggatcttgagatgagga

SEQ ID NO: 85479 - DNA, 22 bp, Homo sapiens
agacggattacctgaggtcagg

SEQ ID NO: 85480 - DNA, 22 bp, Homo sapiens
ctgatcctcctttaagtagctg

SEQ ID NO: 85481 - DNA, 22 bp, Homo sapiens
aatgtgttgaataaattgtgcc

SEQ ID NO: 85482 - DNA, 22 bp, Homo sapiens
tcacagagttaaaagtttcttt

SEQ ID NO: 85483 - DNA, 22 bp, Homo sapiens
cgcaactcagcaacttaactgc

SEQ ID NO: 85484 - DNA, 22 bp, Homo sapiens
catccaggctgaagtgcagtgg

SEQ ID NO: 85485 - DNA, 22 bp, Homo sapiens
aagcttcctgcatgggactgct

SEQ ID NO: 85486 - DNA, 22 bp, Homo sapiens
tcagtggagagcttccaggatt

SEQ ID NO: 85487 - DNA, 22 bp, Homo sapiens
ttgtgggatctccctgttgctc

SEQ ID NO: 85488 - DNA, 22 bp, Homo sapiens
tgggcaggggccctgcttccgt

SEQ ID NO: 85489 - DNA, 22 bp, Homo sapiens
gtagcccacctggggagggcga

SEQ ID NO: 85490 - DNA, 22 bp, Homo sapiens
ttggaagacaatgctgattctc

SEQ ID NO: 85491 - DNA, 22 bp, Homo sapiens
tggttttagggaatcaatctat

SEQ ID NO: 85492 - DNA, 22 bp, Homo sapiens
tcctttgcttctgtcattctcc

SEQ ID NO: 85493 - DNA, 22 bp, Homo sapiens
agggaaatctcagctctaaaat

SEQ ID NO: 85494 - DNA, 22 bp, Homo sapiens
aaagcctcccaggttatgagta

SEQ ID NO: 85495 - DNA, 22 bp, Homo sapiens
cggggttcatccatgctgtggc

SEQ ID NO: 85496 - DNA, 22 bp, Homo sapiens
tgttgagtatatacctacaagt

SEQ ID NO: 85497 - DNA, 22 bp, Homo sapiens
cagtggctggttagggacagga

SEQ ID NO: 85498 - DNA, 22 bp, Homo sapiens
aggacagagggaccagagccca

SEQ ID NO: 85499 - DNA, 21 bp, Homo sapiens
cagagctgtccaaaccctgac

SEQ ID NO: 85500 - DNA, 22 bp, Homo sapiens
tttgatccgttgctggtgagga

SEQ ID NO: 85501 - DNA, 22 bp, Homo sapiens
caagcttgtttctcctgggggt

SEQ ID NO: 85502 - DNA, 22 bp, Homo sapiens
atgcagtggcttcagtgtcagt

SEQ ID NO: 85503 - DNA, 22 bp, Homo sapiens
ttgaagactaatttagataatg

SEQ ID NO: 85504 - DNA, 22 bp, Homo sapiens
gggagctggagctggaagactc

SEQ ID NO: 85505 - DNA, 22 bp, Homo sapiens
gctgggttttcttccgggccta

SEQ ID NO: 85506 - DNA, 22 bp, Homo sapiens
cttagatgaagtcacagaaccc

SEQ ID NO: 85507 - DNA, 22 bp, Homo sapiens
cgcccaggctggagagcagtgg

SEQ ID NO: 85508 - DNA, 22 bp, Homo sapiens
tgcaaagttgaggaaggcatgg

SEQ ID NO: 85509 - DNA, 22 bp, Homo sapiens
cccagctcttcaagtcaccccc

SEQ ID NO: 85510 - DNA, 22 bp, Homo sapiens
aaactcttggtcaacatgagga

SEQ ID NO: 85511 - DNA, 22 bp, Homo sapiens
atttaagggatttggagaccaa

SEQ ID NO: 85512 - DNA, 22 bp, Homo sapiens
tcactgcaagctccacctcccg

SEQ ID NO: 85513 - DNA, 22 bp, Homo sapiens
cacatttttactgccaacttaa

SEQ ID NO: 85514 - DNA, 22 bp, Homo sapiens
ccaggtgtgctctgcagtggat

SEQ ID NO: 85515 - DNA, 22 bp, Homo sapiens
taggccacagagaggagatttc

SEQ ID NO: 85516 - DNA, 22 bp, Homo sapiens
gtgtgcacagagctccagtgtt

SEQ ID NO: 85517 - DNA, 22 bp, Homo sapiens
agccaggatggtctcgatcggc

SEQ ID NO: 85518 - DNA, 22 bp, Homo sapiens
cttgagtcatataaagacagag

SEQ ID NO: 85519 - DNA, 22 bp, Homo sapiens
tagccgggtgtggtggaactcc

SEQ ID NO: 85520 - DNA, 20 bp, Homo sapiens
gggcagtggcgctatctcag

SEQ ID NO: 85521 - DNA, 22 bp, Homo sapiens
ttggagatatcacaccttcaca

SEQ ID NO: 85522 - DNA, 22 bp, Homo sapiens
gcagggtctgaggccacagagg

SEQ ID NO: 85523 - DNA, 22 bp, Homo sapiens
gtcagtaggaacctagggtcaa

SEQ ID NO: 85524 - DNA, 22 bp, Homo sapiens
gctgcagctgtaggacacaatt

SEQ ID NO: 85525 - DNA, 22 bp, Homo sapiens
ttgactgtgatgggctcagctg

SEQ ID NO: 85526 - DNA, 22 bp, Homo sapiens
atctggttttggctgtgtccct

SEQ ID NO: 85527 - DNA, 22 bp, Homo sapiens
atgtttttggaaatgggaacat

SEQ ID NO: 85528 - DNA, 22 bp, Homo sapiens
gctctgagtcacactgccctgt

SEQ ID NO: 85529 - DNA, 22 bp, Homo sapiens
cgggttcacgccattctcctgc

SEQ ID NO: 85530 - DNA, 22 bp, Homo sapiens
catctgctgttccttggactca

SEQ ID NO: 85531 - DNA, 22 bp, Homo sapiens
ggccgtgctccaaagtcatcgt

SEQ ID NO: 85532 - DNA, 19 bp, Homo sapiens
gggtcccaaaagatgtgct

SEQ ID NO: 85533 - DNA, 22 bp, Homo sapiens
ttcctgggattattgtcaagca

SEQ ID NO: 85534 - DNA, 22 bp, Homo sapiens
caggctgatcagggctgggatg

SEQ ID NO: 85535 - DNA, 23 bp, Homo sapiens
attttttgtctttgtaactagat

SEQ ID NO: 85536 - DNA, 22 bp, Homo sapiens
cctttaggagtgaggaccgagc

SEQ ID NO: 85537 - DNA, 22 bp, Homo sapiens
gggtggagagaaagaaacgtga

SEQ ID NO: 85538 - DNA, 22 bp, Homo sapiens
ttttcaggctgatttgtgttag

SEQ ID NO: 85539 - DNA, 22 bp, Homo sapiens
tagaaaagccccagctggaggg

SEQ ID NO: 85540 - DNA, 17 bp, Homo sapiens
gacctcaggtgatctgc

SEQ ID NO: 85541 - DNA, 22 bp, Homo sapiens
cttcttgctgggggcctcagtg

SEQ ID NO: 85542 - DNA, 22 bp, Homo sapiens
gcaggtggatcaccacgtcagg

SEQ ID NO: 85543 - DNA, 22 bp, Homo sapiens
tggatctcggcaatgcgggact

SEQ ID NO: 85544 - DNA, 22 bp, Homo sapiens
cggtctcccgtgtgtgtgcgct

SEQ ID NO: 85545 - DNA, 22 bp, Homo sapiens
tttcttctatgtgtgatatttt

SEQ ID NO: 85546 - DNA, 22 bp, Homo sapiens
ttgcactccagcccgagcaaca

SEQ ID NO: 85547 - DNA, 22 bp, Homo sapiens
tgatatgcatgtaagggagaca

SEQ ID NO: 85548 - DNA, 22 bp, Homo sapiens
acccagggctcaagcgtaggca

SEQ ID NO: 85549 - DNA, 22 bp, Homo sapiens
ggaggcggaggctgcagtgagc

SEQ ID NO: 85550 - DNA, 22 bp, Homo sapiens
tgagatggagtctcactctgtt

SEQ ID NO: 85551 - DNA, 22 bp, Homo sapiens
ctgaacttattgagtgcttgct

SEQ ID NO: 85552 - DNA, 22 bp, Homo sapiens
tatttccttgagacggagtctc

SEQ ID NO: 85553 - DNA, 22 bp, Homo sapiens
gcagcctgggcaacagagtgag

SEQ ID NO: 85554 - DNA, 22 bp, Homo sapiens
ctcccagccttcgccagtctga

SEQ ID NO: 85555 - DNA, 22 bp, Homo sapiens
tgttatcctcagctcacctcta

SEQ ID NO: 85556 - DNA, 22 bp, Homo sapiens
agaagccaccagctgaggaaga

SEQ ID NO: 85557 - DNA, 22 bp, Homo sapiens
cagatgtacatgaagggcaatg

SEQ ID NO: 85558 - DNA, 22 bp, Homo sapiens
tgtgaatggacaattaaatcta

SEQ ID NO: 85559 - DNA, 22 bp, Homo sapiens
ctctgcctgtctcatcctgcaa

SEQ ID NO: 85560 - DNA, 22 bp, Homo sapiens
ctgctttagacggctttcgctg

SEQ ID NO: 85561 - DNA, 22 bp, Homo sapiens
actgtgaacggactgaagccca

SEQ ID NO: 85562 - DNA, 22 bp, Homo sapiens
ggctcactgcaacttccgcctc

SEQ ID NO: 85563 - DNA, 22 bp, Homo sapiens
tggaagggagctggaatttgga

SEQ ID NO: 85564 - DNA, 22 bp, Homo sapiens
gcccaggctggagtgcagtggc

SEQ ID NO: 85565 - DNA, 22 bp, Homo sapiens
ccatgtggtgggaaggagaatg

SEQ ID NO: 85566 - DNA, 22 bp, Homo sapiens
agcttgggcaacacagcaagac

SEQ ID NO: 85567 - DNA, 22 bp, Homo sapiens
gagaggtggaggttgcagtgag

SEQ ID NO: 85568 - DNA, 17 bp, Homo sapiens
caggtgacctggtgatg

SEQ ID NO: 85569 - DNA, 19 bp, Homo sapiens
taggaccctggtggccccc

SEQ ID NO: 85570 - DNA, 22 bp, Homo sapiens
gatagtcacctcccttaacttt

SEQ ID NO: 85571 - DNA, 22 bp, Homo sapiens
aagctctttccactaaaccact

SEQ ID NO: 85572 - DNA, 22 bp, Homo sapiens
tctctagtctcctttaacctga

SEQ ID NO: 85573 - DNA, 22 bp, Homo sapiens
tgacaagaaagcgtcttctttt

SEQ ID NO: 85574 - DNA, 22 bp, Homo sapiens
tgagctgtagcagatgctgttg

SEQ ID NO: 85575 - DNA, 22 bp, Homo sapiens
gcctcagtctcccgagtagctg

SEQ ID NO: 85576 - DNA, 22 bp, Homo sapiens
atgatactctaggtgatttaca

SEQ ID NO: 85577 - DNA, 22 bp, Homo sapiens
ttctcttacattttctcagcct

SEQ ID NO: 85578 - DNA, 22 bp, Homo sapiens
aggagatggagctcagtgggca

SEQ ID NO: 85579 - DNA, 22 bp, Homo sapiens
gggtaattggggccttgcagtg

SEQ ID NO: 85580 - DNA, 22 bp, Homo sapiens
gggtgctttggctcacgcctgt

SEQ ID NO: 85581 - DNA, 22 bp, Homo sapiens
actgcaacctccgcctgccagg

SEQ ID NO: 85582 - DNA, 22 bp, Homo sapiens
cagccacttgtgatgctgggga

SEQ ID NO: 85583 - DNA, 21 bp, Homo sapiens
ccagagcctgagaggattatg

SEQ ID NO: 85584 - DNA, 22 bp, Homo sapiens
agaggccggccgagcccatggg

SEQ ID NO: 85585 - DNA, 22 bp, Homo sapiens
taatatctacttcatagagttt

SEQ ID NO: 85586 - DNA, 22 bp, Homo sapiens
tcttaagcagagaagaagttga

SEQ ID NO: 85587 - DNA, 22 bp, Homo sapiens
cacagtcctgccagagggcctt

SEQ ID NO: 85588 - DNA, 22 bp, Homo sapiens
ggctgcaggttggttggcagct

SEQ ID NO: 85589 - DNA, 22 bp, Homo sapiens
ctgggagtggtgacagctctcg

SEQ ID NO: 85590 - DNA, 22 bp, Homo sapiens
ggtgacctcacctggtcccacc

SEQ ID NO: 85591 - DNA, 22 bp, Homo sapiens
ctcaggacccggtccaggtggg

SEQ ID NO: 85592 - DNA, 22 bp, Homo sapiens
gacctcgtgatccgcccgcttt

SEQ ID NO: 85593 - DNA, 23 bp, Homo sapiens
ggggcctgcaccggtctgcgcgg

SEQ ID NO: 85594 - DNA, 22 bp, Homo sapiens
tgttgactcaacactgtgggca

SEQ ID NO: 85595 - DNA, 22 bp, Homo sapiens
cactgcactccagcctgggaga

SEQ ID NO: 85596 - DNA, 22 bp, Homo sapiens
ggttttcacctccagaatgtgc

SEQ ID NO: 85597 - DNA, 19 bp, Homo sapiens
gccgggcccgggttggccg

SEQ ID NO: 85598 - DNA, 22 bp, Homo sapiens
gggactggagtagaggccggtg

SEQ ID NO: 85599 - DNA, 22 bp, Homo sapiens
gacttttgaataaggtaggata

SEQ ID NO: 85600 - DNA, 22 bp, Homo sapiens
gtctatgatattttgttatagc

SEQ ID NO: 85601 - DNA, 22 bp, Homo sapiens
tctgacattagattaattggaa

SEQ ID NO: 85602 - DNA, 20 bp, Homo sapiens
gtctccactgggggttaacc

SEQ ID NO: 85603 - DNA, 22 bp, Homo sapiens
gaagcgcggcgtcggcgtgggt

SEQ ID NO: 85604 - DNA, 22 bp, Homo sapiens
tagcacagagcttttaaacttc

SEQ ID NO: 85605 - DNA, 22 bp, Homo sapiens
ctgctcttgagggactgcggtc

SEQ ID NO: 85606 - DNA, 19 bp, Homo sapiens
tctagttttgagagacttc

SEQ ID NO: 85607 - DNA, 22 bp, Homo sapiens
gtgggctgcccttgaggtcagc

SEQ ID NO: 85608 - DNA, 22 bp, Homo sapiens
tacatgctccttatgagaatct

SEQ ID NO: 85609 - DNA, 22 bp, Homo sapiens
ctgagctcaagcgatcctccca

SEQ ID NO: 85610 - DNA, 22 bp, Homo sapiens
aggtgacaggacaggagctggt

SEQ ID NO: 85611 - DNA, 22 bp, Homo sapiens
agatgctgctccacaggccagg

SEQ ID NO: 85612 - DNA, 22 bp, Homo sapiens
cctacagttatattcttgattg

SEQ ID NO: 85613 - DNA, 22 bp, Homo sapiens
actgttgaagtgccagcttgat

SEQ ID NO: 85614 - DNA, 22 bp, Homo sapiens
agctgattccactttttcccca

SEQ ID NO: 85615 - DNA, 22 bp, Homo sapiens
gctggggaggcagcagagaaca

SEQ ID NO: 85616 - DNA, 22 bp, Homo sapiens
aagaataagaggatttagaaca

SEQ ID NO: 85617 - DNA, 22 bp, Homo sapiens
tgagccaagatcatgccgttgt

SEQ ID NO: 85618 - DNA, 20 bp, Homo sapiens
agagtgagactccatctcag

SEQ ID NO: 85619 - DNA, 22 bp, Homo sapiens
ctggcagatagtaagtgatcaa

SEQ ID NO: 85620 - DNA, 22 bp, Homo sapiens
tgggaggccaaggcaggcggat

SEQ ID NO: 85621 - DNA, 22 bp, Homo sapiens
gtgggtggacggtgcttttgtt

SEQ ID NO: 85622 - DNA, 22 bp, Homo sapiens
tgggccacacacagaagaatca

SEQ ID NO: 85623 - DNA, 22 bp, Homo sapiens
gcagctattgtctcctgggccc

SEQ ID NO: 85624 - DNA, 22 bp, Homo sapiens
gtagctctgtttaaagttcttt

SEQ ID NO: 85625 - DNA, 22 bp, Homo sapiens
acccaggctggagtgcagtggc

SEQ ID NO: 85626 - DNA, 22 bp, Homo sapiens
cacagagatggtctggcaggtg

SEQ ID NO: 85627 - DNA, 22 bp, Homo sapiens
tgctagtgtgtgagatgttcaa

SEQ ID NO: 85628 - DNA, 22 bp, Homo sapiens
acattacctggcatttgatctt

SEQ ID NO: 85629 - DNA, 21 bp, Homo sapiens
tggtacaccttgcctgtcaga

SEQ ID NO: 85630 - DNA, 22 bp, Homo sapiens
tccagcccaggctggagtgtag

SEQ ID NO: 85631 - DNA, 21 bp, Homo sapiens
tgcaatccagcctgggcgaca

SEQ ID NO: 85632 - DNA, 22 bp, Homo sapiens
aggcaaggtgctacagacagtg

SEQ ID NO: 85633 - DNA, 22 bp, Homo sapiens
gtgaccatcatctcagctagtt

SEQ ID NO: 85634 - DNA, 22 bp, Homo sapiens
acggtgcagcctgtcccttctc

SEQ ID NO: 85635 - DNA, 22 bp, Homo sapiens
gaggccaactttggagaacagg

SEQ ID NO: 85636 - DNA, 22 bp, Homo sapiens
tttgaagggcacgacaatagtt

SEQ ID NO: 85637 - DNA, 22 bp, Homo sapiens
caaagtgctaggattacaggcg

SEQ ID NO: 85638 - DNA, 22 bp, Homo sapiens
tcggagctgtagatgaaaccct

SEQ ID NO: 85639 - DNA, 22 bp, Homo sapiens
tgggtactcctattagttcagt

SEQ ID NO: 85640 - DNA, 22 bp, Homo sapiens
agtgcaggccccaggccaggcc

SEQ ID NO: 85641 - DNA, 22 bp, Homo sapiens
caggagttttaaatctagcatg

SEQ ID NO: 85642 - DNA, 22 bp, Homo sapiens
ggggtgggcgtgcagggacacc

SEQ ID NO: 85643 - DNA, 22 bp, Homo sapiens
tgggcgacagagcaagactccg

SEQ ID NO: 85644 - DNA, 22 bp, Homo sapiens
cgcccaggctggagtgcagtgg

SEQ ID NO: 85645 - DNA, 22 bp, Homo sapiens
ccgaggtcctggacttggccct

SEQ ID NO: 85646 - DNA, 22 bp, Homo sapiens
tcatctaagagtcttacattta

SEQ ID NO: 85647 - DNA, 22 bp, Homo sapiens
agtggagacaggacagtcgata

SEQ ID NO: 85648 - DNA, 22 bp, Homo sapiens
accagcctggccaacatggcaa

SEQ ID NO: 85649 - DNA, 22 bp, Homo sapiens
tggctcatgcctgtaatcttag

SEQ ID NO: 85650 - DNA, 22 bp, Homo sapiens
caggcactgtgctgagctctgc

SEQ ID NO: 85651 - DNA, 22 bp, Homo sapiens
cttgcctacttgtcaaccagca

SEQ ID NO: 85652 - DNA, 22 bp, Homo sapiens
gagcagtaggagaaccctgagc

SEQ ID NO: 85653 - DNA, 22 bp, Homo sapiens
atgccactgcacttcagcctgg

SEQ ID NO: 85654 - DNA, 22 bp, Homo sapiens
ggagtgactcacagctgggaca

SEQ ID NO: 85655 - DNA, 22 bp, Homo sapiens
ctgcaccgtgtctcgggctgcc

SEQ ID NO: 85656 - DNA, 22 bp, Homo sapiens
ttgcaattgctatggagagcgt

SEQ ID NO: 85657 - DNA, 22 bp, Homo sapiens
attttctctttgtatatgctag

SEQ ID NO: 85658 - DNA, 22 bp, Homo sapiens
caggctgaagtgcagtggtgtg

SEQ ID NO: 85659 - DNA, 18 bp, Homo sapiens
atggtctcatactgggag

SEQ ID NO: 85660 - DNA, 22 bp, Homo sapiens
agtggcctggagccccgcctgg

SEQ ID NO: 85661 - DNA, 22 bp, Homo sapiens
aggtctcttgctgtctctgggc

SEQ ID NO: 85662 - DNA, 22 bp, Homo sapiens
gaatgctaagcatgtgggagtt

SEQ ID NO: 85663 - DNA, 22 bp, Homo sapiens
cctggagagctcgggccaggca

SEQ ID NO: 85664 - DNA, 22 bp, Homo sapiens
gcaaagaatgcagatttgcctc

SEQ ID NO: 85665 - DNA, 22 bp, Homo sapiens
tacaaaaaattgatactgacga

SEQ ID NO: 85666 - DNA, 22 bp, Homo sapiens
ctacccttaagtttctgtgggg

SEQ ID NO: 85667 - DNA, 22 bp, Homo sapiens
tgactacaacctccacctcccg

SEQ ID NO: 85668 - DNA, 22 bp, Homo sapiens
cggctgggttcggctgcaggcc

SEQ ID NO: 85669 - DNA, 22 bp, Homo sapiens
atttacaggtagaattttaagt

SEQ ID NO: 85670 - DNA, 22 bp, Homo sapiens
gaccttgtgatccccctgcctt

SEQ ID NO: 85671 - DNA, 22 bp, Homo sapiens
gctcccaggatgaggagccagg

SEQ ID NO: 85672 - DNA, 22 bp, Homo sapiens
gaccatcctggccaacgtggta

SEQ ID NO: 85673 - DNA, 18 bp, Homo sapiens
tgtagagccaggtttgcc

SEQ ID NO: 85674 - DNA, 22 bp, Homo sapiens
tgattcatcagaataggagttt

SEQ ID NO: 85675 - DNA, 22 bp, Homo sapiens
ggagtgaatcactagatgcaga

SEQ ID NO: 85676 - DNA, 22 bp, Homo sapiens
gctcccaccttaaccttcacat

SEQ ID NO: 85677 - DNA, 22 bp, Homo sapiens
tgtcacagtttgtactttatag

SEQ ID NO: 85678 - DNA, 22 bp, Homo sapiens
cccaggaggcggaggttgcagt

SEQ ID NO: 85679 - DNA, 22 bp, Homo sapiens
gttgaggagcaagcatgtgtct

SEQ ID NO: 85680 - DNA, 22 bp, Homo sapiens
gggagctgagctggaagagaat

SEQ ID NO: 85681 - DNA, 22 bp, Homo sapiens
gggctagcctcttccctgctcc

SEQ ID NO: 85682 - DNA, 22 bp, Homo sapiens
tggcgcgacgtgccccctgctt

SEQ ID NO: 85683 - DNA, 22 bp, Homo sapiens
ccctgctgtcaggtgctgggag

SEQ ID NO: 85684 - DNA, 20 bp, Homo sapiens
tgacatagctcttggggtgc

SEQ ID NO: 85685 - DNA, 23 bp, Homo sapiens
cagagctggcttcatgggtgtgc

SEQ ID NO: 85686 - DNA, 22 bp, Homo sapiens
tccagctctgctgtgcgccggt

SEQ ID NO: 85687 - DNA, 22 bp, Homo sapiens
agccacacagcttaatgacaga

SEQ ID NO: 85688 - DNA, 22 bp, Homo sapiens
gtcagtgtcttaacagagatta

SEQ ID NO: 85689 - DNA, 22 bp, Homo sapiens
gccctgccctctcggcactcgc

SEQ ID NO: 85690 - DNA, 22 bp, Homo sapiens
ccaattttattcttctgcaagt

SEQ ID NO: 85691 - DNA, 22 bp, Homo sapiens
gggttactgcttcaaaaaatta

SEQ ID NO: 85692 - DNA, 22 bp, Homo sapiens
ttctgtgaatcttttttcccac

SEQ ID NO: 85693 - DNA, 22 bp, Homo sapiens
tgagaattacaaatgagtcaca

SEQ ID NO: 85694 - DNA, 22 bp, Homo sapiens
atcacaaaggtctcagagcaca

SEQ ID NO: 85695 - DNA, 22 bp, Homo sapiens
tctgttgcaatgtgcatggtga

SEQ ID NO: 85696 - DNA, 22 bp, Homo sapiens
tgtagctctccagccagcaagg

SEQ ID NO: 85697 - DNA, 22 bp, Homo sapiens
ccagcagagcatggggaggaag

SEQ ID NO: 85698 - DNA, 22 bp, Homo sapiens
gagagagctctgtgcctgggat

SEQ ID NO: 85699 - DNA, 22 bp, Homo sapiens
atttagaactttgtttgccaat

SEQ ID NO: 85700 - DNA, 22 bp, Homo sapiens
acacagggctgcgcctgacccc

SEQ ID NO: 85701 - DNA, 22 bp, Homo sapiens
tgagcctgagttcaaggctgca

SEQ ID NO: 85702 - DNA, 22 bp, Homo sapiens
gcccagtagttcaaggttgcag

SEQ ID NO: 85703 - DNA, 22 bp, Homo sapiens
agtgaggggcagctgagtgggc

SEQ ID NO: 85704 - DNA, 22 bp, Homo sapiens
attggtagttttgtatttctct

SEQ ID NO: 85705 - DNA, 22 bp, Homo sapiens
gaagccagtgtttgaagaattt

SEQ ID NO: 85706 - DNA, 22 bp, Homo sapiens
gctgtcttgctcactcttgcag

SEQ ID NO: 85707 - DNA, 22 bp, Homo sapiens
tagaagaaagtgaagctgggga

SEQ ID NO: 85708 - DNA, 22 bp, Homo sapiens
ataaaaactgacccatcctttg

SEQ ID NO: 85709 - DNA, 22 bp, Homo sapiens
tccaagatctacagcagtttag

SEQ ID NO: 85710 - DNA, 22 bp, Homo sapiens
agagtgcaaccgaaacaagcag

SEQ ID NO: 85711 - DNA, 22 bp, Homo sapiens
ggtgggagagctctgtctccag

SEQ ID NO: 85712 - DNA, 22 bp, Homo sapiens
caggctggagtgcagtggggcg

SEQ ID NO: 85713 - DNA, 22 bp, Homo sapiens
attctaaatcagagagctctgt

SEQ ID NO: 85714 - DNA, 22 bp, Homo sapiens
tgtatgaggcatacatcaggca

SEQ ID NO: 85715 - DNA, 22 bp, Homo sapiens
cagccctcctaccctgccaggc

SEQ ID NO: 85716 - DNA, 22 bp, Homo sapiens
tccgggaggcagaggttgcagt

SEQ ID NO: 85717 - DNA, 22 bp, Homo sapiens
ttgaggtcatctgaagtactag

SEQ ID NO: 85718 - DNA, 22 bp, Homo sapiens
ttctgggcacacaggccctggt

SEQ ID NO: 85719 - DNA, 22 bp, Homo sapiens
tccaggctttggggcaggagcg

SEQ ID NO: 85720 - DNA, 22 bp, Homo sapiens
gaatttcacaaggtgaggataa

SEQ ID NO: 85721 - DNA, 22 bp, Homo sapiens
aatcggttgaacccaggaagtg

SEQ ID NO: 85722 - DNA, 22 bp, Homo sapiens
tagcttatcccacagtgcccag

SEQ ID NO: 85723 - DNA, 22 bp, Homo sapiens
atgaccagccgagataaacaga

SEQ ID NO: 85724 - DNA, 22 bp, Homo sapiens
tctcgctctgtcgcccaggctg

SEQ ID NO: 85725 - DNA, 22 bp, Homo sapiens
gagctgggcctgcgagtgctgc

SEQ ID NO: 85726 - DNA, 22 bp, Homo sapiens
tcctcagcttttatttcacttg

SEQ ID NO: 85727 - DNA, 22 bp, Homo sapiens
ggcagcactgcagcttgttggg

SEQ ID NO: 85728 - DNA, 22 bp, Homo sapiens
ggctcactgcaacttccgcctc

SEQ ID NO: 85729 - DNA, 22 bp, Homo sapiens
gggcagagagctggaactcctt

SEQ ID NO: 85730 - DNA, 22 bp, Homo sapiens
tgggcttaggtcggaggcggcc

SEQ ID NO: 85731 - DNA, 22 bp, Homo sapiens
tcagtgttaatcagtggtacct

SEQ ID NO: 85732 - DNA, 22 bp, Homo sapiens
agtatggaggatggaatttgct

SEQ ID NO: 85733 - DNA, 22 bp, Homo sapiens
tgttgagtatatacctacaagt

SEQ ID NO: 85734 - DNA, 21 bp, Homo sapiens
tggtaggtactggcttcaggc

SEQ ID NO: 85735 - DNA, 22 bp, Homo sapiens
tccctagtcgcatctgtggaga

SEQ ID NO: 85736 - DNA, 22 bp, Homo sapiens
aactcactttgtggcttctgaa

SEQ ID NO: 85737 - DNA, 22 bp, Homo sapiens
tgttgcccaggttctctcctgc

SEQ ID NO: 85738 - DNA, 22 bp, Homo sapiens
ctgggattacaggcacccgtca

SEQ ID NO: 85739 - DNA, 22 bp, Homo sapiens
gggagtgggtttggcctaggcc

SEQ ID NO: 85740 - DNA, 22 bp, Homo sapiens
gatctcaaagcagtgtgggttg

SEQ ID NO: 85741 - DNA, 22 bp, Homo sapiens
gctgacccctacaggttgtgtt

SEQ ID NO: 85742 - DNA, 22 bp, Homo sapiens
cacttcaacctctgagtcctgg

SEQ ID NO: 85743 - DNA, 22 bp, Homo sapiens
tcctttgcttctgtcattctcc

SEQ ID NO: 85744 - DNA, 18 bp, Homo sapiens
atggtctcatactgggag

SEQ ID NO: 85745 - DNA, 22 bp, Homo sapiens
ctggtaggggtgactgttatcg

SEQ ID NO: 85746 - DNA, 22 bp, Homo sapiens
ttcactcttcggcatctctgta

SEQ ID NO: 85747 - DNA, 22 bp, Homo sapiens
tttcttggtcttcccgacctgg

SEQ ID NO: 85748 - DNA, 22 bp, Homo sapiens
agtggggattgtgacatattac

SEQ ID NO: 85749 - DNA, 22 bp, Homo sapiens
ggctgcaggttggttggcagct

SEQ ID NO: 85750 - DNA, 22 bp, Homo sapiens
gcttacaggtgaggcagcaaga

SEQ ID NO: 85751 - DNA, 22 bp, Homo sapiens
tctgttgcaatgtgcatggtga

SEQ ID NO: 85752 - DNA, 22 bp, Homo sapiens
tttcttggggctcctgcgccat

SEQ ID NO: 85753 - DNA, 22 bp, Homo sapiens
tctagttctagatccctgagga

SEQ ID NO: 85754 - DNA, 22 bp, Homo sapiens
aaccaccattctctcctcttcc

SEQ ID NO: 85755 - DNA, 22 bp, Homo sapiens
cgtgggtcgggactccgcctcg

SEQ ID NO: 85756 - DNA, 22 bp, Homo sapiens
tttgggcaggcttttccctaga

SEQ ID NO: 85757 - DNA, 22 bp, Homo sapiens
gacctcatgatccacctgcctt

SEQ ID NO: 85758 - DNA, 18 bp, Homo sapiens
cccggctaatttttggta

SEQ ID NO: 85759 - DNA, 22 bp, Homo sapiens
acaggatcgccctgttgcccag

SEQ ID NO: 85760 - DNA, 22 bp, Homo sapiens
ctgctgggatagaagtatctca

SEQ ID NO: 85761 - DNA, 22 bp, Homo sapiens
tcagcctgctccaagtgctgcc

SEQ ID NO: 85762 - DNA, 22 bp, Homo sapiens
caaagtgctaggattacaggcc

SEQ ID NO: 85763 - DNA, 20 bp, Homo sapiens
tttgagaccagtctgcccaa

SEQ ID NO: 85764 - DNA, 22 bp, Homo sapiens
caaagtgctaggattacaggcg

SEQ ID NO: 85765 - DNA, 22 bp, Homo sapiens
gagctcattcattcattgcctg

SEQ ID NO: 85766 - DNA, 22 bp, Homo sapiens
agagctaagaaacagaattgct

SEQ ID NO: 85767 - DNA, 22 bp, Homo sapiens
tggaatggaaacaaactgagga

SEQ ID NO: 85768 - DNA, 22 bp, Homo sapiens
tgctgagcgcatccggcggccg

SEQ ID NO: 85769 - DNA, 22 bp, Homo sapiens
cggctggtgtcgggcacagcaa

SEQ ID NO: 85770 - DNA, 22 bp, Homo sapiens
gggtggtggccagcagtgggca

SEQ ID NO: 85771 - DNA, 22 bp, Homo sapiens
atggagttctgccagcgctgct

SEQ ID NO: 85772 - DNA, 22 bp, Homo sapiens
gttgcctaggctggtcttgaac

SEQ ID NO: 85773 - DNA, 22 bp, Homo sapiens
gctgggacaacaggtgagcacc

SEQ ID NO: 85774 - DNA, 22 bp, Homo sapiens
cagcagcagtgttctagaatct

SEQ ID NO: 85775 - DNA, 22 bp, Homo sapiens
ctccttctgggcctggcagtgg

SEQ ID NO: 85776 - DNA, 22 bp, Homo sapiens
gtgggcatcaccagggcctcca

SEQ ID NO: 85777 - DNA, 22 bp, Homo sapiens
cttgacactgtcactcaggcca

SEQ ID NO: 85778 - DNA, 22 bp, Homo sapiens
caggtgagaggcggtcctgcat

SEQ ID NO: 85779 - DNA, 22 bp, Homo sapiens
gcacttcaccactgtcctggtt

SEQ ID NO: 85780 - DNA, 22 bp, Homo sapiens
gttcaagaccagcctggccaac

SEQ ID NO: 85781 - DNA, 22 bp, Homo sapiens
ttactggctgggcctgagggct

SEQ ID NO: 85782 - DNA, 22 bp, Homo sapiens
ccaggctgctgttggtgtccgc

SEQ ID NO: 85783 - DNA, 22 bp, Homo sapiens
tgcagcctggcttcgcgcctcc

SEQ ID NO: 85784 - DNA, 22 bp, Homo sapiens
agtctcaaactcctaggctcga

SEQ ID NO: 85785 - DNA, 22 bp, Homo sapiens
tgatcagcatcttcccagctcg

SEQ ID NO: 85786 - DNA, 23 bp, Homo sapiens
ggttccaggaacacagcctgatg

SEQ ID NO: 85787 - DNA, 22 bp, Homo sapiens
tcataaattctggtgctgtgag

SEQ ID NO: 85788 - DNA, 22 bp, Homo sapiens
gggaagatagtgttgagggccc

SEQ ID NO: 85789 - DNA, 22 bp, Homo sapiens
cactgctacctctgcctcccgg

SEQ ID NO: 85790 - DNA, 22 bp, Homo sapiens
tgagatgaataactcctgctaa

SEQ ID NO: 85791 - DNA, 22 bp, Homo sapiens
gcccttacagggtggtcagcca

SEQ ID NO: 85792 - DNA, 22 bp, Homo sapiens
aacagtgtttttcttcagcact

SEQ ID NO: 85793 - DNA, 22 bp, Homo sapiens
cagggtttcaccatgttagcag

SEQ ID NO: 85794 - DNA, 22 bp, Homo sapiens
tagtttcatctccaccctgccc

SEQ ID NO: 85795 - DNA, 22 bp, Homo sapiens
agttgctgggaaagatttcagt

SEQ ID NO: 85796 - DNA, 16 bp, Homo sapiens
tggggatggggaagag

SEQ ID NO: 85797 - DNA, 22 bp, Homo sapiens
ccaaagtgctggggttacaggc

SEQ ID NO: 85798 - DNA, 22 bp, Homo sapiens
gtagggctcagtaaatactttg

SEQ ID NO: 85799 - DNA, 22 bp, Homo sapiens
gcgtctcaaggcccccaggcca

SEQ ID NO: 85800 - DNA, 22 bp, Homo sapiens
gcaactgaacatgtgtgtggcc

SEQ ID NO: 85801 - DNA, 20 bp, Homo sapiens
tttcttgtcggctgttgctg

SEQ ID NO: 85802 - DNA, 22 bp, Homo sapiens
acaattctgatggtttcccagt

SEQ ID NO: 85803 - DNA, 22 bp, Homo sapiens
aacggctgtggctggcggcagc

SEQ ID NO: 85804 - DNA, 22 bp, Homo sapiens
tgacctattagatttccttgcc

SEQ ID NO: 85805 - DNA, 22 bp, Homo sapiens
gccagggttcgaatccgtatgg

SEQ ID NO: 85806 - DNA, 22 bp, Homo sapiens
cctgcctatgagacgttttgcc

SEQ ID NO: 85807 - DNA, 22 bp, Homo sapiens
atgtgctgagtgtgtatataca

SEQ ID NO: 85808 - DNA, 22 bp, Homo sapiens
tcccaagtagatgggaatacag

SEQ ID NO: 85809 - DNA, 22 bp, Homo sapiens
tgccacagacaggacagaacag

SEQ ID NO: 85810 - DNA, 22 bp, Homo sapiens
gtgtttggtcagacgtccgggg

SEQ ID NO: 85811 - DNA, 22 bp, Homo sapiens
ggcagacctctccagccccaca

SEQ ID NO: 85812 - DNA, 22 bp, Homo sapiens
cgggcagtgtggctccagagtc

SEQ ID NO: 85813 - DNA, 22 bp, Homo sapiens
gttggagtgcagcttgtgcgat

SEQ ID NO: 85814 - DNA, 22 bp, Homo sapiens
ttcagcagtgcagacacccagt

SEQ ID NO: 85815 - DNA, 22 bp, Homo sapiens
actgcaacctccacctcctggg

SEQ ID NO: 85816 - DNA, 22 bp, Homo sapiens
gtggtgtaggtcacagttagga

SEQ ID NO: 85817 - DNA, 22 bp, Homo sapiens
ggcgtttcaccatgttgaccag

SEQ ID NO: 85818 - DNA, 22 bp, Homo sapiens
caaagtgctggaattacaggtg

SEQ ID NO: 85819 - DNA, 22 bp, Homo sapiens
tggtggggccagacttcagctc

SEQ ID NO: 85820 - DNA, 21 bp, Homo sapiens
gttcttgcaggatttccttcc

SEQ ID NO: 85821 - DNA, 22 bp, Homo sapiens
tttaaaaaactagtctgagtct

SEQ ID NO: 85822 - DNA, 22 bp, Homo sapiens
tgccgtggggctgaggctggag

SEQ ID NO: 85823 - DNA, 22 bp, Homo sapiens
aggctagaggcttctggcttca

SEQ ID NO: 85824 - DNA, 22 bp, Homo sapiens
tgtctcatctcttaaccccact

SEQ ID NO: 85825 - DNA, 22 bp, Homo sapiens
tctcagggctcagagctcaggc

SEQ ID NO: 85826 - DNA, 22 bp, Homo sapiens
ggggtgggcgtgcagggacacc

SEQ ID NO: 85827 - DNA, 22 bp, Homo sapiens
ggagacagggttgaaccacgca

SEQ ID NO: 85828 - DNA, 22 bp, Homo sapiens
caaagtgctgggattacaggct

SEQ ID NO: 85829 - DNA, 22 bp, Homo sapiens
atgaaaacggaccagagctatt

SEQ ID NO: 85830 - DNA, 22 bp, Homo sapiens
tgaagactcagaagctaagata

SEQ ID NO: 85831 - DNA, 22 bp, Homo sapiens
tcgaactcatagtcgtagctgt

SEQ ID NO: 85832 - DNA, 22 bp, Homo sapiens
ttatttttaaaagttcacacag

SEQ ID NO: 85833 - DNA, 22 bp, Homo sapiens
tagactagaggatcagcaaggg

SEQ ID NO: 85834 - DNA, 22 bp, Homo sapiens
accatgttggccaagctggtct

SEQ ID NO: 85835 - DNA, 22 bp, Homo sapiens
tgtgagcagagacatgaaaagc

SEQ ID NO: 85836 - DNA, 22 bp, Homo sapiens
tgagccgtggtctctgagggtg

SEQ ID NO: 85837 - DNA, 22 bp, Homo sapiens
cctcttctaggacgtccttgtg

SEQ ID NO: 85838 - DNA, 22 bp, Homo sapiens
agcaagattgaggcttcctcag

SEQ ID NO: 85839 - DNA, 22 bp, Homo sapiens
ttatttaaaagtggtaagattc

SEQ ID NO: 85840 - DNA, 22 bp, Homo sapiens
acaaacagagttgaaaaatagg

SEQ ID NO: 85841 - DNA, 22 bp, Homo sapiens
aggccttaccatagctgtagca

SEQ ID NO: 85842 - DNA, 22 bp, Homo sapiens
agtatacatagtgcttcctctt

SEQ ID NO: 85843 - DNA, 22 bp, Homo sapiens
atggggggatgaaggagtccaa

SEQ ID NO: 85844 - DNA, 22 bp, Homo sapiens
accattgccccctagtgtctgt

SEQ ID NO: 85845 - DNA, 22 bp, Homo sapiens
ggaggtggagctggaagttcca

SEQ ID NO: 85846 - DNA, 22 bp, Homo sapiens
aaggtgggcagatcacaaggtc

SEQ ID NO: 85847 - DNA, 22 bp, Homo sapiens
ctgattgagaaggaaggggatc

SEQ ID NO: 85848 - DNA, 23 bp, Homo sapiens
aatgggtgcaactatccatgaca

SEQ ID NO: 85849 - DNA, 16 bp, Homo sapiens
tgggtgggaggagcgg

SEQ ID NO: 85850 - DNA, 22 bp, Homo sapiens
attataggcttgagccaccgtg

SEQ ID NO: 85851 - DNA, 22 bp, Homo sapiens
gggtggagagaaagaaacgtga

SEQ ID NO: 85852 - DNA, 22 bp, Homo sapiens
tctggtgtcagtattctttgaa

SEQ ID NO: 85853 - DNA, 22 bp, Homo sapiens
tgagtgtggggaatgtcatgag

SEQ ID NO: 85854 - DNA, 22 bp, Homo sapiens
atttcacttagtgtaatgtctt

SEQ ID NO: 85855 - DNA, 22 bp, Homo sapiens
caaagtgctgggattacaggtg

SEQ ID NO: 85856 - DNA, 16 bp, Homo sapiens
ccacctgcagctctca

SEQ ID NO: 85857 - DNA, 22 bp, Homo sapiens
caagtggaatgctcttcctccc

SEQ ID NO: 85858 - DNA, 22 bp, Homo sapiens
atgattgaccatctgctgggct

SEQ ID NO: 85859 - DNA, 22 bp, Homo sapiens
tcactgcgcttcagcctgggtg

SEQ ID NO: 85860 - DNA, 22 bp, Homo sapiens
cgggttcacgccattctcctgc

SEQ ID NO: 85861 - DNA, 22 bp, Homo sapiens
gcccagccacagtcactttcat

SEQ ID NO: 85862 - DNA, 22 bp, Homo sapiens
ttctttcagaacacaagtgatt

SEQ ID NO: 85863 - DNA, 22 bp, Homo sapiens
gcgcaccacctccaggtggccg

SEQ ID NO: 85864 - DNA, 22 bp, Homo sapiens
ctgagcctcctgcttctatttc

SEQ ID NO: 85865 - DNA, 22 bp, Homo sapiens
cacagcctcctctggctcacgg

SEQ ID NO: 85866 - DNA, 22 bp, Homo sapiens
gcccgcgccagcctctccatct

SEQ ID NO: 85867 - DNA, 22 bp, Homo sapiens
taagaaatttagttatagaatg

SEQ ID NO: 85868 - DNA, 22 bp, Homo sapiens
cctgcctactgagttttatatt

SEQ ID NO: 85869 - DNA, 21 bp, Homo sapiens
caatggcgagatcttggctca

SEQ ID NO: 85870 - DNA, 22 bp, Homo sapiens
ttgtcttttgtgggaaatatgg

SEQ ID NO: 85871 - DNA, 22 bp, Homo sapiens
gagcactgatttatttttgtct

SEQ ID NO: 85872 - DNA, 22 bp, Homo sapiens
gttgtgaatagtgccgcaataa

SEQ ID NO: 85873 - DNA, 22 bp, Homo sapiens
tgcagattcaaatgaaatgcaa

SEQ ID NO: 85874 - DNA, 21 bp, Homo sapiens
tccttcagtctagatgattgt

SEQ ID NO: 85875 - DNA, 22 bp, Homo sapiens
cagatgtacatgaagggcaatg

SEQ ID NO: 85876 - DNA, 22 bp, Homo sapiens
ttgtgaatagtgccgcaataaa

SEQ ID NO: 85877 - DNA, 22 bp, Homo sapiens
tgtgaatggacaattaaatcta

SEQ ID NO: 85878 - DNA, 22 bp, Homo sapiens
aaatgtaagtctttgtttctta

SEQ ID NO: 85879 - DNA, 22 bp, Homo sapiens
atgcagtggcttcagtgtcagt

SEQ ID NO: 85880 - DNA, 22 bp, Homo sapiens
tttgtgaataggttggcttcca

SEQ ID NO: 85881 - DNA, 21 bp, Homo sapiens
gcagcagtgttctagaatact

SEQ ID NO: 85882 - DNA, 22 bp, Homo sapiens
cttagagatgggttttacttag

SEQ ID NO: 85883 - DNA, 21 bp, Homo sapiens
aaactgaccttgcctgagaca

SEQ ID NO: 85884 - DNA, 22 bp, Homo sapiens
tttgttttcaatgtgtcattca

SEQ ID NO: 85885 - DNA, 22 bp, Homo sapiens
attgtgaatagtgccgcagtaa

SEQ ID NO: 85886 - DNA, 22 bp, Homo sapiens
gaaagacatagttgcaagatgg

SEQ ID NO: 85887 - DNA, 22 bp, Homo sapiens
gagcagtaggagaaccctgagc

SEQ ID NO: 85888 - DNA, 17 bp, Homo sapiens
tccttcagtgcctctgc

SEQ ID NO: 85889 - DNA, 22 bp, Homo sapiens
ttgtgaatggtgccgcaataaa

SEQ ID NO: 85890 - DNA, 22 bp, Homo sapiens
ttgcatagtgctgaggttcggg

SEQ ID NO: 85891 - DNA, 22 bp, Homo sapiens
cttaatctcacctgcaaagtcc

SEQ ID NO: 85892 - DNA, 22 bp, Homo sapiens
catgtgaattccaaagctaggt

SEQ ID NO: 85893 - DNA, 22 bp, Homo sapiens
atctgagtcaaatatttcattt

SEQ ID NO: 85894 - DNA, 22 bp, Homo sapiens
accttcaggtgagcacacagat

SEQ ID NO: 85895 - DNA, 22 bp, Homo sapiens
taacaatacccattctaattac

SEQ ID NO: 85896 - DNA, 22 bp, Homo sapiens
ttgtgaatagtgccgctataaa

SEQ ID NO: 85897 - DNA, 22 bp, Homo sapiens
acatatgcgatcataggatgca

SEQ ID NO: 85898 - DNA, 22 bp, Homo sapiens
taacagtatatttaccaaacct

SEQ ID NO: 85899 - DNA, 22 bp, Homo sapiens
gaattttattactagtcaactg

SEQ ID NO: 85900 - DNA, 22 bp, Homo sapiens
tgcctgatgcaggagtatcaga

SEQ ID NO: 85901 - DNA, 22 bp, Homo sapiens
ttggaaacgtcaccttttcctt

SEQ ID NO: 85902 - DNA, 22 bp, Homo sapiens
ctgctttaaaactgatacatga

SEQ ID NO: 85903 - DNA, 22 bp, Homo sapiens
atgccactgcactccagcctag

SEQ ID NO: 85904 - DNA, 22 bp, Homo sapiens
gaaaagagacagggtgggtgat

SEQ ID NO: 85905 - DNA, 18 bp, Homo sapiens
actctgcggaggccccag

SEQ ID NO: 85906 - DNA, 22 bp, Homo sapiens
accacatcgggcggacactggg

SEQ ID NO: 85907 - DNA, 22 bp, Homo sapiens
gggacaatggaggcctctctcc

SEQ ID NO: 85908 - DNA, 22 bp, Homo sapiens
tggtatgaccgtggtgcaagca

SEQ ID NO: 85909 - DNA, 22 bp, Homo sapiens
ttcagcagtgcagacacccagt

SEQ ID NO: 85910 - DNA, 22 bp, Homo sapiens
aaattgtaatgacttcacttga

SEQ ID NO: 85911 - DNA, 22 bp, Homo sapiens
tcttcccccgtgctccagtgca

SEQ ID NO: 85912 - DNA, 22 bp, Homo sapiens
taggattccagaacagtgctgc

SEQ ID NO: 85913 - DNA, 22 bp, Homo sapiens
ctggcagatagtaagtgatcaa

SEQ ID NO: 85914 - DNA, 22 bp, Homo sapiens
ggctctgcagcttggggtcctg

SEQ ID NO: 85915 - DNA, 22 bp, Homo sapiens
ttgttgtcattgtagaggattt

SEQ ID NO: 85916 - DNA, 22 bp, Homo sapiens
actgcactcctgcctgggtaac

SEQ ID NO: 85917 - DNA, 22 bp, Homo sapiens
acaggggcaagggctcacggcc

SEQ ID NO: 85918 - DNA, 22 bp, Homo sapiens
ggtgacggggcccaggtttcct

SEQ ID NO: 85919 - DNA, 22 bp, Homo sapiens
aggggatggagctggaaggcag

SEQ ID NO: 85920 - DNA, 22 bp, Homo sapiens
caggagatgacagggaagaacc

SEQ ID NO: 85921 - DNA, 22 bp, Homo sapiens
tcacagagatgaacttttgata

SEQ ID NO: 85922 - DNA, 22 bp, Homo sapiens
tgttccgaccgtggggtttgat

SEQ ID NO: 85923 - DNA, 17 bp, Homo sapiens
catccgtgagctcggca

SEQ ID NO: 85924 - DNA, 22 bp, Homo sapiens
tgatctaggttggcttcaactg

SEQ ID NO: 85925 - DNA, 22 bp, Homo sapiens
ggggatggaggcgtgtggtcct

SEQ ID NO: 85926 - DNA, 22 bp, Homo sapiens
tcacagagaaatgtggcacaaa

SEQ ID NO: 85927 - DNA, 22 bp, Homo sapiens
gaggtgtcatcaggcagctctg

SEQ ID NO: 85928 - DNA, 22 bp, Homo sapiens
ttttctcttccctctggacctg

SEQ ID NO: 85929 - DNA, 22 bp, Homo sapiens
atgccactgcacttcagcctgg

SEQ ID NO: 85930 - DNA, 22 bp, Homo sapiens
gggaaggccttgtcagcggatt

SEQ ID NO: 85931 - DNA, 22 bp, Homo sapiens
aggtcacccgtttgactatcca

SEQ ID NO: 85932 - DNA, 22 bp, Homo sapiens
tgcccaggctggagtacagtgg

SEQ ID NO: 85933 - DNA, 22 bp, Homo sapiens
ttctagtgtccttggacttgct

SEQ ID NO: 85934 - DNA, 20 bp, Homo sapiens
tttcttgtcggctgttgctg

SEQ ID NO: 85935 - DNA, 22 bp, Homo sapiens
tcactgccattagttggttaat

SEQ ID NO: 85936 - DNA, 22 bp, Homo sapiens
gggagctgaaggagccggcggg

SEQ ID NO: 85937 - DNA, 22 bp, Homo sapiens
gctgtgtatcagatgccacggg

SEQ ID NO: 85938 - DNA, 20 bp, Homo sapiens
tcagccattccttacctttc

SEQ ID NO: 85939 - DNA, 22 bp, Homo sapiens
ttcactgcaacctccgcctccc

SEQ ID NO: 85940 - DNA, 17 bp, Homo sapiens
gtaaggcttgcagatgc

SEQ ID NO: 85941 - DNA, 22 bp, Homo sapiens
aagggctctgtgcttgtcccat

SEQ ID NO: 85942 - DNA, 22 bp, Homo sapiens
gctgcagtgagccaagatcgtg

SEQ ID NO: 85943 - DNA, 22 bp, Homo sapiens
ccaggaggcggaggttgcagtg

SEQ ID NO: 85944 - DNA, 22 bp, Homo sapiens
agagcggggatagttaatattc

SEQ ID NO: 85945 - DNA, 22 bp, Homo sapiens
cactgcactccagcctgggaga

SEQ ID NO: 85946 - DNA, 22 bp, Homo sapiens
tgggaagggtcaacagctggaa

SEQ ID NO: 85947 - DNA, 22 bp, Homo sapiens
acaattctgatggtttcccagt

SEQ ID NO: 85948 - DNA, 22 bp, Homo sapiens
gcctggagaaaggaaggtggga

SEQ ID NO: 85949 - DNA, 22 bp, Homo sapiens
ggctgggcctctccctcagctg

SEQ ID NO: 85950 - DNA, 22 bp, Homo sapiens
agatcggctttgcagacctcat

SEQ ID NO: 85951 - DNA, 22 bp, Homo sapiens
ctgctctgctgatcagtgtctc

SEQ ID NO: 85952 - DNA, 22 bp, Homo sapiens
tgtgtggattcatctcaaagag

SEQ ID NO: 85953 - DNA, 22 bp, Homo sapiens
caaatactacgattcttgcagt

SEQ ID NO: 85954 - DNA, 22 bp, Homo sapiens
tttctgagaaattaaacacttt

SEQ ID NO: 85955 - DNA, 23 bp, Homo sapiens
ggagtgcaatggcgccatctcgg

SEQ ID NO: 85956 - DNA, 20 bp, Homo sapiens
agcggctggcggaggacacg

SEQ ID NO: 85957 - DNA, 22 bp, Homo sapiens
ggttcccggatctccgagtccc

SEQ ID NO: 85958 - DNA, 22 bp, Homo sapiens
ccaggctgctgttggtgtccgc

SEQ ID NO: 85959 - DNA, 22 bp, Homo sapiens
cttctcttcctttgtcaactga

SEQ ID NO: 85960 - DNA, 22 bp, Homo sapiens
acaggcttacaggctgcaagta

SEQ ID NO: 85961 - DNA, 22 bp, Homo sapiens
tatggctaattctttactgacc

SEQ ID NO: 85962 - DNA, 22 bp, Homo sapiens
gattcactcatattttacgttt

SEQ ID NO: 85963 - DNA, 22 bp, Homo sapiens
ccaggaggcggaggttgcagcg

SEQ ID NO: 85964 - DNA, 22 bp, Homo sapiens
gacccggctccaggcccagcag

SEQ ID NO: 85965 - DNA, 22 bp, Homo sapiens
ctggcaggagcattcacagagg

SEQ ID NO: 85966 - DNA, 22 bp, Homo sapiens
gcaaaagtacagccggatttct

SEQ ID NO: 85967 - DNA, 22 bp, Homo sapiens
aagacttgaccaggttgaaggc

SEQ ID NO: 85968 - DNA, 22 bp, Homo sapiens
catgtgtcttgctgccctccat

SEQ ID NO: 85969 - DNA, 22 bp, Homo sapiens
tttgtagcagcatgatttataa

SEQ ID NO: 85970 - DNA, 22 bp, Homo sapiens
catctgtctgcatgctctgggt

SEQ ID NO: 85971 - DNA, 22 bp, Homo sapiens
atgccactgcactccagcctgg

SEQ ID NO: 85972 - DNA, 22 bp, Homo sapiens
cagcgtgggatttggaaaccag

SEQ ID NO: 85973 - DNA, 22 bp, Homo sapiens
aggagatggagctcagtgggca

SEQ ID NO: 85974 - DNA, 22 bp, Homo sapiens
ctgtaatcccagctacctggga

SEQ ID NO: 85975 - DNA, 22 bp, Homo sapiens
ttccatttggagctcgcagcct

SEQ ID NO: 85976 - DNA, 22 bp, Homo sapiens
atatatttgagaatattcatga

SEQ ID NO: 85977 - DNA, 22 bp, Homo sapiens
agtggcgtcctaggaaaggagg

SEQ ID NO: 85978 - DNA, 22 bp, Homo sapiens
acaagcgggccacagtgctggt

SEQ ID NO: 85979 - DNA, 18 bp, Homo sapiens
atggtctcatactgggag

SEQ ID NO: 85980 - DNA, 22 bp, Homo sapiens
gccgggaccaaggccacggagc

SEQ ID NO: 85981 - DNA, 22 bp, Homo sapiens
gggtcgggcaggcgccctcgtc

SEQ ID NO: 85982 - DNA, 18 bp, Homo sapiens
tgtagagccaggtttgcc

SEQ ID NO: 85983 - DNA, 22 bp, Homo sapiens
ggagcagggaattacagcgcag

SEQ ID NO: 85984 - DNA, 22 bp, Homo sapiens
ttattaggaactcaggattttt

SEQ ID NO: 85985 - DNA, 22 bp, Homo sapiens
actgcattccagcctgggcaac

SEQ ID NO: 85986 - DNA, 22 bp, Homo sapiens
tgagccagaggaggctgtgtgg

SEQ ID NO: 85987 - DNA, 22 bp, Homo sapiens
gttgagtgggttaggatgctga

SEQ ID NO: 85988 - DNA, 22 bp, Homo sapiens
actgcacttcaccctgggtgac

SEQ ID NO: 85989 - DNA, 22 bp, Homo sapiens
cttgtagacccctggactcacg

SEQ ID NO: 85990 - DNA, 22 bp, Homo sapiens
ggggtgggcgtgcagggacacc

SEQ ID NO: 85991 - DNA, 22 bp, Homo sapiens
gggagctgagctggaagagaat

SEQ ID NO: 85992 - DNA, 22 bp, Homo sapiens
gactggaaagcctgtcctcaga

SEQ ID NO: 85993 - DNA, 22 bp, Homo sapiens
gagctcattcattcattgcctg

SEQ ID NO: 85994 - DNA, 17 bp, Homo sapiens
gggcagggactcctggg

SEQ ID NO: 85995 - DNA, 22 bp, Homo sapiens
tgccatagcaatggtaagctga

SEQ ID NO: 85996 - DNA, 22 bp, Homo sapiens
cacccaggctggaatgcagtgg

SEQ ID NO: 85997 - DNA, 22 bp, Homo sapiens
cacccaggctggagtgcagtga

SEQ ID NO: 85998 - DNA, 22 bp, Homo sapiens
cacttgttggtggtgaaatcac

SEQ ID NO: 85999 - DNA, 22 bp, Homo sapiens
ccaatgatggtgcccacgatga

SEQ ID NO: 86000 - DNA, 20 bp, Homo sapiens
ttcatgggagcaaagaggcc

SEQ ID NO: 86001 - DNA, 22 bp, Homo sapiens
gaagattgaaggctgggaatta

SEQ ID NO: 86002 - DNA, 22 bp, Homo sapiens
ataaaagatcccttctgagctc

SEQ ID NO: 86003 - DNA, 22 bp, Homo sapiens
ggggcaggagcccttcttcagc

SEQ ID NO: 86004 - DNA, 22 bp, Homo sapiens
ccaggaggcggaaggtacagtg

SEQ ID NO: 86005 - DNA, 22 bp, Homo sapiens
gctgggttttcttccgggccta

SEQ ID NO: 86006 - DNA, 22 bp, Homo sapiens
caccaggctggagtgcagtggc

SEQ ID NO: 86007 - DNA, 22 bp, Homo sapiens
gtggtgtaggtcacagttagga

SEQ ID NO: 86008 - DNA, 22 bp, Homo sapiens
actgcacttcagcctgggtgac

SEQ ID NO: 86009 - DNA, 22 bp, Homo sapiens
tggtggggccagacttcagctc

SEQ ID NO: 86010 - DNA, 22 bp, Homo sapiens
atatacacatctttttaaatat

SEQ ID NO: 86011 - DNA, 22 bp, Homo sapiens
catgtgtccacccttgaacaca

SEQ ID NO: 86012 - DNA, 22 bp, Homo sapiens
agatttatgtggtcacactcag

SEQ ID NO: 86013 - DNA, 22 bp, Homo sapiens
atggctagcaccgcgttgctgg

SEQ ID NO: 86014 - DNA, 22 bp, Homo sapiens
gccaggctgaggctctggaaga

SEQ ID NO: 86015 - DNA, 22 bp, Homo sapiens
gctgaggtggaggaaggagacc

SEQ ID NO: 86016 - DNA, 22 bp, Homo sapiens
cgtgtggtcccggcaaggcaag

SEQ ID NO: 86017 - DNA, 22 bp, Homo sapiens
gtcaggactctgacccgtcccg

SEQ ID NO: 86018 - DNA, 22 bp, Homo sapiens
cccacacacatttatgatagga

SEQ ID NO: 86019 - DNA, 22 bp, Homo sapiens
gataccagacagggagggagaa

SEQ ID NO: 86020 - DNA, 22 bp, Homo sapiens
caaagtgctaggattacaggcc

SEQ ID NO: 86021 - DNA, 22 bp, Homo sapiens
caggaggttgagggtgcagtga

SEQ ID NO: 86022 - DNA, 22 bp, Homo sapiens
gggttggatcctggtggctgcc

SEQ ID NO: 86023 - DNA, 22 bp, Homo sapiens
ggttgcaaactcctgggatcaa

SEQ ID NO: 86024 - DNA, 22 bp, Homo sapiens
gagcacagtaaagcagtgtcac

SEQ ID NO: 86025 - DNA, 22 bp, Homo sapiens
aagttactggcaagggctgcag

SEQ ID NO: 86026 - DNA, 22 bp, Homo sapiens
gcaggtggatcacctgaggtca

SEQ ID NO: 86027 - DNA, 22 bp, Homo sapiens
ctcagctgcagcctggctggca

SEQ ID NO: 86028 - DNA, 22 bp, Homo sapiens
gttcaagaccagcctggccaac

SEQ ID NO: 86029 - DNA, 22 bp, Homo sapiens
gctcaagccttctgcccacctc

SEQ ID NO: 86030 - DNA, 22 bp, Homo sapiens
ccctgccttgtctgggctaggt

SEQ ID NO: 86031 - DNA, 22 bp, Homo sapiens
tttattggatatttacaagata

SEQ ID NO: 86032 - DNA, 22 bp, Homo sapiens
ctcattgcaacctccgcctccc

SEQ ID NO: 86033 - DNA, 22 bp, Homo sapiens
aggggagagttaatgtgaatgt

SEQ ID NO: 86034 - DNA, 22 bp, Homo sapiens
caggaggacatactggctcaca

SEQ ID NO: 86035 - DNA, 22 bp, Homo sapiens
tcgcccaggctggaagtgcagt

SEQ ID NO: 86036 - DNA, 22 bp, Homo sapiens
cactgcactccagcctgggtca

SEQ ID NO: 86037 - DNA, 22 bp, Homo sapiens
atgcacctgaactccatcagct

SEQ ID NO: 86038 - DNA, 22 bp, Homo sapiens
ttatttttaaaagttcacacag

SEQ ID NO: 86039 - DNA, 22 bp, Homo sapiens
ggcaagagggcagatggagtgc

SEQ ID NO: 86040 - DNA, 22 bp, Homo sapiens
ggaggagcatgagagggtagtg

SEQ ID NO: 86041 - DNA, 21 bp, Homo sapiens
ggagtttttctggaagggact

SEQ ID NO: 86042 - DNA, 21 bp, Homo sapiens
gggcactgaaagggaatagca

SEQ ID NO: 86043 - DNA, 22 bp, Homo sapiens
ggctcatatcccggccatcatt

SEQ ID NO: 86044 - DNA, 22 bp, Homo sapiens
taattgtaaagtagtagtacag

SEQ ID NO: 86045 - DNA, 22 bp, Homo sapiens
atggcctgcagtgctgccacag

SEQ ID NO: 86046 - DNA, 22 bp, Homo sapiens
cctggaggcggaggttgcagtg

SEQ ID NO: 86047 - DNA, 22 bp, Homo sapiens
gcagggcacaaggacgcacagg

SEQ ID NO: 86048 - DNA, 22 bp, Homo sapiens
aaagcctcccaggttatgagta

SEQ ID NO: 86049 - DNA, 20 bp, Homo sapiens
gctgaggtggaggaaggaga

SEQ ID NO: 86050 - DNA, 22 bp, Homo sapiens
tatcacagccttttggtgaggg

SEQ ID NO: 86051 - DNA, 22 bp, Homo sapiens
tgcttacgagctattttcactt

SEQ ID NO: 86052 - DNA, 22 bp, Homo sapiens
gtggctcacgtctgtcatctca

SEQ ID NO: 86053 - DNA, 22 bp, Homo sapiens
ctcaggacccggtccaggtggg

SEQ ID NO: 86054 - DNA, 22 bp, Homo sapiens
attggtggtgaggacatgccag

SEQ ID NO: 86055 - DNA, 22 bp, Homo sapiens
cgcccaggctggagtgcagtga

SEQ ID NO: 86056 - DNA, 19 bp, Homo sapiens
aggcttcaggccacatgct

SEQ ID NO: 86057 - DNA, 22 bp, Homo sapiens
gggtgctttggctcacgcctgt

SEQ ID NO: 86058 - DNA, 22 bp, Homo sapiens
caggaagaccagggctgtggct

SEQ ID NO: 86059 - DNA, 22 bp, Homo sapiens
tcaggaggcggaggttgcagtg

SEQ ID NO: 86060 - DNA, 22 bp, Homo sapiens
gtgagccgagtatagttcatag

SEQ ID NO: 86061 - DNA, 22 bp, Homo sapiens
atcaacatgtcataaagtgaaa

SEQ ID NO: 86062 - DNA, 22 bp, Homo sapiens
acatacttctttacattccata

SEQ ID NO: 86063 - DNA, 23 bp, Homo sapiens
aatgggtgcaactatccatgaca

SEQ ID NO: 86064 - DNA, 22 bp, Homo sapiens
tcttaattctgtgtcttcacta

SEQ ID NO: 86065 - DNA, 22 bp, Homo sapiens
tcgtctgtgaaattgggataag

SEQ ID NO: 86066 - DNA, 22 bp, Homo sapiens
caaagctggaaaaggaggctgg

SEQ ID NO: 86067 - DNA, 22 bp, Homo sapiens
agccagactgtgatgtgattaa

SEQ ID NO: 86068 - DNA, 22 bp, Homo sapiens
agcatttatcttttgtttgagt

SEQ ID NO: 86069 - DNA, 22 bp, Homo sapiens
gcagctgacatctggctgggcc

SEQ ID NO: 86070 - DNA, 22 bp, Homo sapiens
tagactggtgaattagggggaa

SEQ ID NO: 86071 - DNA, 22 bp, Homo sapiens
ccacctgagataagagagctca

SEQ ID NO: 86072 - DNA, 22 bp, Homo sapiens
tgtgggtggcatcgtcctggcc

SEQ ID NO: 86073 - DNA, 22 bp, Homo sapiens
ttctgcaggctgtacaagaagc

SEQ ID NO: 86074 - DNA, 22 bp, Homo sapiens
taatgtataacaaatactcatc

SEQ ID NO: 86075 - DNA, 22 bp, Homo sapiens
gtgcggatcggtgtcctccaaa

SEQ ID NO: 86076 - DNA, 22 bp, Homo sapiens
cttatcagattatctgggctgt

SEQ ID NO: 86077 - DNA, 22 bp, Homo sapiens
caggcaggtcagtgaagaagga

SEQ ID NO: 86078 - DNA, 22 bp, Homo sapiens
gaggttggggctgcagtgagct

SEQ ID NO: 86079 - DNA, 22 bp, Homo sapiens
atgaggcaggtggaggctgcca

SEQ ID NO: 86080 - DNA, 22 bp, Homo sapiens
gcctccggagttgcagtgtctt

SEQ ID NO: 86081 - DNA, 22 bp, Homo sapiens
ggccttggttccaaagcaggca

SEQ ID NO: 86082 - DNA, 22 bp, Homo sapiens
atgttctacagatggaaagggg

SEQ ID NO: 86083 - DNA, 22 bp, Homo sapiens
gcatgtgtctttatagcagcat

SEQ ID NO: 86084 - DNA, 22 bp, Homo sapiens
agtgcagtggttaggagccagg

SEQ ID NO: 86085 - DNA, 22 bp, Homo sapiens
ctcactgcaagctccacctctt

SEQ ID NO: 86086 - DNA, 22 bp, Homo sapiens
agaaaatttaaagagacacaca

SEQ ID NO: 86087 - DNA, 20 bp, Homo sapiens
aagcagtgaggtgaggagtg

SEQ ID NO: 86088 - DNA, 22 bp, Homo sapiens
ggtgccaggctgtagtcagggt

SEQ ID NO: 86089 - DNA, 20 bp, Homo sapiens
acgtggccaccagtggctta

SEQ ID NO: 86090 - DNA, 21 bp, Homo sapiens
gtgcggatgccgtcattgtca

SEQ ID NO: 86091 - DNA, 22 bp, Homo sapiens
ggttccacctggcgaggggtat

SEQ ID NO: 86092 - DNA, 22 bp, Homo sapiens
caaagtgctggaattacaggtg

SEQ ID NO: 86093 - DNA, 22 bp, Homo sapiens
actcatgtcctaggagtaaagc

SEQ ID NO: 86094 - DNA, 22 bp, Homo sapiens
cagcttggaggaggatctaaga

SEQ ID NO: 86095 - DNA, 17 bp, Homo sapiens
ggctgcagtccaggagg

SEQ ID NO: 86096 - DNA, 22 bp, Homo sapiens
tcattccctcattgttcactgg

SEQ ID NO: 86097 - DNA, 22 bp, Homo sapiens
acatttatataactcactagga

SEQ ID NO: 86098 - DNA, 22 bp, Homo sapiens
aaggtgggtggatcacgaggtc

SEQ ID NO: 86099 - DNA, 17 bp, Homo sapiens
ttaaggtggatcagcac

SEQ ID NO: 86100 - DNA, 22 bp, Homo sapiens
tccaccctgcttttgtctttga

SEQ ID NO: 86101 - DNA, 22 bp, Homo sapiens
tccacgtgagcttcgtgtgcag

SEQ ID NO: 86102 - DNA, 22 bp, Homo sapiens
tggatatccttgttaactttct

SEQ ID NO: 86103 - DNA, 22 bp, Homo sapiens
ccaaagtgctgggattacaggt

SEQ ID NO: 86104 - DNA, 22 bp, Homo sapiens
aatggccagacagatggctgct

SEQ ID NO: 86105 - DNA, 22 bp, Homo sapiens
cattgctttgtgcatatttaaa

SEQ ID NO: 86106 - DNA, 22 bp, Homo sapiens
atacaaaatatatactggagac

SEQ ID NO: 86107 - DNA, 22 bp, Homo sapiens
ccaggaggttgaggctgcagtg

SEQ ID NO: 86108 - DNA, 22 bp, Homo sapiens
tgttatctgagcaacgtcgacg

SEQ ID NO: 86109 - DNA, 22 bp, Homo sapiens
tcccccaggctggagtgcagtg

SEQ ID NO: 86110 - DNA, 22 bp, Homo sapiens
tgaacatgctgttgatggcctg

SEQ ID NO: 86111 - DNA, 22 bp, Homo sapiens
gaggtaggtgtaggaggcctgc

SEQ ID NO: 86112 - DNA, 22 bp, Homo sapiens
cgtaggtggctcagcacctggg

SEQ ID NO: 86113 - DNA, 23 bp, Homo sapiens
tatgaactgcattgctggtgtgt

SEQ ID NO: 86114 - DNA, 22 bp, Homo sapiens
gtggggtagatctttctcagga

SEQ ID NO: 86115 - DNA, 22 bp, Homo sapiens
cagagagaatcttggcagctga

SEQ ID NO: 86116 - DNA, 22 bp, Homo sapiens
taatgtaaacacagagacagaa

SEQ ID NO: 86117 - DNA, 22 bp, Homo sapiens
catgagataatttttctccagt

SEQ ID NO: 86118 - DNA, 22 bp, Homo sapiens
tggaagactcaaggtggtgaat

SEQ ID NO: 86119 - DNA, 22 bp, Homo sapiens
aagcccttggcgcacaccgggc

SEQ ID NO: 86120 - DNA, 22 bp, Homo sapiens
agttattgagtgcagagcaggg

SEQ ID NO: 86121 - DNA, 22 bp, Homo sapiens
cactgcactccatcctgggaaa

SEQ ID NO: 86122 - DNA, 22 bp, Homo sapiens
ctctggaccctcctgctgagag

SEQ ID NO: 86123 - DNA, 19 bp, Homo sapiens
gcctatgtcttcaaatcat

SEQ ID NO: 86124 - DNA, 22 bp, Homo sapiens
ttggccttagcttcttcttaaa

SEQ ID NO: 86125 - DNA, 22 bp, Homo sapiens
gccggggctggggagagacatg

SEQ ID NO: 86126 - DNA, 22 bp, Homo sapiens
tgcctctgaggaagattgtgtt

SEQ ID NO: 86127 - DNA, 22 bp, Homo sapiens
gggaggttgaggctgcagtgag

SEQ ID NO: 86128 - DNA, 22 bp, Homo sapiens
gggccatgagaggttcatcaac

SEQ ID NO: 86129 - DNA, 22 bp, Homo sapiens
catgatctggtcctactgtggg

SEQ ID NO: 86130 - DNA, 22 bp, Homo sapiens
gcctccggagtcacagtgtctt

SEQ ID NO: 86131 - DNA, 22 bp, Homo sapiens
gtccccgacgtttggcttgatg

SEQ ID NO: 86132 - DNA, 22 bp, Homo sapiens
ttatatgtttctgtttggaggc

SEQ ID NO: 86133 - DNA, 22 bp, Homo sapiens
gttgaaatcctaaccccctagt

SEQ ID NO: 86134 - DNA, 22 bp, Homo sapiens
attttctatgttgtaattgtta

SEQ ID NO: 86135 - DNA, 22 bp, Homo sapiens
ctggtgtggactccgcgcggag

SEQ ID NO: 86136 - DNA, 22 bp, Homo sapiens
agcataagttggtacagccact

SEQ ID NO: 86137 - DNA, 22 bp, Homo sapiens
tgggattcaccatgggcttcag

SEQ ID NO: 86138 - DNA, 22 bp, Homo sapiens
gcagagctcatgcctgcacctc

SEQ ID NO: 86139 - DNA, 22 bp, Homo sapiens
cgggaaggtggaggttgcagtg

SEQ ID NO: 86140 - DNA, 22 bp, Homo sapiens
cccgagtgtctactcactccca

SEQ ID NO: 86141 - DNA, 22 bp, Homo sapiens
tcacagagttaaaagtttcttt

SEQ ID NO: 86142 - DNA, 22 bp, Homo sapiens
tcctcctgtctaccagttcctg

SEQ ID NO: 86143 - DNA, 22 bp, Homo sapiens
tggtgctgccaggctcctgcca

SEQ ID NO: 86144 - DNA, 23 bp, Homo sapiens
agcttttaggtggaaatggcact

SEQ ID NO: 86145 - DNA, 19 bp, Homo sapiens
tggctctgtcgaaggcaca

SEQ ID NO: 86146 - DNA, 22 bp, Homo sapiens
tcagggattgcaaaattcatcc

SEQ ID NO: 86147 - DNA, 17 bp, Homo sapiens
tggctctgtcctcagct

SEQ ID NO: 86148 - DNA, 22 bp, Homo sapiens
caaagtgctgggattacaggtg

SEQ ID NO: 86149 - DNA, 22 bp, Homo sapiens
ccattgtaaattctgtggaagt

SEQ ID NO: 86150 - DNA, 22 bp, Homo sapiens
aaagatcacgtcccaggactcg

SEQ ID NO: 86151 - DNA, 22 bp, Homo sapiens
tccagctgaggtggcctctgtg

SEQ ID NO: 86152 - DNA, 22 bp, Homo sapiens
ccggctactcgggaggctgacg

SEQ ID NO: 86153 - DNA, 22 bp, Homo sapiens
caggctggagtgcaatgacgcc

SEQ ID NO: 86154 - DNA, 22 bp, Homo sapiens
agccagggtctctcgctctgtt

SEQ ID NO: 86155 - DNA, 22 bp, Homo sapiens
cttctgagatgttgttttacag

SEQ ID NO: 86156 - DNA, 22 bp, Homo sapiens
ggctctgcttgaggccagcctg

SEQ ID NO: 86157 - DNA, 22 bp, Homo sapiens
ccaggtgtgctctgcagtggat

SEQ ID NO: 86158 - DNA, 22 bp, Homo sapiens
catggtgatttgcgccttctat

SEQ ID NO: 86159 - DNA, 22 bp, Homo sapiens
actgccaatggtagtttgatgg

SEQ ID NO: 86160 - DNA, 22 bp, Homo sapiens
ataaaatttgctactgttaaat

SEQ ID NO: 86161 - DNA, 22 bp, Homo sapiens
ggaagaaaggtggacaacaggt

SEQ ID NO: 86162 - DNA, 22 bp, Homo sapiens
tgagtagagaattcagctaagg

SEQ ID NO: 86163 - DNA, 22 bp, Homo sapiens
ttcccacattctttacattcat

SEQ ID NO: 86164 - DNA, 22 bp, Homo sapiens
tggaaacacccacgcatgcata

SEQ ID NO: 86165 - DNA, 22 bp, Homo sapiens
gcctggattccttgtttctcag

SEQ ID NO: 86166 - DNA, 22 bp, Homo sapiens
ccaggtaggagagtcaacatgt

SEQ ID NO: 86167 - DNA, 22 bp, Homo sapiens
ggcccaggctggagtgcagtgg

SEQ ID NO: 86168 - DNA, 22 bp, Homo sapiens
tgcactccaggctgggtgacag

SEQ ID NO: 86169 - DNA, 22 bp, Homo sapiens
gggccctgggattcagagcaag

SEQ ID NO: 86170 - DNA, 22 bp, Homo sapiens
ctgtaatcccagctactcggga

SEQ ID NO: 86171 - DNA, 22 bp, Homo sapiens
tgacagaggagctggaatgatt

SEQ ID NO: 86172 - DNA, 22 bp, Homo sapiens
cggggttcatccatgctgtggc

SEQ ID NO: 86173 - DNA, 22 bp, Homo sapiens
ttgtgctcctgtgagaatctag

SEQ ID NO: 86174 - DNA, 22 bp, Homo sapiens
gctcccaccgccgctatgggta

SEQ ID NO: 86175 - DNA, 22 bp, Homo sapiens
tagaagaaagtgaagctgggga

SEQ ID NO: 86176 - DNA, 22 bp, Homo sapiens
ttggaggcaatgggaaggaggc

SEQ ID NO: 86177 - DNA, 22 bp, Homo sapiens
cagggtttcaccatgttagcag

SEQ ID NO: 86178 - DNA, 22 bp, Homo sapiens
tctcgctgaagaagctgcacat

SEQ ID NO: 86179 - DNA, 22 bp, Homo sapiens
tggccttgagagatcaaaaggt

SEQ ID NO: 86180 - DNA, 22 bp, Homo sapiens
gaatgacgccctgtggtcactt

SEQ ID NO: 86181 - DNA, 22 bp, Homo sapiens
agagcacagccaccatttacaa

SEQ ID NO: 86182 - DNA, 22 bp, Homo sapiens
tagcagtgtctaggtaggccat

SEQ ID NO: 86183 - DNA, 22 bp, Homo sapiens
tactgtgtgcccagccgagctg

SEQ ID NO: 86184 - DNA, 22 bp, Homo sapiens
ctctgctgtgccgccagggcct

SEQ ID NO: 86185 - DNA, 22 bp, Homo sapiens
tcccacacagcccgctcaccgg

SEQ ID NO: 86186 - DNA, 21 bp, Homo sapiens
cgcagagcgaacttgcggcgc

SEQ ID NO: 86187 - DNA, 22 bp, Homo sapiens
tatactctgagaaacgtgtcac

SEQ ID NO: 86188 - DNA, 22 bp, Homo sapiens
ccaggaggcagaagttgcagtg

SEQ ID NO: 86189 - DNA, 22 bp, Homo sapiens
gtaatctcagctacttgggagg

SEQ ID NO: 86190 - DNA, 22 bp, Homo sapiens
tattctcatcatcactggagct

SEQ ID NO: 86191 - DNA, 22 bp, Homo sapiens
aggcaacttttggggatgatgg

SEQ ID NO: 86192 - DNA, 22 bp, Homo sapiens
ctgaggcaggagagttgcttga

SEQ ID NO: 86193 - DNA, 22 bp, Homo sapiens
ctgctcttgagggactgcggtc

SEQ ID NO: 86194 - DNA, 22 bp, Homo sapiens
gtatggcactatcctctctgat

SEQ ID NO: 86195 - DNA, 22 bp, Homo sapiens
gctggggaggcagcagagaaca

SEQ ID NO: 86196 - DNA, 17 bp, Homo sapiens
tggtccaggtggagcca

SEQ ID NO: 86197 - DNA, 23 bp, Homo sapiens
tgacctcatgatccgcccacctc

SEQ ID NO: 86198 - DNA, 22 bp, Homo sapiens
atgccactgcgctctagcctgg

SEQ ID NO: 86199 - DNA, 22 bp, Homo sapiens
gaatatcccgctatgcaaagta

SEQ ID NO: 86200 - DNA, 22 bp, Homo sapiens
gtagttctgcagtgtcacctga

SEQ ID NO: 86201 - DNA, 22 bp, Homo sapiens
tctcaagcttgttggtatgttt

SEQ ID NO: 86202 - DNA, 22 bp, Homo sapiens
gccttattacctgcactttgaa

SEQ ID NO: 86203 - DNA, 22 bp, Homo sapiens
ttaccaaatgaaatagagattt

SEQ ID NO: 86204 - DNA, 22 bp, Homo sapiens
ggagaagaggagctggaagcct

SEQ ID NO: 86205 - DNA, 22 bp, Homo sapiens
tgacatgtatatcttacgctat

SEQ ID NO: 86206 - DNA, 22 bp, Homo sapiens
agggctgcccagtgtgagagct

SEQ ID NO: 86207 - DNA, 22 bp, Homo sapiens
ccctcccaggagtggccagaga

SEQ ID NO: 86208 - DNA, 22 bp, Homo sapiens
tttgcttgttcaagatttctgt

SEQ ID NO: 86209 - DNA, 22 bp, Homo sapiens
ccaaagtgctgagattacaggt

SEQ ID NO: 86210 - DNA, 22 bp, Homo sapiens
ctggggaacgcagcgagcagcg

SEQ ID NO: 86211 - DNA, 22 bp, Homo sapiens
attgacctgattgttcctggaa

SEQ ID NO: 86212 - DNA, 22 bp, Homo sapiens
ctgctttagacggctttcgctg

SEQ ID NO: 86213 - DNA, 22 bp, Homo sapiens
tctctagtctcctttaacctga

SEQ ID NO: 86214 - DNA, 22 bp, Homo sapiens
cagagggttgatgtgaggctta

SEQ ID NO: 86215 - DNA, 22 bp, Homo sapiens
tagccgggtgtggtggaactcc

SEQ ID NO: 86216 - DNA, 22 bp, Homo sapiens
ggtaacttagctcatggctgtg

SEQ ID NO: 86217 - DNA, 22 bp, Homo sapiens
ttgagggtctggatctgctgct

SEQ ID NO: 86218 - DNA, 22 bp, Homo sapiens
cacccaggctggagagcagtgg

SEQ ID NO: 86219 - DNA, 22 bp, Homo sapiens
tagcataacaggtaagagtgag

SEQ ID NO: 86220 - DNA, 22 bp, Homo sapiens
gttgcagatgtggaactcgtgc

SEQ ID NO: 86221 - DNA, 22 bp, Homo sapiens
cctgcctatgagacgttttgcc

SEQ ID NO: 86222 - DNA, 22 bp, Homo sapiens
ccagcttgaagatgtgctggtt

SEQ ID NO: 86223 - DNA, 22 bp, Homo sapiens
gctcccaccttaaccttcacat

SEQ ID NO: 86224 - DNA, 22 bp, Homo sapiens
gatgccctggcctgtccccgca

SEQ ID NO: 86225 - DNA, 22 bp, Homo sapiens
gacggagctggttgctgcggct

SEQ ID NO: 86226 - DNA, 22 bp, Homo sapiens
gggccagtgaacaatgagggaa

SEQ ID NO: 86227 - DNA, 22 bp, Homo sapiens
ttaaatattatgttgtctgcaa

SEQ ID NO: 86228 - DNA, 22 bp, Homo sapiens
ccttgctcaagctagtgacggg

SEQ ID NO: 86229 - DNA, 22 bp, Homo sapiens
attataggcttgagccaccgtg

SEQ ID NO: 86230 - DNA, 22 bp, Homo sapiens
ggcagggcaggaaagtcaggaa

SEQ ID NO: 86231 - DNA, 22 bp, Homo sapiens
tacaaaaaattgatactgacga

SEQ ID NO: 86232 - DNA, 20 bp, Homo sapiens
catgtgtcagttctcaccca

SEQ ID NO: 86233 - DNA, 22 bp, Homo sapiens
ggagatatttgtattctgtctc

SEQ ID NO: 86234 - DNA, 22 bp, Homo sapiens
tctgctctgtggcttcagctaa

SEQ ID NO: 86235 - DNA, 22 bp, Homo sapiens
ggctcaatgcaacttctgcctc

SEQ ID NO: 86236 - DNA, 22 bp, Homo sapiens
tgctgtgaggttgagaaggaag

SEQ ID NO: 86237 - DNA, 22 bp, Homo sapiens
gtccaaaagagccagccgggcg

SEQ ID NO: 86238 - DNA, 22 bp, Homo sapiens
ggaggacaggggctgcagcaca

SEQ ID NO: 86239 - DNA, 22 bp, Homo sapiens
ctggcctaggaatggttttccg

SEQ ID NO: 86240 - DNA, 22 bp, Homo sapiens
gccaggttgctgacgacgatct

SEQ ID NO: 86241 - DNA, 22 bp, Homo sapiens
cgcaactcagcaacttaactgc

SEQ ID NO: 86242 - DNA, 22 bp, Homo sapiens
ttggcagattctgaacaaagcc

SEQ ID NO: 86243 - DNA, 22 bp, Homo sapiens
tggccttggccgtgctggggtc

SEQ ID NO: 86244 - DNA, 22 bp, Homo sapiens
tggatctcggcaatgcgggact

SEQ ID NO: 86245 - DNA, 22 bp, Homo sapiens
ccatcacagtccccatcgtgat

SEQ ID NO: 86246 - DNA, 22 bp, Homo sapiens
actaaagctcacagagttgaac

SEQ ID NO: 86247 - DNA, 22 bp, Homo sapiens
aaaagcaattgcgggttttgcc

SEQ ID NO: 86248 - DNA, 22 bp, Homo sapiens
tggtggctaccaggtcctgggg

SEQ ID NO: 86249 - DNA, 22 bp, Homo sapiens
gggaagtgatggagccaggatt

SEQ ID NO: 86250 - DNA, 22 bp, Homo sapiens
ctttaattgtagctcccataat

SEQ ID NO: 86251 - DNA, 23 bp, Homo sapiens
aaataggagtatctggatcatga

SEQ ID NO: 86252 - DNA, 22 bp, Homo sapiens
ggggctgaacctggaggtggtc

SEQ ID NO: 86253 - DNA, 19 bp, Homo sapiens
ttcagcattatattctagc

SEQ ID NO: 86254 - DNA, 22 bp, Homo sapiens
gccgtgcgtgcgcaggtgctgt

SEQ ID NO: 86255 - DNA, 22 bp, Homo sapiens
ctcactgcaagctctgcctccc

SEQ ID NO: 86256 - DNA, 22 bp, Homo sapiens
gttggggtgctataaaaatgat

SEQ ID NO: 86257 - DNA, 22 bp, Homo sapiens
gaggcctgggcaagggggtctg

SEQ ID NO: 86258 - DNA, 22 bp, Homo sapiens
gaggaggcttccgggaggcacg

SEQ ID NO: 86259 - DNA, 22 bp, Homo sapiens
ggccttggcctagccctccagg

SEQ ID NO: 86260 - DNA, 22 bp, Homo sapiens
caatttctaacattccatggat

SEQ ID NO: 86261 - DNA, 20 bp, Homo sapiens
gctgaggggtctatggcata

SEQ ID NO: 86262 - DNA, 21 bp, Homo sapiens
tcctgtaagcttgggtggctc

SEQ ID NO: 86263 - DNA, 22 bp, Homo sapiens
gttattgaggtggagtctcact

SEQ ID NO: 86264 - DNA, 22 bp, Homo sapiens
aggcaggaggatcatggatgca

SEQ ID NO: 86265 - DNA, 22 bp, Homo sapiens
ctcactgcaagctctgcctcca

SEQ ID NO: 86266 - DNA, 22 bp, Homo sapiens
tgccgtggggctgaggctggag

SEQ ID NO: 86267 - DNA, 22 bp, Homo sapiens
cacccaggctggagtgcagtgg

SEQ ID NO: 86268 - DNA, 23 bp, Homo sapiens
atgacactcctgtgcgcaccctg

SEQ ID NO: 86269 - DNA, 22 bp, Homo sapiens
ttgtgctcctatgagaatctaa

SEQ ID NO: 86270 - DNA, 22 bp, Homo sapiens
tcactgcaacctccacctcccg

SEQ ID NO: 86271 - DNA, 22 bp, Homo sapiens
acaggtcctcaagtcagctggg

SEQ ID NO: 86272 - DNA, 22 bp, Homo sapiens
agaggccggccgagcccatggg

SEQ ID NO: 86273 - DNA, 22 bp, Homo sapiens
ctggaggccactgtacagattg

SEQ ID NO: 86274 - DNA, 22 bp, Homo sapiens
ttctttcagaacacaagtgatt

SEQ ID NO: 86275 - DNA, 22 bp, Homo sapiens
ccaggaggtggaggttgcggtg

SEQ ID NO: 86276 - DNA, 22 bp, Homo sapiens
actgcactccaacctgggtgac

SEQ ID NO: 86277 - DNA, 22 bp, Homo sapiens
actgcactccagcctgggtaac

SEQ ID NO: 86278 - DNA, 22 bp, Homo sapiens
gaggccactgtccctgccttcc

SEQ ID NO: 86279 - DNA, 22 bp, Homo sapiens
agctggggctgtggttgtgatt

SEQ ID NO: 86280 - DNA, 16 bp, Homo sapiens
gcagaggaaaggggag

SEQ ID NO: 86281 - DNA, 22 bp, Homo sapiens
ctctggagtgtctggccagggt

SEQ ID NO: 86282 - DNA, 22 bp, Homo sapiens
tgctcgccccacatgccctcat

SEQ ID NO: 86283 - DNA, 22 bp, Homo sapiens
acagacaagtagttcagacaag

SEQ ID NO: 86284 - DNA, 22 bp, Homo sapiens
tagctgggactactggccctgc

SEQ ID NO: 86285 - DNA, 22 bp, Homo sapiens
gcgcactgggcgcacgcgtagg

SEQ ID NO: 86286 - DNA, 22 bp, Homo sapiens
gagacctcttggtatcgctagg

SEQ ID NO: 86287 - DNA, 22 bp, Homo sapiens
agcgctgtgggcgtgcgaggag

SEQ ID NO: 86288 - DNA, 22 bp, Homo sapiens
cacagagatggtctggcaggtg

SEQ ID NO: 86289 - DNA, 22 bp, Homo sapiens
gatggtgcaggtgaagtgctgg

SEQ ID NO: 86290 - DNA, 22 bp, Homo sapiens
tttgttttcaatgtgtcattca

SEQ ID NO: 86291 - DNA, 22 bp, Homo sapiens
ctggccagatgttacgtccaat

SEQ ID NO: 86292 - DNA, 22 bp, Homo sapiens
caggtgtcggtcaggcggtttt

SEQ ID NO: 86293 - DNA, 22 bp, Homo sapiens
tgcaatctcggcactttgggag

SEQ ID NO: 86294 - DNA, 22 bp, Homo sapiens
agaaaacataggagacaggaaa

SEQ ID NO: 86295 - DNA, 22 bp, Homo sapiens
ggagtgcggtggcaccatctca

SEQ ID NO: 86296 - DNA, 22 bp, Homo sapiens
ggggtcggggcatagccactta

SEQ ID NO: 86297 - DNA, 22 bp, Homo sapiens
catctgctgttccttggactca

SEQ ID NO: 86298 - DNA, 22 bp, Homo sapiens
cagtggctggttagggacagga

SEQ ID NO: 86299 - DNA, 22 bp, Homo sapiens
gctccgtgggcattgctaggtg

SEQ ID NO: 86300 - DNA, 22 bp, Homo sapiens
gtagggttggagagcacaacca

SEQ ID NO: 86301 - DNA, 22 bp, Homo sapiens
gagagagctctgtgcctgggat

SEQ ID NO: 86302 - DNA, 19 bp, Homo sapiens
gactccaactttaagcatg

SEQ ID NO: 86303 - DNA, 22 bp, Homo sapiens
cgcaggtgaaagaggctgggca

SEQ ID NO: 86304 - DNA, 22 bp, Homo sapiens
cagtgggtcctgcgtctgccag

SEQ ID NO: 86305 - DNA, 22 bp, Homo sapiens
cctgggaggctgaggctgcagt

SEQ ID NO: 86306 - DNA, 22 bp, Homo sapiens
cctggggtcacttgcagccgca

SEQ ID NO: 86307 - DNA, 22 bp, Homo sapiens
ctgcatccatgttgctgcaaag

SEQ ID NO: 86308 - DNA, 22 bp, Homo sapiens
gggttcagtccctcttgctact

SEQ ID NO: 86309 - DNA, 22 bp, Homo sapiens
cgcaccactgaattccagcctg

SEQ ID NO: 86310 - DNA, 22 bp, Homo sapiens
gggagctggagctggaagactc

SEQ ID NO: 86311 - DNA, 22 bp, Homo sapiens
tgtgacactggccatctgggtt

SEQ ID NO: 86312 - DNA, 22 bp, Homo sapiens
agaaggacccggtgggagatga

SEQ ID NO: 86313 - DNA, 22 bp, Homo sapiens
ggagaggcttccagagtcgtgc

SEQ ID NO: 86314 - DNA, 22 bp, Homo sapiens
gtgcacatcgtgcaggtttgtt

SEQ ID NO: 86315 - DNA, 22 bp, Homo sapiens
ccagggatgcagaggttgcagt

SEQ ID NO: 86316 - DNA, 22 bp, Homo sapiens
aggtggggaggagtgtctcttt

SEQ ID NO: 86317 - DNA, 22 bp, Homo sapiens
cgggcagtgtggctccagagtc

SEQ ID NO: 86318 - DNA, 22 bp, Homo sapiens
acagattcactgcactggccat

SEQ ID NO: 86319 - DNA, 22 bp, Homo sapiens
tggttcctcaagcgctggcggc

SEQ ID NO: 86320 - DNA, 22 bp, Homo sapiens
ggtggcctgttttcaggtttgc

SEQ ID NO: 86321 - DNA, 22 bp, Homo sapiens
tgtaagtagtaatggaaggaca

SEQ ID NO: 86322 - DNA, 22 bp, Homo sapiens
gggcagagactcagaaacagaa

SEQ ID NO: 86323 - DNA, 22 bp, Homo sapiens
gtgcagagaggaccttggggag

SEQ ID NO: 86324 - DNA, 22 bp, Homo sapiens
agagctaagaaacagaattgct

SEQ ID NO: 86325 - DNA, 22 bp, Homo sapiens
tgctgggggtagctctgcgtag

SEQ ID NO: 86326 - DNA, 22 bp, Homo sapiens
tgtagatattaattattccttt

SEQ ID NO: 86327 - DNA, 22 bp, Homo sapiens
cggctgggttcggctgcaggcc

SEQ ID NO: 86328 - DNA, 22 bp, Homo sapiens
ttatttaatgtgatctgaagag

SEQ ID NO: 86329 - DNA, 23 bp, Homo sapiens
ttgtcctctggatcggtttggtt

SEQ ID NO: 86330 - DNA, 22 bp, Homo sapiens
tcagtgatttctggggtgaggg

SEQ ID NO: 86331 - DNA, 22 bp, Homo sapiens
atacagggacatccagtttttc

SEQ ID NO: 86332 - DNA, 22 bp, Homo sapiens
ctgagggtcaacttgattgtat

SEQ ID NO: 86333 - DNA, 23 bp, Homo sapiens
ccagtgattgcctggaaggaggt

SEQ ID NO: 86334 - DNA, 22 bp, Homo sapiens
ttgcactccagcccgagcaaca

SEQ ID NO: 86335 - DNA, 22 bp, Homo sapiens
tctcccaggcaggagtgcagtg

SEQ ID NO: 86336 - DNA, 22 bp, Homo sapiens
atttgtgggactataatgcagg

SEQ ID NO: 86337 - DNA, 22 bp, Homo sapiens
gtcccctgtccagggccagcca

SEQ ID NO: 86338 - DNA, 22 bp, Homo sapiens
gctgctctcagagctcatgctg

SEQ ID NO: 86339 - DNA, 22 bp, Homo sapiens
tgcagattcaaatgaaatgcaa

SEQ ID NO: 86340 - DNA, 22 bp, Homo sapiens
cgtcacttcttagtctattttc

SEQ ID NO: 86341 - DNA, 21 bp, Homo sapiens
gggcagaggggcctcctgggt

SEQ ID NO: 86342 - DNA, 22 bp, Homo sapiens
ggcgggaagttcttgcccactt

SEQ ID NO: 86343 - DNA, 22 bp, Homo sapiens
caggcagggagctggaaaggat

SEQ ID NO: 86344 - DNA, 22 bp, Homo sapiens
agccagtgcagctggaaattca

SEQ ID NO: 86345 - DNA, 22 bp, Homo sapiens
ggaggcccagaaggaagcccag

SEQ ID NO: 86346 - DNA, 22 bp, Homo sapiens
cctagagctctgctttatctaa

SEQ ID NO: 86347 - DNA, 22 bp, Homo sapiens
gcagtatctatgtgatgggttg

SEQ ID NO: 86348 - DNA, 17 bp, Homo sapiens
tccttcagtgcctctgc

SEQ ID NO: 86349 - DNA, 22 bp, Homo sapiens
tcagaattgtggagaaagggga

SEQ ID NO: 86350 - DNA, 22 bp, Homo sapiens
gcaggtggatcaccacgtcagg

SEQ ID NO: 86351 - DNA, 22 bp, Homo sapiens
aaggaggcctggcagatgaaga

SEQ ID NO: 86352 - DNA, 22 bp, Homo sapiens
cacattggcaaacggggttgca

SEQ ID NO: 86353 - DNA, 22 bp, Homo sapiens
ctgggcagctgtatcagggagt

SEQ ID NO: 86354 - DNA, 22 bp, Homo sapiens
ggttggtaactccctgtgcagt

SEQ ID NO: 86355 - DNA, 22 bp, Homo sapiens
tctggtgtcagtattctttgaa

SEQ ID NO: 86356 - DNA, 22 bp, Homo sapiens
ctcctctttagccccagctgga

SEQ ID NO: 86357 - DNA, 22 bp, Homo sapiens
gtcatggtgctagcgggaatgt

SEQ ID NO: 86358 - DNA, 22 bp, Homo sapiens
cactctgcagctgaagggctgg

SEQ ID NO: 86359 - DNA, 22 bp, Homo sapiens
attaatgaaactttggttaagc

SEQ ID NO: 86360 - DNA, 22 bp, Homo sapiens
gccccagcctcccgagtagctg

SEQ ID NO: 86361 - DNA, 22 bp, Homo sapiens
actgcactccagcctgggtgat

SEQ ID NO: 86362 - DNA, 22 bp, Homo sapiens
ttgagcaggatggctatgcaca

SEQ ID NO: 86363 - DNA, 22 bp, Homo sapiens
ccagtgtgcaatctctggctta

SEQ ID NO: 86364 - DNA, 20 bp, Homo sapiens
ataaaataactgccacaaga

SEQ ID NO: 86365 - DNA, 22 bp, Homo sapiens
tacaccattcccaggtggattt

SEQ ID NO: 86366 - DNA, 22 bp, Homo sapiens
cgccaggcttggtagctcatgc

SEQ ID NO: 86367 - DNA, 22 bp, Homo sapiens
gaagccttgaactgcaaacccc

SEQ ID NO: 86368 - DNA, 22 bp, Homo sapiens
tccagggagagccgctgctcca

SEQ ID NO: 86369 - DNA, 22 bp, Homo sapiens
tgggcaggggccctgcttccgt

SEQ ID NO: 86370 - DNA, 22 bp, Homo sapiens
gaccctctagatggaagcactg

SEQ ID NO: 86371 - DNA, 22 bp, Homo sapiens
tgcctaggctggagtgtagtgg

SEQ ID NO: 86372 - DNA, 22 bp, Homo sapiens
ggccctggtcctaggggtggaa

SEQ ID NO: 86373 - DNA, 22 bp, Homo sapiens
ttgtcgggcttacgcagggcca

SEQ ID NO: 86374 - DNA, 20 bp, Homo sapiens
gggaagtcccgcctgtcttc

SEQ ID NO: 86375 - DNA, 22 bp, Homo sapiens
tggaatggaaacaaactgagga

SEQ ID NO: 86376 - DNA, 22 bp, Homo sapiens
tggtatgtaaattgtaactcaa

SEQ ID NO: 86377 - DNA, 19 bp, Homo sapiens
gctgaggtggaggaaggag

SEQ ID NO: 86378 - DNA, 22 bp, Homo sapiens
ccctcccagatgggcttgaggt

SEQ ID NO: 86379 - DNA, 22 bp, Homo sapiens
cagagactggagtgcagtggcg

SEQ ID NO: 86380 - DNA, 22 bp, Homo sapiens
tcttctatcctcagcccctgcc

SEQ ID NO: 86381 - DNA, 22 bp, Homo sapiens
attcacagggggagaagggtat

SEQ ID NO: 86382 - DNA, 22 bp, Homo sapiens
atatgcagtctcttgcccttct

SEQ ID NO: 86383 - DNA, 22 bp, Homo sapiens
ttatttgtggcatatgagacga

SEQ ID NO: 86384 - DNA, 22 bp, Homo sapiens
agggccagcactcctggcagga

SEQ ID NO: 86385 - DNA, 21 bp, Homo sapiens
tgactgaggcttcttcacaca

SEQ ID NO: 86386 - DNA, 22 bp, Homo sapiens
actgcacttcagcctgggtgtc

SEQ ID NO: 86387 - DNA, 22 bp, Homo sapiens
ctccaggccatggctgcggagg

SEQ ID NO: 86388 - DNA, 22 bp, Homo sapiens
ccaggaggtggagattgcagtg

SEQ ID NO: 86389 - DNA, 22 bp, Homo sapiens
gcagcctcaaactccccagctc

SEQ ID NO: 86390 - DNA, 22 bp, Homo sapiens
gcccagtggtaaaagcaggcct

SEQ ID NO: 86391 - DNA, 22 bp, Homo sapiens
cggaggttgaggctgcagtgag

SEQ ID NO: 86392 - DNA, 22 bp, Homo sapiens
cagggccagggacacgctgtca

SEQ ID NO: 86393 - DNA, 19 bp, Homo sapiens
agagtattgaatttgccct

SEQ ID NO: 86394 - DNA, 22 bp, Homo sapiens
ctgctcttcacactacacccgt

SEQ ID NO: 86395 - DNA, 22 bp, Homo sapiens
gctcactgcaacctccacctcc

SEQ ID NO: 86396 - DNA, 22 bp, Homo sapiens
gctggaggatggactggaagaa

SEQ ID NO: 86397 - DNA, 22 bp, Homo sapiens
ggtccccgtggaggctggagcg

SEQ ID NO: 86398 - DNA, 22 bp, Homo sapiens
tacttttctataggtttgaaat

SEQ ID NO: 86399 - DNA, 22 bp, Homo sapiens
ccaaagtgctggggttacaggc

SEQ ID NO: 86400 - DNA, 22 bp, Homo sapiens
tgggcagggagctggaaccaca

SEQ ID NO: 86401 - DNA, 22 bp, Homo sapiens
cactgcactccagcctgggtga

SEQ ID NO: 86402 - DNA, 22 bp, Homo sapiens
ctcactgcaacctctgcctccc

SEQ ID NO: 86403 - DNA, 22 bp, Homo sapiens
caaagtgctaggattacaggcg

SEQ ID NO: 86404 - DNA, 22 bp, Homo sapiens
ctacaaaagtaattgtggtttt

SEQ ID NO: 86405 - DNA, 22 bp, Homo sapiens
cactgcccaccaagtggctggt

SEQ ID NO: 86406 - DNA, 22 bp, Homo sapiens
tgaggcactccaggatgctgtt

SEQ ID NO: 86407 - DNA, 22 bp, Homo sapiens
ggtgttgcagttgaagactggt

SEQ ID NO: 86408 - DNA, 22 bp, Homo sapiens
gtctatatattgcttgaataat

SEQ ID NO: 86409 - DNA, 22 bp, Homo sapiens
ttccagctaactcacatccctt

SEQ ID NO: 86410 - DNA, 22 bp, Homo sapiens
catttacatttaaggttaatat

SEQ ID NO: 86411 - DNA, 22 bp, Homo sapiens
atgttggagtcgtaaggcatgg

SEQ ID NO: 86412 - DNA, 22 bp, Homo sapiens
cttcttgctgggggcctcagtg

SEQ ID NO: 86413 - DNA, 22 bp, Homo sapiens
tcgtggatcaccgcgtctgtgt

SEQ ID NO: 86414 - DNA, 22 bp, Homo sapiens
ctgggaggcagaggttgcagtg

SEQ ID NO: 86415 - DNA, 22 bp, Homo sapiens
actggacagaggaaatatggag

SEQ ID NO: 86416 - DNA, 22 bp, Homo sapiens
atttttctctttccactgagat

SEQ ID NO: 86417 - DNA, 22 bp, Homo sapiens
ttaataaagtatgaattggaaa

SEQ ID NO: 86418 - DNA, 22 bp, Homo sapiens
ccaaagtgctgggattacaggc

SEQ ID NO: 86419 - DNA, 22 bp, Homo sapiens
attgtggtgtcagttataggca

SEQ ID NO: 86420 - DNA, 22 bp, Homo sapiens
tgtcctcatcctccagtctgtc

SEQ ID NO: 86421 - DNA, 22 bp, Homo sapiens
actggggtttaggcctgggcaa

SEQ ID NO: 86422 - DNA, 22 bp, Homo sapiens
tcctgccttgcctgggacatca

SEQ ID NO: 86423 - DNA, 22 bp, Homo sapiens
atgaggcaggagtgcagtggca

SEQ ID NO: 86424 - DNA, 22 bp, Homo sapiens
catggggcccatgtgctccaag

SEQ ID NO: 86425 - DNA, 22 bp, Homo sapiens
tcactgcaacctccacctcctg

SEQ ID NO: 86426 - DNA, 22 bp, Homo sapiens
tgttgcccaggttctctcctgc

SEQ ID NO: 86427 - DNA, 22 bp, Homo sapiens
ccacgacgagtcatcagggcga

SEQ ID NO: 86428 - DNA, 22 bp, Homo sapiens
agagtggctctgctgggcacag

SEQ ID NO: 86429 - DNA, 22 bp, Homo sapiens
tgattcatcagaataggagttt

SEQ ID NO: 86430 - DNA, 22 bp, Homo sapiens
atctggttttggctgtgtccct

SEQ ID NO: 86431 - DNA, 22 bp, Homo sapiens
tatctcattttattgcaaatgt

SEQ ID NO: 86432 - DNA, 22 bp, Homo sapiens
tgcacgtgggctctctgctctt

SEQ ID NO: 86433 - DNA, 22 bp, Homo sapiens
tctagctctgcttatcatggct

SEQ ID NO: 86434 - DNA, 22 bp, Homo sapiens
gtagcccacctggggagggcga

SEQ ID NO: 86435 - DNA, 22 bp, Homo sapiens
tgcgatggcgtagacaaatccc

SEQ ID NO: 86436 - DNA, 22 bp, Homo sapiens
tccaagatctacagcagtttag

SEQ ID NO: 86437 - DNA, 22 bp, Homo sapiens
gcaggaggttgagccaggactg

SEQ ID NO: 86438 - DNA, 22 bp, Homo sapiens
ggcaggaggtgagtggcgggtg

SEQ ID NO: 86439 - DNA, 22 bp, Homo sapiens
tcccggcgctgggaggtgggtc

SEQ ID NO: 86440 - DNA, 22 bp, Homo sapiens
tgggtgctctgcgaccgtaggg

SEQ ID NO: 86441 - DNA, 22 bp, Homo sapiens
atgccacttcattccagcctcg

SEQ ID NO: 86442 - DNA, 22 bp, Homo sapiens
atagaatatgacttttagatcc

SEQ ID NO: 86443 - DNA, 22 bp, Homo sapiens
tctcgctctgtcgcccaggctg

SEQ ID NO: 86444 - DNA, 22 bp, Homo sapiens
agtgagagtattaatgtgaact

SEQ ID NO: 86445 - DNA, 22 bp, Homo sapiens
atacaaaaattagccgggagta

SEQ ID NO: 86446 - DNA, 22 bp, Homo sapiens
atgccactgcgctccagcctgg

SEQ ID NO: 86447 - DNA, 16 bp, Homo sapiens
aggctcagaggctgga

SEQ ID NO: 86448 - DNA, 22 bp, Homo sapiens
cactgcacttcagcctgggtga

SEQ ID NO: 86449 - DNA, 20 bp, Homo sapiens
gggcagagccagccagtccc

SEQ ID NO: 86450 - DNA, 22 bp, Homo sapiens
ggctgtggcagctggaagtggt

SEQ ID NO: 86451 - DNA, 22 bp, Homo sapiens
agacaaagaaaccgtagaagca

SEQ ID NO: 86452 - DNA, 22 bp, Homo sapiens
atgtttaaagggttgagaaata

SEQ ID NO: 86453 - DNA, 22 bp, Homo sapiens
tgtctggtgggttgacaggcag

SEQ ID NO: 86454 - DNA, 22 bp, Homo sapiens
tctggacaggggcgctttgggg

SEQ ID NO: 86455 - DNA, 22 bp, Homo sapiens
atagggcctaaaaagtattgct

SEQ ID NO: 86456 - DNA, 22 bp, Homo sapiens
cgtggggcgggtggacacttgc

SEQ ID NO: 86457 - DNA, 22 bp, Homo sapiens
tggagataggctgaggcagggc

SEQ ID NO: 86458 - DNA, 22 bp, Homo sapiens
gcccccgtagtagatgaggcgc

SEQ ID NO: 86459 - DNA, 22 bp, Homo sapiens
ataatacatggttgatcttttc

SEQ ID NO: 86460 - DNA, 22 bp, Homo sapiens
ctgggttggggttacatgactg

SEQ ID NO: 86461 - DNA, 22 bp, Homo sapiens
ctggagggctgcagcgaggctg

SEQ ID NO: 86462 - DNA, 22 bp, Homo sapiens
tttgaggttagctagcagatca

SEQ ID NO: 86463 - DNA, 22 bp, Homo sapiens
gacaggtgctaagggacctggc

SEQ ID NO: 86464 - DNA, 22 bp, Homo sapiens
taggctaggctgaaggttttgg

SEQ ID NO: 86465 - DNA, 22 bp, Homo sapiens
acaaacagagttgaaaaatagg

SEQ ID NO: 86466 - DNA, 23 bp, Homo sapiens
gcagaggagcaagctggacacca

SEQ ID NO: 86467 - DNA, 22 bp, Homo sapiens
cgcagggccgcgagcgggacca

SEQ ID NO: 86468 - DNA, 22 bp, Homo sapiens
agctgattccactttttcccca

SEQ ID NO: 86469 - DNA, 22 bp, Homo sapiens
agggctggagccacagctggga

SEQ ID NO: 86470 - DNA, 20 bp, Homo sapiens
tgaggcccagcagagtcggg

SEQ ID NO: 86471 - DNA, 22 bp, Homo sapiens
gctgcagggagctggaaggctc

SEQ ID NO: 86472 - DNA, 22 bp, Homo sapiens
tggggagtgatgcctcggataa

SEQ ID NO: 86473 - DNA, 22 bp, Homo sapiens
gctgcgccggatcccacgttcc

SEQ ID NO: 86474 - DNA, 22 bp, Homo sapiens
caaccccactacacgttggaga

SEQ ID NO: 86475 - DNA, 22 bp, Homo sapiens
ctccaggctcgtccaagatcga

SEQ ID NO: 86476 - DNA, 22 bp, Homo sapiens
ttcaggaagtgctgcctggtgt

SEQ ID NO: 86477 - DNA, 22 bp, Homo sapiens
gagaggtggaggttgcagtgag

SEQ ID NO: 86478 - DNA, 22 bp, Homo sapiens
ttgaggcaggtccgggtccttc

SEQ ID NO: 86479 - DNA, 22 bp, Homo sapiens
ggatgttctggggttctcttgt

SEQ ID NO: 86480 - DNA, 22 bp, Homo sapiens
tgccaggcgtggtggtgcgcac

SEQ ID NO: 86481 - DNA, 22 bp, Homo sapiens
atgctatgtaactggcagatag

SEQ ID NO: 86482 - DNA, 22 bp, Homo sapiens
acgcctgtaatcccagcacttt

SEQ ID NO: 86483 - DNA, 22 bp, Homo sapiens
ggtcacgtgaccgcacctgcct

SEQ ID NO: 86484 - DNA, 22 bp, Homo sapiens
gctaagggataggctgcctcct

SEQ ID NO: 86485 - DNA, 22 bp, Homo sapiens
cagtctctaaatcaatctgaat

SEQ ID NO: 86486 - DNA, 18 bp, Homo sapiens
cagggctgtggggtcact

SEQ ID NO: 86487 - DNA, 22 bp, Homo sapiens
ccccagtggaggtgagggtcct

SEQ ID NO: 86488 - DNA, 22 bp, Homo sapiens
cctgccagagcagcttgtcctc

SEQ ID NO: 86489 - DNA, 22 bp, Homo sapiens
gtgggctgcccttgaggtcagc

SEQ ID NO: 86490 - DNA, 22 bp, Homo sapiens
accatgttggccaagctggtct

SEQ ID NO: 86491 - DNA, 22 bp, Homo sapiens
gctgctaagcgtttctgttcca

SEQ ID NO: 86492 - DNA, 22 bp, Homo sapiens
ccaaagtgctaggattacaggc

SEQ ID NO: 86493 - DNA, 22 bp, Homo sapiens
ttggaacatgccggggtccagg

SEQ ID NO: 86494 - DNA, 21 bp, Homo sapiens
tcacgtggtcacatgagcttt

SEQ ID NO: 86495 - DNA, 22 bp, Homo sapiens
ctcattgcccagatccccacag

SEQ ID NO: 86496 - DNA, 22 bp, Homo sapiens
tgggactcactcttttggccag

SEQ ID NO: 86497 - DNA, 22 bp, Homo sapiens
agcccaggttgaggctgcagtg

SEQ ID NO: 86498 - DNA, 22 bp, Homo sapiens
ggagagcttggagtgcgatttt

SEQ ID NO: 86499 - DNA, 22 bp, Homo sapiens
cacccaggcaaggattctgcaa

SEQ ID NO: 86500 - DNA, 22 bp, Homo sapiens
tgtagtagcattcacgaagtgt

SEQ ID NO: 86501 - DNA, 20 bp, Homo sapiens
aaattactgccacacatttc

SEQ ID NO: 86502 - DNA, 22 bp, Homo sapiens
cacagctgaagtagccatgtgg

SEQ ID NO: 86503 - DNA, 22 bp, Homo sapiens
tgcgttgcgctcctgcagcagg

SEQ ID NO: 86504 - DNA, 22 bp, Homo sapiens
gagctcatccccatggtccgtc

SEQ ID NO: 86505 - DNA, 22 bp, Homo sapiens
tcgtggatgcgcagggcggcct

SEQ ID NO: 86506 - DNA, 22 bp, Homo sapiens
cgcgaggtggaggttgcagtga

SEQ ID NO: 86507 - DNA, 22 bp, Homo sapiens
gaactttgcgcagttcccgggg

SEQ ID NO: 86508 - DNA, 22 bp, Homo sapiens
cccccaaagtttgcacggataa

SEQ ID NO: 86509 - DNA, 22 bp, Homo sapiens
gcagaggacacaggagggcaag

SEQ ID NO: 86510 - DNA, 22 bp, Homo sapiens
ctgggaggcggaggttgcagtg

SEQ ID NO: 86511 - DNA, 22 bp, Homo sapiens
gggctgggattgcttgctgtga

SEQ ID NO: 86512 - DNA, 22 bp, Homo sapiens
ctactttaacatggaggcactt

SEQ ID NO: 86513 - DNA, 22 bp, Homo sapiens
tgctagtgtgtgagatgttcaa

SEQ ID NO: 86514 - DNA, 22 bp, Homo sapiens
ttccatttggcacttcactgag

SEQ ID NO: 86515 - DNA, 22 bp, Homo sapiens
gggctgagacgatggggtcttc

SEQ ID NO: 86516 - DNA, 22 bp, Homo sapiens
tggaaagaaagtaaaggcgtat

SEQ ID NO: 86517 - DNA, 18 bp, Homo sapiens
taggttacagccagccag

SEQ ID NO: 86518 - DNA, 22 bp, Homo sapiens
cgggcaaggcgagactaggccc

SEQ ID NO: 86519 - DNA, 22 bp, Homo sapiens
aactcactttgtggcttctgaa

SEQ ID NO: 86520 - DNA, 22 bp, Homo sapiens
actgcactccagcctcggggtc

SEQ ID NO: 86521 - DNA, 22 bp, Homo sapiens
gtctatgatattttgttatagc

SEQ ID NO: 86522 - DNA, 22 bp, Homo sapiens
ttgatcaaatcagctactgagg

SEQ ID NO: 86523 - DNA, 22 bp, Homo sapiens
ggacagaaaccatatgagtgta

SEQ ID NO: 86524 - DNA, 22 bp, Homo sapiens
cacagacagtgtccctttgttg

SEQ ID NO: 86525 - DNA, 22 bp, Homo sapiens
caggtggtcaggcaaggacacg

SEQ ID NO: 86526 - DNA, 22 bp, Homo sapiens
cacggtggcccacaggtgcaag

SEQ ID NO: 86527 - DNA, 17 bp, Homo sapiens
cttcccaccatctcctg

SEQ ID NO: 86528 - DNA, 22 bp, Homo sapiens
ggccctgggccctctagcttgt

SEQ ID NO: 86529 - DNA, 22 bp, Homo sapiens
atgccactgcacttcagcttgg

SEQ ID NO: 86530 - DNA, 22 bp, Homo sapiens
atggccaggcacctctggctga

SEQ ID NO: 86531 - DNA, 22 bp, Homo sapiens
tcccagagctctggaggttgga

SEQ ID NO: 86532 - DNA, 22 bp, Homo sapiens
tgagacgaagtcttgctctgtt

SEQ ID NO: 86533 - DNA, 22 bp, Homo sapiens
acgcagtttgtggacatttttt

SEQ ID NO: 86534 - DNA, 23 bp, Homo sapiens
aaacttgctatggctgaaatcat

SEQ ID NO: 86535 - DNA, 22 bp, Homo sapiens
tcaccgaggctggagtgcagtg

SEQ ID NO: 86536 - DNA, 22 bp, Homo sapiens
gttatataagacaaatcagagt

SEQ ID NO: 86537 - DNA, 22 bp, Homo sapiens
cgccccggacgtctgaccaaac

SEQ ID NO: 86538 - DNA, 22 bp, Homo sapiens
gggcggggggagctggaatgaa

SEQ ID NO: 86539 - DNA, 22 bp, Homo sapiens
tcaaatgaagacagttgacttg

SEQ ID NO: 86540 - DNA, 22 bp, Homo sapiens
aggtggagaagagatgggcagt

SEQ ID NO: 86541 - DNA, 22 bp, Homo sapiens
cactgcactccagcccgggcaa

SEQ ID NO: 86542 - DNA, 22 bp, Homo sapiens
ctcggcaggtggaggttgtagt

SEQ ID NO: 86543 - DNA, 22 bp, Homo sapiens
ggattgcaacaagctagtttag

SEQ ID NO: 86544 - DNA, 22 bp, Homo sapiens
tctgctttcttactaaaaatga

SEQ ID NO: 86545 - DNA, 21 bp, Homo sapiens
ggccagtggaattttatgtca

SEQ ID NO: 86546 - DNA, 23 bp, Homo sapiens
aggatgtaggatgtatggcagag

SEQ ID NO: 86547 - DNA, 22 bp, Homo sapiens
ttttctaacatctagtaatttg

SEQ ID NO: 86548 - DNA, 22 bp, Homo sapiens
ttccacattccttacattcata

SEQ ID NO: 86549 - DNA, 22 bp, Homo sapiens
tctgtagtaggttgtagttctt

SEQ ID NO: 86550 - DNA, 22 bp, Homo sapiens
aggacaaaggaccagatctgga

SEQ ID NO: 86551 - DNA, 22 bp, Homo sapiens
ttcttcagcctaccttgacctc

SEQ ID NO: 86552 - DNA, 22 bp, Homo sapiens
cctactctgagcgcctccgcat

SEQ ID NO: 86553 - DNA, 22 bp, Homo sapiens
aggctatttccactcttctcat

SEQ ID NO: 86554 - DNA, 22 bp, Homo sapiens
gcctgtgtggatgcgccggtgc

SEQ ID NO: 86555 - DNA, 22 bp, Homo sapiens
gggacgacaggctctgtggtag

SEQ ID NO: 86556 - DNA, 22 bp, Homo sapiens
taacaatacccattctaattac

SEQ ID NO: 86557 - DNA, 22 bp, Homo sapiens
agtcttagaactacagtgccta

SEQ ID NO: 86558 - DNA, 22 bp, Homo sapiens
tctgctggaaaaccagggaatt

SEQ ID NO: 86559 - DNA, 22 bp, Homo sapiens
tcctggcttgtcacatctacgt

SEQ ID NO: 86560 - DNA, 22 bp, Homo sapiens
agaggctgcacttgctcatgat

SEQ ID NO: 86561 - DNA, 22 bp, Homo sapiens
cctcgacctccccaggctcagg

SEQ ID NO: 86562 - DNA, 22 bp, Homo sapiens
actttatttcctattgcatcca

SEQ ID NO: 86563 - DNA, 22 bp, Homo sapiens
agcatggccatctgggccgtcc

SEQ ID NO: 86564 - DNA, 22 bp, Homo sapiens
caggccagggttgagaagagaa

SEQ ID NO: 86565 - DNA, 22 bp, Homo sapiens
aagtcgtggcaggcttgcacga

SEQ ID NO: 86566 - DNA, 22 bp, Homo sapiens
gagagaagggggatatgagcct

SEQ ID NO: 86567 - DNA, 22 bp, Homo sapiens
acacagagccaaaccatatcac

SEQ ID NO: 86568 - DNA, 22 bp, Homo sapiens
ctctctgggcccagttggcacc

SEQ ID NO: 86569 - DNA, 22 bp, Homo sapiens
ggctgcaggttggttggcagct

SEQ ID NO: 86570 - DNA, 22 bp, Homo sapiens
gagctgggcctgcgagtgctgc

SEQ ID NO: 86571 - DNA, 22 bp, Homo sapiens
cttctcggccgtgtggatgcgc

SEQ ID NO: 86572 - DNA, 22 bp, Homo sapiens
caaagtgctgggattacaggct

SEQ ID NO: 86573 - DNA, 22 bp, Homo sapiens
cccaggaggtcgaagctgcagt

SEQ ID NO: 86574 - DNA, 22 bp, Homo sapiens
tgggaagaggagcactggaatg

SEQ ID NO: 86575 - DNA, 22 bp, Homo sapiens
catgctgggtaaaggtggtgaa

SEQ ID NO: 86576 - DNA, 22 bp, Homo sapiens
tgggttagattccgcgaagcag

SEQ ID NO: 86577 - DNA, 22 bp, Homo sapiens
agtgcaggccccaggccaggcc

SEQ ID NO: 86578 - DNA, 22 bp, Homo sapiens
ggcaaggggtcaggctgagaca

SEQ ID NO: 86579 - DNA, 22 bp, Homo sapiens
atgaccagccgagataaacaga

SEQ ID NO: 86580 - DNA, 22 bp, Homo sapiens
ggggtctgggcttagctggaat

SEQ ID NO: 86581 - DNA, 22 bp, Homo sapiens
aggcgcctgcgggatccttgcc

SEQ ID NO: 86582 - DNA, 20 bp, Homo sapiens
gggcagtggcgctatctcag

SEQ ID NO: 86583 - DNA, 22 bp, Homo sapiens
tcaggaggtccgcccgggaggg

SEQ ID NO: 86584 - DNA, 22 bp, Homo sapiens
tcacaacgcctctgcaaatcct

SEQ ID NO: 86585 - DNA, 22 bp, Homo sapiens
cccatgcaccctctaagaagga

SEQ ID NO: 86586 - DNA, 22 bp, Homo sapiens
gcagctggaagtgacactctgt

SEQ ID NO: 86587 - DNA, 22 bp, Homo sapiens
aggctagaggcttctggcttca

SEQ ID NO: 86588 - DNA, 22 bp, Homo sapiens
ctctgtggtggagtgggtcacc

SEQ ID NO: 86589 - DNA, 22 bp, Homo sapiens
tgtgtgagtaaggctgagagag

SEQ ID NO: 86590 - DNA, 21 bp, Homo sapiens
aaactgaccttgcctgagaca

SEQ ID NO: 86591 - DNA, 21 bp, Homo sapiens
cactccacttagaacagggtt

SEQ ID NO: 86592 - DNA, 22 bp, Homo sapiens
atgcagtggcttcagtgtcagt

SEQ ID NO: 86593 - DNA, 22 bp, Homo sapiens
gctgggctgcgtcggggaagcc

SEQ ID NO: 86594 - DNA, 22 bp, Homo sapiens
tggagaattctatgttgagggg

SEQ ID NO: 86595 - DNA, 22 bp, Homo sapiens
tcgcaccattgcactccagcca

SEQ ID NO: 86596 - DNA, 22 bp, Homo sapiens
gcccagccacagtcactttcat

SEQ ID NO: 86597 - DNA, 22 bp, Homo sapiens
tcttgggcatgtgtttgatttc

SEQ ID NO: 86598 - DNA, 22 bp, Homo sapiens
gtgggggcaggcagtgctagga

SEQ ID NO: 86599 - DNA, 22 bp, Homo sapiens
tgcgggttggtggcatatgcag

SEQ ID NO: 86600 - DNA, 22 bp, Homo sapiens
catgcctgtaatcccagcactt

SEQ ID NO: 86601 - DNA, 22 bp, Homo sapiens
ggccgtgctccaaagtcatcgt

SEQ ID NO: 86602 - DNA, 22 bp, Homo sapiens
catgagatttgggaggggccag

SEQ ID NO: 86603 - DNA, 22 bp, Homo sapiens
actgcaacacctcctgggttca

SEQ ID NO: 86604 - DNA, 22 bp, Homo sapiens
cgctgataaacgtcacgttccc

SEQ ID NO: 86605 - DNA, 22 bp, Homo sapiens
tgggaagctgcattttaacaag

SEQ ID NO: 86606 - DNA, 22 bp, Homo sapiens
tgttcttgagcctttagaccta

SEQ ID NO: 86607 - DNA, 22 bp, Homo sapiens
gcagtggggcaatcatagctca

SEQ ID NO: 86608 - DNA, 22 bp, Homo sapiens
agttggcactgagctgtgattg

SEQ ID NO: 86609 - DNA, 22 bp, Homo sapiens
aagtctctcacatatctggtcc

SEQ ID NO: 86610 - DNA, 22 bp, Homo sapiens
acgtgcaggatctggttggcga

SEQ ID NO: 86611 - DNA, 22 bp, Homo sapiens
gggtaaatctcttttcatggct

SEQ ID NO: 86612 - DNA, 22 bp, Homo sapiens
gagatgggcgagaaggtggact

SEQ ID NO: 86613 - DNA, 22 bp, Homo sapiens
tatctatgtgctctgacctctc

SEQ ID NO: 86614 - DNA, 22 bp, Homo sapiens
ctcaggagttggaggctacagt

SEQ ID NO: 86615 - DNA, 22 bp, Homo sapiens
gtgtgtcccttggaacctcagc

SEQ ID NO: 86616 - DNA, 22 bp, Homo sapiens
ttatgatttgccacagattggt

SEQ ID NO: 86617 - DNA, 22 bp, Homo sapiens
tgtggacgtcattaaagcagtg

SEQ ID NO: 86618 - DNA, 22 bp, Homo sapiens
cggctggtgtcgggcacagcaa

SEQ ID NO: 86619 - DNA, 22 bp, Homo sapiens
ttctatttttgtggaactgtag

SEQ ID NO: 86620 - DNA, 22 bp, Homo sapiens
tgtgtcccttggaacctcagct

SEQ ID NO: 86621 - DNA, 22 bp, Homo sapiens
aacttaggaaaataaggcatga

SEQ ID NO: 86622 - DNA, 16 bp, Homo sapiens
atgctgctattagagg

SEQ ID NO: 86623 - DNA, 23 bp, Homo sapiens
gtgtgttcccggagtagctcccg

SEQ ID NO: 86624 - DNA, 19 bp, Homo sapiens
catctggatgattctcctg

SEQ ID NO: 86625 - DNA, 22 bp, Homo sapiens
taaagggtaggttttactgtaa

SEQ ID NO: 86626 - DNA, 22 bp, Homo sapiens
tacttttagcctatttgattct

SEQ ID NO: 86627 - DNA, 22 bp, Homo sapiens
cactgcaacctccacctcctgg

SEQ ID NO: 86628 - DNA, 20 bp, Homo sapiens
agcagagtgcccatcccgga

SEQ ID NO: 86629 - DNA, 22 bp, Homo sapiens
gcaagacctatctagttgctgt

SEQ ID NO: 86630 - DNA, 22 bp, Homo sapiens
cgcccaggctggagtgcagtgg

SEQ ID NO: 86631 - DNA, 19 bp, Homo sapiens
ttgacgttgtggaattaac

SEQ ID NO: 86632 - DNA, 22 bp, Homo sapiens
ggagctcctggcagtgacagag

SEQ ID NO: 86633 - DNA, 22 bp, Homo sapiens
acagagcaataacagggagagg

SEQ ID NO: 86634 - DNA, 22 bp, Homo sapiens
actgcaacctccacctcctggg

SEQ ID NO: 86635 - DNA, 22 bp, Homo sapiens
catccaggctgaagtgcagtgg

SEQ ID NO: 86636 - DNA, 22 bp, Homo sapiens
agatggtagactatggaacgta

SEQ ID NO: 86637 - DNA, 22 bp, Homo sapiens
ggactgggaatcagggagatgc

SEQ ID NO: 86638 - DNA, 22 bp, Homo sapiens
tgcctgatgcaggagtatcaga

SEQ ID NO: 86639 - DNA, 22 bp, Homo sapiens
acggtgctgggtattggggttc

SEQ ID NO: 86640 - DNA, 22 bp, Homo sapiens
ttaatgaaaggcagtttggaac

SEQ ID NO: 86641 - DNA, 22 bp, Homo sapiens
ggctgagttgagaggattactt

SEQ ID NO: 86642 - DNA, 22 bp, Homo sapiens
tgagccaggagtttgaggctgt

SEQ ID NO: 86643 - DNA, 20 bp, Homo sapiens
gctctgtggtttgagtctcc

SEQ ID NO: 86644 - DNA, 22 bp, Homo sapiens
aacccgggaggcggaggttgtg

SEQ ID NO: 86645 - DNA, 20 bp, Homo sapiens
tggcctctgagatgccacgg

SEQ ID NO: 86646 - DNA, 22 bp, Homo sapiens
cctggcaggtggcgccctcggc

SEQ ID NO: 86647 - DNA, 22 bp, Homo sapiens
cgagagttagctaggagtcaca

SEQ ID NO: 86648 - DNA, 22 bp, Homo sapiens
ttttaatactgctattgtagga

SEQ ID NO: 86649 - DNA, 22 bp, Homo sapiens
actgcactccagcctgggtgac

SEQ ID NO: 86650 - DNA, 22 bp, Homo sapiens
tcgaatggcaaggaaagaggct

SEQ ID NO: 86651 - DNA, 22 bp, Homo sapiens
tgctcttcacagtttcagcatc

SEQ ID NO: 86652 - DNA, 22 bp, Homo sapiens
tgcaccctcatcagtcaaatgg

SEQ ID NO: 86653 - DNA, 22 bp, Homo sapiens
gagtcgagcagaaagccgtcgg

SEQ ID NO: 86654 - DNA, 22 bp, Homo sapiens
agcccaggctggagtgcagtgg

SEQ ID NO: 86655 - DNA, 22 bp, Homo sapiens
ggccttggagtcagccttgagc

SEQ ID NO: 86656 - DNA, 22 bp, Homo sapiens
ggctctgcgcctgcggggactt

SEQ ID NO: 86657 - DNA, 22 bp, Homo sapiens
gggcaggggtcagtggccccaa

SEQ ID NO: 86658 - DNA, 19 bp, Homo sapiens
ccagagagctaggtacaga

SEQ ID NO: 86659 - DNA, 22 bp, Homo sapiens
gctgggacaacaggtgagcacc

SEQ ID NO: 86660 - DNA, 19 bp, Homo sapiens
gcagacaggtccagagagg

SEQ ID NO: 86661 - DNA, 22 bp, Homo sapiens
tgttgactcaacactgtgggca

SEQ ID NO: 86662 - DNA, 22 bp, Homo sapiens
atagagtgatgtaaggtatgtg

SEQ ID NO: 86663 - DNA, 22 bp, Homo sapiens
ttggaagacaatgctgattctc

SEQ ID NO: 86664 - DNA, 19 bp, Homo sapiens
catggtgaaaccccgtctc

SEQ ID NO: 86665 - DNA, 22 bp, Homo sapiens
ccctgtgggaactcctgagttg

SEQ ID NO: 86666 - DNA, 22 bp, Homo sapiens
tttaatgtagcgtgaaatgatt

SEQ ID NO: 86667 - DNA, 22 bp, Homo sapiens
cattcattacactcataaggtt

SEQ ID NO: 86668 - DNA, 19 bp, Homo sapiens
aggaatggaattaattctg

SEQ ID NO: 86669 - DNA, 21 bp, Homo sapiens
tgtaagtttcatctgaattgg

SEQ ID NO: 86670 - DNA, 22 bp, Homo sapiens
ctaggtgatccactgctctctt

SEQ ID NO: 86671 - DNA, 22 bp, Homo sapiens
tggaagacaatttgaaaacatt

SEQ ID NO: 86672 - DNA, 19 bp, Homo sapiens
tcctgcctggggccgcctg

SEQ ID NO: 86673 - DNA, 22 bp, Homo sapiens
gtctcgtcaatggcaggttccc

SEQ ID NO: 86674 - DNA, 22 bp, Homo sapiens
gatgtgtttccaggatttgttt

SEQ ID NO: 86675 - DNA, 22 bp, Homo sapiens
gccagtggtcactgaggaagaa

SEQ ID NO: 86676 - DNA, 22 bp, Homo sapiens
attcgacaaccttgttttgtac

SEQ ID NO: 86677 - DNA, 22 bp, Homo sapiens
gctggcagacttcctctggaac

SEQ ID NO: 86678 - DNA, 22 bp, Homo sapiens
ccctgcctacagggttttcttt

SEQ ID NO: 86679 - DNA, 22 bp, Homo sapiens
ggccactgctctccagcctggg

SEQ ID NO: 86680 - DNA, 22 bp, Homo sapiens
gtgtgtccaaggcacggatgac

SEQ ID NO: 86681 - DNA, 22 bp, Homo sapiens
acatgtttaagtttgttatatg

SEQ ID NO: 86682 - DNA, 22 bp, Homo sapiens
gggtggtggccagcagtgggca

SEQ ID NO: 86683 - DNA, 22 bp, Homo sapiens
cttagatgaagtcacagaaccc

SEQ ID NO: 86684 - DNA, 19 bp, Homo sapiens
taggaccctggtggccccc

SEQ ID NO: 86685 - DNA, 22 bp, Homo sapiens
gacagacacaattgatccatga

SEQ ID NO: 86686 - DNA, 22 bp, Homo sapiens
agaaatatgctgattagatgaa

SEQ ID NO: 86687 - DNA, 22 bp, Homo sapiens
ttctatattcgcttcccaaggc

SEQ ID NO: 86688 - DNA, 16 bp, Homo sapiens
ccacctgcagctctca

SEQ ID NO: 86689 - DNA, 22 bp, Homo sapiens
aaacttgagccaagggcttggg

SEQ ID NO: 86690 - DNA, 22 bp, Homo sapiens
tggcactgagcagccgcggcag

SEQ ID NO: 86691 - DNA, 22 bp, Homo sapiens
cctctgtgtgatgcgcaaagta

SEQ ID NO: 86692 - DNA, 22 bp, Homo sapiens
ctggcaagaaatatatatctta

SEQ ID NO: 86693 - DNA, 22 bp, Homo sapiens
aattgcaaattcagacttaaga

SEQ ID NO: 86694 - DNA, 20 bp, Homo sapiens
gccactgggcaccagcaggg

SEQ ID NO: 86695 - DNA, 22 bp, Homo sapiens
aatgccagtgtgttgattccag

SEQ ID NO: 86696 - DNA, 22 bp, Homo sapiens
tcctggcaaagatgttggtgtt

SEQ ID NO: 86697 - DNA, 16 bp, Homo sapiens
tgggtgggaggagcgg

SEQ ID NO: 86698 - DNA, 22 bp, Homo sapiens
gtgctggggagataggaagaga

SEQ ID NO: 86699 - DNA, 22 bp, Homo sapiens
cctcttcaggcactcgaaggcc

SEQ ID NO: 86700 - DNA, 22 bp, Homo sapiens
ccaaagtgctaggattacaggt

SEQ ID NO: 86701 - DNA, 22 bp, Homo sapiens
gcaggctgtctaaagttagagt

SEQ ID NO: 86702 - DNA, 22 bp, Homo sapiens
gctcttgtcaaaaattagttga

SEQ ID NO: 86703 - DNA, 22 bp, Homo sapiens
cacccaggttggagtgcagtgg

SEQ ID NO: 86704 - DNA, 22 bp, Homo sapiens
tgacctcatgatccgcccacct

SEQ ID NO: 86705 - DNA, 22 bp, Homo sapiens
aacccgggaggcagaggttgtg

SEQ ID NO: 86706 - DNA, 22 bp, Homo sapiens
tgtacaatgctgaggtttgggg

SEQ ID NO: 86707 - DNA, 22 bp, Homo sapiens
aggagggagcttaagccaggca

SEQ ID NO: 86708 - DNA, 22 bp, Homo sapiens
tgactggattgtcattacgacg

SEQ ID NO: 86709 - DNA, 22 bp, Homo sapiens
aggtaaatgtcagagcctttaa

SEQ ID NO: 86710 - DNA, 22 bp, Homo sapiens
caggaggattgcttgaggccag

SEQ ID NO: 86711 - DNA, 22 bp, Homo sapiens
gtcgttctctgccagggcgttg

SEQ ID NO: 86712 - DNA, 22 bp, Homo sapiens
actgcactccagcctcggggtc

SEQ ID NO: 86713 - DNA, 22 bp, Homo sapiens
gcttacaggtgaggcagcaaga

SEQ ID NO: 86714 - DNA, 22 bp, Homo sapiens
tattcatagtaaacaaaagtgg

SEQ ID NO: 86715 - DNA, 22 bp, Homo sapiens
ttggaacatgccggggtccagg

SEQ ID NO: 86716 - DNA, 22 bp, Homo sapiens
tagactggtgaattagggggaa

SEQ ID NO: 86717 - DNA, 22 bp, Homo sapiens
agagctaagaaacagaattgct

SEQ ID NO: 86718 - DNA, 22 bp, Homo sapiens
actgcacttcagcctgggtgtc

SEQ ID NO: 86719 - DNA, 22 bp, Homo sapiens
gagagcaggaggcagcgggacg

SEQ ID NO: 86720 - DNA, 22 bp, Homo sapiens
cagagcccctcgtctccaccac

SEQ ID NO: 86721 - DNA, 22 bp, Homo sapiens
agaggaggctctgggatcgtcc

SEQ ID NO: 86722 - DNA, 22 bp, Homo sapiens
ggcaaggtgctacagacagtga

SEQ ID NO: 86723 - DNA, 22 bp, Homo sapiens
ctgagggtcaacttgattgtat

SEQ ID NO: 86724 - DNA, 22 bp, Homo sapiens
ctctgcctgtctcatcctgcaa

SEQ ID NO: 86725 - DNA, 22 bp, Homo sapiens
ggaggtgggctaaggactctct

SEQ ID NO: 86726 - DNA, 22 bp, Homo sapiens
cggctcactgcagctccgcctc

SEQ ID NO: 86727 - DNA, 22 bp, Homo sapiens
atgccactgcacttcagcctgg

SEQ ID NO: 86728 - DNA, 22 bp, Homo sapiens
ggaggtggaggttgcagtgagc

SEQ ID NO: 86729 - DNA, 22 bp, Homo sapiens
ggaggcggaggttgcagtgagt

SEQ ID NO: 86730 - DNA, 22 bp, Homo sapiens
ccccaggacgtggccctcatag

SEQ ID NO: 86731 - DNA, 22 bp, Homo sapiens
gagcccaggagtttgatgctgc

SEQ ID NO: 86732 - DNA, 22 bp, Homo sapiens
agtgcaggccccaggccaggcc

SEQ ID NO: 86733 - DNA, 18 bp, Homo sapiens
ggcgggtgttttattcac

SEQ ID NO: 86734 - DNA, 22 bp, Homo sapiens
gagaggtggaggttgcagtgag

SEQ ID NO: 86735 - DNA, 22 bp, Homo sapiens
taggtttactgaattagtggaa

SEQ ID NO: 86736 - DNA, 22 bp, Homo sapiens
cgttctctcatgatcttcccga

SEQ ID NO: 86737 - DNA, 18 bp, Homo sapiens
tgtccctgcaaataacat

SEQ ID NO: 86738 - DNA, 23 bp, Homo sapiens
gctcatcaggcttagagtcaagg

SEQ ID NO: 86739 - DNA, 22 bp, Homo sapiens
atcctcagagaacgaacacaat

SEQ ID NO: 86740 - DNA, 22 bp, Homo sapiens
ggaggctgaggcaggcggatca

SEQ ID NO: 86741 - DNA, 16 bp, Homo sapiens
gcagaggaaaggggag

SEQ ID NO: 86742 - DNA, 22 bp, Homo sapiens
cactgcaacctccacctcctgg

SEQ ID NO: 86743 - DNA, 22 bp, Homo sapiens
agttgggtttgtgtcagttgca

SEQ ID NO: 86744 - DNA, 19 bp, Homo sapiens
ctgggatgtctcctcccag

SEQ ID NO: 86745 - DNA, 22 bp, Homo sapiens
cggggccctggggctgaaggtc

SEQ ID NO: 86746 - DNA, 22 bp, Homo sapiens
gggctagcctcttccctgctcc

SEQ ID NO: 86747 - DNA, 22 bp, Homo sapiens
cccagcgagtttgccggtgaac

SEQ ID NO: 86748 - DNA, 22 bp, Homo sapiens
gactactcaaactttctctata

SEQ ID NO: 86749 - DNA, 22 bp, Homo sapiens
taaaatttgtccctgagtgttg

SEQ ID NO: 86750 - DNA, 22 bp, Homo sapiens
aggtgggcggattcatgaggtc

SEQ ID NO: 86751 - DNA, 22 bp, Homo sapiens
cagggatggcgctggctgcccg

SEQ ID NO: 86752 - DNA, 22 bp, Homo sapiens
tgaagttgttaaggttgccatt

SEQ ID NO: 86753 - DNA, 22 bp, Homo sapiens
gccatcctgatgacaggccact

SEQ ID NO: 86754 - DNA, 22 bp, Homo sapiens
gagccaggtcgggccgcggcga

SEQ ID NO: 86755 - DNA, 22 bp, Homo sapiens
ctgggttggggttacatgactg

SEQ ID NO: 86756 - DNA, 22 bp, Homo sapiens
tggagaattctatgttgagggg

SEQ ID NO: 86757 - DNA, 22 bp, Homo sapiens
tcaggaggtccgcccgggaggg

SEQ ID NO: 86758 - DNA, 22 bp, Homo sapiens
actgcactccagcctgggtaac

SEQ ID NO: 86759 - DNA, 22 bp, Homo sapiens
actgcactccaacctgggtgac

SEQ ID NO: 86760 - DNA, 18 bp, Homo sapiens
gtcaggcatgaatctggg

SEQ ID NO: 86761 - DNA, 22 bp, Homo sapiens
ctcaggacggccgggggagcct

SEQ ID NO: 86762 - DNA, 22 bp, Homo sapiens
ggaggaggggtgactgaatgct

SEQ ID NO: 86763 - DNA, 22 bp, Homo sapiens
actgcgtggggagctgtgacta

SEQ ID NO: 86764 - DNA, 20 bp, Homo sapiens
gggcagagccagccagtccc

SEQ ID NO: 86765 - DNA, 21 bp, Homo sapiens
tgactgaggcttcttcacaca

SEQ ID NO: 86766 - DNA, 22 bp, Homo sapiens
atagggcctaaaaagtattgct

SEQ ID NO: 86767 - DNA, 22 bp, Homo sapiens
tgggaaggggagctggaaagga

SEQ ID NO: 86768 - DNA, 22 bp, Homo sapiens
ggctcactgcaacttccgcctc

SEQ ID NO: 86769 - DNA, 22 bp, Homo sapiens
ctcctctttagccccagctgga

SEQ ID NO: 86770 - DNA, 17 bp, Homo sapiens
tggtccaggtggagcca

SEQ ID NO: 86771 - DNA, 22 bp, Homo sapiens
ctgctttaaaactgatacatga

SEQ ID NO: 86772 - DNA, 22 bp, Homo sapiens
gaggggcacagtaaagggtccc

SEQ ID NO: 86773 - DNA, 22 bp, Homo sapiens
cacagggcttctcatggggtgc

SEQ ID NO: 86774 - DNA, 22 bp, Homo sapiens
tgttgcacggccttcacagagc

SEQ ID NO: 86775 - DNA, 22 bp, Homo sapiens
tgggaggtgattaaattatggg

SEQ ID NO: 86776 - DNA, 22 bp, Homo sapiens
actcccagaacatgctcttctt

SEQ ID NO: 86777 - DNA, 22 bp, Homo sapiens
aagcacaatgaacatcttagat

SEQ ID NO: 86778 - DNA, 22 bp, Homo sapiens
gagagtctagtgcacctagttt

SEQ ID NO: 86779 - DNA, 22 bp, Homo sapiens
atagaatatgacttttagatcc

SEQ ID NO: 86780 - DNA, 22 bp, Homo sapiens
ccaggctgctgttggtgtccgc

SEQ ID NO: 86781 - DNA, 22 bp, Homo sapiens
catgcctgcctggtgggcgtgg

SEQ ID NO: 86782 - DNA, 22 bp, Homo sapiens
tgaagctttaggatgggttcat

SEQ ID NO: 86783 - DNA, 22 bp, Homo sapiens
ctgtaatcccagctacctggga

SEQ ID NO: 86784 - DNA, 22 bp, Homo sapiens
gttggagtgcagcttgtgcgat

SEQ ID NO: 86785 - DNA, 22 bp, Homo sapiens
aagttgttgttgaggtgggtaa

SEQ ID NO: 86786 - DNA, 22 bp, Homo sapiens
gcgagggcacgcggttgaaggc

SEQ ID NO: 86787 - DNA, 22 bp, Homo sapiens
ttcttctaaatgtgcttattaa

SEQ ID NO: 86788 - DNA, 22 bp, Homo sapiens
atgtttaaagggttgagaaata

SEQ ID NO: 86789 - DNA, 22 bp, Homo sapiens
ttgagatggagcctcagtcttg

SEQ ID NO: 86790 - DNA, 22 bp, Homo sapiens
ggggaaggaaagttattagcag

SEQ ID NO: 86791 - DNA, 22 bp, Homo sapiens
ttactcgtgacaatgtccttga

SEQ ID NO: 86792 - DNA, 22 bp, Homo sapiens
ttcctgggattattgtcaagca

SEQ ID NO: 86793 - DNA, 22 bp, Homo sapiens
ctcggaatggaacaacagcggt

SEQ ID NO: 86794 - DNA, 22 bp, Homo sapiens
cactgctacctctgcctcccgg

SEQ ID NO: 86795 - DNA, 22 bp, Homo sapiens
acccagggctcaagcgtaggca

SEQ ID NO: 86796 - DNA, 22 bp, Homo sapiens
ttttggctctgtctgtatcttt

SEQ ID NO: 86797 - DNA, 22 bp, Homo sapiens
ccctgctgtcaggtgctgggag

SEQ ID NO: 86798 - DNA, 18 bp, Homo sapiens
cttgttcttctcttggcg

SEQ ID NO: 86799 - DNA, 22 bp, Homo sapiens
gctcaagccttctgcccacctc

SEQ ID NO: 86800 - DNA, 22 bp, Homo sapiens
ctgctttagacggctttcgctg

SEQ ID NO: 86801 - DNA, 22 bp, Homo sapiens
atgagctagaaaaccatgtgga

SEQ ID NO: 86802 - DNA, 22 bp, Homo sapiens
ctccacagctgtaaatataggg

SEQ ID NO: 86803 - DNA, 22 bp, Homo sapiens
agtccgcctgctgccgtggcag

SEQ ID NO: 86804 - DNA, 22 bp, Homo sapiens
caggaggacatactggctcaca

SEQ ID NO: 86805 - DNA, 21 bp, Homo sapiens
cgcagagcgaacttgcggcgc

SEQ ID NO: 86806 - DNA, 22 bp, Homo sapiens
actgcacttcagcctgggtgac

SEQ ID NO: 86807 - DNA, 22 bp, Homo sapiens
ccttacctgattgctggcatcc

SEQ ID NO: 86808 - DNA, 22 bp, Homo sapiens
tccttcagcctcccagctcaaa

SEQ ID NO: 86809 - DNA, 22 bp, Homo sapiens
gtgtttggtcagacgtccgggg

SEQ ID NO: 86810 - DNA, 22 bp, Homo sapiens
aagcgccatggttcctgcgcag

SEQ ID NO: 86811 - DNA, 22 bp, Homo sapiens
tgctgagcgcatccggcggccg

SEQ ID NO: 86812 - DNA, 22 bp, Homo sapiens
tttgtgaataggttggcttcca

SEQ ID NO: 86813 - DNA, 22 bp, Homo sapiens
tacgcctgtaatcccagcactt

SEQ ID NO: 86814 - DNA, 22 bp, Homo sapiens
cctgtaactccttggctcaagt

SEQ ID NO: 86815 - DNA, 22 bp, Homo sapiens
agccagtgcagctggaaattca

SEQ ID NO: 86816 - DNA, 22 bp, Homo sapiens
aattagttcacgtcctgtgctt

SEQ ID NO: 86817 - DNA, 22 bp, Homo sapiens
tgagacgaagtcttgctctgtt

SEQ ID NO: 86818 - DNA, 22 bp, Homo sapiens
tggcccgaagatccgagggtca

SEQ ID NO: 86819 - DNA, 20 bp, Homo sapiens
tgtccccacccaaatctcat

SEQ ID NO: 86820 - DNA, 22 bp, Homo sapiens
tttctgagaaattaaacacttt

SEQ ID NO: 86821 - DNA, 22 bp, Homo sapiens
caggctggagttcagtggtgtg

SEQ ID NO: 86822 - DNA, 23 bp, Homo sapiens
aggatgtaggatgtatggcagag

SEQ ID NO: 86823 - DNA, 22 bp, Homo sapiens
atgccactgcactccagcctgg

SEQ ID NO: 86824 - DNA, 22 bp, Homo sapiens
caggtgcctcaggatgagacaa

SEQ ID NO: 86825 - DNA, 22 bp, Homo sapiens
cagcctgccgtcagccaggtag

SEQ ID NO: 86826 - DNA, 22 bp, Homo sapiens
cagcgtctcgttgtgggcctcg

SEQ ID NO: 86827 - DNA, 22 bp, Homo sapiens
aggtggcagatgggggtgctcg

SEQ ID NO: 86828 - DNA, 22 bp, Homo sapiens
gtccaggcctgcctctgaggag

SEQ ID NO: 86829 - DNA, 22 bp, Homo sapiens
ggtcccaggttgacagggagac

SEQ ID NO: 86830 - DNA, 22 bp, Homo sapiens
gcaggcagatcacctgtcagga

SEQ ID NO: 86831 - DNA, 22 bp, Homo sapiens
gggcatggtggcaggcacctgt

SEQ ID NO: 86832 - DNA, 21 bp, Homo sapiens
ttgaccaagggtgcgtgctcc

SEQ ID NO: 86833 - DNA, 22 bp, Homo sapiens
gtagcccacctggggagggcga

SEQ ID NO: 86834 - DNA, 22 bp, Homo sapiens
agagggatcaccctgtttctgg

SEQ ID NO: 86835 - DNA, 22 bp, Homo sapiens
tgtagatatagaaaaagactga

SEQ ID NO: 86836 - DNA, 21 bp, Homo sapiens
gggcctggctgcgcaggacgg

SEQ ID NO: 86837 - DNA, 22 bp, Homo sapiens
agcccaggtccagttcactgca

SEQ ID NO: 86838 - DNA, 22 bp, Homo sapiens
gccatcatatcccctgtgacct

SEQ ID NO: 86839 - DNA, 22 bp, Homo sapiens
gtgctggggagataggaagaga

SEQ ID NO: 86840 - DNA, 22 bp, Homo sapiens
gcccctgcctttgaacctggag

SEQ ID NO: 86841 - DNA, 23 bp, Homo sapiens
gcaagagacagagcatcctgttc

SEQ ID NO: 86842 - DNA, 22 bp, Homo sapiens
cggaggcctcagctcatggttt

SEQ ID NO: 86843 - DNA, 22 bp, Homo sapiens
cccaggaggcagaagttgcagt

SEQ ID NO: 86844 - DNA, 21 bp, Homo sapiens
aaactgaccttgcctgagaca

SEQ ID NO: 86845 - DNA, 22 bp, Homo sapiens
gaggcagtccagtgggtaagaa

SEQ ID NO: 86846 - DNA, 22 bp, Homo sapiens
atacaaaaattagccgggagta

SEQ ID NO: 86847 - DNA, 22 bp, Homo sapiens
agcttgtagaaggccacgagca

SEQ ID NO: 86848 - DNA, 22 bp, Homo sapiens
tttattggatatttacaagata

SEQ ID NO: 86849 - DNA, 21 bp, Homo sapiens
cgtgactgggtccgtctggct

SEQ ID NO: 86850 - DNA, 22 bp, Homo sapiens
gcctgtcccgcaccggagcccg

SEQ ID NO: 86851 - DNA, 23 bp, Homo sapiens
ggctgggagctccgggtgcacgt

SEQ ID NO: 86852 - DNA, 22 bp, Homo sapiens
gaggcctcagcctgccctgaac

SEQ ID NO: 86853 - DNA, 22 bp, Homo sapiens
tggaggctggagtgcagtggcg

SEQ ID NO: 86854 - DNA, 22 bp, Homo sapiens
ggtgacgaatccatagcatcga

SEQ ID NO: 86855 - DNA, 22 bp, Homo sapiens
caggctggagtacaattgtgtg

SEQ ID NO: 86856 - DNA, 22 bp, Homo sapiens
tcacagacccttgctgagctct

SEQ ID NO: 86857 - DNA, 22 bp, Homo sapiens
ggactgggaatcagggagatgc

SEQ ID NO: 86858 - DNA, 22 bp, Homo sapiens
gagaactttctgtgtttttatc

SEQ ID NO: 86859 - DNA, 22 bp, Homo sapiens
tctaccctgcggtcttggggca

SEQ ID NO: 86860 - DNA, 22 bp, Homo sapiens
gctcactgcaagctctgcctcc

SEQ ID NO: 86861 - DNA, 22 bp, Homo sapiens
acgaggttggagagttgtttgg

SEQ ID NO: 86862 - DNA, 22 bp, Homo sapiens
caggcagggagctggaaaggat

SEQ ID NO: 86863 - DNA, 21 bp, Homo sapiens
tggtacaccttgcctgtcaga

SEQ ID NO: 86864 - DNA, 22 bp, Homo sapiens
gggcagagagctggaactcctt

SEQ ID NO: 86865 - DNA, 22 bp, Homo sapiens
taacaatacccattctaattac

SEQ ID NO: 86866 - DNA, 22 bp, Homo sapiens
ctcagcactgacccaggagatg

SEQ ID NO: 86867 - DNA, 22 bp, Homo sapiens
cctgccctgctcactgtcggta

SEQ ID NO: 86868 - DNA, 22 bp, Homo sapiens
ctgcagggagaggggacagcct

SEQ ID NO: 86869 - DNA, 22 bp, Homo sapiens
ggcctctcttgggacagctgtc

SEQ ID NO: 86870 - DNA, 21 bp, Homo sapiens
aggtgctggcgccccaggaga

SEQ ID NO: 86871 - DNA, 22 bp, Homo sapiens
tccaactttctcctccggcttg

SEQ ID NO: 86872 - DNA, 22 bp, Homo sapiens
gctgcagctcgccttccggcct

SEQ ID NO: 86873 - DNA, 22 bp, Homo sapiens
tatttcttttcgtgacttattg

SEQ ID NO: 86874 - DNA, 22 bp, Homo sapiens
caggccagggttgagaagagaa

SEQ ID NO: 86875 - DNA, 22 bp, Homo sapiens
tggacaacatagtgagacctca

SEQ ID NO: 86876 - DNA, 22 bp, Homo sapiens
ttggccatctaagcccagccac

SEQ ID NO: 86877 - DNA, 23 bp, Homo sapiens
caaaatgctatgtgcccaatgca

SEQ ID NO: 86878 - DNA, 22 bp, Homo sapiens
ttagcttttgagaatgatttct

SEQ ID NO: 86879 - DNA, 22 bp, Homo sapiens
gggcagagactcagaaacagaa

SEQ ID NO: 86880 - DNA, 22 bp, Homo sapiens
ttctttgaatagatgttcccag

SEQ ID NO: 86881 - DNA, 22 bp, Homo sapiens
agaaatcctgatggagtctgaa

SEQ ID NO: 86882 - DNA, 22 bp, Homo sapiens
gccaggacctcagatgcagggc

SEQ ID NO: 86883 - DNA, 22 bp, Homo sapiens
agattgtcattgacgatgagca

SEQ ID NO: 86884 - DNA, 22 bp, Homo sapiens
acggggctagagaaggtttctt

SEQ ID NO: 86885 - DNA, 22 bp, Homo sapiens
tgcctcagctgaggccgctcca

SEQ ID NO: 86886 - DNA, 22 bp, Homo sapiens
tctacatgcagcgaggggactt

SEQ ID NO: 86887 - DNA, 22 bp, Homo sapiens
aggaggggttctcgggtgctga

SEQ ID NO: 86888 - DNA, 22 bp, Homo sapiens
atttacaggtagaattttaagt

SEQ ID NO: 86889 - DNA, 22 bp, Homo sapiens
ctgcaccctcaaactcctgggc

SEQ ID NO: 86890 - DNA, 22 bp, Homo sapiens
agccctggtttgcagcatttgc

SEQ ID NO: 86891 - DNA, 22 bp, Homo sapiens
gtacaaatgcaggtttgttaca

SEQ ID NO: 86892 - DNA, 22 bp, Homo sapiens
ttcctcaggctgctttcacata

SEQ ID NO: 86893 - DNA, 22 bp, Homo sapiens
aagaagcaggtcacagacaggg

SEQ ID NO: 86894 - DNA, 22 bp, Homo sapiens
gcccaggaggcagaggttgtgg

SEQ ID NO: 86895 - DNA, 22 bp, Homo sapiens
agcctgcgatcccacctggcct

SEQ ID NO: 86896 - DNA, 22 bp, Homo sapiens
gctggggaggcagcagagaaca

SEQ ID NO: 86897 - DNA, 17 bp, Homo sapiens
gagcccctttccaagtt

SEQ ID NO: 86898 - DNA, 22 bp, Homo sapiens
aaagaggcaatcaatgtagcaa

SEQ ID NO: 86899 - DNA, 22 bp, Homo sapiens
tttaaaaaactagtctgagtct

SEQ ID NO: 86900 - DNA, 22 bp, Homo sapiens
ctgattgagaaggaaggggatc

SEQ ID NO: 86901 - DNA, 23 bp, Homo sapiens
ccaagactgttaggagtggggag

SEQ ID NO: 86902 - DNA, 22 bp, Homo sapiens
gtttcgtcaggcttattctatc

SEQ ID NO: 86903 - DNA, 20 bp, Homo sapiens
aaaattgctctgcagtcccc

SEQ ID NO: 86904 - DNA, 22 bp, Homo sapiens
tcctgggccctccggatcaggt

SEQ ID NO: 86905 - DNA, 22 bp, Homo sapiens
ggtggcagtagcactgggcctg

SEQ ID NO: 86906 - DNA, 22 bp, Homo sapiens
ctctctgggcccagttggcacc

SEQ ID NO: 86907 - DNA, 22 bp, Homo sapiens
gcgagtgccgagagggcagggc

SEQ ID NO: 86908 - DNA, 22 bp, Homo sapiens
gctcagaggcacgacctcttgg

SEQ ID NO: 86909 - DNA, 22 bp, Homo sapiens
ccaatgatggtgcccacgatga

SEQ ID NO: 86910 - DNA, 22 bp, Homo sapiens
cctcacctcagtctgggcctca

SEQ ID NO: 86911 - DNA, 22 bp, Homo sapiens
ctggcctaggaatggttttccg

SEQ ID NO: 86912 - DNA, 22 bp, Homo sapiens
agtgtattctgcatgggagact

SEQ ID NO: 86913 - DNA, 22 bp, Homo sapiens
cccaggctggagtgcagtggcg

SEQ ID NO: 86914 - DNA, 22 bp, Homo sapiens
agcgcttgccgcactccaagca

SEQ ID NO: 86915 - DNA, 22 bp, Homo sapiens
gacaattgcttttgccgaataa

SEQ ID NO: 86916 - DNA, 22 bp, Homo sapiens
agggccagcactcctggcagga

SEQ ID NO: 86917 - DNA, 22 bp, Homo sapiens
aaaatatgtataactcttctgc

SEQ ID NO: 86918 - DNA, 22 bp, Homo sapiens
gctcactgcaacctctgcctcc

SEQ ID NO: 86919 - DNA, 22 bp, Homo sapiens
ggaggcggaggctgcagtgagc

SEQ ID NO: 86920 - DNA, 20 bp, Homo sapiens
acgtggccaccagtggctta

SEQ ID NO: 86921 - DNA, 18 bp, Homo sapiens
tttctcagactctctttc

SEQ ID NO: 86922 - DNA, 22 bp, Homo sapiens
cccaggggttctgagcagcagc

SEQ ID NO: 86923 - DNA, 23 bp, Homo sapiens
ccactagcacctgttcaacttct

SEQ ID NO: 86924 - DNA, 22 bp, Homo sapiens
gaggtgggtgtatcacaggtca

SEQ ID NO: 86925 - DNA, 23 bp, Homo sapiens
agcttttaggtggaaatggcact

SEQ ID NO: 86926 - DNA, 22 bp, Homo sapiens
aagcagcacagcaatgactcta

SEQ ID NO: 86927 - DNA, 22 bp, Homo sapiens
gcaggtggatcacctgaggtca

SEQ ID NO: 86928 - DNA, 22 bp, Homo sapiens
gtgacaatattagctcaggggc

SEQ ID NO: 86929 - DNA, 22 bp, Homo sapiens
tttccctttagcctgagaatcc

SEQ ID NO: 86930 - DNA, 22 bp, Homo sapiens
cgcaactcagcaacttaactgc

SEQ ID NO: 86931 - DNA, 22 bp, Homo sapiens
tggctaacaaggtgaaaccccg

SEQ ID NO: 86932 - DNA, 21 bp, Homo sapiens
ggagcctctggcagggggcca

SEQ ID NO: 86933 - DNA, 22 bp, Homo sapiens
cgggttcacgccattctcctgc

SEQ ID NO: 86934 - DNA, 22 bp, Homo sapiens
tcactgcgcttcagcctgggtg

SEQ ID NO: 86935 - DNA, 22 bp, Homo sapiens
ccttttgctctcccatccagaa

SEQ ID NO: 86936 - DNA, 22 bp, Homo sapiens
aaagtgctgggattacaggtgt

SEQ ID NO: 86937 - DNA, 22 bp, Homo sapiens
actgcactcctgcctgggtaac

SEQ ID NO: 86938 - DNA, 22 bp, Homo sapiens
tagcgaggtgtttctaggactg

SEQ ID NO: 86939 - DNA, 22 bp, Homo sapiens
ggctctgtaagtgttgcaggta

SEQ ID NO: 86940 - DNA, 22 bp, Homo sapiens
tcaggtccaagatggccatcca

SEQ ID NO: 86941 - DNA, 22 bp, Homo sapiens
ggcatcttgttgctcaaatcta

SEQ ID NO: 86942 - DNA, 22 bp, Homo sapiens
gggaagtgagctggaatcaagg

SEQ ID NO: 86943 - DNA, 22 bp, Homo sapiens
agctagtatttcattgaggatt

SEQ ID NO: 86944 - DNA, 22 bp, Homo sapiens
ttcaccatgttggccaggctgg

SEQ ID NO: 86945 - DNA, 22 bp, Homo sapiens
ttagtttataattcatttctgt

SEQ ID NO: 86946 - DNA, 22 bp, Homo sapiens
ctgtaatcccagctactcggga

SEQ ID NO: 86947 - DNA, 22 bp, Homo sapiens
caggctggagtgcagtggcgct

SEQ ID NO: 86948 - DNA, 22 bp, Homo sapiens
cctcgggctgaggctcccaggc

SEQ ID NO: 86949 - DNA, 22 bp, Homo sapiens
aggagcagaccgtagtcctgca

SEQ ID NO: 86950 - DNA, 22 bp, Homo sapiens
gtctgctttgtctttcatgata

SEQ ID NO: 86951 - DNA, 22 bp, Homo sapiens
tgagccaagatcatgccgttgt

SEQ ID NO: 86952 - DNA, 22 bp, Homo sapiens
ccactgcacttcagcctgggtg

SEQ ID NO: 86953 - DNA, 22 bp, Homo sapiens
tacaaaggaggtgcatagaaca

SEQ ID NO: 86954 - DNA, 22 bp, Homo sapiens
tgagtcatgggcttgaggttac

SEQ ID NO: 86955 - DNA, 22 bp, Homo sapiens
ctgagatggagtttcgctcttc

SEQ ID NO: 86956 - DNA, 22 bp, Homo sapiens
tgcacgtgtgagcattcacatg

SEQ ID NO: 86957 - DNA, 22 bp, Homo sapiens
tctcaacagtgcaagctgctcc

SEQ ID NO: 86958 - DNA, 22 bp, Homo sapiens
gccaccctggacgcactgttcg

SEQ ID NO: 86959 - DNA, 22 bp, Homo sapiens
ctcgggcaccctggttctggtg

SEQ ID NO: 86960 - DNA, 22 bp, Homo sapiens
taattataacagttacatctta

SEQ ID NO: 86961 - DNA, 20 bp, Homo sapiens
gtttctgattcagtaggtct

SEQ ID NO: 86962 - DNA, 21 bp, Homo sapiens
ttagaagctaatgcagctggt

SEQ ID NO: 86963 - DNA, 22 bp, Homo sapiens
atacctgtgtatccacaagcgt

SEQ ID NO: 86964 - DNA, 22 bp, Homo sapiens
aaggagtctgggccattcagag

SEQ ID NO: 86965 - DNA, 22 bp, Homo sapiens
aggaaataggaccagacaaagc

SEQ ID NO: 86966 - DNA, 22 bp, Homo sapiens
ctggggaacgcagcgagcagcg

SEQ ID NO: 86967 - DNA, 22 bp, Homo sapiens
ttgcttcttagatattcctctc

SEQ ID NO: 86968 - DNA, 22 bp, Homo sapiens
cctgacgaaaggcgtgctggag

SEQ ID NO: 86969 - DNA, 22 bp, Homo sapiens
cgccgtcccctaggaaagagct

SEQ ID NO: 86970 - DNA, 22 bp, Homo sapiens
aaagggaagttgcacatgttcc

SEQ ID NO: 86971 - DNA, 22 bp, Homo sapiens
agggtggcactggtggctctat

SEQ ID NO: 86972 - DNA, 22 bp, Homo sapiens
caggctggagtgcagtggcgcc

SEQ ID NO: 86973 - DNA, 22 bp, Homo sapiens
ggcttagcaactcctgaggctc

SEQ ID NO: 86974 - DNA, 22 bp, Homo sapiens
agagagcccgggccagggcaca

SEQ ID NO: 86975 - DNA, 22 bp, Homo sapiens
tagcccctgcctttgaacctgg

SEQ ID NO: 86976 - DNA, 22 bp, Homo sapiens
gggctgagacgatggggtcttc

SEQ ID NO: 86977 - DNA, 22 bp, Homo sapiens
ctggcaggttatagagctgccc

SEQ ID NO: 86978 - DNA, 22 bp, Homo sapiens
tcagcctggcaggatggcctgg

SEQ ID NO: 86979 - DNA, 22 bp, Homo sapiens
ggcaggactgatcagtgggatg

SEQ ID NO: 86980 - DNA, 22 bp, Homo sapiens
tctcctggtacccttcctagca

SEQ ID NO: 86981 - DNA, 22 bp, Homo sapiens
tccaggtgacagagacaggata

SEQ ID NO: 86982 - DNA, 22 bp, Homo sapiens
ccgggagcaggcgccaccgcca

SEQ ID NO: 86983 - DNA, 22 bp, Homo sapiens
atatgggggggcgtgcagagga

SEQ ID NO: 86984 - DNA, 22 bp, Homo sapiens
aacgtcctcacctgtaacttgg

SEQ ID NO: 86985 - DNA, 22 bp, Homo sapiens
atgaggcaggtggaggctgcca

SEQ ID NO: 86986 - DNA, 22 bp, Homo sapiens
agccaggatggtctcgatcggc

SEQ ID NO: 86987 - DNA, 22 bp, Homo sapiens
aggcaaatgatcctgctccttg

SEQ ID NO: 86988 - DNA, 23 bp, Homo sapiens
tgaggcaggcggatcacgaggtc

SEQ ID NO: 86989 - DNA, 22 bp, Homo sapiens
ttgggattacaggtgtaagcca

SEQ ID NO: 86990 - DNA, 22 bp, Homo sapiens
accctctagagggaagcacttt

SEQ ID NO: 86991 - DNA, 22 bp, Homo sapiens
ggaggcggaggttgcagtgagc

SEQ ID NO: 86992 - DNA, 22 bp, Homo sapiens
accatgtcatttattggccaaa

SEQ ID NO: 86993 - DNA, 22 bp, Homo sapiens
actctccttttgatcttcagaa

SEQ ID NO: 86994 - DNA, 22 bp, Homo sapiens
tcactgcaacctccacctcccg

SEQ ID NO: 86995 - DNA, 22 bp, Homo sapiens
ggagcagggaattacagcgcag

SEQ ID NO: 86996 - DNA, 22 bp, Homo sapiens
ccaggctggagtgcaatggcat

SEQ ID NO: 86997 - DNA, 22 bp, Homo sapiens
aggccttaccatagctgtagca

SEQ ID NO: 86998 - DNA, 22 bp, Homo sapiens
ctcagcactttggaaggctgat

SEQ ID NO: 86999 - DNA, 22 bp, Homo sapiens
cctggcctttgaacgctagact

SEQ ID NO: 87000 - DNA, 22 bp, Homo sapiens
tgcaagtaattccagctactga

SEQ ID NO: 87001 - DNA, 22 bp, Homo sapiens
tgaggcaggaggattgcaggat

SEQ ID NO: 87002 - DNA, 22 bp, Homo sapiens
cccattcatcctcgcttccttc

SEQ ID NO: 87003 - DNA, 22 bp, Homo sapiens
tctaatccttgctacctgggtg

SEQ ID NO: 87004 - DNA, 20 bp, Homo sapiens
aggaaaaatggaaactggag

SEQ ID NO: 87005 - DNA, 22 bp, Homo sapiens
gaggcacagagtaggtgcacac

SEQ ID NO: 87006 - DNA, 22 bp, Homo sapiens
tattgggtaaagatccagtttt

SEQ ID NO: 87007 - DNA, 23 bp, Homo sapiens
tcctcgcaggagggagatgatgc

SEQ ID NO: 87008 - DNA, 22 bp, Homo sapiens
ggctccaccctgcttccagaag

SEQ ID NO: 87009 - DNA, 22 bp, Homo sapiens
ctgggctagaaggaccaggatg

SEQ ID NO: 87010 - DNA, 22 bp, Homo sapiens
ccaggctggagtgcagtggcac

SEQ ID NO: 87011 - DNA, 22 bp, Homo sapiens
aaattgattaaagtccgtgctt

SEQ ID NO: 87012 - DNA, 22 bp, Homo sapiens
ctgagatggagttttgctcttg

SEQ ID NO: 87013 - DNA, 22 bp, Homo sapiens
aggacagagggaccagagccca

SEQ ID NO: 87014 - DNA, 22 bp, Homo sapiens
ggttgcaaactcctgggatcaa

SEQ ID NO: 87015 - DNA, 17 bp, Homo sapiens
tgtatttatcatgtcag

SEQ ID NO: 87016 - DNA, 22 bp, Homo sapiens
atgggctgtccattgctggctg

SEQ ID NO: 87017 - DNA, 22 bp, Homo sapiens
cgtgccactgcactctagcctg

SEQ ID NO: 87018 - DNA, 22 bp, Homo sapiens
actttatttcctattgcatcca

SEQ ID NO: 87019 - DNA, 22 bp, Homo sapiens
agtgaatgtccccgcgggtcag

SEQ ID NO: 87020 - DNA, 22 bp, Homo sapiens
agcctggcctgggcaggcacat

SEQ ID NO: 87021 - DNA, 22 bp, Homo sapiens
ggatgttgattgaatggccatt

SEQ ID NO: 87022 - DNA, 23 bp, Homo sapiens
attttttgtctttgtaactagat

SEQ ID NO: 87023 - DNA, 22 bp, Homo sapiens
ccaaggccttgaaggcgcgggg

SEQ ID NO: 87024 - DNA, 22 bp, Homo sapiens
accctgctttatgccgtcctct

SEQ ID NO: 87025 - DNA, 22 bp, Homo sapiens
aggctgaggcaagaggatcact

SEQ ID NO: 87026 - DNA, 21 bp, Homo sapiens
tctctttctggaagcttccct

SEQ ID NO: 87027 - DNA, 22 bp, Homo sapiens
cctgaggatgccagcatgggtg

SEQ ID NO: 87028 - DNA, 22 bp, Homo sapiens
tctgccgtgcgaggtcccacca

SEQ ID NO: 87029 - DNA, 22 bp, Homo sapiens
ttgtgaatagtgctgcagtaaa

SEQ ID NO: 87030 - DNA, 22 bp, Homo sapiens
acttgtgttaccaaggtttggt

SEQ ID NO: 87031 - DNA, 22 bp, Homo sapiens
tttgcttgttcaagatttctgt

SEQ ID NO: 87032 - DNA, 22 bp, Homo sapiens
aaaaatcacttttataggcagc

SEQ ID NO: 87033 - DNA, 21 bp, Homo sapiens
tttcttaggctctaaaatgac

SEQ ID NO: 87034 - DNA, 22 bp, Homo sapiens
gtctctcaaaactagaagagaa

SEQ ID NO: 87035 - DNA, 22 bp, Homo sapiens
cttctcttcctttgtcaactga

SEQ ID NO: 87036 - DNA, 22 bp, Homo sapiens
tcagcctgctccaagtgctgcc

SEQ ID NO: 87037 - DNA, 22 bp, Homo sapiens
tgttttaagggtcaactgtcac

SEQ ID NO: 87038 - DNA, 22 bp, Homo sapiens
gaggagggagctggaagctctt

SEQ ID NO: 87039 - DNA, 22 bp, Homo sapiens
tgagatggagtctcactctgtt

SEQ ID NO: 87040 - DNA, 22 bp, Homo sapiens
gctggccacagatccccaggga

SEQ ID NO: 87041 - DNA, 22 bp, Homo sapiens
ggctgatgggcatgagctgtca

SEQ ID NO: 87042 - DNA, 22 bp, Homo sapiens
actgcactccagcctgggtgac

SEQ ID NO: 87043 - DNA, 22 bp, Homo sapiens
tgctccagcaccaagagctcca

SEQ ID NO: 87044 - DNA, 22 bp, Homo sapiens
ttaaattttagaaacagactct

SEQ ID NO: 87045 - DNA, 18 bp, Homo sapiens
cagggctgtggggtcact

SEQ ID NO: 87046 - DNA, 22 bp, Homo sapiens
gctgggctgcgtcggggaagcc

SEQ ID NO: 87047 - DNA, 22 bp, Homo sapiens
gacaggaggcagagctcaggtg

SEQ ID NO: 87048 - DNA, 22 bp, Homo sapiens
gcgccactgcactcccacctgg

SEQ ID NO: 87049 - DNA, 22 bp, Homo sapiens
ccctgcctacagggttttcttt

SEQ ID NO: 87050 - DNA, 22 bp, Homo sapiens
ccgcaaggcagaggttgcagtg

SEQ ID NO: 87051 - DNA, 22 bp, Homo sapiens
agaaaacataggagacaggaaa

SEQ ID NO: 87052 - DNA, 22 bp, Homo sapiens
gggagtgggtttggcctaggcc

SEQ ID NO: 87053 - DNA, 22 bp, Homo sapiens
accactgcccatggtgaaaact

SEQ ID NO: 87054 - DNA, 20 bp, Homo sapiens
caggtccagcacgtgcacgg

SEQ ID NO: 87055 - DNA, 22 bp, Homo sapiens
tgggggctgggatgtcactttc

SEQ ID NO: 87056 - DNA, 21 bp, Homo sapiens
tggcggggacttgtggctgcc

SEQ ID NO: 87057 - DNA, 22 bp, Homo sapiens
tgctgggggtagctctgcgtag

SEQ ID NO: 87058 - DNA, 22 bp, Homo sapiens
gttctgagtcctcctttgaagg

SEQ ID NO: 87059 - DNA, 22 bp, Homo sapiens
ggctgggctccgggagcatgcg

SEQ ID NO: 87060 - DNA, 22 bp, Homo sapiens
cacgggagacgtgatcttggac

SEQ ID NO: 87061 - DNA, 22 bp, Homo sapiens
aaggctgtggttctatacagaa

SEQ ID NO: 87062 - DNA, 22 bp, Homo sapiens
ttcatatttctttaaggacttt

SEQ ID NO: 87063 - DNA, 22 bp, Homo sapiens
atgattgaaaatgacattgcca

SEQ ID NO: 87064 - DNA, 22 bp, Homo sapiens
ggggaccctcaggactgcgtct

SEQ ID NO: 87065 - DNA, 22 bp, Homo sapiens
cacagagctggaaaggctgggc

SEQ ID NO: 87066 - DNA, 22 bp, Homo sapiens
cccaggccccagggcttgtcag

SEQ ID NO: 87067 - DNA, 22 bp, Homo sapiens
gtgcacatcgtgcaggtttgtt

SEQ ID NO: 87068 - DNA, 22 bp, Homo sapiens
gagggtggtggcttaaggtgct

SEQ ID NO: 87069 - DNA, 22 bp, Homo sapiens
agtgaaaacctaatcatgcagt

SEQ ID NO: 87070 - DNA, 22 bp, Homo sapiens
gggcagatcacctgaggtcagg

SEQ ID NO: 87071 - DNA, 22 bp, Homo sapiens
gcttcggggtccaagcgcgtgt

SEQ ID NO: 87072 - DNA, 22 bp, Homo sapiens
ccagaggtgctctttggaagtg

SEQ ID NO: 87073 - DNA, 22 bp, Homo sapiens
tttggtattgcacactgtcttc

SEQ ID NO: 87074 - DNA, 17 bp, Homo sapiens
ggctgcagtccaggagg

SEQ ID NO: 87075 - DNA, 22 bp, Homo sapiens
tagcagcaaagcaggatctgct

SEQ ID NO: 87076 - DNA, 22 bp, Homo sapiens
tctgctctgtggcttcagctaa

SEQ ID NO: 87077 - DNA, 22 bp, Homo sapiens
gaagcctcaacatctctgcgtc

SEQ ID NO: 87078 - DNA, 22 bp, Homo sapiens
tatctgttaaaacaagctttaa

SEQ ID NO: 87079 - DNA, 22 bp, Homo sapiens
tgtgttgtgacattcttggatg

SEQ ID NO: 87080 - DNA, 22 bp, Homo sapiens
catagagtgatgtaaggtatgt

SEQ ID NO: 87081 - DNA, 22 bp, Homo sapiens
attgtaaatagtgccacaataa

SEQ ID NO: 87082 - DNA, 22 bp, Homo sapiens
tgtccagatcaatgcccacatg

SEQ ID NO: 87083 - DNA, 22 bp, Homo sapiens
caagtctgacctctgggtgaag

SEQ ID NO: 87084 - DNA, 22 bp, Homo sapiens
agacaaagaaaccgtagaagca

SEQ ID NO: 87085 - DNA, 22 bp, Homo sapiens
gtcctggggattatagagtgtt

SEQ ID NO: 87086 - DNA, 22 bp, Homo sapiens
ttggcataccttagtggtggag

SEQ ID NO: 87087 - DNA, 22 bp, Homo sapiens
tgcagtcttccagctgcacaaa

SEQ ID NO: 87088 - DNA, 22 bp, Homo sapiens
ctgtcctgccagtcctggactc

SEQ ID NO: 87089 - DNA, 22 bp, Homo sapiens
aaagtgctggtattacaggtgt

SEQ ID NO: 87090 - DNA, 22 bp, Homo sapiens
ttacgcagctgctccaggaagc

SEQ ID NO: 87091 - DNA, 22 bp, Homo sapiens
gcgtggcttagagtggggtacc

SEQ ID NO: 87092 - DNA, 22 bp, Homo sapiens
agaaaatttaaagagacacaca

SEQ ID NO: 87093 - DNA, 22 bp, Homo sapiens
aagagggctgcaatcttattgc

SEQ ID NO: 87094 - DNA, 22 bp, Homo sapiens
tatgacttttcccaattcagga

SEQ ID NO: 87095 - DNA, 22 bp, Homo sapiens
gaccttgtgatccgcccgcctt

SEQ ID NO: 87096 - DNA, 22 bp, Homo sapiens
agctggggctgtggttgtgatt

SEQ ID NO: 87097 - DNA, 22 bp, Homo sapiens
cccaggaggcggaggttgcagt

SEQ ID NO: 87098 - DNA, 22 bp, Homo sapiens
tgagatgagatttcactgtcct

SEQ ID NO: 87099 - DNA, 22 bp, Homo sapiens
tggtattacttctagacacaag

SEQ ID NO: 87100 - DNA, 22 bp, Homo sapiens
agatggagtctcactcttgttg

SEQ ID NO: 87101 - DNA, 22 bp, Homo sapiens
tgctggtaccgcgcctccgcca

SEQ ID NO: 87102 - DNA, 22 bp, Homo sapiens
gggaacagcttgggctctgcca

SEQ ID NO: 87103 - DNA, 22 bp, Homo sapiens
atgtgggccgtgcgggtgtcct

SEQ ID NO: 87104 - DNA, 22 bp, Homo sapiens
tccgggcaactgaagggaggtt

SEQ ID NO: 87105 - DNA, 22 bp, Homo sapiens
ttagcacaggagtctctgttat

SEQ ID NO: 87106 - DNA, 22 bp, Homo sapiens
ccgaggctggagtgcagtggcg

SEQ ID NO: 87107 - DNA, 22 bp, Homo sapiens
gatgtagacacttggaggctta

SEQ ID NO: 87108 - DNA, 22 bp, Homo sapiens
tgggggtgtcctggtgcacaca

SEQ ID NO: 87109 - DNA, 22 bp, Homo sapiens
tgatctaggttggcttcaactg

SEQ ID NO: 87110 - DNA, 22 bp, Homo sapiens
gacctccgtgtacacctcccag

SEQ ID NO: 87111 - DNA, 22 bp, Homo sapiens
gtggggacgggatggctcactg

SEQ ID NO: 87112 - DNA, 22 bp, Homo sapiens
ttgcttcagagggagacacttt

SEQ ID NO: 87113 - DNA, 22 bp, Homo sapiens
ggagccgcacgtgctgggcccg

SEQ ID NO: 87114 - DNA, 22 bp, Homo sapiens
caggaaggcgcggctgtgcctg

SEQ ID NO: 87115 - DNA, 22 bp, Homo sapiens
tgtgggagaaggaagcaagctg

SEQ ID NO: 87116 - DNA, 22 bp, Homo sapiens
tcctgggacaagccgtggaagt

SEQ ID NO: 87117 - DNA, 22 bp, Homo sapiens
ttcaaagggaaaagcaggctgg

SEQ ID NO: 87118 - DNA, 22 bp, Homo sapiens
tcagggctgcagaagaggcagg

SEQ ID NO: 87119 - DNA, 22 bp, Homo sapiens
atgcttccagattggtaggggt

SEQ ID NO: 87120 - DNA, 22 bp, Homo sapiens
tttaggttttttcacgtggcta

SEQ ID NO: 87121 - DNA, 22 bp, Homo sapiens
ttcatagtgtttccttccagtg

SEQ ID NO: 87122 - DNA, 22 bp, Homo sapiens
actaggggctcaggcccaggga

SEQ ID NO: 87123 - DNA, 22 bp, Homo sapiens
atgattgaccatctgctgggct

SEQ ID NO: 87124 - DNA, 22 bp, Homo sapiens
ggagagggtaggggtcctgccc

SEQ ID NO: 87125 - DNA, 22 bp, Homo sapiens
agatttggtgtctggttgatat

SEQ ID NO: 87126 - DNA, 22 bp, Homo sapiens
gcttctcaattctcaccctcca

SEQ ID NO: 87127 - DNA, 22 bp, Homo sapiens
gtcagatctttggggatgctgt

SEQ ID NO: 87128 - DNA, 22 bp, Homo sapiens
ataaaatttgctactgttaaat

SEQ ID NO: 87129 - DNA, 22 bp, Homo sapiens
gaccctctagatggaagcactg

SEQ ID NO: 87130 - DNA, 22 bp, Homo sapiens
gcagggtctgaggccacagagg

SEQ ID NO: 87131 - DNA, 22 bp, Homo sapiens
cactgcactccagcctgggaga

SEQ ID NO: 87132 - DNA, 22 bp, Homo sapiens
caggcaggtcagtgaagaagga

SEQ ID NO: 87133 - DNA, 22 bp, Homo sapiens
ctccaggccatggctgcggagg

SEQ ID NO: 87134 - DNA, 22 bp, Homo sapiens
tgccgcagtgcggggagggccc

SEQ ID NO: 87135 - DNA, 22 bp, Homo sapiens
ctggctggagtgcaggtgagtg

SEQ ID NO: 87136 - DNA, 22 bp, Homo sapiens
cttgcctttgtcttcaaaggct

SEQ ID NO: 87137 - DNA, 22 bp, Homo sapiens
ggtgtccgcgctgtagaaggtc

SEQ ID NO: 87138 - DNA, 22 bp, Homo sapiens
atgccactgcgctctagcctgg

SEQ ID NO: 87139 - DNA, 22 bp, Homo sapiens
acttaccagagaggatccgccc

SEQ ID NO: 87140 - DNA, 22 bp, Homo sapiens
gctcatgactgtaatcccagca

SEQ ID NO: 87141 - DNA, 19 bp, Homo sapiens
aggcttcaggccacatgct

SEQ ID NO: 87142 - DNA, 22 bp, Homo sapiens
agcccaggctggagtgcagtgg

SEQ ID NO: 87143 - DNA, 22 bp, Homo sapiens
tcctttgcttctgtcattctcc

SEQ ID NO: 87144 - DNA, 22 bp, Homo sapiens
acgcctgtaatcccagcacttt

SEQ ID NO: 87145 - DNA, 23 bp, Homo sapiens
caccactttctccttctccttgg

SEQ ID NO: 87146 - DNA, 22 bp, Homo sapiens
ttactggctgggcctgagggct

SEQ ID NO: 87147 - DNA, 22 bp, Homo sapiens
gaccagtcattactcatgccct

SEQ ID NO: 87148 - DNA, 18 bp, Homo sapiens
tgagagcattcgaggcaa

SEQ ID NO: 87149 - DNA, 22 bp, Homo sapiens
tttgctttgtttaaaagtggta

SEQ ID NO: 87150 - DNA, 22 bp, Homo sapiens
tgaaatgtgttctagtgttttg

SEQ ID NO: 87151 - DNA, 22 bp, Homo sapiens
ggatgtcgaggatggggtagca

SEQ ID NO: 87152 - DNA, 22 bp, Homo sapiens
aggcaggaaaatcgcttgaacc

SEQ ID NO: 87153 - DNA, 22 bp, Homo sapiens
gggtccaggcggcatagttgta

SEQ ID NO: 87154 - DNA, 22 bp, Homo sapiens
atttattcctttatggctggag

SEQ ID NO: 87155 - DNA, 22 bp, Homo sapiens
gccgccgctgtgcaatttagca

SEQ ID NO: 87156 - DNA, 22 bp, Homo sapiens
atacaaaatatatactggagac

SEQ ID NO: 87157 - DNA, 18 bp, Homo sapiens
ggtgagggagctggaagc

SEQ ID NO: 87158 - DNA, 22 bp, Homo sapiens
ctacattaaattggcttactta

SEQ ID NO: 87159 - DNA, 22 bp, Homo sapiens
ggtgacctcacctggtcccacc

SEQ ID NO: 87160 - DNA, 22 bp, Homo sapiens
ctgatattctattttgcttgct

SEQ ID NO: 87161 - DNA, 22 bp, Homo sapiens
tcatctccatacggtctcgcag

SEQ ID NO: 87162 - DNA, 22 bp, Homo sapiens
ctggcctggcgcagtggctcac

SEQ ID NO: 87163 - DNA, 22 bp, Homo sapiens
cattgcaacttcaaactcctgg

SEQ ID NO: 87164 - DNA, 22 bp, Homo sapiens
tccctagtcgcatctgtggaga

SEQ ID NO: 87165 - DNA, 22 bp, Homo sapiens
ctctcgccagcggggctgcgct

SEQ ID NO: 87166 - DNA, 22 bp, Homo sapiens
agggtgaatctcacaactctta

SEQ ID NO: 87167 - DNA, 22 bp, Homo sapiens
gttactcttgagaggctgaggt

SEQ ID NO: 87168 - DNA, 22 bp, Homo sapiens
cgggcaaggcgagactaggccc

SEQ ID NO: 87169 - DNA, 22 bp, Homo sapiens
tgtgacctcatcttaactggaa

SEQ ID NO: 87170 - DNA, 22 bp, Homo sapiens
gtatttggaaaccaccagtgcc

SEQ ID NO: 87171 - DNA, 22 bp, Homo sapiens
gagcctcgtggcggccactgcg

SEQ ID NO: 87172 - DNA, 22 bp, Homo sapiens
gtgccccagacacgcatgtggg

SEQ ID NO: 87173 - DNA, 22 bp, Homo sapiens
agaggctgcacttgctcatgat

SEQ ID NO: 87174 - DNA, 22 bp, Homo sapiens
ttttgagatggtgtctcgctcc

SEQ ID NO: 87175 - DNA, 22 bp, Homo sapiens
gagctgggcctgcgagtgctgc

SEQ ID NO: 87176 - DNA, 22 bp, Homo sapiens
aggaccatcctaaggtaggcaa

SEQ ID NO: 87177 - DNA, 20 bp, Homo sapiens
tggcctctgagatgccacgg

SEQ ID NO: 87178 - DNA, 22 bp, Homo sapiens
attcgcgggcctggagggtggg

SEQ ID NO: 87179 - DNA, 19 bp, Homo sapiens
gactccaactttaagcatg

SEQ ID NO: 87180 - DNA, 22 bp, Homo sapiens
atgagatgaggaatggccctcc

SEQ ID NO: 87181 - DNA, 22 bp, Homo sapiens
ctcaggagttggaggctacagt

SEQ ID NO: 87182 - DNA, 22 bp, Homo sapiens
gcgttggggaccccgaagctgg

SEQ ID NO: 87183 - DNA, 22 bp, Homo sapiens
aatgcaatgcagcacctccttg

SEQ ID NO: 87184 - DNA, 23 bp, Homo sapiens
gggtccagccaattccaaggaaa

SEQ ID NO: 87185 - DNA, 22 bp, Homo sapiens
gcaggagaacaaagcaagctgc

SEQ ID NO: 87186 - DNA, 21 bp, Homo sapiens
tcgacctgctgggctcgggct

SEQ ID NO: 87187 - DNA, 22 bp, Homo sapiens
gcagttaaaaataaaccttcat

SEQ ID NO: 87188 - DNA, 22 bp, Homo sapiens
ggccctgggccctctagcttgt

SEQ ID NO: 87189 - DNA, 22 bp, Homo sapiens
gccctgggcaaggttctggcca

SEQ ID NO: 87190 - DNA, 22 bp, Homo sapiens
ctggctcctgtttaaccagctg

SEQ ID NO: 87191 - DNA, 22 bp, Homo sapiens
gaggtgggcggatcacaaggtc

SEQ ID NO: 87192 - DNA, 22 bp, Homo sapiens
acaactttgacccttgttctta

SEQ ID NO: 87193 - DNA, 22 bp, Homo sapiens
ctgggaggcggaggttgcagtg

SEQ ID NO: 87194 - DNA, 22 bp, Homo sapiens
ggcctgggctccgggagttact

SEQ ID NO: 87195 - DNA, 22 bp, Homo sapiens
cacatgaaggctggggtcgtga

SEQ ID NO: 87196 - DNA, 22 bp, Homo sapiens
tggcaccagggaacaagcattt

SEQ ID NO: 87197 - DNA, 22 bp, Homo sapiens
cctagagccgcacctcctccac

SEQ ID NO: 87198 - DNA, 22 bp, Homo sapiens
ctggctctcaggctggtcccca

SEQ ID NO: 87199 - DNA, 22 bp, Homo sapiens
gggcgcatcacctgaggtcagg

SEQ ID NO: 87200 - DNA, 19 bp, Homo sapiens
agggaatccggctgaggga

SEQ ID NO: 87201 - DNA, 22 bp, Homo sapiens
gtgcaaaagtaattgtggtttt

SEQ ID NO: 87202 - DNA, 22 bp, Homo sapiens
gtcgcttgaacccaggaagtgg

SEQ ID NO: 87203 - DNA, 22 bp, Homo sapiens
caggagctcagatgacatctca

SEQ ID NO: 87204 - DNA, 22 bp, Homo sapiens
ctcgcaagtcgctccggttact

SEQ ID NO: 87205 - DNA, 22 bp, Homo sapiens
atgccactgcgctccagcctgg

SEQ ID NO: 87206 - DNA, 22 bp, Homo sapiens
ggaactcctgctccaagcagct

SEQ ID NO: 87207 - DNA, 22 bp, Homo sapiens
gggagctgaaggagccggcggg

SEQ ID NO: 87208 - DNA, 22 bp, Homo sapiens
cctgggaggctgaggctgcagt

SEQ ID NO: 87209 - DNA, 22 bp, Homo sapiens
agcctctcagagtgctgggatt

SEQ ID NO: 87210 - DNA, 22 bp, Homo sapiens
tccttagacaaagagtgggctt

SEQ ID NO: 87211 - DNA, 22 bp, Homo sapiens
cactgcactccagcttgggtga

SEQ ID NO: 87212 - DNA, 22 bp, Homo sapiens
tctgcatattgttaatggaatg

SEQ ID NO: 87213 - DNA, 22 bp, Homo sapiens
ccttcccatgcagcctgtctga

SEQ ID NO: 87214 - DNA, 22 bp, Homo sapiens
taggtcagaacaagcagtatcg

SEQ ID NO: 87215 - DNA, 22 bp, Homo sapiens
ggcttgaagggaggaaagcagg

SEQ ID NO: 87216 - DNA, 22 bp, Homo sapiens
ggtgctggacacgtggcactcc

SEQ ID NO: 87217 - DNA, 22 bp, Homo sapiens
tttggtaagtacccacctgggt

SEQ ID NO: 87218 - DNA, 22 bp, Homo sapiens
actgcaacacctcctgggttca

SEQ ID NO: 87219 - DNA, 18 bp, Homo sapiens
gaggatggaaggagatgc

SEQ ID NO: 87220 - DNA, 19 bp, Homo sapiens
ggggcctgtgatggtcaca

SEQ ID NO: 87221 - DNA, 22 bp, Homo sapiens
ctgaggaggctaatttgaggat

SEQ ID NO: 87222 - DNA, 22 bp, Homo sapiens
gaggcaggaggattgcttgagc

SEQ ID NO: 87223 - DNA, 22 bp, Homo sapiens
atgctaaggcccaggagaaaat

SEQ ID NO: 87224 - DNA, 21 bp, Homo sapiens
ttggtagatgcagcaccagta

SEQ ID NO: 87225 - DNA, 22 bp, Homo sapiens
ggcctcgcggcttctggtggct

SEQ ID NO: 87226 - DNA, 22 bp, Homo sapiens
ttctcccctttagggcctacgg

SEQ ID NO: 87227 - DNA, 22 bp, Homo sapiens
cttgctttcagtctcggcctca

SEQ ID NO: 87228 - DNA, 22 bp, Homo sapiens
cccaggaggcagagatagcagt

SEQ ID NO: 87229 - DNA, 22 bp, Homo sapiens
gggagctggagctggaagactc

SEQ ID NO: 87230 - DNA, 22 bp, Homo sapiens
ggggatggaggcgtgtggtcct

SEQ ID NO: 87231 - DNA, 22 bp, Homo sapiens
gttgaggtgatgccagccctgc

SEQ ID NO: 87232 - DNA, 22 bp, Homo sapiens
tcattaatcccggggtccaggg

SEQ ID NO: 87233 - DNA, 22 bp, Homo sapiens
agaaggggcccaaggatgtcag

SEQ ID NO: 87234 - DNA, 22 bp, Homo sapiens
cgccggcttgaggcaggcggca

SEQ ID NO: 87235 - DNA, 17 bp, Homo sapiens
gggcagggactcctggg

SEQ ID NO: 87236 - DNA, 22 bp, Homo sapiens
gggcggatcacctgaggtcagg

SEQ ID NO: 87237 - DNA, 22 bp, Homo sapiens
cgagagatgggttggcaggggc

SEQ ID NO: 87238 - DNA, 22 bp, Homo sapiens
accaggcccgctgctatggtgg

SEQ ID NO: 87239 - DNA, 22 bp, Homo sapiens
gtggcagagccaaggctggagc

SEQ ID NO: 87240 - DNA, 22 bp, Homo sapiens
ccctctacagggaagcgctttc

SEQ ID NO: 87241 - DNA, 22 bp, Homo sapiens
cagcagcagtgttctagaatct

SEQ ID NO: 87242 - DNA, 22 bp, Homo sapiens
gggaggttgaggctgcagtgag

SEQ ID NO: 87243 - DNA, 22 bp, Homo sapiens
tccaggatggtgacggtggcca

SEQ ID NO: 87244 - DNA, 22 bp, Homo sapiens
gcccgcagagatctttaacaaa

SEQ ID NO: 87245 - DNA, 22 bp, Homo sapiens
gttatacgcctgtcaggaagct

SEQ ID NO: 87246 - DNA, 22 bp, Homo sapiens
gatgcgggcccgctccactgcc

SEQ ID NO: 87247 - DNA, 22 bp, Homo sapiens
aaagcctcccaggttatgagta

SEQ ID NO: 87248 - DNA, 22 bp, Homo sapiens
agtaaaactcacaaaaggatgg

SEQ ID NO: 87249 - DNA, 22 bp, Homo sapiens
ggccagaagttggaaaagagcc

SEQ ID NO: 87250 - DNA, 22 bp, Homo sapiens
gagccaggggtcagctccgagg

SEQ ID NO: 87251 - DNA, 22 bp, Homo sapiens
gggaagtgatggagccaggatt

SEQ ID NO: 87252 - DNA, 22 bp, Homo sapiens
cccaggaggttgaggctgcagt

SEQ ID NO: 87253 - DNA, 22 bp, Homo sapiens
tcctgggatcaagtgatcctcc

SEQ ID NO: 87254 - DNA, 22 bp, Homo sapiens
tctcgatctcctgaccttgtga

SEQ ID NO: 87255 - DNA, 22 bp, Homo sapiens
gtagaccatttatctggggagt

SEQ ID NO: 87256 - DNA, 20 bp, Homo sapiens
gccaacgcgctggggctgcc

SEQ ID NO: 87257 - DNA, 22 bp, Homo sapiens
gagccaggttggaggctgcagt

SEQ ID NO: 87258 - DNA, 22 bp, Homo sapiens
cctcgacctccccaggctcagg

SEQ ID NO: 87259 - DNA, 22 bp, Homo sapiens
gaggggctgccctggtgtcagg

SEQ ID NO: 87260 - DNA, 22 bp, Homo sapiens
gctgtgtatcagatgccacggg

SEQ ID NO: 87261 - DNA, 17 bp, Homo sapiens
tccttcagtgcctctgc

SEQ ID NO: 87262 - DNA, 22 bp, Homo sapiens
cccagtttcaactttccagtgg

SEQ ID NO: 87263 - DNA, 22 bp, Homo sapiens
ctgcttctagcaccaagtccct

SEQ ID NO: 87264 - DNA, 22 bp, Homo sapiens
ctgcactgacttccccggctgc

SEQ ID NO: 87265 - DNA, 22 bp, Homo sapiens
agaggaagtaatcaggacctgc

SEQ ID NO: 87266 - DNA, 22 bp, Homo sapiens
ttccatacgactgaggtctcgg

SEQ ID NO: 87267 - DNA, 22 bp, Homo sapiens
cccagcaggaggaggttgcagt

SEQ ID NO: 87268 - DNA, 22 bp, Homo sapiens
gggccatgagaggttcatcaac

SEQ ID NO: 87269 - DNA, 20 bp, Homo sapiens
ccagagctgatggctgcccg

SEQ ID NO: 87270 - DNA, 22 bp, Homo sapiens
agctacctgatccttcttctga

SEQ ID NO: 87271 - DNA, 22 bp, Homo sapiens
ggcagggcaggaaagtcaggaa

SEQ ID NO: 87272 - DNA, 22 bp, Homo sapiens
ggaggagcatgagagggtagtg

SEQ ID NO: 87273 - DNA, 22 bp, Homo sapiens
cctggctgacagcttaattcca

SEQ ID NO: 87274 - DNA, 22 bp, Homo sapiens
cccaggaggtggaggctgcagt

SEQ ID NO: 87275 - DNA, 22 bp, Homo sapiens
gctttatccgcttgacccttac

SEQ ID NO: 87276 - DNA, 22 bp, Homo sapiens
ggccactgacctacatctgggg

SEQ ID NO: 87277 - DNA, 22 bp, Homo sapiens
ttacaattacttgatctcagct

SEQ ID NO: 87278 - DNA, 22 bp, Homo sapiens
tgagccaagttcacaccattgc

SEQ ID NO: 87279 - DNA, 18 bp, Homo sapiens
gagtcgtcggagagtctg

SEQ ID NO: 87280 - DNA, 22 bp, Homo sapiens
gcggccttgtggcggagcaggc

SEQ ID NO: 87281 - DNA, 22 bp, Homo sapiens
tctcagggctcagagctcaggc

SEQ ID NO: 87282 - DNA, 22 bp, Homo sapiens
ccaagtagttgagactacaggt

SEQ ID NO: 87283 - DNA, 22 bp, Homo sapiens
gttaaggctgagcaggacactg

SEQ ID NO: 87284 - DNA, 23 bp, Homo sapiens
aggtaggttattgctgctacctg

SEQ ID NO: 87285 - DNA, 22 bp, Homo sapiens
cagtgacgtaaactgcatgtgc

SEQ ID NO: 87286 - DNA, 22 bp, Homo sapiens
ctgggcacagcgttgggctctt

SEQ ID NO: 87287 - DNA, 22 bp, Homo sapiens
agcccaggagtttgaggctgtg

SEQ ID NO: 87288 - DNA, 22 bp, Homo sapiens
tcgtgatctgtccacctcggcc

SEQ ID NO: 87289 - DNA, 22 bp, Homo sapiens
cacagagatggtctggcaggtg

SEQ ID NO: 87290 - DNA, 22 bp, Homo sapiens
aggtcaagagtaaatttgggta

SEQ ID NO: 87291 - DNA, 22 bp, Homo sapiens
ttagatttacaagcactgttta

SEQ ID NO: 87292 - DNA, 22 bp, Homo sapiens
tttacttcatttccagtgagga

SEQ ID NO: 87293 - DNA, 22 bp, Homo sapiens
gaccttcttgctgtgtcctaac

SEQ ID NO: 87294 - DNA, 22 bp, Homo sapiens
acggcttcttgactgtgggttg

SEQ ID NO: 87295 - DNA, 22 bp, Homo sapiens
ctctttggatagaattacaaag

SEQ ID NO: 87296 - DNA, 22 bp, Homo sapiens
gccggggctggggagagacatg

SEQ ID NO: 87297 - DNA, 23 bp, Homo sapiens
ctggggctttcaaatctgggcag

SEQ ID NO: 87298 - DNA, 22 bp, Homo sapiens
tatgaagtgatgttgaattttg

SEQ ID NO: 87299 - DNA, 22 bp, Homo sapiens
cggctgggttcggctgcaggcc

SEQ ID NO: 87300 - DNA, 22 bp, Homo sapiens
ttttacctgaaccacacagtat

SEQ ID NO: 87301 - DNA, 22 bp, Homo sapiens
aaagtgctgaaattacaggtgt

SEQ ID NO: 87302 - DNA, 22 bp, Homo sapiens
aaatggaagctatttatgattc

SEQ ID NO: 87303 - DNA, 22 bp, Homo sapiens
cgaggaggaaacgcggagaact

SEQ ID NO: 87304 - DNA, 22 bp, Homo sapiens
cagcagcattgctctggattcc

SEQ ID NO: 87305 - DNA, 22 bp, Homo sapiens
aagaagcattctttcattggtt

SEQ ID NO: 87306 - DNA, 22 bp, Homo sapiens
tgaggcaggtggattacaaggt

SEQ ID NO: 87307 - DNA, 22 bp, Homo sapiens
gccccagcctcccgagtagctg

SEQ ID NO: 87308 - DNA, 22 bp, Homo sapiens
tgtccccacccaaatctcatct

SEQ ID NO: 87309 - DNA, 22 bp, Homo sapiens
gcaggcagaggtggaggagaca

SEQ ID NO: 87310 - DNA, 22 bp, Homo sapiens
gcctccagcccacgcaggcctg

SEQ ID NO: 87311 - DNA, 22 bp, Homo sapiens
tataaagagtctcaaagaagtt

SEQ ID NO: 87312 - DNA, 22 bp, Homo sapiens
ttgctcttgaaaattgatgctg

SEQ ID NO: 87313 - DNA, 22 bp, Homo sapiens
agcctctctgttagtcactggg

SEQ ID NO: 87314 - DNA, 23 bp, Homo sapiens
atgtttgcagtaacccatcctgg

SEQ ID NO: 87315 - DNA, 22 bp, Homo sapiens
gctgcagacttctcatctcatt

SEQ ID NO: 87316 - DNA, 22 bp, Homo sapiens
tgtgaatggacaattaaatcta

SEQ ID NO: 87317 - DNA, 22 bp, Homo sapiens
gacctcgtgatccgcccgcttt

SEQ ID NO: 87318 - DNA, 22 bp, Homo sapiens
gtctttatttgagattgtcatt

SEQ ID NO: 87319 - DNA, 20 bp, Homo sapiens
ttcgctgggagtggccaggc

SEQ ID NO: 87320 - DNA, 20 bp, Homo sapiens
attagctcaggtgaggtcat

SEQ ID NO: 87321 - DNA, 22 bp, Homo sapiens
ggagtgactctcggggccacta

SEQ ID NO: 87322 - DNA, 22 bp, Homo sapiens
ctgcactgagcatctaacctta

SEQ ID NO: 87323 - DNA, 22 bp, Homo sapiens
ccaggctggagtgcaatggcgt

SEQ ID NO: 87324 - DNA, 22 bp, Homo sapiens
attataggcttgagccaccgtg

SEQ ID NO: 87325 - DNA, 20 bp, Homo sapiens
tgtccccaccaaaatttcat

SEQ ID NO: 87326 - DNA, 22 bp, Homo sapiens
caggagtccatctggcctggtg

SEQ ID NO: 87327 - DNA, 22 bp, Homo sapiens
ctcccagccttcgccagtctga

SEQ ID NO: 87328 - DNA, 22 bp, Homo sapiens
acttttaaatgagtttcagttg

SEQ ID NO: 87329 - DNA, 22 bp, Homo sapiens
cggtctcccgtgtgtgtgcgct

SEQ ID NO: 87330 - DNA, 22 bp, Homo sapiens
ctcctgggaaaggctggacaca

SEQ ID NO: 87331 - DNA, 22 bp, Homo sapiens
aaattacagccttgggtagctt

SEQ ID NO: 87332 - DNA, 22 bp, Homo sapiens
gcccaggaggagaggctgcagt

SEQ ID NO: 87333 - DNA, 22 bp, Homo sapiens
aagtagcagggattacaggtgt

SEQ ID NO: 87334 - DNA, 22 bp, Homo sapiens
ctgctccccagcctgcgccttt

SEQ ID NO: 87335 - DNA, 22 bp, Homo sapiens
accccaggaagtggaggtcatg

SEQ ID NO: 87336 - DNA, 22 bp, Homo sapiens
ggccgccctttccacggtttct

SEQ ID NO: 87337 - DNA, 22 bp, Homo sapiens
gtccaagagtcaagaagggggc

SEQ ID NO: 87338 - DNA, 22 bp, Homo sapiens
tggtagtcggcctcggtggctc

SEQ ID NO: 87339 - DNA, 22 bp, Homo sapiens
gcctcctgagtagctgggattg

SEQ ID NO: 87340 - DNA, 22 bp, Homo sapiens
gcctgatcaggtcctcggcata

SEQ ID NO: 87341 - DNA, 22 bp, Homo sapiens
ctgaggagaggtggcctgtgtt

SEQ ID NO: 87342 - DNA, 22 bp, Homo sapiens
cctgcttaacattgccatgaca

SEQ ID NO: 87343 - DNA, 23 bp, Homo sapiens
ctcctcgtaactctgtggtgggt

SEQ ID NO: 87344 - DNA, 22 bp, Homo sapiens
gccaggctgaggctctggaaga

SEQ ID NO: 87345 - DNA, 22 bp, Homo sapiens
tcacccctccattctctcatgt

SEQ ID NO: 87346 - DNA, 22 bp, Homo sapiens
gcagcctcaaactccccagctc

SEQ ID NO: 87347 - DNA, 22 bp, Homo sapiens
tgcgggtcccagggtcacaggc

SEQ ID NO: 87348 - DNA, 22 bp, Homo sapiens
tctaatcctatggtggggaggg

SEQ ID NO: 87349 - DNA, 22 bp, Homo sapiens
actgcaacctccacctcctggg

SEQ ID NO: 87350 - DNA, 20 bp, Homo sapiens
tttgaatgtaaagcatgtca

SEQ ID NO: 87351 - DNA, 22 bp, Homo sapiens
ccgcggggcgtgggctcttacc

SEQ ID NO: 87352 - DNA, 22 bp, Homo sapiens
gtaggtcagacataagaggaca

SEQ ID NO: 87353 - DNA, 22 bp, Homo sapiens
actcagtacatctggagttggc

SEQ ID NO: 87354 - DNA, 22 bp, Homo sapiens
tggcaccatcaaggctgagaac

SEQ ID NO: 87355 - DNA, 22 bp, Homo sapiens
tgtgttcagaatttgctgcttt

SEQ ID NO: 87356 - DNA, 20 bp, Homo sapiens
ggtggccgtagcgggcggcg

SEQ ID NO: 87357 - DNA, 22 bp, Homo sapiens
ccaggcagcctgctccattctg

SEQ ID NO: 87358 - DNA, 22 bp, Homo sapiens
aggtattattagcatctctatt

SEQ ID NO: 87359 - DNA, 22 bp, Homo sapiens
cactgcactccagcctgggtga

SEQ ID NO: 87360 - DNA, 22 bp, Homo sapiens
ggaaggggtgggtgagcctcag

SEQ ID NO: 87361 - DNA, 22 bp, Homo sapiens
ttccagctaactcacatccctt

SEQ ID NO: 87362 - DNA, 22 bp, Homo sapiens
ccccatgaagtagggtctctga

SEQ ID NO: 87363 - DNA, 22 bp, Homo sapiens
ctttaattgtagctcccataat

SEQ ID NO: 87364 - DNA, 22 bp, Homo sapiens
agatgtgtttctagttcctgca

SEQ ID NO: 87365 - DNA, 22 bp, Homo sapiens
tgagccaggagtttgaggctgt

SEQ ID NO: 87366 - DNA, 20 bp, Homo sapiens
agcagagtgcccatcccgga

SEQ ID NO: 87367 - DNA, 22 bp, Homo sapiens
tcaggggcttgaggtgcatgtc

SEQ ID NO: 87368 - DNA, 22 bp, Homo sapiens
gctccgccacgcccactcctac

SEQ ID NO: 87369 - DNA, 22 bp, Homo sapiens
ctcctgaattgtccctcacagc

SEQ ID NO: 87370 - DNA, 20 bp, Homo sapiens
tcacatcctctcccaacatg

SEQ ID NO: 87371 - DNA, 22 bp, Homo sapiens
cttagagatgggttttacttag

SEQ ID NO: 87372 - DNA, 22 bp, Homo sapiens
aggaaaatggaccagagttgtt

SEQ ID NO: 87373 - DNA, 22 bp, Homo sapiens
gacctcgtgatccgccctcctt

SEQ ID NO: 87374 - DNA, 22 bp, Homo sapiens
atgtttttaaatagacttacag

SEQ ID NO: 87375 - DNA, 22 bp, Homo sapiens
tcagtgactccttcttcctgct

SEQ ID NO: 87376 - DNA, 22 bp, Homo sapiens
acggtgctgggtattggggttc

SEQ ID NO: 87377 - DNA, 22 bp, Homo sapiens
gagccaggaggcagagactgca

SEQ ID NO: 87378 - DNA, 22 bp, Homo sapiens
ggctgcaggttggttggcagct

SEQ ID NO: 87379 - DNA, 22 bp, Homo sapiens
gcacatccaatgattgttttga

SEQ ID NO: 87380 - DNA, 19 bp, Homo sapiens
tgcctgctgtattccagag

SEQ ID NO: 87381 - DNA, 22 bp, Homo sapiens
tgagcaggcgcagcaggaggtc

SEQ ID NO: 87382 - DNA, 22 bp, Homo sapiens
catggcagctcctccagtgtga

SEQ ID NO: 87383 - DNA, 19 bp, Homo sapiens
acacagggatcagagggtt

SEQ ID NO: 87384 - DNA, 21 bp, Homo sapiens
ggcctcccggaccgcagcgcc

SEQ ID NO: 87385 - DNA, 22 bp, Homo sapiens
atccaccctgtggtggctttct

SEQ ID NO: 87386 - DNA, 22 bp, Homo sapiens
tgtctggtgggttgacaggcag

SEQ ID NO: 87387 - DNA, 22 bp, Homo sapiens
tttctggcagcgggacaggggt

SEQ ID NO: 87388 - DNA, 22 bp, Homo sapiens
caggagctcaagaccaccctgg

SEQ ID NO: 87389 - DNA, 22 bp, Homo sapiens
gggaggaggaatgttttgtgta

SEQ ID NO: 87390 - DNA, 22 bp, Homo sapiens
tgctcccaaacctgacaggctc

SEQ ID NO: 87391 - DNA, 22 bp, Homo sapiens
gacctcgtgatctgccagcctt

SEQ ID NO: 87392 - DNA, 22 bp, Homo sapiens
agtacccttttcactgtcacaa

SEQ ID NO: 87393 - DNA, 22 bp, Homo sapiens
ctgaggcaggatggcctggctg

SEQ ID NO: 87394 - DNA, 22 bp, Homo sapiens
tggctccacaggccagggtgtg

SEQ ID NO: 87395 - DNA, 22 bp, Homo sapiens
atgccactgcactccagcctag

SEQ ID NO: 87396 - DNA, 22 bp, Homo sapiens
ctgggaggcagaggttgcagtg

SEQ ID NO: 87397 - DNA, 22 bp, Homo sapiens
taaggcaggaactggctgtttt

SEQ ID NO: 87398 - DNA, 22 bp, Homo sapiens
gtttgtgcgggacatgatccgg

SEQ ID NO: 87399 - DNA, 22 bp, Homo sapiens
caggcagaagaagtggaaggac

SEQ ID NO: 87400 - DNA, 22 bp, Homo sapiens
atgaaatatcttgaagaaattc

SEQ ID NO: 87401 - DNA, 22 bp, Homo sapiens
atgaaaacggaccagagctatt

SEQ ID NO: 87402 - DNA, 22 bp, Homo sapiens
gggagaggttacccgagcaact

SEQ ID NO: 87403 - DNA, 22 bp, Homo sapiens
aagttactggcaagggctgcag

SEQ ID NO: 87404 - DNA, 22 bp, Homo sapiens
aggcaggaggatcatggatgca

SEQ ID NO: 87405 - DNA, 22 bp, Homo sapiens
ggaggcggaagttgcagtgagc

SEQ ID NO: 87406 - DNA, 22 bp, Homo sapiens
gccttattacctgcactttgaa

SEQ ID NO: 87407 - DNA, 22 bp, Homo sapiens
tacaaaaaattgatactgacga

SEQ ID NO: 87408 - DNA, 22 bp, Homo sapiens
tgaggcaggaggttgagaactg

SEQ ID NO: 87409 - DNA, 22 bp, Homo sapiens
aaaatcctgctgactcgagatg

SEQ ID NO: 87410 - DNA, 22 bp, Homo sapiens
gtgcttccatctagagggtcac

SEQ ID NO: 87411 - DNA, 18 bp, Homo sapiens
atgagaggtgtcagaaga

SEQ ID NO: 87412 - DNA, 22 bp, Homo sapiens
tctgtcttagccatctcaggct

SEQ ID NO: 87413 - DNA, 22 bp, Homo sapiens
ttctttgcccatgtttcctaag

SEQ ID NO: 87414 - DNA, 22 bp, Homo sapiens
gctggcagacttcctctggaac

SEQ ID NO: 87415 - DNA, 22 bp, Homo sapiens
gctccctggtagccatgctctc

SEQ ID NO: 87416 - DNA, 22 bp, Homo sapiens
ggcttcgcagctcggcagccgc

SEQ ID NO: 87417 - DNA, 22 bp, Homo sapiens
tgaaatgttaaacaagtggctc

SEQ ID NO: 87418 - DNA, 21 bp, Homo sapiens
ctggaggcaggtggtgccagg

SEQ ID NO: 87419 - DNA, 22 bp, Homo sapiens
aatgttacgatcaacaacacat

SEQ ID NO: 87420 - DNA, 20 bp, Homo sapiens
ataaaataactgccacaaga

SEQ ID NO: 87421 - DNA, 22 bp, Homo sapiens
aggcaaggtgctacagacagtg

SEQ ID NO: 87422 - DNA, 22 bp, Homo sapiens
gcagggcacaaggacgcacagg

SEQ ID NO: 87423 - DNA, 22 bp, Homo sapiens
taggaatggtgctcagcagaaa

SEQ ID NO: 87424 - DNA, 22 bp, Homo sapiens
ggcatagatttctttaggttta

SEQ ID NO: 87425 - DNA, 22 bp, Homo sapiens
ctgtccccacccaaatctcatc

SEQ ID NO: 87426 - DNA, 22 bp, Homo sapiens
cactaggcgccgggtggctgtg

SEQ ID NO: 87427 - DNA, 22 bp, Homo sapiens
tgatcagcatcttcccagctcg

SEQ ID NO: 87428 - DNA, 22 bp, Homo sapiens
tcggggtctttgacacgctctg

SEQ ID NO: 87429 - DNA, 22 bp, Homo sapiens
cggagcctgcttgttgcagctg

SEQ ID NO: 87430 - DNA, 22 bp, Homo sapiens
ggagtgctttgaagccttcatt

SEQ ID NO: 87431 - DNA, 23 bp, Homo sapiens
gtgcgccaggacaacctgacgga

SEQ ID NO: 87432 - DNA, 22 bp, Homo sapiens
tgtagctctccagccagcaagg

SEQ ID NO: 87433 - DNA, 22 bp, Homo sapiens
gttactcttccccggggtctgg

SEQ ID NO: 87434 - DNA, 22 bp, Homo sapiens
aacagtgtttttcttcagcact

SEQ ID NO: 87435 - DNA, 19 bp, Homo sapiens
catggtgaaaccccgtctc

SEQ ID NO: 87436 - DNA, 22 bp, Homo sapiens
ctcaagtgtgagttttaaagtc

SEQ ID NO: 87437 - DNA, 22 bp, Homo sapiens
ggttggacactaggtaggagcg

SEQ ID NO: 87438 - DNA, 22 bp, Homo sapiens
cagaggaacgtttggattgatt

SEQ ID NO: 87439 - DNA, 22 bp, Homo sapiens
ggtgggagagcttgctttgatg

SEQ ID NO: 87440 - DNA, 22 bp, Homo sapiens
cctgggctctgtcagaattggg

SEQ ID NO: 87441 - DNA, 23 bp, Homo sapiens
agagcaaggaaatgaggtgtgat

SEQ ID NO: 87442 - DNA, 22 bp, Homo sapiens
tcacttcccagacggggtggca

SEQ ID NO: 87443 - DNA, 22 bp, Homo sapiens
ggtccccgtggaggctggagcg

SEQ ID NO: 87444 - DNA, 21 bp, Homo sapiens
tgaaggggtggcagtgtgctt

SEQ ID NO: 87445 - DNA, 22 bp, Homo sapiens
cattgctttgtgcatatttaaa

SEQ ID NO: 87446 - DNA, 22 bp, Homo sapiens
gtcagaggggcagctgccaggc

SEQ ID NO: 87447 - DNA, 22 bp, Homo sapiens
tcacattttcaaaagctggtgc

SEQ ID NO: 87448 - DNA, 22 bp, Homo sapiens
atggcaccttccccagagctca

SEQ ID NO: 87449 - DNA, 22 bp, Homo sapiens
gagccagactgcctgaagctca

SEQ ID NO: 87450 - DNA, 22 bp, Homo sapiens
tagccgggtgtggtggaactcc

SEQ ID NO: 87451 - DNA, 22 bp, Homo sapiens
cctagatgggatggcggccggg

SEQ ID NO: 87452 - DNA, 22 bp, Homo sapiens
gggaggcagtgctggaggctgg

SEQ ID NO: 87453 - DNA, 22 bp, Homo sapiens
ggtgggagagctctgtctccag

SEQ ID NO: 87454 - DNA, 18 bp, Homo sapiens
ttgcttcttttctctagg

SEQ ID NO: 87455 - DNA, 22 bp, Homo sapiens
tgaggcaggacttgcataaagt

SEQ ID NO: 87456 - DNA, 22 bp, Homo sapiens
tttattctgtgctacatgaaga

SEQ ID NO: 87457 - DNA, 22 bp, Homo sapiens
tgggaagggtcaacagctggaa

SEQ ID NO: 87458 - DNA, 21 bp, Homo sapiens
accactgcctccaaggttcag

SEQ ID NO: 87459 - DNA, 22 bp, Homo sapiens
aacctcaaactcttgggcttaa

SEQ ID NO: 87460 - DNA, 22 bp, Homo sapiens
agcataagttggtacagccact

SEQ ID NO: 87461 - DNA, 22 bp, Homo sapiens
ttcattcttcagagctgcgctt

SEQ ID NO: 87462 - DNA, 23 bp, Homo sapiens
gggggccgtcctggggattatag

SEQ ID NO: 87463 - DNA, 22 bp, Homo sapiens
aaggtgggtggatcacgaggtc

SEQ ID NO: 87464 - DNA, 22 bp, Homo sapiens
agggaaattaatgtgagcaatg

SEQ ID NO: 87465 - DNA, 21 bp, Homo sapiens
ctcccagggtgactgttcaac

SEQ ID NO: 87466 - DNA, 22 bp, Homo sapiens
ggctcctgggggtgctcctgcc

SEQ ID NO: 87467 - DNA, 22 bp, Homo sapiens
tctttctacatcatttgcttct

SEQ ID NO: 87468 - DNA, 22 bp, Homo sapiens
gatctgtgtgattggatgcatt

SEQ ID NO: 87469 - DNA, 21 bp, Homo sapiens
acacaggcagtgtcccgaggt

SEQ ID NO: 87470 - DNA, 22 bp, Homo sapiens
ggggtgtggacggctgtgccag

SEQ ID NO: 87471 - DNA, 22 bp, Homo sapiens
tgttttaagctctagaagggga

SEQ ID NO: 87472 - DNA, 16 bp, Homo sapiens
tgcggcaacttgcggc

SEQ ID NO: 87473 - DNA, 22 bp, Homo sapiens
aaggctccagtgaatgctggca

SEQ ID NO: 87474 - DNA, 22 bp, Homo sapiens
gaggctggacgtgcatttctac

SEQ ID NO: 87475 - DNA, 22 bp, Homo sapiens
gcggcaggagtaaaggaggaag

SEQ ID NO: 87476 - DNA, 22 bp, Homo sapiens
agggctggagccacagctggga

SEQ ID NO: 87477 - DNA, 20 bp, Homo sapiens
gtctccactgggggttaacc

SEQ ID NO: 87478 - DNA, 22 bp, Homo sapiens
gctcccaggatgaggagccagg

SEQ ID NO: 87479 - DNA, 22 bp, Homo sapiens
tttgctgctgtatatggagccc

SEQ ID NO: 87480 - DNA, 22 bp, Homo sapiens
ctggcctcggcagcaggaacag

SEQ ID NO: 87481 - DNA, 22 bp, Homo sapiens
gttatataagacaaatcagagt

SEQ ID NO: 87482 - DNA, 22 bp, Homo sapiens
tcctcagaatcacctggcagct

SEQ ID NO: 87483 - DNA, 22 bp, Homo sapiens
gtagtgggtggaaatgactaca

SEQ ID NO: 87484 - DNA, 22 bp, Homo sapiens
cagagatgtgatccagctgtct

SEQ ID NO: 87485 - DNA, 22 bp, Homo sapiens
gaagattgaaggctgggaatta

SEQ ID NO: 87486 - DNA, 22 bp, Homo sapiens
ttctctgcctcacaggtctaag

SEQ ID NO: 87487 - DNA, 22 bp, Homo sapiens
aaagaaatagatggcatttaaa

SEQ ID NO: 87488 - DNA, 19 bp, Homo sapiens
gctgaggtggaggaaggag

SEQ ID NO: 87489 - DNA, 22 bp, Homo sapiens
aggaaggactccatggtccgtc

SEQ ID NO: 87490 - DNA, 22 bp, Homo sapiens
agtctacaaagggaagcccttt

SEQ ID NO: 87491 - DNA, 22 bp, Homo sapiens
caagtagaacagagctaccttg

SEQ ID NO: 87492 - DNA, 22 bp, Homo sapiens
tagaaaagccccagctggaggg

SEQ ID NO: 87493 - DNA, 22 bp, Homo sapiens
tctctcttttttgaacccgctc

SEQ ID NO: 87494 - DNA, 19 bp, Homo sapiens
ccctcttgcacaaagcaaa

SEQ ID NO: 87495 - DNA, 22 bp, Homo sapiens
gctgctctccaagcctccttga

SEQ ID NO: 87496 - DNA, 22 bp, Homo sapiens
ggctgggcctctccctcagctg

SEQ ID NO: 87497 - DNA, 22 bp, Homo sapiens
atagagtgatgtaaggtatgtg

SEQ ID NO: 87498 - DNA, 22 bp, Homo sapiens
gttcaagaccagcctggccaac

SEQ ID NO: 87499 - DNA, 22 bp, Homo sapiens
gcaaatacatgttgagcaccta

SEQ ID NO: 87500 - DNA, 20 bp, Homo sapiens
tctgccacgtctggtgactg

SEQ ID NO: 87501 - DNA, 22 bp, Homo sapiens
agtgaccgaggcacttggcaac

SEQ ID NO: 87502 - DNA, 21 bp, Homo sapiens
tctgatggtagatgagatgtg

SEQ ID NO: 87503 - DNA, 22 bp, Homo sapiens
gatggaggagatggcagggtgc

SEQ ID NO: 87504 - DNA, 22 bp, Homo sapiens
taggcctggatctctgggagca

SEQ ID NO: 87505 - DNA, 22 bp, Homo sapiens
agttggagtgaacatgagattg

SEQ ID NO: 87506 - DNA, 22 bp, Homo sapiens
gcgggccaccttggagagcgct

SEQ ID NO: 87507 - DNA, 22 bp, Homo sapiens
tggaagggagctggaatttgga

SEQ ID NO: 87508 - DNA, 22 bp, Homo sapiens
agccttcggccagagggtggcc

SEQ ID NO: 87509 - DNA, 22 bp, Homo sapiens
ggcaggtcaggtccatgaccaa

SEQ ID NO: 87510 - DNA, 22 bp, Homo sapiens
ggggccttttctgaatgtggaa

SEQ ID NO: 87511 - DNA, 22 bp, Homo sapiens
acgcccagactcccatactttg

SEQ ID NO: 87512 - DNA, 22 bp, Homo sapiens
cattctgcgatcctcaagcaca

SEQ ID NO: 87513 - DNA, 22 bp, Homo sapiens
acaggtcctcaagtcagctggg

SEQ ID NO: 87514 - DNA, 22 bp, Homo sapiens
tgaggcaggagttcaggctgcg

SEQ ID NO: 87515 - DNA, 22 bp, Homo sapiens
ttgcttcctctagtttcttgaa

SEQ ID NO: 87516 - DNA, 22 bp, Homo sapiens
ggggtgggcgtgcagggacacc

SEQ ID NO: 87517 - DNA, 22 bp, Homo sapiens
cgcggtggcggcctccagcgcc

SEQ ID NO: 87518 - DNA, 22 bp, Homo sapiens
acgtgcaggatctggttggcga

SEQ ID NO: 87519 - DNA, 22 bp, Homo sapiens
gcctgtgtggatgcgccggtgc

SEQ ID NO: 87520 - DNA, 22 bp, Homo sapiens
tggtgctgccaggctcctgcca

SEQ ID NO: 87521 - DNA, 22 bp, Homo sapiens
agctcttacatttaggtctatg

SEQ ID NO: 87522 - DNA, 22 bp, Homo sapiens
tgagcttccctcctgcactaca

SEQ ID NO: 87523 - DNA, 22 bp, Homo sapiens
ctacaaaagtaattgtggtttt

SEQ ID NO: 87524 - DNA, 22 bp, Homo sapiens
ctccaggctcgtccaagatcga

SEQ ID NO: 87525 - DNA, 22 bp, Homo sapiens
ggaggcagaatagagtgtgggt

SEQ ID NO: 87526 - DNA, 22 bp, Homo sapiens
tattagttgcaaaacattgact

SEQ ID NO: 87527 - DNA, 22 bp, Homo sapiens
tgagatgaataactcctgctaa

SEQ ID NO: 87528 - DNA, 22 bp, Homo sapiens
tctgaggctgaatggactccgt

SEQ ID NO: 87529 - DNA, 22 bp, Homo sapiens
ctggtgtggactccgcgcggag

SEQ ID NO: 87530 - DNA, 22 bp, Homo sapiens
aggtggggaggagtgtctcttt

SEQ ID NO: 87531 - DNA, 22 bp, Homo sapiens
cagggtgctgcaccatccctca

SEQ ID NO: 87532 - DNA, 22 bp, Homo sapiens
tgaaggggttcagcatgggggt

SEQ ID NO: 87533 - DNA, 18 bp, Homo sapiens
tcctttctccctcatctt

SEQ ID NO: 87534 - DNA, 22 bp, Homo sapiens
gtgggctgcccttgaggtcagc

SEQ ID NO: 87535 - DNA, 22 bp, Homo sapiens
ttattttaccttcctctgagct

SEQ ID NO: 87536 - DNA, 22 bp, Homo sapiens
ttcagagaattggataattcgt

SEQ ID NO: 87537 - DNA, 22 bp, Homo sapiens
tgcacgtgggctctctgctctt

SEQ ID NO: 87538 - DNA, 22 bp, Homo sapiens
ggcagcactgcagcttgttggg

SEQ ID NO: 87539 - DNA, 22 bp, Homo sapiens
gctgacccctacaggttgtgtt

SEQ ID NO: 87540 - DNA, 22 bp, Homo sapiens
tgagccatgggactccaaggga

SEQ ID NO: 87541 - DNA, 22 bp, Homo sapiens
aatggaatacctaggtggccca

SEQ ID NO: 87542 - DNA, 22 bp, Homo sapiens
aaagcagaggttgcagtgagct

SEQ ID NO: 87543 - DNA, 22 bp, Homo sapiens
tctcgctctgtcgcccaggctg

SEQ ID NO: 87544 - DNA, 22 bp, Homo sapiens
gcttcaaactgagcttcaagtg

SEQ ID NO: 87545 - DNA, 22 bp, Homo sapiens
cagagggttgatgtgaggctta

SEQ ID NO: 87546 - DNA, 22 bp, Homo sapiens
aataaacaaaggacaaggaggt

SEQ ID NO: 87547 - DNA, 22 bp, Homo sapiens
gggttgaggcggatgtcggcgg

SEQ ID NO: 87548 - DNA, 22 bp, Homo sapiens
gcctgtgtctgggtggccagag

SEQ ID NO: 87549 - DNA, 21 bp, Homo sapiens
ggtgtgggatggactgaacca

SEQ ID NO: 87550 - DNA, 22 bp, Homo sapiens
aggacaaaggaccagatctgga

SEQ ID NO: 87551 - DNA, 22 bp, Homo sapiens
ttttctcttccctctggacctg

SEQ ID NO: 87552 - DNA, 22 bp, Homo sapiens
ttcctaagtcctgccagcagtc

SEQ ID NO: 87553 - DNA, 22 bp, Homo sapiens
ttcctagggcagagccgctggg

SEQ ID NO: 87554 - DNA, 22 bp, Homo sapiens
cccaggaggtcaaggctgcagt

SEQ ID NO: 87555 - DNA, 22 bp, Homo sapiens
tctcgacagcctggcacagtgg

SEQ ID NO: 87556 - DNA, 22 bp, Homo sapiens
agctttacctgccttggggcac

SEQ ID NO: 87557 - DNA, 22 bp, Homo sapiens
tgaatgtgatgctaaacatatg

SEQ ID NO: 87558 - DNA, 22 bp, Homo sapiens
aggactgggtgcagagggcatc

SEQ ID NO: 87559 - DNA, 22 bp, Homo sapiens
ttacactttaaatccagcttgt

SEQ ID NO: 87560 - DNA, 22 bp, Homo sapiens
ttgagatggagtctcgcactgt

SEQ ID NO: 87561 - DNA, 22 bp, Homo sapiens
caggctggagtgcagtggggcg

SEQ ID NO: 87562 - DNA, 22 bp, Homo sapiens
ttacaaagtttaaggtggcact

SEQ ID NO: 87563 - DNA, 22 bp, Homo sapiens
agcccaggttgaggctgcagtg

SEQ ID NO: 87564 - DNA, 22 bp, Homo sapiens
ataaaaactgacccatcctttg

SEQ ID NO: 87565 - DNA, 22 bp, Homo sapiens
gtgtgggctgcagaggcacagc

SEQ ID NO: 87566 - DNA, 22 bp, Homo sapiens
tgattatgcatgagacagtact

SEQ ID NO: 87567 - DNA, 22 bp, Homo sapiens
agaggcaggaggttgacttgag

SEQ ID NO: 87568 - DNA, 22 bp, Homo sapiens
gctgaggctcctcgggaggaca

SEQ ID NO: 87569 - DNA, 22 bp, Homo sapiens
gttatgatggcaccactgcact

SEQ ID NO: 87570 - DNA, 22 bp, Homo sapiens
tgctgaataagacgtggcttgt

SEQ ID NO: 87571 - DNA, 22 bp, Homo sapiens
gaggtggccaagcgaggaaggg

SEQ ID NO: 87572 - DNA, 22 bp, Homo sapiens
ggctcacgcaattatcccggcc

SEQ ID NO: 87573 - DNA, 23 bp, Homo sapiens
cagtgtgacaaaacttattactt

SEQ ID NO: 87574 - DNA, 22 bp, Homo sapiens
cgtcatcacggcaagcatctcc

SEQ ID NO: 87575 - DNA, 22 bp, Homo sapiens
cctccaaccataggtccagggg

SEQ ID NO: 87576 - DNA, 22 bp, Homo sapiens
ggagaggggaacttgttgcttg

SEQ ID NO: 87577 - DNA, 22 bp, Homo sapiens
cataaaaggtagcagtttgaaa

SEQ ID NO: 87578 - DNA, 22 bp, Homo sapiens
tatttaataaaactatggcatg

SEQ ID NO: 87579 - DNA, 22 bp, Homo sapiens
tcgctgaggctgcacggctgcc

SEQ ID NO: 87580 - DNA, 22 bp, Homo sapiens
ggaggtggagctggaagttcca

SEQ ID NO: 87581 - DNA, 22 bp, Homo sapiens
caggctggagtgcaatgacgcc

SEQ ID NO: 87582 - DNA, 22 bp, Homo sapiens
caaaatgcatctgagaccaggc

SEQ ID NO: 87583 - DNA, 22 bp, Homo sapiens
ggcagggagtggagactcccta

SEQ ID NO: 87584 - DNA, 22 bp, Homo sapiens
gggctgggattgcttgctgtga

SEQ ID NO: 87585 - DNA, 22 bp, Homo sapiens
ggtcgctgtgtaggttcagcta

SEQ ID NO: 87586 - DNA, 22 bp, Homo sapiens
cctcccctcagacagagactgg

SEQ ID NO: 87587 - DNA, 22 bp, Homo sapiens
ttgccttgttattctctcagaa

SEQ ID NO: 87588 - DNA, 22 bp, Homo sapiens
agttcgagatctgctgatgaga

SEQ ID NO: 87589 - DNA, 22 bp, Homo sapiens
ggctagggatctagaccaggac

SEQ ID NO: 87590 - DNA, 22 bp, Homo sapiens
aatctgttgatgcaaacctccc

SEQ ID NO: 87591 - DNA, 22 bp, Homo sapiens
tcgtctgtgaaattgggataag

SEQ ID NO: 87592 - DNA, 19 bp, Homo sapiens
tcctgcctggggccgcctg

SEQ ID NO: 87593 - DNA, 22 bp, Homo sapiens
ttgtgcttgccctggaggtgcg

SEQ ID NO: 87594 - DNA, 22 bp, Homo sapiens
tccctgatgccttgatccgtgg

SEQ ID NO: 87595 - DNA, 22 bp, Homo sapiens
tactgtgtgcccagccgagctg

SEQ ID NO: 87596 - DNA, 21 bp, Homo sapiens
aggcatgagccctgcatggac

SEQ ID NO: 87597 - DNA, 22 bp, Homo sapiens
gggagctgagctggaagagaat

SEQ ID NO: 87598 - DNA, 22 bp, Homo sapiens
gcaaggtctttcagaaaggaaa

SEQ ID NO: 87599 - DNA, 22 bp, Homo sapiens
gaggggagcccccatcctccag

SEQ ID NO: 87600 - DNA, 22 bp, Homo sapiens
gaggcagaagttgcagtgagca

SEQ ID NO: 87601 - DNA, 20 bp, Homo sapiens
aggctgttgacggctgcctc

SEQ ID NO: 87602 - DNA, 22 bp, Homo sapiens
tacagaggaggggattttaata

SEQ ID NO: 87603 - DNA, 22 bp, Homo sapiens
caggctggagtgcagtggtgcc

SEQ ID NO: 87604 - DNA, 22 bp, Homo sapiens
gggcttcagttctgaccatctt

SEQ ID NO: 87605 - DNA, 20 bp, Homo sapiens
cagagccagggttttgtttt

SEQ ID NO: 87606 - DNA, 22 bp, Homo sapiens
tacaggcatgtagcatggtgat

SEQ ID NO: 87607 - DNA, 22 bp, Homo sapiens
tagaggattttgcatttcatat

SEQ ID NO: 87608 - DNA, 22 bp, Homo sapiens
taatcctgtcttgaccatcagg

SEQ ID NO: 87609 - DNA, 22 bp, Homo sapiens
tcctagttctctgccagtcgct

SEQ ID NO: 87610 - DNA, 22 bp, Homo sapiens
tcactgcaacctccacctcctg

SEQ ID NO: 87611 - DNA, 22 bp, Homo sapiens
gaatttaagaggatgaatctgt

SEQ ID NO: 87612 - DNA, 20 bp, Homo sapiens
aactcctagcctcaagtgat

SEQ ID NO: 87613 - DNA, 23 bp, Homo sapiens
cagagctggcttcatgggtgtgc

SEQ ID NO: 87614 - DNA, 22 bp, Homo sapiens
gcaccactacactccagcctgg

SEQ ID NO: 87615 - DNA, 21 bp, Homo sapiens
accctgctttatgccgtcctc

SEQ ID NO: 87616 - DNA, 22 bp, Homo sapiens
cctgccagagcagcttgtcctc

SEQ ID NO: 87617 - DNA, 22 bp, Homo sapiens
tgaactcctgacctcatgatcc

SEQ ID NO: 87618 - DNA, 22 bp, Homo sapiens
gcagcctgggcaacagagtgag

SEQ ID NO: 87619 - DNA, 22 bp, Homo sapiens
cccacgtcgaacttgctccaga

SEQ ID NO: 87620 - DNA, 22 bp, Homo sapiens
atcatcctagaaggaagctagg

SEQ ID NO: 87621 - DNA, 22 bp, Homo sapiens
ccgggcctcgggacaccgggta

SEQ ID NO: 87622 - DNA, 22 bp, Homo sapiens
ctggcttttttcccattatgca

SEQ ID NO: 87623 - DNA, 18 bp, Homo sapiens
aggcttacagcagcaggc

SEQ ID NO: 87624 - DNA, 22 bp, Homo sapiens
tgggcaggggccctgcttccgt

SEQ ID NO: 87625 - DNA, 22 bp, Homo sapiens
gaaggagccgagctcttcccca

SEQ ID NO: 87626 - DNA, 22 bp, Homo sapiens
gtgctccctccttcctcaagga

SEQ ID NO: 87627 - DNA, 22 bp, Homo sapiens
ggctggacgatctccccttcct

SEQ ID NO: 87628 - DNA, 22 bp, Homo sapiens
ccttggcaggcacgtcctgcgg

SEQ ID NO: 87629 - DNA, 22 bp, Homo sapiens
cctggcaggtggcgccctcggc

SEQ ID NO: 87630 - DNA, 19 bp, Homo sapiens
actggcacacaggggctgc

SEQ ID NO: 87631 - DNA, 22 bp, Homo sapiens
cccaggccctggcagagcttgt

SEQ ID NO: 87632 - DNA, 22 bp, Homo sapiens
cgagcatgatgacggctgtggc

SEQ ID NO: 87633 - DNA, 22 bp, Homo sapiens
tttgttttcaatgtgtcattca

SEQ ID NO: 87634 - DNA, 22 bp, Homo sapiens
ggtgcagaggagccagctgggg

SEQ ID NO: 87635 - DNA, 22 bp, Homo sapiens
cccaggaggtcgaagctgcagt

SEQ ID NO: 87636 - DNA, 22 bp, Homo sapiens
tgaacatgctgttgatggcctg

SEQ ID NO: 87637 - DNA, 22 bp, Homo sapiens
tcccctggtgccacgatctgct

SEQ ID NO: 87638 - DNA, 22 bp, Homo sapiens
gcttccgcgatgtcctaggtgg

SEQ ID NO: 87639 - DNA, 22 bp, Homo sapiens
gagctcattcattcattgcctg

SEQ ID NO: 87640 - DNA, 22 bp, Homo sapiens
gggcgccgtgggaaacagccgg

SEQ ID NO: 87641 - DNA, 22 bp, Homo sapiens
tcaccttgtgatctccctgcct

SEQ ID NO: 87642 - DNA, 22 bp, Homo sapiens
tttcttctatgtgtgatatttt

SEQ ID NO: 87643 - DNA, 22 bp, Homo sapiens
ttttgagatggagtcttgctct

SEQ ID NO: 87644 - DNA, 22 bp, Homo sapiens
cggcatgggcgtccccctcact

SEQ ID NO: 87645 - DNA, 22 bp, Homo sapiens
gcagaggacacaggagggcaag

SEQ ID NO: 87646 - DNA, 22 bp, Homo sapiens
tcccagattcctgctcttatat

SEQ ID NO: 87647 - DNA, 22 bp, Homo sapiens
ttctcagtgaagtttagaacat

SEQ ID NO: 87648 - DNA, 22 bp, Homo sapiens
ctgggaggcggagcttgcagtg

SEQ ID NO: 87649 - DNA, 22 bp, Homo sapiens
gcccaggagttcaagtctagtg

SEQ ID NO: 87650 - DNA, 22 bp, Homo sapiens
caaggtagttctggtcattgac

SEQ ID NO: 87651 - DNA, 22 bp, Homo sapiens
attttttgttaactcaggatag

SEQ ID NO: 87652 - DNA, 22 bp, Homo sapiens
tcgcccaggctggaagtgcagt

SEQ ID NO: 87653 - DNA, 22 bp, Homo sapiens
ggaggcccagaaggaagcccag

SEQ ID NO: 87654 - DNA, 22 bp, Homo sapiens
ctttggctggcaccccagcggg

SEQ ID NO: 87655 - DNA, 22 bp, Homo sapiens
cccaggcttttctcttgcccca

SEQ ID NO: 87656 - DNA, 22 bp, Homo sapiens
ctgtggccagagcgccgttgac

SEQ ID NO: 87657 - DNA, 22 bp, Homo sapiens
ctgaggctggagtgcagtggtg

SEQ ID NO: 87658 - DNA, 22 bp, Homo sapiens
ctggcagagttgggtctcaaat

SEQ ID NO: 87659 - DNA, 22 bp, Homo sapiens
tagcttatcccacagtgcccag

SEQ ID NO: 87660 - DNA, 22 bp, Homo sapiens
gctgcagctgtaggacacaatt

SEQ ID NO: 87661 - DNA, 22 bp, Homo sapiens
tgggaggccaaggcaggcggat

SEQ ID NO: 87662 - DNA, 22 bp, Homo sapiens
cggtcaggtgcagcgttggcac

SEQ ID NO: 87663 - DNA, 22 bp, Homo sapiens
gggtccagtagttggtggccgt

SEQ ID NO: 87664 - DNA, 22 bp, Homo sapiens
tgcaggctgtgtcatttagtga

SEQ ID NO: 87665 - DNA, 22 bp, Homo sapiens
ctccagttggccccagttggtt

SEQ ID NO: 87666 - DNA, 22 bp, Homo sapiens
gaggcagaggttgcagtgagct

SEQ ID NO: 87667 - DNA, 22 bp, Homo sapiens
ctaggctggagtgcagtggcac

SEQ ID NO: 87668 - DNA, 22 bp, Homo sapiens
ccatgtacatgaacacggcggc

SEQ ID NO: 87669 - DNA, 22 bp, Homo sapiens
gtggattacaagacagttgaga

SEQ ID NO: 87670 - DNA, 22 bp, Homo sapiens
ccctggaggttgaggctgcagt

SEQ ID NO: 87671 - DNA, 22 bp, Homo sapiens
gggttggcatcagggttctgtg

SEQ ID NO: 87672 - DNA, 22 bp, Homo sapiens
accagcctggccaacatggcaa

SEQ ID NO: 87673 - DNA, 22 bp, Homo sapiens
ttcattttctttcacgctgctg

SEQ ID NO: 87674 - DNA, 22 bp, Homo sapiens
gaggtaggtgtaggaggcctgc

SEQ ID NO: 87675 - DNA, 22 bp, Homo sapiens
gggaggcacgaggcgcgcagtg

SEQ ID NO: 87676 - DNA, 22 bp, Homo sapiens
cggggttcatccatgctgtggc

SEQ ID NO: 87677 - DNA, 22 bp, Homo sapiens
gcaggtccagtcaccagagaga

SEQ ID NO: 87678 - DNA, 22 bp, Homo sapiens
gacctcgtgatctgccggcctt

SEQ ID NO: 87679 - DNA, 22 bp, Homo sapiens
tgggcagggagctggaaccaca

SEQ ID NO: 87680 - DNA, 22 bp, Homo sapiens
taacatttaaatttttcacata

SEQ ID NO: 87681 - DNA, 22 bp, Homo sapiens
ttctcttttcaccagttgctaa

SEQ ID NO: 87682 - DNA, 22 bp, Homo sapiens
ccctggaggcggagcttgcagt

SEQ ID NO: 87683 - DNA, 22 bp, Homo sapiens
gtggagggtgattgccggctgt

SEQ ID NO: 87684 - DNA, 22 bp, Homo sapiens
actgcaaagggaagccctttct

SEQ ID NO: 87685 - DNA, 22 bp, Homo sapiens
acccgggaggcaggagtcatag

SEQ ID NO: 87686 - DNA, 22 bp, Homo sapiens
ctcattgcagctgcattactgt

SEQ ID NO: 87687 - DNA, 22 bp, Homo sapiens
atggagttctgccagcgctgct

SEQ ID NO: 87688 - DNA, 22 bp, Homo sapiens
ggaggctgagaggtcgcagtgg

SEQ ID NO: 87689 - DNA, 22 bp, Homo sapiens
tccaggctttggggcaggagcg

SEQ ID NO: 87690 - DNA, 22 bp, Homo sapiens
ttcagcactgactgagtggtta

SEQ ID NO: 87691 - DNA, 22 bp, Homo sapiens
ctgaggtgtgaaatggtggcaa

SEQ ID NO: 87692 - DNA, 22 bp, Homo sapiens
gtgtggtcgaagttctcccgga

SEQ ID NO: 87693 - DNA, 22 bp, Homo sapiens
ctgtccctgagcaactcctgtt

SEQ ID NO: 87694 - DNA, 22 bp, Homo sapiens
ggctcgtctgagttctagtctc

SEQ ID NO: 87695 - DNA, 22 bp, Homo sapiens
cagcagcagtggctgcagaaca

SEQ ID NO: 87696 - DNA, 22 bp, Homo sapiens
gaggaggcttccgggaggcacg

SEQ ID NO: 87697 - DNA, 22 bp, Homo sapiens
atgaggcaggagtgcagtggca

SEQ ID NO: 87698 - DNA, 22 bp, Homo sapiens
agcgtgaattagttggtacaca

SEQ ID NO: 87699 - DNA, 22 bp, Homo sapiens
aaggaaagctgtggttctgaga

SEQ ID NO: 87700 - DNA, 22 bp, Homo sapiens
tgggaggccgaggcaggtggat

SEQ ID NO: 87701 - DNA, 22 bp, Homo sapiens
aggcttcaggtttgctttgcag

SEQ ID NO: 87702 - DNA, 22 bp, Homo sapiens
gagtggggggtccgtctcagtg

SEQ ID NO: 87703 - DNA, 22 bp, Homo sapiens
gggggaagaaagaacatggcat

SEQ ID NO: 87704 - DNA, 22 bp, Homo sapiens
cactgcacttcagcctgggtga

SEQ ID NO: 87705 - DNA, 22 bp, Homo sapiens
tgtgctcagtctttggctggga

SEQ ID NO: 87706 - DNA, 22 bp, Homo sapiens
ttcttctccgaggagggctggt

SEQ ID NO: 87707 - DNA, 22 bp, Homo sapiens
ctctgcctcagtgatttcttta

SEQ ID NO: 87708 - DNA, 22 bp, Homo sapiens
ggctgagttgagaggattactt

SEQ ID NO: 87709 - DNA, 22 bp, Homo sapiens
tccagggccatctccatgaggc

SEQ ID NO: 87710 - DNA, 22 bp, Homo sapiens
gggcggatcatttgaggtcagg

SEQ ID NO: 87711 - DNA, 22 bp, Homo sapiens
gtccaaaagagccagccgggcg

SEQ ID NO: 87712 - DNA, 22 bp, Homo sapiens
tcgcgggttgcacatggccatc

SEQ ID NO: 87713 - DNA, 22 bp, Homo sapiens
tcagcttcgcctgaggtatggg

SEQ ID NO: 87714 - DNA, 22 bp, Homo sapiens
tcccagtttttctccactaagg

SEQ ID NO: 87715 - DNA, 22 bp, Homo sapiens
tgaggcaggagaatcaccggaa

SEQ ID NO: 87716 - DNA, 22 bp, Homo sapiens
tcccgtcttgctgttgtctgcg

SEQ ID NO: 87717 - DNA, 22 bp, Homo sapiens
ttgagatgtcttttggcattat

SEQ ID NO: 87718 - DNA, 22 bp, Homo sapiens
gggaagagggagctggaatgat

SEQ ID NO: 87719 - DNA, 22 bp, Homo sapiens
ttttctaacatctagtaatttg

SEQ ID NO: 87720 - DNA, 20 bp, Homo sapiens
gccactgggcaccagcaggg

SEQ ID NO: 87721 - DNA, 22 bp, Homo sapiens
gcaggaggttgagccaggactg

SEQ ID NO: 87722 - DNA, 22 bp, Homo sapiens
ttgagatggagtcttgctctct

SEQ ID NO: 87723 - DNA, 22 bp, Homo sapiens
ccctgccttgtctgggctaggt

SEQ ID NO: 87724 - DNA, 22 bp, Homo sapiens
ccaggaggttgaggctgcagtg

SEQ ID NO: 87725 - DNA, 22 bp, Homo sapiens
actgcacttcaccctgggtgac

SEQ ID NO: 87726 - DNA, 22 bp, Homo sapiens
agcaggagtttgatgcttttat

SEQ ID NO: 87727 - DNA, 21 bp, Homo sapiens
tcactagtgccttctgtcatt

SEQ ID NO: 87728 - DNA, 21 bp, Homo sapiens
tgctccaggagggggcagtcc

SEQ ID NO: 87729 - DNA, 22 bp, Homo sapiens
tcccgggcaggtcgagcgagcc

SEQ ID NO: 87730 - DNA, 22 bp, Homo sapiens
caggctgctgcctagaatgaca

SEQ ID NO: 87731 - DNA, 22 bp, Homo sapiens
gggccgtagaccacgtccgggc

SEQ ID NO: 87732 - DNA, 19 bp, Homo sapiens
tcctgcccaccagccaggg

SEQ ID NO: 87733 - DNA, 21 bp, Homo sapiens
ctggccactgcacctcttcct

SEQ ID NO: 87734 - DNA, 22 bp, Homo sapiens
tagtttcatctccaccctgccc

SEQ ID NO: 87735 - DNA, 22 bp, Homo sapiens
aagattttcagtgcctaaaaca

SEQ ID NO: 87736 - DNA, 22 bp, Homo sapiens
agagggtgggcacgtgatggat

SEQ ID NO: 87737 - DNA, 22 bp, Homo sapiens
actattagcatatcatgaatgg

SEQ ID NO: 87738 - DNA, 22 bp, Homo sapiens
agatttatgtggtcacactcag

SEQ ID NO: 87739 - DNA, 22 bp, Homo sapiens
tggctgtgtccctgtccagagt

SEQ ID NO: 87740 - DNA, 22 bp, Homo sapiens
tcaggctcaggttaggggccaa

SEQ ID NO: 87741 - DNA, 22 bp, Homo sapiens
agcaagattgaggcttcctcag

SEQ ID NO: 87742 - DNA, 22 bp, Homo sapiens
caaccccactacacgttggaga

SEQ ID NO: 87743 - DNA, 22 bp, Homo sapiens
ggctgccttccctgagccccgg

SEQ ID NO: 87744 - DNA, 22 bp, Homo sapiens
gggagtgtgcacacatggtata

SEQ ID NO: 87745 - DNA, 22 bp, Homo sapiens
cggggaagcggttctggcggta

SEQ ID NO: 87746 - DNA, 22 bp, Homo sapiens
taggctaggctgaaggttttgg

SEQ ID NO: 87747 - DNA, 23 bp, Homo sapiens
ctcaccaagcgccgccgctgtgt

SEQ ID NO: 87748 - DNA, 21 bp, Homo sapiens
acataggcgaatgttcgggag

SEQ ID NO: 87749 - DNA, 22 bp, Homo sapiens
gaaggtggcgagcggattgctg

SEQ ID NO: 87750 - DNA, 22 bp, Homo sapiens
gcagtatctatgtgatgggttg

SEQ ID NO: 87751 - DNA, 22 bp, Homo sapiens
aggggaatgggtagactgttga

SEQ ID NO: 87752 - DNA, 16 bp, Homo sapiens
aggctcagaggctgga

SEQ ID NO: 87753 - DNA, 22 bp, Homo sapiens
cagggtgacaagtggcaaggag

SEQ ID NO: 87754 - DNA, 22 bp, Homo sapiens
taggtttaggagtgaaggtgaa

SEQ ID NO: 87755 - DNA, 22 bp, Homo sapiens
caagggaattgtgtgtgagagg

SEQ ID NO: 87756 - DNA, 22 bp, Homo sapiens
ttagcacaattatttcagttgt

SEQ ID NO: 87757 - DNA, 22 bp, Homo sapiens
ggtgccaggctgtagtcagggt

SEQ ID NO: 87758 - DNA, 22 bp, Homo sapiens
tccagcagtccatgtgagacac

SEQ ID NO: 87759 - DNA, 22 bp, Homo sapiens
ccctgctgtgtagcggaggaac

SEQ ID NO: 87760 - DNA, 22 bp, Homo sapiens
gggaaactttcacaatgtccag

SEQ ID NO: 87761 - DNA, 23 bp, Homo sapiens
ggagtgcaatggcgccatctcgg

SEQ ID NO: 87762 - DNA, 22 bp, Homo sapiens
cttgtcttgcacacggttgcca

SEQ ID NO: 87763 - DNA, 22 bp, Homo sapiens
tgatctggtcctactgtgggca

SEQ ID NO: 87764 - DNA, 22 bp, Homo sapiens
agtaatcaatttttcggtggat

SEQ ID NO: 87765 - DNA, 22 bp, Homo sapiens
attaattagagaggtgcctgtt

SEQ ID NO: 87766 - DNA, 22 bp, Homo sapiens
ttgagatggagtctcactctgt

SEQ ID NO: 87767 - DNA, 22 bp, Homo sapiens
tttcagatggaggtttaggaca

SEQ ID NO: 87768 - DNA, 22 bp, Homo sapiens
ccctggctgcgtgatggatgaa

SEQ ID NO: 87769 - DNA, 22 bp, Homo sapiens
ggatggtgacggcggcccgctt

SEQ ID NO: 87770 - DNA, 22 bp, Homo sapiens
tatgtcactcggctcggcccac

SEQ ID NO: 87771 - DNA, 22 bp, Homo sapiens
ccgcccacactaaatatgagcg

SEQ ID NO: 87772 - DNA, 22 bp, Homo sapiens
ggccactgctctccagcctggg

SEQ ID NO: 87773 - DNA, 22 bp, Homo sapiens
ttggaaacgtcaccttttcctt

SEQ ID NO: 87774 - DNA, 22 bp, Homo sapiens
actgcactccagcctgggtgat

SEQ ID NO: 87775 - DNA, 22 bp, Homo sapiens
gaggactgaaacttacaggaaa

SEQ ID NO: 87776 - DNA, 22 bp, Homo sapiens
ggggccttggatctgtgccccg

SEQ ID NO: 87777 - DNA, 22 bp, Homo sapiens
ccaggagttggaagctgccatg

SEQ ID NO: 87778 - DNA, 22 bp, Homo sapiens
ttaaatattatgttgtctgcaa

SEQ ID NO: 87779 - DNA, 22 bp, Homo sapiens
gaacttggcctgtctgtctggc

SEQ ID NO: 87780 - DNA, 22 bp, Homo sapiens
acagcagcaatagcagtgacat

SEQ ID NO: 87781 - DNA, 22 bp, Homo sapiens
gggcaggggtcagtggccccaa

SEQ ID NO: 87782 - DNA, 22 bp, Homo sapiens
tctgctcagccgatctgctccg

SEQ ID NO: 87783 - DNA, 22 bp, Homo sapiens
caactccctgtggggtactggg

SEQ ID NO: 87784 - DNA, 22 bp, Homo sapiens
gctcccagtctgatggaggaga

SEQ ID NO: 87785 - DNA, 22 bp, Homo sapiens
atgcccaatgtcacaatttttg

SEQ ID NO: 87786 - DNA, 18 bp, Homo sapiens
acgtgctgtgccttttgc

SEQ ID NO: 87787 - DNA, 22 bp, Homo sapiens
gaaagacatagttgcaagatgg

SEQ ID NO: 87788 - DNA, 21 bp, Homo sapiens
tcctgtaagcttgggtggctc

SEQ ID NO: 87789 - DNA, 22 bp, Homo sapiens
tgcgaccctagccccctcactt

SEQ ID NO: 87790 - DNA, 22 bp, Homo sapiens
ctgctgagccgcacccaggagc

SEQ ID NO: 87791 - DNA, 22 bp, Homo sapiens
aggctatttccactcttctcat

SEQ ID NO: 87792 - DNA, 22 bp, Homo sapiens
gaggcaggcagattgcttgagg

SEQ ID NO: 87793 - DNA, 18 bp, Homo sapiens
gcctggcttcggagccgc

SEQ ID NO: 87794 - DNA, 22 bp, Homo sapiens
gtgttagtttgctaaggataat

SEQ ID NO: 87795 - DNA, 19 bp, Homo sapiens
taggaccctggtggccccc

SEQ ID NO: 87796 - DNA, 22 bp, Homo sapiens
aagccaggttccatggaggagc

SEQ ID NO: 87797 - DNA, 22 bp, Homo sapiens
cactgcactccatcctgggaaa

SEQ ID NO: 87798 - DNA, 22 bp, Homo sapiens
tcctccccaaagcccagcctgg

SEQ ID NO: 87799 - DNA, 22 bp, Homo sapiens
ctccccagccctggtattctga

SEQ ID NO: 87800 - DNA, 22 bp, Homo sapiens
gaggtggctgcttgctgggaaa

SEQ ID NO: 87801 - DNA, 22 bp, Homo sapiens
ggaaacttggatgccagcactc

SEQ ID NO: 87802 - DNA, 22 bp, Homo sapiens
acaggatcgccctgttgcccag

SEQ ID NO: 87803 - DNA, 21 bp, Homo sapiens
gccagcggccgccctccagga

SEQ ID NO: 87804 - DNA, 22 bp, Homo sapiens
ccttctcagccccagctcccgc

SEQ ID NO: 87805 - DNA, 22 bp, Homo sapiens
tcctgccttgcctgggacatca

SEQ ID NO: 87806 - DNA, 22 bp, Homo sapiens
gcctcctgtcccaggctgagga

SEQ ID NO: 87807 - DNA, 22 bp, Homo sapiens
agtgactggtgtgaagttaaat

SEQ ID NO: 87808 - DNA, 22 bp, Homo sapiens
ggcaatagttgtgggttcttta

SEQ ID NO: 87809 - DNA, 21 bp, Homo sapiens
ttgttcctatctgcctcctgc

SEQ ID NO: 87810 - DNA, 22 bp, Homo sapiens
tgatttatgcattatactgttg

SEQ ID NO: 87811 - DNA, 22 bp, Homo sapiens
gaggcagaggttgttgcagtga

SEQ ID NO: 87812 - DNA, 22 bp, Homo sapiens
atcctcagacttcacgttccat

SEQ ID NO: 87813 - DNA, 22 bp, Homo sapiens
cgcgctgcagacagcggaggcc

SEQ ID NO: 87814 - DNA, 22 bp, Homo sapiens
aggctcagatccttgtgtcctg

SEQ ID NO: 87815 - DNA, 22 bp, Homo sapiens
tatgcagtgagcactatttata

SEQ ID NO: 87816 - DNA, 22 bp, Homo sapiens
tggctttctcacagaccacctc

SEQ ID NO: 87817 - DNA, 22 bp, Homo sapiens
taagcctgcatgaaccatgaga

SEQ ID NO: 87818 - DNA, 22 bp, Homo sapiens
tgtccccacctaaatcttatct

SEQ ID NO: 87819 - DNA, 22 bp, Homo sapiens
gctcccaccgccgctatgggta

SEQ ID NO: 87820 - DNA, 22 bp, Homo sapiens
ggcgctcagtgttgccccagag

SEQ ID NO: 87821 - DNA, 22 bp, Homo sapiens
atggctagcaccgcgttgctgg

SEQ ID NO: 87822 - DNA, 22 bp, Homo sapiens
ttcttctcagggtcccacatgg

SEQ ID NO: 87823 - DNA, 22 bp, Homo sapiens
gttcagtcacgtgcccaagttc

SEQ ID NO: 87824 - DNA, 20 bp, Homo sapiens
ggcagagggcctgggagaag

SEQ ID NO: 87825 - DNA, 22 bp, Homo sapiens
tctgcctagaaacagtgtttgc

SEQ ID NO: 87826 - DNA, 22 bp, Homo sapiens
caggctgctgacaggcttggag

SEQ ID NO: 87827 - DNA, 22 bp, Homo sapiens
ttctcacagaagcacgaagcct

SEQ ID NO: 87828 - DNA, 22 bp, Homo sapiens
tgcaaaggtttgtgcttggaaa

SEQ ID NO: 87829 - DNA, 22 bp, Homo sapiens
actgcaacctccgcctgccagg

SEQ ID NO: 87830 - DNA, 22 bp, Homo sapiens
gggacatctttctagtcagggt

SEQ ID NO: 87831 - DNA, 22 bp, Homo sapiens
gtctctatcatagctgaaccct

SEQ ID NO: 87832 - DNA, 22 bp, Homo sapiens
atatattttttgagacagagtc

SEQ ID NO: 87833 - DNA, 22 bp, Homo sapiens
ggtgggagccaacacccttctg

SEQ ID NO: 87834 - DNA, 22 bp, Homo sapiens
agcctggcggtcgtcggtcagg

SEQ ID NO: 87835 - DNA, 19 bp, Homo sapiens
ggctgccttctgctcatct

SEQ ID NO: 87836 - DNA, 22 bp, Homo sapiens
gctggctgacagatttggggtg

SEQ ID NO: 87837 - DNA, 22 bp, Homo sapiens
gaggccacggaagggagctgtg

SEQ ID NO: 87838 - DNA, 22 bp, Homo sapiens
agaggcagtatacaatccgagc

SEQ ID NO: 87839 - DNA, 22 bp, Homo sapiens
gaccatcctggccaacgtggta

SEQ ID NO: 87840 - DNA, 22 bp, Homo sapiens
atgccactgcacttcagcttgg

SEQ ID NO: 87841 - DNA, 22 bp, Homo sapiens
atgccacttcattccagcctcg

SEQ ID NO: 87842 - DNA, 22 bp, Homo sapiens
aggtggagaagagatgggcagt

SEQ ID NO: 87843 - DNA, 22 bp, Homo sapiens
aaagtgctcggattacaggtat

SEQ ID NO: 87844 - DNA, 22 bp, Homo sapiens
tgcagaaacaagccatcattca

SEQ ID NO: 87845 - DNA, 22 bp, Homo sapiens
aaggcaggatgggaaaagattt

SEQ ID NO: 87846 - DNA, 22 bp, Homo sapiens
tttccagagggtgctcagggcg

SEQ ID NO: 87847 - DNA, 22 bp, Homo sapiens
aataaaatggtcagttttctca

SEQ ID NO: 87848 - DNA, 20 bp, Homo sapiens
ctgggtggcaagcaaggggg

SEQ ID NO: 87849 - DNA, 22 bp, Homo sapiens
gcccttctgctgttaggtagcc

SEQ ID NO: 87850 - DNA, 22 bp, Homo sapiens
gagacctcttggtatcgctagg

SEQ ID NO: 87851 - DNA, 22 bp, Homo sapiens
taggctgggaagaaagattctc

SEQ ID NO: 87852 - DNA, 22 bp, Homo sapiens
cactgcactccagcctgggtca

SEQ ID NO: 87853 - DNA, 22 bp, Homo sapiens
gccctgccctctcggcactcgc

SEQ ID NO: 87854 - DNA, 22 bp, Homo sapiens
gactggaaagcctgtcctcaga

SEQ ID NO: 87855 - DNA, 22 bp, Homo sapiens
gtcaggactctgacccgtcccg

SEQ ID NO: 87856 - DNA, 22 bp, Homo sapiens
actttcttggtcccatgtttga

SEQ ID NO: 87857 - DNA, 18 bp, Homo sapiens
gatcgggggcgccccaag

SEQ ID NO: 87858 - DNA, 22 bp, Homo sapiens
cggagtcttgctatgttgccca

SEQ ID NO: 87859 - DNA, 22 bp, Homo sapiens
gcaggcaggcttccttgaactg

SEQ ID NO: 87860 - DNA, 22 bp, Homo sapiens
tgaggcaggagaatcacatgaa

SEQ ID NO: 87861 - DNA, 22 bp, Homo sapiens
ctcagccccagcccagatagca

SEQ ID NO: 87862 - DNA, 22 bp, Homo sapiens
tcccagagctctggaggttgga

SEQ ID NO: 87863 - DNA, 22 bp, Homo sapiens
ctggcaagaaatatatatctta

SEQ ID NO: 87864 - DNA, 22 bp, Homo sapiens
agccaagcactcaactcctgga

SEQ ID NO: 87865 - DNA, 22 bp, Homo sapiens
ttgagcccaggaggcctgggtg

SEQ ID NO: 87866 - DNA, 22 bp, Homo sapiens
atatatttgagaatattcatga

SEQ ID NO: 87867 - DNA, 22 bp, Homo sapiens
ccagttccagtgctcacatcca

SEQ ID NO: 87868 - DNA, 22 bp, Homo sapiens
gtgagatggagttggtgtcttt

SEQ ID NO: 87869 - DNA, 22 bp, Homo sapiens
cttctgagatgttgttttacag

SEQ ID NO: 87870 - DNA, 22 bp, Homo sapiens
acatttatataactcactagga

SEQ ID NO: 87871 - DNA, 22 bp, Homo sapiens
ccactgcactccagccttggca

SEQ ID NO: 87872 - DNA, 22 bp, Homo sapiens
ttgtgtgtactggttatgggca

SEQ ID NO: 87873 - DNA, 17 bp, Homo sapiens
aatctgtttacagtcag

SEQ ID NO: 87874 - DNA, 22 bp, Homo sapiens
ttgctgacctttgctctccgtt

SEQ ID NO: 87875 - DNA, 22 bp, Homo sapiens
aggagctgtcagagtgccagag

SEQ ID NO: 87876 - DNA, 22 bp, Homo sapiens
ggggtctgggcttagctggaat

SEQ ID NO: 87877 - DNA, 18 bp, Homo sapiens
ccctgccagctcccagca

SEQ ID NO: 87878 - DNA, 22 bp, Homo sapiens
tagcagcatttttgtagagtat

SEQ ID NO: 87879 - DNA, 22 bp, Homo sapiens
cggccaagccggggccccgaag

SEQ ID NO: 87880 - DNA, 20 bp, Homo sapiens
tagcatgggtgagggtagag

SEQ ID NO: 87881 - DNA, 22 bp, Homo sapiens
gctcccaccttaaccttcacat

SEQ ID NO: 87882 - DNA, 22 bp, Homo sapiens
acttgccccagaattgctgctg

SEQ ID NO: 87883 - DNA, 22 bp, Homo sapiens
cacctagggtttcgcctttctt

SEQ ID NO: 87884 - DNA, 22 bp, Homo sapiens
agctgccccgaggcggcgggaa

SEQ ID NO: 87885 - DNA, 22 bp, Homo sapiens
atcatgttttaattagcaaact

SEQ ID NO: 87886 - DNA, 22 bp, Homo sapiens
ttgagggtctggatctgctgct

SEQ ID NO: 87887 - DNA, 22 bp, Homo sapiens
aattttctggtgtgtaatgaag

SEQ ID NO: 87888 - DNA, 22 bp, Homo sapiens
accgggaagtcctgcactgggc

SEQ ID NO: 87889 - DNA, 22 bp, Homo sapiens
cagctacaaatacttttgtatg

SEQ ID NO: 87890 - DNA, 22 bp, Homo sapiens
gtgggggcaggcagtgctagga

SEQ ID NO: 87891 - DNA, 22 bp, Homo sapiens
cttgtagacccctggactcacg

SEQ ID NO: 87892 - DNA, 22 bp, Homo sapiens
tgttatcagagagaggtgctgt

SEQ ID NO: 87893 - DNA, 22 bp, Homo sapiens
atgttgagagctgagatcagcc

SEQ ID NO: 87894 - DNA, 22 bp, Homo sapiens
tcaagcacttacagtctggtaa

SEQ ID NO: 87895 - DNA, 22 bp, Homo sapiens
aggagaagccaagttgtgagca

SEQ ID NO: 87896 - DNA, 22 bp, Homo sapiens
tttctcttcactgtgtgcctca

SEQ ID NO: 87897 - DNA, 22 bp, Homo sapiens
agccagggacgctgcaggctac

SEQ ID NO: 87898 - DNA, 22 bp, Homo sapiens
gagctcatccccatggtccgtc

SEQ ID NO: 87899 - DNA, 22 bp, Homo sapiens
ctggccagatgttacgtccaat

SEQ ID NO: 87900 - DNA, 20 bp, Homo sapiens
tgtcttccagcaggtgttta

SEQ ID NO: 87901 - DNA, 22 bp, Homo sapiens
ttgagatggagcttcactcttg

SEQ ID NO: 87902 - DNA, 22 bp, Homo sapiens
caggtagaggctgccatcagct

SEQ ID NO: 87903 - DNA, 22 bp, Homo sapiens
ttgcaattgctatggagagcgt

SEQ ID NO: 87904 - DNA, 22 bp, Homo sapiens
gtcggccacgcaggtgcggtag

SEQ ID NO: 87905 - DNA, 22 bp, Homo sapiens
agaggccggccgagcccatggg

SEQ ID NO: 87906 - DNA, 22 bp, Homo sapiens
tgatattttatgagctttcata

SEQ ID NO: 87907 - DNA, 22 bp, Homo sapiens
ccaggctggagtatagtggcgc

SEQ ID NO: 87908 - DNA, 22 bp, Homo sapiens
ctagcctgggatttgaacttat

SEQ ID NO: 87909 - DNA, 22 bp, Homo sapiens
ggccttggagtcagccttgagc

SEQ ID NO: 87910 - DNA, 22 bp, Homo sapiens
tgtgcctgttcccactttgcct

SEQ ID NO: 87911 - DNA, 22 bp, Homo sapiens
tggtggggccagacttcagctc

SEQ ID NO: 87912 - DNA, 22 bp, Homo sapiens
taggctgggggtaggaattgag

SEQ ID NO: 87913 - DNA, 22 bp, Homo sapiens
tagcaaaggatgactatgtacc

SEQ ID NO: 87914 - DNA, 20 bp, Homo sapiens
gccgactgccttgtgagcct

SEQ ID NO: 87915 - DNA, 22 bp, Homo sapiens
catgaaattgtattggcctcaa

SEQ ID NO: 87916 - DNA, 22 bp, Homo sapiens
catgagatttgggaggggccag

SEQ ID NO: 87917 - DNA, 22 bp, Homo sapiens
aagtcgtcgaagatggaggttg

SEQ ID NO: 87918 - DNA, 22 bp, Homo sapiens
tcacttagatggggatcatcac

SEQ ID NO: 87919 - DNA, 22 bp, Homo sapiens
cccaggagttggaggctgcagt

SEQ ID NO: 87920 - DNA, 22 bp, Homo sapiens
cactgcactccagcccgggcaa

SEQ ID NO: 87921 - DNA, 22 bp, Homo sapiens
gagcccaggaagtggaggctga

SEQ ID NO: 87922 - DNA, 22 bp, Homo sapiens
gagaaatgcatgcatgtcatca

SEQ ID NO: 87923 - DNA, 22 bp, Homo sapiens
tggggagtgatgcctcggataa

SEQ ID NO: 87924 - DNA, 22 bp, Homo sapiens
atattacacacggtatcacggg

SEQ ID NO: 87925 - DNA, 22 bp, Homo sapiens
ctggctgggagcgagctgctca

SEQ ID NO: 87926 - DNA, 22 bp, Homo sapiens
acccaggagacggaggtgcagt

SEQ ID NO: 87927 - DNA, 22 bp, Homo sapiens
tgtgactggttgtcccgctttc

SEQ ID NO: 87928 - DNA, 22 bp, Homo sapiens
cctggctctgccacttactgcc

SEQ ID NO: 87929 - DNA, 22 bp, Homo sapiens
aaatgcaacgggctttccttat

SEQ ID NO: 87930 - DNA, 22 bp, Homo sapiens
ccggctactcgggaggctgacg

SEQ ID NO: 87931 - DNA, 22 bp, Homo sapiens
accgtgtctgacactttgggcg

SEQ ID NO: 87932 - DNA, 22 bp, Homo sapiens
agggaagaggaccagagtctct

SEQ ID NO: 87933 - DNA, 22 bp, Homo sapiens
gaatttcctctaaacccctgag

SEQ ID NO: 87934 - DNA, 22 bp, Homo sapiens
tcccagtttttctccactaagg

SEQ ID NO: 87935 - DNA, 22 bp, Homo sapiens
ctgggcacagcgttgggctctt

SEQ ID NO: 87936 - DNA, 22 bp, Homo sapiens
cggctgggttcggctgcaggcc

SEQ ID NO: 87937 - DNA, 22 bp, Homo sapiens
ctggtaggggtgactgttatcg

SEQ ID NO: 87938 - DNA, 22 bp, Homo sapiens
gagaatgatgatttccaatttc

SEQ ID NO: 87939 - DNA, 22 bp, Homo sapiens
actgcactccagcctgggcggc

SEQ ID NO: 87940 - DNA, 22 bp, Homo sapiens
gctcccaggatgaggagccagg

SEQ ID NO: 87941 - DNA, 22 bp, Homo sapiens
gtcacctgtgccacatactggg

SEQ ID NO: 87942 - DNA, 22 bp, Homo sapiens
ggcaaggggtcaggctgagaca

SEQ ID NO: 87943 - DNA, 22 bp, Homo sapiens
agggccagcactcctggcagga

SEQ ID NO: 87944 - DNA, 22 bp, Homo sapiens
aggagggagcttaagccaggca

SEQ ID NO: 87945 - DNA, 22 bp, Homo sapiens
tcctttgcttctgtcattctcc

SEQ ID NO: 87946 - DNA, 22 bp, Homo sapiens
ggaaggggtgggtgagcctcag

SEQ ID NO: 87947 - DNA, 22 bp, Homo sapiens
tggtatgaccgtggtgcaagca

SEQ ID NO: 87948 - DNA, 22 bp, Homo sapiens
ggcatagatttctttaggttta

SEQ ID NO: 87949 - DNA, 22 bp, Homo sapiens
gatgtagacacttggaggctta

SEQ ID NO: 87950 - DNA, 22 bp, Homo sapiens
ggctcactgcaacttccgcctc

SEQ ID NO: 87951 - DNA, 22 bp, Homo sapiens
tctcccaggcaggagtgcagtg

SEQ ID NO: 87952 - DNA, 22 bp, Homo sapiens
gggagaggttacccgagcaact

SEQ ID NO: 87953 - DNA, 22 bp, Homo sapiens
gagctgggcctgcgagtgctgc

SEQ ID NO: 87954 - DNA, 22 bp, Homo sapiens
tggtgcaaaactaattgcggtt

SEQ ID NO: 87955 - DNA, 19 bp, Homo sapiens
tcctggggaggggcatggc

SEQ ID NO: 87956 - DNA, 18 bp, Homo sapiens
ctgcactcccgcctgggc

SEQ ID NO: 87957 - DNA, 22 bp, Homo sapiens
ggcatctggatctgcttctccc

SEQ ID NO: 87958 - DNA, 22 bp, Homo sapiens
aagagggctgcaatcttattgc

SEQ ID NO: 87959 - DNA, 22 bp, Homo sapiens
aggctagaggcttctggcttca

SEQ ID NO: 87960 - DNA, 22 bp, Homo sapiens
ccttttgctctcccatccagaa

SEQ ID NO: 87961 - DNA, 20 bp, Homo sapiens
tcagccattccttacctttc

SEQ ID NO: 87962 - DNA, 22 bp, Homo sapiens
caggaggacatactggctcaca

SEQ ID NO: 87963 - DNA, 22 bp, Homo sapiens
actgcactccagcctgggcgac

SEQ ID NO: 87964 - DNA, 22 bp, Homo sapiens
ggctgggctccgggagcatgcg

SEQ ID NO: 87965 - DNA, 22 bp, Homo sapiens
ctctccattccctacagttttc

SEQ ID NO: 87966 - DNA, 22 bp, Homo sapiens
cctactctgagcgcctccgcat

SEQ ID NO: 87967 - DNA, 22 bp, Homo sapiens
agccaggatggtctcgatcggc

SEQ ID NO: 87968 - DNA, 22 bp, Homo sapiens
gcaggagaacaaagcaagctgc

SEQ ID NO: 87969 - DNA, 22 bp, Homo sapiens
ggctagggatctagaccaggac

SEQ ID NO: 87970 - DNA, 22 bp, Homo sapiens
gcgccccatctacagtactttt

SEQ ID NO: 87971 - DNA, 22 bp, Homo sapiens
ctggggaccagtgtctgtttgt

SEQ ID NO: 87972 - DNA, 22 bp, Homo sapiens
ggatgttctggggttctcttgt

SEQ ID NO: 87973 - DNA, 20 bp, Homo sapiens
ttctccagtgcggtagccat

SEQ ID NO: 87974 - DNA, 22 bp, Homo sapiens
ggaggtggaggttgcagtgagc

SEQ ID NO: 87975 - DNA, 22 bp, Homo sapiens
tggcctcggcatccagcaagag

SEQ ID NO: 87976 - DNA, 22 bp, Homo sapiens
aggccaggaatccttgtcccag

SEQ ID NO: 87977 - DNA, 22 bp, Homo sapiens
cctcggtttccacatctgtaca

SEQ ID NO: 87978 - DNA, 22 bp, Homo sapiens
ttggagatatcacaccttcaca

SEQ ID NO: 87979 - DNA, 22 bp, Homo sapiens
atgaagctactgaatatttggt

SEQ ID NO: 87980 - DNA, 22 bp, Homo sapiens
aggaggggttctcgggtgctga

SEQ ID NO: 87981 - DNA, 22 bp, Homo sapiens
gggcactcagctgtagagcagg

SEQ ID NO: 87982 - DNA, 22 bp, Homo sapiens
tcgttatagaacattcttgggt

SEQ ID NO: 87983 - DNA, 22 bp, Homo sapiens
cctcggggcaccgcggcctgct

SEQ ID NO: 87984 - DNA, 22 bp, Homo sapiens
gctcggtggccagcctgaggcc

SEQ ID NO: 87985 - DNA, 22 bp, Homo sapiens
agggcgacaatggagagcgttt

SEQ ID NO: 87986 - DNA, 22 bp, Homo sapiens
attggccatttgcatgtattat

SEQ ID NO: 87987 - DNA, 22 bp, Homo sapiens
tctacctggagtccgttgttaa

SEQ ID NO: 87988 - DNA, 22 bp, Homo sapiens
tcttgcacttcatgaatatgtt

SEQ ID NO: 87989 - DNA, 22 bp, Homo sapiens
gttcaagaccagcctggccaac

SEQ ID NO: 87990 - DNA, 22 bp, Homo sapiens
tgtctggtgggttgacaggcag

SEQ ID NO: 87991 - DNA, 22 bp, Homo sapiens
gttactcttgagaggctgaggt

SEQ ID NO: 87992 - DNA, 22 bp, Homo sapiens
gtgctccctccttcctcaagga

SEQ ID NO: 87993 - DNA, 22 bp, Homo sapiens
cactgcactccagcctgggcaa

SEQ ID NO: 87994 - DNA, 22 bp, Homo sapiens
gctgcactttgactgctggggt

SEQ ID NO: 87995 - DNA, 22 bp, Homo sapiens
acagttaataagtagtaagtca

SEQ ID NO: 87996 - DNA, 22 bp, Homo sapiens
ctgcgttctgcctggcggccta

SEQ ID NO: 87997 - DNA, 22 bp, Homo sapiens
gggttcagtccctcttgctact

SEQ ID NO: 87998 - DNA, 22 bp, Homo sapiens
tttctcctcatgactggttgtg

SEQ ID NO: 87999 - DNA, 22 bp, Homo sapiens
gcctatctgtcaaatttctctg

SEQ ID NO: 88000 - DNA, 22 bp, Homo sapiens
atgtgggccgtgcgggtgtcct

SEQ ID NO: 88001 - DNA, 22 bp, Homo sapiens
atatccagcagcaggtgagtat

SEQ ID NO: 88002 - DNA, 22 bp, Homo sapiens
tttcacagaggaggaagctgag

SEQ ID NO: 88003 - DNA, 22 bp, Homo sapiens
tcttgcacttcatgaatatgtt

SEQ ID NO: 88004 - DNA, 22 bp, Homo sapiens
gtcttagatttcaccgataatg

SEQ ID NO: 88005 - DNA, 22 bp, Homo sapiens
tccacgctgtgtgaccttgggc

SEQ ID NO: 88006 - DNA, 22 bp, Homo sapiens
tgcaatctcggcactttgggag

SEQ ID NO: 88007 - DNA, 22 bp, Homo sapiens
atctggttcttcttaggcatca

SEQ ID NO: 88008 - DNA, 22 bp, Homo sapiens
attgggtacgattattttatgg

SEQ ID NO: 88009 - DNA, 22 bp, Homo sapiens
tgttttcgatcatttcacagta

SEQ ID NO: 88010 - DNA, 22 bp, Homo sapiens
tcactgcaacctccacctcccg

SEQ ID NO: 88011 - DNA, 22 bp, Homo sapiens
tcactgcaacctccacctcctg

SEQ ID NO: 88012 - DNA, 22 bp, Homo sapiens
tataccatgtgtgcacactccc

SEQ ID NO: 88013 - DNA, 22 bp, Homo sapiens
tgcatggtgtaattctaatgct

SEQ ID NO: 88014 - DNA, 22 bp, Homo sapiens
catgatctggtcctactgtggg

SEQ ID NO: 88015 - DNA, 22 bp, Homo sapiens
tctgcgttgctcacgctgggag

SEQ ID NO: 88016 - DNA, 22 bp, Homo sapiens
gttgaaatcctaaccccctagt

SEQ ID NO: 88017 - DNA, 22 bp, Homo sapiens
tggaaacacccacgcatgcata

SEQ ID NO: 88018 - DNA, 20 bp, Homo sapiens
atggatgaccttggccaggg

SEQ ID NO: 88019 - DNA, 22 bp, Homo sapiens
atgaattgtccgatgttgtgca

SEQ ID NO: 88020 - DNA, 22 bp, Homo sapiens
gccacctcggctttctctgctc

SEQ ID NO: 88021 - DNA, 22 bp, Homo sapiens
ggcagccccatcagagacgctg

SEQ ID NO: 88022 - DNA, 22 bp, Homo sapiens
ctctgtggtggagtgggtcacc

SEQ ID NO: 88023 - DNA, 22 bp, Homo sapiens
aggtcacccgtttgactatcca

SEQ ID NO: 88024 - DNA, 19 bp, Homo sapiens
ttctggtctggaatcaagg

SEQ ID NO: 88025 - DNA, 21 bp, Homo sapiens
gctcctggtgctgcgtggcgc

SEQ ID NO: 88026 - DNA, 19 bp, Homo sapiens
ggagtttccaatgggtaaa

SEQ ID NO: 88027 - DNA, 22 bp, Homo sapiens
taggtttactgaattagtggaa

SEQ ID NO: 88028 - DNA, 22 bp, Homo sapiens
tattgggtaaagatccagtttt

SEQ ID NO: 88029 - DNA, 22 bp, Homo sapiens
tccaagatctacagcagtttag

SEQ ID NO: 88030 - DNA, 22 bp, Homo sapiens
tgaggcaggtggattacaaggt

SEQ ID NO: 88031 - DNA, 22 bp, Homo sapiens
ggcctcttatctggctcctgca

SEQ ID NO: 88032 - DNA, 22 bp, Homo sapiens
tcttgaattgtactcccataag

SEQ ID NO: 88033 - DNA, 22 bp, Homo sapiens
aggtacatggggtgtgtgcacg

SEQ ID NO: 88034 - DNA, 22 bp, Homo sapiens
ctcactgcaagctcagcctccc

SEQ ID NO: 88035 - DNA, 22 bp, Homo sapiens
gcagagctcatgcctgcacctc

SEQ ID NO: 88036 - DNA, 22 bp, Homo sapiens
gcccccgtagtagatgaggcgc

SEQ ID NO: 88037 - DNA, 22 bp, Homo sapiens
gcccagccacagtcactttcat

SEQ ID NO: 88038 - DNA, 18 bp, Homo sapiens
tgagaggctattttttgc

SEQ ID NO: 88039 - DNA, 22 bp, Homo sapiens
actacagtgtgataagaggggc

SEQ ID NO: 88040 - DNA, 21 bp, Homo sapiens
cccgcacagcggtaggccgcc

SEQ ID NO: 88041 - DNA, 20 bp, Homo sapiens
aggggcacctgcgacggggc

SEQ ID NO: 88042 - DNA, 22 bp, Homo sapiens
ccaggaggtggaggttgcggtg

SEQ ID NO: 88043 - DNA, 22 bp, Homo sapiens
atacataattacttccgatgtt

SEQ ID NO: 88044 - DNA, 22 bp, Homo sapiens
acatagtgttttgagagacagc

SEQ ID NO: 88045 - DNA, 23 bp, Homo sapiens
tgtcttcgactcctgcgtgcttc

SEQ ID NO: 88046 - DNA, 22 bp, Homo sapiens
gtttacttgtgccttggcttaa

SEQ ID NO: 88047 - DNA, 19 bp, Homo sapiens
ttactatgtgacaagcact

SEQ ID NO: 88048 - DNA, 16 bp, Homo sapiens
ccacctgcagctctca

SEQ ID NO: 88049 - DNA, 22 bp, Homo sapiens
aatggcactttataaatgttaa

SEQ ID NO: 88050 - DNA, 22 bp, Homo sapiens
cagggtgctgcaccatccctca

SEQ ID NO: 88051 - DNA, 22 bp, Homo sapiens
atgtgtattacctcgattgtga

SEQ ID NO: 88052 - DNA, 22 bp, Homo sapiens
aaagtaattgtggttcttgcca

SEQ ID NO: 88053 - DNA, 19 bp, Homo sapiens
gggcttggggctgaagcct

SEQ ID NO: 88054 - DNA, 22 bp, Homo sapiens
aggctggagtgcagtggtgtga

SEQ ID NO: 88055 - DNA, 22 bp, Homo sapiens
ccaagggcgcctccgttccccc

SEQ ID NO: 88056 - DNA, 18 bp, Homo sapiens
tcaagtgattctcctgcc

SEQ ID NO: 88057 - DNA, 22 bp, Homo sapiens
atcacaaaggtctcagagcaca

SEQ ID NO: 88058 - DNA, 22 bp, Homo sapiens
cactctgcagctgaagggctgg

SEQ ID NO: 88059 - DNA, 22 bp, Homo sapiens
acaggggaatttactgtcatta

SEQ ID NO: 88060 - DNA, 22 bp, Homo sapiens
attgcactccagcctgggggac

SEQ ID NO: 88061 - DNA, 21 bp, Homo sapiens
gggcctggctgcgcaggacgg

SEQ ID NO: 88062 - DNA, 22 bp, Homo sapiens
gtgtaagtatctttgtatcttt

SEQ ID NO: 88063 - DNA, 22 bp, Homo sapiens
ttatgggagcaattggggaggt

SEQ ID NO: 88064 - DNA, 22 bp, Homo sapiens
agcttgggcaacacagcaagac

SEQ ID NO: 88065 - DNA, 22 bp, Homo sapiens
agtgaggggcagctgagtgggc

SEQ ID NO: 88066 - DNA, 22 bp, Homo sapiens
acaactccttcttgggtcctgg

SEQ ID NO: 88067 - DNA, 22 bp, Homo sapiens
ggcgggaagttcttgcccactt

SEQ ID NO: 88068 - DNA, 22 bp, Homo sapiens
tggtatgaccgtggtgcaagca

SEQ ID NO: 88069 - DNA, 22 bp, Homo sapiens
ggccctggcagccacgaaagcc

SEQ ID NO: 88070 - DNA, 22 bp, Homo sapiens
cctcgacctccccaggctcagg

SEQ ID NO: 88071 - DNA, 22 bp, Homo sapiens
tttaatgtagcgtgaaatgatt

SEQ ID NO: 88072 - DNA, 22 bp, Homo sapiens
gggtgtagaaagaaccctctgg

SEQ ID NO: 88073 - DNA, 22 bp, Homo sapiens
atgggtcagttcagtggccaac

SEQ ID NO: 88074 - DNA, 22 bp, Homo sapiens
ggaaatgacttggtgcttcgtt

SEQ ID NO: 88075 - DNA, 22 bp, Homo sapiens
taagcctgcatgaaccatgaga

SEQ ID NO: 88076 - DNA, 22 bp, Homo sapiens
tgagccgtggtctctgagggtg

SEQ ID NO: 88077 - DNA, 22 bp, Homo sapiens
aagaagcaggtcacagacaggg

SEQ ID NO: 88078 - DNA, 22 bp, Homo sapiens
ttgaggcaggtccgggtccttc

SEQ ID NO: 88079 - DNA, 22 bp, Homo sapiens
tgggaagctgcattttaacaag

SEQ ID NO: 88080 - DNA, 22 bp, Homo sapiens
tgcctgttgcccacctgataaa

SEQ ID NO: 88081 - DNA, 22 bp, Homo sapiens
ggtgacagtggttaaaatttgt

SEQ ID NO: 88082 - DNA, 22 bp, Homo sapiens
gcgggccaccttggagagcgct

SEQ ID NO: 88083 - DNA, 22 bp, Homo sapiens
tcacttcccagacggggtggca

SEQ ID NO: 88084 - DNA, 22 bp, Homo sapiens
ctagttctagatccctgaggaa

SEQ ID NO: 88085 - DNA, 22 bp, Homo sapiens
gaggtaggtgtaggaggcctgc

SEQ ID NO: 88086 - DNA, 22 bp, Homo sapiens
agctgaacgtgcttctgcagca

SEQ ID NO: 88087 - DNA, 22 bp, Homo sapiens
gagatggagtctttttctgtca

SEQ ID NO: 88088 - DNA, 22 bp, Homo sapiens
atgaagctactgaatatttggt

SEQ ID NO: 88089 - DNA, 22 bp, Homo sapiens
gtcaccttgaacaggctactca

SEQ ID NO: 88090 - DNA, 22 bp, Homo sapiens
cgtggggcgggtggacacttgc

SEQ ID NO: 88091 - DNA, 22 bp, Homo sapiens
catgcggctctttccaaaccgg

SEQ ID NO: 88092 - DNA, 21 bp, Homo sapiens
ggtgtgggatggactgaacca

SEQ ID NO: 88093 - DNA, 22 bp, Homo sapiens
acccaggctggagtgcagtggg

SEQ ID NO: 88094 - DNA, 22 bp, Homo sapiens
atgttatgtctgggaaggggta

SEQ ID NO: 88095 - DNA, 22 bp, Homo sapiens
taggctgggaagaaagattctc

SEQ ID NO: 88096 - DNA, 22 bp, Homo sapiens
cagctgcccctccagggctggg

SEQ ID NO: 88097 - DNA, 22 bp, Homo sapiens
gcatctaaataaacgtgggagt

SEQ ID NO: 88098 - DNA, 22 bp, Homo sapiens
ggagtgaagtggcgcgatctcg

SEQ ID NO: 88099 - DNA, 22 bp, Homo sapiens
tagctgggactactggccctgc

SEQ ID NO: 88100 - DNA, 22 bp, Homo sapiens
tgtctttgttattgtggacagg

SEQ ID NO: 88101 - DNA, 22 bp, Homo sapiens
ttgtgaatagtgccgctataaa

SEQ ID NO: 88102 - DNA, 22 bp, Homo sapiens
gctctgccagcccaaggcgcag

SEQ ID NO: 88103 - DNA, 22 bp, Homo sapiens
aaagcagaggttgcagtgagct

SEQ ID NO: 88104 - DNA, 22 bp, Homo sapiens
aggtggaaatggctttcctagg

SEQ ID NO: 88105 - DNA, 22 bp, Homo sapiens
gtgaggtggtacaatattaact

SEQ ID NO: 88106 - DNA, 20 bp, Homo sapiens
tcagccattccttacctttc

SEQ ID NO: 88107 - DNA, 20 bp, Homo sapiens
gccactgggcaccagcaggg

SEQ ID NO: 88108 - DNA, 22 bp, Homo sapiens
tggttgtggtcctccacatcgc

SEQ ID NO: 88109 - DNA, 22 bp, Homo sapiens
agcctctcagagtgctgggatt

SEQ ID NO: 88110 - DNA, 22 bp, Homo sapiens
ccgggcctcgggacaccgggta

SEQ ID NO: 88111 - DNA, 22 bp, Homo sapiens
acaggggacctaggaccctcgg

SEQ ID NO: 88112 - DNA, 22 bp, Homo sapiens
tgcccaggctggagtgcagtgg

SEQ ID NO: 88113 - DNA, 22 bp, Homo sapiens
ttattttaccttcctctgagct

SEQ ID NO: 88114 - DNA, 22 bp, Homo sapiens
gggaagagggagctggaatgat

SEQ ID NO: 88115 - DNA, 22 bp, Homo sapiens
cccagagcatgtgctgcctttg

SEQ ID NO: 88116 - DNA, 22 bp, Homo sapiens
aaggagaaatggtagatgtgca

SEQ ID NO: 88117 - DNA, 22 bp, Homo sapiens
aaagtgctgggattccaggcgt

SEQ ID NO: 88118 - DNA, 22 bp, Homo sapiens
aaactgaggctcccgagggtgt

SEQ ID NO: 88119 - DNA, 21 bp, Homo sapiens
agctgcctccacttctgaggc

SEQ ID NO: 88120 - DNA, 22 bp, Homo sapiens
tcggggtctttgacacgctctg

SEQ ID NO: 88121 - DNA, 22 bp, Homo sapiens
gtccacttctgcctttctggat

SEQ ID NO: 88122 - DNA, 22 bp, Homo sapiens
cttgtagaattgaaatggtctc

SEQ ID NO: 88123 - DNA, 22 bp, Homo sapiens
tgagcaggcgcagcaggaggtc

SEQ ID NO: 88124 - DNA, 22 bp, Homo sapiens
atgtgtcaggtacactcattag

SEQ ID NO: 88125 - DNA, 19 bp, Homo sapiens
gttggcactgaaaatggct

SEQ ID NO: 88126 - DNA, 22 bp, Homo sapiens
acctcctccaaggagccatagg

SEQ ID NO: 88127 - DNA, 22 bp, Homo sapiens
ggcaagagggcagatggagtgc

SEQ ID NO: 88128 - DNA, 22 bp, Homo sapiens
attgttgggtctcactcctaga

SEQ ID NO: 88129 - DNA, 21 bp, Homo sapiens
acataggcgaatgttcgggag

SEQ ID NO: 88130 - DNA, 22 bp, Homo sapiens
tcaggcagtagaattgcttgaa

SEQ ID NO: 88131 - DNA, 22 bp, Homo sapiens
tctcgctctgtcgcccaggctg

SEQ ID NO: 88132 - DNA, 22 bp, Homo sapiens
ctgggcagctgtatcagggagt

SEQ ID NO: 88133 - DNA, 22 bp, Homo sapiens
tcccgcatgccgccggtgaaca

SEQ ID NO: 88134 - DNA, 18 bp, Homo sapiens
catgggtgacaggtggat

SEQ ID NO: 88135 - DNA, 22 bp, Homo sapiens
cctgtcataatgtccgatgtca

SEQ ID NO: 88136 - DNA, 22 bp, Homo sapiens
aggagaagccaagttgtgagca

SEQ ID NO: 88137 - DNA, 15 bp, Homo sapiens
tctagttttgaagac

SEQ ID NO: 88138 - DNA, 22 bp, Homo sapiens
gcagtggcatgatgtgggctca

SEQ ID NO: 88139 - DNA, 22 bp, Homo sapiens
agggctctgagtgggaaagagg

SEQ ID NO: 88140 - DNA, 22 bp, Homo sapiens
tgccgcaagtactgctgcctgt

SEQ ID NO: 88141 - DNA, 22 bp, Homo sapiens
gaatatcccgctatgcaaagta

SEQ ID NO: 88142 - DNA, 22 bp, Homo sapiens
tccttgtaaaggagctctaaca

SEQ ID NO: 88143 - DNA, 22 bp, Homo sapiens
atgccactgcactccagcctag

SEQ ID NO: 88144 - DNA, 22 bp, Homo sapiens
gaccttgtgatctgcctgcctt

SEQ ID NO: 88145 - DNA, 22 bp, Homo sapiens
tgggttagattccgcgaagcag

SEQ ID NO: 88146 - DNA, 22 bp, Homo sapiens
ggcatagatttctttaggttta

SEQ ID NO: 88147 - DNA, 22 bp, Homo sapiens
agaggcaggaggttgacttgag

SEQ ID NO: 88148 - DNA, 22 bp, Homo sapiens
ctcagcactttggaaggctgat

SEQ ID NO: 88149 - DNA, 23 bp, Homo sapiens
ttgcttagagacctcctcatcag

SEQ ID NO: 88150 - DNA, 22 bp, Homo sapiens
cactgcaacctccatcttctgg

SEQ ID NO: 88151 - DNA, 22 bp, Homo sapiens
tatgtgtttgacaccctgcaag

SEQ ID NO: 88152 - DNA, 22 bp, Homo sapiens
acaagaagtaaaggtcggatgc

SEQ ID NO: 88153 - DNA, 22 bp, Homo sapiens
ctgctttgcatagctgccagag

SEQ ID NO: 88154 - DNA, 22 bp, Homo sapiens
gagtggctattgatccgtgatg

SEQ ID NO: 88155 - DNA, 22 bp, Homo sapiens
ctgaggaaggctgggggcatcc

SEQ ID NO: 88156 - DNA, 22 bp, Homo sapiens
cagcccgccctgaactttcggg

SEQ ID NO: 88157 - DNA, 22 bp, Homo sapiens
ttggagtgacagatgaggaaac

SEQ ID NO: 88158 - DNA, 22 bp, Homo sapiens
gactttctgatgtaaacattta

SEQ ID NO: 88159 - DNA, 22 bp, Homo sapiens
ggccactgctctccagcctggg

SEQ ID NO: 88160 - DNA, 22 bp, Homo sapiens
atgtgggccgtgcgggtgtcct

SEQ ID NO: 88161 - DNA, 22 bp, Homo sapiens
tgagccaggagtttgaggctgt

SEQ ID NO: 88162 - DNA, 22 bp, Homo sapiens
tgtgactgaggctccaagctag

SEQ ID NO: 88163 - DNA, 22 bp, Homo sapiens
aagatgcggttgaccatggtgt

SEQ ID NO: 88164 - DNA, 21 bp, Homo sapiens
ggcctcccggaccgcagcgcc

SEQ ID NO: 88165 - DNA, 22 bp, Homo sapiens
ttaaatattatgttgtctgcaa

SEQ ID NO: 88166 - DNA, 22 bp, Homo sapiens
gtggcaggagggcatcacttgg

SEQ ID NO: 88167 - DNA, 22 bp, Homo sapiens
gccaggcgggtctcaaactcct

SEQ ID NO: 88168 - DNA, 22 bp, Homo sapiens
tggggtacacgtggggcaggat

SEQ ID NO: 88169 - DNA, 22 bp, Homo sapiens
tcttgcacttcatgaatatgtt

SEQ ID NO: 88170 - DNA, 22 bp, Homo sapiens
atctccgaaagtcttgtcaccc

SEQ ID NO: 88171 - DNA, 22 bp, Homo sapiens
tgtgcatgtgtctttatagtag

SEQ ID NO: 88172 - DNA, 22 bp, Homo sapiens
ggaggtggagctggaagttcca

SEQ ID NO: 88173 - DNA, 22 bp, Homo sapiens
agcttgtagaaggccacgagca

SEQ ID NO: 88174 - DNA, 22 bp, Homo sapiens
ttaccaaatgaaatagagattt

SEQ ID NO: 88175 - DNA, 22 bp, Homo sapiens
cggagcctgcttgttgcagctg

SEQ ID NO: 88176 - DNA, 22 bp, Homo sapiens
ggtctcttgtccaaggtcacac

SEQ ID NO: 88177 - DNA, 22 bp, Homo sapiens
gtggcccaggttggagtgcagt

SEQ ID NO: 88178 - DNA, 22 bp, Homo sapiens
agcagcagtatccttccccggc

SEQ ID NO: 88179 - DNA, 22 bp, Homo sapiens
tattattgacatttacttggtg

SEQ ID NO: 88180 - DNA, 22 bp, Homo sapiens
acagcacttgggttttcctgtt

SEQ ID NO: 88181 - DNA, 22 bp, Homo sapiens
agaaatcctgatggagtctgaa

SEQ ID NO: 88182 - DNA, 23 bp, Homo sapiens
tctctgcatgtcctgagcacatc

SEQ ID NO: 88183 - DNA, 22 bp, Homo sapiens
cctgattcagtggtgcccagag

SEQ ID NO: 88184 - DNA, 22 bp, Homo sapiens
gcaaacaaggacatacatcctg

SEQ ID NO: 88185 - DNA, 22 bp, Homo sapiens
ctggaaggcagaggttgcagtg

SEQ ID NO: 88186 - DNA, 22 bp, Homo sapiens
tctctggttatgtcattaagca

SEQ ID NO: 88187 - DNA, 22 bp, Homo sapiens
ggtgtagctctgtgtcccactg

SEQ ID NO: 88188 - DNA, 19 bp, Homo sapiens
tctagttttgagagacttc

SEQ ID NO: 88189 - DNA, 22 bp, Homo sapiens
aggaattggcacggccttctca

SEQ ID NO: 88190 - DNA, 22 bp, Homo sapiens
gtgctgacaggagcctggcggt

SEQ ID NO: 88191 - DNA, 22 bp, Homo sapiens
atgcacctgaactccatcagct

SEQ ID NO: 88192 - DNA, 22 bp, Homo sapiens
tctcagggctcagagctcaggc

SEQ ID NO: 88193 - DNA, 20 bp, Homo sapiens
gccaacgcgctggggctgcc

SEQ ID NO: 88194 - DNA, 22 bp, Homo sapiens
ggctcagatggtttgttctaga

SEQ ID NO: 88195 - DNA, 22 bp, Homo sapiens
ctgtcaggtttcccggctcacg

SEQ ID NO: 88196 - DNA, 22 bp, Homo sapiens
cgggaaggtggaggttgcagtg

SEQ ID NO: 88197 - DNA, 22 bp, Homo sapiens
gagccaggtcgggccgcggcga

SEQ ID NO: 88198 - DNA, 22 bp, Homo sapiens
gatatcattgagcccaggagtt

SEQ ID NO: 88199 - DNA, 20 bp, Homo sapiens
tttctgtgagaaacactgtt

SEQ ID NO: 88200 - DNA, 22 bp, Homo sapiens
aggtgcccatgagctccatggc

SEQ ID NO: 88201 - DNA, 22 bp, Homo sapiens
tacttttcctggaaccactgct

SEQ ID NO: 88202 - DNA, 22 bp, Homo sapiens
gagcactgatttatttttgtct

SEQ ID NO: 88203 - DNA, 22 bp, Homo sapiens
gctgtgtatcagatgccacggg

SEQ ID NO: 88204 - DNA, 22 bp, Homo sapiens
gccctagcgccagctcagcacc

SEQ ID NO: 88205 - DNA, 22 bp, Homo sapiens
atcaaatacaaagggcataagg

SEQ ID NO: 88206 - DNA, 22 bp, Homo sapiens
gcaggtctatcaggctgcaggt

SEQ ID NO: 88207 - DNA, 22 bp, Homo sapiens
tgcctgatgcaggagtatcaga

SEQ ID NO: 88208 - DNA, 22 bp, Homo sapiens
aagcctggcacattggagtctg

SEQ ID NO: 88209 - DNA, 22 bp, Homo sapiens
aggaggaagggaagacaagtaa

SEQ ID NO: 88210 - DNA, 22 bp, Homo sapiens
tgacatttcctagtgctttgtg

SEQ ID NO: 88211 - DNA, 22 bp, Homo sapiens
tgcaagctgacatccagagaga

SEQ ID NO: 88212 - DNA, 22 bp, Homo sapiens
cgtgaggggggtaaggcgtccg

SEQ ID NO: 88213 - DNA, 22 bp, Homo sapiens
ctcgttgctgaagccaaagtca

SEQ ID NO: 88214 - DNA, 22 bp, Homo sapiens
tctgttgcaatgtgcatggtga

SEQ ID NO: 88215 - DNA, 22 bp, Homo sapiens
gcatgtgtctttatagcagcat

SEQ ID NO: 88216 - DNA, 22 bp, Homo sapiens
ctcattgcaacctccgcctccc

SEQ ID NO: 88217 - DNA, 22 bp, Homo sapiens
tgctcttcacagtttcagcatc

SEQ ID NO: 88218 - DNA, 22 bp, Homo sapiens
gccttgccgctcagcagtgggg

SEQ ID NO: 88219 - DNA, 19 bp, Homo sapiens
gcataaatacactattgtc

SEQ ID NO: 88220 - DNA, 21 bp, Homo sapiens
ttgctgttttcccaatgcagt

SEQ ID NO: 88221 - DNA, 22 bp, Homo sapiens
aagagggctgcaatcttattgc

SEQ ID NO: 88222 - DNA, 22 bp, Homo sapiens
acgtagcactgagagatgcagg

SEQ ID NO: 88223 - DNA, 22 bp, Homo sapiens
agtgctgtctccttcccccggg

SEQ ID NO: 88224 - DNA, 22 bp, Homo sapiens
gggcgccgtgggaaacagccgg

SEQ ID NO: 88225 - DNA, 22 bp, Homo sapiens
tagagtgtcataacagtgccca

SEQ ID NO: 88226 - DNA, 22 bp, Homo sapiens
tgctcccaaacctgacaggctc

SEQ ID NO: 88227 - DNA, 22 bp, Homo sapiens
ctggcaggttatagagctgccc

SEQ ID NO: 88228 - DNA, 22 bp, Homo sapiens
accctgctttatgccgtcctct

SEQ ID NO: 88229 - DNA, 22 bp, Homo sapiens
ggccttggttccaaagcaggca

SEQ ID NO: 88230 - DNA, 22 bp, Homo sapiens
ccctggaggcggagcttgcagt

SEQ ID NO: 88231 - DNA, 22 bp, Homo sapiens
cggaagagggacagcgccagcc

SEQ ID NO: 88232 - DNA, 22 bp, Homo sapiens
tggcggcgtgtggactgaggac

SEQ ID NO: 88233 - DNA, 22 bp, Homo sapiens
gagccaagattgtgtccctgca

SEQ ID NO: 88234 - DNA, 21 bp, Homo sapiens
aggcatgagccctgcatggac

SEQ ID NO: 88235 - DNA, 22 bp, Homo sapiens
cagggagtgtacaccatgtgta

SEQ ID NO: 88236 - DNA, 22 bp, Homo sapiens
caggctgatcagggctgggatg

SEQ ID NO: 88237 - DNA, 22 bp, Homo sapiens
cttgacactgtcactcaggcca

SEQ ID NO: 88238 - DNA, 19 bp, Homo sapiens
aggcttcaggccacatgct

SEQ ID NO: 88239 - DNA, 22 bp, Homo sapiens
ctcactgcaacctctgcctccc

SEQ ID NO: 88240 - DNA, 19 bp, Homo sapiens
ccacagcctgctgtcttcc

SEQ ID NO: 88241 - DNA, 19 bp, Homo sapiens
aggtggctgaaactacaga

SEQ ID NO: 88242 - DNA, 22 bp, Homo sapiens
gacgcatcaggaggcgaggagc

SEQ ID NO: 88243 - DNA, 22 bp, Homo sapiens
atgcccaatgtcacaatttttg

SEQ ID NO: 88244 - DNA, 22 bp, Homo sapiens
caagcttgtttctcctgggggt

SEQ ID NO: 88245 - DNA, 22 bp, Homo sapiens
agcttagtggttgtatgagtta

SEQ ID NO: 88246 - DNA, 22 bp, Homo sapiens
tctgcgcgctgctggtaccgaa

SEQ ID NO: 88247 - DNA, 22 bp, Homo sapiens
tgtcctcgtccgcctcgaactc

SEQ ID NO: 88248 - DNA, 21 bp, Homo sapiens
cttccccaggctggtctgtat

SEQ ID NO: 88249 - DNA, 22 bp, Homo sapiens
ccaggcaggcgatggtgcagtg

SEQ ID NO: 88250 - DNA, 22 bp, Homo sapiens
cactgcactccatcctgggaaa

SEQ ID NO: 88251 - DNA, 22 bp, Homo sapiens
tgcacgtgggctctctgctctt

SEQ ID NO: 88252 - DNA, 22 bp, Homo sapiens
gaggcaggaggattgcttgagc

SEQ ID NO: 88253 - DNA, 19 bp, Homo sapiens
atgtacccagtgtcaatcc

SEQ ID NO: 88254 - DNA, 22 bp, Homo sapiens
agtggagacaggacagtcgata

SEQ ID NO: 88255 - DNA, 22 bp, Homo sapiens
ctttggcaatgtcattttcaat

SEQ ID NO: 88256 - DNA, 22 bp, Homo sapiens
tctgggtccgggactgtggatg

SEQ ID NO: 88257 - DNA, 22 bp, Homo sapiens
tgatctaggttggcttcaactg

SEQ ID NO: 88258 - DNA, 22 bp, Homo sapiens
atcctccagctcctgcttctgc

SEQ ID NO: 88259 - DNA, 22 bp, Homo sapiens
caagagtgaaactctgtctcaa

SEQ ID NO: 88260 - DNA, 22 bp, Homo sapiens
ccgggccccacggtgacctcag

SEQ ID NO: 88261 - DNA, 22 bp, Homo sapiens
gccaggctgaggctctggaaga

SEQ ID NO: 88262 - DNA, 22 bp, Homo sapiens
actgccaatggtagtttgatgg

SEQ ID NO: 88263 - DNA, 23 bp, Homo sapiens
tcatcttcctcatttctccaggg

SEQ ID NO: 88264 - DNA, 22 bp, Homo sapiens
gctggagaggatcccaaagcca

SEQ ID NO: 88265 - DNA, 22 bp, Homo sapiens
tgggctgcaggggttgagagct

SEQ ID NO: 88266 - DNA, 22 bp, Homo sapiens
ccactgtgcccagcctcatggg

SEQ ID NO: 88267 - DNA, 22 bp, Homo sapiens
agatgtgtttctagttcctgca

SEQ ID NO: 88268 - DNA, 22 bp, Homo sapiens
tgatctggtcctactgtgggca

SEQ ID NO: 88269 - DNA, 22 bp, Homo sapiens
ttcccagtcaaacgaaggactt

SEQ ID NO: 88270 - DNA, 22 bp, Homo sapiens
taggtcagaacaagcagtatcg

SEQ ID NO: 88271 - DNA, 22 bp, Homo sapiens
caggctggagtgcagtggcgct

SEQ ID NO: 88272 - DNA, 23 bp, Homo sapiens
acagtcgtaggtatccttttcct

SEQ ID NO: 88273 - DNA, 22 bp, Homo sapiens
ctcagccccagcccagatagca

SEQ ID NO: 88274 - DNA, 22 bp, Homo sapiens
ttccctccatttcattttataa

SEQ ID NO: 88275 - DNA, 22 bp, Homo sapiens
cagtcactggaatagctgagga

SEQ ID NO: 88276 - DNA, 22 bp, Homo sapiens
ggaaggggtgggtgagcctcag

SEQ ID NO: 88277 - DNA, 22 bp, Homo sapiens
tgagggaatattgatagatccg

SEQ ID NO: 88278 - DNA, 22 bp, Homo sapiens
ctttgcttgacactgtgattgt

SEQ ID NO: 88279 - DNA, 22 bp, Homo sapiens
tccccatgtctgcagggagggt

SEQ ID NO: 88280 - DNA, 22 bp, Homo sapiens
ttagggttacaccagcctcctg

SEQ ID NO: 88281 - DNA, 22 bp, Homo sapiens
aataaaatggtcagttttctca

SEQ ID NO: 88282 - DNA, 19 bp, Homo sapiens
ccttgtctggtgaaggact

SEQ ID NO: 88283 - DNA, 22 bp, Homo sapiens
aaggcaggatgggaaaagattt

SEQ ID NO: 88284 - DNA, 22 bp, Homo sapiens
catttacatttaaggttaatat

SEQ ID NO: 88285 - DNA, 22 bp, Homo sapiens
ttggaagacaatgctgattctc

SEQ ID NO: 88286 - DNA, 17 bp, Homo sapiens
tgcatgtcctttgttcc

SEQ ID NO: 88287 - DNA, 22 bp, Homo sapiens
ctgtatctgtgttggatgagtt

SEQ ID NO: 88288 - DNA, 22 bp, Homo sapiens
gtgggccagcttttctcctggg

SEQ ID NO: 88289 - DNA, 22 bp, Homo sapiens
tggtccttctgtcttccgcacc

SEQ ID NO: 88290 - DNA, 22 bp, Homo sapiens
actgttgaagtgccagcttgat

SEQ ID NO: 88291 - DNA, 22 bp, Homo sapiens
gggacaatggaggcctctctcc

SEQ ID NO: 88292 - DNA, 22 bp, Homo sapiens
cccaggggttcaaggctgcagt

SEQ ID NO: 88293 - DNA, 22 bp, Homo sapiens
acagagcaatgcgtgttctcta

SEQ ID NO: 88294 - DNA, 22 bp, Homo sapiens
tcagcctgctccaagtgctgcc

SEQ ID NO: 88295 - DNA, 22 bp, Homo sapiens
tgaagactcagaagctaagata

SEQ ID NO: 88296 - DNA, 22 bp, Homo sapiens
ctgagatctttatacgaggcac

SEQ ID NO: 88297 - DNA, 22 bp, Homo sapiens
tcctccactttgtctagcaaca

SEQ ID NO: 88298 - DNA, 22 bp, Homo sapiens
gcgctgcgcctcctcttccgca

SEQ ID NO: 88299 - DNA, 22 bp, Homo sapiens
ctccaccccgtgccggtgctgg

SEQ ID NO: 88300 - DNA, 22 bp, Homo sapiens
tgtcagtgtctatgaagaattt

SEQ ID NO: 88301 - DNA, 22 bp, Homo sapiens
gtgagactcgcctttgtgtagc

SEQ ID NO: 88302 - DNA, 22 bp, Homo sapiens
aaagtaattgcagtttctgcca

SEQ ID NO: 88303 - DNA, 22 bp, Homo sapiens
tgtgtggattcatctcaaagag

SEQ ID NO: 88304 - DNA, 22 bp, Homo sapiens
tcttgggcaatttctctagagg

SEQ ID NO: 88305 - DNA, 22 bp, Homo sapiens
ttgtgggggctgccctgtacgg

SEQ ID NO: 88306 - DNA, 22 bp, Homo sapiens
actgcaacctccacctcctggg

SEQ ID NO: 88307 - DNA, 22 bp, Homo sapiens
actgcactccaacctgggtgac

SEQ ID NO: 88308 - DNA, 22 bp, Homo sapiens
actgcactccagcctgggtaac

SEQ ID NO: 88309 - DNA, 22 bp, Homo sapiens
agcgctgtgggcgtgcgaggag

SEQ ID NO: 88310 - DNA, 22 bp, Homo sapiens
tctgccttttactagctggatg

SEQ ID NO: 88311 - DNA, 22 bp, Homo sapiens
cccaggaggttgaggctgcagt

SEQ ID NO: 88312 - DNA, 22 bp, Homo sapiens
ggtgttgcagttgaagactggt

SEQ ID NO: 88313 - DNA, 22 bp, Homo sapiens
gctgtggcctggcgcagagctg

SEQ ID NO: 88314 - DNA, 22 bp, Homo sapiens
tccgtggggcctgtggcttccg

SEQ ID NO: 88315 - DNA, 19 bp, Homo sapiens
agggagtttatatttgcac

SEQ ID NO: 88316 - DNA, 22 bp, Homo sapiens
aatactgcctgtgaggtaactc

SEQ ID NO: 88317 - DNA, 22 bp, Homo sapiens
agagcagctcgctacctctcta

SEQ ID NO: 88318 - DNA, 22 bp, Homo sapiens
gtaggccatggtggttgtctct

SEQ ID NO: 88319 - DNA, 22 bp, Homo sapiens
gctcagaggcacgacctcttgg

SEQ ID NO: 88320 - DNA, 22 bp, Homo sapiens
cattctctctacttgttttcaa

SEQ ID NO: 88321 - DNA, 22 bp, Homo sapiens
ttctcatgaaactcgcttcctc

SEQ ID NO: 88322 - DNA, 21 bp, Homo sapiens
aggcttggatctagacaggcc

SEQ ID NO: 88323 - DNA, 22 bp, Homo sapiens
tattcatagtaaacaaaagtgg

SEQ ID NO: 88324 - DNA, 22 bp, Homo sapiens
aaccaggtgactcatggtgagc

SEQ ID NO: 88325 - DNA, 21 bp, Homo sapiens
gttctacagttttagaattcc

SEQ ID NO: 88326 - DNA, 22 bp, Homo sapiens
tatcactacacctggctaatta

SEQ ID NO: 88327 - DNA, 22 bp, Homo sapiens
ttgtagtctaggatagattttt

SEQ ID NO: 88328 - DNA, 19 bp, Homo sapiens
gttctttcatagtaagagc

SEQ ID NO: 88329 - DNA, 22 bp, Homo sapiens
tctgctcagccgatctgctccg

SEQ ID NO: 88330 - DNA, 22 bp, Homo sapiens
tcattacaagatttccaatttg

SEQ ID NO: 88331 - DNA, 22 bp, Homo sapiens
gtcctgacggctgattggcctg

SEQ ID NO: 88332 - DNA, 22 bp, Homo sapiens
agtccaggcattccagccattc

SEQ ID NO: 88333 - DNA, 22 bp, Homo sapiens
ttatttttaaaagttcacacag

SEQ ID NO: 88334 - DNA, 22 bp, Homo sapiens
caaatgtataaatgtactttct

SEQ ID NO: 88335 - DNA, 22 bp, Homo sapiens
tgcgggttggtggcatatgcag

SEQ ID NO: 88336 - DNA, 22 bp, Homo sapiens
tctgtgcctgcttccccaccca

SEQ ID NO: 88337 - DNA, 22 bp, Homo sapiens
cggctggtgtcgggcacagcaa

SEQ ID NO: 88338 - DNA, 22 bp, Homo sapiens
gcctgcagggcctgggcctacc

SEQ ID NO: 88339 - DNA, 22 bp, Homo sapiens
tttgtggcaggagcggagaccg

SEQ ID NO: 88340 - DNA, 22 bp, Homo sapiens
agaaaatttaaagagacacaca

SEQ ID NO: 88341 - DNA, 21 bp, Homo sapiens
tgactgaggcttcttcacaca

SEQ ID NO: 88342 - DNA, 22 bp, Homo sapiens
ataaaatttgctactgttaaat

SEQ ID NO: 88343 - DNA, 22 bp, Homo sapiens
cgagagatgggttggcaggggc

SEQ ID NO: 88344 - DNA, 22 bp, Homo sapiens
atggatttgcttatacacatgt

SEQ ID NO: 88345 - DNA, 22 bp, Homo sapiens
ggaagtcctcatacctgattct

SEQ ID NO: 88346 - DNA, 22 bp, Homo sapiens
tcagtgatttctggggtgaggg

SEQ ID NO: 88347 - DNA, 22 bp, Homo sapiens
acagcagagcctggtacttact

SEQ ID NO: 88348 - DNA, 17 bp, Homo sapiens
gggcagggactcctggg

SEQ ID NO: 88349 - DNA, 22 bp, Homo sapiens
gatgatcatctgtaaagttaga

SEQ ID NO: 88350 - DNA, 22 bp, Homo sapiens
tggcccgaagatccgagggtca

SEQ ID NO: 88351 - DNA, 22 bp, Homo sapiens
atcatgttttaattagcaaact

SEQ ID NO: 88352 - DNA, 22 bp, Homo sapiens
tcactgcaacctccacctcccg

SEQ ID NO: 88353 - DNA, 22 bp, Homo sapiens
gagaggaagccttctgtacttg

SEQ ID NO: 88354 - DNA, 22 bp, Homo sapiens
gcgaggaggggtgctgggcccc

SEQ ID NO: 88355 - DNA, 22 bp, Homo sapiens
ggttccacctggcgaggggtat

SEQ ID NO: 88356 - DNA, 22 bp, Homo sapiens
aggaattgtgttgtagtggaga

SEQ ID NO: 88357 - DNA, 22 bp, Homo sapiens
aggccttaccatagctgtagca

SEQ ID NO: 88358 - DNA, 22 bp, Homo sapiens
ttgtccgtggtgagttcgcatt

SEQ ID NO: 88359 - DNA, 21 bp, Homo sapiens
gggcactgaaagggaatagca

SEQ ID NO: 88360 - DNA, 22 bp, Homo sapiens
cggccgcagcagtgtcggccca

SEQ ID NO: 88361 - DNA, 22 bp, Homo sapiens
cgcgaggtggaggttgcagtga

SEQ ID NO: 88362 - DNA, 22 bp, Homo sapiens
atggctagcaccgcgttgctgg

SEQ ID NO: 88363 - DNA, 22 bp, Homo sapiens
gggacgacaggctctgtggtag

SEQ ID NO: 88364 - DNA, 22 bp, Homo sapiens
gggccgtagaccacgtccgggc

SEQ ID NO: 88365 - DNA, 22 bp, Homo sapiens
tgtctccaccatcatcttacca

SEQ ID NO: 88366 - DNA, 22 bp, Homo sapiens
caggaggttgagggtgcagtga

SEQ ID NO: 88367 - DNA, 22 bp, Homo sapiens
ctctggagtgtctggccagggt

SEQ ID NO: 88368 - DNA, 22 bp, Homo sapiens
ccttcattcattaatttagccc

SEQ ID NO: 88369 - DNA, 22 bp, Homo sapiens
ccacaggggcccacgagccgct

SEQ ID NO: 88370 - DNA, 22 bp, Homo sapiens
ttacctctagctctttgcttgt

SEQ ID NO: 88371 - DNA, 22 bp, Homo sapiens
ccctcccaggagtggccagaga

SEQ ID NO: 88372 - DNA, 22 bp, Homo sapiens
agggccagcactcctggcagga

SEQ ID NO: 88373 - DNA, 22 bp, Homo sapiens
tttggtgttccggtcattgctg

SEQ ID NO: 88374 - DNA, 22 bp, Homo sapiens
tcacatctaattccatttctgc

SEQ ID NO: 88375 - DNA, 22 bp, Homo sapiens
aaattacagccttgggtagctt

SEQ ID NO: 88376 - DNA, 22 bp, Homo sapiens
taatggttttttggagactgct

SEQ ID NO: 88377 - DNA, 22 bp, Homo sapiens
ggccctgggccctctagcttgt

SEQ ID NO: 88378 - DNA, 22 bp, Homo sapiens
aaaatatgtataactcttctgc

SEQ ID NO: 88379 - DNA, 22 bp, Homo sapiens
ttgatcaaatcagctactgagg

SEQ ID NO: 88380 - DNA, 22 bp, Homo sapiens
ggctgccttccctgagccccgg

SEQ ID NO: 88381 - DNA, 22 bp, Homo sapiens
gggacttcatagctaggcactt

SEQ ID NO: 88382 - DNA, 19 bp, Homo sapiens
catctggatgattctcctg

SEQ ID NO: 88383 - DNA, 22 bp, Homo sapiens
aatgttgcagagtgattgtcca

SEQ ID NO: 88384 - DNA, 22 bp, Homo sapiens
tcttaagcagagaagaagttga

SEQ ID NO: 88385 - DNA, 22 bp, Homo sapiens
tgcctaggctggagtgtagtgg

SEQ ID NO: 88386 - DNA, 22 bp, Homo sapiens
ttgtggaactcatctgcctggt

SEQ ID NO: 88387 - DNA, 22 bp, Homo sapiens
gggtcgggcaggcgccctcgtc

SEQ ID NO: 88388 - DNA, 23 bp, Homo sapiens
tcatgcccaggctccagatgtca

SEQ ID NO: 88389 - DNA, 22 bp, Homo sapiens
acaggatcgccctgttgcccag

SEQ ID NO: 88390 - DNA, 22 bp, Homo sapiens
tgctcgccccacatgccctcat

SEQ ID NO: 88391 - DNA, 22 bp, Homo sapiens
gtgaccatcatctcagctagtt

SEQ ID NO: 88392 - DNA, 19 bp, Homo sapiens
gccttcccaccacccgtcc

SEQ ID NO: 88393 - DNA, 22 bp, Homo sapiens
gcagagtgctgtcgtacgcccc

SEQ ID NO: 88394 - DNA, 22 bp, Homo sapiens
attgcactccggcctgggtgac

SEQ ID NO: 88395 - DNA, 22 bp, Homo sapiens
ccagaggagttgaggctttggg

SEQ ID NO: 88396 - DNA, 22 bp, Homo sapiens
aggggaatgggtagactgttga

SEQ ID NO: 88397 - DNA, 22 bp, Homo sapiens
caggctggagtgcagtggtgcc

SEQ ID NO: 88398 - DNA, 22 bp, Homo sapiens
agcccaggttgaggctgcagtg

SEQ ID NO: 88399 - DNA, 19 bp, Homo sapiens
gctgaggtggaggaaggag

SEQ ID NO: 88400 - DNA, 22 bp, Homo sapiens
gaaaattattgaaaatggctct

SEQ ID NO: 88401 - DNA, 22 bp, Homo sapiens
cttgcctttgtcttcaaaggct

SEQ ID NO: 88402 - DNA, 22 bp, Homo sapiens
agcttgtgtttttctaagtatc

SEQ ID NO: 88403 - DNA, 22 bp, Homo sapiens
cattaaacaaccttgaatcaat

SEQ ID NO: 88404 - DNA, 22 bp, Homo sapiens
atgccactgcgctccagcctgg

SEQ ID NO: 88405 - DNA, 22 bp, Homo sapiens
tttgcttcacaagtatggttct

SEQ ID NO: 88406 - DNA, 22 bp, Homo sapiens
ggtgtctatgattcagtttatg

SEQ ID NO: 88407 - DNA, 22 bp, Homo sapiens
cgggttcacgccattctcctgc

SEQ ID NO: 88408 - DNA, 22 bp, Homo sapiens
tgatttatgcattatactgttg

SEQ ID NO: 88409 - DNA, 22 bp, Homo sapiens
acccatggtctggtggggccct

SEQ ID NO: 88410 - DNA, 22 bp, Homo sapiens
atcagagtgtaagttctttcct

SEQ ID NO: 88411 - DNA, 21 bp, Homo sapiens
tttcttaggctctaaaatgac

SEQ ID NO: 88412 - DNA, 22 bp, Homo sapiens
aggatcagggtggtggaagtca

SEQ ID NO: 88413 - DNA, 22 bp, Homo sapiens
tttgaacagtagcttaggtgtg

SEQ ID NO: 88414 - DNA, 22 bp, Homo sapiens
tccccaagcaggcaatctcccg

SEQ ID NO: 88415 - DNA, 22 bp, Homo sapiens
gcggcccgagcaggacgggtgg

SEQ ID NO: 88416 - DNA, 22 bp, Homo sapiens
tcccaggccacacttggggaac

SEQ ID NO: 88417 - DNA, 22 bp, Homo sapiens
tgtcacagtttgtactttatag

SEQ ID NO: 88418 - DNA, 22 bp, Homo sapiens
gggcggatcatttgaggtcagg

SEQ ID NO: 88419 - DNA, 22 bp, Homo sapiens
actgcactcctgcctgggtaac

SEQ ID NO: 88420 - DNA, 22 bp, Homo sapiens
actgcaacctccgcctgccagg

SEQ ID NO: 88421 - DNA, 22 bp, Homo sapiens
ctgggcacagcgttgggctctt

SEQ ID NO: 88422 - DNA, 22 bp, Homo sapiens
ggccagaagttggaaaagagcc

SEQ ID NO: 88423 - DNA, 22 bp, Homo sapiens
ggggtcggggcatagccactta

SEQ ID NO: 88424 - DNA, 22 bp, Homo sapiens
caaagtggaggctctggggcca

SEQ ID NO: 88425 - DNA, 22 bp, Homo sapiens
tgagcacatgccagcccttctc

SEQ ID NO: 88426 - DNA, 22 bp, Homo sapiens
ccaggcagcctgctccattctg

SEQ ID NO: 88427 - DNA, 22 bp, Homo sapiens
gtagctctgtttaaagttcttt

SEQ ID NO: 88428 - DNA, 22 bp, Homo sapiens
gccctgtgcaggtgtgcagcag

SEQ ID NO: 88429 - DNA, 22 bp, Homo sapiens
ggacctgaacataaaacgaggc

SEQ ID NO: 88430 - DNA, 22 bp, Homo sapiens
ctacaccggagcctggaaggta

SEQ ID NO: 88431 - DNA, 22 bp, Homo sapiens
tgaaatctttagtttctgtccc

SEQ ID NO: 88432 - DNA, 22 bp, Homo sapiens
gccagcagcttcttctcatcct

SEQ ID NO: 88433 - DNA, 22 bp, Homo sapiens
acagaagcctttggccatttga

SEQ ID NO: 88434 - DNA, 22 bp, Homo sapiens
tcacttagatggggatcatcac

SEQ ID NO: 88435 - DNA, 22 bp, Homo sapiens
ggctgtggagctgcagagttgg

SEQ ID NO: 88436 - DNA, 22 bp, Homo sapiens
tgagcctgtcattattcagaga

SEQ ID NO: 88437 - DNA, 22 bp, Homo sapiens
tgagacgaagtcttgctctgtt

SEQ ID NO: 88438 - DNA, 22 bp, Homo sapiens
ctggaaggcggaggttgtagtg

SEQ ID NO: 88439 - DNA, 22 bp, Homo sapiens
taactaggattacaagcgtgcg

SEQ ID NO: 88440 - DNA, 22 bp, Homo sapiens
ggaggcggaagttgcagtgagc

SEQ ID NO: 88441 - DNA, 22 bp, Homo sapiens
aggtcaccatggcatgctccac

SEQ ID NO: 88442 - DNA, 22 bp, Homo sapiens
cactgcactccagcctgggtga

SEQ ID NO: 88443 - DNA, 22 bp, Homo sapiens
ggtggctgcaatggctaacttc

SEQ ID NO: 88444 - DNA, 22 bp, Homo sapiens
tttctcctcatgactggttgtg

SEQ ID NO: 88445 - DNA, 22 bp, Homo sapiens
tcctgccgtcctccggggcctc

SEQ ID NO: 88446 - DNA, 22 bp, Homo sapiens
cctgacaggcggaggctgcagt

SEQ ID NO: 88447 - DNA, 22 bp, Homo sapiens
gggaatgtagcaaatctgcaat

SEQ ID NO: 88448 - DNA, 22 bp, Homo sapiens
gcttggccagcagccgggatgc

SEQ ID NO: 88449 - DNA, 22 bp, Homo sapiens
ccagagctgattcctgggactt

SEQ ID NO: 88450 - DNA, 22 bp, Homo sapiens
tctcatggagtcaggagcagaa

SEQ ID NO: 88451 - DNA, 22 bp, Homo sapiens
tttgaagccatgtcaatagttt

SEQ ID NO: 88452 - DNA, 22 bp, Homo sapiens
ttgtgaatagtgccgcaataaa

SEQ ID NO: 88453 - DNA, 22 bp, Homo sapiens
atctgggagcggaggttgcagt

SEQ ID NO: 88454 - DNA, 22 bp, Homo sapiens
accctcaacaaattcactctat

SEQ ID NO: 88455 - DNA, 22 bp, Homo sapiens
attctggacaaggcaagctcct

SEQ ID NO: 88456 - DNA, 22 bp, Homo sapiens
caaaatgcatctgagaccaggc

SEQ ID NO: 88457 - DNA, 22 bp, Homo sapiens
atcagagtagttgttgcccaga

SEQ ID NO: 88458 - DNA, 22 bp, Homo sapiens
ttggaaacgtcaccttttcctt

SEQ ID NO: 88459 - DNA, 16 bp, Homo sapiens
gcagaggaaaggggag

SEQ ID NO: 88460 - DNA, 22 bp, Homo sapiens
tgccaccccggaccccgaagtg

SEQ ID NO: 88461 - DNA, 22 bp, Homo sapiens
ggagagcagggaggctgctctg

SEQ ID NO: 88462 - DNA, 22 bp, Homo sapiens
ctgagatggagtttcgctcttc

SEQ ID NO: 88463 - DNA, 22 bp, Homo sapiens
ggtaacttagctcatggctgtg

SEQ ID NO: 88464 - DNA, 22 bp, Homo sapiens
tcacagctcactgtagcctcga

SEQ ID NO: 88465 - DNA, 22 bp, Homo sapiens
gaccttgtgatctgcccacctt

SEQ ID NO: 88466 - DNA, 22 bp, Homo sapiens
aatggccagacagatggctgct

SEQ ID NO: 88467 - DNA, 22 bp, Homo sapiens
aggggagagttaatgtgaatgt

SEQ ID NO: 88468 - DNA, 22 bp, Homo sapiens
gggagaggttacccgagcaact

SEQ ID NO: 88469 - DNA, 22 bp, Homo sapiens
gccctccagcctgtggaaccgg

SEQ ID NO: 88470 - DNA, 22 bp, Homo sapiens
tgccagattgtggcatggcact

SEQ ID NO: 88471 - DNA, 22 bp, Homo sapiens
tgggaggccgaggcaggtggat

SEQ ID NO: 88472 - DNA, 22 bp, Homo sapiens
agcctgggccctgcctcttctc

SEQ ID NO: 88473 - DNA, 22 bp, Homo sapiens
tctttctacatcatttgcttct

SEQ ID NO: 88474 - DNA, 22 bp, Homo sapiens
tcattgagttgcacttttacta

SEQ ID NO: 88475 - DNA, 22 bp, Homo sapiens
ttctggaaggatgtttctatct

SEQ ID NO: 88476 - DNA, 22 bp, Homo sapiens
tccgcccgcacgtatggagtgg

SEQ ID NO: 88477 - DNA, 22 bp, Homo sapiens
gctgctttgtctgtaaaatgga

SEQ ID NO: 88478 - DNA, 22 bp, Homo sapiens
tctccgatcacaggttttcaat

SEQ ID NO: 88479 - DNA, 22 bp, Homo sapiens
tcttcatgtcatggtatattga

SEQ ID NO: 88480 - DNA, 22 bp, Homo sapiens
cagccacttgtgatgctgggga

SEQ ID NO: 88481 - DNA, 22 bp, Homo sapiens
ttggagaggcagtcttgctctg

SEQ ID NO: 88482 - DNA, 22 bp, Homo sapiens
ccaggctggagtgcaatggcgt

SEQ ID NO: 88483 - DNA, 23 bp, Homo sapiens
tcggtgggcgtggaggccgaggc

SEQ ID NO: 88484 - DNA, 22 bp, Homo sapiens
cacgggagacgtgatcttggac

SEQ ID NO: 88485 - DNA, 18 bp, Homo sapiens
ggctcaagtgatcctcct

SEQ ID NO: 88486 - DNA, 22 bp, Homo sapiens
ccagcagagcatggggaggaag

SEQ ID NO: 88487 - DNA, 22 bp, Homo sapiens
atccccctcttggatggcggca

SEQ ID NO: 88488 - DNA, 22 bp, Homo sapiens
gcttaattctggctcagtttcc

SEQ ID NO: 88489 - DNA, 22 bp, Homo sapiens
agcttgacagacagatggtagc

SEQ ID NO: 88490 - DNA, 22 bp, Homo sapiens
tggcctcggcatccagcaagag

SEQ ID NO: 88491 - DNA, 22 bp, Homo sapiens
gaccaagatacagcatcataga

SEQ ID NO: 88492 - DNA, 20 bp, Homo sapiens
ccagagctgatggctgcccg

SEQ ID NO: 88493 - DNA, 23 bp, Homo sapiens
aatgggtgcaactatccatgaca

SEQ ID NO: 88494 - DNA, 22 bp, Homo sapiens
agatgtgagaatcaagtgacca

SEQ ID NO: 88495 - DNA, 22 bp, Homo sapiens
tcgtgatctgtccacctcggcc

SEQ ID NO: 88496 - DNA, 22 bp, Homo sapiens
cagtggcctctggctttgctgt

SEQ ID NO: 88497 - DNA, 22 bp, Homo sapiens
taggaatggtgctcagcagaaa

SEQ ID NO: 88498 - DNA, 22 bp, Homo sapiens
agcaggagtttgatgcttttat

SEQ ID NO: 88499 - DNA, 22 bp, Homo sapiens
taattctgacaacagtggcgtt

SEQ ID NO: 88500 - DNA, 22 bp, Homo sapiens
taggcatgcaaataaatgtgca

SEQ ID NO: 88501 - DNA, 22 bp, Homo sapiens
gctccgtgggcattgctaggtg

SEQ ID NO: 88502 - DNA, 22 bp, Homo sapiens
gcagctgacatctggctgggcc

SEQ ID NO: 88503 - DNA, 22 bp, Homo sapiens
acgatgatgaaagagaacattc

SEQ ID NO: 88504 - DNA, 22 bp, Homo sapiens
aagaggtttaactgactcacag

SEQ ID NO: 88505 - DNA, 21 bp, Homo sapiens
gttcttgcaggatttccttcc

SEQ ID NO: 88506 - DNA, 16 bp, Homo sapiens
aggctcagaggctgga

SEQ ID NO: 88507 - DNA, 22 bp, Homo sapiens
gctcgtacaccagcgtggaggt

SEQ ID NO: 88508 - DNA, 22 bp, Homo sapiens
ttacaattacttgatctcagct

SEQ ID NO: 88509 - DNA, 17 bp, Homo sapiens
catccgtgagctcggca

SEQ ID NO: 88510 - DNA, 22 bp, Homo sapiens
caacatggcgaaaccccatctc

SEQ ID NO: 88511 - DNA, 22 bp, Homo sapiens
gtggggtagatctttctcagga

SEQ ID NO: 88512 - DNA, 18 bp, Homo sapiens
ccctcttgcacaaagcaa

SEQ ID NO: 88513 - DNA, 22 bp, Homo sapiens
atgccactgcacttcagcttgg

SEQ ID NO: 88514 - DNA, 22 bp, Homo sapiens
aggccctattcaatggggccca

SEQ ID NO: 88515 - DNA, 22 bp, Homo sapiens
ttttctagggtgctaaatgaac

SEQ ID NO: 88516 - DNA, 22 bp, Homo sapiens
tgtgaagaattaatgtgaatca

SEQ ID NO: 88517 - DNA, 22 bp, Homo sapiens
ctgattgagaaggaaggggatc

SEQ ID NO: 88518 - DNA, 22 bp, Homo sapiens
tttgatccgttgctggtgagga

SEQ ID NO: 88519 - DNA, 22 bp, Homo sapiens
ggttggtaactccctgtgcagt

SEQ ID NO: 88520 - DNA, 22 bp, Homo sapiens
aggtcacgtcctgtgatgtcat

SEQ ID NO: 88521 - DNA, 22 bp, Homo sapiens
ctgggttggggttacatgactg

SEQ ID NO: 88522 - DNA, 22 bp, Homo sapiens
gccggggctggggagagacatg

SEQ ID NO: 88523 - DNA, 22 bp, Homo sapiens
gaccatcctggccaacgtggta

SEQ ID NO: 88524 - DNA, 22 bp, Homo sapiens
gtcagatctttggggatgctgt

SEQ ID NO: 88525 - DNA, 22 bp, Homo sapiens
aagtgatgctacgactttgaca

SEQ ID NO: 88526 - DNA, 22 bp, Homo sapiens
tgtcctcatcctccagtctgtc

SEQ ID NO: 88527 - DNA, 22 bp, Homo sapiens
agaaatgggccttgggacacaa

SEQ ID NO: 88528 - DNA, 22 bp, Homo sapiens
gcccagtggtaaaagcaggcct

SEQ ID NO: 88529 - DNA, 22 bp, Homo sapiens
tcttgggcatgtgtttgatttc

SEQ ID NO: 88530 - DNA, 22 bp, Homo sapiens
gaggccactgtccctgccttcc

SEQ ID NO: 88531 - DNA, 22 bp, Homo sapiens
agacagggtgatcgcttgagcc

SEQ ID NO: 88532 - DNA, 22 bp, Homo sapiens
ggtcccaggttgacagggagac

SEQ ID NO: 88533 - DNA, 22 bp, Homo sapiens
agatcacagtggcaactccctt

SEQ ID NO: 88534 - DNA, 22 bp, Homo sapiens
tgccatagcaatggtaagctga

SEQ ID NO: 88535 - DNA, 22 bp, Homo sapiens
ctgctttggacaactattcttg

SEQ ID NO: 88536 - DNA, 22 bp, Homo sapiens
ccggagtgtctggcctgctggg

SEQ ID NO: 88537 - DNA, 22 bp, Homo sapiens
caggaaagggatgggctgccac

SEQ ID NO: 88538 - DNA, 22 bp, Homo sapiens
gggccagtgaacaatgagggaa

SEQ ID NO: 88539 - DNA, 22 bp, Homo sapiens
ctgccctggggggcctccttgc

SEQ ID NO: 88540 - DNA, 22 bp, Homo sapiens
ccaccgccatggcgttgtacag

SEQ ID NO: 88541 - DNA, 22 bp, Homo sapiens
aagaaggcggaccagaagggag

SEQ ID NO: 88542 - DNA, 22 bp, Homo sapiens
tgctccagcaccaagagctcca

SEQ ID NO: 88543 - DNA, 19 bp, Homo sapiens
caggcctcttaccctctct

SEQ ID NO: 88544 - DNA, 22 bp, Homo sapiens
cgcggtggcggcctccagcgcc

SEQ ID NO: 88545 - DNA, 22 bp, Homo sapiens
gggaaactttcacaatgtccag

SEQ ID NO: 88546 - DNA, 22 bp, Homo sapiens
gaggctgaggttgcagtgagcc

SEQ ID NO: 88547 - DNA, 22 bp, Homo sapiens
ttactttgcttcaggaagagga

SEQ ID NO: 88548 - DNA, 22 bp, Homo sapiens
cagagctggtgtgtcctggcat

SEQ ID NO: 88549 - DNA, 22 bp, Homo sapiens
cattgcaacttcaaactcctgg

SEQ ID NO: 88550 - DNA, 22 bp, Homo sapiens
ttttaatactgctattgtagga

SEQ ID NO: 88551 - DNA, 22 bp, Homo sapiens
gacaatatagttgaatgagcaa

SEQ ID NO: 88552 - DNA, 22 bp, Homo sapiens
ggctgagctccaagtattccat

SEQ ID NO: 88553 - DNA, 22 bp, Homo sapiens
agaaatatgctgattagatgaa

SEQ ID NO: 88554 - DNA, 22 bp, Homo sapiens
actccacaccacgggggccgcc

SEQ ID NO: 88555 - DNA, 22 bp, Homo sapiens
agtgaaaacctaatcatgcagt

SEQ ID NO: 88556 - DNA, 22 bp, Homo sapiens
ttgaggtccccagtacccactg

SEQ ID NO: 88557 - DNA, 22 bp, Homo sapiens
gtgtttggtcagacgtccgggg

SEQ ID NO: 88558 - DNA, 22 bp, Homo sapiens
tcccgttgatgacggtgcatcc

SEQ ID NO: 88559 - DNA, 22 bp, Homo sapiens
tgagtggacacctgcttcttta

SEQ ID NO: 88560 - DNA, 21 bp, Homo sapiens
cccagaagttccatggggggc

SEQ ID NO: 88561 - DNA, 22 bp, Homo sapiens
tgaagttgttaaggttgccatt

SEQ ID NO: 88562 - DNA, 19 bp, Homo sapiens
acacagggatcagagggtt

SEQ ID NO: 88563 - DNA, 22 bp, Homo sapiens
ggggtggatttcaggcggtgtc

SEQ ID NO: 88564 - DNA, 22 bp, Homo sapiens
aagaaatgctgatgttggatgg

SEQ ID NO: 88565 - DNA, 22 bp, Homo sapiens
cctgaggatgccagcatgggtg

SEQ ID NO: 88566 - DNA, 22 bp, Homo sapiens
caaccccactacacgttggaga

SEQ ID NO: 88567 - DNA, 22 bp, Homo sapiens
tttgaagactactgggagtgaa

SEQ ID NO: 88568 - DNA, 19 bp, Homo sapiens
gactccaactttaagcatg

SEQ ID NO: 88569 - DNA, 21 bp, Homo sapiens
tcttttctcagctttgtggtt

SEQ ID NO: 88570 - DNA, 22 bp, Homo sapiens
cagagcccctcgtctccaccac

SEQ ID NO: 88571 - DNA, 22 bp, Homo sapiens
ttggagatatcacaccttcaca

SEQ ID NO: 88572 - DNA, 22 bp, Homo sapiens
ttcgactctgtgcctgaagagc

SEQ ID NO: 88573 - DNA, 22 bp, Homo sapiens
gcgagaaactaagtgccctttg

SEQ ID NO: 88574 - DNA, 22 bp, Homo sapiens
ctgtaatcccagctactcggga

SEQ ID NO: 88575 - DNA, 22 bp, Homo sapiens
tcctgggacaagccgtggaagt

SEQ ID NO: 88576 - DNA, 22 bp, Homo sapiens
agccctggtttgcagcatttgc

SEQ ID NO: 88577 - DNA, 22 bp, Homo sapiens
gagagcaggaggcagcgggacg

SEQ ID NO: 88578 - DNA, 22 bp, Homo sapiens
cccaggaggcagagcttgcagt

SEQ ID NO: 88579 - DNA, 22 bp, Homo sapiens
agaagcagaaactgggcttgtg

SEQ ID NO: 88580 - DNA, 22 bp, Homo sapiens
agtacccttttcactgtcacaa

SEQ ID NO: 88581 - DNA, 22 bp, Homo sapiens
cctgggaggctgaggctgcagt

SEQ ID NO: 88582 - DNA, 22 bp, Homo sapiens
ctgtccatattcaaggggtagg

SEQ ID NO: 88583 - DNA, 22 bp, Homo sapiens
tatcacatttggagatttatga

SEQ ID NO: 88584 - DNA, 22 bp, Homo sapiens
acattaaaattgggtggggtaa

SEQ ID NO: 88585 - DNA, 22 bp, Homo sapiens
tcctgccaggagatggtagcca

SEQ ID NO: 88586 - DNA, 22 bp, Homo sapiens
ttccggacgcccgtcttccagc

SEQ ID NO: 88587 - DNA, 22 bp, Homo sapiens
tcagggctgcagaagaggcagg

SEQ ID NO: 88588 - DNA, 22 bp, Homo sapiens
tgggggtgtcctggtgcacaca

SEQ ID NO: 88589 - DNA, 22 bp, Homo sapiens
atttattcctttatggctggag

SEQ ID NO: 88590 - DNA, 22 bp, Homo sapiens
caacatggtaaaaccccgtctc

SEQ ID NO: 88591 - DNA, 22 bp, Homo sapiens
tgtctgatcatgaggcagggct

SEQ ID NO: 88592 - DNA, 22 bp, Homo sapiens
ttatatgtttctgtttggaggc

SEQ ID NO: 88593 - DNA, 22 bp, Homo sapiens
gatgcgggcccgctccactgcc

SEQ ID NO: 88594 - DNA, 22 bp, Homo sapiens
acccacgaagatgagcggcatg

SEQ ID NO: 88595 - DNA, 22 bp, Homo sapiens
aggctagaggcttctggcttca

SEQ ID NO: 88596 - DNA, 22 bp, Homo sapiens
gaggctgcagctatcagacatt

SEQ ID NO: 88597 - DNA, 22 bp, Homo sapiens
gagctcatccccatggtccgtc

SEQ ID NO: 88598 - DNA, 22 bp, Homo sapiens
gacagacacaattgatccatga

SEQ ID NO: 88599 - DNA, 22 bp, Homo sapiens
actgcacttcagcctgggtgtc

SEQ ID NO: 88600 - DNA, 22 bp, Homo sapiens
tgagcccagagatctgagctat

SEQ ID NO: 88601 - DNA, 22 bp, Homo sapiens
catggcactgagcaggtatgca

SEQ ID NO: 88602 - DNA, 22 bp, Homo sapiens
aggcactgtgcagtcccaagca

SEQ ID NO: 88603 - DNA, 22 bp, Homo sapiens
ccaagcagagcagcctctctgg

SEQ ID NO: 88604 - DNA, 22 bp, Homo sapiens
ccagaagcagagcctgaggcag

SEQ ID NO: 88605 - DNA, 22 bp, Homo sapiens
gaggcctgggcaagggggtctg

SEQ ID NO: 88606 - DNA, 22 bp, Homo sapiens
tgaggtgccacccaagagcctt

SEQ ID NO: 88607 - DNA, 22 bp, Homo sapiens
atcatccaagcgtagttcttct

SEQ ID NO: 88608 - DNA, 22 bp, Homo sapiens
ggctgggcaggtctgcacaggg

SEQ ID NO: 88609 - DNA, 22 bp, Homo sapiens
tcgcaccattgcactccagcca

SEQ ID NO: 88610 - DNA, 22 bp, Homo sapiens
ttcttctttccaattacatggt

SEQ ID NO: 88611 - DNA, 22 bp, Homo sapiens
aggtgacaggacaggagctggt

SEQ ID NO: 88612 - DNA, 22 bp, Homo sapiens
aaaaaattatcatagttcctga

SEQ ID NO: 88613 - DNA, 22 bp, Homo sapiens
aagcagcacagcaatgactcta

SEQ ID NO: 88614 - DNA, 22 bp, Homo sapiens
tctccccagtatggattctctg

SEQ ID NO: 88615 - DNA, 22 bp, Homo sapiens
gtggcccaggctggagtgcagt

SEQ ID NO: 88616 - DNA, 22 bp, Homo sapiens
tatacgtgcaggtcacagggga

SEQ ID NO: 88617 - DNA, 22 bp, Homo sapiens
cagtgacgtaaactgcatgtgc

SEQ ID NO: 88618 - DNA, 22 bp, Homo sapiens
acagattcactgcactggccat

SEQ ID NO: 88619 - DNA, 22 bp, Homo sapiens
gcccaggctggagtgcagtggc

SEQ ID NO: 88620 - DNA, 22 bp, Homo sapiens
tgatatgtccctcgacatcagg

SEQ ID NO: 88621 - DNA, 22 bp, Homo sapiens
atcttgccagtctccaaatcaa

SEQ ID NO: 88622 - DNA, 22 bp, Homo sapiens
gggctagcctcttccctgctcc

SEQ ID NO: 88623 - DNA, 22 bp, Homo sapiens
aactaatacattaatacatgtg

SEQ ID NO: 88624 - DNA, 21 bp, Homo sapiens
ggccagtggaattttatgtca

SEQ ID NO: 88625 - DNA, 22 bp, Homo sapiens
gcccttacagggtggtcagcca

SEQ ID NO: 88626 - DNA, 21 bp, Homo sapiens
agtagtttagcacagggtttg

SEQ ID NO: 88627 - DNA, 22 bp, Homo sapiens
ccaggaggcagaagttgcagtg

SEQ ID NO: 88628 - DNA, 22 bp, Homo sapiens
gctagtgcagggaaatctttgg

SEQ ID NO: 88629 - DNA, 22 bp, Homo sapiens
ttcctgggattattgtcaagca

SEQ ID NO: 88630 - DNA, 22 bp, Homo sapiens
agccagggtctctcgctctgtt

SEQ ID NO: 88631 - DNA, 22 bp, Homo sapiens
tggggccatctcacccactgtt

SEQ ID NO: 88632 - DNA, 22 bp, Homo sapiens
agcagcttgaggctggattcca

SEQ ID NO: 88633 - DNA, 22 bp, Homo sapiens
gtgcgcttcttcctgagccagg

SEQ ID NO: 88634 - DNA, 21 bp, Homo sapiens
tgttttccaccttgaggcaag

SEQ ID NO: 88635 - DNA, 22 bp, Homo sapiens
gctggctgacagatttggggtg

SEQ ID NO: 88636 - DNA, 22 bp, Homo sapiens
ccagactgcttgcttcccagcc

SEQ ID NO: 88637 - DNA, 22 bp, Homo sapiens
cattacagaatatgtaatgatc

SEQ ID NO: 88638 - DNA, 22 bp, Homo sapiens
tgttccagatttagccaaccga

SEQ ID NO: 88639 - DNA, 22 bp, Homo sapiens
gacaattgcttttgccgaataa

SEQ ID NO: 88640 - DNA, 22 bp, Homo sapiens
tacaccattcccaggtggattt

SEQ ID NO: 88641 - DNA, 22 bp, Homo sapiens
atgattgaaaatgacattgcca

SEQ ID NO: 88642 - DNA, 22 bp, Homo sapiens
actgcacttcaccctgggtgac

SEQ ID NO: 88643 - DNA, 22 bp, Homo sapiens
catcatcaaaagtgacagagaa

SEQ ID NO: 88644 - DNA, 22 bp, Homo sapiens
tttgattgcaatagttttatga

SEQ ID NO: 88645 - DNA, 22 bp, Homo sapiens
gctgggctgcgtcggggaagcc

SEQ ID NO: 88646 - DNA, 22 bp, Homo sapiens
agcctctttttcaaggtccaca

SEQ ID NO: 88647 - DNA, 22 bp, Homo sapiens
aactatgttaataagtttcatt

SEQ ID NO: 88648 - DNA, 22 bp, Homo sapiens
ggggcattgtgtctgggttcct

SEQ ID NO: 88649 - DNA, 22 bp, Homo sapiens
cctgagtagctggaattaaagg

SEQ ID NO: 88650 - DNA, 22 bp, Homo sapiens
gccccaagtccctatgtttcca

SEQ ID NO: 88651 - DNA, 22 bp, Homo sapiens
ggccgctctccggtgtggatct

SEQ ID NO: 88652 - DNA, 22 bp, Homo sapiens
gacggagctggttgctgcggct

SEQ ID NO: 88653 - DNA, 22 bp, Homo sapiens
aggaggcagtctgtcccttagc

SEQ ID NO: 88654 - DNA, 22 bp, Homo sapiens
cccaggccccagggcttgtcag

SEQ ID NO: 88655 - DNA, 21 bp, Homo sapiens
gctgttcggcggccctcgcgc

SEQ ID NO: 88656 - DNA, 22 bp, Homo sapiens
taggattccagaacagtgctgc

SEQ ID NO: 88657 - DNA, 22 bp, Homo sapiens
tgtgttcagaatttgctgcttt

SEQ ID NO: 88658 - DNA, 22 bp, Homo sapiens
ttctttgcccatgtttcctaag

SEQ ID NO: 88659 - DNA, 22 bp, Homo sapiens
gctgatagactgaatgttggga

SEQ ID NO: 88660 - DNA, 23 bp, Homo sapiens
ggaagctcacgtagtcctgcact

SEQ ID NO: 88661 - DNA, 22 bp, Homo sapiens
cacagctgaagtagccatgtgg

SEQ ID NO: 88662 - DNA, 22 bp, Homo sapiens
aggggaggtgtccccaaatctc

SEQ ID NO: 88663 - DNA, 22 bp, Homo sapiens
gtggcattgccttctgcaggaa

SEQ ID NO: 88664 - DNA, 22 bp, Homo sapiens
tgctgagcgcatccggcggccg

SEQ ID NO: 88665 - DNA, 22 bp, Homo sapiens
aggggatgcctagtggagtctc

SEQ ID NO: 88666 - DNA, 22 bp, Homo sapiens
ggaaaagtgttaaggtgttgat

SEQ ID NO: 88667 - DNA, 22 bp, Homo sapiens
tggcaccatcaaggctgagaac

SEQ ID NO: 88668 - DNA, 22 bp, Homo sapiens
ttgggctcaggagtttgagacc

SEQ ID NO: 88669 - DNA, 22 bp, Homo sapiens
agtgctatcgagttctaatgct

SEQ ID NO: 88670 - DNA, 22 bp, Homo sapiens
tgagtgtggggaatgtcatgag

SEQ ID NO: 88671 - DNA, 22 bp, Homo sapiens
aagtataatcaaagcagggcta

SEQ ID NO: 88672 - DNA, 22 bp, Homo sapiens
ttacatgtggtgtgaagaagag

SEQ ID NO: 88673 - DNA, 22 bp, Homo sapiens
tgatatgggaaaagggctcgga

SEQ ID NO: 88674 - DNA, 23 bp, Homo sapiens
actcgtggaattctctgcgatcg

SEQ ID NO: 88675 - DNA, 21 bp, Homo sapiens
acctgagctccacctcctgcc

SEQ ID NO: 88676 - DNA, 22 bp, Homo sapiens
tcacagtgttaaacctttcttt

SEQ ID NO: 88677 - DNA, 22 bp, Homo sapiens
tccccagcttgctacttctgct

SEQ ID NO: 88678 - DNA, 22 bp, Homo sapiens
tcaaattgtcatcttgataatg

SEQ ID NO: 88679 - DNA, 22 bp, Homo sapiens
tgaaggtgggaattcaccaggt

SEQ ID NO: 88680 - DNA, 22 bp, Homo sapiens
ctcctgagctctgaggaagctt

SEQ ID NO: 88681 - DNA, 22 bp, Homo sapiens
caggaggagggcagccgcctcc

SEQ ID NO: 88682 - DNA, 22 bp, Homo sapiens
gaggcagaggttgttgcagtga

SEQ ID NO: 88683 - DNA, 22 bp, Homo sapiens
aaggggaagagaccgcagagtc

SEQ ID NO: 88684 - DNA, 22 bp, Homo sapiens
accagcacttccagaggtcagg

SEQ ID NO: 88685 - DNA, 22 bp, Homo sapiens
gtgttaaccagctaaactttgc

SEQ ID NO: 88686 - DNA, 22 bp, Homo sapiens
catgcctgtaatcccagcactt

SEQ ID NO: 88687 - DNA, 22 bp, Homo sapiens
ggcttggaaactagagtgtgca

SEQ ID NO: 88688 - DNA, 22 bp, Homo sapiens
tagcagcaaagcaggatctgct

SEQ ID NO: 88689 - DNA, 22 bp, Homo sapiens
ccaggagtgcagggatggtatc

SEQ ID NO: 88690 - DNA, 22 bp, Homo sapiens
tctcagctcatggcagccttga

SEQ ID NO: 88691 - DNA, 22 bp, Homo sapiens
gagctactgaaatattgatttt

SEQ ID NO: 88692 - DNA, 22 bp, Homo sapiens
tatgacagtttcgtaggggttg

SEQ ID NO: 88693 - DNA, 18 bp, Homo sapiens
cagctgccagctcatgga

SEQ ID NO: 88694 - DNA, 22 bp, Homo sapiens
cctacagttatattcttgattg

SEQ ID NO: 88695 - DNA, 22 bp, Homo sapiens
gggcagccccagcgcgttggct

SEQ ID NO: 88696 - DNA, 22 bp, Homo sapiens
gtcttgtcccagctctgccact

SEQ ID NO: 88697 - DNA, 22 bp, Homo sapiens
aggctcgcatgccctgcaccac

SEQ ID NO: 88698 - DNA, 22 bp, Homo sapiens
aaacactcatgtgttactctcc

SEQ ID NO: 88699 - DNA, 22 bp, Homo sapiens
gcatatgatcacgtgtgtcggt

SEQ ID NO: 88700 - DNA, 22 bp, Homo sapiens
gctcactgcaagctccgcctcc

SEQ ID NO: 88701 - DNA, 22 bp, Homo sapiens
aacccacaaaggatttcagctc

SEQ ID NO: 88702 - DNA, 22 bp, Homo sapiens
cctgtctctgcagggccctgcc

SEQ ID NO: 88703 - DNA, 22 bp, Homo sapiens
gtcactcaggctggagttcagt

SEQ ID NO: 88704 - DNA, 22 bp, Homo sapiens
ggaggacaggggctgcagcaca

SEQ ID NO: 88705 - DNA, 20 bp, Homo sapiens
caggtccagcacgtgcacgg

SEQ ID NO: 88706 - DNA, 22 bp, Homo sapiens
attgtcgtcaatggacacatag

SEQ ID NO: 88707 - DNA, 22 bp, Homo sapiens
cgtcccgggttcacgccattct

SEQ ID NO: 88708 - DNA, 22 bp, Homo sapiens
tctcaagcttgttggtatgttt

SEQ ID NO: 88709 - DNA, 22 bp, Homo sapiens
cccaggctggagtgtaatggtg

SEQ ID NO: 88710 - DNA, 22 bp, Homo sapiens
cttcctctgtggccagagtgta

SEQ ID NO: 88711 - DNA, 22 bp, Homo sapiens
aagaatgagctcaaagatctta

SEQ ID NO: 88712 - DNA, 22 bp, Homo sapiens
agccacacagcttaatgacaga

SEQ ID NO: 88713 - DNA, 22 bp, Homo sapiens
cgccccggacgtctgaccaaac

SEQ ID NO: 88714 - DNA, 22 bp, Homo sapiens
ctccaggctcgtccaagatcga

SEQ ID NO: 88715 - DNA, 22 bp, Homo sapiens
gctaggttggggaagttctcct

SEQ ID NO: 88716 - DNA, 22 bp, Homo sapiens
cagtggaggccttgggaccttt

SEQ ID NO: 88717 - DNA, 19 bp, Homo sapiens
aggaatggaattaattctg

SEQ ID NO: 88718 - DNA, 22 bp, Homo sapiens
tgaggcaggagaatcaccggaa

SEQ ID NO: 88719 - DNA, 21 bp, Homo sapiens
ccaggccaggcctacggggat

SEQ ID NO: 88720 - DNA, 22 bp, Homo sapiens
aaccccgctcaggctgggtgag

SEQ ID NO: 88721 - DNA, 22 bp, Homo sapiens
aggcaggaggatcatggatgca

SEQ ID NO: 88722 - DNA, 22 bp, Homo sapiens
tcactacaacctccgcctcctg

SEQ ID NO: 88723 - DNA, 22 bp, Homo sapiens
ctgctcttgagggactgcggtc

SEQ ID NO: 88724 - DNA, 22 bp, Homo sapiens
cagccagtgtgaccgaggagga

SEQ ID NO: 88725 - DNA, 18 bp, Homo sapiens
gaaagatgaacttttttc

SEQ ID NO: 88726 - DNA, 22 bp, Homo sapiens
aggccacggcgggtggattact

SEQ ID NO: 88727 - DNA, 22 bp, Homo sapiens
agtgcattcctggggaagaagc

SEQ ID NO: 88728 - DNA, 18 bp, Homo sapiens
gcagtgaagaaagagctt

SEQ ID NO: 88729 - DNA, 22 bp, Homo sapiens
acaccatactcatgttggttcc

SEQ ID NO: 88730 - DNA, 22 bp, Homo sapiens
tagtttcatctccaccctgccc

SEQ ID NO: 88731 - DNA, 22 bp, Homo sapiens
attgaaaataaggccagaaaca

SEQ ID NO: 88732 - DNA, 23 bp, Homo sapiens
aggtaggttattgctgctacctg

SEQ ID NO: 88733 - DNA, 22 bp, Homo sapiens
ttccagttcactccatttctgg

SEQ ID NO: 88734 - DNA, 22 bp, Homo sapiens
gaataatcatgaaattcagtga

SEQ ID NO: 88735 - DNA, 22 bp, Homo sapiens
gcccagagttcaaggctgcagt

SEQ ID NO: 88736 - DNA, 22 bp, Homo sapiens
taacaatacccattctaattac

SEQ ID NO: 88737 - DNA, 22 bp, Homo sapiens
acaattctgatggtttcccagt

SEQ ID NO: 88738 - DNA, 22 bp, Homo sapiens
gtagttctgcagtgtcacctga

SEQ ID NO: 88739 - DNA, 22 bp, Homo sapiens
aagatattcaaagatttattag

SEQ ID NO: 88740 - DNA, 22 bp, Homo sapiens
ggcttctctccagtatgcattc

SEQ ID NO: 88741 - DNA, 22 bp, Homo sapiens
tgcaggcctggactgatgtggt

SEQ ID NO: 88742 - DNA, 22 bp, Homo sapiens
gtggcagagccaaggctggagc

SEQ ID NO: 88743 - DNA, 22 bp, Homo sapiens
gcccaggctggagttcagtggt

SEQ ID NO: 88744 - DNA, 22 bp, Homo sapiens
tgagatgtaaggtatgcttact

SEQ ID NO: 88745 - DNA, 22 bp, Homo sapiens
tgtatgaggcatacatcaggca

SEQ ID NO: 88746 - DNA, 22 bp, Homo sapiens
tacctcaagttccaggaaagcg

SEQ ID NO: 88747 - DNA, 22 bp, Homo sapiens
gagagagctctgtgcctgggat

SEQ ID NO: 88748 - DNA, 22 bp, Homo sapiens
aggctcagatccttgtgtcctg

SEQ ID NO: 88749 - DNA, 22 bp, Homo sapiens
cccagcaggaggaggttgcagt

SEQ ID NO: 88750 - DNA, 22 bp, Homo sapiens
aaagaaggtagggctggtgact

SEQ ID NO: 88751 - DNA, 22 bp, Homo sapiens
gtcctgtgagattcatgctcaa

SEQ ID NO: 88752 - DNA, 22 bp, Homo sapiens
ggcagacctctccagccccaca

SEQ ID NO: 88753 - DNA, 17 bp, Homo sapiens
ggcccggtgacgtcact

SEQ ID NO: 88754 - DNA, 22 bp, Homo sapiens
ggcatgcatgttgttttaggtg

SEQ ID NO: 88755 - DNA, 22 bp, Homo sapiens
tcttagaaattccccagtggct

SEQ ID NO: 88756 - DNA, 22 bp, Homo sapiens
ttcatagtgtttccttccagtg

SEQ ID NO: 88757 - DNA, 22 bp, Homo sapiens
gctgaggctcctcgggaggaca

SEQ ID NO: 88758 - DNA, 22 bp, Homo sapiens
aacttgccaagagctttgctag

SEQ ID NO: 88759 - DNA, 22 bp, Homo sapiens
cctcgggctgaggctcccaggc

SEQ ID NO: 88760 - DNA, 22 bp, Homo sapiens
tcataaattctggtgctgtgag

SEQ ID NO: 88761 - DNA, 22 bp, Homo sapiens
aagtgattgttccgttgagtgt

SEQ ID NO: 88762 - DNA, 22 bp, Homo sapiens
ggatgctctgtctcttgctgtt

SEQ ID NO: 88763 - DNA, 22 bp, Homo sapiens
atatccagcagcaggtgagtat

SEQ ID NO: 88764 - DNA, 22 bp, Homo sapiens
tgcaatttttccatgacctaga

SEQ ID NO: 88765 - DNA, 22 bp, Homo sapiens
aggtcaagagtaaatttgggta

SEQ ID NO: 88766 - DNA, 22 bp, Homo sapiens
tctgttttgcataatgttcttt

SEQ ID NO: 88767 - DNA, 22 bp, Homo sapiens
ttctcccatctcagtcttacat

SEQ ID NO: 88768 - DNA, 22 bp, Homo sapiens
gtgggctgcccttgaggtcagc

SEQ ID NO: 88769 - DNA, 22 bp, Homo sapiens
tgggggagctcagtccagccca

SEQ ID NO: 88770 - DNA, 22 bp, Homo sapiens
atatatttgagaatattcatga

SEQ ID NO: 88771 - DNA, 22 bp, Homo sapiens
acccggagtcggaggttgcagt

SEQ ID NO: 88772 - DNA, 22 bp, Homo sapiens
tttgttttcaatgtgtcattca

SEQ ID NO: 88773 - DNA, 19 bp, Homo sapiens
tctcacagctctactatgt

SEQ ID NO: 88774 - DNA, 22 bp, Homo sapiens
cagtgccagctgcttggcctac

SEQ ID NO: 88775 - DNA, 22 bp, Homo sapiens
atattgttagtaatatttcgaa

SEQ ID NO: 88776 - DNA, 22 bp, Homo sapiens
cgcgctgcagacagcggaggcc

SEQ ID NO: 88777 - DNA, 23 bp, Homo sapiens
aggttatgattatagagcgagga

SEQ ID NO: 88778 - DNA, 23 bp, Homo sapiens
caggagatggctgctgtgtcagc

SEQ ID NO: 88779 - DNA, 22 bp, Homo sapiens
tgagcctgggagatggaggctg

SEQ ID NO: 88780 - DNA, 22 bp, Homo sapiens
tgggaggccaaggcaggcggat

SEQ ID NO: 88781 - DNA, 22 bp, Homo sapiens
tgaggcaggacttgcataaagt

SEQ ID NO: 88782 - DNA, 21 bp, Homo sapiens
tcacgtggtcacatgagcttt

SEQ ID NO: 88783 - DNA, 22 bp, Homo sapiens
ctggtctggctacccagcgaat

SEQ ID NO: 88784 - DNA, 22 bp, Homo sapiens
ttattgaaggaactgaaataaa

SEQ ID NO: 88785 - DNA, 22 bp, Homo sapiens
gctcactgcctgggcaacaaga

SEQ ID NO: 88786 - DNA, 22 bp, Homo sapiens
ttctagtgtccttggacttgct

SEQ ID NO: 88787 - DNA, 22 bp, Homo sapiens
acgcctgtaatcccagcacttt

SEQ ID NO: 88788 - DNA, 18 bp, Homo sapiens
gctctgcaggtgctcggt

SEQ ID NO: 88789 - DNA, 22 bp, Homo sapiens
ctcctctttagccccagctgga

SEQ ID NO: 88790 - DNA, 22 bp, Homo sapiens
tgcgatgcaacagcttggcgga

SEQ ID NO: 88791 - DNA, 22 bp, Homo sapiens
gtgtcaggccctgcattatgtg

SEQ ID NO: 88792 - DNA, 23 bp, Homo sapiens
aagtggttttgaacccggaccct

SEQ ID NO: 88793 - DNA, 22 bp, Homo sapiens
gaccctctagatggaagcactg

SEQ ID NO: 88794 - DNA, 22 bp, Homo sapiens
gcagggcacaaggacgcacagg

SEQ ID NO: 88795 - DNA, 22 bp, Homo sapiens
ctgccgtgtttttcatgttaaa

SEQ ID NO: 88796 - DNA, 22 bp, Homo sapiens
gtccaaaagagccagccgggcg

SEQ ID NO: 88797 - DNA, 22 bp, Homo sapiens
tacaaaggaggtgcatagaaca

SEQ ID NO: 88798 - DNA, 22 bp, Homo sapiens
aattgcaaattcagacttaaga

SEQ ID NO: 88799 - DNA, 22 bp, Homo sapiens
ctgctgggatagaagtatctca

SEQ ID NO: 88800 - DNA, 22 bp, Homo sapiens
cttctcggggttcccgcgccct

SEQ ID NO: 88801 - DNA, 22 bp, Homo sapiens
ggccgccctttccacggtttct

SEQ ID NO: 88802 - DNA, 22 bp, Homo sapiens
atgccactgcacttcagcctgg

SEQ ID NO: 88803 - DNA, 22 bp, Homo sapiens
tgctgtgaggttgagaaggaag

SEQ ID NO: 88804 - DNA, 22 bp, Homo sapiens
actatagatgctggcgaggctg

SEQ ID NO: 88805 - DNA, 22 bp, Homo sapiens
gtgagagattgattgtagcggc

SEQ ID NO: 88806 - DNA, 22 bp, Homo sapiens
cacatgaaggctggggtcgtga

SEQ ID NO: 88807 - DNA, 22 bp, Homo sapiens
accctcaagatggaagcagttt

SEQ ID NO: 88808 - DNA, 22 bp, Homo sapiens
ggaggcccagaaggaagcccag

SEQ ID NO: 88809 - DNA, 22 bp, Homo sapiens
gtctccccagggccctcttcat

SEQ ID NO: 88810 - DNA, 22 bp, Homo sapiens
ggctctgcgcctgcggggactt

SEQ ID NO: 88811 - DNA, 22 bp, Homo sapiens
aggaatgacatagaaaggggag

SEQ ID NO: 88812 - DNA, 22 bp, Homo sapiens
ggagaagaggagctggaagcct

SEQ ID NO: 88813 - DNA, 22 bp, Homo sapiens
gcaagtgaatgaggttgagatt

SEQ ID NO: 88814 - DNA, 22 bp, Homo sapiens
gccaccctggacgcactgttcg

SEQ ID NO: 88815 - DNA, 22 bp, Homo sapiens
ctatggtgatagaaatcagaat

SEQ ID NO: 88816 - DNA, 22 bp, Homo sapiens
gccaggacctcagatgcagggc

SEQ ID NO: 88817 - DNA, 22 bp, Homo sapiens
tgcagattcaaatgaaatgcaa

SEQ ID NO: 88818 - DNA, 20 bp, Homo sapiens
tgtcattcttctttcacagg

SEQ ID NO: 88819 - DNA, 22 bp, Homo sapiens
tgctccatgcgctcggccggcg

SEQ ID NO: 88820 - DNA, 22 bp, Homo sapiens
ttgtttccataattaagtgtga

SEQ ID NO: 88821 - DNA, 22 bp, Homo sapiens
gcaggctgtctaaagttagagt

SEQ ID NO: 88822 - DNA, 22 bp, Homo sapiens
ttcacagtggtagtgcatttag

SEQ ID NO: 88823 - DNA, 22 bp, Homo sapiens
cagtgcagccaaggacaggcac

SEQ ID NO: 88824 - DNA, 22 bp, Homo sapiens
tgaggaaacttacaaggcagaa

SEQ ID NO: 88825 - DNA, 22 bp, Homo sapiens
gcagcaacgcggccctactgct

SEQ ID NO: 88826 - DNA, 19 bp, Homo sapiens
ggagccgccgcccttcatt

SEQ ID NO: 88827 - DNA, 22 bp, Homo sapiens
tgaaatgattatatggtgtttg

SEQ ID NO: 88828 - DNA, 17 bp, Homo sapiens
cgggcatggagggcagg

SEQ ID NO: 88829 - DNA, 22 bp, Homo sapiens
cctggggtcacttgcagccgca

SEQ ID NO: 88830 - DNA, 22 bp, Homo sapiens
atcatcatgcccacttgagact

SEQ ID NO: 88831 - DNA, 22 bp, Homo sapiens
aggagatggagctcagtgggca

SEQ ID NO: 88832 - DNA, 22 bp, Homo sapiens
aacccaggagttggaggctgtg

SEQ ID NO: 88833 - DNA, 22 bp, Homo sapiens
gaggctggacgtgcatttctac

SEQ ID NO: 88834 - DNA, 22 bp, Homo sapiens
gctcttgtcaaaaattagttga

SEQ ID NO: 88835 - DNA, 22 bp, Homo sapiens
gtatgtgaggttggtttccagg

SEQ ID NO: 88836 - DNA, 22 bp, Homo sapiens
cggccaagccggggccccgaag

SEQ ID NO: 88837 - DNA, 19 bp, Homo sapiens
ccctcttgcacaaagcaaa

SEQ ID NO: 88838 - DNA, 20 bp, Homo sapiens
tttgagaccagtctgcccaa

SEQ ID NO: 88839 - DNA, 21 bp, Homo sapiens
gttgtggttggggctgcagct

SEQ ID NO: 88840 - DNA, 22 bp, Homo sapiens
tccagcagtccatgtgagacac

SEQ ID NO: 88841 - DNA, 22 bp, Homo sapiens
gagcatcgctgagatcccagac

SEQ ID NO: 88842 - DNA, 19 bp, Homo sapiens
gctgaaggaggtgcctgca

SEQ ID NO: 88843 - DNA, 22 bp, Homo sapiens
ctggctgggagcgagctgctca

SEQ ID NO: 88844 - DNA, 22 bp, Homo sapiens
tcaggaggcggaggttgcagtg

SEQ ID NO: 88845 - DNA, 22 bp, Homo sapiens
cagaggctggcggccgccccga

SEQ ID NO: 88846 - DNA, 22 bp, Homo sapiens
tttgtgaataggttggcttcca

SEQ ID NO: 88847 - DNA, 22 bp, Homo sapiens
ctctcgccagcggggctgcgct

SEQ ID NO: 88848 - DNA, 22 bp, Homo sapiens
gccaggttgctgacgacgatct

SEQ ID NO: 88849 - DNA, 22 bp, Homo sapiens
tggctgagttacgaacagagca

SEQ ID NO: 88850 - DNA, 22 bp, Homo sapiens
ctcgcgttccagctgcgggccg

SEQ ID NO: 88851 - DNA, 22 bp, Homo sapiens
cttatcagattatctgggctgt

SEQ ID NO: 88852 - DNA, 22 bp, Homo sapiens
agaggctgcacttgctcatgat

SEQ ID NO: 88853 - DNA, 22 bp, Homo sapiens
gggaagtgatggagccaggatt

SEQ ID NO: 88854 - DNA, 22 bp, Homo sapiens
gcccgcgccagcctctccatct

SEQ ID NO: 88855 - DNA, 22 bp, Homo sapiens
gcaggaggttgagccaggactg

SEQ ID NO: 88856 - DNA, 22 bp, Homo sapiens
tgggccacacacagaagaatca

SEQ ID NO: 88857 - DNA, 22 bp, Homo sapiens
gggttcagtccctcttgctact

SEQ ID NO: 88858 - DNA, 22 bp, Homo sapiens
tggggaaaatgcttgtagtcag

SEQ ID NO: 88859 - DNA, 22 bp, Homo sapiens
catctcccacttccttgggggt

SEQ ID NO: 88860 - DNA, 22 bp, Homo sapiens
ggcagggcaggaaagtcaggaa

SEQ ID NO: 88861 - DNA, 21 bp, Homo sapiens
caatggcgagatcttggctca

SEQ ID NO: 88862 - DNA, 22 bp, Homo sapiens
cttcctttgctgttcggaggtt

SEQ ID NO: 88863 - DNA, 22 bp, Homo sapiens
cctgggctctgtcagaattggg

SEQ ID NO: 88864 - DNA, 22 bp, Homo sapiens
cagcaggaggtgagtagcaggt

SEQ ID NO: 88865 - DNA, 22 bp, Homo sapiens
actgaataaggtgaatgctctg

SEQ ID NO: 88866 - DNA, 22 bp, Homo sapiens
tgttgcccaggttctctcctgc

SEQ ID NO: 88867 - DNA, 22 bp, Homo sapiens
aagactgtgtctatggctactc

SEQ ID NO: 88868 - DNA, 22 bp, Homo sapiens
gcaccgccttggaccgcccgct

SEQ ID NO: 88869 - DNA, 22 bp, Homo sapiens
ctgaagagaaagggagctcttc

SEQ ID NO: 88870 - DNA, 20 bp, Homo sapiens
gggcaaggaaacagccccca

SEQ ID NO: 88871 - DNA, 22 bp, Homo sapiens
tctgtcttagccatctcaggct

SEQ ID NO: 88872 - DNA, 20 bp, Homo sapiens
tgatatggtttggctgtgtt

SEQ ID NO: 88873 - DNA, 22 bp, Homo sapiens
ctgcttctagcaccaagtccct

SEQ ID NO: 88874 - DNA, 22 bp, Homo sapiens
agcagctttcacctccccgcct

SEQ ID NO: 88875 - DNA, 22 bp, Homo sapiens
tggaggctggagtgcagtggcg

SEQ ID NO: 88876 - DNA, 22 bp, Homo sapiens
tgattcatcagaataggagttt

SEQ ID NO: 88877 - DNA, 22 bp, Homo sapiens
tggagccagcggcctgctgagg

SEQ ID NO: 88878 - DNA, 22 bp, Homo sapiens
gcaggcagatcacctgtcagga

SEQ ID NO: 88879 - DNA, 22 bp, Homo sapiens
gctgcaagtgcatgttgcaact

SEQ ID NO: 88880 - DNA, 19 bp, Homo sapiens
ttccatctatcttcttact

SEQ ID NO: 88881 - DNA, 23 bp, Homo sapiens
tgctggagaagcaaagttctgag

SEQ ID NO: 88882 - DNA, 22 bp, Homo sapiens
agccctcttccagccagcacag

SEQ ID NO: 88883 - DNA, 22 bp, Homo sapiens
ttggtttccttaacagcctaaa

SEQ ID NO: 88884 - DNA, 22 bp, Homo sapiens
ttcactggtcctttataggaac

SEQ ID NO: 88885 - DNA, 22 bp, Homo sapiens
ctgagccaaggggacagtgaca

SEQ ID NO: 88886 - DNA, 22 bp, Homo sapiens
taaaatttgtccctgagtgttg

SEQ ID NO: 88887 - DNA, 22 bp, Homo sapiens
ttaggatttgaaaaggggcaga

SEQ ID NO: 88888 - DNA, 21 bp, Homo sapiens
cactccacttagaacagggtt

SEQ ID NO: 88889 - DNA, 22 bp, Homo sapiens
gctggcagacttcctctggaac

SEQ ID NO: 88890 - DNA, 22 bp, Homo sapiens
ggctgagtctgtgacccatgcg

SEQ ID NO: 88891 - DNA, 22 bp, Homo sapiens
gctcactgcaagctctgcctcc

SEQ ID NO: 88892 - DNA, 22 bp, Homo sapiens
atttacaggtagaattttaagt

SEQ ID NO: 88893 - DNA, 17 bp, Homo sapiens
caggtgttctgtttttc

SEQ ID NO: 88894 - DNA, 22 bp, Homo sapiens
attgcactccagcctgggtgac

SEQ ID NO: 88895 - DNA, 22 bp, Homo sapiens
catgtgtccacccttgaacaca

SEQ ID NO: 88896 - DNA, 22 bp, Homo sapiens
ggctctgtaagtgttgcaggta

SEQ ID NO: 88897 - DNA, 22 bp, Homo sapiens
acgcagtttgtggacatttttt

SEQ ID NO: 88898 - DNA, 22 bp, Homo sapiens
agccagtgcagctggaaattca

SEQ ID NO: 88899 - DNA, 22 bp, Homo sapiens
agcactgatttaaactggattt

SEQ ID NO: 88900 - DNA, 20 bp, Homo sapiens
ctgtggaattttaccatgcg

SEQ ID NO: 88901 - DNA, 21 bp, Homo sapiens
ggtgctcgctgatgaggagtg

SEQ ID NO: 88902 - DNA, 23 bp, Homo sapiens
ggagtgcaatggcgccatctcgg

SEQ ID NO: 88903 - DNA, 22 bp, Homo sapiens
cagaggaacgtttggattgatt

SEQ ID NO: 88904 - DNA, 22 bp, Homo sapiens
cccagacccagagggaggcagg

SEQ ID NO: 88905 - DNA, 22 bp, Homo sapiens
agctggggctgtggttgtgatt

SEQ ID NO: 88906 - DNA, 22 bp, Homo sapiens
agccaagcactcaactcctgga

SEQ ID NO: 88907 - DNA, 22 bp, Homo sapiens
tggcacttttcccagttttggt

SEQ ID NO: 88908 - DNA, 22 bp, Homo sapiens
cactgcactccagcctgggtca

SEQ ID NO: 88909 - DNA, 22 bp, Homo sapiens
actgggaagtcagagagaggct

SEQ ID NO: 88910 - DNA, 22 bp, Homo sapiens
atgatggctaggctggttttga

SEQ ID NO: 88911 - DNA, 22 bp, Homo sapiens
cacggtggcccacaggtgcaag

SEQ ID NO: 88912 - DNA, 22 bp, Homo sapiens
tgagctgacacccaatcatact

SEQ ID NO: 88913 - DNA, 22 bp, Homo sapiens
agggtggcactggtggctctat

SEQ ID NO: 88914 - DNA, 22 bp, Homo sapiens
caggagatgacagggaagaacc

SEQ ID NO: 88915 - DNA, 20 bp, Homo sapiens
aactcctagcctcaagtgat

SEQ ID NO: 88916 - DNA, 22 bp, Homo sapiens
aggctctcaccctctgaccaga

SEQ ID NO: 88917 - DNA, 22 bp, Homo sapiens
gacctccgtgtacacctcccag

SEQ ID NO: 88918 - DNA, 22 bp, Homo sapiens
cagggtttcaccatgttagcag

SEQ ID NO: 88919 - DNA, 22 bp, Homo sapiens
acccagtgttgggcagaactgt

SEQ ID NO: 88920 - DNA, 22 bp, Homo sapiens
cacagggcttctcatggggtgc

SEQ ID NO: 88921 - DNA, 21 bp, Homo sapiens
gttcaaatcctgacactacac

SEQ ID NO: 88922 - DNA, 22 bp, Homo sapiens
tggagccagagcgcagcctggg

SEQ ID NO: 88923 - DNA, 22 bp, Homo sapiens
tgccaggcgtggtggtgcgcac

SEQ ID NO: 88924 - DNA, 22 bp, Homo sapiens
ttattagagtgctttgagaaag

SEQ ID NO: 88925 - DNA, 22 bp, Homo sapiens
ggatctgggctgcagtctaggc

SEQ ID NO: 88926 - DNA, 22 bp, Homo sapiens
gtggctgcagcggctgtggaga

SEQ ID NO: 88927 - DNA, 22 bp, Homo sapiens
tgtacttgaacttgactgtaga

SEQ ID NO: 88928 - DNA, 22 bp, Homo sapiens
aatgttgtgcatgtattttgta

SEQ ID NO: 88929 - DNA, 22 bp, Homo sapiens
cttgtgcatttcattcctcagg

SEQ ID NO: 88930 - DNA, 22 bp, Homo sapiens
cttctggcgttggaggtctgag

SEQ ID NO: 88931 - DNA, 22 bp, Homo sapiens
atttagaactttgtttgccaat

SEQ ID NO: 88932 - DNA, 16 bp, Homo sapiens
tgggtgggaggagcgg

SEQ ID NO: 88933 - DNA, 22 bp, Homo sapiens
aaggctccagtgaatgctggca

SEQ ID NO: 88934 - DNA, 22 bp, Homo sapiens
gcttcaggctgaattcctccta

SEQ ID NO: 88935 - DNA, 22 bp, Homo sapiens
gaaagacatagttgcaagatgg

SEQ ID NO: 88936 - DNA, 22 bp, Homo sapiens
actgtctagttctcttttctaa

SEQ ID NO: 88937 - DNA, 22 bp, Homo sapiens
aactctatttaccctactaaac

SEQ ID NO: 88938 - DNA, 22 bp, Homo sapiens
accatgttggccaagctggtct

SEQ ID NO: 88939 - DNA, 22 bp, Homo sapiens
tctgccttgtttgagctttgac

SEQ ID NO: 88940 - DNA, 22 bp, Homo sapiens
tgggagcagcctcagcttcggg

SEQ ID NO: 88941 - DNA, 22 bp, Homo sapiens
ctggcctaggaatggttttccg

SEQ ID NO: 88942 - DNA, 22 bp, Homo sapiens
tgcctcagctgaggccgctcca

SEQ ID NO: 88943 - DNA, 22 bp, Homo sapiens
ctctggaggtggaggttgcagt

SEQ ID NO: 88944 - DNA, 22 bp, Homo sapiens
agtaatcaatttttcggtggat

SEQ ID NO: 88945 - DNA, 22 bp, Homo sapiens
gtggcatgtgcctgtaatctca

SEQ ID NO: 88946 - DNA, 22 bp, Homo sapiens
caaagttgcagttatgtgatta

SEQ ID NO: 88947 - DNA, 22 bp, Homo sapiens
tactaattgttcacacttgttt

SEQ ID NO: 88948 - DNA, 19 bp, Homo sapiens
ttctctgctacattctcag

SEQ ID NO: 88949 - DNA, 22 bp, Homo sapiens
agccacacttgccaggggaagg

SEQ ID NO: 88950 - DNA, 22 bp, Homo sapiens
tcatcagggatattggcctgaa

SEQ ID NO: 88951 - DNA, 22 bp, Homo sapiens
agatttatgtggtcacactcag

SEQ ID NO: 88952 - DNA, 22 bp, Homo sapiens
cacctgccaaatggggatgctg

SEQ ID NO: 88953 - DNA, 22 bp, Homo sapiens
caggctggagtgcagtggcgcc

SEQ ID NO: 88954 - DNA, 22 bp, Homo sapiens
aaattagtcatgttgtattact

SEQ ID NO: 88955 - DNA, 22 bp, Homo sapiens
cacccaggctggagtgcagtga

SEQ ID NO: 88956 - DNA, 22 bp, Homo sapiens
gggctgcactagggcaaggtga

SEQ ID NO: 88957 - DNA, 22 bp, Homo sapiens
cattcattacactcataaggtt

SEQ ID NO: 88958 - DNA, 22 bp, Homo sapiens
attgtgtcctcattgaccttca

SEQ ID NO: 88959 - DNA, 22 bp, Homo sapiens
attaatgaaactttggttaagc

SEQ ID NO: 88960 - DNA, 22 bp, Homo sapiens
tctgctctgtggcttcagctaa

SEQ ID NO: 88961 - DNA, 21 bp, Homo sapiens
tctgcaccccagcctgagtga

SEQ ID NO: 88962 - DNA, 22 bp, Homo sapiens
tccaggtgggctgcacccaggc

SEQ ID NO: 88963 - DNA, 22 bp, Homo sapiens
acagtcttcagaagggattggg

SEQ ID NO: 88964 - DNA, 22 bp, Homo sapiens
taacatttaaatttttcacata

SEQ ID NO: 88965 - DNA, 22 bp, Homo sapiens
gggcaggggtcagtggccccaa

SEQ ID NO: 88966 - DNA, 22 bp, Homo sapiens
tatcagtccagggttttgtgac

SEQ ID NO: 88967 - DNA, 22 bp, Homo sapiens
gtgttgatgacattttagaaac

SEQ ID NO: 88968 - DNA, 22 bp, Homo sapiens
gtgtggtcgaagttctcccgga

SEQ ID NO: 88969 - DNA, 22 bp, Homo sapiens
aaggtggaggttgcagtgagct

SEQ ID NO: 88970 - DNA, 22 bp, Homo sapiens
tcgtggaatatggatgcttgtc

SEQ ID NO: 88971 - DNA, 22 bp, Homo sapiens
gatggtgcaggtgaagtgctgg

SEQ ID NO: 88972 - DNA, 22 bp, Homo sapiens
accattgccccctagtgtctgt

SEQ ID NO: 88973 - DNA, 22 bp, Homo sapiens
ttctgggtttacatctgacttc

SEQ ID NO: 88974 - DNA, 22 bp, Homo sapiens
caggtggcagtgcctgcattct

SEQ ID NO: 88975 - DNA, 22 bp, Homo sapiens
cagcagcattgctctggattcc

SEQ ID NO: 88976 - DNA, 22 bp, Homo sapiens
atggtactggggtcccggagtt

SEQ ID NO: 88977 - DNA, 22 bp, Homo sapiens
gctactgattgaccttggagag

SEQ ID NO: 88978 - DNA, 22 bp, Homo sapiens
ttctgggcacacaggccctggt

SEQ ID NO: 88979 - DNA, 22 bp, Homo sapiens
ctgccgttgtgaagctcttaga

SEQ ID NO: 88980 - DNA, 22 bp, Homo sapiens
agcagcagtgttctggaattct

SEQ ID NO: 88981 - DNA, 22 bp, Homo sapiens
tcgtctgtgaaattgggataag

SEQ ID NO: 88982 - DNA, 20 bp, Homo sapiens
aaaatatgtataactcttct

SEQ ID NO: 88983 - DNA, 22 bp, Homo sapiens
cttggaggtggaagttgcagtg

SEQ ID NO: 88984 - DNA, 20 bp, Homo sapiens
gttaggaggttggacatgga

SEQ ID NO: 88985 - DNA, 22 bp, Homo sapiens
aacccaggaggcagatgttgtg

SEQ ID NO: 88986 - DNA, 22 bp, Homo sapiens
actttcttggtcccatgtttga

SEQ ID NO: 88987 - DNA, 22 bp, Homo sapiens
atgcacacgtaccctacaaggc

SEQ ID NO: 88988 - DNA, 22 bp, Homo sapiens
ggcctctcttgggacagctgtc

SEQ ID NO: 88989 - DNA, 22 bp, Homo sapiens
agcggcgccggagggaggtgcg

SEQ ID NO: 88990 - DNA, 21 bp, Homo sapiens
cagtggcacgatttcggctca

SEQ ID NO: 88991 - DNA, 23 bp, Homo sapiens
tgcatggggctatactgctgttc

SEQ ID NO: 88992 - DNA, 22 bp, Homo sapiens
aggctgagataggtggatcatt

SEQ ID NO: 88993 - DNA, 22 bp, Homo sapiens
agagtgtaccaaatatcctaca

SEQ ID NO: 88994 - DNA, 22 bp, Homo sapiens
tggaagctcaaggcagggtgag

SEQ ID NO: 88995 - DNA, 22 bp, Homo sapiens
agccttacataaacagccttat

SEQ ID NO: 88996 - DNA, 22 bp, Homo sapiens
ccactgcacttcagcctgggtg

SEQ ID NO: 88997 - DNA, 22 bp, Homo sapiens
gctgcagctgtaggacacaatt

SEQ ID NO: 88998 - DNA, 22 bp, Homo sapiens
cagcagcagtgttctagaatct

SEQ ID NO: 88999 - DNA, 18 bp, Homo sapiens
tccctcagaattatagaa

SEQ ID NO: 89000 - DNA, 22 bp, Homo sapiens
ttctcaagaacatatgtagggt

SEQ ID NO: 89001 - DNA, 22 bp, Homo sapiens
aaattgtaatgacttcacttga

SEQ ID NO: 89002 - DNA, 22 bp, Homo sapiens
tgatggctgtagggtccggggc

SEQ ID NO: 89003 - DNA, 23 bp, Homo sapiens
ccaagactgttaggagtggggag

SEQ ID NO: 89004 - DNA, 22 bp, Homo sapiens
gaatttaagaggatgaatctgt

SEQ ID NO: 89005 - DNA, 20 bp, Homo sapiens
tgtttactctagagggtaga

SEQ ID NO: 89006 - DNA, 22 bp, Homo sapiens
tgcactccaggctgggtgacag

SEQ ID NO: 89007 - DNA, 20 bp, Homo sapiens
agagatggggtatcaccgta

SEQ ID NO: 89008 - DNA, 22 bp, Homo sapiens
ggtgacggggcccaggtttcct

SEQ ID NO: 89009 - DNA, 22 bp, Homo sapiens
ctgaggcaggcagatcacttga

SEQ ID NO: 89010 - DNA, 22 bp, Homo sapiens
caggaaggcgcggctgtgcctg

SEQ ID NO: 89011 - DNA, 22 bp, Homo sapiens
acaggcacctgccaccacatct

SEQ ID NO: 89012 - DNA, 22 bp, Homo sapiens
ggaacagttgcgtcatgggcct

SEQ ID NO: 89013 - DNA, 22 bp, Homo sapiens
taattcttcaggccttttgtct

SEQ ID NO: 89014 - DNA, 17 bp, Homo sapiens
ctggagcagacaaaagg

SEQ ID NO: 89015 - DNA, 22 bp, Homo sapiens
tcccctttgtcttcctgtgggt

SEQ ID NO: 89016 - DNA, 22 bp, Homo sapiens
tcccacaggtggagcttgcagt

SEQ ID NO: 89017 - DNA, 22 bp, Homo sapiens
tccagggagagccgctgctcca

SEQ ID NO: 89018 - DNA, 22 bp, Homo sapiens
cctcctgcacctccaggaactc

SEQ ID NO: 89019 - DNA, 22 bp, Homo sapiens
gagatatgttggcagctggtat

SEQ ID NO: 89020 - DNA, 22 bp, Homo sapiens
tagcagcatttttgtagagtat

SEQ ID NO: 89021 - DNA, 22 bp, Homo sapiens
gctgggtgattcatttccataa

SEQ ID NO: 89022 - DNA, 22 bp, Homo sapiens
atatacacatctttttaaatat

SEQ ID NO: 89023 - DNA, 19 bp, Homo sapiens
ttcagcattatattctagc

SEQ ID NO: 89024 - DNA, 22 bp, Homo sapiens
cctactctgagcgcctccgcat

SEQ ID NO: 89025 - DNA, 22 bp, Homo sapiens
gccagatttacagatttgccct

SEQ ID NO: 89026 - DNA, 22 bp, Homo sapiens
accgggaagtcctgcactgggc

SEQ ID NO: 89027 - DNA, 22 bp, Homo sapiens
gcaggtggatcaccacgtcagg

SEQ ID NO: 89028 - DNA, 21 bp, Homo sapiens
tgtaagtttcatctgaattgg

SEQ ID NO: 89029 - DNA, 22 bp, Homo sapiens
gtcacctcgctgtcttcctgag

SEQ ID NO: 89030 - DNA, 22 bp, Homo sapiens
aggtgtcccggcctgcggggct

SEQ ID NO: 89031 - DNA, 22 bp, Homo sapiens
aacccaggagccggaggttgtg

SEQ ID NO: 89032 - DNA, 22 bp, Homo sapiens
cccagggagagcgcggaggcgg

SEQ ID NO: 89033 - DNA, 22 bp, Homo sapiens
atgggtgcagcatggtgggaac

SEQ ID NO: 89034 - DNA, 22 bp, Homo sapiens
cttatagtatgatgttgagaat

SEQ ID NO: 89035 - DNA, 22 bp, Homo sapiens
ctccagattccgtttattcagg

SEQ ID NO: 89036 - DNA, 22 bp, Homo sapiens
atgttggagtcgtaaggcatgg

SEQ ID NO: 89037 - DNA, 22 bp, Homo sapiens
cttggtgccacagcagcttgcg

SEQ ID NO: 89038 - DNA, 22 bp, Homo sapiens
gtcctggggattatagagtgtt

SEQ ID NO: 89039 - DNA, 22 bp, Homo sapiens
gggacgtgagtgaagaaggtct

SEQ ID NO: 89040 - DNA, 22 bp, Homo sapiens
ttccatttggcacttcactgag

SEQ ID NO: 89041 - DNA, 22 bp, Homo sapiens
ccctctctgctgcatagaggaa

SEQ ID NO: 89042 - DNA, 15 bp, Homo sapiens
gcaggcaggtcacct

SEQ ID NO: 89043 - DNA, 22 bp, Homo sapiens
acacccaggctggcgtgcagtg

SEQ ID NO: 89044 - DNA, 22 bp, Homo sapiens
tatttcacatctatgaagtgag

SEQ ID NO: 89045 - DNA, 18 bp, Homo sapiens
tcctttctccctcatctt

SEQ ID NO: 89046 - DNA, 22 bp, Homo sapiens
tctgcaggtaagcgttcttgga

SEQ ID NO: 89047 - DNA, 21 bp, Homo sapiens
ggccgccgccttgtgctctgc

SEQ ID NO: 89048 - DNA, 22 bp, Homo sapiens
gtgagtaaaggttcattgaatt

SEQ ID NO: 89049 - DNA, 22 bp, Homo sapiens
caaagtaattacggttttggcc

SEQ ID NO: 89050 - DNA, 22 bp, Homo sapiens
acccaggctggagtgcagtggc

SEQ ID NO: 89051 - DNA, 22 bp, Homo sapiens
atatcactagagaagttgttaa

SEQ ID NO: 89052 - DNA, 23 bp, Homo sapiens
ttaaacactagttcgagtagcat

SEQ ID NO: 89053 - DNA, 22 bp, Homo sapiens
acttcttcttcagctgggggat

SEQ ID NO: 89054 - DNA, 22 bp, Homo sapiens
caggtgagaggcggtcctgcat

SEQ ID NO: 89055 - DNA, 22 bp, Homo sapiens
tgtgagcagagacatgaaaagc

SEQ ID NO: 89056 - DNA, 22 bp, Homo sapiens
aaggctgagacagcacaggtcc

SEQ ID NO: 89057 - DNA, 19 bp, Homo sapiens
aggctaaagagtcttgcgt

SEQ ID NO: 89058 - DNA, 22 bp, Homo sapiens
aagtcgtggcaggcttgcacga

SEQ ID NO: 89059 - DNA, 22 bp, Homo sapiens
caggccggggcggcgccatctt

SEQ ID NO: 89060 - DNA, 22 bp, Homo sapiens
gaacgggtgcagccatgggccc

SEQ ID NO: 89061 - DNA, 22 bp, Homo sapiens
gtacagaggttgctggaggctc

SEQ ID NO: 89062 - DNA, 22 bp, Homo sapiens
atacaccaccttggatctttca

SEQ ID NO: 89063 - DNA, 22 bp, Homo sapiens
agtgcaggccccaggccaggcc

SEQ ID NO: 89064 - DNA, 22 bp, Homo sapiens
attggtggtgaggacatgccag

SEQ ID NO: 89065 - DNA, 22 bp, Homo sapiens
tatggctaattctttactgacc

SEQ ID NO: 89066 - DNA, 18 bp, Homo sapiens
tggcgatggtcatttttc

SEQ ID NO: 89067 - DNA, 22 bp, Homo sapiens
tgctggaagggtcggcgtgggc

SEQ ID NO: 89068 - DNA, 22 bp, Homo sapiens
ctgaaggatgtgtggtgggagt

SEQ ID NO: 89069 - DNA, 23 bp, Homo sapiens
atcattaacagtgcaggggtagg

SEQ ID NO: 89070 - DNA, 22 bp, Homo sapiens
ccgggttgaggttcccatagat

SEQ ID NO: 89071 - DNA, 22 bp, Homo sapiens
cagagagaatcttggcagctga

SEQ ID NO: 89072 - DNA, 22 bp, Homo sapiens
cgtgtggtcccggcaaggcaag

SEQ ID NO: 89073 - DNA, 22 bp, Homo sapiens
ggttgcaaactcctgggatcaa

SEQ ID NO: 89074 - DNA, 22 bp, Homo sapiens
tacgggcacgcaccacgatgcc

SEQ ID NO: 89075 - DNA, 22 bp, Homo sapiens
gagggggctagcgcagtgccca

SEQ ID NO: 89076 - DNA, 22 bp, Homo sapiens
ctgagctcaagcgatcctccca

SEQ ID NO: 89077 - DNA, 22 bp, Homo sapiens
tgcactactgtgatacacagcc

SEQ ID NO: 89078 - DNA, 22 bp, Homo sapiens
tgcagaaacaagccatcattca

SEQ ID NO: 89079 - DNA, 22 bp, Homo sapiens
agtgcactggcaccatctcagc

SEQ ID NO: 89080 - DNA, 22 bp, Homo sapiens
gggaggttgaggctgcagtgag

SEQ ID NO: 89081 - DNA, 22 bp, Homo sapiens
ccaggagttggaagctgccatg

SEQ ID NO: 89082 - DNA, 22 bp, Homo sapiens
ctgaggtgtgaaatggtggcaa

SEQ ID NO: 89083 - DNA, 22 bp, Homo sapiens
ctgagatggagttttgctcttg

SEQ ID NO: 89084 - DNA, 21 bp, Homo sapiens
tgcttgttctctgtccttgca

SEQ ID NO: 89085 - DNA, 22 bp, Homo sapiens
aatttcggttcaaggcccagtt

SEQ ID NO: 89086 - DNA, 18 bp, Homo sapiens
actctgcggaggccccag

SEQ ID NO: 89087 - DNA, 21 bp, Homo sapiens
gaccccagaccagcagacaca

SEQ ID NO: 89088 - DNA, 22 bp, Homo sapiens
gcaggtccagtcaccagagaga

SEQ ID NO: 89089 - DNA, 22 bp, Homo sapiens
taatggtgtttttctgtaattt

SEQ ID NO: 89090 - DNA, 22 bp, Homo sapiens
cgccaggcttggtagctcatgc

SEQ ID NO: 89091 - DNA, 22 bp, Homo sapiens
tgttatctgagcaacgtcgacg

SEQ ID NO: 89092 - DNA, 22 bp, Homo sapiens
agagtggctctgctgggcacag

SEQ ID NO: 89093 - DNA, 22 bp, Homo sapiens
ggaggctgagaggtcgcagtgg

SEQ ID NO: 89094 - DNA, 22 bp, Homo sapiens
ctccagttggccccagttggtt

SEQ ID NO: 89095 - DNA, 22 bp, Homo sapiens
ctcctgcttcacgggcaccgcc

SEQ ID NO: 89096 - DNA, 18 bp, Homo sapiens
tgtagagccaggtttgcc

SEQ ID NO: 89097 - DNA, 22 bp, Homo sapiens
agcaagattgaggcttcctcag

SEQ ID NO: 89098 - DNA, 22 bp, Homo sapiens
gatgggcgtggcgcgtttggtg

SEQ ID NO: 89099 - DNA, 22 bp, Homo sapiens
cggagtcttgctatgttgccca

SEQ ID NO: 89100 - DNA, 22 bp, Homo sapiens
tctgagctgggtcttgacagct

SEQ ID NO: 89101 - DNA, 22 bp, Homo sapiens
ggtggcagtagcactgggcctg

SEQ ID NO: 89102 - DNA, 22 bp, Homo sapiens
aagtggactaatacaaggacta

SEQ ID NO: 89103 - DNA, 22 bp, Homo sapiens
ccctggaggttgaggctgcagt

SEQ ID NO: 89104 - DNA, 22 bp, Homo sapiens
tctgccgtgcgaggtcccacca

SEQ ID NO: 89105 - DNA, 22 bp, Homo sapiens
cctcagctcccatgagatctgc

SEQ ID NO: 89106 - DNA, 22 bp, Homo sapiens
aaagcctcccaggttatgagta

SEQ ID NO: 89107 - DNA, 21 bp, Homo sapiens
atgtagggtttgccttctcta

SEQ ID NO: 89108 - DNA, 22 bp, Homo sapiens
ctggccagatgttacgtccaat

SEQ ID NO: 89109 - DNA, 22 bp, Homo sapiens
caatttctaacattccatggat

SEQ ID NO: 89110 - DNA, 22 bp, Homo sapiens
tcagtcttgaacagccccctgt

SEQ ID NO: 89111 - DNA, 22 bp, Homo sapiens
tgagatggagtctcgctctgtt

SEQ ID NO: 89112 - DNA, 22 bp, Homo sapiens
tgtttctgtatgatcaatattg

SEQ ID NO: 89113 - DNA, 22 bp, Homo sapiens
aaagatcacgtcccaggactcg

SEQ ID NO: 89114 - DNA, 22 bp, Homo sapiens
ggaagggcaaaagagatgaact

SEQ ID NO: 89115 - DNA, 22 bp, Homo sapiens
tgtccccacctaaatcttatct

SEQ ID NO: 89116 - DNA, 22 bp, Homo sapiens
ccctggctggctctgcccggac

SEQ ID NO: 89117 - DNA, 22 bp, Homo sapiens
cggaggttgaggctgcagtgag

SEQ ID NO: 89118 - DNA, 22 bp, Homo sapiens
gcccagcccagaaaggttcgga

SEQ ID NO: 89119 - DNA, 22 bp, Homo sapiens
agaggtgagtcattacctagtg

SEQ ID NO: 89120 - DNA, 22 bp, Homo sapiens
aagtcgtcgaagatggaggttg

SEQ ID NO: 89121 - DNA, 22 bp, Homo sapiens
aggtggagaagagatgggcagt

SEQ ID NO: 89122 - DNA, 22 bp, Homo sapiens
aagctgcagcacagagaggtgg

SEQ ID NO: 89123 - DNA, 22 bp, Homo sapiens
cccaggaggtcaaggctgcagt

SEQ ID NO: 89124 - DNA, 22 bp, Homo sapiens
tcccgcttcttccgaatcgcga

SEQ ID NO: 89125 - DNA, 23 bp, Homo sapiens
ctatttctcatagttcaggtctt

SEQ ID NO: 89126 - DNA, 22 bp, Homo sapiens
agccagggacgctgcaggctac

SEQ ID NO: 89127 - DNA, 22 bp, Homo sapiens
aggactgggtgcagagggcatc

SEQ ID NO: 89128 - DNA, 22 bp, Homo sapiens
acagtctgtcccccaggtgcta

SEQ ID NO: 89129 - DNA, 22 bp, Homo sapiens
tgttgactcaacactgtgggca

SEQ ID NO: 89130 - DNA, 22 bp, Homo sapiens
aaagttctctatggtgtaaaaa

SEQ ID NO: 89131 - DNA, 22 bp, Homo sapiens
atgaagtggttctattggtttt

SEQ ID NO: 89132 - DNA, 22 bp, Homo sapiens
ggtgtccacattccctggcagg

SEQ ID NO: 89133 - DNA, 22 bp, Homo sapiens
gaccttgtgatccgcccgcctt

SEQ ID NO: 89134 - DNA, 22 bp, Homo sapiens
aggggatggagctggaaggcag

SEQ ID NO: 89135 - DNA, 22 bp, Homo sapiens
gtgggttcgtggtctcgctggc

SEQ ID NO: 89136 - DNA, 22 bp, Homo sapiens
agctcctgaaaatccagactgg

SEQ ID NO: 89137 - DNA, 21 bp, Homo sapiens
ctggccactgcacctcttcct

SEQ ID NO: 89138 - DNA, 22 bp, Homo sapiens
gggtaaatctcttttcatggct

SEQ ID NO: 89139 - DNA, 22 bp, Homo sapiens
cactccagcctcagtgacagag

SEQ ID NO: 89140 - DNA, 22 bp, Homo sapiens
ttcctggtcactgctgttccct

SEQ ID NO: 89141 - DNA, 23 bp, Homo sapiens
aaataggagtatctggatcatga

SEQ ID NO: 89142 - DNA, 22 bp, Homo sapiens
cccgggaggcagaggttgcagt

SEQ ID NO: 89143 - DNA, 22 bp, Homo sapiens
accttgatggggctgttggagt

SEQ ID NO: 89144 - DNA, 22 bp, Homo sapiens
gaagccttgaactgcaaacccc

SEQ ID NO: 89145 - DNA, 23 bp, Homo sapiens
ctggggctttcaaatctgggcag

SEQ ID NO: 89146 - DNA, 22 bp, Homo sapiens
tcccaccttccgtggaacccgt

SEQ ID NO: 89147 - DNA, 22 bp, Homo sapiens
ttctccgctaagttctctgcag

SEQ ID NO: 89148 - DNA, 22 bp, Homo sapiens
ctcagcactgacccaggagatg

SEQ ID NO: 89149 - DNA, 22 bp, Homo sapiens
catggggcccatgtgctccaag

SEQ ID NO: 89150 - DNA, 22 bp, Homo sapiens
tcaccttgtgatccgcccacct

SEQ ID NO: 89151 - DNA, 22 bp, Homo sapiens
ggcaatatggtgaaaccccatc

SEQ ID NO: 89152 - DNA, 22 bp, Homo sapiens
ttgagcaggatggctatgcaca

SEQ ID NO: 89153 - DNA, 22 bp, Homo sapiens
cacagctgtgagaagggagcct

SEQ ID NO: 89154 - DNA, 22 bp, Homo sapiens
gaggggcacagtaaagggtccc

SEQ ID NO: 89155 - DNA, 22 bp, Homo sapiens
aacccgggaggcggaggttgtg

SEQ ID NO: 89156 - DNA, 22 bp, Homo sapiens
tgaatgtgatgctaaacatatg

SEQ ID NO: 89157 - DNA, 22 bp, Homo sapiens
gcagaagcacaggtgacgggcc

SEQ ID NO: 89158 - DNA, 22 bp, Homo sapiens
acacagggctgcgcctgacccc

SEQ ID NO: 89159 - DNA, 22 bp, Homo sapiens
atttcatactaaggctcaaaaa

SEQ ID NO: 89160 - DNA, 22 bp, Homo sapiens
tgagccatgggactccaaggga

SEQ ID NO: 89161 - DNA, 22 bp, Homo sapiens
cgtctaggccgtgccctgaggt

SEQ ID NO: 89162 - DNA, 20 bp, Homo sapiens
ttcatgggagcaaagaggcc

SEQ ID NO: 89163 - DNA, 22 bp, Homo sapiens
gttctgagtcctcctttgaagg

SEQ ID NO: 89164 - DNA, 22 bp, Homo sapiens
agagggcattaactctgtcttg

SEQ ID NO: 89165 - DNA, 22 bp, Homo sapiens
atggcagcggagctggaaatga

SEQ ID NO: 89166 - DNA, 20 bp, Homo sapiens
aggccccaggtggacactag

SEQ ID NO: 89167 - DNA, 22 bp, Homo sapiens
aagtcattggtagcttgatagg

SEQ ID NO: 89168 - DNA, 22 bp, Homo sapiens
ttgtgctcctatgagaatctaa

SEQ ID NO: 89169 - DNA, 22 bp, Homo sapiens
agttattactctttaacatatt

SEQ ID NO: 89170 - DNA, 22 bp, Homo sapiens
taggtttcagaggtgccgggaa

SEQ ID NO: 89171 - DNA, 22 bp, Homo sapiens
ccatccttgtcatcttcatgtt

SEQ ID NO: 89172 - DNA, 23 bp, Homo sapiens
gaggtggcaatgagggcagttgg

SEQ ID NO: 89173 - DNA, 22 bp, Homo sapiens
aatgttacgatcaacaacacat

SEQ ID NO: 89174 - DNA, 22 bp, Homo sapiens
cctggagagctcgggccaggca

SEQ ID NO: 89175 - DNA, 22 bp, Homo sapiens
ccagggatgcagaggttgcagt

SEQ ID NO: 89176 - DNA, 22 bp, Homo sapiens
ggagctcctggcagtgacagag

SEQ ID NO: 89177 - DNA, 20 bp, Homo sapiens
gggcagtggcgctatctcag

SEQ ID NO: 89178 - DNA, 22 bp, Homo sapiens
ttcacagcttaataaggctcag

SEQ ID NO: 89179 - DNA, 22 bp, Homo sapiens
ttcaccatgttggccaggctgg

SEQ ID NO: 89180 - DNA, 22 bp, Homo sapiens
catggcagctcctccagtgtga

SEQ ID NO: 89181 - DNA, 22 bp, Homo sapiens
ccaggctagaaactgaggcaca

SEQ ID NO: 89182 - DNA, 21 bp, Homo sapiens
cgcagagcgaacttgcggcgc

SEQ ID NO: 89183 - DNA, 22 bp, Homo sapiens
cgctccttgagcgtgtcggcct

SEQ ID NO: 89184 - DNA, 22 bp, Homo sapiens
gtatggcactatcctctctgat

SEQ ID NO: 89185 - DNA, 22 bp, Homo sapiens
actgcaacacctcctgggttca

SEQ ID NO: 89186 - DNA, 22 bp, Homo sapiens
cctggggccccgagccagaagc

SEQ ID NO: 89187 - DNA, 22 bp, Homo sapiens
aataaacaaaggacaaggaggt

SEQ ID NO: 89188 - DNA, 22 bp, Homo sapiens
agcccttagtacatttctcaag

SEQ ID NO: 89189 - DNA, 22 bp, Homo sapiens
acaggggcaagggctcacggcc

SEQ ID NO: 89190 - DNA, 22 bp, Homo sapiens
ctggcctggcgcagtggctcac

SEQ ID NO: 89191 - DNA, 22 bp, Homo sapiens
tgggaatgcaaggaaagctgtt

SEQ ID NO: 89192 - DNA, 22 bp, Homo sapiens
tgtgagttcttagaaagtcagt

SEQ ID NO: 89193 - DNA, 22 bp, Homo sapiens
atgttgtgtttgactgttaccc

SEQ ID NO: 89194 - DNA, 23 bp, Homo sapiens
ggatggacgtgatgccttagcca

SEQ ID NO: 89195 - DNA, 22 bp, Homo sapiens
tcacccaggctggactgcagtg

SEQ ID NO: 89196 - DNA, 22 bp, Homo sapiens
tttgcattgcattaagtattct

SEQ ID NO: 89197 - DNA, 22 bp, Homo sapiens
ggcaaggggtcaggctgagaca

SEQ ID NO: 89198 - DNA, 22 bp, Homo sapiens
agggtgaatctcacaactctta

SEQ ID NO: 89199 - DNA, 22 bp, Homo sapiens
ctgctcttcacactacacccgt

SEQ ID NO: 89200 - DNA, 22 bp, Homo sapiens
tcctgggaggcggaggttgcag

SEQ ID NO: 89201 - DNA, 22 bp, Homo sapiens
ggctcactgcaacctctgcctc

SEQ ID NO: 89202 - DNA, 21 bp, Homo sapiens
aaactgaccttgcctgagaca

SEQ ID NO: 89203 - DNA, 22 bp, Homo sapiens
gcagcctgggcaacagagtgag

SEQ ID NO: 89204 - DNA, 22 bp, Homo sapiens
cagagggttgatgtgaggctta

SEQ ID NO: 89205 - DNA, 22 bp, Homo sapiens
tactgtactgcagttctgcaaa

SEQ ID NO: 89206 - DNA, 22 bp, Homo sapiens
agtccgcctgctgccgtggcag

SEQ ID NO: 89207 - DNA, 22 bp, Homo sapiens
atggctgcctgggcgctggccg

SEQ ID NO: 89208 - DNA, 22 bp, Homo sapiens
gggcagagactcagaaacagaa

SEQ ID NO: 89209 - DNA, 23 bp, Homo sapiens
ggactgcaatggcgccgtctcag

SEQ ID NO: 89210 - DNA, 22 bp, Homo sapiens
ctgcgtgagcgtgcccgtcttg

SEQ ID NO: 89211 - DNA, 20 bp, Homo sapiens
ctgggtggcaagcaaggggg

SEQ ID NO: 89212 - DNA, 22 bp, Homo sapiens
gccttgtttctctcccagataa

SEQ ID NO: 89213 - DNA, 22 bp, Homo sapiens
gccagtggtcactgaggaagaa

SEQ ID NO: 89214 - DNA, 22 bp, Homo sapiens
actcagtacatctggagttggc

SEQ ID NO: 89215 - DNA, 22 bp, Homo sapiens
tggcactgaagctggaaagcct

SEQ ID NO: 89216 - DNA, 21 bp, Homo sapiens
tagcccttctccacctcgccc

SEQ ID NO: 89217 - DNA, 22 bp, Homo sapiens
cgtcagtttactgttgccatgg

SEQ ID NO: 89218 - DNA, 22 bp, Homo sapiens
ggagagggtaggggtcctgccc

SEQ ID NO: 89219 - DNA, 22 bp, Homo sapiens
ccagcccgaatccctggccagg

SEQ ID NO: 89220 - DNA, 22 bp, Homo sapiens
gcttggaagtaggattgggaga

SEQ ID NO: 89221 - DNA, 22 bp, Homo sapiens
agaggaagtaatcaggacctgc

SEQ ID NO: 89222 - DNA, 22 bp, Homo sapiens
caccaggctggagtgcagtggc

SEQ ID NO: 89223 - DNA, 22 bp, Homo sapiens
gtatcacttttgagagtgagaa

SEQ ID NO: 89224 - DNA, 22 bp, Homo sapiens
atcttctcatgtgtaatgaggt

SEQ ID NO: 89225 - DNA, 22 bp, Homo sapiens
cgcaggtgaaagaggctgggca

SEQ ID NO: 89226 - DNA, 22 bp, Homo sapiens
acacttggagcaacacttatgg

SEQ ID NO: 89227 - DNA, 19 bp, Homo sapiens
tgcctgctgtattccagag

SEQ ID NO: 89228 - DNA, 22 bp, Homo sapiens
gtaggtcagacataagaggaca

SEQ ID NO: 89229 - DNA, 22 bp, Homo sapiens
gtgtgggctgcagaggcacagc

SEQ ID NO: 89230 - DNA, 22 bp, Homo sapiens
acctgcaggcacaggtgtgcgc

SEQ ID NO: 89231 - DNA, 22 bp, Homo sapiens
tcaagcaaagtttagctggtta

SEQ ID NO: 89232 - DNA, 23 bp, Homo sapiens
aaacttgctatggctgaaatcat

SEQ ID NO: 89233 - DNA, 22 bp, Homo sapiens
gggcagagagctggaactcctt

SEQ ID NO: 89234 - DNA, 22 bp, Homo sapiens
gagagtgagatcctcctgggga

SEQ ID NO: 89235 - DNA, 22 bp, Homo sapiens
ccgccaggatattgtggctttt

SEQ ID NO: 89236 - DNA, 22 bp, Homo sapiens
acgggccttctcttcaggcgag

SEQ ID NO: 89237 - DNA, 22 bp, Homo sapiens
taatttcagtgcaagctcacgg

SEQ ID NO: 89238 - DNA, 22 bp, Homo sapiens
cgtcacttcttagtctattttc

SEQ ID NO: 89239 - DNA, 22 bp, Homo sapiens
acagatgttgcttgtcattctc

SEQ ID NO: 89240 - DNA, 22 bp, Homo sapiens
ctatggtctggaccgaggtcct

SEQ ID NO: 89241 - DNA, 22 bp, Homo sapiens
tgtgacctcatcttaactggaa

SEQ ID NO: 89242 - DNA, 22 bp, Homo sapiens
atacatgcgccatgttggtgtg

SEQ ID NO: 89243 - DNA, 23 bp, Homo sapiens
tgagctgggcctgcaggggtctc

SEQ ID NO: 89244 - DNA, 22 bp, Homo sapiens
cagccccacacggtctagctct

SEQ ID NO: 89245 - DNA, 22 bp, Homo sapiens
attgcacttcagcctgggtgac

SEQ ID NO: 89246 - DNA, 22 bp, Homo sapiens
agggcgctgaaatactaacatg

SEQ ID NO: 89247 - DNA, 22 bp, Homo sapiens
catggcggtcaggatgtaggtg

SEQ ID NO: 89248 - DNA, 22 bp, Homo sapiens
tctaccctgcggtcttggggca

SEQ ID NO: 89249 - DNA, 22 bp, Homo sapiens
ccagaccctccattcaagctcc

SEQ ID NO: 89250 - DNA, 22 bp, Homo sapiens
gcctgtgtggatgcgccggtgc

SEQ ID NO: 89251 - DNA, 22 bp, Homo sapiens
gcccttggcctctttggcccgg

SEQ ID NO: 89252 - DNA, 22 bp, Homo sapiens
ggaatcgttaggtaagcaggga

SEQ ID NO: 89253 - DNA, 22 bp, Homo sapiens
attgttcaatgtaataattttg

SEQ ID NO: 89254 - DNA, 22 bp, Homo sapiens
ttatcacttatgagctttttgc

SEQ ID NO: 89255 - DNA, 22 bp, Homo sapiens
gaagaaagatcaaatagtttcc

SEQ ID NO: 89256 - DNA, 22 bp, Homo sapiens
ggctcaggcctgtaatcctagc

SEQ ID NO: 89257 - DNA, 22 bp, Homo sapiens
actctgctctgtatttcactgt

SEQ ID NO: 89258 - DNA, 22 bp, Homo sapiens
aatgtgagccaatgcccgtggg

SEQ ID NO: 89259 - DNA, 17 bp, Homo sapiens
gtaaggcttgcagatgc

SEQ ID NO: 89260 - DNA, 22 bp, Homo sapiens
tatctatgtgctctgacctctc

SEQ ID NO: 89261 - DNA, 22 bp, Homo sapiens
gcaactgaacatgtgtgtggcc

SEQ ID NO: 89262 - DNA, 22 bp, Homo sapiens
tcagccagccagctacaggctt

SEQ ID NO: 89263 - DNA, 22 bp, Homo sapiens
agttacagaatgtacagaggtt

SEQ ID NO: 89264 - DNA, 22 bp, Homo sapiens
tcccttatctggtattttttag

SEQ ID NO: 89265 - DNA, 22 bp, Homo sapiens
accctccccaagaggtcgtgcc

SEQ ID NO: 89266 - DNA, 22 bp, Homo sapiens
gggaaggaaagttattagcaga

SEQ ID NO: 89267 - DNA, 22 bp, Homo sapiens
cgaggaggaaacgcggagaact

SEQ ID NO: 89268 - DNA, 22 bp, Homo sapiens
gcagcctcaaactccccagctc

SEQ ID NO: 89269 - DNA, 22 bp, Homo sapiens
tgctgctgaggctaaagtatag

SEQ ID NO: 89270 - DNA, 22 bp, Homo sapiens
agctggtgtgccagttccagtt

SEQ ID NO: 89271 - DNA, 22 bp, Homo sapiens
ctggagagaatgtggaatgatt

SEQ ID NO: 89272 - DNA, 22 bp, Homo sapiens
tttgagatggagtcttgctctg

SEQ ID NO: 89273 - DNA, 22 bp, Homo sapiens
tgatattttatgagctttcata

SEQ ID NO: 89274 - DNA, 22 bp, Homo sapiens
agaatgggggctacaggccaca

SEQ ID NO: 89275 - DNA, 21 bp, Homo sapiens
acgctgcaccacgttctgcgg

SEQ ID NO: 89276 - DNA, 22 bp, Homo sapiens
tggctaacaaggtgaaaccccg

SEQ ID NO: 89277 - DNA, 18 bp, Homo sapiens
gatatggaaggccatgcc

SEQ ID NO: 89278 - DNA, 22 bp, Homo sapiens
cctgggcctctcaaagtgctgg

SEQ ID NO: 89279 - DNA, 22 bp, Homo sapiens
aacccgggaggcagaggttgtg

SEQ ID NO: 89280 - DNA, 22 bp, Homo sapiens
tagattatccctgatttgtcca

SEQ ID NO: 89281 - DNA, 22 bp, Homo sapiens
ggttttatcctacccacacagc

SEQ ID NO: 89282 - DNA, 22 bp, Homo sapiens
ggagaacatatctcccacattg

SEQ ID NO: 89283 - DNA, 23 bp, Homo sapiens
agaaagtcatggccaggtttgat

SEQ ID NO: 89284 - DNA, 22 bp, Homo sapiens
gggctgagacgatggggtcttc

SEQ ID NO: 89285 - DNA, 17 bp, Homo sapiens
ttaaggtggatcagcac

SEQ ID NO: 89286 - DNA, 22 bp, Homo sapiens
tggtgcaaaactaattgcggtt

SEQ ID NO: 89287 - DNA, 22 bp, Homo sapiens
cagcgtctcgttgtgggcctcg

SEQ ID NO: 89288 - DNA, 22 bp, Homo sapiens
tactggacacgtatatatagat

SEQ ID NO: 89289 - DNA, 22 bp, Homo sapiens
aggtgactggtttatctggcag

SEQ ID NO: 89290 - DNA, 22 bp, Homo sapiens
tacaggcatgtagcatggtgat

SEQ ID NO: 89291 - DNA, 22 bp, Homo sapiens
caggctgctgcctagaatgaca

SEQ ID NO: 89292 - DNA, 22 bp, Homo sapiens
acaaagccagattctggagcac

SEQ ID NO: 89293 - DNA, 22 bp, Homo sapiens
gctccctggtagccatgctctc

SEQ ID NO: 89294 - DNA, 22 bp, Homo sapiens
gaaaagagacagggtgggtgat

SEQ ID NO: 89295 - DNA, 22 bp, Homo sapiens
tcacagagaaatgtggcacaaa

SEQ ID NO: 89296 - DNA, 19 bp, Homo sapiens
aatgctgcttctttttgca

SEQ ID NO: 89297 - DNA, 22 bp, Homo sapiens
atgtacataaaatgtataatga

SEQ ID NO: 89298 - DNA, 22 bp, Homo sapiens
gaggcctcagcctgccctgaac

SEQ ID NO: 89299 - DNA, 22 bp, Homo sapiens
ggcccaggctggagtgcagtgg

SEQ ID NO: 89300 - DNA, 23 bp, Homo sapiens
cttcacaggttcaggggattaag

SEQ ID NO: 89301 - DNA, 22 bp, Homo sapiens
cttagatgaagtcacagaaccc

SEQ ID NO: 89302 - DNA, 22 bp, Homo sapiens
ccagatgtccctctcaggtttg

SEQ ID NO: 89303 - DNA, 22 bp, Homo sapiens
tgggtgctctgcgaccgtaggg

SEQ ID NO: 89304 - DNA, 22 bp, Homo sapiens
catgagatttgggaggggccag

SEQ ID NO: 89305 - DNA, 22 bp, Homo sapiens
tgcctcaagccctccactgcac

SEQ ID NO: 89306 - DNA, 22 bp, Homo sapiens
ttttcctttgattcccagatgt

SEQ ID NO: 89307 - DNA, 22 bp, Homo sapiens
atgtatatgcatgcattcaaag

SEQ ID NO: 89308 - DNA, 22 bp, Homo sapiens
tgaggcaggagttcaggctgcg

SEQ ID NO: 89309 - DNA, 22 bp, Homo sapiens
gtggttgtttccaggtttgaaa

SEQ ID NO: 89310 - DNA, 22 bp, Homo sapiens
ccagaagtcaagtaagatgaag

SEQ ID NO: 89311 - DNA, 22 bp, Homo sapiens
aaaagcaattgcgggttttgcc

SEQ ID NO: 89312 - DNA, 22 bp, Homo sapiens
tggctgtgtccctgtccagagt

SEQ ID NO: 89313 - DNA, 22 bp, Homo sapiens
ctagggtgtgcagattttgcct

SEQ ID NO: 89314 - DNA, 22 bp, Homo sapiens
tcatcttcctcatttctccagg

SEQ ID NO: 89315 - DNA, 18 bp, Homo sapiens
tcaaatactttgggcagt

SEQ ID NO: 89316 - DNA, 22 bp, Homo sapiens
ccctggctgataccggaaaggc

SEQ ID NO: 89317 - DNA, 22 bp, Homo sapiens
cagtggctggttagggacagga

SEQ ID NO: 89318 - DNA, 22 bp, Homo sapiens
gccgccgctgtgcaatttagca

SEQ ID NO: 89319 - DNA, 22 bp, Homo sapiens
tctgaggctgaatggactccgt

SEQ ID NO: 89320 - DNA, 22 bp, Homo sapiens
ttgagatggagtcttgctctct

SEQ ID NO: 89321 - DNA, 22 bp, Homo sapiens
tttcctcttctggcaggcaggg

SEQ ID NO: 89322 - DNA, 22 bp, Homo sapiens
cagtggcgtgatctctgctcac

SEQ ID NO: 89323 - DNA, 23 bp, Homo sapiens
aggatgtaggatgtatggcagag

SEQ ID NO: 89324 - DNA, 22 bp, Homo sapiens
ggagtgcagtggtgggatctca

SEQ ID NO: 89325 - DNA, 19 bp, Homo sapiens
agtcctggcctgggggacc

SEQ ID NO: 89326 - DNA, 22 bp, Homo sapiens
agccccttgtgggcgcacagca

SEQ ID NO: 89327 - DNA, 22 bp, Homo sapiens
tggaaagaaagtaaaggcgtat

SEQ ID NO: 89328 - DNA, 22 bp, Homo sapiens
ttgctaccattgataccagcac

SEQ ID NO: 89329 - DNA, 22 bp, Homo sapiens
cctctgtgtgatgcgcaaagta

SEQ ID NO: 89330 - DNA, 22 bp, Homo sapiens
tggcagtggcgggactcagggc

SEQ ID NO: 89331 - DNA, 22 bp, Homo sapiens
tggaagacaatttgaaaacatt

SEQ ID NO: 89332 - DNA, 22 bp, Homo sapiens
gaccttcttgctgtgtcctaac

SEQ ID NO: 89333 - DNA, 22 bp, Homo sapiens
cactctcacatgccctgtcagt

SEQ ID NO: 89334 - DNA, 22 bp, Homo sapiens
atgaaatatcttgaagaaattc

SEQ ID NO: 89335 - DNA, 22 bp, Homo sapiens
tggcaggcgggagccatagagg

SEQ ID NO: 89336 - DNA, 22 bp, Homo sapiens
atgccaggaacaaacagtggtg

SEQ ID NO: 89337 - DNA, 22 bp, Homo sapiens
tggtattacttctagacacaag

SEQ ID NO: 89338 - DNA, 22 bp, Homo sapiens
aatgtgaggccttggtagttat

SEQ ID NO: 89339 - DNA, 22 bp, Homo sapiens
ccaggagctggagggtgcagtg

SEQ ID NO: 89340 - DNA, 20 bp, Homo sapiens
gggtgtgtgcagggcctggt

SEQ ID NO: 89341 - DNA, 22 bp, Homo sapiens
aggcgagaggcttgggctagta

SEQ ID NO: 89342 - DNA, 22 bp, Homo sapiens
agcaacctcatgagagtgaaat

SEQ ID NO: 89343 - DNA, 22 bp, Homo sapiens
aggtgtctggacttgtgaagca

SEQ ID NO: 89344 - DNA, 22 bp, Homo sapiens
atagggcctaaaaagtattgct

SEQ ID NO: 89345 - DNA, 22 bp, Homo sapiens
tccataaattttatgaacatat

SEQ ID NO: 89346 - DNA, 23 bp, Homo sapiens
gacagagtgagaccttgtcttac

SEQ ID NO: 89347 - DNA, 22 bp, Homo sapiens
taattagtgtccagcttctgct

SEQ ID NO: 89348 - DNA, 22 bp, Homo sapiens
ggggtgggcgtgcagggacacc

SEQ ID NO: 89349 - DNA, 22 bp, Homo sapiens
tgcctccctggcaagtctctcc

SEQ ID NO: 89350 - DNA, 22 bp, Homo sapiens
gctttatccgcttgacccttac

SEQ ID NO: 89351 - DNA, 22 bp, Homo sapiens
cccaggatggggctgcagttat

SEQ ID NO: 89352 - DNA, 22 bp, Homo sapiens
caggtggtcaggcaaggacacg

SEQ ID NO: 89353 - DNA, 22 bp, Homo sapiens
gaatgcagatggctggtgtatg

SEQ ID NO: 89354 - DNA, 21 bp, Homo sapiens
acatggactgtgaatggggac

SEQ ID NO: 89355 - DNA, 22 bp, Homo sapiens
gagtcgagcagaaagccgtcgg

SEQ ID NO: 89356 - DNA, 22 bp, Homo sapiens
gcgtggcttagagtggggtacc

SEQ ID NO: 89357 - DNA, 18 bp, Homo sapiens
agagtatacagacaacaa

SEQ ID NO: 89358 - DNA, 22 bp, Homo sapiens
cagcctgtcggctccttcattc

SEQ ID NO: 89359 - DNA, 22 bp, Homo sapiens
ccagctttatagcttcaaagga

SEQ ID NO: 89360 - DNA, 19 bp, Homo sapiens
gttttgcaggcagagggga

SEQ ID NO: 89361 - DNA, 22 bp, Homo sapiens
tctacatgcagcgaggggactt

SEQ ID NO: 89362 - DNA, 22 bp, Homo sapiens
ctgctcctgtccagcagggcca

SEQ ID NO: 89363 - DNA, 22 bp, Homo sapiens
atttttctctttccactgagat

SEQ ID NO: 89364 - DNA, 22 bp, Homo sapiens
gaagtgtagtcttgagccccca

SEQ ID NO: 89365 - DNA, 22 bp, Homo sapiens
ggaggcggaggttgcagtgagc

SEQ ID NO: 89366 - DNA, 22 bp, Homo sapiens
actgggctcaagtgattgtcct

SEQ ID NO: 89367 - DNA, 22 bp, Homo sapiens
tgtgtcattgccatgaaaaggc

SEQ ID NO: 89368 - DNA, 22 bp, Homo sapiens
aaagaaatagatggcatttaaa

SEQ ID NO: 89369 - DNA, 22 bp, Homo sapiens
cccaagaggtggaggttgcagt

SEQ ID NO: 89370 - DNA, 22 bp, Homo sapiens
ctccttctgggcctggcagtgg

SEQ ID NO: 89371 - DNA, 17 bp, Homo sapiens
tccttcagtgcctctgc

SEQ ID NO: 89372 - DNA, 22 bp, Homo sapiens
tggcacgacaattggcaccaat

SEQ ID NO: 89373 - DNA, 22 bp, Homo sapiens
tttaaaaaactagtctgagtct

SEQ ID NO: 89374 - DNA, 22 bp, Homo sapiens
acctcctggcctcaagcaatcc

SEQ ID NO: 89375 - DNA, 22 bp, Homo sapiens
tccagcttataggtagatttaa

SEQ ID NO: 89376 - DNA, 22 bp, Homo sapiens
tcaccttgtgatctccctgcct

SEQ ID NO: 89377 - DNA, 20 bp, Homo sapiens
ggtcactgtggctgcaggat

SEQ ID NO: 89378 - DNA, 22 bp, Homo sapiens
tcagccccacggggtcagccaa

SEQ ID NO: 89379 - DNA, 22 bp, Homo sapiens
acttgccccagaattgctgctg

SEQ ID NO: 89380 - DNA, 22 bp, Homo sapiens
agaggaggctctgggatcgtcc

SEQ ID NO: 89381 - DNA, 22 bp, Homo sapiens
atggagttctgccagcgctgct

SEQ ID NO: 89382 - DNA, 22 bp, Homo sapiens
tccttttgagctcctatgtggg

SEQ ID NO: 89383 - DNA, 20 bp, Homo sapiens
gctgaggtggaggaaggaga

SEQ ID NO: 89384 - DNA, 22 bp, Homo sapiens
ctacccttaagtttctgtgggg

SEQ ID NO: 89385 - DNA, 23 bp, Homo sapiens
tatgaactgcattgctggtgtgt

SEQ ID NO: 89386 - DNA, 22 bp, Homo sapiens
ggcctgggctccgggagttact

SEQ ID NO: 89387 - DNA, 22 bp, Homo sapiens
gttacagtcaggagatattttg

SEQ ID NO: 89388 - DNA, 22 bp, Homo sapiens
tatttccttgagacggagtctc

SEQ ID NO: 89389 - DNA, 23 bp, Homo sapiens
gtgccgacgctccagcaccatcc

SEQ ID NO: 89390 - DNA, 21 bp, Homo sapiens
cagggccaatcctgacctcta

SEQ ID NO: 89391 - DNA, 22 bp, Homo sapiens
ctcccagccttcgccagtctga

SEQ ID NO: 89392 - DNA, 22 bp, Homo sapiens
gtaatctcagctacttgggagg

SEQ ID NO: 89393 - DNA, 22 bp, Homo sapiens
gtggagggtgattgccggctgt

SEQ ID NO: 89394 - DNA, 22 bp, Homo sapiens
tgcccagagcctgagaggatta

SEQ ID NO: 89395 - DNA, 22 bp, Homo sapiens
gtgtggctgaaatcaaggcagg

SEQ ID NO: 89396 - DNA, 22 bp, Homo sapiens
gttgctcaggcaggagtacagt

SEQ ID NO: 89397 - DNA, 22 bp, Homo sapiens
gacttttgaataaggtaggata

SEQ ID NO: 89398 - DNA, 22 bp, Homo sapiens
ttgggctgaaccctgcagctga

SEQ ID NO: 89399 - DNA, 22 bp, Homo sapiens
tggttgcctctcagagattccg

SEQ ID NO: 89400 - DNA, 22 bp, Homo sapiens
gctcactgcaacctccgccttc

SEQ ID NO: 89401 - DNA, 22 bp, Homo sapiens
tgctggaggccagaagtctgag

SEQ ID NO: 89402 - DNA, 22 bp, Homo sapiens
ggcctcgcggcttctggtggct

SEQ ID NO: 89403 - DNA, 22 bp, Homo sapiens
atatgggggggcgtgcagagga

SEQ ID NO: 89404 - DNA, 22 bp, Homo sapiens
gcggcaggagtaaaggaggaag

SEQ ID NO: 89405 - DNA, 22 bp, Homo sapiens
tggttcctcaagcgctggcggc

SEQ ID NO: 89406 - DNA, 18 bp, Homo sapiens
gatcgggggcgccccaag

SEQ ID NO: 89407 - DNA, 22 bp, Homo sapiens
ggttccccaggcggcccttgga

SEQ ID NO: 89408 - DNA, 22 bp, Homo sapiens
ttgtggaatgtggctgtcaatt

SEQ ID NO: 89409 - DNA, 22 bp, Homo sapiens
aaagcagaactgagagagctgg

SEQ ID NO: 89410 - DNA, 22 bp, Homo sapiens
ttggagagtgatattcagatgc

SEQ ID NO: 89411 - DNA, 22 bp, Homo sapiens
gctggaggatggactggaagaa

SEQ ID NO: 89412 - DNA, 19 bp, Homo sapiens
tgtgactggttgtctcgct

SEQ ID NO: 89413 - DNA, 22 bp, Homo sapiens
ttttctaacatctagtaatttg

SEQ ID NO: 89414 - DNA, 20 bp, Homo sapiens
tgggatcgaatcaagtctgt

SEQ ID NO: 89415 - DNA, 22 bp, Homo sapiens
tggacaacatagtgagacctca

SEQ ID NO: 89416 - DNA, 22 bp, Homo sapiens
gaggtgctgctgtacttcttgc

SEQ ID NO: 89417 - DNA, 22 bp, Homo sapiens
cacccaggctggagtgcagtgg

SEQ ID NO: 89418 - DNA, 22 bp, Homo sapiens
catccctgtcgtcaagtctctg

SEQ ID NO: 89419 - DNA, 22 bp, Homo sapiens
gcttggcccattgatcagctgg

SEQ ID NO: 89420 - DNA, 22 bp, Homo sapiens
gctcagacctgtaatcttagca

SEQ ID NO: 89421 - DNA, 22 bp, Homo sapiens
tcctggcaaagatgttggtgtt

SEQ ID NO: 89422 - DNA, 22 bp, Homo sapiens
cctggcaggtggcgccctcggc

SEQ ID NO: 89423 - DNA, 22 bp, Homo sapiens
agggatggagtgcggcccggac

SEQ ID NO: 89424 - DNA, 22 bp, Homo sapiens
ctgggaggcggagcttgcagtg

SEQ ID NO: 89425 - DNA, 22 bp, Homo sapiens
ttgcatgttccaaagaattttg

SEQ ID NO: 89426 - DNA, 22 bp, Homo sapiens
tgcgcctgtaagtccagagtcc

SEQ ID NO: 89427 - DNA, 22 bp, Homo sapiens
ccaggaggcggaaggtacagtg

SEQ ID NO: 89428 - DNA, 22 bp, Homo sapiens
taaatgttgtaagtacatctaa

SEQ ID NO: 89429 - DNA, 20 bp, Homo sapiens
gctctgtggtttgagtctcc

SEQ ID NO: 89430 - DNA, 22 bp, Homo sapiens
taggttttcctaaaattctggt

SEQ ID NO: 89431 - DNA, 22 bp, Homo sapiens
cccgacctcgcaaagcgcactc

SEQ ID NO: 89432 - DNA, 22 bp, Homo sapiens
tccattatacttctgattcaaa

SEQ ID NO: 89433 - DNA, 23 bp, Homo sapiens
cagagctggcttcatgggtgtgc

SEQ ID NO: 89434 - DNA, 22 bp, Homo sapiens
ctgatcctcctttaagtagctg

SEQ ID NO: 89435 - DNA, 22 bp, Homo sapiens
atgaggtgggagaatcacttga

SEQ ID NO: 89436 - DNA, 22 bp, Homo sapiens
cctacggaggacaggttagcca

SEQ ID NO: 89437 - DNA, 22 bp, Homo sapiens
cgcagggccgcgagcgggacca

SEQ ID NO: 89438 - DNA, 22 bp, Homo sapiens
acagcagcaatagcagtgacat

SEQ ID NO: 89439 - DNA, 22 bp, Homo sapiens
agctcttacatttaggtctatg

SEQ ID NO: 89440 - DNA, 22 bp, Homo sapiens
tttgattgtcacctaccttgca

SEQ ID NO: 89441 - DNA, 22 bp, Homo sapiens
gaggtggctgcttgctgggaaa

SEQ ID NO: 89442 - DNA, 20 bp, Homo sapiens
aaattactgccacacatttc

SEQ ID NO: 89443 - DNA, 22 bp, Homo sapiens
tgtgactggttgtcccgctttc

SEQ ID NO: 89444 - DNA, 22 bp, Homo sapiens
ctgggaggcagaggttgcagtg

SEQ ID NO: 89445 - DNA, 22 bp, Homo sapiens
gctcatgactgtaatcccagca

SEQ ID NO: 89446 - DNA, 22 bp, Homo sapiens
tctaatccttgctacctgggtg

SEQ ID NO: 89447 - DNA, 22 bp, Homo sapiens
tgtaagtagtaatggaaggaca

SEQ ID NO: 89448 - DNA, 22 bp, Homo sapiens
gtcggccacgcaggtgcggtag

SEQ ID NO: 89449 - DNA, 22 bp, Homo sapiens
tctgcaacagtgccctgtaaat

SEQ ID NO: 89450 - DNA, 22 bp, Homo sapiens
ggtgcagaggagccagctgggg

SEQ ID NO: 89451 - DNA, 22 bp, Homo sapiens
ttaaacatttatggaggcagca

SEQ ID NO: 89452 - DNA, 18 bp, Homo sapiens
cccggctaatttttggta

SEQ ID NO: 89453 - DNA, 22 bp, Homo sapiens
tggtacacatgtccaaggtcag

SEQ ID NO: 89454 - DNA, 22 bp, Homo sapiens
gagcctggagctggaacgaagc

SEQ ID NO: 89455 - DNA, 22 bp, Homo sapiens
gctgcagctcgccttccggcct

SEQ ID NO: 89456 - DNA, 22 bp, Homo sapiens
gggccatgagaggttcatcaac

SEQ ID NO: 89457 - DNA, 22 bp, Homo sapiens
gtggagagagataagcctggtc

SEQ ID NO: 89458 - DNA, 21 bp, Homo sapiens
cagagctgtccaaaccctgac

SEQ ID NO: 89459 - DNA, 22 bp, Homo sapiens
tcactgcgcttcagcctgggtg

SEQ ID NO: 89460 - DNA, 22 bp, Homo sapiens
ggagagtggattccagctgtat

SEQ ID NO: 89461 - DNA, 20 bp, Homo sapiens
ttggatgtgcatggccgtgc

SEQ ID NO: 89462 - DNA, 22 bp, Homo sapiens
ctgaggcaggatggcctggctg

SEQ ID NO: 89463 - DNA, 22 bp, Homo sapiens
aggacaaaggaccagatctgga

SEQ ID NO: 89464 - DNA, 22 bp, Homo sapiens
aggaaataggaccagacaaagc

SEQ ID NO: 89465 - DNA, 22 bp, Homo sapiens
gaaggaagtcattagtgcagac

SEQ ID NO: 89466 - DNA, 22 bp, Homo sapiens
gcaggcagaggtggaggagaca

SEQ ID NO: 89467 - DNA, 22 bp, Homo sapiens
cagtgcacgggccagtcctgcc

SEQ ID NO: 89468 - DNA, 22 bp, Homo sapiens
gctcactgcaacctccacctcc

SEQ ID NO: 89469 - DNA, 22 bp, Homo sapiens
ctggtctgccacccacacccct

SEQ ID NO: 89470 - DNA, 22 bp, Homo sapiens
gaagcctcaacatctctgcgtc

SEQ ID NO: 89471 - DNA, 22 bp, Homo sapiens
tttgtagcagcatgatttataa

SEQ ID NO: 89472 - DNA, 22 bp, Homo sapiens
ttgcatcttctggttgagcccc

SEQ ID NO: 89473 - DNA, 22 bp, Homo sapiens
gcaggcattagcccccatggct

SEQ ID NO: 89474 - DNA, 22 bp, Homo sapiens
ttcattcttttacatgtgaata

SEQ ID NO: 89475 - DNA, 22 bp, Homo sapiens
caggagtgtctccacacagcaa

SEQ ID NO: 89476 - DNA, 22 bp, Homo sapiens
attgtgaatagtgccgcagtaa

SEQ ID NO: 89477 - DNA, 22 bp, Homo sapiens
gcagtggggcaatcatagctca

SEQ ID NO: 89478 - DNA, 22 bp, Homo sapiens
cataatttctaccagggccata

SEQ ID NO: 89479 - DNA, 22 bp, Homo sapiens
tgtctcctcggctgtccagcca

SEQ ID NO: 89480 - DNA, 22 bp, Homo sapiens
ctgctcatcagccgagcagggc

SEQ ID NO: 89481 - DNA, 22 bp, Homo sapiens
acatcatttgtctgtagctgaa

SEQ ID NO: 89482 - DNA, 19 bp, Homo sapiens
gctggatggatcctggagt

SEQ ID NO: 89483 - DNA, 22 bp, Homo sapiens
ggggatggaggcgtgtggtcct

SEQ ID NO: 89484 - DNA, 23 bp, Homo sapiens
ccagtgattgcctggaaggaggt

SEQ ID NO: 89485 - DNA, 22 bp, Homo sapiens
agccggccatgtggtcttgtgc

SEQ ID NO: 89486 - DNA, 22 bp, Homo sapiens
tctatgcttgagacagatgggg

SEQ ID NO: 89487 - DNA, 19 bp, Homo sapiens
gggtcccaaaagatgtgct

SEQ ID NO: 89488 - DNA, 22 bp, Homo sapiens
caaccgcggggcccagcggttc

SEQ ID NO: 89489 - DNA, 22 bp, Homo sapiens
agctcagggccaggcgcgtttc

SEQ ID NO: 89490 - DNA, 22 bp, Homo sapiens
ccatgaattcactccatgctag

SEQ ID NO: 89491 - DNA, 23 bp, Homo sapiens
cggcagcgtccggctacgggagg

SEQ ID NO: 89492 - DNA, 23 bp, Homo sapiens
agcctcttgtggatggtcagcga

SEQ ID NO: 89493 - DNA, 22 bp, Homo sapiens
acaggggattgattggaagtct

SEQ ID NO: 89494 - DNA, 22 bp, Homo sapiens
gtgtgtccaaggcacggatgac

SEQ ID NO: 89495 - DNA, 22 bp, Homo sapiens
actcttgattgatttagtcttt

SEQ ID NO: 89496 - DNA, 22 bp, Homo sapiens
cccacaggtgtgagcttgctgg

SEQ ID NO: 89497 - DNA, 22 bp, Homo sapiens
ccaggaggttgaggctgcagtg

SEQ ID NO: 89498 - DNA, 22 bp, Homo sapiens
gctgaggtggaggaaggagacc

SEQ ID NO: 89499 - DNA, 21 bp, Homo sapiens
ctggaggcaggtggtgccagg

SEQ ID NO: 89500 - DNA, 22 bp, Homo sapiens
ggctgtggcagctggaagtggt

SEQ ID NO: 89501 - DNA, 22 bp, Homo sapiens
ccttacctgattgctggcatcc

SEQ ID NO: 89502 - DNA, 22 bp, Homo sapiens
gtgtatgttctacttaatatta

SEQ ID NO: 89503 - DNA, 22 bp, Homo sapiens
atgtatgtctaaaacggggagg

SEQ ID NO: 89504 - DNA, 22 bp, Homo sapiens
gggttgaggcggatgtcggcgg

SEQ ID NO: 89505 - DNA, 21 bp, Homo sapiens
gccatttcacacagacatttg

SEQ ID NO: 89506 - DNA, 22 bp, Homo sapiens
tgtccagcttttcccaccaagt

SEQ ID NO: 89507 - DNA, 21 bp, Homo sapiens
accaccctgtttatccagagg

SEQ ID NO: 89508 - DNA, 22 bp, Homo sapiens
tacaacaatttccacattagaa

SEQ ID NO: 89509 - DNA, 22 bp, Homo sapiens
gcgagggcacgcggttgaaggc

SEQ ID NO: 89510 - DNA, 22 bp, Homo sapiens
ggctttgacatgctgaattaaa

SEQ ID NO: 89511 - DNA, 22 bp, Homo sapiens
ggaggaggggtgactgaatgct

SEQ ID NO: 89512 - DNA, 22 bp, Homo sapiens
gactacaggccggcatcagaga

SEQ ID NO: 89513 - DNA, 22 bp, Homo sapiens
gtgggggctggaaatcttgcca

SEQ ID NO: 89514 - DNA, 22 bp, Homo sapiens
gagccaggggtcagctccgagg

SEQ ID NO: 89515 - DNA, 22 bp, Homo sapiens
ccaagctacttaggagtctgag

SEQ ID NO: 89516 - DNA, 22 bp, Homo sapiens
ctatacagcagcttactagtta

SEQ ID NO: 89517 - DNA, 22 bp, Homo sapiens
tacttttagcctatttgattct

SEQ ID NO: 89518 - DNA, 21 bp, Homo sapiens
ccgccgctgatagctctgggc

SEQ ID NO: 89519 - DNA, 22 bp, Homo sapiens
agagggtgggcacgtgatggat

SEQ ID NO: 89520 - DNA, 22 bp, Homo sapiens
aggatttctgtgcctggaaaat

SEQ ID NO: 89521 - DNA, 23 bp, Homo sapiens
tctacaaagctgtgtcaggaccc

SEQ ID NO: 89522 - DNA, 22 bp, Homo sapiens
gctcccaggatgaggagccagg

SEQ ID NO: 89523 - DNA, 22 bp, Homo sapiens
gaagattgaaggctgggaatta

SEQ ID NO: 89524 - DNA, 22 bp, Homo sapiens
tttctttatcatagcatctttg

SEQ ID NO: 89525 - DNA, 22 bp, Homo sapiens
taattataacatgctttctggc

SEQ ID NO: 89526 - DNA, 22 bp, Homo sapiens
tctagttctagatccctgagga

SEQ ID NO: 89527 - DNA, 22 bp, Homo sapiens
gctggggaggcagcagagaaca

SEQ ID NO: 89528 - DNA, 22 bp, Homo sapiens
aattttctggtgtgtaatgaag

SEQ ID NO: 89529 - DNA, 22 bp, Homo sapiens
gagctgggcctgcgagtgctgc

SEQ ID NO: 89530 - DNA, 22 bp, Homo sapiens
cctgtgatattgttcataatat

SEQ ID NO: 89531 - DNA, 22 bp, Homo sapiens
agaggccggccgagcccatggg

SEQ ID NO: 89532 - DNA, 22 bp, Homo sapiens
tttcccaggctggaatgcagtg

SEQ ID NO: 89533 - DNA, 22 bp, Homo sapiens
gggtaggcaaagcaatgacgtt

SEQ ID NO: 89534 - DNA, 22 bp, Homo sapiens
gaggccacggaagggagctgtg

SEQ ID NO: 89535 - DNA, 22 bp, Homo sapiens
acccagggctcaagcgtaggca

SEQ ID NO: 89536 - DNA, 22 bp, Homo sapiens
gggaagatagtgttgagggccc

SEQ ID NO: 89537 - DNA, 22 bp, Homo sapiens
gaggtggatgttgcagtgagct

SEQ ID NO: 89538 - DNA, 22 bp, Homo sapiens
acaaagtgctgacattacaggc

SEQ ID NO: 89539 - DNA, 22 bp, Homo sapiens
tgtgactaggcctgagctcttg

SEQ ID NO: 89540 - DNA, 22 bp, Homo sapiens
agtggctgagtgactgtgactc

SEQ ID NO: 89541 - DNA, 22 bp, Homo sapiens
gctggtagacctcactgcactc

SEQ ID NO: 89542 - DNA, 22 bp, Homo sapiens
tcaccaggctagagtgcagtgg

SEQ ID NO: 89543 - DNA, 22 bp, Homo sapiens
attgattttcagactatgcgag

SEQ ID NO: 89544 - DNA, 22 bp, Homo sapiens
taggctgggggtaggaattgag

SEQ ID NO: 89545 - DNA, 22 bp, Homo sapiens
ggcggctactcctcctggtgag

SEQ ID NO: 89546 - DNA, 22 bp, Homo sapiens
attggtagttttgtatttctct

SEQ ID NO: 89547 - DNA, 22 bp, Homo sapiens
atgccacttcattccagcctcg

SEQ ID NO: 89548 - DNA, 22 bp, Homo sapiens
tcactgcaacctccacctcctg

SEQ ID NO: 89549 - DNA, 22 bp, Homo sapiens
ggaggtgactggatcatgggca

SEQ ID NO: 89550 - DNA, 22 bp, Homo sapiens
aagccggctgggccgaggctgc

SEQ ID NO: 89551 - DNA, 22 bp, Homo sapiens
gacccttagaatgtgatcttat

SEQ ID NO: 89552 - DNA, 22 bp, Homo sapiens
gagaagtcatttgaccacctag

SEQ ID NO: 89553 - DNA, 22 bp, Homo sapiens
tcgcgctgtagccgcgcagagt

SEQ ID NO: 89554 - DNA, 22 bp, Homo sapiens
cgtgtacagtctatcttttttc

SEQ ID NO: 89555 - DNA, 22 bp, Homo sapiens
tgtgtgagtaaggctgagagag

SEQ ID NO: 89556 - DNA, 22 bp, Homo sapiens
gcatggcttcggggtgctgcct

SEQ ID NO: 89557 - DNA, 22 bp, Homo sapiens
tgtctggtgggttgacaggcag

SEQ ID NO: 89558 - DNA, 22 bp, Homo sapiens
actattagcatatcatgaatgg

SEQ ID NO: 89559 - DNA, 22 bp, Homo sapiens
agcccaggctggagtgcagtgg

SEQ ID NO: 89560 - DNA, 22 bp, Homo sapiens
tggccttggccgtgctggggtc

SEQ ID NO: 89561 - DNA, 20 bp, Homo sapiens
taagcatagttgtcagggtc

SEQ ID NO: 89562 - DNA, 22 bp, Homo sapiens
gcgagcctctggagtcctctgg

SEQ ID NO: 89563 - DNA, 22 bp, Homo sapiens
atcctagaatcagcccttgctg

SEQ ID NO: 89564 - DNA, 20 bp, Homo sapiens
gtctccactgggggttaacc

SEQ ID NO: 89565 - DNA, 22 bp, Homo sapiens
taagaaatttagttatagaatg

SEQ ID NO: 89566 - DNA, 22 bp, Homo sapiens
ccaggttggagttcagtggcgc

SEQ ID NO: 89567 - DNA, 22 bp, Homo sapiens
cctgcgcgtctgggtctgtctc

SEQ ID NO: 89568 - DNA, 22 bp, Homo sapiens
aaattgcaaaagtacttttagg

SEQ ID NO: 89569 - DNA, 22 bp, Homo sapiens
atccatttgacataatttcagc

SEQ ID NO: 89570 - DNA, 22 bp, Homo sapiens
cttccttctcactagcagcgcc

SEQ ID NO: 89571 - DNA, 22 bp, Homo sapiens
aatgagatggaattcccgccta

SEQ ID NO: 89572 - DNA, 22 bp, Homo sapiens
ctgcgttctgcctggcggccta

SEQ ID NO: 89573 - DNA, 22 bp, Homo sapiens
caagcgtggctgctctgatgga

SEQ ID NO: 89574 - DNA, 22 bp, Homo sapiens
ccaggaggcggaggttgcagcg

SEQ ID NO: 89575 - DNA, 22 bp, Homo sapiens
aagcagagaatctgggagcgag

SEQ ID NO: 89576 - DNA, 22 bp, Homo sapiens
tgcctactagtactattttgtg

SEQ ID NO: 89577 - DNA, 18 bp, Homo sapiens
cccaggttggcctacaga

SEQ ID NO: 89578 - DNA, 22 bp, Homo sapiens
aatgcaatgcagcacctccttg

SEQ ID NO: 89579 - DNA, 22 bp, Homo sapiens
caggctggagttcagtggtgtg

SEQ ID NO: 89580 - DNA, 22 bp, Homo sapiens
atgccactgcactccagcctgg

SEQ ID NO: 89581 - DNA, 18 bp, Homo sapiens
tctgccccagccgcactg

SEQ ID NO: 89582 - DNA, 22 bp, Homo sapiens
ttggaacatgccggggtccagg

SEQ ID NO: 89583 - DNA, 19 bp, Homo sapiens
ggctgccttctgctcatct

SEQ ID NO: 89584 - DNA, 22 bp, Homo sapiens
cgggcagcggcgtggccatggt

SEQ ID NO: 89585 - DNA, 22 bp, Homo sapiens
ggaggcagaatagagtgtgggt

SEQ ID NO: 89586 - DNA, 19 bp, Homo sapiens
gagcagtgaggaccaccag

SEQ ID NO: 89587 - DNA, 22 bp, Homo sapiens
gctgggttttcttccgggccta

SEQ ID NO: 89588 - DNA, 22 bp, Homo sapiens
caggaggattgcttgaggccag

SEQ ID NO: 89589 - DNA, 22 bp, Homo sapiens
atacctgtgtatccacaagcgt

SEQ ID NO: 89590 - DNA, 22 bp, Homo sapiens
gggcagccgcgtgacctgccag

SEQ ID NO: 89591 - DNA, 22 bp, Homo sapiens
caggtgtcggtcaggcggtttt

SEQ ID NO: 89592 - DNA, 22 bp, Homo sapiens
ggctccctgcaacctccgcctc

SEQ ID NO: 89593 - DNA, 22 bp, Homo sapiens
atcttcccaggctggggagagg

SEQ ID NO: 89594 - DNA, 22 bp, Homo sapiens
tctggctctggagtccacctgc

SEQ ID NO: 89595 - DNA, 22 bp, Homo sapiens
cctggaggcggaggttgcagtg

SEQ ID NO: 89596 - DNA, 22 bp, Homo sapiens
aggaattcaagaccagctgggc

SEQ ID NO: 89597 - DNA, 22 bp, Homo sapiens
agcaggcctgccacctcggggt

SEQ ID NO: 89598 - DNA, 22 bp, Homo sapiens
tccacgtgagcttcgtgtgcag

SEQ ID NO: 89599 - DNA, 20 bp, Homo sapiens
agagtgagactccatctcag

SEQ ID NO: 89600 - DNA, 22 bp, Homo sapiens
ggtgggagagcttgctttgatg

SEQ ID NO: 89601 - DNA, 22 bp, Homo sapiens
gtctgaatacgtacttgtgaag

SEQ ID NO: 89602 - DNA, 22 bp, Homo sapiens
cagtcacaagcgtacctaattt

SEQ ID NO: 89603 - DNA, 22 bp, Homo sapiens
actcaaatagcaacggtgagaa

SEQ ID NO: 89604 - DNA, 22 bp, Homo sapiens
gtgagatggagttggtgtcttt

SEQ ID NO: 89605 - DNA, 22 bp, Homo sapiens
ttgtatgtggcaaatgggggag

SEQ ID NO: 89606 - DNA, 22 bp, Homo sapiens
ggagaagcagcttcttgatgaa

SEQ ID NO: 89607 - DNA, 22 bp, Homo sapiens
ctgggtggcagagcctgcagtg

SEQ ID NO: 89608 - DNA, 22 bp, Homo sapiens
tacttttctataggtttgaaat

SEQ ID NO: 89609 - DNA, 22 bp, Homo sapiens
acagtgcttagcacagagtaga

SEQ ID NO: 89610 - DNA, 22 bp, Homo sapiens
aacccgggaggtggaggttatg

SEQ ID NO: 89611 - DNA, 22 bp, Homo sapiens
ttgtgtgtactggttatgggca

SEQ ID NO: 89612 - DNA, 18 bp, Homo sapiens
ggagactaaactgttgac

SEQ ID NO: 89613 - DNA, 22 bp, Homo sapiens
ctgggcgcgtcccctgaggcgg

SEQ ID NO: 89614 - DNA, 22 bp, Homo sapiens
gccatcatatcccctgtgacct

SEQ ID NO: 89615 - DNA, 22 bp, Homo sapiens
ctctggcaattgctgctgactc

SEQ ID NO: 89616 - DNA, 22 bp, Homo sapiens
ttttcctggagatggagttgtt

SEQ ID NO: 89617 - DNA, 22 bp, Homo sapiens
cgccgcctgctgcagcagctgt

SEQ ID NO: 89618 - DNA, 22 bp, Homo sapiens
tccttaggcaatttgggagagt

SEQ ID NO: 89619 - DNA, 22 bp, Homo sapiens
gggcggggggagctggaatgaa

SEQ ID NO: 89620 - DNA, 22 bp, Homo sapiens
acagacaagtagttcagacaag

SEQ ID NO: 89621 - DNA, 22 bp, Homo sapiens
accttcaggtgagcacacagat

SEQ ID NO: 89622 - DNA, 20 bp, Homo sapiens
caagggtttgcattggcttt

SEQ ID NO: 89623 - DNA, 22 bp, Homo sapiens
tggagggcatgctgtccatggg

SEQ ID NO: 89624 - DNA, 22 bp, Homo sapiens
tgggtagtttcccctgccctgc

SEQ ID NO: 89625 - DNA, 22 bp, Homo sapiens
atgccactgcgctctagcctgg

SEQ ID NO: 89626 - DNA, 22 bp, Homo sapiens
ccattgtaaattctgtggaagt

SEQ ID NO: 89627 - DNA, 22 bp, Homo sapiens
gcttctggtgaggcctcaggaa

SEQ ID NO: 89628 - DNA, 22 bp, Homo sapiens
caggctggagtacaattgtgtg

SEQ ID NO: 89629 - DNA, 23 bp, Homo sapiens
actctcaggttctttccagcagg

SEQ ID NO: 89630 - DNA, 22 bp, Homo sapiens
gcaggtggatcacctgaggtca

SEQ ID NO: 89631 - DNA, 22 bp, Homo sapiens
ctccccattatgcagtcattat

SEQ ID NO: 89632 - DNA, 22 bp, Homo sapiens
ctctgcctgtctcatcctgcaa

SEQ ID NO: 89633 - DNA, 22 bp, Homo sapiens
tggagttggccgcccggaccga

SEQ ID NO: 89634 - DNA, 22 bp, Homo sapiens
cccagttgttgccggctctgga

SEQ ID NO: 89635 - DNA, 22 bp, Homo sapiens
caattcccagctgccgggctgc

SEQ ID NO: 89636 - DNA, 22 bp, Homo sapiens
ctgaggagaggtggcctgtgtt

SEQ ID NO: 89637 - DNA, 22 bp, Homo sapiens
tgggtgagcggctgcacacccg

SEQ ID NO: 89638 - DNA, 22 bp, Homo sapiens
tgcttttagctagtaactagta

SEQ ID NO: 89639 - DNA, 22 bp, Homo sapiens
cccaggccctggcagagcttgt

SEQ ID NO: 89640 - DNA, 22 bp, Homo sapiens
ctgagcagatgaccagccccag

SEQ ID NO: 89641 - DNA, 22 bp, Homo sapiens
gggccggagctgggtcccgcgc

SEQ ID NO: 89642 - DNA, 22 bp, Homo sapiens
tggcgcgacgtgccccctgctt

SEQ ID NO: 89643 - DNA, 23 bp, Homo sapiens
tgttccagatacgccttttcctc

SEQ ID NO: 89644 - DNA, 22 bp, Homo sapiens
tcctttaaacaaccagctctca

SEQ ID NO: 89645 - DNA, 22 bp, Homo sapiens
cacagtcctgccagagggcctt

SEQ ID NO: 89646 - DNA, 21 bp, Homo sapiens
ccaccaggtcttctgctcggg

SEQ ID NO: 89647 - DNA, 22 bp, Homo sapiens
ggagtagctgcattccgagcac

SEQ ID NO: 89648 - DNA, 22 bp, Homo sapiens
cttagagatgggttttacttag

SEQ ID NO: 89649 - DNA, 22 bp, Homo sapiens
cgtgccactgcactctagcctg

SEQ ID NO: 89650 - DNA, 22 bp, Homo sapiens
gcagactgtatcaatgtcagta

SEQ ID NO: 89651 - DNA, 22 bp, Homo sapiens
tcagtttttctatactttgtag

SEQ ID NO: 89652 - DNA, 22 bp, Homo sapiens
tgtgttgtgacattcttggatg

SEQ ID NO: 89653 - DNA, 22 bp, Homo sapiens
gctgctctccaagcctccttga

SEQ ID NO: 89654 - DNA, 22 bp, Homo sapiens
atatattttttgagacagagtc

SEQ ID NO: 89655 - DNA, 22 bp, Homo sapiens
cactgggcgtgtcctgggtgag

SEQ ID NO: 89656 - DNA, 22 bp, Homo sapiens
tgtctcttttcaagctaccctt

SEQ ID NO: 89657 - DNA, 20 bp, Homo sapiens
tgttgattggtgtcatctca

SEQ ID NO: 89658 - DNA, 22 bp, Homo sapiens
ttacactttaaatccagcttgt

SEQ ID NO: 89659 - DNA, 22 bp, Homo sapiens
acagagcaataacagggagagg

SEQ ID NO: 89660 - DNA, 22 bp, Homo sapiens
ccagatatcactgccgtgttgt

SEQ ID NO: 89661 - DNA, 22 bp, Homo sapiens
tccgggcaactgaagggaggtt

SEQ ID NO: 89662 - DNA, 22 bp, Homo sapiens
tcgtgaggctctgcatcgcaca

SEQ ID NO: 89663 - DNA, 22 bp, Homo sapiens
ccgcggggcgtgggctcttacc

SEQ ID NO: 89664 - DNA, 22 bp, Homo sapiens
ttctttcagaacacaagtgatt

SEQ ID NO: 89665 - DNA, 19 bp, Homo sapiens
gcagacaggtccagagagg

SEQ ID NO: 89666 - DNA, 21 bp, Homo sapiens
ctcccagggtgactgttcaac

SEQ ID NO: 89667 - DNA, 20 bp, Homo sapiens
aaacgagccatcattctggt

SEQ ID NO: 89668 - DNA, 22 bp, Homo sapiens
atttagtagagaaattaagaaa

SEQ ID NO: 89669 - DNA, 22 bp, Homo sapiens
ggaaggcagaggtgtcgtgggg

SEQ ID NO: 89670 - DNA, 22 bp, Homo sapiens
agtggcacaactgtttagctac

SEQ ID NO: 89671 - DNA, 17 bp, Homo sapiens
ggctgcagtccaggagg

SEQ ID NO: 89672 - DNA, 22 bp, Homo sapiens
ttgagatggagcctcagtcttg

SEQ ID NO: 89673 - DNA, 22 bp, Homo sapiens
gccatgggcaaatgcagagctg

SEQ ID NO: 89674 - DNA, 22 bp, Homo sapiens
ctggaggccactgtacagattg

SEQ ID NO: 89675 - DNA, 22 bp, Homo sapiens
gaaatcatattctcagtccttc

SEQ ID NO: 89676 - DNA, 22 bp, Homo sapiens
ctgctaaacctctctgagagct

SEQ ID NO: 89677 - DNA, 22 bp, Homo sapiens
acctggaggcagaggttgcagt

SEQ ID NO: 89678 - DNA, 22 bp, Homo sapiens
ctacaaaagtaattgtggtttt

SEQ ID NO: 89679 - DNA, 22 bp, Homo sapiens
gagggtggtggcttaaggtgct

SEQ ID NO: 89680 - DNA, 22 bp, Homo sapiens
ctttaaggtgatgagagatgct

SEQ ID NO: 89681 - DNA, 22 bp, Homo sapiens
actggacagaggaaatatggag

SEQ ID NO: 89682 - DNA, 22 bp, Homo sapiens
cccaggctggagtgcagtggcg

SEQ ID NO: 89683 - DNA, 22 bp, Homo sapiens
tgtcttcaggagtaaatatcat

SEQ ID NO: 89684 - DNA, 22 bp, Homo sapiens
gcacagccacgtaatgtggtca

SEQ ID NO: 89685 - DNA, 22 bp, Homo sapiens
tccagcccaggctggagtgtag

SEQ ID NO: 89686 - DNA, 14 bp, Homo sapiens
gcaggcggatcact

SEQ ID NO: 89687 - DNA, 22 bp, Homo sapiens
cttgggaggcagaggttgcagt

SEQ ID NO: 89688 - DNA, 22 bp, Homo sapiens
gaggactgaaacttacaggaaa

SEQ ID NO: 89689 - DNA, 22 bp, Homo sapiens
aaaatcctgctgactcgagatg

SEQ ID NO: 89690 - DNA, 22 bp, Homo sapiens
tcgaatggcaaggaaagaggct

SEQ ID NO: 89691 - DNA, 22 bp, Homo sapiens
ggagtgaatcactagatgcaga

SEQ ID NO: 89692 - DNA, 22 bp, Homo sapiens
atagagtgatgtaaggtatgtg

SEQ ID NO: 89693 - DNA, 22 bp, Homo sapiens
gtgcacatcgtgcaggtttgtt

SEQ ID NO: 89694 - DNA, 22 bp, Homo sapiens
gatccgaatcattgctctttta

SEQ ID NO: 89695 - DNA, 22 bp, Homo sapiens
gctatgggatgtgctgtggatg

SEQ ID NO: 89696 - DNA, 22 bp, Homo sapiens
gatattcctgaaggacagggtt

SEQ ID NO: 89697 - DNA, 22 bp, Homo sapiens
aggtctcttgctgtctctgggc

SEQ ID NO: 89698 - DNA, 22 bp, Homo sapiens
cagcctggtccccggctcaccc

SEQ ID NO: 89699 - DNA, 22 bp, Homo sapiens
tctgcggtccccttctcgccct

SEQ ID NO: 89700 - DNA, 22 bp, Homo sapiens
ttttggccacatccttttgagt

SEQ ID NO: 89701 - DNA, 22 bp, Homo sapiens
tccgggttttacactcacatca

SEQ ID NO: 89702 - DNA, 22 bp, Homo sapiens
ttgagggtctggatctgctgct

SEQ ID NO: 89703 - DNA, 22 bp, Homo sapiens
tctgactcccatattccacttc

SEQ ID NO: 89704 - DNA, 22 bp, Homo sapiens
tgttcttgagcctttagaccta

SEQ ID NO: 89705 - DNA, 22 bp, Homo sapiens
gaccctgtttctacaaataatt

SEQ ID NO: 89706 - DNA, 22 bp, Homo sapiens
tcagtgcagggtgggagagaga

SEQ ID NO: 89707 - DNA, 22 bp, Homo sapiens
gcctgggtccaccgctcgcgct

SEQ ID NO: 89708 - DNA, 22 bp, Homo sapiens
tcaggaggtccgcccgggaggg

SEQ ID NO: 89709 - DNA, 22 bp, Homo sapiens
tcttcacgccaagtgcccctca

SEQ ID NO: 89710 - DNA, 22 bp, Homo sapiens
aagttgttgttgaggtgggtaa

SEQ ID NO: 89711 - DNA, 21 bp, Homo sapiens
cctcaagtgcctcctgctgct

SEQ ID NO: 89712 - DNA, 19 bp, Homo sapiens
taggaccctggtggccccc

SEQ ID NO: 89713 - DNA, 17 bp, Homo sapiens
aggtgggtggatcacct

SEQ ID NO: 89714 - DNA, 21 bp, Homo sapiens
gtgcggatgccgtcattgtca

SEQ ID NO: 89715 - DNA, 22 bp, Homo sapiens
acactccagggagggagggaat

SEQ ID NO: 89716 - DNA, 22 bp, Homo sapiens
tctgtagtaggttgtagttctt

SEQ ID NO: 89717 - DNA, 22 bp, Homo sapiens
ctattgtttctatgctctgagg

SEQ ID NO: 89718 - DNA, 22 bp, Homo sapiens
caggagtgttgattgctcagga

SEQ ID NO: 89719 - DNA, 22 bp, Homo sapiens
tgagcctgagttcaaggctgca

SEQ ID NO: 89720 - DNA, 22 bp, Homo sapiens
gttccaggtggtcacagagctc

SEQ ID NO: 89721 - DNA, 22 bp, Homo sapiens
gggaggcagtgctggaggctgg

SEQ ID NO: 89722 - DNA, 22 bp, Homo sapiens
ctgaggcctctcccactccagc

SEQ ID NO: 89723 - DNA, 22 bp, Homo sapiens
aggacgctctcgctgaacttct

SEQ ID NO: 89724 - DNA, 22 bp, Homo sapiens
tcctgggccctccggatcaggt

SEQ ID NO: 89725 - DNA, 22 bp, Homo sapiens
aagcagaatagaggcccttccc

SEQ ID NO: 89726 - DNA, 22 bp, Homo sapiens
cgctgcgaggcgcccttgttgc

SEQ ID NO: 89727 - DNA, 22 bp, Homo sapiens
gagaggtggaggttgcagtgag

SEQ ID NO: 89728 - DNA, 22 bp, Homo sapiens
ctccaggccatggctgcggagg

SEQ ID NO: 89729 - DNA, 22 bp, Homo sapiens
atggaaggctttatgactcaaa

SEQ ID NO: 89730 - DNA, 22 bp, Homo sapiens
gaggcaggcagattgcttgagg

SEQ ID NO: 89731 - DNA, 22 bp, Homo sapiens
tggtggggccagacttcagctc

SEQ ID NO: 89732 - DNA, 22 bp, Homo sapiens
ctagcctgggatttgaacttat

SEQ ID NO: 89733 - DNA, 22 bp, Homo sapiens
cccaggaggcagaagttgcagt

SEQ ID NO: 89734 - DNA, 22 bp, Homo sapiens
ttgtaacaggtactaaataact

SEQ ID NO: 89735 - DNA, 22 bp, Homo sapiens
tggagaattctatgttgagggg

SEQ ID NO: 89736 - DNA, 22 bp, Homo sapiens
agtgagagtattaatgtgaact

SEQ ID NO: 89737 - DNA, 22 bp, Homo sapiens
caatagtaaattacggaggaga

SEQ ID NO: 89738 - DNA, 22 bp, Homo sapiens
cagggaaagtcccaccccacac

SEQ ID NO: 89739 - DNA, 22 bp, Homo sapiens
aagtgcttccatgtttgagtgt

SEQ ID NO: 89740 - DNA, 22 bp, Homo sapiens
ttcctggcttgtcacatctacg

SEQ ID NO: 89741 - DNA, 22 bp, Homo sapiens
tgctcgaggtccccaccggctc

SEQ ID NO: 89742 - DNA, 22 bp, Homo sapiens
ttccaactttgtcatatattat

SEQ ID NO: 89743 - DNA, 22 bp, Homo sapiens
ttccctgtgtgcagatgggtgt

SEQ ID NO: 89744 - DNA, 23 bp, Homo sapiens
gcctgccgcctggctgagaactg

SEQ ID NO: 89745 - DNA, 22 bp, Homo sapiens
ggtgccaggctgtagtcagggt

SEQ ID NO: 89746 - DNA, 22 bp, Homo sapiens
aaagaggcaatcaatgtagcaa

SEQ ID NO: 89747 - DNA, 22 bp, Homo sapiens
tggaggcagccgtgaaccacct

SEQ ID NO: 89748 - DNA, 21 bp, Homo sapiens
gctgctcgagatccagtgctt

SEQ ID NO: 89749 - DNA, 22 bp, Homo sapiens
gatttttatataaagtgagaaa

SEQ ID NO: 89750 - DNA, 22 bp, Homo sapiens
gaggggctgccctggtgtcagg

SEQ ID NO: 89751 - DNA, 22 bp, Homo sapiens
gctgcagacttctcatctcatt

SEQ ID NO: 89752 - DNA, 22 bp, Homo sapiens
ggcagagcttgcagtgagccga

SEQ ID NO: 89753 - DNA, 22 bp, Homo sapiens
gctcaagccttctgcccacctc

SEQ ID NO: 89754 - DNA, 22 bp, Homo sapiens
aggagctgtcagagtgccagag

SEQ ID NO: 89755 - DNA, 22 bp, Homo sapiens
ccgaggctggagtgcagtggcg

SEQ ID NO: 89756 - DNA, 22 bp, Homo sapiens
aaagctaaggtagcattggaga

SEQ ID NO: 89757 - DNA, 22 bp, Homo sapiens
cctgggtttggagcctgcagaa

SEQ ID NO: 89758 - DNA, 22 bp, Homo sapiens
atccccctgtatctggaagaat

SEQ ID NO: 89759 - DNA, 22 bp, Homo sapiens
tggaagactcaaggtggtgaat

SEQ ID NO: 89760 - DNA, 22 bp, Homo sapiens
gctcggtggccagcctgaggcc

SEQ ID NO: 89761 - DNA, 22 bp, Homo sapiens
agcgccgcccctgctggtgttg

SEQ ID NO: 89762 - DNA, 22 bp, Homo sapiens
aactgaggtatctgctgtgttt

SEQ ID NO: 89763 - DNA, 22 bp, Homo sapiens
actttatttcctattgcatcca

SEQ ID NO: 89764 - DNA, 23 bp, Homo sapiens
ttgcatagacatcctcatagatt

SEQ ID NO: 89765 - DNA, 22 bp, Homo sapiens
gcggggttccgtgccccagagt

SEQ ID NO: 89766 - DNA, 22 bp, Homo sapiens
ctgtggctctttagttgagcac

SEQ ID NO: 89767 - DNA, 22 bp, Homo sapiens
actggggctgatgcgttcgtgt

SEQ ID NO: 89768 - DNA, 22 bp, Homo sapiens
agaagccaccagctgaggaaga

SEQ ID NO: 89769 - DNA, 22 bp, Homo sapiens
tagaggctttcagcggtaggtc

SEQ ID NO: 89770 - DNA, 22 bp, Homo sapiens
ccaggctggagtatagtggcgc

SEQ ID NO: 89771 - DNA, 22 bp, Homo sapiens
ccaggctagagtgcaatggcat

SEQ ID NO: 89772 - DNA, 22 bp, Homo sapiens
atacagttatagtcagggctaa

SEQ ID NO: 89773 - DNA, 22 bp, Homo sapiens
aagggctctgtgcttgtcccat

SEQ ID NO: 89774 - DNA, 22 bp, Homo sapiens
acggggctagagaaggtttctt

SEQ ID NO: 89775 - DNA, 22 bp, Homo sapiens
caggaggacatactggctcaca

SEQ ID NO: 89776 - DNA, 22 bp, Homo sapiens
gtcatcatcaggcagatgctgc

SEQ ID NO: 89777 - DNA, 22 bp, Homo sapiens
gttactcttccccggggtctgg

SEQ ID NO: 89778 - DNA, 22 bp, Homo sapiens
tcttgggggactttggcatgga

SEQ ID NO: 89779 - DNA, 22 bp, Homo sapiens
actgcacttcagcctgggtgac

SEQ ID NO: 89780 - DNA, 22 bp, Homo sapiens
aagagggaaattgttggctgct

SEQ ID NO: 89781 - DNA, 22 bp, Homo sapiens
cccagctcttcaagtcaccccc

SEQ ID NO: 89782 - DNA, 22 bp, Homo sapiens
tgaaatgtgttctagtgttttg

SEQ ID NO: 89783 - DNA, 22 bp, Homo sapiens
aactcagatgtttggctacctt

SEQ ID NO: 89784 - DNA, 23 bp, Homo sapiens
aaactacaacgccaggcactgag

SEQ ID NO: 89785 - DNA, 22 bp, Homo sapiens
agcctgcgatcccacctggcct

SEQ ID NO: 89786 - DNA, 22 bp, Homo sapiens
gacaggaggcagagctcaggtg

SEQ ID NO: 89787 - DNA, 22 bp, Homo sapiens
ctggcaagaaatatatatctta

SEQ ID NO: 89788 - DNA, 20 bp, Homo sapiens
ttctccagtgcggtagccat

SEQ ID NO: 89789 - DNA, 22 bp, Homo sapiens
gggtccagtagttggtggccgt

SEQ ID NO: 89790 - DNA, 22 bp, Homo sapiens
tccacagtggttgaactagtaa

SEQ ID NO: 89791 - DNA, 22 bp, Homo sapiens
cactgctacctctgcctcccgg

SEQ ID NO: 89792 - DNA, 22 bp, Homo sapiens
gattcactcatattttacgttt

SEQ ID NO: 89793 - DNA, 22 bp, Homo sapiens
aggcaagggggcgccaccttcc

SEQ ID NO: 89794 - DNA, 22 bp, Homo sapiens
tcttcccccgtgctccagtgca

SEQ ID NO: 89795 - DNA, 22 bp, Homo sapiens
ttgtcttttgtgggaaatatgg

SEQ ID NO: 89796 - DNA, 20 bp, Homo sapiens
tgcagcacgggccctttcca

SEQ ID NO: 89797 - DNA, 22 bp, Homo sapiens
ctgtatttcttggacagttgct

SEQ ID NO: 89798 - DNA, 22 bp, Homo sapiens
ctgcagggagaggggacagcct

SEQ ID NO: 89799 - DNA, 22 bp, Homo sapiens
acagtatagggcttatattgta

SEQ ID NO: 89800 - DNA, 22 bp, Homo sapiens
gtcgtggtcagacaccagaaaa

SEQ ID NO: 89801 - DNA, 22 bp, Homo sapiens
tgtgtctcaagtcagagcatca

SEQ ID NO: 89802 - DNA, 22 bp, Homo sapiens
cgtgatttctggctttctatat

SEQ ID NO: 89803 - DNA, 22 bp, Homo sapiens
tatgaagtgatgttgaattttg

SEQ ID NO: 89804 - DNA, 22 bp, Homo sapiens
aggaagatgtgcaaagttggaa

SEQ ID NO: 89805 - DNA, 22 bp, Homo sapiens
atctttgattgaagggaccctg

SEQ ID NO: 89806 - DNA, 22 bp, Homo sapiens
taacaactgctgaggtatttga

SEQ ID NO: 89807 - DNA, 22 bp, Homo sapiens
tctgctggaaaaccagggaatt

SEQ ID NO: 89808 - DNA, 22 bp, Homo sapiens
cccgggaggcggaggttgcagt

SEQ ID NO: 89809 - DNA, 22 bp, Homo sapiens
tggagaagattggtcaccattc

SEQ ID NO: 89810 - DNA, 22 bp, Homo sapiens
taagtcttcatagtctaatgtc

SEQ ID NO: 89811 - DNA, 22 bp, Homo sapiens
tgttcagaacaaaggtaaatga

SEQ ID NO: 89812 - DNA, 22 bp, Homo sapiens
tactttgtccatttgcaggcag

SEQ ID NO: 89813 - DNA, 22 bp, Homo sapiens
ctgcattgatcaggcagaatct

SEQ ID NO: 89814 - DNA, 22 bp, Homo sapiens
aactcaaagatgcatgacgctt

SEQ ID NO: 89815 - DNA, 22 bp, Homo sapiens
gcaaatacatgttgagcaccta

SEQ ID NO: 89816 - DNA, 22 bp, Homo sapiens
tggaatggaaacaaactgagga

SEQ ID NO: 89817 - DNA, 20 bp, Homo sapiens
aaactaaaggtgtttggttt

SEQ ID NO: 89818 - DNA, 22 bp, Homo sapiens
aaacaacctaaagttactgatc

SEQ ID NO: 89819 - DNA, 22 bp, Homo sapiens
ccttctagcaaatcaacataaa

SEQ ID NO: 89820 - DNA, 20 bp, Homo sapiens
ataaaataactgccacaaga

SEQ ID NO: 89821 - DNA, 22 bp, Homo sapiens
tctcctggagcccagatgctgg

SEQ ID NO: 89822 - DNA, 22 bp, Homo sapiens
ggacaagcctgtgagtgggttt

SEQ ID NO: 89823 - DNA, 22 bp, Homo sapiens
gctctctgcagcctccttggag

SEQ ID NO: 89824 - DNA, 22 bp, Homo sapiens
accacctcatcaagctggattg

SEQ ID NO: 89825 - DNA, 22 bp, Homo sapiens
gagaaatgcatgcatgtcatca

SEQ ID NO: 89826 - DNA, 22 bp, Homo sapiens
cctcgcggcactcgggccggat

SEQ ID NO: 89827 - DNA, 22 bp, Homo sapiens
tggcacaggatctcagcggcca

SEQ ID NO: 89828 - DNA, 22 bp, Homo sapiens
gcaggatgagtgagtacattta

SEQ ID NO: 89829 - DNA, 22 bp, Homo sapiens
ccactgtggaaagcagttcaga

SEQ ID NO: 89830 - DNA, 22 bp, Homo sapiens
ggctgcaggttggttggcagct

SEQ ID NO: 89831 - DNA, 23 bp, Homo sapiens
cagggccctgctcaatttctcca

SEQ ID NO: 89832 - DNA, 23 bp, Homo sapiens
gggggccgtcctggggattatag

SEQ ID NO: 89833 - DNA, 22 bp, Homo sapiens
catcccctgatgctcttgagta

SEQ ID NO: 89834 - DNA, 22 bp, Homo sapiens
attttctctttgtatatgctag

SEQ ID NO: 89835 - DNA, 20 bp, Homo sapiens
caaatccctgctctgtgctg

SEQ ID NO: 89836 - DNA, 22 bp, Homo sapiens
ctcagcttttcccggataggtg

SEQ ID NO: 89837 - DNA, 22 bp, Homo sapiens
aagttactggcaagggctgcag

SEQ ID NO: 89838 - DNA, 22 bp, Homo sapiens
agtggtcttagcttgctgggct

SEQ ID NO: 89839 - DNA, 22 bp, Homo sapiens
ttataagactgtagtgagtatt

SEQ ID NO: 89840 - DNA, 22 bp, Homo sapiens
ccggctactcgggaggctgacg

SEQ ID NO: 89841 - DNA, 22 bp, Homo sapiens
gctggccacagatccccaggga

SEQ ID NO: 89842 - DNA, 22 bp, Homo sapiens
cggctcactgcagctccgcctc

SEQ ID NO: 89843 - DNA, 19 bp, Homo sapiens
tggctctgtcgaaggcaca

SEQ ID NO: 89844 - DNA, 19 bp, Homo sapiens
gatttaaacgtggctctat

SEQ ID NO: 89845 - DNA, 22 bp, Homo sapiens
ccagggtggcgtagatgctggg

SEQ ID NO: 89846 - DNA, 22 bp, Homo sapiens
ggtgtccgcgctgtagaaggtc

SEQ ID NO: 89847 - DNA, 22 bp, Homo sapiens
gagcagtgtttgtggacctgga

SEQ ID NO: 89848 - DNA, 22 bp, Homo sapiens
ggtgagttctcagcttattgca

SEQ ID NO: 89849 - DNA, 22 bp, Homo sapiens
acattaaacttgcttggctgta

SEQ ID NO: 89850 - DNA, 22 bp, Homo sapiens
aatgccttggagagcctagagg

SEQ ID NO: 89851 - DNA, 22 bp, Homo sapiens
aaggagtctgggccattcagag

SEQ ID NO: 89852 - DNA, 22 bp, Homo sapiens
ataaaaactgacccatcctttg

SEQ ID NO: 89853 - DNA, 22 bp, Homo sapiens
gggagaagaatgtgtcaattgt

SEQ ID NO: 89854 - DNA, 22 bp, Homo sapiens
ctcattgcccagatccccacag

SEQ ID NO: 89855 - DNA, 22 bp, Homo sapiens
aaggtgggtggatcacgaggtc

SEQ ID NO: 89856 - DNA, 22 bp, Homo sapiens
ccggctcggcgaccaggctgaa

SEQ ID NO: 89857 - DNA, 22 bp, Homo sapiens
tgccctggctcttcttgttcca

SEQ ID NO: 89858 - DNA, 22 bp, Homo sapiens
agggcgacaatggagagcgttt

SEQ ID NO: 89859 - DNA, 19 bp, Homo sapiens
tgaaggacagtgcacatca

SEQ ID NO: 89860 - DNA, 22 bp, Homo sapiens
aggtaaagacagtgaaagaggg

SEQ ID NO: 89861 - DNA, 22 bp, Homo sapiens
tgtgggagaaggaagcaagctg

SEQ ID NO: 89862 - DNA, 22 bp, Homo sapiens
aggggcacgagtagagctctag

SEQ ID NO: 89863 - DNA, 22 bp, Homo sapiens
tctttgctattgtgagtagtgc

SEQ ID NO: 89864 - DNA, 22 bp, Homo sapiens
tcctcagaatcacctggcagct

SEQ ID NO: 89865 - DNA, 22 bp, Homo sapiens
tctagctctgcttatcatggct

SEQ ID NO: 89866 - DNA, 21 bp, Homo sapiens
tctcttcctccgcgccgccgc

SEQ ID NO: 89867 - DNA, 22 bp, Homo sapiens
agcccaggagtttgaggctgtg

SEQ ID NO: 89868 - DNA, 22 bp, Homo sapiens
ggcatcttgttgctcaaatcta

SEQ ID NO: 89869 - DNA, 22 bp, Homo sapiens
gggtattaaaatgaaggagaaa

SEQ ID NO: 89870 - DNA, 22 bp, Homo sapiens
agtgctgtcagttttatagata

SEQ ID NO: 89871 - DNA, 22 bp, Homo sapiens
ctcctggaggatagtgactggg

SEQ ID NO: 89872 - DNA, 22 bp, Homo sapiens
ctgcatccatgttgctgcaaag

SEQ ID NO: 89873 - DNA, 22 bp, Homo sapiens
gaatgctaagcatgtgggagtt

SEQ ID NO: 89874 - DNA, 22 bp, Homo sapiens
ttagtttataattcatttctgt

SEQ ID NO: 89875 - DNA, 22 bp, Homo sapiens
gaagccagtgtttgaagaattt

SEQ ID NO: 89876 - DNA, 22 bp, Homo sapiens
cacgaatggaagggtcttggct

SEQ ID NO: 89877 - DNA, 22 bp, Homo sapiens
gaaagagaacctgggcctagat

SEQ ID NO: 89878 - DNA, 22 bp, Homo sapiens
ctggcagatagtaagtgatcaa

SEQ ID NO: 89879 - DNA, 22 bp, Homo sapiens
tagtatagattgaagcagatca

SEQ ID NO: 89880 - DNA, 22 bp, Homo sapiens
cctgggggccaggaaggtgtga

SEQ ID NO: 89881 - DNA, 22 bp, Homo sapiens
ttacatgtttatgtggtacatg

SEQ ID NO: 89882 - DNA, 22 bp, Homo sapiens
tgagtgaggctgggcagtccct

SEQ ID NO: 89883 - DNA, 22 bp, Homo sapiens
cagccctcctaccctgccaggc

SEQ ID NO: 89884 - DNA, 22 bp, Homo sapiens
ccaggctggagtgcaatggcat

SEQ ID NO: 89885 - DNA, 21 bp, Homo sapiens
tcgtgcagcagctgaggcttg

SEQ ID NO: 89886 - DNA, 19 bp, Homo sapiens
agggaatccggctgaggga

SEQ ID NO: 89887 - DNA, 22 bp, Homo sapiens
tgctttgtgacagattagtttt

SEQ ID NO: 89888 - DNA, 14 bp, Homo sapiens
gcaggcagatcacc

SEQ ID NO: 89889 - DNA, 22 bp, Homo sapiens
ctggctggagtgcaggtgagtg

SEQ ID NO: 89890 - DNA, 22 bp, Homo sapiens
cctgcctatgagacgttttgcc

SEQ ID NO: 89891 - DNA, 22 bp, Homo sapiens
gcccgcagagatctttaacaaa

SEQ ID NO: 89892 - DNA, 22 bp, Homo sapiens
ggtgtcagactttgcatatcct

SEQ ID NO: 89893 - DNA, 22 bp, Homo sapiens
ggcgcccccttcaaacagagca

SEQ ID NO: 89894 - DNA, 22 bp, Homo sapiens
atctggttcttcttaggcatca

SEQ ID NO: 89895 - DNA, 22 bp, Homo sapiens
ttgagatgtcttttggcattat

SEQ ID NO: 89896 - DNA, 22 bp, Homo sapiens
agcctgggcaacagagcaaaac

SEQ ID NO: 89897 - DNA, 22 bp, Homo sapiens
agcccggcttccccggttgcta

SEQ ID NO: 89898 - DNA, 22 bp, Homo sapiens
aagccctggacggcccttcccc

SEQ ID NO: 89899 - DNA, 18 bp, Homo sapiens
cttgttcttctcttggcg

SEQ ID NO: 89900 - DNA, 22 bp, Homo sapiens
tttacagcagcatgatttataa

SEQ ID NO: 89901 - DNA, 22 bp, Homo sapiens
gggtacagttcttccagtgtca

SEQ ID NO: 89902 - DNA, 22 bp, Homo sapiens
gcctccccaagcagcagggatt

SEQ ID NO: 89903 - DNA, 22 bp, Homo sapiens
atcccaggcggcacaggttgca

SEQ ID NO: 89904 - DNA, 18 bp, Homo sapiens
cagggctgtggggtcact

SEQ ID NO: 89905 - DNA, 20 bp, Homo sapiens
tttcaccatcttggccaggc

SEQ ID NO: 89906 - DNA, 22 bp, Homo sapiens
agaatagaattctcatagaatt

SEQ ID NO: 89907 - DNA, 22 bp, Homo sapiens
actgcaagaatggtaatatttg

SEQ ID NO: 89908 - DNA, 22 bp, Homo sapiens
cccagcgagtttgccggtgaac

SEQ ID NO: 89909 - DNA, 22 bp, Homo sapiens
tctgccttctatcttttgtctg

SEQ ID NO: 89910 - DNA, 22 bp, Homo sapiens
cagatgtacatgaagggcaatg

SEQ ID NO: 89911 - DNA, 22 bp, Homo sapiens
atgaggcaggagtgcagtggca

SEQ ID NO: 89912 - DNA, 22 bp, Homo sapiens
taggcccctagtgccacgtggc

SEQ ID NO: 89913 - DNA, 22 bp, Homo sapiens
cttttgattgagcagtttcaaa

SEQ ID NO: 89914 - DNA, 22 bp, Homo sapiens
ggattgcaacaagctagtttag

SEQ ID NO: 89915 - DNA, 22 bp, Homo sapiens
aactcactttgtggcttctgaa

SEQ ID NO: 89916 - DNA, 22 bp, Homo sapiens
tagtgtctcttcctgtttgaaa

SEQ ID NO: 89917 - DNA, 22 bp, Homo sapiens
ctggggaacgcagcgagcagcg

SEQ ID NO: 89918 - DNA, 22 bp, Homo sapiens
ggccagcctggggctcccagac

SEQ ID NO: 89919 - DNA, 23 bp, Homo sapiens
agctctgctcgggcatgccctgc

SEQ ID NO: 89920 - DNA, 22 bp, Homo sapiens
acccatccagtgtccctgctag

SEQ ID NO: 89921 - DNA, 22 bp, Homo sapiens
cgctgataaacgtcacgttccc

SEQ ID NO: 89922 - DNA, 22 bp, Homo sapiens
gtgggggagatgcttaggtccg

SEQ ID NO: 89923 - DNA, 22 bp, Homo sapiens
cagcagtgtacaaggtgtcaga

SEQ ID NO: 89924 - DNA, 22 bp, Homo sapiens
agtgccttcagatttgccccag

SEQ ID NO: 89925 - DNA, 22 bp, Homo sapiens
ttgagaaccactgagttagata

SEQ ID NO: 89926 - DNA, 22 bp, Homo sapiens
ggttcccggatctccgagtccc

SEQ ID NO: 89927 - DNA, 22 bp, Homo sapiens
tcagacattattttcaagataa

SEQ ID NO: 89928 - DNA, 22 bp, Homo sapiens
cccgtgtgtgcgaggctcccgc

SEQ ID NO: 89929 - DNA, 22 bp, Homo sapiens
ttctaattaaatctacgctagg

SEQ ID NO: 89930 - DNA, 22 bp, Homo sapiens
gctgcgccggatcccacgttcc

SEQ ID NO: 89931 - DNA, 19 bp, Homo sapiens
ttttggaaatgtgaacagc

SEQ ID NO: 89932 - DNA, 22 bp, Homo sapiens
cttggattcctcatatgcacag

SEQ ID NO: 89933 - DNA, 22 bp, Homo sapiens
acgtgcaggatctggttggcga

SEQ ID NO: 89934 - DNA, 22 bp, Homo sapiens
agagtactgcctcagttatgaa

SEQ ID NO: 89935 - DNA, 22 bp, Homo sapiens
ggttgtagttggaggttgtata

SEQ ID NO: 89936 - DNA, 22 bp, Homo sapiens
gccgggttcaagccattctcct

SEQ ID NO: 89937 - DNA, 22 bp, Homo sapiens
acttttaaatgagtttcagttg

SEQ ID NO: 89938 - DNA, 22 bp, Homo sapiens
ccctggcagtgctcctttagac

SEQ ID NO: 89939 - DNA, 22 bp, Homo sapiens
tcgctgaggctgcacggctgcc

SEQ ID NO: 89940 - DNA, 22 bp, Homo sapiens
gatggcacacagacatccccgc

SEQ ID NO: 89941 - DNA, 22 bp, Homo sapiens
accccagaggcggaggctgcag

SEQ ID NO: 89942 - DNA, 22 bp, Homo sapiens
tatactacgcaccaaacaaagg

SEQ ID NO: 89943 - DNA, 22 bp, Homo sapiens
tcgagctctggagccaaggatg

SEQ ID NO: 89944 - DNA, 22 bp, Homo sapiens
ggctagggatctagaccaggac

SEQ ID NO: 89945 - DNA, 22 bp, Homo sapiens
gttactcttgagaggctgaggt

SEQ ID NO: 89946 - DNA, 22 bp, Homo sapiens
ccaggaggtggagattgcagtg

SEQ ID NO: 89947 - DNA, 22 bp, Homo sapiens
ggctcttccgccaccagccaca

SEQ ID NO: 89948 - DNA, 22 bp, Homo sapiens
ctgtaatcccagctacctggga

SEQ ID NO: 89949 - DNA, 22 bp, Homo sapiens
aagcccttggcgcacaccgggc

SEQ ID NO: 89950 - DNA, 22 bp, Homo sapiens
catgtgaattccaaagctaggt

SEQ ID NO: 89951 - DNA, 22 bp, Homo sapiens
ctgtcctggggaaagccagccc

SEQ ID NO: 89952 - DNA, 22 bp, Homo sapiens
caccttactccctctggatgcc

SEQ ID NO: 89953 - DNA, 22 bp, Homo sapiens
caggcagaagaagtggaaggac

SEQ ID NO: 89954 - DNA, 22 bp, Homo sapiens
cactgcactccagcctgcgcaa

SEQ ID NO: 89955 - DNA, 22 bp, Homo sapiens
actttaaaactgatcatcagag

SEQ ID NO: 89956 - DNA, 22 bp, Homo sapiens
gaggaggcttccgggaggcacg

SEQ ID NO: 89957 - DNA, 22 bp, Homo sapiens
agaaagagatgaatgctttaag

SEQ ID NO: 89958 - DNA, 22 bp, Homo sapiens
aggtggcagatgggggtgctcg

SEQ ID NO: 89959 - DNA, 22 bp, Homo sapiens
actcatgtaagcggaatgtagt

SEQ ID NO: 89960 - DNA, 22 bp, Homo sapiens
ggaggtgggctaaggactctct

SEQ ID NO: 89961 - DNA, 19 bp, Homo sapiens
tcctgcctggggccgcctg

SEQ ID NO: 89962 - DNA, 22 bp, Homo sapiens
gtagggctcagtaaatactttg

SEQ ID NO: 89963 - DNA, 22 bp, Homo sapiens
tggtggctcacacctgtaatcc

SEQ ID NO: 89964 - DNA, 22 bp, Homo sapiens
atacaaaaattagccgggagta

SEQ ID NO: 89965 - DNA, 17 bp, Homo sapiens
tggctctgtcctcagct

SEQ ID NO: 89966 - DNA, 22 bp, Homo sapiens
ggtttgttggggtccaggccca

SEQ ID NO: 89967 - DNA, 22 bp, Homo sapiens
gctcactgcaacctctgcctcc

SEQ ID NO: 89968 - DNA, 22 bp, Homo sapiens
agtccgtcctgtcaagcagctg

SEQ ID NO: 89969 - DNA, 22 bp, Homo sapiens
ttacatgtttatgggggtacat

SEQ ID NO: 89970 - DNA, 22 bp, Homo sapiens
aagtgattctccctacgcggga

SEQ ID NO: 89971 - DNA, 22 bp, Homo sapiens
aggtgggcggattcatgaggtc

SEQ ID NO: 89972 - DNA, 22 bp, Homo sapiens
cacttgttggtggtgaaatcac

SEQ ID NO: 89973 - DNA, 22 bp, Homo sapiens
cgcccaggctggagagcagtgg

SEQ ID NO: 89974 - DNA, 22 bp, Homo sapiens
cttgatgagtcagaactgaagg

SEQ ID NO: 89975 - DNA, 22 bp, Homo sapiens
gcctccagcccacgcaggcctg

SEQ ID NO: 89976 - DNA, 22 bp, Homo sapiens
atgatactctaggtgatttaca

SEQ ID NO: 89977 - DNA, 22 bp, Homo sapiens
tgaaatgtgtaatgtggatgcc

SEQ ID NO: 89978 - DNA, 22 bp, Homo sapiens
ctgggaggcggaggttgtagtg

SEQ ID NO: 89979 - DNA, 22 bp, Homo sapiens
ttcctggaaattatgctcacct

SEQ ID NO: 89980 - DNA, 22 bp, Homo sapiens
tctcgatctcctgaccttgtga

SEQ ID NO: 89981 - DNA, 22 bp, Homo sapiens
gcgccccatctacagtactttt

SEQ ID NO: 89982 - DNA, 22 bp, Homo sapiens
tggccaccaccaatacttgcct

SEQ ID NO: 89983 - DNA, 22 bp, Homo sapiens
cgtgggtcgggactccgcctcg

SEQ ID NO: 89984 - DNA, 22 bp, Homo sapiens
gcccaggctggagtgcagtggt

SEQ ID NO: 89985 - DNA, 22 bp, Homo sapiens
cactcagctgagccctcagccc

SEQ ID NO: 89986 - DNA, 22 bp, Homo sapiens
tacatttataaggcttctctgt

SEQ ID NO: 89987 - DNA, 22 bp, Homo sapiens
atggcctgcagtgctgccacag

SEQ ID NO: 89988 - DNA, 22 bp, Homo sapiens
acgcctctgcagctgccgggcc

SEQ ID NO: 89989 - DNA, 22 bp, Homo sapiens
agaaaacataggagacaggaaa

SEQ ID NO: 89990 - DNA, 22 bp, Homo sapiens
aggagcagaccgtagtcctgca

SEQ ID NO: 89991 - DNA, 22 bp, Homo sapiens
agggctggagccacagctggga

SEQ ID NO: 89992 - DNA, 22 bp, Homo sapiens
gttgaggagcaagcatgtgtct

SEQ ID NO: 89993 - DNA, 22 bp, Homo sapiens
tgggaaggggagctggaaagga

SEQ ID NO: 89994 - DNA, 22 bp, Homo sapiens
cttgtcagccaattgtggattt

SEQ ID NO: 89995 - DNA, 22 bp, Homo sapiens
aggccccctccacccattctgg

SEQ ID NO: 89996 - DNA, 22 bp, Homo sapiens
agagagcccgggccagggcaca

SEQ ID NO: 89997 - DNA, 22 bp, Homo sapiens
gcagaggacacaggagggcaag

SEQ ID NO: 89998 - DNA, 22 bp, Homo sapiens
accaggcccgctgctatggtgg

SEQ ID NO: 89999 - DNA, 22 bp, Homo sapiens
gccctcctgagctagcacgtgt

SEQ ID NO: 90000 - DNA, 22 bp, Homo sapiens
tggagagttctgtagatatcta

SEQ ID NO: 90001 - DNA, 22 bp, Homo sapiens
gtctatgatattttgttatagc

SEQ ID NO: 90002 - DNA, 23 bp, Homo sapiens
ttgtcctctggatcggtttggtt

SEQ ID NO: 90003 - DNA, 22 bp, Homo sapiens
cactgcactccagctgggtgac

SEQ ID NO: 90004 - DNA, 22 bp, Homo sapiens
gggtgctttggctcacgcctgt

SEQ ID NO: 90005 - DNA, 16 bp, Homo sapiens
atgctgctattagagg

SEQ ID NO: 90006 - DNA, 22 bp, Homo sapiens
atgttctacagatggaaagggg

SEQ ID NO: 90007 - DNA, 22 bp, Homo sapiens
gcagtgagttatgatcatgcca

SEQ ID NO: 90008 - DNA, 22 bp, Homo sapiens
gccaggaaagggaattccctga

SEQ ID NO: 90009 - DNA, 22 bp, Homo sapiens
tagcagaagttgcaaactaggg

SEQ ID NO: 90010 - DNA, 22 bp, Homo sapiens
ctcttcctagtgtgcagcgtgg

SEQ ID NO: 90011 - DNA, 20 bp, Homo sapiens
acctcctggcgggcatcctc

SEQ ID NO: 90012 - DNA, 22 bp, Homo sapiens
aggacagagggaccagagccca

SEQ ID NO: 90013 - DNA, 22 bp, Homo sapiens
ggagcatgcgctctgtgaccga

SEQ ID NO: 90014 - DNA, 22 bp, Homo sapiens
gtcccctgtccagggccagcca

SEQ ID NO: 90015 - DNA, 22 bp, Homo sapiens
ttggccatctaagcccagccac

SEQ ID NO: 90016 - DNA, 22 bp, Homo sapiens
caagcaccatgtgctccatgtt

SEQ ID NO: 90017 - DNA, 18 bp, Homo sapiens
tcttccaacactgacacc

SEQ ID NO: 90018 - DNA, 22 bp, Homo sapiens
ttgtggttaaccgcacattttt

SEQ ID NO: 90019 - DNA, 22 bp, Homo sapiens
gggagcaagccggaggtactgt

SEQ ID NO: 90020 - DNA, 22 bp, Homo sapiens
gatctggaatctgaaggctgag

SEQ ID NO: 90021 - DNA, 22 bp, Homo sapiens
tataaagagtctcaaagaagtt

SEQ ID NO: 90022 - DNA, 22 bp, Homo sapiens
tcttcctgtcaatgagaattaa

SEQ ID NO: 90023 - DNA, 22 bp, Homo sapiens
gggccccaagaacctcctcctg

SEQ ID NO: 90024 - DNA, 22 bp, Homo sapiens
ttctcccctttagggcctacgg

SEQ ID NO: 90025 - DNA, 22 bp, Homo sapiens
aaggctgaggcagtgaggcaga

SEQ ID NO: 90026 - DNA, 22 bp, Homo sapiens
ggtgacctcacctggtcccacc

SEQ ID NO: 90027 - DNA, 20 bp, Homo sapiens
atgctttcttgtgtgctgct

SEQ ID NO: 90028 - DNA, 22 bp, Homo sapiens
tctgacattttgagaatgacat

SEQ ID NO: 90029 - DNA, 22 bp, Homo sapiens
caggaagaccagggctgtggct

SEQ ID NO: 90030 - DNA, 22 bp, Homo sapiens
gcgactgtacagaattgcccct

SEQ ID NO: 90031 - DNA, 22 bp, Homo sapiens
gtctcccagcctacatctttct

SEQ ID NO: 90032 - DNA, 20 bp, Homo sapiens
tttcttgtcggctgttgctg

SEQ ID NO: 90033 - DNA, 22 bp, Homo sapiens
gacaggtgctaagggacctggc

SEQ ID NO: 90034 - DNA, 22 bp, Homo sapiens
tgatttacagtagtgtctaaac

SEQ ID NO: 90035 - DNA, 22 bp, Homo sapiens
tcgggctcgctctcctagcgga

SEQ ID NO: 90036 - DNA, 22 bp, Homo sapiens
tagcataacaggtaagagtgag

SEQ ID NO: 90037 - DNA, 22 bp, Homo sapiens
tccaggctttggggcaggagcg

SEQ ID NO: 90038 - DNA, 22 bp, Homo sapiens
gcctggagaaaggaaggtggga

SEQ ID NO: 90039 - DNA, 22 bp, Homo sapiens
attttctatgttgtaattgtta

SEQ ID NO: 90040 - DNA, 22 bp, Homo sapiens
agagtgcaaccgaaacaagcag

SEQ ID NO: 90041 - DNA, 22 bp, Homo sapiens
gaggcacagagtaggtgcacac

SEQ ID NO: 90042 - DNA, 22 bp, Homo sapiens
tctttcttgtgggtgccctttt

SEQ ID NO: 90043 - DNA, 22 bp, Homo sapiens
catctgtaaagtaggaatattg

SEQ ID NO: 90044 - DNA, 22 bp, Homo sapiens
gcggggggaggaacatcttgca

SEQ ID NO: 90045 - DNA, 22 bp, Homo sapiens
gaatttcctctaaacccctgag

SEQ ID NO: 90046 - DNA, 22 bp, Homo sapiens
catagagtgatgtaaggtatgt

SEQ ID NO: 90047 - DNA, 22 bp, Homo sapiens
tggatatccttgttaactttct

SEQ ID NO: 90048 - DNA, 22 bp, Homo sapiens
cttctacacgtggctgtgccaa

SEQ ID NO: 90049 - DNA, 22 bp, Homo sapiens
tttttccacataccctaggcca

SEQ ID NO: 90050 - DNA, 22 bp, Homo sapiens
ctgctctgctgatcagtgtctc

SEQ ID NO: 90051 - DNA, 22 bp, Homo sapiens
taagggttcagaatgcagtggt

SEQ ID NO: 90052 - DNA, 22 bp, Homo sapiens
ccagaggtgctctttggaagtg

SEQ ID NO: 90053 - DNA, 22 bp, Homo sapiens
tggctcactgtagccttgacct

SEQ ID NO: 90054 - DNA, 22 bp, Homo sapiens
tgaacatgctgttgatggcctg

SEQ ID NO: 90055 - DNA, 22 bp, Homo sapiens
cagcgtgggatttggaaaccag

SEQ ID NO: 90056 - DNA, 22 bp, Homo sapiens
cttccccaggacctctgctaaa

SEQ ID NO: 90057 - DNA, 22 bp, Homo sapiens
agagtggagagaaacaactctg

SEQ ID NO: 90058 - DNA, 23 bp, Homo sapiens
gttttacaggtgagaaaatggag

SEQ ID NO: 90059 - DNA, 22 bp, Homo sapiens
ggaactgaatgtctcggtataa

SEQ ID NO: 90060 - DNA, 22 bp, Homo sapiens
tcgcttgaacccaggaagtgga

SEQ ID NO: 90061 - DNA, 22 bp, Homo sapiens
gcctgtgtctgggtggccagag

SEQ ID NO: 90062 - DNA, 22 bp, Homo sapiens
catgctgtgtgttttagctcca

SEQ ID NO: 90063 - DNA, 22 bp, Homo sapiens
gtgaaatatttaacgtccaggt

SEQ ID NO: 90064 - DNA, 22 bp, Homo sapiens
gggcactcagctgtagagcagg

SEQ ID NO: 90065 - DNA, 22 bp, Homo sapiens
tgacatgtatatcttacgctat

SEQ ID NO: 90066 - DNA, 22 bp, Homo sapiens
aggaatgtgaaacaggtggctg

SEQ ID NO: 90067 - DNA, 22 bp, Homo sapiens
gcacatccaatgattgttttga

SEQ ID NO: 90068 - DNA, 22 bp, Homo sapiens
gcccatgaggtggaggctgcag

SEQ ID NO: 90069 - DNA, 21 bp, Homo sapiens
tggtaggtactggcttcaggc

SEQ ID NO: 90070 - DNA, 22 bp, Homo sapiens
aacccaggaggcggaggttgtg

SEQ ID NO: 90071 - DNA, 22 bp, Homo sapiens
actgccctccagcctgggtgac

SEQ ID NO: 90072 - DNA, 22 bp, Homo sapiens
tagattcagatatttaggacaa

SEQ ID NO: 90073 - DNA, 22 bp, Homo sapiens
atggccaggcacctctggctga

SEQ ID NO: 90074 - DNA, 22 bp, Homo sapiens
cactgcactccagcactccagc

SEQ ID NO: 90075 - DNA, 22 bp, Homo sapiens
tgtgtcagaaggcaatggggat

SEQ ID NO: 90076 - DNA, 22 bp, Homo sapiens
tgacttcctgcactcaggtgat

SEQ ID NO: 90077 - DNA, 22 bp, Homo sapiens
ggtgtgattatgacatgtgact

SEQ ID NO: 90078 - DNA, 22 bp, Homo sapiens
ggagaccagaaggaagcttcga

SEQ ID NO: 90079 - DNA, 22 bp, Homo sapiens
tgggcagggagctggaaccaca

SEQ ID NO: 90080 - DNA, 22 bp, Homo sapiens
gaggtgtcatcaggcagctctg

SEQ ID NO: 90081 - DNA, 22 bp, Homo sapiens
ccacccttgggttcggaggccg

SEQ ID NO: 90082 - DNA, 22 bp, Homo sapiens
caggaacagggtgtcctggcag

SEQ ID NO: 90083 - DNA, 22 bp, Homo sapiens
atagaataatggttgtcaggag

SEQ ID NO: 90084 - DNA, 22 bp, Homo sapiens
tcctagttctctgccagtcgct

SEQ ID NO: 90085 - DNA, 22 bp, Homo sapiens
tccttaggaaaatgatgagggg

SEQ ID NO: 90086 - DNA, 22 bp, Homo sapiens
atagaatatgacttttagatcc

SEQ ID NO: 90087 - DNA, 22 bp, Homo sapiens
gctgctaagcgtttctgttcca

SEQ ID NO: 90088 - DNA, 22 bp, Homo sapiens
ggtttattgttaataagtttga

SEQ ID NO: 90089 - DNA, 22 bp, Homo sapiens
ccaggctgctgttggtgtccgc

SEQ ID NO: 90090 - DNA, 22 bp, Homo sapiens
aaggaaagctgtggttctgaga

SEQ ID NO: 90091 - DNA, 22 bp, Homo sapiens
tcaggctcaggttaggggccaa

SEQ ID NO: 90092 - DNA, 22 bp, Homo sapiens
gtggtgtaggtcacagttagga

SEQ ID NO: 90093 - DNA, 22 bp, Homo sapiens
ggcctctgccccgcggggctcg

SEQ ID NO: 90094 - DNA, 22 bp, Homo sapiens
tttcagatggaggtttaggaca

SEQ ID NO: 90095 - DNA, 22 bp, Homo sapiens
ttaggtattttgttatgtcagc

SEQ ID NO: 90096 - DNA, 22 bp, Homo sapiens
cagcagcagtggctgcagaaca

SEQ ID NO: 90097 - DNA, 17 bp, Homo sapiens
aagtgattcagccctca

SEQ ID NO: 90098 - DNA, 21 bp, Homo sapiens
tctgatggtagatgagatgtg

SEQ ID NO: 90099 - DNA, 22 bp, Homo sapiens
ggccaggcgatgacccctccac

SEQ ID NO: 90100 - DNA, 22 bp, Homo sapiens
cactgcaacctccacctcctgg

SEQ ID NO: 90101 - DNA, 22 bp, Homo sapiens
cggtcaggtgcagcgttggcac

SEQ ID NO: 90102 - DNA, 22 bp, Homo sapiens
agcccgcatctcgctaaagata

SEQ ID NO: 90103 - DNA, 22 bp, Homo sapiens
gccctgccctctcggcactcgc

SEQ ID NO: 90104 - DNA, 22 bp, Homo sapiens
ccaaagaaacccaagctcaggg

SEQ ID NO: 90105 - DNA, 22 bp, Homo sapiens
gtcagtaggaacctagggtcaa

SEQ ID NO: 90106 - DNA, 22 bp, Homo sapiens
ttgttgtcattgtagaggattt

SEQ ID NO: 90107 - DNA, 22 bp, Homo sapiens
acatatgcgatcataggatgca

SEQ ID NO: 90108 - DNA, 22 bp, Homo sapiens
gggaggcacgaggcgcgcagtg

SEQ ID NO: 90109 - DNA, 22 bp, Homo sapiens
gtgacaggccactgcggctctg

SEQ ID NO: 90110 - DNA, 22 bp, Homo sapiens
agacaaagaaaccgtagaagca

SEQ ID NO: 90111 - DNA, 22 bp, Homo sapiens
tgctgggggtagctctgcgtag

SEQ ID NO: 90112 - DNA, 22 bp, Homo sapiens
tccaggtgacagagacaggata

SEQ ID NO: 90113 - DNA, 22 bp, Homo sapiens
tgagtagagaattcagctaagg

SEQ ID NO: 90114 - DNA, 22 bp, Homo sapiens
gcctccagggatgattccttcc

SEQ ID NO: 90115 - DNA, 22 bp, Homo sapiens
tattagttgcaaaacattgact

SEQ ID NO: 90116 - DNA, 22 bp, Homo sapiens
gatggaggagatggcagggtgc

SEQ ID NO: 90117 - DNA, 22 bp, Homo sapiens
caggagttcaaggttgcagtga

SEQ ID NO: 90118 - DNA, 20 bp, Homo sapiens
attagctcaggtgaggtcat

SEQ ID NO: 90119 - DNA, 22 bp, Homo sapiens
ggaggcggaggctgcagtgagc

SEQ ID NO: 90120 - DNA, 22 bp, Homo sapiens
cccagggaggcccaggctctgc

SEQ ID NO: 90121 - DNA, 22 bp, Homo sapiens
gagccaagctcttctccatgag

SEQ ID NO: 90122 - DNA, 22 bp, Homo sapiens
cctgtcacctaggtactgagca

SEQ ID NO: 90123 - DNA, 22 bp, Homo sapiens
cagcctgccgtcagccaggtag

SEQ ID NO: 90124 - DNA, 22 bp, Homo sapiens
cccaggaggtggagcttgcagt

SEQ ID NO: 90125 - DNA, 22 bp, Homo sapiens
aggggttggacataagacagaa

SEQ ID NO: 90126 - DNA, 22 bp, Homo sapiens
cctccccacagcccaggagact

SEQ ID NO: 90127 - DNA, 22 bp, Homo sapiens
gtggagaggaacccagctctgt

SEQ ID NO: 90128 - DNA, 22 bp, Homo sapiens
aacctcaaactcttgggcttaa

SEQ ID NO: 90129 - DNA, 22 bp, Homo sapiens
ggaggctgaggcaggcggatca

SEQ ID NO: 90130 - DNA, 22 bp, Homo sapiens
tcatcagcaccctatgtccttt

SEQ ID NO: 90131 - DNA, 22 bp, Homo sapiens
tttcccagcctcagctcagcag

SEQ ID NO: 90132 - DNA, 22 bp, Homo sapiens
tgagaaacacaggcatgaatag

SEQ ID NO: 90133 - DNA, 22 bp, Homo sapiens
tgtgcctgttcccactttgcct

SEQ ID NO: 90134 - DNA, 20 bp, Homo sapiens
atcctctcctgattaattca

SEQ ID NO: 90135 - DNA, 22 bp, Homo sapiens
tacccagtgccaccctctgagg

SEQ ID NO: 90136 - DNA, 22 bp, Homo sapiens
ctggagggtggagagaagtctc

SEQ ID NO: 90137 - DNA, 22 bp, Homo sapiens
tcagggattgcaaaattcatcc

SEQ ID NO: 90138 - DNA, 22 bp, Homo sapiens
tctctatttgcctaggcttgtg

SEQ ID NO: 90139 - DNA, 22 bp, Homo sapiens
atgggctgtccattgctggctg

SEQ ID NO: 90140 - DNA, 22 bp, Homo sapiens
ctgtcctgccagtcctggactc

SEQ ID NO: 90141 - DNA, 22 bp, Homo sapiens
ggctccccaggtccaggagctg

SEQ ID NO: 90142 - DNA, 22 bp, Homo sapiens
gcgtctcaaggcccccaggcca

SEQ ID NO: 90143 - DNA, 22 bp, Homo sapiens
tggtggctaccaggtcctgggg

SEQ ID NO: 90144 - DNA, 22 bp, Homo sapiens
ggaggggatttagtagatgcta

SEQ ID NO: 90145 - DNA, 22 bp, Homo sapiens
tcttcctggatgggggttgatg

SEQ ID NO: 90146 - DNA, 22 bp, Homo sapiens
tcccagattcctgctcttatat

SEQ ID NO: 90147 - DNA, 22 bp, Homo sapiens
gggttggatcctggtggctgcc

SEQ ID NO: 90148 - DNA, 22 bp, Homo sapiens
gagcaggaaggccagaagggtc

SEQ ID NO: 90149 - DNA, 22 bp, Homo sapiens
ttccacattccttacattcata

SEQ ID NO: 90150 - DNA, 22 bp, Homo sapiens
gaggagctgcccgtgtgtctgc

SEQ ID NO: 90151 - DNA, 23 bp, Homo sapiens
tcagaacagttcttggtgcatag

SEQ ID NO: 90152 - DNA, 22 bp, Homo sapiens
gcgagtgccgagagggcagggc

SEQ ID NO: 90153 - DNA, 22 bp, Homo sapiens
tggtggctcacgtctgtaatct

SEQ ID NO: 90154 - DNA, 22 bp, Homo sapiens
tctcccaggcaggagtgcagtg

SEQ ID NO: 90155 - DNA, 22 bp, Homo sapiens
tcaggagtgccagtaccttttg

SEQ ID NO: 90156 - DNA, 22 bp, Homo sapiens
gggagctggagctggaagactc

SEQ ID NO: 90157 - DNA, 22 bp, Homo sapiens
gggaaggccttgtcagcggatt

SEQ ID NO: 90158 - DNA, 22 bp, Homo sapiens
gggaggctctgctcagcccccg

SEQ ID NO: 90159 - DNA, 22 bp, Homo sapiens
tgccttgtccttcgtcagggct

SEQ ID NO: 90160 - DNA, 23 bp, Homo sapiens
ggctgggagctccgggtgcacgt

SEQ ID NO: 90161 - DNA, 22 bp, Homo sapiens
ggacagaaaccatatgagtgta

SEQ ID NO: 90162 - DNA, 22 bp, Homo sapiens
ttactttaagggtgtcttatta

SEQ ID NO: 90163 - DNA, 22 bp, Homo sapiens
tttttgggtccaggctgtatct

SEQ ID NO: 90164 - DNA, 23 bp, Homo sapiens
gcagaggagcaagctggacacca

SEQ ID NO: 90165 - DNA, 22 bp, Homo sapiens
aacccaggaggtggaggttgtg

SEQ ID NO: 90166 - DNA, 22 bp, Homo sapiens
tgggattcaccatgggcttcag

SEQ ID NO: 90167 - DNA, 22 bp, Homo sapiens
atacttctttagcatattgaac

SEQ ID NO: 90168 - DNA, 22 bp, Homo sapiens
gtcgtggagctcacagtgtgcc

SEQ ID NO: 90169 - DNA, 22 bp, Homo sapiens
gcagctattgtctcctgggccc

SEQ ID NO: 90170 - DNA, 22 bp, Homo sapiens
tagactggtgaattagggggaa

SEQ ID NO: 90171 - DNA, 22 bp, Homo sapiens
ggcatggacgtctctgaggcca

SEQ ID NO: 90172 - DNA, 22 bp, Homo sapiens
tttcaccatcttggccaggctg

SEQ ID NO: 90173 - DNA, 22 bp, Homo sapiens
taagtcgtggatgattcttcgg

SEQ ID NO: 90174 - DNA, 22 bp, Homo sapiens
acatcctcccgatctactggct

SEQ ID NO: 90175 - DNA, 22 bp, Homo sapiens
tctggcttcgcagctcccagcc

SEQ ID NO: 90176 - DNA, 22 bp, Homo sapiens
ttcttctccgaggagggctggt

SEQ ID NO: 90177 - DNA, 22 bp, Homo sapiens
cagtggccaacttcctgcctct

SEQ ID NO: 90178 - DNA, 22 bp, Homo sapiens
ttgtgaatggtgccgcaataaa

SEQ ID NO: 90179 - DNA, 22 bp, Homo sapiens
gttggctatgagagctttagtg

SEQ ID NO: 90180 - DNA, 20 bp, Homo sapiens
atcggcttgcctggaaacaa

SEQ ID NO: 90181 - DNA, 22 bp, Homo sapiens
gcagcgaggtgatgaaatagct

SEQ ID NO: 90182 - DNA, 22 bp, Homo sapiens
gagctcattcattcattgcctg

SEQ ID NO: 90183 - DNA, 22 bp, Homo sapiens
taccagggaacagggatattaa

SEQ ID NO: 90184 - DNA, 22 bp, Homo sapiens
gtctcttgttatcatttctgag

SEQ ID NO: 90185 - DNA, 22 bp, Homo sapiens
tttgcttgttcaagatttctgt

SEQ ID NO: 90186 - DNA, 22 bp, Homo sapiens
ttcagcttgctgactgcggcag

SEQ ID NO: 90187 - DNA, 22 bp, Homo sapiens
actgcactccagcctgggtgat

SEQ ID NO: 90188 - DNA, 22 bp, Homo sapiens
gcctcctggggtgccatcatct

SEQ ID NO: 90189 - DNA, 22 bp, Homo sapiens
tgaggcaggaggttgagaactg

SEQ ID NO: 90190 - DNA, 22 bp, Homo sapiens
tgtgctctgactttctcctggt

SEQ ID NO: 90191 - DNA, 22 bp, Homo sapiens
tttgaggttagctagcagatca

SEQ ID NO: 90192 - DNA, 22 bp, Homo sapiens
ttaataaagtatgaattggaaa

SEQ ID NO: 90193 - DNA, 20 bp, Homo sapiens
catgtgtcagttctcaccca

SEQ ID NO: 90194 - DNA, 22 bp, Homo sapiens
tgggctgtggagcacctttgca

SEQ ID NO: 90195 - DNA, 22 bp, Homo sapiens
aatccaggtggcggaggttgtg

SEQ ID NO: 90196 - DNA, 22 bp, Homo sapiens
ctggagggctgcagcgaggctg

SEQ ID NO: 90197 - DNA, 22 bp, Homo sapiens
ctgaggctggagtgcagtggtg

SEQ ID NO: 90198 - DNA, 18 bp, Homo sapiens
gcctggcttcggagccgc

SEQ ID NO: 90199 - DNA, 21 bp, Homo sapiens
tgcaatccagcctgggcgaca

SEQ ID NO: 90200 - DNA, 22 bp, Homo sapiens
tttcataatactgtacatgaaa

SEQ ID NO: 90201 - DNA, 22 bp, Homo sapiens
tcatctaagagtcttacattta

SEQ ID NO: 90202 - DNA, 22 bp, Homo sapiens
atagcagggatgtcagcaagta

SEQ ID NO: 90203 - DNA, 22 bp, Homo sapiens
cgagagttagctaggagtcaca

SEQ ID NO: 90204 - DNA, 22 bp, Homo sapiens
gccagggttcgaatccgtatgg

SEQ ID NO: 90205 - DNA, 22 bp, Homo sapiens
cctcagacccctgctgagcttc

SEQ ID NO: 90206 - DNA, 22 bp, Homo sapiens
gatttctctgcacccactcagg

SEQ ID NO: 90207 - DNA, 22 bp, Homo sapiens
atggcaccttccccagagctca

SEQ ID NO: 90208 - DNA, 22 bp, Homo sapiens
aaacatggccattcagactgtg

SEQ ID NO: 90209 - DNA, 22 bp, Homo sapiens
tgtgagttattttcaggagttt

SEQ ID NO: 90210 - DNA, 22 bp, Homo sapiens
catccatagcttgatctgttcc

SEQ ID NO: 90211 - DNA, 16 bp, Homo sapiens
gcaggcagatcacatg

SEQ ID NO: 90212 - DNA, 22 bp, Homo sapiens
agttattgagtgcagagcaggg

SEQ ID NO: 90213 - DNA, 22 bp, Homo sapiens
ttttcagaattagcataccatt

SEQ ID NO: 90214 - DNA, 22 bp, Homo sapiens
gtgggtggacggtgcttttgtt

SEQ ID NO: 90215 - DNA, 22 bp, Homo sapiens
tagatgaccttgtgttaggcaa

SEQ ID NO: 90216 - DNA, 22 bp, Homo sapiens
cgcaccactgaattccagcctg

SEQ ID NO: 90217 - DNA, 22 bp, Homo sapiens
ctgctccccagcctgcgccttt

SEQ ID NO: 90218 - DNA, 22 bp, Homo sapiens
aagtggcagttcaggaagcaga

SEQ ID NO: 90219 - DNA, 22 bp, Homo sapiens
atggcagaatatctgcatcgca

SEQ ID NO: 90220 - DNA, 22 bp, Homo sapiens
cagaccagaaggaagccgacaa

SEQ ID NO: 90221 - DNA, 22 bp, Homo sapiens
caaggtgccatgctgggcgggg

SEQ ID NO: 90222 - DNA, 22 bp, Homo sapiens
gtcaccagtgctaagaggtgga

SEQ ID NO: 90223 - DNA, 22 bp, Homo sapiens
ctttttcctcgtagagcctaat

SEQ ID NO: 90224 - DNA, 23 bp, Homo sapiens
aatggtcttcctccacccctctg

SEQ ID NO: 90225 - DNA, 22 bp, Homo sapiens
gagacacaggcacagaagaggc

SEQ ID NO: 90226 - DNA, 22 bp, Homo sapiens
gaggagggagctggaagctctt

SEQ ID NO: 90227 - DNA, 22 bp, Homo sapiens
tttacacagaggacactgggct

SEQ ID NO: 90228 - DNA, 22 bp, Homo sapiens
cagagctgtccaaaccctgaca

SEQ ID NO: 90229 - DNA, 22 bp, Homo sapiens
gggaacagcttgggctctgcca

SEQ ID NO: 90230 - DNA, 22 bp, Homo sapiens
ttgaaaagttttgaaacactct

SEQ ID NO: 90231 - DNA, 22 bp, Homo sapiens
gaggctgaggcaggaggatcac

SEQ ID NO: 90232 - DNA, 22 bp, Homo sapiens
aaggaggttatcccagtggact

SEQ ID NO: 90233 - DNA, 22 bp, Homo sapiens
gcccagtagttcaaggttgcag

SEQ ID NO: 90234 - DNA, 22 bp, Homo sapiens
agtggcgtcctaggaaaggagg

SEQ ID NO: 90235 - DNA, 22 bp, Homo sapiens
gcaggcaggcttccttgaactg

SEQ ID NO: 90236 - DNA, 22 bp, Homo sapiens
attttttgttaactcaggatag

SEQ ID NO: 90237 - DNA, 22 bp, Homo sapiens
gaagaaggtggcccaggggtag

SEQ ID NO: 90238 - DNA, 22 bp, Homo sapiens
ctgaggcaggagagttgcttga

SEQ ID NO: 90239 - DNA, 22 bp, Homo sapiens
tgaggcaggaggattgcaggat

SEQ ID NO: 90240 - DNA, 22 bp, Homo sapiens
agggagcaaaggtttcagggtt

SEQ ID NO: 90241 - DNA, 22 bp, Homo sapiens
tccacagtggttgaactagttt

SEQ ID NO: 90242 - DNA, 21 bp, Homo sapiens
gcccacagtgaggaggatccc

SEQ ID NO: 90243 - DNA, 22 bp, Homo sapiens
caggctggagtgcaatgacgcc

SEQ ID NO: 90244 - DNA, 22 bp, Homo sapiens
gggggaagaaagaacatggcat

SEQ ID NO: 90245 - DNA, 22 bp, Homo sapiens
gggctgcatcagcaggacccgg

SEQ ID NO: 90246 - DNA, 22 bp, Homo sapiens
tccagggccatctccatgaggc

SEQ ID NO: 90247 - DNA, 23 bp, Homo sapiens
tgaggcaggcggatcacgaggtc

SEQ ID NO: 90248 - DNA, 22 bp, Homo sapiens
ccttcccatgcagcctgtctga

SEQ ID NO: 90249 - DNA, 22 bp, Homo sapiens
ttccagctaactcacatccctt

SEQ ID NO: 90250 - DNA, 22 bp, Homo sapiens
gattgtggaagtcagtggttct

SEQ ID NO: 90251 - DNA, 20 bp, Homo sapiens
agcggctggcggaggacacg

SEQ ID NO: 90252 - DNA, 22 bp, Homo sapiens
agtgaatgtccccgcgggtcag

SEQ ID NO: 90253 - DNA, 22 bp, Homo sapiens
atacaaaatatatactggagac

SEQ ID NO: 90254 - DNA, 22 bp, Homo sapiens
cccacacacatttatgatagga

SEQ ID NO: 90255 - DNA, 22 bp, Homo sapiens
catgctgggtaaaggtggtgaa

SEQ ID NO: 90256 - DNA, 22 bp, Homo sapiens
tagggcaatatttcccagaaaa

SEQ ID NO: 90257 - DNA, 22 bp, Homo sapiens
ttccccttgataagcagggttg

SEQ ID NO: 90258 - DNA, 22 bp, Homo sapiens
aaaagtcttggggaaggccagg

SEQ ID NO: 90259 - DNA, 22 bp, Homo sapiens
gcagccagagggggtgtgatca

SEQ ID NO: 90260 - DNA, 22 bp, Homo sapiens
agtgctgggctatctactgcta

SEQ ID NO: 90261 - DNA, 22 bp, Homo sapiens
aagccaggttccatggaggagc

SEQ ID NO: 90262 - DNA, 22 bp, Homo sapiens
catcagaacgtgagctccttgt

SEQ ID NO: 90263 - DNA, 22 bp, Homo sapiens
caagtgatcctcccatcttggc

SEQ ID NO: 90264 - DNA, 19 bp, Homo sapiens
cccaggaagcggaggttgc

SEQ ID NO: 90265 - DNA, 22 bp, Homo sapiens
tgtcatagtgtggtagcagtgg

SEQ ID NO: 90266 - DNA, 22 bp, Homo sapiens
gaggcagaggttgcagtgagct

SEQ ID NO: 90267 - DNA, 22 bp, Homo sapiens
tcccttgggagtggtgaccaca

SEQ ID NO: 90268 - DNA, 19 bp, Homo sapiens
ctgtccttggctgcactgt

SEQ ID NO: 90269 - DNA, 22 bp, Homo sapiens
attacctatttcattttctgtc

SEQ ID NO: 90270 - DNA, 22 bp, Homo sapiens
agaaacgcctgtgaaattatct

SEQ ID NO: 90271 - DNA, 22 bp, Homo sapiens
cagcagcccacgcgtgctgtcc

SEQ ID NO: 90272 - DNA, 22 bp, Homo sapiens
ttgagacacagtttcactctgt

SEQ ID NO: 90273 - DNA, 22 bp, Homo sapiens
caggtgttggaagggcagtggg

SEQ ID NO: 90274 - DNA, 22 bp, Homo sapiens
cgggcaaggcgagactaggccc

SEQ ID NO: 90275 - DNA, 22 bp, Homo sapiens
tacaaaaaattgatactgacga

SEQ ID NO: 90276 - DNA, 22 bp, Homo sapiens
gtgtgtcccttggaacctcagc

SEQ ID NO: 90277 - DNA, 21 bp, Homo sapiens
agatcctggggtctggggagg

SEQ ID NO: 90278 - DNA, 22 bp, Homo sapiens
tgtctgttattggtgtataaga

SEQ ID NO: 90279 - DNA, 22 bp, Homo sapiens
gggcatggtggcaggcacctgt

SEQ ID NO: 90280 - DNA, 22 bp, Homo sapiens
tgtggccattcttgaggtcgac

SEQ ID NO: 90281 - DNA, 20 bp, Homo sapiens
tatttctgggcaaccattta

SEQ ID NO: 90282 - DNA, 22 bp, Homo sapiens
tcagtgtgaattcaggagccta

SEQ ID NO: 90283 - DNA, 22 bp, Homo sapiens
gtgcatgtcggggtgcatgtca

SEQ ID NO: 90284 - DNA, 20 bp, Homo sapiens
ggcagagggcctgggagaag

SEQ ID NO: 90285 - DNA, 22 bp, Homo sapiens
gtgccccagacacgcatgtggg

SEQ ID NO: 90286 - DNA, 22 bp, Homo sapiens
cagcagagaaattacatatttg

SEQ ID NO: 90287 - DNA, 22 bp, Homo sapiens
ggactgggaatcagggagatgc

SEQ ID NO: 90288 - DNA, 22 bp, Homo sapiens
ccaggctggagtgcagtggcac

SEQ ID NO: 90289 - DNA, 22 bp, Homo sapiens
gtctcgtcaatggcaggttccc

SEQ ID NO: 90290 - DNA, 22 bp, Homo sapiens
aagagaattctggttttcctat

SEQ ID NO: 90291 - DNA, 19 bp, Homo sapiens
agcggttctcaaagtcagg

SEQ ID NO: 90292 - DNA, 22 bp, Homo sapiens
ccctgtgggaactcctgagttg

SEQ ID NO: 90293 - DNA, 20 bp, Homo sapiens
gggcagagccagccagtccc

SEQ ID NO: 90294 - DNA, 22 bp, Homo sapiens
aatatgcactctgatttagcag

SEQ ID NO: 90295 - DNA, 22 bp, Homo sapiens
cactgcactccagcccgggcaa

SEQ ID NO: 90296 - DNA, 22 bp, Homo sapiens
ctgctgtttctcaaaattaagt

SEQ ID NO: 90297 - DNA, 22 bp, Homo sapiens
atggactgggaggtcatcttct

SEQ ID NO: 90298 - DNA, 22 bp, Homo sapiens
acactgcagatgaaagcataag

SEQ ID NO: 90299 - DNA, 22 bp, Homo sapiens
aggcgaagggaccagacggtag

SEQ ID NO: 90300 - DNA, 22 bp, Homo sapiens
gtggcttggaccagtcacagtg

SEQ ID NO: 90301 - DNA, 22 bp, Homo sapiens
ctgggatccacgggctcccaag

SEQ ID NO: 90302 - DNA, 22 bp, Homo sapiens
ctcaggagttggaggctacagt

SEQ ID NO: 90303 - DNA, 19 bp, Homo sapiens
tcctgcccaccagccaggg

SEQ ID NO: 90304 - DNA, 22 bp, Homo sapiens
ctcagctgcagcctggctggca

SEQ ID NO: 90305 - DNA, 22 bp, Homo sapiens
ctcgggcttgaggctgtttacc

SEQ ID NO: 90306 - DNA, 22 bp, Homo sapiens
cctgcgggctgtgctgaagcct

SEQ ID NO: 90307 - DNA, 22 bp, Homo sapiens
cccaggcttttctcttgcccca

SEQ ID NO: 90308 - DNA, 17 bp, Homo sapiens
tggtccaggtggagcca

SEQ ID NO: 90309 - DNA, 22 bp, Homo sapiens
tcccgtaggttgctgtagtcgg

SEQ ID NO: 90310 - DNA, 22 bp, Homo sapiens
tgttttaagggtcaactgtcac

SEQ ID NO: 90311 - DNA, 19 bp, Homo sapiens
atcttcattttacaggcag

SEQ ID NO: 90312 - DNA, 22 bp, Homo sapiens
gggaaatctcgtcctctattta

SEQ ID NO: 90313 - DNA, 22 bp, Homo sapiens
tgaagctttaggatgggttcat

SEQ ID NO: 90314 - DNA, 22 bp, Homo sapiens
ctgggatgcggaggttgcggtg

SEQ ID NO: 90315 - DNA, 22 bp, Homo sapiens
cagggatggcgctggctgcccg

SEQ ID NO: 90316 - DNA, 22 bp, Homo sapiens
aaatgtaagtctttgtttctta

SEQ ID NO: 90317 - DNA, 22 bp, Homo sapiens
aggaaaatggaccagagttgtt

SEQ ID NO: 90318 - DNA, 22 bp, Homo sapiens
gatgtgtttccaggatttgttt

SEQ ID NO: 90319 - DNA, 22 bp, Homo sapiens
attgcagatgatccccaagtta

SEQ ID NO: 90320 - DNA, 18 bp, Homo sapiens
ggcgggtgttttattcac

SEQ ID NO: 90321 - DNA, 22 bp, Homo sapiens
gaaggtggcgagcggattgctg

SEQ ID NO: 90322 - DNA, 22 bp, Homo sapiens
ctattattagataatctacttg

SEQ ID NO: 90323 - DNA, 22 bp, Homo sapiens
tctctagtctcctttaacctga

SEQ ID NO: 90324 - DNA, 21 bp, Homo sapiens
ctctgaatcctgcttctcagt

SEQ ID NO: 90325 - DNA, 22 bp, Homo sapiens
actggggtttaggcctgggcaa

SEQ ID NO: 90326 - DNA, 22 bp, Homo sapiens
ttccatacgactgaggtctcgg

SEQ ID NO: 90327 - DNA, 22 bp, Homo sapiens
ttgcaattgctatggagagcgt

SEQ ID NO: 90328 - DNA, 22 bp, Homo sapiens
cccttggggtggaggttgcagt

SEQ ID NO: 90329 - DNA, 19 bp, Homo sapiens
caccaagatggctctagtc

SEQ ID NO: 90330 - DNA, 22 bp, Homo sapiens
acccaggctggagtgcagtgat

SEQ ID NO: 90331 - DNA, 22 bp, Homo sapiens
gggcaccttgggtctcaggcaa

SEQ ID NO: 90332 - DNA, 22 bp, Homo sapiens
atgtttttggaaatgggaacat

SEQ ID NO: 90333 - DNA, 22 bp, Homo sapiens
cctgccagagcagcttgtcctc

SEQ ID NO: 90334 - DNA, 22 bp, Homo sapiens
tgcatattatgtgtatctgtct

SEQ ID NO: 90335 - DNA, 22 bp, Homo sapiens
aaatcccatcggagaggaggat

SEQ ID NO: 90336 - DNA, 22 bp, Homo sapiens
ggaatgaatttccagctgggtc

SEQ ID NO: 90337 - DNA, 22 bp, Homo sapiens
cccaggggttctgagcagcagc

SEQ ID NO: 90338 - DNA, 22 bp, Homo sapiens
tcccgcccttgtacttgccgag

SEQ ID NO: 90339 - DNA, 22 bp, Homo sapiens
ggagagcttggagtgcgatttt

SEQ ID NO: 90340 - DNA, 22 bp, Homo sapiens
caacaacatgggattcatttct

SEQ ID NO: 90341 - DNA, 22 bp, Homo sapiens
ttggatccatctcaggcatagg

SEQ ID NO: 90342 - DNA, 22 bp, Homo sapiens
cagctgctgttcagttttgttt

SEQ ID NO: 90343 - DNA, 22 bp, Homo sapiens
cagtcaccttgaggactcagac

SEQ ID NO: 90344 - DNA, 22 bp, Homo sapiens
tagtggatgttcagagatttga

SEQ ID NO: 90345 - DNA, 22 bp, Homo sapiens
aggcaaggtgctacagacagtg

SEQ ID NO: 90346 - DNA, 18 bp, Homo sapiens
tccatgcacatagccccc

SEQ ID NO: 90347 - DNA, 22 bp, Homo sapiens
agccaggatggtctcgatcggc

SEQ ID NO: 90348 - DNA, 22 bp, Homo sapiens
gcctccggagttgcagtgtctt

SEQ ID NO: 90349 - DNA, 22 bp, Homo sapiens
aaacttttttaggttcataggc

SEQ ID NO: 90350 - DNA, 22 bp, Homo sapiens
ccaggtgtgctctgcagtggat

SEQ ID NO: 90351 - DNA, 22 bp, Homo sapiens
tatcttaaaaatcgaagcagat

SEQ ID NO: 90352 - DNA, 22 bp, Homo sapiens
agctggagatgagtgacgtgcc

SEQ ID NO: 90353 - DNA, 22 bp, Homo sapiens
ccaggaggcggaggttgcagtg

SEQ ID NO: 90354 - DNA, 22 bp, Homo sapiens
cctccctgccggctggactagt

SEQ ID NO: 90355 - DNA, 22 bp, Homo sapiens
actgatcaagggtttaatttta

SEQ ID NO: 90356 - DNA, 22 bp, Homo sapiens
tgatgggaggtgctgcaggacc

SEQ ID NO: 90357 - DNA, 22 bp, Homo sapiens
caggcagggagctggaaaggat

SEQ ID NO: 90358 - DNA, 22 bp, Homo sapiens
agtggccagcagcctagcctag

SEQ ID NO: 90359 - DNA, 22 bp, Homo sapiens
gcctcctgtcccaggctgagga

SEQ ID NO: 90360 - DNA, 22 bp, Homo sapiens
caggaaggggctcactctggcc

SEQ ID NO: 90361 - DNA, 22 bp, Homo sapiens
aattacagtcggagcagcactg

SEQ ID NO: 90362 - DNA, 22 bp, Homo sapiens
gctgcagtgagccaagatcgtg

SEQ ID NO: 90363 - DNA, 22 bp, Homo sapiens
tctagcaagctcgtgctcaagg

SEQ ID NO: 90364 - DNA, 22 bp, Homo sapiens
agggctgcccagtgtgagagct

SEQ ID NO: 90365 - DNA, 22 bp, Homo sapiens
gcagctggaagtgacactctgt

SEQ ID NO: 90366 - DNA, 22 bp, Homo sapiens
gtggatggagctggaagccatt

SEQ ID NO: 90367 - DNA, 22 bp, Homo sapiens
tggggtcagcaggcctggcctg

SEQ ID NO: 90368 - DNA, 19 bp, Homo sapiens
gactcacaccttccgctgt

SEQ ID NO: 90369 - DNA, 22 bp, Homo sapiens
gacccggctccaggcccagcag

SEQ ID NO: 90370 - DNA, 22 bp, Homo sapiens
ggtcagccttggatttggtagc

SEQ ID NO: 90371 - DNA, 22 bp, Homo sapiens
ccagcctggttcagaattggct

SEQ ID NO: 90372 - DNA, 22 bp, Homo sapiens
gagccaggaggcagagactgca

SEQ ID NO: 90373 - DNA, 21 bp, Homo sapiens
gggcagaggggcctcctgggt

SEQ ID NO: 90374 - DNA, 22 bp, Homo sapiens
cggcccgctgcgagtgcaccgt

SEQ ID NO: 90375 - DNA, 22 bp, Homo sapiens
cctggcactgctgaagtcctgg

SEQ ID NO: 90376 - DNA, 22 bp, Homo sapiens
tgtacacatggtgtacactccc

SEQ ID NO: 90377 - DNA, 22 bp, Homo sapiens
tgctgctccccagcacacagca

SEQ ID NO: 90378 - DNA, 22 bp, Homo sapiens
gctcccagtctgatggaggaga

SEQ ID NO: 90379 - DNA, 16 bp, Homo sapiens
gcgcctcctcggcctc

SEQ ID NO: 90380 - DNA, 22 bp, Homo sapiens
gactggaaagcctgtcctcaga

SEQ ID NO: 90381 - DNA, 22 bp, Homo sapiens
tcaccaggctggagtgcagtgg

SEQ ID NO: 90382 - DNA, 18 bp, Homo sapiens
gaggatggaaggagatgc

SEQ ID NO: 90383 - DNA, 22 bp, Homo sapiens
gataccagacagggagggagaa

SEQ ID NO: 90384 - DNA, 22 bp, Homo sapiens
atttcagtattatacaactgct

SEQ ID NO: 90385 - DNA, 22 bp, Homo sapiens
tcttctatcctcagcccctgcc

SEQ ID NO: 90386 - DNA, 22 bp, Homo sapiens
aaactgctttccacagtggcta

SEQ ID NO: 90387 - DNA, 22 bp, Homo sapiens
catgatctggtcctactgtggg

SEQ ID NO: 90388 - DNA, 22 bp, Homo sapiens
acggcaggctcagagctggaat

SEQ ID NO: 90389 - DNA, 22 bp, Homo sapiens
ctgtgctccctctggcgccccg

SEQ ID NO: 90390 - DNA, 22 bp, Homo sapiens
ttatttaatgtgatctgaagag

SEQ ID NO: 90391 - DNA, 21 bp, Homo sapiens
aaggacgaggttttgattaca

SEQ ID NO: 90392 - DNA, 22 bp, Homo sapiens
ccagcagccaccttctcgaaat

SEQ ID NO: 90393 - DNA, 22 bp, Homo sapiens
gcacagagagggaaggtaactt

SEQ ID NO: 90394 - DNA, 23 bp, Homo sapiens
atgacactcctgtgcgcaccctg

SEQ ID NO: 90395 - DNA, 22 bp, Homo sapiens
acgggctgggacggggaagctc

SEQ ID NO: 90396 - DNA, 22 bp, Homo sapiens
ctgcactgagcatctaacctta

SEQ ID NO: 90397 - DNA, 22 bp, Homo sapiens
catgtgtgtctccaccagctgc

SEQ ID NO: 90398 - DNA, 22 bp, Homo sapiens
ccgggagcaggcgccaccgcca

SEQ ID NO: 90399 - DNA, 22 bp, Homo sapiens
ccctgccttgtctgggctaggt

SEQ ID NO: 90400 - DNA, 22 bp, Homo sapiens
tcctcctgtctaccagttcctg

SEQ ID NO: 90401 - DNA, 22 bp, Homo sapiens
ggttcagagcctgcccagtata

SEQ ID NO: 90402 - DNA, 18 bp, Homo sapiens
tggtcactgtggatagtg

SEQ ID NO: 90403 - DNA, 21 bp, Homo sapiens
agtggctctcagcttgctaag

SEQ ID NO: 90404 - DNA, 22 bp, Homo sapiens
atgtttttaaatagacttacag

SEQ ID NO: 90405 - DNA, 22 bp, Homo sapiens
aatggaatacctaggtggccca

SEQ ID NO: 90406 - DNA, 22 bp, Homo sapiens
ggggtgtggacggctgtgccag

SEQ ID NO: 90407 - DNA, 22 bp, Homo sapiens
ctgatagacaatcaccatggga

SEQ ID NO: 90408 - DNA, 22 bp, Homo sapiens
cctggaagttggaggttgcagt

SEQ ID NO: 90409 - DNA, 22 bp, Homo sapiens
tgtagctctccagccagcaagg

SEQ ID NO: 90410 - DNA, 22 bp, Homo sapiens
tgagactcagcacttgtgtgtc

SEQ ID NO: 90411 - DNA, 22 bp, Homo sapiens
tcgcccaggctggaagtgcagt

SEQ ID NO: 90412 - DNA, 22 bp, Homo sapiens
cgagcatgatgacggctgtggc

SEQ ID NO: 90413 - DNA, 22 bp, Homo sapiens
ggctcctgggggtgctcctgcc

SEQ ID NO: 90414 - DNA, 22 bp, Homo sapiens
ttctgcagtgttaacaatgtca

SEQ ID NO: 90415 - DNA, 22 bp, Homo sapiens
gaggtggccaagcgaggaaggg

SEQ ID NO: 90416 - DNA, 22 bp, Homo sapiens
atacagggacatccagtttttc

SEQ ID NO: 90417 - DNA, 22 bp, Homo sapiens
agggggctccttggtgtgcaga

SEQ ID NO: 90418 - DNA, 22 bp, Homo sapiens
aggaatgacagatgtccgcacc

SEQ ID NO: 90419 - DNA, 22 bp, Homo sapiens
gagctctgactgctgggtgaca

SEQ ID NO: 90420 - DNA, 22 bp, Homo sapiens
gggaggaggaatgttttgtgta

SEQ ID NO: 90421 - DNA, 22 bp, Homo sapiens
gggggctccaggcgagaatgtg

SEQ ID NO: 90422 - DNA, 22 bp, Homo sapiens
gttcaagaccagcctggccaac

SEQ ID NO: 90423 - DNA, 22 bp, Homo sapiens
tccagctgaggtggcctctgtg

SEQ ID NO: 90424 - DNA, 20 bp, Homo sapiens
gctgaggggtctatggcata

SEQ ID NO: 90425 - DNA, 22 bp, Homo sapiens
agctcaatgcaacctccgcctc

SEQ ID NO: 90426 - DNA, 22 bp, Homo sapiens
ccggtcccaggtgccccggtga

SEQ ID NO: 90427 - DNA, 22 bp, Homo sapiens
agacattttcgttggagaggtt

SEQ ID NO: 90428 - DNA, 22 bp, Homo sapiens
gagatttccatattttgtaaca

SEQ ID NO: 90429 - DNA, 22 bp, Homo sapiens
tagaagaaagtgaagctgggga

SEQ ID NO: 90430 - DNA, 22 bp, Homo sapiens
gtgattttctcctcctagaagt

SEQ ID NO: 90431 - DNA, 22 bp, Homo sapiens
tataaactcctcttgcattcct

SEQ ID NO: 90432 - DNA, 20 bp, Homo sapiens
gaaatgtacacattaccaca

SEQ ID NO: 90433 - DNA, 22 bp, Homo sapiens
ctgtggctcaggcctgtaagcc

SEQ ID NO: 90434 - DNA, 22 bp, Homo sapiens
gagagtctaggaacctcatata

SEQ ID NO: 90435 - DNA, 22 bp, Homo sapiens
tacagtgcttggtatctagtaa

SEQ ID NO: 90436 - DNA, 22 bp, Homo sapiens
ataatggtagatgtccacgcag

SEQ ID NO: 90437 - DNA, 22 bp, Homo sapiens
ttcctagggcagagccgctggg

SEQ ID NO: 90438 - DNA, 22 bp, Homo sapiens
aacactctctgttggtaaggct

SEQ ID NO: 90439 - DNA, 22 bp, Homo sapiens
gggagctgaaggagccggcggg

SEQ ID NO: 90440 - DNA, 22 bp, Homo sapiens
tgcaccctcatcagtcaaatgg

SEQ ID NO: 90441 - DNA, 22 bp, Homo sapiens
ggggaccctcaggactgcgtct

SEQ ID NO: 90442 - DNA, 22 bp, Homo sapiens
tattttgtgccatgcactgcct

SEQ ID NO: 90443 - DNA, 22 bp, Homo sapiens
cttctgagatgttgttttacag

SEQ ID NO: 90444 - DNA, 22 bp, Homo sapiens
tccttcagcctcccagctcaaa

SEQ ID NO: 90445 - DNA, 22 bp, Homo sapiens
ttgggtgctgtcatggggcacg

SEQ ID NO: 90446 - DNA, 19 bp, Homo sapiens
ggggcctgtgatggtcaca

SEQ ID NO: 90447 - DNA, 21 bp, Homo sapiens
ctgtggtacagctgggacgga

SEQ ID NO: 90448 - DNA, 22 bp, Homo sapiens
tggtcgaccagttggaaagtaa

SEQ ID NO: 90449 - DNA, 22 bp, Homo sapiens
caggctggagtgcagtggggcg

SEQ ID NO: 90450 - DNA, 22 bp, Homo sapiens
ggagtgactcacagctgggaca

SEQ ID NO: 90451 - DNA, 22 bp, Homo sapiens
tttggggatgtctgagttgttg

SEQ ID NO: 90452 - DNA, 22 bp, Homo sapiens
ggctgggctccgggagcatgcg

SEQ ID NO: 90453 - DNA, 22 bp, Homo sapiens
ctctccattccctacagttttc

SEQ ID NO: 90454 - DNA, 22 bp, Homo sapiens
tcagaattgtggagaaagggga

SEQ ID NO: 90455 - DNA, 22 bp, Homo sapiens
aagcatttcaggtagagatatt

SEQ ID NO: 90456 - DNA, 22 bp, Homo sapiens
ggaagaaaggtggacaacaggt

SEQ ID NO: 90457 - DNA, 22 bp, Homo sapiens
gtgggccactgggaggcaaggg

SEQ ID NO: 90458 - DNA, 22 bp, Homo sapiens
cccaactactctcaggcagctt

SEQ ID NO: 90459 - DNA, 22 bp, Homo sapiens
tggtgctgccaggctcctgcca

SEQ ID NO: 90460 - DNA, 22 bp, Homo sapiens
gcccatgcactttctgtgatgg

SEQ ID NO: 90461 - DNA, 22 bp, Homo sapiens
ccgtggtcacctgagctccttg

SEQ ID NO: 90462 - DNA, 22 bp, Homo sapiens
ttcattttctttcacgctgctg

SEQ ID NO: 90463 - DNA, 22 bp, Homo sapiens
agcgccactgcactccagcctg

SEQ ID NO: 90464 - DNA, 22 bp, Homo sapiens
cccgggaggtggaggttgcagt

SEQ ID NO: 90465 - DNA, 22 bp, Homo sapiens
tgtatgtatgaataagcaagat

SEQ ID NO: 90466 - DNA, 22 bp, Homo sapiens
cccccagctctgctgggtcccg

SEQ ID NO: 90467 - DNA, 22 bp, Homo sapiens
acaggcttacaggctgcaagta

SEQ ID NO: 90468 - DNA, 22 bp, Homo sapiens
tgcacgtgtgagcattcacatg

SEQ ID NO: 90469 - DNA, 22 bp, Homo sapiens
ttttaagttggattgctaagta

SEQ ID NO: 90470 - DNA, 22 bp, Homo sapiens
ctcactgcaagctctgcctcca

SEQ ID NO: 90471 - DNA, 22 bp, Homo sapiens
gtgagcagagatcgcgtgattg

SEQ ID NO: 90472 - DNA, 22 bp, Homo sapiens
tagatagattctcctatagagt

SEQ ID NO: 90473 - DNA, 22 bp, Homo sapiens
agagaagagtcttgtcaaatta

SEQ ID NO: 90474 - DNA, 22 bp, Homo sapiens
ctctgctgtgccgccagggcct

SEQ ID NO: 90475 - DNA, 22 bp, Homo sapiens
catagcggtattccacgtggtt

SEQ ID NO: 90476 - DNA, 22 bp, Homo sapiens
cctcttctaggacgtccttgtg

SEQ ID NO: 90477 - DNA, 22 bp, Homo sapiens
caggtgtgccgggagcagtttg

SEQ ID NO: 90478 - DNA, 22 bp, Homo sapiens
tgccgcagtgcggggagggccc

SEQ ID NO: 90479 - DNA, 23 bp, Homo sapiens
acagcaagaggaccagatgtgag

SEQ ID NO: 90480 - DNA, 22 bp, Homo sapiens
tggtcttagctggaaggaggga

SEQ ID NO: 90481 - DNA, 22 bp, Homo sapiens
ttgtatagcccagagagtgaga

SEQ ID NO: 90482 - DNA, 21 bp, Homo sapiens
accctgctttatgccgtcctc

SEQ ID NO: 90483 - DNA, 22 bp, Homo sapiens
cgggcgcactccgggcagctgt

SEQ ID NO: 90484 - DNA, 22 bp, Homo sapiens
tgacttgtctctttgggagaca

SEQ ID NO: 90485 - DNA, 22 bp, Homo sapiens
tgatcaaaacattactccacca

SEQ ID NO: 90486 - DNA, 22 bp, Homo sapiens
gcctccggagtcacagtgtctt

SEQ ID NO: 90487 - DNA, 22 bp, Homo sapiens
agatggggtttcatcatgttgg

SEQ ID NO: 90488 - DNA, 22 bp, Homo sapiens
agggaagaggaccagagtctct

SEQ ID NO: 90489 - DNA, 22 bp, Homo sapiens
ggggaaggaaagttattagcag

SEQ ID NO: 90490 - DNA, 22 bp, Homo sapiens
acaagcgggccacagtgctggt

SEQ ID NO: 90491 - DNA, 21 bp, Homo sapiens
ggccccgcagacccagcacgt

SEQ ID NO: 90492 - DNA, 22 bp, Homo sapiens
ttggcataccttagtggtggag

SEQ ID NO: 90493 - DNA, 18 bp, Homo sapiens
gctgtggaagtctttata

SEQ ID NO: 90494 - DNA, 22 bp, Homo sapiens
gagcagtgccaaagaatttgcg

SEQ ID NO: 90495 - DNA, 22 bp, Homo sapiens
ggctccaccctgcttccagaag

SEQ ID NO: 90496 - DNA, 22 bp, Homo sapiens
cagctggcgactctcctcgatg

SEQ ID NO: 90497 - DNA, 22 bp, Homo sapiens
ctgggaggcagaggttgtagtg

SEQ ID NO: 90498 - DNA, 22 bp, Homo sapiens
cactgcccaccaagtggctggt

SEQ ID NO: 90499 - DNA, 22 bp, Homo sapiens
cactgcactccagcctgggcaa

SEQ ID NO: 90500 - DNA, 22 bp, Homo sapiens
aaactagctcttagtttagagg

SEQ ID NO: 90501 - DNA, 22 bp, Homo sapiens
ttatttgtggcatatgagacga

SEQ ID NO: 90502 - DNA, 22 bp, Homo sapiens
tagatgtgttgcctggagttgt

SEQ ID NO: 90503 - DNA, 22 bp, Homo sapiens
ctcttagtaatgccatgaagca

SEQ ID NO: 90504 - DNA, 23 bp, Homo sapiens
caccactttctccttctccttgg

SEQ ID NO: 90505 - DNA, 22 bp, Homo sapiens
tgaggcaggagaatcacatgaa

SEQ ID NO: 90506 - DNA, 22 bp, Homo sapiens
tgtgacaagcattgtatattgg

SEQ ID NO: 90507 - DNA, 22 bp, Homo sapiens
gggagtgggtttggcctaggcc

SEQ ID NO: 90508 - DNA, 22 bp, Homo sapiens
ttccagagagttattcccctgg

SEQ ID NO: 90509 - DNA, 22 bp, Homo sapiens
tccaccatgtaacaagctctgt

SEQ ID NO: 90510 - DNA, 22 bp, Homo sapiens
aagtgtgtgagcctgtcaggct

SEQ ID NO: 90511 - DNA, 22 bp, Homo sapiens
tttctaatctgattctcctacc

SEQ ID NO: 90512 - DNA, 22 bp, Homo sapiens
acctggccagtggggccgcgct

SEQ ID NO: 90513 - DNA, 22 bp, Homo sapiens
tgccgctccaggtctcgcggtg

SEQ ID NO: 90514 - DNA, 22 bp, Homo sapiens
tgttttaagctctagaagggga

SEQ ID NO: 90515 - DNA, 22 bp, Homo sapiens
cccaggagttggaggctgcagt

SEQ ID NO: 90516 - DNA, 22 bp, Homo sapiens
actgcaaagggaagccctttct

SEQ ID NO: 90517 - DNA, 22 bp, Homo sapiens
gctgcagggagctggaaggctc

SEQ ID NO: 90518 - DNA, 22 bp, Homo sapiens
tggttttagggaatcaatctat

SEQ ID NO: 90519 - DNA, 22 bp, Homo sapiens
gaccttgtgatccacctgcctt

SEQ ID NO: 90520 - DNA, 22 bp, Homo sapiens
tgctcattggcgatctgaggga

SEQ ID NO: 90521 - DNA, 22 bp, Homo sapiens
gtcaggactctgacccgtcccg

SEQ ID NO: 90522 - DNA, 22 bp, Homo sapiens
cctctgtgtctccaagaggcct

SEQ ID NO: 90523 - DNA, 22 bp, Homo sapiens
tgagagcaacacgcagtagtat

SEQ ID NO: 90524 - DNA, 22 bp, Homo sapiens
agcctctctgttagtcactggg

SEQ ID NO: 90525 - DNA, 22 bp, Homo sapiens
tcagtgccatgggcagacaggc

SEQ ID NO: 90526 - DNA, 17 bp, Homo sapiens
cttcccaccatctcctg

SEQ ID NO: 90527 - DNA, 22 bp, Homo sapiens
aggctggagtgcagttgcatga

SEQ ID NO: 90528 - DNA, 22 bp, Homo sapiens
agggaattcactggaacgccct

SEQ ID NO: 90529 - DNA, 22 bp, Homo sapiens
gagcccaggaagtggaggctga

SEQ ID NO: 90530 - DNA, 22 bp, Homo sapiens
accactgcccatggtgaaaact

SEQ ID NO: 90531 - DNA, 22 bp, Homo sapiens
ccaggggggcgtagatgctggg

SEQ ID NO: 90532 - DNA, 22 bp, Homo sapiens
attctacatgatagaagggaga

SEQ ID NO: 90533 - DNA, 22 bp, Homo sapiens
atgaggcaggtggaggctgcca

SEQ ID NO: 90534 - DNA, 22 bp, Homo sapiens
cacggcctgtaaggacccagga

SEQ ID NO: 90535 - DNA, 22 bp, Homo sapiens
tgtatatacacactcccatgtt

SEQ ID NO: 90536 - DNA, 23 bp, Homo sapiens
attttttgtctttgtaactagat

SEQ ID NO: 90537 - DNA, 22 bp, Homo sapiens
tgttgattagtgtttagactta

SEQ ID NO: 90538 - DNA, 22 bp, Homo sapiens
ttcaatttgtgctaaggcaccg

SEQ ID NO: 90539 - DNA, 22 bp, Homo sapiens
taggtttaggagtgaaggtgaa

SEQ ID NO: 90540 - DNA, 22 bp, Homo sapiens
aacaattactaccaaggcctgt

SEQ ID NO: 90541 - DNA, 22 bp, Homo sapiens
tgggaagggtcaacagctggaa

SEQ ID NO: 90542 - DNA, 22 bp, Homo sapiens
agcctggtttaagcattttata

SEQ ID NO: 90543 - DNA, 18 bp, Homo sapiens
taggttacagccagccag

SEQ ID NO: 90544 - DNA, 22 bp, Homo sapiens
agcataagttggtacagccact

SEQ ID NO: 90545 - DNA, 22 bp, Homo sapiens
tgtgcccaacgtgcaggtttgt

SEQ ID NO: 90546 - DNA, 17 bp, Homo sapiens
ggcctgcacctcctgct

SEQ ID NO: 90547 - DNA, 22 bp, Homo sapiens
tgggaagaggagcactggaatg

SEQ ID NO: 90548 - DNA, 22 bp, Homo sapiens
gctgatcacatttccaaaaccc

SEQ ID NO: 90549 - DNA, 22 bp, Homo sapiens
gggccctgggattcagagcaag

SEQ ID NO: 90550 - DNA, 22 bp, Homo sapiens
tcccccaggctggagtgcagtg

SEQ ID NO: 90551 - DNA, 22 bp, Homo sapiens
tatccaattcaccattgatggg

SEQ ID NO: 90552 - DNA, 23 bp, Homo sapiens
cagtgtgacaaaacttattactt

SEQ ID NO: 90553 - DNA, 22 bp, Homo sapiens
ctcgggcaccctggttctggtg

SEQ ID NO: 90554 - DNA, 22 bp, Homo sapiens
cactgcactccagcctgggaga

SEQ ID NO: 90555 - DNA, 22 bp, Homo sapiens
tccgaggccaaagctgtgaata

SEQ ID NO: 90556 - DNA, 22 bp, Homo sapiens
ggtcgagtcacttgttgccttt

SEQ ID NO: 90557 - DNA, 22 bp, Homo sapiens
ggaggactcaggtctggccatg

SEQ ID NO: 90558 - DNA, 22 bp, Homo sapiens
ttgcttcttagatattcctctc

SEQ ID NO: 90559 - DNA, 22 bp, Homo sapiens
ccatgtggtgggaaggagaatg

SEQ ID NO: 90560 - DNA, 22 bp, Homo sapiens
ggctgagttgagaggattactt

SEQ ID NO: 90561 - DNA, 22 bp, Homo sapiens
ttgcactccagcccgagcaaca

SEQ ID NO: 90562 - DNA, 22 bp, Homo sapiens
gcagtatctatgtgatgggttg

SEQ ID NO: 90563 - DNA, 22 bp, Homo sapiens
gccgtccacctcgatggccact

SEQ ID NO: 90564 - DNA, 22 bp, Homo sapiens
aggctatttccactcttctcat

SEQ ID NO: 90565 - DNA, 22 bp, Homo sapiens
cccaggaggtggaggctgcagt

SEQ ID NO: 90566 - DNA, 22 bp, Homo sapiens
tctgcaacattcctctccccac

SEQ ID NO: 90567 - DNA, 22 bp, Homo sapiens
gtgcacttgatctagacagatt

SEQ ID NO: 90568 - DNA, 22 bp, Homo sapiens
ccggcgtctcttccacttccta

SEQ ID NO: 90569 - DNA, 22 bp, Homo sapiens
tatttcttttcgtgacttattg

SEQ ID NO: 90570 - DNA, 22 bp, Homo sapiens
ttgtgttaaggtgcatctagtg

SEQ ID NO: 90571 - DNA, 22 bp, Homo sapiens
ggtccccgtggaggctggagcg

SEQ ID NO: 90572 - DNA, 22 bp, Homo sapiens
caaagctggaaaaggaggctgg

SEQ ID NO: 90573 - DNA, 22 bp, Homo sapiens
ttcaatatgatattagctgtgg

SEQ ID NO: 90574 - DNA, 22 bp, Homo sapiens
ccctctacagggaagcgctttc

SEQ ID NO: 90575 - DNA, 22 bp, Homo sapiens
tggattcacaccattctcctgc

SEQ ID NO: 90576 - DNA, 19 bp, Homo sapiens
ggcttgtctcggcagccgc

SEQ ID NO: 90577 - DNA, 22 bp, Homo sapiens
tcctgagccctactctagacga

SEQ ID NO: 90578 - DNA, 22 bp, Homo sapiens
gcttagtcaattataaataggc

SEQ ID NO: 90579 - DNA, 22 bp, Homo sapiens
gttattgaggtggagtctcact

SEQ ID NO: 90580 - DNA, 22 bp, Homo sapiens
ttctatttttgtggaactgtag

SEQ ID NO: 90581 - DNA, 17 bp, Homo sapiens
cccgttctcttcgctgg

SEQ ID NO: 90582 - DNA, 22 bp, Homo sapiens
ttggcgcccaggacgccgccgc

SEQ ID NO: 90583 - DNA, 22 bp, Homo sapiens
aaagcagggaaatctatttgca

SEQ ID NO: 90584 - DNA, 22 bp, Homo sapiens
aggaggggttctcgggtgctga

SEQ ID NO: 90585 - DNA, 22 bp, Homo sapiens
tttctcggcagagatgatgggc

SEQ ID NO: 90586 - DNA, 22 bp, Homo sapiens
tagaaaagccccagctggaggg

SEQ ID NO: 90587 - DNA, 22 bp, Homo sapiens
ctcctccacccgctggggccca

SEQ ID NO: 90588 - DNA, 22 bp, Homo sapiens
tggtctgctgaacagccgtatc

SEQ ID NO: 90589 - DNA, 22 bp, Homo sapiens
cgggcagtgtggctccagagtc

SEQ ID NO: 90590 - DNA, 22 bp, Homo sapiens
agagttgctccattagaactta

SEQ ID NO: 90591 - DNA, 22 bp, Homo sapiens
ctgcagtctacctggattttta

SEQ ID NO: 90592 - DNA, 22 bp, Homo sapiens
gtccaagagtcaagaagggggc

SEQ ID NO: 90593 - DNA, 22 bp, Homo sapiens
gcgctaggcaagtcctttcaac

SEQ ID NO: 90594 - DNA, 22 bp, Homo sapiens
ggcaaggtgctacagacagtga

SEQ ID NO: 90595 - DNA, 22 bp, Homo sapiens
agcaggaaggggatgatgggca

SEQ ID NO: 90596 - DNA, 22 bp, Homo sapiens
ttcttttaattgtgggggagtg

SEQ ID NO: 90597 - DNA, 22 bp, Homo sapiens
ggatgttctggggttctcttgt

SEQ ID NO: 90598 - DNA, 22 bp, Homo sapiens
gttaggtagaagtttactttga

SEQ ID NO: 90599 - DNA, 22 bp, Homo sapiens
tcattccctcattgttcactgg

SEQ ID NO: 90600 - DNA, 22 bp, Homo sapiens
aggcaggaaaatcgcttgaacc

SEQ ID NO: 90601 - DNA, 22 bp, Homo sapiens
gactacaggtgtgtgccaccat

SEQ ID NO: 90602 - DNA, 22 bp, Homo sapiens
attataggcttgagccaccgtg

SEQ ID NO: 90603 - DNA, 22 bp, Homo sapiens
ggagtgtcccgattttccaggt

SEQ ID NO: 90604 - DNA, 22 bp, Homo sapiens
ggagaggcttccagagtcgtgc

SEQ ID NO: 90605 - DNA, 22 bp, Homo sapiens
aagacttgaccaggttgaaggc

SEQ ID NO: 90606 - DNA, 22 bp, Homo sapiens
tgcaatctcggcactttgggag

SEQ ID NO: 90607 - DNA, 23 bp, Homo sapiens
catgatgttaactttgttatgct

SEQ ID NO: 90608 - DNA, 22 bp, Homo sapiens
ggaggtggaggttgcagtgagc

SEQ ID NO: 90609 - DNA, 22 bp, Homo sapiens
ggaggcggaggttgcagtgagt

SEQ ID NO: 90610 - DNA, 22 bp, Homo sapiens
ttcttctcagggtcccacatgg

SEQ ID NO: 90611 - DNA, 22 bp, Homo sapiens
cagtgggtcctgcgtctgccag

SEQ ID NO: 90612 - DNA, 22 bp, Homo sapiens
ttgtggttgactaaatttgtaa

SEQ ID NO: 90613 - DNA, 22 bp, Homo sapiens
aggggctcctttgtgctgcgtc

SEQ ID NO: 90614 - DNA, 22 bp, Homo sapiens
ctcggcaggtggaggttgtagt

SEQ ID NO: 90615 - DNA, 22 bp, Homo sapiens
caggccagggttgagaagagaa

SEQ ID NO: 90616 - DNA, 22 bp, Homo sapiens
agatttctgggcttcaccacct

SEQ ID NO: 90617 - DNA, 22 bp, Homo sapiens
ttatttaaaagtggtaagattc

SEQ ID NO: 90618 - DNA, 22 bp, Homo sapiens
gggtggtggccagcagtgggca

SEQ ID NO: 90619 - DNA, 22 bp, Homo sapiens
agaggacagagtgctggattta

SEQ ID NO: 90620 - DNA, 22 bp, Homo sapiens
aggattgtgcctccagtcagaa

SEQ ID NO: 90621 - DNA, 22 bp, Homo sapiens
agaggccgggtgcctgctcaga

SEQ ID NO: 90622 - DNA, 22 bp, Homo sapiens
gaggctgaggcggatggatcac

SEQ ID NO: 90623 - DNA, 22 bp, Homo sapiens
gtccaggcctgcctctgaggag

SEQ ID NO: 90624 - DNA, 22 bp, Homo sapiens
tgggcaggggccctgcttccgt

SEQ ID NO: 90625 - DNA, 22 bp, Homo sapiens
gacttctgaattcctatcaggt

SEQ ID NO: 90626 - DNA, 22 bp, Homo sapiens
agaacagaggccttatgtttca

SEQ ID NO: 90627 - DNA, 22 bp, Homo sapiens
ctgggaggtggaggttgcattg

SEQ ID NO: 90628 - DNA, 22 bp, Homo sapiens
ctgggagtggtgacagctctcg

SEQ ID NO: 90629 - DNA, 22 bp, Homo sapiens
agattgtcattgacgatgagca

SEQ ID NO: 90630 - DNA, 22 bp, Homo sapiens
attctcaaaacataacttcact

SEQ ID NO: 90631 - DNA, 22 bp, Homo sapiens
agctgattccactttttcccca

SEQ ID NO: 90632 - DNA, 22 bp, Homo sapiens
tggctcctcacgtcctcagagc

SEQ ID NO: 90633 - DNA, 22 bp, Homo sapiens
gtagcccacctggggagggcga

SEQ ID NO: 90634 - DNA, 22 bp, Homo sapiens
cgtaggtggctcagcacctggg

SEQ ID NO: 90635 - DNA, 19 bp, Homo sapiens
tcctggggaggggcatggc

SEQ ID NO: 90636 - DNA, 22 bp, Homo sapiens
agcccaggtccagttcactgca

SEQ ID NO: 90637 - DNA, 22 bp, Homo sapiens
cccgggttgtccgcgcgtccgg

SEQ ID NO: 90638 - DNA, 22 bp, Homo sapiens
atagttttaaaacctcaggaag

SEQ ID NO: 90639 - DNA, 22 bp, Homo sapiens
accaggttggtgtccttctggc

SEQ ID NO: 90640 - DNA, 22 bp, Homo sapiens
ccttttatagatcagtgtgtta

SEQ ID NO: 90641 - DNA, 22 bp, Homo sapiens
tggaatgtcagctacaagaggg

SEQ ID NO: 90642 - DNA, 22 bp, Homo sapiens
catgtgtcttgctgccctccat

SEQ ID NO: 90643 - DNA, 22 bp, Homo sapiens
gcacggctaatttttgtatttt

SEQ ID NO: 90644 - DNA, 22 bp, Homo sapiens
gacctcatgatccacctgcctt

SEQ ID NO: 90645 - DNA, 22 bp, Homo sapiens
tggggtacttgtatcaaagcac

SEQ ID NO: 90646 - DNA, 22 bp, Homo sapiens
cgtcatcacggcaagcatctcc

SEQ ID NO: 90647 - DNA, 22 bp, Homo sapiens
gtgcggatcggtgtcctccaaa

SEQ ID NO: 90648 - DNA, 22 bp, Homo sapiens
aaaatcttgtgacttaggaagg

SEQ ID NO: 90649 - DNA, 22 bp, Homo sapiens
acttttcttatcagaaaggcca

SEQ ID NO: 90650 - DNA, 22 bp, Homo sapiens
ttggaatgcacactgagcctgc

SEQ ID NO: 90651 - DNA, 18 bp, Homo sapiens
tgtccctgcaaataacat

SEQ ID NO: 90652 - DNA, 22 bp, Homo sapiens
taggtgcctgcacgacccaaac

SEQ ID NO: 90653 - DNA, 22 bp, Homo sapiens
gaaaggagagggttaaggagct

SEQ ID NO: 90654 - DNA, 22 bp, Homo sapiens
gctccccaaaagctccaggaaa

SEQ ID NO: 90655 - DNA, 22 bp, Homo sapiens
ttgcatagtgctgaggttcggg

SEQ ID NO: 90656 - DNA, 22 bp, Homo sapiens
gccgggaccaaggccacggagc

SEQ ID NO: 90657 - DNA, 22 bp, Homo sapiens
ctggcaggtggaggttgcagtg

SEQ ID NO: 90658 - DNA, 22 bp, Homo sapiens
gagtggggggtccgtctcagtg

SEQ ID NO: 90659 - DNA, 23 bp, Homo sapiens
cagagctggctcagagctgcctg

SEQ ID NO: 90660 - DNA, 22 bp, Homo sapiens
taggcctggatctctgggagca

SEQ ID NO: 90661 - DNA, 22 bp, Homo sapiens
gaccttgtgatccccctgcctt

SEQ ID NO: 90662 - DNA, 22 bp, Homo sapiens
agagcacagccaccatttacaa

SEQ ID NO: 90663 - DNA, 22 bp, Homo sapiens
ggcatcgtcctgggcataggga

SEQ ID NO: 90664 - DNA, 22 bp, Homo sapiens
gcaagacctatctagttgctgt

SEQ ID NO: 90665 - DNA, 22 bp, Homo sapiens
aggagggagcttaagccaggca

SEQ ID NO: 90666 - DNA, 22 bp, Homo sapiens
ctgagcctcctgcttctatttc

SEQ ID NO: 90667 - DNA, 22 bp, Homo sapiens
gaggctgaggttgcagtgagct

SEQ ID NO: 90668 - DNA, 22 bp, Homo sapiens
acccaggctggcgtgcagtggc

SEQ ID NO: 90669 - DNA, 22 bp, Homo sapiens
gagatgggcgagaaggtggact

SEQ ID NO: 90670 - DNA, 22 bp, Homo sapiens
ctcagcagtatactctgaagat

SEQ ID NO: 90671 - DNA, 22 bp, Homo sapiens
gagccaggttggaggctgcagt

SEQ ID NO: 90672 - DNA, 22 bp, Homo sapiens
caggaattcatagcattgttct

SEQ ID NO: 90673 - DNA, 22 bp, Homo sapiens
caggtagaggctgccatcagct

SEQ ID NO: 90674 - DNA, 22 bp, Homo sapiens
agctgctgagccaggctgatgt

SEQ ID NO: 90675 - DNA, 22 bp, Homo sapiens
agcatttatcttttgtttgagt

SEQ ID NO: 90676 - DNA, 22 bp, Homo sapiens
tggacaggcaagcaagacatac

SEQ ID NO: 90677 - DNA, 22 bp, Homo sapiens
tcctgggatcaagtgatcctcc

SEQ ID NO: 90678 - DNA, 22 bp, Homo sapiens
ggcagggagtggagactcccta

SEQ ID NO: 90679 - DNA, 22 bp, Homo sapiens
cacagacagtgtccctttgttg

SEQ ID NO: 90680 - DNA, 22 bp, Homo sapiens
taggctaggctgaaggttttgg

SEQ ID NO: 90681 - DNA, 23 bp, Homo sapiens
ccatcccttggaagctggtttta

SEQ ID NO: 90682 - DNA, 22 bp, Homo sapiens
caggtgcctcaggatgagacaa

SEQ ID NO: 90683 - DNA, 22 bp, Homo sapiens
gggcggatcacctgaggtcagg

SEQ ID NO: 90684 - DNA, 18 bp, Homo sapiens
tgggaatgctcaaggccc

SEQ ID NO: 90685 - DNA, 22 bp, Homo sapiens
tgtggtgccgagagtctggacg

SEQ ID NO: 90686 - DNA, 22 bp, Homo sapiens
caggaagctgtgaaggagacgg

SEQ ID NO: 90687 - DNA, 22 bp, Homo sapiens
actgcactccagcctgggtgac

SEQ ID NO: 90688 - DNA, 22 bp, Homo sapiens
ccaaggtgggaggattgcttga

SEQ ID NO: 90689 - DNA, 22 bp, Homo sapiens
ggctcaatgcaacttctgcctc

SEQ ID NO: 90690 - DNA, 22 bp, Homo sapiens
tctgcaggaagctggcggctga

SEQ ID NO: 90691 - DNA, 22 bp, Homo sapiens
atgattgaccatctgctgggct

SEQ ID NO: 90692 - DNA, 23 bp, Homo sapiens
ggggcctgcaccggtctgcgcgg

SEQ ID NO: 90693 - DNA, 22 bp, Homo sapiens
ctcctgggaaaggctggacaca

SEQ ID NO: 90694 - DNA, 22 bp, Homo sapiens
catctgctgttccttggactca

SEQ ID NO: 90695 - DNA, 22 bp, Homo sapiens
tgtggcacatacacaggagggc

SEQ ID NO: 90696 - DNA, 22 bp, Homo sapiens
gcccaggaggagaggctgcagt

SEQ ID NO: 90697 - DNA, 22 bp, Homo sapiens
tgatatgtaactactccttata

SEQ ID NO: 90698 - DNA, 22 bp, Homo sapiens
gtcactgtatccaggttccagc

SEQ ID NO: 90699 - DNA, 22 bp, Homo sapiens
gcgggttgaagggcgcatcgaa

SEQ ID NO: 90700 - DNA, 22 bp, Homo sapiens
tctaattttggcattttaacct

SEQ ID NO: 90701 - DNA, 22 bp, Homo sapiens
aagtcagacagctgagctgcct

SEQ ID NO: 90702 - DNA, 22 bp, Homo sapiens
cacttcattgggaccagggctg

SEQ ID NO: 90703 - DNA, 22 bp, Homo sapiens
tttgtcctaacagtggtaaagg

SEQ ID NO: 90704 - DNA, 22 bp, Homo sapiens
aggccaggaatccttgtcccag

SEQ ID NO: 90705 - DNA, 22 bp, Homo sapiens
ggggccgaccgcggttcaggcc

SEQ ID NO: 90706 - DNA, 22 bp, Homo sapiens
tctggagataagcagcaatgaa

SEQ ID NO: 90707 - DNA, 22 bp, Homo sapiens
agagctaagaaacagaattgct

SEQ ID NO: 90708 - DNA, 22 bp, Homo sapiens
gccctcctggcaggcagtgatg

SEQ ID NO: 90709 - DNA, 22 bp, Homo sapiens
gtagggttggagagcacaacca

SEQ ID NO: 90710 - DNA, 22 bp, Homo sapiens
gctgctctcagagctcatgctg

SEQ ID NO: 90711 - DNA, 18 bp, Homo sapiens
ggtgagggagctggaagc

SEQ ID NO: 90712 - DNA, 22 bp, Homo sapiens
tctcctggtacccttcctagca

SEQ ID NO: 90713 - DNA, 22 bp, Homo sapiens
ccacaccatcgtttttacctta

SEQ ID NO: 90714 - DNA, 22 bp, Homo sapiens
ctgggaggcggaggttgcagtg

SEQ ID NO: 90715 - DNA, 22 bp, Homo sapiens
attgtaaatagtgccacaataa

SEQ ID NO: 90716 - DNA, 22 bp, Homo sapiens
aggtggggaggagtgtctcttt

SEQ ID NO: 90717 - DNA, 22 bp, Homo sapiens
ggccctggtcctaggggtggaa

SEQ ID NO: 90718 - DNA, 22 bp, Homo sapiens
agcctggcctgggcaggcacat

SEQ ID NO: 90719 - DNA, 22 bp, Homo sapiens
gggtaattggggccttgcagtg

SEQ ID NO: 90720 - DNA, 22 bp, Homo sapiens
actaggggctcaggcccaggga

SEQ ID NO: 90721 - DNA, 22 bp, Homo sapiens
tgggcgacagagcaagactccg

SEQ ID NO: 90722 - DNA, 22 bp, Homo sapiens
gagagaagggggatatgagcct

SEQ ID NO: 90723 - DNA, 22 bp, Homo sapiens
tccggtccgggtactcctctct

SEQ ID NO: 90724 - DNA, 22 bp, Homo sapiens
ggaggagacagtaaaaagcacg

SEQ ID NO: 90725 - DNA, 17 bp, Homo sapiens
tggtagaatgacaggcc

SEQ ID NO: 90726 - DNA, 22 bp, Homo sapiens
aggctctgtcaggcggagcagc

SEQ ID NO: 90727 - DNA, 22 bp, Homo sapiens
tctttggtttctgtctctgtaa

SEQ ID NO: 90728 - DNA, 22 bp, Homo sapiens
gttggggtgctataaaaatgat

SEQ ID NO: 90729 - DNA, 18 bp, Homo sapiens
acacttcctggtggtgtg

SEQ ID NO: 90730 - DNA, 22 bp, Homo sapiens
cagtctctaaatcaatctgaat

SEQ ID NO: 90731 - DNA, 22 bp, Homo sapiens
atgaccagccgagataaacaga

SEQ ID NO: 90732 - DNA, 22 bp, Homo sapiens
ggaggagcatgagagggtagtg

SEQ ID NO: 90733 - DNA, 22 bp, Homo sapiens
tgaagaaacgcagagaggtagg

SEQ ID NO: 90734 - DNA, 22 bp, Homo sapiens
gggagctgagctggaagagaat

SEQ ID NO: 90735 - DNA, 22 bp, Homo sapiens
tctgcgttgctcacgctgggag

SEQ ID NO: 90736 - DNA, 22 bp, Homo sapiens
acccaataatgcaactccactt

SEQ ID NO: 90737 - DNA, 22 bp, Homo sapiens
gctgtagtgaatggccgcgttc

SEQ ID NO: 90738 - DNA, 22 bp, Homo sapiens
gaggacaagctgtgagtggggt

SEQ ID NO: 90739 - DNA, 22 bp, Homo sapiens
ctgtggctctcagaggctgctg

SEQ ID NO: 90740 - DNA, 22 bp, Homo sapiens
tggggcagttaataaacattct

SEQ ID NO: 90741 - DNA, 22 bp, Homo sapiens
aggcgcctgcgggatccttgcc

SEQ ID NO: 90742 - DNA, 22 bp, Homo sapiens
ggtgccagatgaggcccgcgat

SEQ ID NO: 90743 - DNA, 22 bp, Homo sapiens
ggctcacgcaattatcccggcc

SEQ ID NO: 90744 - DNA, 22 bp, Homo sapiens
tagcccctgcctttgaacctgg

SEQ ID NO: 90745 - DNA, 22 bp, Homo sapiens
cccaggaggcctgcctggccgg

SEQ ID NO: 90746 - DNA, 22 bp, Homo sapiens
acatttatataactcactagga

SEQ ID NO: 90747 - DNA, 22 bp, Homo sapiens
cggctgggttcggctgcaggcc

SEQ ID NO: 90748 - DNA, 22 bp, Homo sapiens
acccaggccattggcaagagtc

SEQ ID NO: 90749 - DNA, 22 bp, Homo sapiens
aatcagaccgttctggctgtcc

SEQ ID NO: 90750 - DNA, 22 bp, Homo sapiens
agtccaaagcagatgagggcca

SEQ ID NO: 90751 - DNA, 22 bp, Homo sapiens
taattataacagttacatctta

SEQ ID NO: 90752 - DNA, 22 bp, Homo sapiens
gtgctggggagataggaagaga

SEQ ID NO: 90753 - DNA, 22 bp, Homo sapiens
ttaatgaaaggcagtttggaac

SEQ ID NO: 90754 - DNA, 22 bp, Homo sapiens
tttattctgtgctacatgaaga

SEQ ID NO: 90755 - DNA, 22 bp, Homo sapiens
gatcctgggcccttctgggtca

SEQ ID NO: 90756 - DNA, 22 bp, Homo sapiens
ctctggaccctcctgctgagag

SEQ ID NO: 90757 - DNA, 18 bp, Homo sapiens
ccctgccagctcccagca

SEQ ID NO: 90758 - DNA, 20 bp, Homo sapiens
ttgagcttttagtacagaca

SEQ ID NO: 90759 - DNA, 22 bp, Homo sapiens
tacagggattgttttaatcacc

SEQ ID NO: 90760 - DNA, 22 bp, Homo sapiens
gggcttcagttctgaccatctt

SEQ ID NO: 90761 - DNA, 22 bp, Homo sapiens
agcatgcgcttgatcagctcca

SEQ ID NO: 90762 - DNA, 22 bp, Homo sapiens
cagcacatgctcatcagggaag

SEQ ID NO: 90763 - DNA, 20 bp, Homo sapiens
tcacatcctctcccaacatg

SEQ ID NO: 90764 - DNA, 22 bp, Homo sapiens
tttattggatatttacaagata

SEQ ID NO: 90765 - DNA, 22 bp, Homo sapiens
ggagaggggaacttgttgcttg

SEQ ID NO: 90766 - DNA, 22 bp, Homo sapiens
tgtgtgattgcaggagatgtgg

SEQ ID NO: 90767 - DNA, 22 bp, Homo sapiens
tttctgagaaattaaacacttt

SEQ ID NO: 90768 - DNA, 22 bp, Homo sapiens
ttgtgctcctgtgagaatctag

SEQ ID NO: 90769 - DNA, 22 bp, Homo sapiens
cagggcctcctaaggcatctaa

SEQ ID NO: 90770 - DNA, 21 bp, Homo sapiens
tctctttctggaagcttccct

SEQ ID NO: 90771 - DNA, 22 bp, Homo sapiens
atggccctaatgagttggtgtt

SEQ ID NO: 90772 - DNA, 22 bp, Homo sapiens
ttttccttcatatcccttatgt

SEQ ID NO: 90773 - DNA, 22 bp, Homo sapiens
cctgggccctcaccgccggtgg

SEQ ID NO: 90774 - DNA, 22 bp, Homo sapiens
ttcagcccaggagttggaggct

SEQ ID NO: 90775 - DNA, 22 bp, Homo sapiens
ggcgctcagtgttgccccagag

SEQ ID NO: 90776 - DNA, 22 bp, Homo sapiens
agctagtatttcattgaggatt

SEQ ID NO: 90777 - DNA, 22 bp, Homo sapiens
tggcagttcaggttggactctt

SEQ ID NO: 90778 - DNA, 22 bp, Homo sapiens
actcaagtcataggcttctttc

SEQ ID NO: 90779 - DNA, 22 bp, Homo sapiens
ccatgtacatgaacacggcggc

SEQ ID NO: 90780 - DNA, 22 bp, Homo sapiens
ggctcactgcaacttccgcctc

SEQ ID NO: 90781 - DNA, 22 bp, Homo sapiens
cagtggcaggatttcagctcag

SEQ ID NO: 90782 - DNA, 22 bp, Homo sapiens
tgcccagggtggagtgcagtgg

SEQ ID NO: 90783 - DNA, 22 bp, Homo sapiens
acctggacacctgctgtcatct

SEQ ID NO: 90784 - DNA, 22 bp, Homo sapiens
cctcccctcagacagagactgg

SEQ ID NO: 90785 - DNA, 22 bp, Homo sapiens
taaagggtaggttttactgtaa

SEQ ID NO: 90786 - DNA, 22 bp, Homo sapiens
acaaacagagttgaaaaatagg

SEQ ID NO: 90787 - DNA, 22 bp, Homo sapiens
tcttgaacttctgcacactcag

SEQ ID NO: 90788 - DNA, 22 bp, Homo sapiens
tgatcagcatcttcccagctcg

SEQ ID NO: 90789 - DNA, 22 bp, Homo sapiens
tatctcattttattgcaaatgt

SEQ ID NO: 90790 - DNA, 22 bp, Homo sapiens
tggtattctttctgtagatcat

SEQ ID NO: 90791 - DNA, 22 bp, Homo sapiens
gcgtccccatcatccagccgta

SEQ ID NO: 90792 - DNA, 22 bp, Homo sapiens
accctaataatcacagactagt

SEQ ID NO: 90793 - DNA, 22 bp, Homo sapiens
gcttccgcgatgtcctaggtgg

SEQ ID NO: 90794 - DNA, 22 bp, Homo sapiens
gtggtgagattgctggatcaaa

SEQ ID NO: 90795 - DNA, 22 bp, Homo sapiens
aggctgaggcaagaggatcact

SEQ ID NO: 90796 - DNA, 22 bp, Homo sapiens
gggatttcaccatgttggttgg

SEQ ID NO: 90797 - DNA, 22 bp, Homo sapiens
gccctgggcaaggttctggcca

SEQ ID NO: 90798 - DNA, 22 bp, Homo sapiens
ctggtaggggtgactgttatcg

SEQ ID NO: 90799 - DNA, 22 bp, Homo sapiens
gggctgggattgcttgctgtga

SEQ ID NO: 90800 - DNA, 22 bp, Homo sapiens
agcatggccatctgggccgtcc

SEQ ID NO: 90801 - DNA, 22 bp, Homo sapiens
tggcatctttgtcccagaagct

SEQ ID NO: 90802 - DNA, 22 bp, Homo sapiens
ctgcaagctacccctagcatca

SEQ ID NO: 90803 - DNA, 22 bp, Homo sapiens
ccagtggctacaggggggttga

SEQ ID NO: 90804 - DNA, 22 bp, Homo sapiens
ctggaggtgcttcgctggccac

SEQ ID NO: 90805 - DNA, 22 bp, Homo sapiens
ggatgttgattgaatggccatt

SEQ ID NO: 90806 - DNA, 21 bp, Homo sapiens
ttaaagcctccctcataagga

SEQ ID NO: 90807 - DNA, 22 bp, Homo sapiens
ctggcaggagcattcacagagg

SEQ ID NO: 90808 - DNA, 22 bp, Homo sapiens
agccaccaccactgaaaggtta

SEQ ID NO: 90809 - DNA, 22 bp, Homo sapiens
ctgaatccacacaaggtgatgg

SEQ ID NO: 90810 - DNA, 22 bp, Homo sapiens
taatatctacttcatagagttt

SEQ ID NO: 90811 - DNA, 22 bp, Homo sapiens
taatcctgtcttgaccatcagg

SEQ ID NO: 90812 - DNA, 22 bp, Homo sapiens
tcagtggagagcttccaggatt

SEQ ID NO: 90813 - DNA, 22 bp, Homo sapiens
ttggaagttgatttaaaaagga

SEQ ID NO: 90814 - DNA, 22 bp, Homo sapiens
tgcagtggcgccatctcagctc

SEQ ID NO: 90815 - DNA, 22 bp, Homo sapiens
actcatgtcctaggagtaaagc

SEQ ID NO: 90816 - DNA, 22 bp, Homo sapiens
ggtcagaggtcccagaagaagc

SEQ ID NO: 90817 - DNA, 22 bp, Homo sapiens
tgatctcctgaccttgtaatcc

SEQ ID NO: 90818 - DNA, 22 bp, Homo sapiens
tcctccccaaagcccagcctgg

SEQ ID NO: 90819 - DNA, 22 bp, Homo sapiens
gggttggcatcagggttctgtg

SEQ ID NO: 90820 - DNA, 22 bp, Homo sapiens
gtgattttcatgccctgctagg

SEQ ID NO: 90821 - DNA, 22 bp, Homo sapiens
tggaagggagctggaatttgga

SEQ ID NO: 90822 - DNA, 22 bp, Homo sapiens
tgtgggtggcatcgtcctggcc

SEQ ID NO: 90823 - DNA, 22 bp, Homo sapiens
aggtgcttggctcgtgcacaca

SEQ ID NO: 90824 - DNA, 22 bp, Homo sapiens
cagtcctgaatactggacggtg

SEQ ID NO: 90825 - DNA, 22 bp, Homo sapiens
ggagcagggaattacagcgcag

SEQ ID NO: 90826 - DNA, 22 bp, Homo sapiens
ggcccagacccaagagtggtgg

SEQ ID NO: 90827 - DNA, 22 bp, Homo sapiens
gcctcctgagtagctgggattg

SEQ ID NO: 90828 - DNA, 22 bp, Homo sapiens
cctagagctctgctttatctaa

SEQ ID NO: 90829 - DNA, 22 bp, Homo sapiens
ctacttgttcactgtaggtcgc

SEQ ID NO: 90830 - DNA, 22 bp, Homo sapiens
gctgtcttgctcactcttgcag

SEQ ID NO: 90831 - DNA, 22 bp, Homo sapiens
aaacccagggttttgtcttccc

SEQ ID NO: 90832 - DNA, 22 bp, Homo sapiens
gatagtcacctcccttaacttt

SEQ ID NO: 90833 - DNA, 22 bp, Homo sapiens
gagctgagaagcagcgcttgat

SEQ ID NO: 90834 - DNA, 22 bp, Homo sapiens
ggcggaggttgcagtaagccga

SEQ ID NO: 90835 - DNA, 22 bp, Homo sapiens
gaggcagaagttgcagtgagca

SEQ ID NO: 90836 - DNA, 22 bp, Homo sapiens
ggcagcactgcagcttgttggg

SEQ ID NO: 90837 - DNA, 22 bp, Homo sapiens
tcctgccttgcctgggacatca

SEQ ID NO: 90838 - DNA, 22 bp, Homo sapiens
gctgacccctacaggttgtgtt

SEQ ID NO: 90839 - DNA, 22 bp, Homo sapiens
ggtttgtggagctggaaacact

SEQ ID NO: 90840 - DNA, 22 bp, Homo sapiens
aggtcaagggagctgagggcca

SEQ ID NO: 90841 - DNA, 22 bp, Homo sapiens
gctcaggtagatggggttgtcc

SEQ ID NO: 90842 - DNA, 22 bp, Homo sapiens
aggatgagccgcgcaagctgac

SEQ ID NO: 90843 - DNA, 22 bp, Homo sapiens
tgtctggatagagcctaggccc

SEQ ID NO: 90844 - DNA, 22 bp, Homo sapiens
caacatggtgaaaccccgtctc

SEQ ID NO: 90845 - DNA, 22 bp, Homo sapiens
ttctccctgtcctatcaagact

SEQ ID NO: 90846 - DNA, 22 bp, Homo sapiens
tctggtgtcagtattctttgaa

SEQ ID NO: 90847 - DNA, 22 bp, Homo sapiens
ctctctgggcccagttggcacc

SEQ ID NO: 90848 - DNA, 22 bp, Homo sapiens
tgggtggcagcttcagcatgtt

SEQ ID NO: 90849 - DNA, 22 bp, Homo sapiens
agcaacctgccagtcactcagt

SEQ ID NO: 90850 - DNA, 22 bp, Homo sapiens
ggggccttttctgaatgtggaa

SEQ ID NO: 90851 - DNA, 22 bp, Homo sapiens
cttcagctgcagttatgtttag

SEQ ID NO: 90852 - DNA, 22 bp, Homo sapiens
aatggggtagtgggcagcctgg

SEQ ID NO: 90853 - DNA, 22 bp, Homo sapiens
gccccagcctcccgagtagctg

SEQ ID NO: 90854 - DNA, 22 bp, Homo sapiens
ctctggactttttgtggattct

SEQ ID NO: 90855 - DNA, 22 bp, Homo sapiens
tgagccagaggaggctgtgtgg

SEQ ID NO: 90856 - DNA, 22 bp, Homo sapiens
ctcactgcaagctctgcctccc

SEQ ID NO: 90857 - DNA, 22 bp, Homo sapiens
ttgccgccgtctgctcgccccg

SEQ ID NO: 90858 - DNA, 22 bp, Homo sapiens
ggggccttggatctgtgccccg

SEQ ID NO: 90859 - DNA, 22 bp, Homo sapiens
caggcaggtcagtgaagaagga

SEQ ID NO: 90860 - DNA, 22 bp, Homo sapiens
ctgtccctgagcaactcctgtt

SEQ ID NO: 90861 - DNA, 22 bp, Homo sapiens
gagcctcgtggcggccactgcg

SEQ ID NO: 90862 - DNA, 22 bp, Homo sapiens
ctgaacttattgagtgcttgct

SEQ ID NO: 90863 - DNA, 22 bp, Homo sapiens
ttatgatttgccacagattggt

SEQ ID NO: 90864 - DNA, 22 bp, Homo sapiens
gctgaaggcccggaggacaggg

SEQ ID NO: 90865 - DNA, 22 bp, Homo sapiens
cccaggaggtcgaagctgcagt

SEQ ID NO: 90866 - DNA, 22 bp, Homo sapiens
cccagaaggtcgaggctgcagt

SEQ ID NO: 90867 - DNA, 20 bp, Homo sapiens
acgtggccaccagtggctta

SEQ ID NO: 90868 - DNA, 22 bp, Homo sapiens
agctggtgctcggggagctggc

SEQ ID NO: 90869 - DNA, 22 bp, Homo sapiens
atgaattgaggaaaacagtcgt

SEQ ID NO: 90870 - DNA, 22 bp, Homo sapiens
aagattttcagtgcctaaaaca

SEQ ID NO: 90871 - DNA, 22 bp, Homo sapiens
tgtccagctcgagacactatct

SEQ ID NO: 90872 - DNA, 20 bp, Homo sapiens
aatgctgcttctttttgcat

SEQ ID NO: 90873 - DNA, 22 bp, Homo sapiens
ccactgcactccagccttggca

SEQ ID NO: 90874 - DNA, 22 bp, Homo sapiens
aggacttagaacattatgtact

SEQ ID NO: 90875 - DNA, 22 bp, Homo sapiens
ctagggtcaggggcctgcgtcg

SEQ ID NO: 90876 - DNA, 22 bp, Homo sapiens
tctgtggcccaagtgatggctg

SEQ ID NO: 90877 - DNA, 22 bp, Homo sapiens
agcggcgccgagcttggccagg

SEQ ID NO: 90878 - DNA, 22 bp, Homo sapiens
gtggcgtgatctcggctcactg

SEQ ID NO: 90879 - DNA, 22 bp, Homo sapiens
cttaatctcacctgcaaagtcc

SEQ ID NO: 90880 - DNA, 22 bp, Homo sapiens
tgcagcaccgtcccactggcta

SEQ ID NO: 90881 - DNA, 22 bp, Homo sapiens
gagcccaggagtttgatgctgc

SEQ ID NO: 90882 - DNA, 22 bp, Homo sapiens
cggggccctggggctgaaggtc

SEQ ID NO: 90883 - DNA, 22 bp, Homo sapiens
agtgggtgacagtgaacacgta

SEQ ID NO: 90884 - DNA, 22 bp, Homo sapiens
tgccacagacaggacagaacag

SEQ ID NO: 90885 - DNA, 22 bp, Homo sapiens
ctgtcctgtgctttttactgtc

SEQ ID NO: 90886 - DNA, 22 bp, Homo sapiens
cctaggagttcgaagctgcagt

SEQ ID NO: 90887 - DNA, 22 bp, Homo sapiens
gtccctgagcctggcatttccc

SEQ ID NO: 90888 - DNA, 22 bp, Homo sapiens
ctgagggtcaacttgattgtat

SEQ ID NO: 90889 - DNA, 22 bp, Homo sapiens
gatcagagccagagatgataac

SEQ ID NO: 90890 - DNA, 22 bp, Homo sapiens
tgggcttggtttctaggtaggt

SEQ ID NO: 90891 - DNA, 22 bp, Homo sapiens
gaggtgggtgtatcacaggtca

SEQ ID NO: 90892 - DNA, 22 bp, Homo sapiens
caggcacggtggctcatgcctg

SEQ ID NO: 90893 - DNA, 22 bp, Homo sapiens
gtgctccctccttcctcaagga

SEQ ID NO: 90894 - DNA, 22 bp, Homo sapiens
tgtgaatggacaattaaatcta

SEQ ID NO: 90895 - DNA, 22 bp, Homo sapiens
aagccaatgctagcccacatgc

SEQ ID NO: 90896 - DNA, 22 bp, Homo sapiens
atgagaaagttaatcatcatga

SEQ ID NO: 90897 - DNA, 22 bp, Homo sapiens
gagtagaactggttatctaata

SEQ ID NO: 90898 - DNA, 22 bp, Homo sapiens
gtctgctcatgctaccgcgggc

SEQ ID NO: 90899 - DNA, 17 bp, Homo sapiens
tgtatttatcatgtcag

SEQ ID NO: 90900 - DNA, 22 bp, Homo sapiens
ctctgcaacttctagcagtgtc

SEQ ID NO: 90901 - DNA, 22 bp, Homo sapiens
cactgcactccagcctcggtga

SEQ ID NO: 90902 - DNA, 22 bp, Homo sapiens
ccggtgttcaaagtctggtatg

SEQ ID NO: 90903 - DNA, 22 bp, Homo sapiens
aggccagcctcaggcagggacc

SEQ ID NO: 90904 - DNA, 22 bp, Homo sapiens
agcattccacactgaagtctgc

SEQ ID NO: 90905 - DNA, 22 bp, Homo sapiens
ggggcaggagcccttcttcagc

SEQ ID NO: 90906 - DNA, 22 bp, Homo sapiens
tggtggcactgacatcagacac

SEQ ID NO: 90907 - DNA, 22 bp, Homo sapiens
gtgcccagcagcagcgtccccg

SEQ ID NO: 90908 - DNA, 22 bp, Homo sapiens
ttccacggggctccccgctctt

SEQ ID NO: 90909 - DNA, 22 bp, Homo sapiens
ggcaggaggtgagtggcgggtg

SEQ ID NO: 90910 - DNA, 22 bp, Homo sapiens
tgagatggagtctcactctgtt

SEQ ID NO: 90911 - DNA, 22 bp, Homo sapiens
aaggatgattggtaatgacact

SEQ ID NO: 90912 - DNA, 22 bp, Homo sapiens
catataaatacaacatgtgtta

SEQ ID NO: 90913 - DNA, 22 bp, Homo sapiens
tcctgggtccatggcagccgaa

SEQ ID NO: 90914 - DNA, 22 bp, Homo sapiens
caggccctgtgctgggtgatgt

SEQ ID NO: 90915 - DNA, 22 bp, Homo sapiens
ccaggagttggaggttgcagtg

SEQ ID NO: 90916 - DNA, 22 bp, Homo sapiens
ttaaattttagaaacagactct

SEQ ID NO: 90917 - DNA, 22 bp, Homo sapiens
gggcaggaacaaatcaaatgat

SEQ ID NO: 90918 - DNA, 22 bp, Homo sapiens
atattacacacggtatcacggg

SEQ ID NO: 90919 - DNA, 22 bp, Homo sapiens
tagatacctgctggacctcatt

SEQ ID NO: 90920 - DNA, 22 bp, Homo sapiens
cccattcatcctcgcttccttc

SEQ ID NO: 90921 - DNA, 22 bp, Homo sapiens
ccaggagttggaggctgcagtg

SEQ ID NO: 90922 - DNA, 22 bp, Homo sapiens
atgcattgtcaggcaatttcat

SEQ ID NO: 90923 - DNA, 22 bp, Homo sapiens
gggctgtaggagctggaatggg

SEQ ID NO: 90924 - DNA, 21 bp, Homo sapiens
cagaggcctatcacagactcc

SEQ ID NO: 90925 - DNA, 22 bp, Homo sapiens
ctgcattaagttgcctgtaaga

SEQ ID NO: 90926 - DNA, 22 bp, Homo sapiens
cactgcacttcagcctgggtga

SEQ ID NO: 90927 - DNA, 22 bp, Homo sapiens
gctcccaccttaaccttcacat

SEQ ID NO: 90928 - DNA, 22 bp, Homo sapiens
tctgacattagattaattggaa

SEQ ID NO: 90929 - DNA, 22 bp, Homo sapiens
ctggtagtttgcaaaatggtgt

SEQ ID NO: 90930 - DNA, 22 bp, Homo sapiens
cacccaggttggagtgcagtgg

SEQ ID NO: 90931 - DNA, 22 bp, Homo sapiens
agggaacatttgcactgttggt

SEQ ID NO: 90932 - DNA, 22 bp, Homo sapiens
cctggctgacagcttaattcca

SEQ ID NO: 90933 - DNA, 22 bp, Homo sapiens
cttctcttcctttgtcaactga

SEQ ID NO: 90934 - DNA, 19 bp, Homo sapiens
gggaatgatggaagacttc

SEQ ID NO: 90935 - DNA, 22 bp, Homo sapiens
actgggcagcagctcgagccgc

SEQ ID NO: 90936 - DNA, 22 bp, Homo sapiens
gattgagtctgaggatgctgca

SEQ ID NO: 90937 - DNA, 22 bp, Homo sapiens
tcccaatagcctaagagcctgg

SEQ ID NO: 90938 - DNA, 22 bp, Homo sapiens
ggagtgactctcggggccacta

SEQ ID NO: 90939 - DNA, 22 bp, Homo sapiens
ggtgaggggctcctctgcccgg

SEQ ID NO: 90940 - DNA, 22 bp, Homo sapiens
aacccaggagatggaggttgtg

SEQ ID NO: 90941 - DNA, 22 bp, Homo sapiens
ttttctcttccctctggacctg

SEQ ID NO: 90942 - DNA, 22 bp, Homo sapiens
cgtgccctgcgcaagtgctgct

SEQ ID NO: 90943 - DNA, 22 bp, Homo sapiens
aaaaatcacttttataggcagc

SEQ ID NO: 90944 - DNA, 22 bp, Homo sapiens
tcttgccacttcatcccctttc

SEQ ID NO: 90945 - DNA, 18 bp, Homo sapiens
atggtctcatactgggag

SEQ ID NO: 90946 - DNA, 22 bp, Homo sapiens
tggcacagactgggccaaggaa

SEQ ID NO: 90947 - DNA, 22 bp, Homo sapiens
gctcaagacccctctgtgactg

SEQ ID NO: 90948 - DNA, 22 bp, Homo sapiens
caggagctcagatgacatctca

SEQ ID NO: 90949 - DNA, 22 bp, Homo sapiens
agtgagtttagggtgcaggtgt

SEQ ID NO: 90950 - DNA, 22 bp, Homo sapiens
gcaaaagtacagccggatttct

SEQ ID NO: 90951 - DNA, 22 bp, Homo sapiens
gcagctggaagtgacactctgt

SEQ ID NO: 90952 - DNA, 22 bp, Homo sapiens
cggcccgctgcgagtgcaccgt

SEQ ID NO: 90953 - DNA, 22 bp, Homo sapiens
tgtttctgtatgatcaatattg

SEQ ID NO: 90954 - DNA, 22 bp, Homo sapiens
ctgaaatgacggtttggggcaa

SEQ ID NO: 90955 - DNA, 22 bp, Homo sapiens
gattcactcatattttacgttt

SEQ ID NO: 90956 - DNA, 22 bp, Homo sapiens
cagaggtagcatgctgtggctt

SEQ ID NO: 90957 - DNA, 22 bp, Homo sapiens
ccaggagttggaggctgcagtg

SEQ ID NO: 90958 - DNA, 22 bp, Homo sapiens
acttcttcttcagctgggggat

SEQ ID NO: 90959 - DNA, 19 bp, Homo sapiens
gccttcccaccacccgtcc

SEQ ID NO: 90960 - DNA, 22 bp, Homo sapiens
tgcactccaggctgggtgacag

SEQ ID NO: 90961 - DNA, 22 bp, Homo sapiens
ctgaattatttaaggtgaaggg

SEQ ID NO: 90962 - DNA, 22 bp, Homo sapiens
gggcatggtggcaggcacctgt

SEQ ID NO: 90963 - DNA, 22 bp, Homo sapiens
ttcctggaaattatgctcacct

SEQ ID NO: 90964 - DNA, 22 bp, Homo sapiens
agcctagggttctgatgtcact

SEQ ID NO: 90965 - DNA, 22 bp, Homo sapiens
acgatgatgaaagagaacattc

SEQ ID NO: 90966 - DNA, 22 bp, Homo sapiens
ccctcccaggagtggccagaga

SEQ ID NO: 90967 - DNA, 22 bp, Homo sapiens
tacagtgcttggtatctagtaa

SEQ ID NO: 90968 - DNA, 22 bp, Homo sapiens
cccagggaggcccaggctctgc

SEQ ID NO: 90969 - DNA, 21 bp, Homo sapiens
tagcccttctccacctcgccc

SEQ ID NO: 90970 - DNA, 22 bp, Homo sapiens
gggatttcaccatgttggttgg

SEQ ID NO: 90971 - DNA, 22 bp, Homo sapiens
tctgtagtaggttgtagttctt

SEQ ID NO: 90972 - DNA, 22 bp, Homo sapiens
cctgcagacacttgtccagcaa

SEQ ID NO: 90973 - DNA, 22 bp, Homo sapiens
taaatacttagttttgtgtcta

SEQ ID NO: 90974 - DNA, 22 bp, Homo sapiens
cgcggtggcggcctccagcgcc

SEQ ID NO: 90975 - DNA, 22 bp, Homo sapiens
ggccactgctctccagcctggg

SEQ ID NO: 90976 - DNA, 22 bp, Homo sapiens
gggagtgggtttggcctaggcc

SEQ ID NO: 90977 - DNA, 22 bp, Homo sapiens
cgcccaggctggagagcagtgg

SEQ ID NO: 90978 - DNA, 18 bp, Homo sapiens
tgtagagccaggtttgcc

SEQ ID NO: 90979 - DNA, 22 bp, Homo sapiens
gacctggtccttgtactttgaa

SEQ ID NO: 90980 - DNA, 22 bp, Homo sapiens
agggcgacaatggagagcgttt

SEQ ID NO: 90981 - DNA, 22 bp, Homo sapiens
tcttgggggactttggcatgga

SEQ ID NO: 90982 - DNA, 22 bp, Homo sapiens
ccaggaggtggagattgcagtg

SEQ ID NO: 90983 - DNA, 22 bp, Homo sapiens
ctgtaatcccagctacctggga

SEQ ID NO: 90984 - DNA, 22 bp, Homo sapiens
tgaagctttaggatgggttcat

SEQ ID NO: 90985 - DNA, 22 bp, Homo sapiens
gcataaactccaaaaggcaggg

SEQ ID NO: 90986 - DNA, 22 bp, Homo sapiens
ctgtgctccctctggcgccccg

SEQ ID NO: 90987 - DNA, 22 bp, Homo sapiens
agttgcagacgcagagatgttg

SEQ ID NO: 90988 - DNA, 22 bp, Homo sapiens
tgtcaccttgctcatcctcgga

SEQ ID NO: 90989 - DNA, 21 bp, Homo sapiens
cgtgactgggtccgtctggct

SEQ ID NO: 90990 - DNA, 22 bp, Homo sapiens
tagcacagagcttttaaacttc

SEQ ID NO: 90991 - DNA, 23 bp, Homo sapiens
ccagtgattgcctggaaggaggt

SEQ ID NO: 90992 - DNA, 22 bp, Homo sapiens
cccagctcttcaagtcaccccc

SEQ ID NO: 90993 - DNA, 22 bp, Homo sapiens
aggacctactgatatcttagca

SEQ ID NO: 90994 - DNA, 22 bp, Homo sapiens
gcactttgcccctcctttggca

SEQ ID NO: 90995 - DNA, 20 bp, Homo sapiens
aaacgagccatcattctggt

SEQ ID NO: 90996 - DNA, 22 bp, Homo sapiens
gtccaaaagagccagccgggcg

SEQ ID NO: 90997 - DNA, 22 bp, Homo sapiens
ggtgtgtctgccaggaactgca

SEQ ID NO: 90998 - DNA, 22 bp, Homo sapiens
gcgctgaggctggaggcgcacg

SEQ ID NO: 90999 - DNA, 22 bp, Homo sapiens
gcctgtgtctgggtggccagag

SEQ ID NO: 91000 - DNA, 22 bp, Homo sapiens
ttaataaagtatgaattggaaa

SEQ ID NO: 91001 - DNA, 22 bp, Homo sapiens
gggatctgggacaacaggtggt

SEQ ID NO: 91002 - DNA, 22 bp, Homo sapiens
gtgggacaggtcaaatcttaaa

SEQ ID NO: 91003 - DNA, 22 bp, Homo sapiens
atgtttaaagggttgagaaata

SEQ ID NO: 91004 - DNA, 22 bp, Homo sapiens
aggggcacgagtagagctctag

SEQ ID NO: 91005 - DNA, 22 bp, Homo sapiens
tgggaaggggagctggaaagga

SEQ ID NO: 91006 - DNA, 22 bp, Homo sapiens
ttgagaaccactgagttagata

SEQ ID NO: 91007 - DNA, 22 bp, Homo sapiens
aaagtgctgtgattacaggcat

SEQ ID NO: 91008 - DNA, 22 bp, Homo sapiens
aggctggagtgcagtggtgtga

SEQ ID NO: 91009 - DNA, 22 bp, Homo sapiens
acgtggcggccgccgtgagcgg

SEQ ID NO: 91010 - DNA, 22 bp, Homo sapiens
ttagctcagaaaatttaaactt

SEQ ID NO: 91011 - DNA, 22 bp, Homo sapiens
caggagatgacagggaagaacc

SEQ ID NO: 91012 - DNA, 22 bp, Homo sapiens
tatgaagtgatgttgaattttg

SEQ ID NO: 91013 - DNA, 22 bp, Homo sapiens
cctcaccttcccagagacgatc

SEQ ID NO: 91014 - DNA, 20 bp, Homo sapiens
aagacaccagtggcagcccc

SEQ ID NO: 91015 - DNA, 22 bp, Homo sapiens
gtatgtgaggttggtttccagg

SEQ ID NO: 91016 - DNA, 22 bp, Homo sapiens
tccagggagagccgctgctcca

SEQ ID NO: 91017 - DNA, 22 bp, Homo sapiens
cacccaggctggattgcagtgg

SEQ ID NO: 91018 - DNA, 22 bp, Homo sapiens
cagtcaccttgaggactcagac

SEQ ID NO: 91019 - DNA, 22 bp, Homo sapiens
ccgggctggagtgcaatggctc

SEQ ID NO: 91020 - DNA, 22 bp, Homo sapiens
aatgccttggagagcctagagg

SEQ ID NO: 91021 - DNA, 22 bp, Homo sapiens
tgttatatctaaatagccacat

SEQ ID NO: 91022 - DNA, 22 bp, Homo sapiens
agtggcaggatctcggttcact

SEQ ID NO: 91023 - DNA, 22 bp, Homo sapiens
agacagggtgatcgcttgagcc

SEQ ID NO: 91024 - DNA, 22 bp, Homo sapiens
ggagagcttggagtgcgatttt

SEQ ID NO: 91025 - DNA, 22 bp, Homo sapiens
gaagccagtgtttgaagaattt

SEQ ID NO: 91026 - DNA, 22 bp, Homo sapiens
atgctctctgtcctgctcagag

SEQ ID NO: 91027 - DNA, 16 bp, Homo sapiens
atgctgctattagagg

SEQ ID NO: 91028 - DNA, 22 bp, Homo sapiens
gaggcctgggcaagggggtctg

SEQ ID NO: 91029 - DNA, 22 bp, Homo sapiens
tcccgtcttgctgttgtctgcg

SEQ ID NO: 91030 - DNA, 22 bp, Homo sapiens
ttgtgaatagtgctgcaataaa

SEQ ID NO: 91031 - DNA, 22 bp, Homo sapiens
atacaaaaattagccgggagta

SEQ ID NO: 91032 - DNA, 22 bp, Homo sapiens
tgagatcattgacttgttcctg

SEQ ID NO: 91033 - DNA, 22 bp, Homo sapiens
ttatttaatgtgatctgaagag

SEQ ID NO: 91034 - DNA, 22 bp, Homo sapiens
aatgtcctggagggcggccgct

SEQ ID NO: 91035 - DNA, 22 bp, Homo sapiens
agctggaattacaggcacgcac

SEQ ID NO: 91036 - DNA, 19 bp, Homo sapiens
gactccaactttaagcatg

SEQ ID NO: 91037 - DNA, 22 bp, Homo sapiens
ttccaatagtgtgaccttatag

SEQ ID NO: 91038 - DNA, 22 bp, Homo sapiens
tgggattcaccatgggcttcag

SEQ ID NO: 91039 - DNA, 22 bp, Homo sapiens
tgaagcaaattgtttagcctga

SEQ ID NO: 91040 - DNA, 22 bp, Homo sapiens
ccggctactcgggaggctgacg

SEQ ID NO: 91041 - DNA, 22 bp, Homo sapiens
gccagtggtcactgaggaagaa

SEQ ID NO: 91042 - DNA, 22 bp, Homo sapiens
aggtgactggtttatctggcag

SEQ ID NO: 91043 - DNA, 22 bp, Homo sapiens
tgatatgggaaaagggctcgga

SEQ ID NO: 91044 - DNA, 22 bp, Homo sapiens
ctaggtgatccactgctctctt

SEQ ID NO: 91045 - DNA, 22 bp, Homo sapiens
aggtcaccatggcatgctccac

SEQ ID NO: 91046 - DNA, 22 bp, Homo sapiens
gatgcacggtcatgtcttttca

SEQ ID NO: 91047 - DNA, 22 bp, Homo sapiens
gacctggttgactgtgagcagg

SEQ ID NO: 91048 - DNA, 22 bp, Homo sapiens
tgtggttttggttcagaaacaa

SEQ ID NO: 91049 - DNA, 22 bp, Homo sapiens
tgctgctgaggctaaagtatag

SEQ ID NO: 91050 - DNA, 22 bp, Homo sapiens
agccctcgtttctgcatcctgt

SEQ ID NO: 91051 - DNA, 22 bp, Homo sapiens
tgatatgcatgtaagggagaca

SEQ ID NO: 91052 - DNA, 22 bp, Homo sapiens
tggggccatctcacccactgtt

SEQ ID NO: 91053 - DNA, 22 bp, Homo sapiens
aaggcaaaagaggtgtcatcac

SEQ ID NO: 91054 - DNA, 22 bp, Homo sapiens
gaagaaagatcaaatagtttcc

SEQ ID NO: 91055 - DNA, 22 bp, Homo sapiens
caggcagaagaagtggaaggac

SEQ ID NO: 91056 - DNA, 22 bp, Homo sapiens
tatcacagccttttggtgaggg

SEQ ID NO: 91057 - DNA, 22 bp, Homo sapiens
atttcacttagtgtaatgtctt

SEQ ID NO: 91058 - DNA, 22 bp, Homo sapiens
gagcccaggcagaggttgcagt

SEQ ID NO: 91059 - DNA, 22 bp, Homo sapiens
aagtggactaatacaaggacta

SEQ ID NO: 91060 - DNA, 22 bp, Homo sapiens
cagctggcgactctcctcgatg

SEQ ID NO: 91061 - DNA, 22 bp, Homo sapiens
tgggaagctgcattttaacaag

SEQ ID NO: 91062 - DNA, 22 bp, Homo sapiens
cagagcttcctgctgggcttct

SEQ ID NO: 91063 - DNA, 22 bp, Homo sapiens
tgacagtgcgggtacatcatag

SEQ ID NO: 91064 - DNA, 20 bp, Homo sapiens
aaattactgccacacatttc

SEQ ID NO: 91065 - DNA, 22 bp, Homo sapiens
tgaaggtgggaattcaccaggt

SEQ ID NO: 91066 - DNA, 22 bp, Homo sapiens
agatgcagtggttaacaataca

SEQ ID NO: 91067 - DNA, 22 bp, Homo sapiens
taaaggtagtgtgacatattgt

SEQ ID NO: 91068 - DNA, 22 bp, Homo sapiens
gcactgcaggtgggtggagagg

SEQ ID NO: 91069 - DNA, 22 bp, Homo sapiens
agccggccatgtggtcttgtgc

SEQ ID NO: 91070 - DNA, 22 bp, Homo sapiens
ctctcagtcctgcgcgcctctg

SEQ ID NO: 91071 - DNA, 22 bp, Homo sapiens
ggctcactgcaacttccgcctc

SEQ ID NO: 91072 - DNA, 16 bp, Homo sapiens
tggggatggggaagag

SEQ ID NO: 91073 - DNA, 22 bp, Homo sapiens
ggccagcctggggctcccagac

SEQ ID NO: 91074 - DNA, 22 bp, Homo sapiens
aggtcaagagtaaatttgggta

SEQ ID NO: 91075 - DNA, 22 bp, Homo sapiens
tctctatttgcctaggcttgtg

SEQ ID NO: 91076 - DNA, 22 bp, Homo sapiens
aagctgtagcttttcaaaacgt

SEQ ID NO: 91077 - DNA, 22 bp, Homo sapiens
gacagctccagctcctccaggc

SEQ ID NO: 91078 - DNA, 22 bp, Homo sapiens
cgtgcgcctcagcctcgtgcgc

SEQ ID NO: 91079 - DNA, 22 bp, Homo sapiens
aaagcagaggttgcagtgagct

SEQ ID NO: 91080 - DNA, 22 bp, Homo sapiens
attgcactccggcctgggtgac

SEQ ID NO: 91081 - DNA, 22 bp, Homo sapiens
gaggggcacagtaaagggtccc

SEQ ID NO: 91082 - DNA, 22 bp, Homo sapiens
tatcacatttggagatttatga

SEQ ID NO: 91083 - DNA, 22 bp, Homo sapiens
gcctccggagtcacagtgtctt

SEQ ID NO: 91084 - DNA, 22 bp, Homo sapiens
tgaagaaacgcagagaggtagg

SEQ ID NO: 91085 - DNA, 22 bp, Homo sapiens
caggccagggttgagaagagaa

SEQ ID NO: 91086 - DNA, 22 bp, Homo sapiens
agccagggacgctgcaggctac

SEQ ID NO: 91087 - DNA, 22 bp, Homo sapiens
gacctcgtgatccgcccgcttt

SEQ ID NO: 91088 - DNA, 22 bp, Homo sapiens
ggtcagccttggatttggtagc

SEQ ID NO: 91089 - DNA, 22 bp, Homo sapiens
gtagaggggtgattctgtgaga

SEQ ID NO: 91090 - DNA, 22 bp, Homo sapiens
ttatagcagcatgatttataat

SEQ ID NO: 91091 - DNA, 22 bp, Homo sapiens
agttcgagatctgctgatgaga

SEQ ID NO: 91092 - DNA, 22 bp, Homo sapiens
ctgggaggcggaggttgtagtg

SEQ ID NO: 91093 - DNA, 22 bp, Homo sapiens
attcactgtgggtcctttggat

SEQ ID NO: 91094 - DNA, 22 bp, Homo sapiens
aaggagcgcttagggggcagaa

SEQ ID NO: 91095 - DNA, 22 bp, Homo sapiens
ctccaacgaggctggggtacaa

SEQ ID NO: 91096 - DNA, 22 bp, Homo sapiens
gcaccctgtcaaaatggaccaa

SEQ ID NO: 91097 - DNA, 22 bp, Homo sapiens
tgggggctgggatgtcactttc

SEQ ID NO: 91098 - DNA, 22 bp, Homo sapiens
aagtgctgggattacaggggtg

SEQ ID NO: 91099 - DNA, 22 bp, Homo sapiens
gggattacagatgtgagccatt

SEQ ID NO: 91100 - DNA, 22 bp, Homo sapiens
atcgatcccgcgtaaggccccg

SEQ ID NO: 91101 - DNA, 19 bp, Homo sapiens
caggcctcttaccctctct

SEQ ID NO: 91102 - DNA, 22 bp, Homo sapiens
gggagctggagctggaagactc

SEQ ID NO: 91103 - DNA, 22 bp, Homo sapiens
gctggagaggatcccaaagcca

SEQ ID NO: 91104 - DNA, 22 bp, Homo sapiens
gaggggtccaggaggcacttac

SEQ ID NO: 91105 - DNA, 22 bp, Homo sapiens
caaagtgctggaattacaggtg

SEQ ID NO: 91106 - DNA, 22 bp, Homo sapiens
ggggctgaacctggaggtggtc

SEQ ID NO: 91107 - DNA, 22 bp, Homo sapiens
actttaattaatgaactgtggc

SEQ ID NO: 91108 - DNA, 22 bp, Homo sapiens
gtatagaaacccagaaagatag

SEQ ID NO: 91109 - DNA, 22 bp, Homo sapiens
ggttctctaactttgactggag

SEQ ID NO: 91110 - DNA, 22 bp, Homo sapiens
atcttcccaggctggggagagg

SEQ ID NO: 91111 - DNA, 22 bp, Homo sapiens
tgatgggaggtgctgcaggacc

SEQ ID NO: 91112 - DNA, 22 bp, Homo sapiens
ggtgggagagcttgctttgatg

SEQ ID NO: 91113 - DNA, 22 bp, Homo sapiens
tacttttcctggaaccactgct

SEQ ID NO: 91114 - DNA, 22 bp, Homo sapiens
acttaccagagaggatccgccc

SEQ ID NO: 91115 - DNA, 22 bp, Homo sapiens
ggagtagctgcattccgagcac

SEQ ID NO: 91116 - DNA, 22 bp, Homo sapiens
atacaaagtattaatcctggat

SEQ ID NO: 91117 - DNA, 22 bp, Homo sapiens
ggcggtctcagcaccctcttgg

SEQ ID NO: 91118 - DNA, 22 bp, Homo sapiens
ttcagcagtgcagacacccagt

SEQ ID NO: 91119 - DNA, 22 bp, Homo sapiens
cctttcccgctttgagggcaag

SEQ ID NO: 91120 - DNA, 22 bp, Homo sapiens
gtctccttgtggatctcaagga

SEQ ID NO: 91121 - DNA, 23 bp, Homo sapiens
tgagctgggcctgcaggggtctc

SEQ ID NO: 91122 - DNA, 22 bp, Homo sapiens
cgggagcctctgggtcacactg

SEQ ID NO: 91123 - DNA, 22 bp, Homo sapiens
gtggcccaggttggagtgcagt

SEQ ID NO: 91124 - DNA, 22 bp, Homo sapiens
aggcaacttttggggatgatgg

SEQ ID NO: 91125 - DNA, 22 bp, Homo sapiens
ggcttagcaactcctgaggctc

SEQ ID NO: 91126 - DNA, 22 bp, Homo sapiens
ccacaggggcccacgagccgct

SEQ ID NO: 91127 - DNA, 22 bp, Homo sapiens
aagatattcaaagatttattag

SEQ ID NO: 91128 - DNA, 22 bp, Homo sapiens
gaggtgggtgtatcacaggtca

SEQ ID NO: 91129 - DNA, 22 bp, Homo sapiens
agagctccagggttttgtagtg

SEQ ID NO: 91130 - DNA, 18 bp, Homo sapiens
tggtcactgtggatagtg

SEQ ID NO: 91131 - DNA, 22 bp, Homo sapiens
tcttcctgtcaatgagaattaa

SEQ ID NO: 91132 - DNA, 22 bp, Homo sapiens
ggaggcggaggttgcagtgagc

SEQ ID NO: 91133 - DNA, 22 bp, Homo sapiens
ttgagcccaggaggcctgggtg

SEQ ID NO: 91134 - DNA, 22 bp, Homo sapiens
gactccccacgttaaggaatgt

SEQ ID NO: 91135 - DNA, 20 bp, Homo sapiens
acctcctggcgggcatcctc

SEQ ID NO: 91136 - DNA, 22 bp, Homo sapiens
gatataggttcatagtgttaca

SEQ ID NO: 91137 - DNA, 22 bp, Homo sapiens
tctctagtctcctttaacctga

SEQ ID NO: 91138 - DNA, 22 bp, Homo sapiens
ctcagcagtatactctgaagat

SEQ ID NO: 91139 - DNA, 22 bp, Homo sapiens
agaatagaattctcatagaatt

SEQ ID NO: 91140 - DNA, 21 bp, Homo sapiens
tgctccaggagggggcagtcc

SEQ ID NO: 91141 - DNA, 22 bp, Homo sapiens
ggagctcctggcagtgacagag

SEQ ID NO: 91142 - DNA, 21 bp, Homo sapiens
agtagtttagcacagggtttg

SEQ ID NO: 91143 - DNA, 23 bp, Homo sapiens
actcgtggaattctctgcgatcg

SEQ ID NO: 91144 - DNA, 22 bp, Homo sapiens
ctttttcctcgtagagcctaat

SEQ ID NO: 91145 - DNA, 22 bp, Homo sapiens
ctggcagagttgggtctcaaat

SEQ ID NO: 91146 - DNA, 22 bp, Homo sapiens
gttgcagatgtggaactcgtgc

SEQ ID NO: 91147 - DNA, 18 bp, Homo sapiens
cttttcccctttggactc

SEQ ID NO: 91148 - DNA, 22 bp, Homo sapiens
gagagtctaggaacctcatata

SEQ ID NO: 91149 - DNA, 22 bp, Homo sapiens
gctggcaaggtgctggagggcc

SEQ ID NO: 91150 - DNA, 22 bp, Homo sapiens
gaaagcatccgcctggaggtgg

SEQ ID NO: 91151 - DNA, 22 bp, Homo sapiens
gcccagcccagaaaggttcgga

SEQ ID NO: 91152 - DNA, 22 bp, Homo sapiens
tcctgggatcaagtgatcctcc

SEQ ID NO: 91153 - DNA, 22 bp, Homo sapiens
aggggtgacacatatcagtgca

SEQ ID NO: 91154 - DNA, 20 bp, Homo sapiens
tttgagaccagtctgcccaa

SEQ ID NO: 91155 - DNA, 22 bp, Homo sapiens
cacctgtacagggccgggctgg

SEQ ID NO: 91156 - DNA, 22 bp, Homo sapiens
ccctcaggtgaaaggaaaaatt

SEQ ID NO: 91157 - DNA, 22 bp, Homo sapiens
ccaggagtgcagggatggtatc

SEQ ID NO: 91158 - DNA, 22 bp, Homo sapiens
ccaaccagctatggaatcttgt

SEQ ID NO: 91159 - DNA, 22 bp, Homo sapiens
ttaaattttagaaacagactct

SEQ ID NO: 91160 - DNA, 22 bp, Homo sapiens
atgtatatgcatgcattcaaag

SEQ ID NO: 91161 - DNA, 23 bp, Homo sapiens
ggatggacgtgatgccttagcca

SEQ ID NO: 91162 - DNA, 22 bp, Homo sapiens
aatatttccaaggcctgtcagg

SEQ ID NO: 91163 - DNA, 22 bp, Homo sapiens
ggctcctgggggtgctcctgcc

SEQ ID NO: 91164 - DNA, 19 bp, Homo sapiens
gagaaagcaggcacagcac

SEQ ID NO: 91165 - DNA, 22 bp, Homo sapiens
ctgcttctagcaccaagtccct

SEQ ID NO: 91166 - DNA, 22 bp, Homo sapiens
cactgcactccagcctgcgcaa

SEQ ID NO: 91167 - DNA, 22 bp, Homo sapiens
tttaggttttttcacgtggcta

SEQ ID NO: 91168 - DNA, 22 bp, Homo sapiens
tctggagataagcagcaatgaa

SEQ ID NO: 91169 - DNA, 22 bp, Homo sapiens
cttgcagtttaggtcctctgtg

SEQ ID NO: 91170 - DNA, 22 bp, Homo sapiens
agtcaggggatctagacttgaa

SEQ ID NO: 91171 - DNA, 22 bp, Homo sapiens
tgatctttggtaatctggcaca

SEQ ID NO: 91172 - DNA, 22 bp, Homo sapiens
tagtaacccacacaacagtaga

SEQ ID NO: 91173 - DNA, 22 bp, Homo sapiens
aaagaaatagatggcatttaaa

SEQ ID NO: 91174 - DNA, 22 bp, Homo sapiens
aacccacaaaggatttcagctc

SEQ ID NO: 91175 - DNA, 22 bp, Homo sapiens
aggattgtgcctccagtcagaa

SEQ ID NO: 91176 - DNA, 22 bp, Homo sapiens
catgagataatttttctccagt

SEQ ID NO: 91177 - DNA, 22 bp, Homo sapiens
cctgagagcattccacactgaa

SEQ ID NO: 91178 - DNA, 22 bp, Homo sapiens
tcacttcccagacggggtggca

SEQ ID NO: 91179 - DNA, 20 bp, Homo sapiens
aggggcacctgcgacggggc

SEQ ID NO: 91180 - DNA, 22 bp, Homo sapiens
actgattgcattcatagggttt

SEQ ID NO: 91181 - DNA, 22 bp, Homo sapiens
aaagatgttgctgctccgccct

SEQ ID NO: 91182 - DNA, 22 bp, Homo sapiens
cacttcattgggaccagggctg

SEQ ID NO: 91183 - DNA, 22 bp, Homo sapiens
aggaagatgtgcaaagttggaa

SEQ ID NO: 91184 - DNA, 22 bp, Homo sapiens
tccaactttctcctccggcttg

SEQ ID NO: 91185 - DNA, 22 bp, Homo sapiens
gtgcaaaagtaattgtggtttt

SEQ ID NO: 91186 - DNA, 23 bp, Homo sapiens
ggcctcagtgatgatgggttaaa

SEQ ID NO: 91187 - DNA, 22 bp, Homo sapiens
taaatgttgtaagtacatctaa

SEQ ID NO: 91188 - DNA, 22 bp, Homo sapiens
gggcaggggtcagtggccccaa

SEQ ID NO: 91189 - DNA, 22 bp, Homo sapiens
aggtacatggggtgtgtgcacg

SEQ ID NO: 91190 - DNA, 22 bp, Homo sapiens
gtgtttggtcagacgtccgggg

SEQ ID NO: 91191 - DNA, 22 bp, Homo sapiens
cacaaaccttctgcagcctgta

SEQ ID NO: 91192 - DNA, 22 bp, Homo sapiens
ggttggacactaggtaggagcg

SEQ ID NO: 91193 - DNA, 22 bp, Homo sapiens
aggaaataagggacaagacaaa

SEQ ID NO: 91194 - DNA, 22 bp, Homo sapiens
tccgggttttacactcacatca

SEQ ID NO: 91195 - DNA, 22 bp, Homo sapiens
ccttgctcaagctagtgacggg

SEQ ID NO: 91196 - DNA, 22 bp, Homo sapiens
aagctgttgttcatcctgaatt

SEQ ID NO: 91197 - DNA, 20 bp, Homo sapiens
gttaggaggttggacatgga

SEQ ID NO: 91198 - DNA, 22 bp, Homo sapiens
tccctgtgtcctgggggcacct

SEQ ID NO: 91199 - DNA, 22 bp, Homo sapiens
ttggggtcccacaggctgcctg

SEQ ID NO: 91200 - DNA, 19 bp, Homo sapiens
ggggcctgtgatggtcaca

SEQ ID NO: 91201 - DNA, 22 bp, Homo sapiens
tgttttaagggtcaactgtcac

SEQ ID NO: 91202 - DNA, 20 bp, Homo sapiens
gtgtgacctcctgtggatgc

SEQ ID NO: 91203 - DNA, 22 bp, Homo sapiens
tagcatgtcagtcgccacacgt

SEQ ID NO: 91204 - DNA, 22 bp, Homo sapiens
ctcgggcaccctggttctggtg

SEQ ID NO: 91205 - DNA, 22 bp, Homo sapiens
tgaagttgttaaggttgccatt

SEQ ID NO: 91206 - DNA, 22 bp, Homo sapiens
accctcttgagggaagcacttt

SEQ ID NO: 91207 - DNA, 22 bp, Homo sapiens
ttcctggtcactgctgttccct

SEQ ID NO: 91208 - DNA, 22 bp, Homo sapiens
agaaggggcccaaggatgtcag

SEQ ID NO: 91209 - DNA, 22 bp, Homo sapiens
gcggggcctgactctgacccgc

SEQ ID NO: 91210 - DNA, 17 bp, Homo sapiens
cttcccaccatctcctg

SEQ ID NO: 91211 - DNA, 22 bp, Homo sapiens
gccgtgcgtgcgcaggtgctgt

SEQ ID NO: 91212 - DNA, 23 bp, Homo sapiens
aggtaggttattgctgctacctg

SEQ ID NO: 91213 - DNA, 22 bp, Homo sapiens
atgccactgcacttcagcttgg

SEQ ID NO: 91214 - DNA, 22 bp, Homo sapiens
gcccaggaggagaggctgcagt

SEQ ID NO: 91215 - DNA, 22 bp, Homo sapiens
ccctggcagtgctcctttagac

SEQ ID NO: 91216 - DNA, 22 bp, Homo sapiens
gtctctatcatagctgaaccct

SEQ ID NO: 91217 - DNA, 22 bp, Homo sapiens
cactgctacctctgcctcccgg

SEQ ID NO: 91218 - DNA, 22 bp, Homo sapiens
ggtttgttggggtccaggccca

SEQ ID NO: 91219 - DNA, 22 bp, Homo sapiens
ttctcatgaaactcgcttcctc

SEQ ID NO: 91220 - DNA, 22 bp, Homo sapiens
cactgcactccagcttgggcaa

SEQ ID NO: 91221 - DNA, 22 bp, Homo sapiens
atttcatactaaggctcaaaaa

SEQ ID NO: 91222 - DNA, 22 bp, Homo sapiens
cagctggttgaagaggagctgg

SEQ ID NO: 91223 - DNA, 22 bp, Homo sapiens
ctcactgcaacctctgcctccc

SEQ ID NO: 91224 - DNA, 22 bp, Homo sapiens
ttgaggcctgctggaaggtgtt

SEQ ID NO: 91225 - DNA, 21 bp, Homo sapiens
ggccccgcagacccagcacgt

SEQ ID NO: 91226 - DNA, 22 bp, Homo sapiens
tttcataatactgtacatgaaa

SEQ ID NO: 91227 - DNA, 19 bp, Homo sapiens
atgtacccagtgtcaatcc

SEQ ID NO: 91228 - DNA, 22 bp, Homo sapiens
tgcgccatgtgctctcggccct

SEQ ID NO: 91229 - DNA, 23 bp, Homo sapiens
cgcccagcctcagtgacctgggc

SEQ ID NO: 91230 - DNA, 23 bp, Homo sapiens
tgaggcaggcggatcacgaggtc

SEQ ID NO: 91231 - DNA, 22 bp, Homo sapiens
ggccatttgctttattcacttc

SEQ ID NO: 91232 - DNA, 22 bp, Homo sapiens
agggccagcactcctggcagga

SEQ ID NO: 91233 - DNA, 22 bp, Homo sapiens
gggcaggaacaaatcaaatgat

SEQ ID NO: 91234 - DNA, 22 bp, Homo sapiens
cttggggcagcccaggctgagc

SEQ ID NO: 91235 - DNA, 22 bp, Homo sapiens
atattgttagtaatatttcgaa

SEQ ID NO: 91236 - DNA, 23 bp, Homo sapiens
ggcccccggaacgctctgtgacc

SEQ ID NO: 91237 - DNA, 18 bp, Homo sapiens
tccatgcacatagccccc

SEQ ID NO: 91238 - DNA, 22 bp, Homo sapiens
cggggccctggggctgaaggtc

SEQ ID NO: 91239 - DNA, 20 bp, Homo sapiens
cgcccagtgcggttctgacc

SEQ ID NO: 91240 - DNA, 22 bp, Homo sapiens
gggggagagacgagcggctctg

SEQ ID NO: 91241 - DNA, 22 bp, Homo sapiens
ggctgccttccctgagccccgg

SEQ ID NO: 91242 - DNA, 22 bp, Homo sapiens
atctgagctccgcctcctgtca

SEQ ID NO: 91243 - DNA, 22 bp, Homo sapiens
gccttattacctgcactttgaa

SEQ ID NO: 91244 - DNA, 22 bp, Homo sapiens
atatattttttgagacagagtc

SEQ ID NO: 91245 - DNA, 22 bp, Homo sapiens
gtagaggtagacttccttgtct

SEQ ID NO: 91246 - DNA, 22 bp, Homo sapiens
ggtgcagaggagccagctgggg

SEQ ID NO: 91247 - DNA, 22 bp, Homo sapiens
gagctactgaaatattgatttt

SEQ ID NO: 91248 - DNA, 22 bp, Homo sapiens
ccagaagtcaagtaagatgaag

SEQ ID NO: 91249 - DNA, 22 bp, Homo sapiens
actctttgtctgttgccgctta

SEQ ID NO: 91250 - DNA, 22 bp, Homo sapiens
ggctccaccctgcttccagaag

SEQ ID NO: 91251 - DNA, 22 bp, Homo sapiens
ggcccagacccaagagtggtgg

SEQ ID NO: 91252 - DNA, 22 bp, Homo sapiens
caccatttagtagcaagagctc

SEQ ID NO: 91253 - DNA, 21 bp, Homo sapiens
gccatttcacacagacatttg

SEQ ID NO: 91254 - DNA, 22 bp, Homo sapiens
cctcggggcaccgcggcctgct

SEQ ID NO: 91255 - DNA, 22 bp, Homo sapiens
tagtttcatctccaccctgccc

SEQ ID NO: 91256 - DNA, 18 bp, Homo sapiens
gcagtgaagaaagagctt

SEQ ID NO: 91257 - DNA, 22 bp, Homo sapiens
gactttgtgccaaacgccagaa

SEQ ID NO: 91258 - DNA, 22 bp, Homo sapiens
tctggcttcgcagctcccagcc

SEQ ID NO: 91259 - DNA, 22 bp, Homo sapiens
ccgggcgggggctctcgtcacc

SEQ ID NO: 91260 - DNA, 21 bp, Homo sapiens
tccctgagcccaaggggctcc

SEQ ID NO: 91261 - DNA, 22 bp, Homo sapiens
cctgcctactgagttttatatt

SEQ ID NO: 91262 - DNA, 23 bp, Homo sapiens
gcctgggagttgcgatctgcccg

SEQ ID NO: 91263 - DNA, 21 bp, Homo sapiens
ttgaccaagggtgcgtgctcc

SEQ ID NO: 91264 - DNA, 22 bp, Homo sapiens
agctggtgtgccagttccagtt

SEQ ID NO: 91265 - DNA, 22 bp, Homo sapiens
agtggcctggagccccgcctgg

SEQ ID NO: 91266 - DNA, 22 bp, Homo sapiens
ccggtcccaggtgccccggtga

SEQ ID NO: 91267 - DNA, 22 bp, Homo sapiens
catcatcaaaagtgacagagaa

SEQ ID NO: 91268 - DNA, 18 bp, Homo sapiens
tgagaggctattttttgc

SEQ ID NO: 91269 - DNA, 22 bp, Homo sapiens
tcttagaaattccccagtggct

SEQ ID NO: 91270 - DNA, 22 bp, Homo sapiens
tgattcatcagaataggagttt

SEQ ID NO: 91271 - DNA, 22 bp, Homo sapiens
gctcaagccttctgcccacctc

SEQ ID NO: 91272 - DNA, 22 bp, Homo sapiens
tttaaaaaactagtctgagtct

SEQ ID NO: 91273 - DNA, 22 bp, Homo sapiens
ccccatgaagtagggtctctga

SEQ ID NO: 91274 - DNA, 22 bp, Homo sapiens
cacctagggtttcgcctttctt

SEQ ID NO: 91275 - DNA, 22 bp, Homo sapiens
tctcatggagtcaggagcagaa

SEQ ID NO: 91276 - DNA, 22 bp, Homo sapiens
tgctcatcaacatgatgatcat

SEQ ID NO: 91277 - DNA, 22 bp, Homo sapiens
tagaaaagccccagctggaggg

SEQ ID NO: 91278 - DNA, 22 bp, Homo sapiens
gtcgtggagctcacagtgtgcc

SEQ ID NO: 91279 - DNA, 22 bp, Homo sapiens
tttgaaatgtatcagtataggt

SEQ ID NO: 91280 - DNA, 22 bp, Homo sapiens
tcacaatatttatcttccaatt

SEQ ID NO: 91281 - DNA, 22 bp, Homo sapiens
tgtgacaagcattgtatattgg

SEQ ID NO: 91282 - DNA, 22 bp, Homo sapiens
accagcctggccaacatggtga

SEQ ID NO: 91283 - DNA, 22 bp, Homo sapiens
cgcaactcagcaacttaactgc

SEQ ID NO: 91284 - DNA, 22 bp, Homo sapiens
tgaggcccaccttggccccggc

SEQ ID NO: 91285 - DNA, 20 bp, Homo sapiens
tttctgtgagaaacactgtt

SEQ ID NO: 91286 - DNA, 22 bp, Homo sapiens
ctccaggccatggctgcggagg

SEQ ID NO: 91287 - DNA, 22 bp, Homo sapiens
tgtgagttattttcaggagttt

SEQ ID NO: 91288 - DNA, 22 bp, Homo sapiens
ctcactgcaagctctgcctcca

SEQ ID NO: 91289 - DNA, 22 bp, Homo sapiens
cttaactctacactgcacttta

SEQ ID NO: 91290 - DNA, 22 bp, Homo sapiens
ttttcagaattagcataccatt

SEQ ID NO: 91291 - DNA, 19 bp, Homo sapiens
ccctcttgcacaaagcaaa

SEQ ID NO: 91292 - DNA, 22 bp, Homo sapiens
cttccctctgctccttggtcca

SEQ ID NO: 91293 - DNA, 22 bp, Homo sapiens
ttgcagttttgacagaccaaat

SEQ ID NO: 91294 - DNA, 22 bp, Homo sapiens
aaccagctaacatgtggaatga

SEQ ID NO: 91295 - DNA, 22 bp, Homo sapiens
tgatattttatgagctttcata

SEQ ID NO: 91296 - DNA, 22 bp, Homo sapiens
tgtgcctgttcccactttgcct

SEQ ID NO: 91297 - DNA, 22 bp, Homo sapiens
tgagcaggcgcagcaggaggtc

SEQ ID NO: 91298 - DNA, 22 bp, Homo sapiens
cagtgcagccaaggacaggcac

SEQ ID NO: 91299 - DNA, 22 bp, Homo sapiens
ggctggtgttgagtgcctgtag

SEQ ID NO: 91300 - DNA, 22 bp, Homo sapiens
tcacgtgagggacctgtgtctg

SEQ ID NO: 91301 - DNA, 22 bp, Homo sapiens
gcctggccgggtcttggatttt

SEQ ID NO: 91302 - DNA, 22 bp, Homo sapiens
aggaaagcttggcaaactaaat

SEQ ID NO: 91303 - DNA, 22 bp, Homo sapiens
tgctagtgtgtgagatgttcaa

SEQ ID NO: 91304 - DNA, 22 bp, Homo sapiens
tgggatgccctgaccctctgga

SEQ ID NO: 91305 - DNA, 22 bp, Homo sapiens
ttgtatagcccagagagtgaga

SEQ ID NO: 91306 - DNA, 22 bp, Homo sapiens
tccaggattgtcagccagaagg

SEQ ID NO: 91307 - DNA, 22 bp, Homo sapiens
ctagggtgtgcagattttgcct

SEQ ID NO: 91308 - DNA, 23 bp, Homo sapiens
ccccactaccgtgatgtgcgagg

SEQ ID NO: 91309 - DNA, 22 bp, Homo sapiens
gggacaatggaggcctctctcc

SEQ ID NO: 91310 - DNA, 22 bp, Homo sapiens
cccttagaattttgtagttatt

SEQ ID NO: 91311 - DNA, 22 bp, Homo sapiens
cctctgtgtctccaagaggcct

SEQ ID NO: 91312 - DNA, 22 bp, Homo sapiens
aataaacaaaggacaaggaggt

SEQ ID NO: 91313 - DNA, 22 bp, Homo sapiens
cactccagcctcagtgacagag

SEQ ID NO: 91314 - DNA, 22 bp, Homo sapiens
acggcctggtgcagcaggtcgc

SEQ ID NO: 91315 - DNA, 22 bp, Homo sapiens
agtccaggcattccagccattc

SEQ ID NO: 91316 - DNA, 22 bp, Homo sapiens
gtaaactattctttcaggagct

SEQ ID NO: 91317 - DNA, 22 bp, Homo sapiens
acctggccaatttttgtatttt

SEQ ID NO: 91318 - DNA, 22 bp, Homo sapiens
aaattagtgcaccaggttgaag

SEQ ID NO: 91319 - DNA, 22 bp, Homo sapiens
gaaagtgctctctctatacaca

SEQ ID NO: 91320 - DNA, 22 bp, Homo sapiens
gaaggagccgagctcttcccca

SEQ ID NO: 91321 - DNA, 22 bp, Homo sapiens
tctccgatcacaggttttcaat

SEQ ID NO: 91322 - DNA, 22 bp, Homo sapiens
ttctgattgctgatgaggccca

SEQ ID NO: 91323 - DNA, 22 bp, Homo sapiens
ccaaaaggaactttttgaaggt

SEQ ID NO: 91324 - DNA, 22 bp, Homo sapiens
attctaaatcagagagctctgt

SEQ ID NO: 91325 - DNA, 22 bp, Homo sapiens
cccaggagttagaggttgtggt

SEQ ID NO: 91326 - DNA, 22 bp, Homo sapiens
ctggctttgatcagagtgacct

SEQ ID NO: 91327 - DNA, 22 bp, Homo sapiens
gtgtctcttagcctgctaatgc

SEQ ID NO: 91328 - DNA, 22 bp, Homo sapiens
agggcgctgaaatactaacatg

SEQ ID NO: 91329 - DNA, 22 bp, Homo sapiens
tctgtggcccaagtgatggctg

SEQ ID NO: 91330 - DNA, 22 bp, Homo sapiens
ttagtttataattcatttctgt

SEQ ID NO: 91331 - DNA, 22 bp, Homo sapiens
aggctcccaagcactgacccca

SEQ ID NO: 91332 - DNA, 22 bp, Homo sapiens
ccacagtctatgcaacaaggtc

SEQ ID NO: 91333 - DNA, 22 bp, Homo sapiens
caatagtaaattacggaggaga

SEQ ID NO: 91334 - DNA, 22 bp, Homo sapiens
ggaggtagcctcaaaagcagct

SEQ ID NO: 91335 - DNA, 22 bp, Homo sapiens
cctgtctctgcagggccctgcc

SEQ ID NO: 91336 - DNA, 22 bp, Homo sapiens
acaccatactcatgttggttcc

SEQ ID NO: 91337 - DNA, 22 bp, Homo sapiens
gccaggcgggtctcaaactcct

SEQ ID NO: 91338 - DNA, 22 bp, Homo sapiens
tcccccaggctggagtgcagtg

SEQ ID NO: 91339 - DNA, 22 bp, Homo sapiens
gtggatggagctggaagccatt

SEQ ID NO: 91340 - DNA, 22 bp, Homo sapiens
ccaggcagcctgctccattctg

SEQ ID NO: 91341 - DNA, 22 bp, Homo sapiens
tcactcaggctggagtgcagtg

SEQ ID NO: 91342 - DNA, 22 bp, Homo sapiens
ctgcaccgtgtctcgggctgcc

SEQ ID NO: 91343 - DNA, 20 bp, Homo sapiens
ttctccagtgcggtagccat

SEQ ID NO: 91344 - DNA, 22 bp, Homo sapiens
tgacagaggagctggaatgatt

SEQ ID NO: 91345 - DNA, 22 bp, Homo sapiens
ccagatatcactgccgtgttgt

SEQ ID NO: 91346 - DNA, 22 bp, Homo sapiens
cgtggcctctatggctcccgcc

SEQ ID NO: 91347 - DNA, 22 bp, Homo sapiens
ggcagagcttgcagtgagccga

SEQ ID NO: 91348 - DNA, 22 bp, Homo sapiens
ctgatagacaatcaccatggga

SEQ ID NO: 91349 - DNA, 23 bp, Homo sapiens
caggagatggctgctgtgtcagc

SEQ ID NO: 91350 - DNA, 22 bp, Homo sapiens
tcctccccaaagcccagcctgg

SEQ ID NO: 91351 - DNA, 22 bp, Homo sapiens
tgctggtaccgcgcctccgcca

SEQ ID NO: 91352 - DNA, 22 bp, Homo sapiens
tcaccagatctctctgtaatgg

SEQ ID NO: 91353 - DNA, 20 bp, Homo sapiens
aactcctagcctcaagtgat

SEQ ID NO: 91354 - DNA, 22 bp, Homo sapiens
ccatgaattcactccatgctag

SEQ ID NO: 91355 - DNA, 23 bp, Homo sapiens
agagcaaggaaatgaggtgtgat

SEQ ID NO: 91356 - DNA, 22 bp, Homo sapiens
atctggttttggctgtgtccct

SEQ ID NO: 91357 - DNA, 22 bp, Homo sapiens
ctctgcaacttctagcagtgtc

SEQ ID NO: 91358 - DNA, 21 bp, Homo sapiens
ctggccactgcacctcttcct

SEQ ID NO: 91359 - DNA, 22 bp, Homo sapiens
agcctggcctgggcaggcacat

SEQ ID NO: 91360 - DNA, 22 bp, Homo sapiens
tgattttctccattgtaaattc

SEQ ID NO: 91361 - DNA, 22 bp, Homo sapiens
gtcaccttgaacaggctactca

SEQ ID NO: 91362 - DNA, 22 bp, Homo sapiens
tttcttcctgctttgtcccatg

SEQ ID NO: 91363 - DNA, 22 bp, Homo sapiens
cacagctgtgagaagggagcct

SEQ ID NO: 91364 - DNA, 22 bp, Homo sapiens
tataaagagtctcaaagaagtt

SEQ ID NO: 91365 - DNA, 22 bp, Homo sapiens
gcccttacagggtggtcagcca

SEQ ID NO: 91366 - DNA, 22 bp, Homo sapiens
tgagataatcatgtgatttcat

SEQ ID NO: 91367 - DNA, 22 bp, Homo sapiens
ttcaatttgtgctaaggcaccg

SEQ ID NO: 91368 - DNA, 22 bp, Homo sapiens
tgagacaggcttccttcttggg

SEQ ID NO: 91369 - DNA, 22 bp, Homo sapiens
tgtccccacctaaatcttatct

SEQ ID NO: 91370 - DNA, 22 bp, Homo sapiens
tgagcctgggagatggaggctg

SEQ ID NO: 91371 - DNA, 20 bp, Homo sapiens
aaaatatgtataactcttct

SEQ ID NO: 91372 - DNA, 22 bp, Homo sapiens
aaactgaggctcccgagggtgt

SEQ ID NO: 91373 - DNA, 22 bp, Homo sapiens
gcatatgatcacgtgtgtcggt

SEQ ID NO: 91374 - DNA, 22 bp, Homo sapiens
gggctgtgaggtgagaacttac

SEQ ID NO: 91375 - DNA, 22 bp, Homo sapiens
tggagccagagcgcagcctggg

SEQ ID NO: 91376 - DNA, 22 bp, Homo sapiens
cggaggttgaggctgcagtgag

SEQ ID NO: 91377 - DNA, 22 bp, Homo sapiens
ggagtgtgattgttctctgtta

SEQ ID NO: 91378 - DNA, 22 bp, Homo sapiens
ttgcaaatcagaagtatagatt

SEQ ID NO: 91379 - DNA, 22 bp, Homo sapiens
tcttaagcagagaagaagttga

SEQ ID NO: 91380 - DNA, 22 bp, Homo sapiens
tcatggggccacagctgccagc

SEQ ID NO: 91381 - DNA, 18 bp, Homo sapiens
tctggaacaacttcatgt

SEQ ID NO: 91382 - DNA, 22 bp, Homo sapiens
ttccagctaactcacatccctt

SEQ ID NO: 91383 - DNA, 22 bp, Homo sapiens
tcagggattgcaaaattcatcc

SEQ ID NO: 91384 - DNA, 22 bp, Homo sapiens
ctctggaggtggaggttgcagt

SEQ ID NO: 91385 - DNA, 22 bp, Homo sapiens
tcaccagacgcgtgggtctgag

SEQ ID NO: 91386 - DNA, 22 bp, Homo sapiens
tccttaggaaaatgatgagggg

SEQ ID NO: 91387 - DNA, 22 bp, Homo sapiens
agtccccctctgagcccaggga

SEQ ID NO: 91388 - DNA, 22 bp, Homo sapiens
gtcttgggacccgcactgtggg

SEQ ID NO: 91389 - DNA, 22 bp, Homo sapiens
gagtccaagctagagccactca

SEQ ID NO: 91390 - DNA, 22 bp, Homo sapiens
tggttaacttctgagcaggctg

SEQ ID NO: 91391 - DNA, 22 bp, Homo sapiens
ccaggaggcggaaggtacagtg

SEQ ID NO: 91392 - DNA, 22 bp, Homo sapiens
gtcctggggattatagagtgtt

SEQ ID NO: 91393 - DNA, 22 bp, Homo sapiens
ccttctagcaaatcaacataaa

SEQ ID NO: 91394 - DNA, 22 bp, Homo sapiens
aaaatcctgctgactcgagatg

SEQ ID NO: 91395 - DNA, 22 bp, Homo sapiens
caggagctcaagaccaccctgg

SEQ ID NO: 91396 - DNA, 22 bp, Homo sapiens
cctgacgaaaggcgtgctggag

SEQ ID NO: 91397 - DNA, 19 bp, Homo sapiens
ggagccgccgcccttcatt

SEQ ID NO: 91398 - DNA, 22 bp, Homo sapiens
acattaaacttgcttggctgta

SEQ ID NO: 91399 - DNA, 22 bp, Homo sapiens
tttaatgtagcgtgaaatgatt

SEQ ID NO: 91400 - DNA, 22 bp, Homo sapiens
acaggggacctaggaccctcgg

SEQ ID NO: 91401 - DNA, 22 bp, Homo sapiens
ccgcgccacccattcccactga

SEQ ID NO: 91402 - DNA, 22 bp, Homo sapiens
aaaaaattatcatagttcctga

SEQ ID NO: 91403 - DNA, 22 bp, Homo sapiens
tagtcccggaactccttcaggt

SEQ ID NO: 91404 - DNA, 22 bp, Homo sapiens
tggcacaggatctcagcggcca

SEQ ID NO: 91405 - DNA, 20 bp, Homo sapiens
tttgaatgtaaagcatgtca

SEQ ID NO: 91406 - DNA, 22 bp, Homo sapiens
cccaggaggcctgcctggccgg

SEQ ID NO: 91407 - DNA, 22 bp, Homo sapiens
ccagagctgcaggtaaaatgct

SEQ ID NO: 91408 - DNA, 22 bp, Homo sapiens
catgtgtgtctccaccagctgc

SEQ ID NO: 91409 - DNA, 22 bp, Homo sapiens
agctcaagctacacacagagtc

SEQ ID NO: 91410 - DNA, 22 bp, Homo sapiens
ccaggctggagtgcaatggcgt

SEQ ID NO: 91411 - DNA, 22 bp, Homo sapiens
acatttatataactcactagga

SEQ ID NO: 91412 - DNA, 22 bp, Homo sapiens
ttacaattacttgatctcagct

SEQ ID NO: 91413 - DNA, 22 bp, Homo sapiens
tgtacttgaacttgactgtaga

SEQ ID NO: 91414 - DNA, 22 bp, Homo sapiens
tccaggatggtgacggtggcca

SEQ ID NO: 91415 - DNA, 22 bp, Homo sapiens
cccagttgttgccggctctgga

SEQ ID NO: 91416 - DNA, 22 bp, Homo sapiens
ggaatcctgccagctctgcccc

SEQ ID NO: 91417 - DNA, 22 bp, Homo sapiens
tgtgttgtgacattcttggatg

SEQ ID NO: 91418 - DNA, 22 bp, Homo sapiens
aataaaatggtcagttttctca

SEQ ID NO: 91419 - DNA, 22 bp, Homo sapiens
acctcctccaaggagccatagg

SEQ ID NO: 91420 - DNA, 22 bp, Homo sapiens
cgtcacttcttagtctattttc

SEQ ID NO: 91421 - DNA, 22 bp, Homo sapiens
ctgccctggggggcctccttgc

SEQ ID NO: 91422 - DNA, 22 bp, Homo sapiens
tgagcctgagttcaaggctgca

SEQ ID NO: 91423 - DNA, 22 bp, Homo sapiens
cttttcattgtttgtacatgca

SEQ ID NO: 91424 - DNA, 22 bp, Homo sapiens
gggaggttctgttcgcacttga

SEQ ID NO: 91425 - DNA, 22 bp, Homo sapiens
tgttttaagctctagaagggga

SEQ ID NO: 91426 - DNA, 22 bp, Homo sapiens
gaggcaggcagattgcttgagg

SEQ ID NO: 91427 - DNA, 22 bp, Homo sapiens
gaccttgtgatccgcccgcctt

SEQ ID NO: 91428 - DNA, 22 bp, Homo sapiens
agtgggtgtagtcttcctcctg

SEQ ID NO: 91429 - DNA, 22 bp, Homo sapiens
aaggatgattggtaatgacact

SEQ ID NO: 91430 - DNA, 22 bp, Homo sapiens
tcatctccatacggtctcgcag

SEQ ID NO: 91431 - DNA, 22 bp, Homo sapiens
gccaggctgaggctctggaaga

SEQ ID NO: 91432 - DNA, 22 bp, Homo sapiens
tattgggtaaagatccagtttt

SEQ ID NO: 91433 - DNA, 22 bp, Homo sapiens
tcagtgtgaattcaggagccta

SEQ ID NO: 91434 - DNA, 22 bp, Homo sapiens
ggaggctgaggcaggcggatca

SEQ ID NO: 91435 - DNA, 22 bp, Homo sapiens
agctggggctgtggttgtgatt

SEQ ID NO: 91436 - DNA, 22 bp, Homo sapiens
tgcctgttgcccacctgataaa

SEQ ID NO: 91437 - DNA, 22 bp, Homo sapiens
ccctagtccacaggttcctgga

SEQ ID NO: 91438 - DNA, 22 bp, Homo sapiens
ctctggaccctcctgctgagag

SEQ ID NO: 91439 - DNA, 20 bp, Homo sapiens
gccactgggcaccagcaggg

SEQ ID NO: 91440 - DNA, 22 bp, Homo sapiens
gggtgtagaaagaaccctctgg

SEQ ID NO: 91441 - DNA, 22 bp, Homo sapiens
tgggatgctcagggcctggagc

SEQ ID NO: 91442 - DNA, 22 bp, Homo sapiens
gcagcctgggcaacagagtgag

SEQ ID NO: 91443 - DNA, 22 bp, Homo sapiens
aaggctgtggttctatacagaa

SEQ ID NO: 91444 - DNA, 22 bp, Homo sapiens
gacaattgcttttgccgaataa

SEQ ID NO: 91445 - DNA, 22 bp, Homo sapiens
taagaaatttagttatagaatg

SEQ ID NO: 91446 - DNA, 20 bp, Homo sapiens
accccagtgtgtgcctcaag

SEQ ID NO: 91447 - DNA, 22 bp, Homo sapiens
acaatgctccctgtagtcagga

SEQ ID NO: 91448 - DNA, 22 bp, Homo sapiens
gtgcacatcgtgcaggtttgtt

SEQ ID NO: 91449 - DNA, 22 bp, Homo sapiens
catttacatttaaggttaatat

SEQ ID NO: 91450 - DNA, 22 bp, Homo sapiens
ctcttagtaatgccatgaagca

SEQ ID NO: 91451 - DNA, 22 bp, Homo sapiens
atggccaggcacctctggctga

SEQ ID NO: 91452 - DNA, 22 bp, Homo sapiens
ctttatgaaaacctgaattatg

SEQ ID NO: 91453 - DNA, 22 bp, Homo sapiens
ggcccaggctggagtgcagtgg

SEQ ID NO: 91454 - DNA, 22 bp, Homo sapiens
aaaatggtctcagctggcacca

SEQ ID NO: 91455 - DNA, 22 bp, Homo sapiens
gtgaggcgaaggtgctggcgcc

SEQ ID NO: 91456 - DNA, 22 bp, Homo sapiens
caggctggagtgcagtggtgcc

SEQ ID NO: 91457 - DNA, 22 bp, Homo sapiens
tctctttgcctgctgccatcca

SEQ ID NO: 91458 - DNA, 22 bp, Homo sapiens
tctttgctattgtgaatagtgc

SEQ ID NO: 91459 - DNA, 22 bp, Homo sapiens
gggtggtggccagcagtgggca

SEQ ID NO: 91460 - DNA, 22 bp, Homo sapiens
gagctgtgtatgcatcattctg

SEQ ID NO: 91461 - DNA, 19 bp, Homo sapiens
acacagggatcagagggtt

SEQ ID NO: 91462 - DNA, 22 bp, Homo sapiens
ttctctgcctcacaggtctaag

SEQ ID NO: 91463 - DNA, 22 bp, Homo sapiens
ctccatatgttcagttatgcag

SEQ ID NO: 91464 - DNA, 22 bp, Homo sapiens
ggaggtcccaggcctggcagca

SEQ ID NO: 91465 - DNA, 22 bp, Homo sapiens
ggacacgtggctgaaggcggcc

SEQ ID NO: 91466 - DNA, 21 bp, Homo sapiens
ctggaggcaggtggtgccagg

SEQ ID NO: 91467 - DNA, 22 bp, Homo sapiens
atcttggggaatcctctgtgta

SEQ ID NO: 91468 - DNA, 22 bp, Homo sapiens
cccaggaggcgcaggttgcggt

SEQ ID NO: 91469 - DNA, 22 bp, Homo sapiens
ccccggaggcggaggttgcagt

SEQ ID NO: 91470 - DNA, 22 bp, Homo sapiens
gaagcctcaacatctctgcgtc

SEQ ID NO: 91471 - DNA, 22 bp, Homo sapiens
tcctgaagaaggcagatatttg

SEQ ID NO: 91472 - DNA, 22 bp, Homo sapiens
caggaacagggtgtcctggcag

SEQ ID NO: 91473 - DNA, 22 bp, Homo sapiens
agaaatatgctgattagatgaa

SEQ ID NO: 91474 - DNA, 22 bp, Homo sapiens
agggtgaatctcacaactctta

SEQ ID NO: 91475 - DNA, 22 bp, Homo sapiens
acacagagccaaaccatatcac

SEQ ID NO: 91476 - DNA, 22 bp, Homo sapiens
atgttctacagatggaaagggg

SEQ ID NO: 91477 - DNA, 22 bp, Homo sapiens
tctaatcctatggtggggaggg

SEQ ID NO: 91478 - DNA, 22 bp, Homo sapiens
cttttgattgagcagtttcaaa

SEQ ID NO: 91479 - DNA, 22 bp, Homo sapiens
tgcctaggctggagtgtagtgg

SEQ ID NO: 91480 - DNA, 18 bp, Homo sapiens
ttgcttcttttctctagg

SEQ ID NO: 91481 - DNA, 22 bp, Homo sapiens
gagccaggttggaggctgcagt

SEQ ID NO: 91482 - DNA, 22 bp, Homo sapiens
aaagtgctaggattacaagcgt

SEQ ID NO: 91483 - DNA, 22 bp, Homo sapiens
tcctgagataaatctcatgtga

SEQ ID NO: 91484 - DNA, 22 bp, Homo sapiens
tgctcgaggtccccaccggctc

SEQ ID NO: 91485 - DNA, 22 bp, Homo sapiens
tctgcaacagtgccctgtaaat

SEQ ID NO: 91486 - DNA, 22 bp, Homo sapiens
acagcagagcctggtacttact

SEQ ID NO: 91487 - DNA, 22 bp, Homo sapiens
ctcctgggaaaggctggacaca

SEQ ID NO: 91488 - DNA, 22 bp, Homo sapiens
ttcctgggattattgtcaagca

SEQ ID NO: 91489 - DNA, 22 bp, Homo sapiens
gcacggctaatttttgtatttt

SEQ ID NO: 91490 - DNA, 22 bp, Homo sapiens
tcgcgcccccaagcgtcattgg

SEQ ID NO: 91491 - DNA, 18 bp, Homo sapiens
tcactgggtgtatgtggc

SEQ ID NO: 91492 - DNA, 22 bp, Homo sapiens
gagcctggagctggaacgaagc

SEQ ID NO: 91493 - DNA, 22 bp, Homo sapiens
ttaggctgttcttgtgttgtta

SEQ ID NO: 91494 - DNA, 22 bp, Homo sapiens
ccagtgtgcattatcatgtgtc

SEQ ID NO: 91495 - DNA, 22 bp, Homo sapiens
ataaagtggaggtagtattcat

SEQ ID NO: 91496 - DNA, 22 bp, Homo sapiens
gggctgggattgcttgctgtga

SEQ ID NO: 91497 - DNA, 22 bp, Homo sapiens
agcccaggtccagttcactgca

SEQ ID NO: 91498 - DNA, 22 bp, Homo sapiens
cctactctgagcgcctccgcat

SEQ ID NO: 91499 - DNA, 22 bp, Homo sapiens
tcccagagctctggaggttgga

SEQ ID NO: 91500 - DNA, 22 bp, Homo sapiens
acacggcactttaggaaggggc

SEQ ID NO: 91501 - DNA, 22 bp, Homo sapiens
gaccttgtgatccacccgcctt

SEQ ID NO: 91502 - DNA, 22 bp, Homo sapiens
cgtcccgggttcacgccattct

SEQ ID NO: 91503 - DNA, 22 bp, Homo sapiens
gagatgcagaaccctcaggagc

SEQ ID NO: 91504 - DNA, 22 bp, Homo sapiens
ccaagctacttaggagtctgag

SEQ ID NO: 91505 - DNA, 22 bp, Homo sapiens
gaccttcttgctgtgtcctaac

SEQ ID NO: 91506 - DNA, 22 bp, Homo sapiens
agaggctgcacttgctcatgat

SEQ ID NO: 91507 - DNA, 22 bp, Homo sapiens
aagaggcgctcctcacttccta

SEQ ID NO: 91508 - DNA, 22 bp, Homo sapiens
catataaatacaacatgtgtta

SEQ ID NO: 91509 - DNA, 22 bp, Homo sapiens
tcctggtcttcaggttgcaaaa

SEQ ID NO: 91510 - DNA, 22 bp, Homo sapiens
ctgaggctggagtgcagtggtg

SEQ ID NO: 91511 - DNA, 22 bp, Homo sapiens
caatagtgtctgcttgtttcta

SEQ ID NO: 91512 - DNA, 22 bp, Homo sapiens
taaattgagattattagggtaa

SEQ ID NO: 91513 - DNA, 21 bp, Homo sapiens
ccgccgctgatagctctgggc

SEQ ID NO: 91514 - DNA, 22 bp, Homo sapiens
tctgaggctgaatggactccgt

SEQ ID NO: 91515 - DNA, 22 bp, Homo sapiens
gctgtagtgaatggccgcgttc

SEQ ID NO: 91516 - DNA, 22 bp, Homo sapiens
agttgcatgtccaagggggtag

SEQ ID NO: 91517 - DNA, 21 bp, Homo sapiens
ttgctgttttcccaatgcagt

SEQ ID NO: 91518 - DNA, 22 bp, Homo sapiens
cagcagcattgctctggattcc

SEQ ID NO: 91519 - DNA, 22 bp, Homo sapiens
ctctccattccctacagttttc

SEQ ID NO: 91520 - DNA, 22 bp, Homo sapiens
aatgttgcagagtgattgtcca

SEQ ID NO: 91521 - DNA, 22 bp, Homo sapiens
tccacaggtccggcatgaacag

SEQ ID NO: 91522 - DNA, 22 bp, Homo sapiens
tctttcattctagtctgaggtt

SEQ ID NO: 91523 - DNA, 22 bp, Homo sapiens
cttccttctcactagcagcgcc

SEQ ID NO: 91524 - DNA, 22 bp, Homo sapiens
cgtgagcaaaatggacactccc

SEQ ID NO: 91525 - DNA, 22 bp, Homo sapiens
tggctgagttacgaacagagca

SEQ ID NO: 91526 - DNA, 22 bp, Homo sapiens
ccaggaggttgaggctgcagtg

SEQ ID NO: 91527 - DNA, 22 bp, Homo sapiens
taaggctatcttttgagtgtgt

SEQ ID NO: 91528 - DNA, 22 bp, Homo sapiens
ttgtgggggctgccctgtacgg

SEQ ID NO: 91529 - DNA, 22 bp, Homo sapiens
cccatgcaccctctaagaagga

SEQ ID NO: 91530 - DNA, 22 bp, Homo sapiens
cgcagggccgcgagcgggacca

SEQ ID NO: 91531 - DNA, 22 bp, Homo sapiens
gggccccaagaacctcctcctg

SEQ ID NO: 91532 - DNA, 22 bp, Homo sapiens
gcagggtctgaggccacagagg

SEQ ID NO: 91533 - DNA, 22 bp, Homo sapiens
aagacacaatgtagcccagcac

SEQ ID NO: 91534 - DNA, 18 bp, Homo sapiens
tgagttcattagacttcc

SEQ ID NO: 91535 - DNA, 22 bp, Homo sapiens
agggaagaggaccagagtctct

SEQ ID NO: 91536 - DNA, 22 bp, Homo sapiens
agagggtgggcacgtgatggat

SEQ ID NO: 91537 - DNA, 22 bp, Homo sapiens
attgtgaatagtgccgcagtaa

SEQ ID NO: 91538 - DNA, 22 bp, Homo sapiens
acggggctagagaaggtttctt

SEQ ID NO: 91539 - DNA, 22 bp, Homo sapiens
ccagaaaaatcctcccttgtcc

SEQ ID NO: 91540 - DNA, 22 bp, Homo sapiens
tggctcatgcctgtaatcttag

SEQ ID NO: 91541 - DNA, 22 bp, Homo sapiens
ggcgcagttgagcgtgctgttc

SEQ ID NO: 91542 - DNA, 23 bp, Homo sapiens
agcagccagagatcctcggccct

SEQ ID NO: 91543 - DNA, 22 bp, Homo sapiens
gaggcagaggttgcagtgagct

SEQ ID NO: 91544 - DNA, 22 bp, Homo sapiens
ctgtaatcccagctactcggga

SEQ ID NO: 91545 - DNA, 22 bp, Homo sapiens
aaagctgtcaaggcaggaggct

SEQ ID NO: 91546 - DNA, 22 bp, Homo sapiens
cttctcggccgtgtggatgcgc

SEQ ID NO: 91547 - DNA, 20 bp, Homo sapiens
gctctgtggtttgagtctcc

SEQ ID NO: 91548 - DNA, 22 bp, Homo sapiens
acaatgaagctccactgagctt

SEQ ID NO: 91549 - DNA, 22 bp, Homo sapiens
tgcctgcctaggaagctgtgaa

SEQ ID NO: 91550 - DNA, 22 bp, Homo sapiens
gggaggcagtgctggaggctgg

SEQ ID NO: 91551 - DNA, 22 bp, Homo sapiens
agtgctatcgagttctaatgct

SEQ ID NO: 91552 - DNA, 22 bp, Homo sapiens
tacttttagcctatttgattct

SEQ ID NO: 91553 - DNA, 22 bp, Homo sapiens
ggcatgagcacgaagtggtacc

SEQ ID NO: 91554 - DNA, 22 bp, Homo sapiens
gaccctgtttctacaaataatt

SEQ ID NO: 91555 - DNA, 22 bp, Homo sapiens
taattataacatgctttctggc

SEQ ID NO: 91556 - DNA, 22 bp, Homo sapiens
ggcagacctctccagccccaca

SEQ ID NO: 91557 - DNA, 22 bp, Homo sapiens
gctgatagactgaatgttggga

SEQ ID NO: 91558 - DNA, 22 bp, Homo sapiens
cctgtcacctaggtactgagca

SEQ ID NO: 91559 - DNA, 22 bp, Homo sapiens
aggaaataggaccagacaaagc

SEQ ID NO: 91560 - DNA, 22 bp, Homo sapiens
taacatttaaatttttcacata

SEQ ID NO: 91561 - DNA, 22 bp, Homo sapiens
agcgctgtgggcgtgcgaggag

SEQ ID NO: 91562 - DNA, 22 bp, Homo sapiens
ctaggctggagtgcagtggcac

SEQ ID NO: 91563 - DNA, 22 bp, Homo sapiens
ttacctaaaatagctcaattta

SEQ ID NO: 91564 - DNA, 22 bp, Homo sapiens
tacaccattcccaggtggattt

SEQ ID NO: 91565 - DNA, 22 bp, Homo sapiens
gagggaaaggttaatacatgat

SEQ ID NO: 91566 - DNA, 22 bp, Homo sapiens
catctgtaaagtaggaatattg

SEQ ID NO: 91567 - DNA, 22 bp, Homo sapiens
tttctgagaaattaaacacttt

SEQ ID NO: 91568 - DNA, 22 bp, Homo sapiens
atgatgtaaaataagttgtgag

SEQ ID NO: 91569 - DNA, 22 bp, Homo sapiens
gaggccaaggtgggcagatcac

SEQ ID NO: 91570 - DNA, 22 bp, Homo sapiens
ttgtggttaaccgcacattttt

SEQ ID NO: 91571 - DNA, 23 bp, Homo sapiens
acagtcgtaggtatccttttcct

SEQ ID NO: 91572 - DNA, 22 bp, Homo sapiens
cctgaggatgccagcatgggtg

SEQ ID NO: 91573 - DNA, 22 bp, Homo sapiens
ttagtctctttgcattgccata

SEQ ID NO: 91574 - DNA, 22 bp, Homo sapiens
tgtgaatggacaattaaatcta

SEQ ID NO: 91575 - DNA, 22 bp, Homo sapiens
aggggatgcctagtggagtctc

SEQ ID NO: 91576 - DNA, 21 bp, Homo sapiens
tggtacaccttgcctgtcaga

SEQ ID NO: 91577 - DNA, 22 bp, Homo sapiens
actgcaaagggaagccctttct

SEQ ID NO: 91578 - DNA, 22 bp, Homo sapiens
caggctgctgcctagaatgaca

SEQ ID NO: 91579 - DNA, 22 bp, Homo sapiens
catgtgtccacccttgaacaca

SEQ ID NO: 91580 - DNA, 22 bp, Homo sapiens
tgagtagagaattcagctaagg

SEQ ID NO: 91581 - DNA, 22 bp, Homo sapiens
gcctggagaaaggaaggtggga

SEQ ID NO: 91582 - DNA, 22 bp, Homo sapiens
cagtgatatttatcctactcac

SEQ ID NO: 91583 - DNA, 22 bp, Homo sapiens
ttggcataccttagtggtggag

SEQ ID NO: 91584 - DNA, 22 bp, Homo sapiens
catttctgggagacatgctaga

SEQ ID NO: 91585 - DNA, 22 bp, Homo sapiens
gggcaccttgggtctcaggcaa

SEQ ID NO: 91586 - DNA, 22 bp, Homo sapiens
gtctcccaaactctgatggtcc

SEQ ID NO: 91587 - DNA, 22 bp, Homo sapiens
aagaactgtttacaattttcac

SEQ ID NO: 91588 - DNA, 22 bp, Homo sapiens
ccctttagcccctgcagagact

SEQ ID NO: 91589 - DNA, 22 bp, Homo sapiens
aagcagagaatctgggagcgag

SEQ ID NO: 91590 - DNA, 22 bp, Homo sapiens
agccaccaccactgaaaggtta

SEQ ID NO: 91591 - DNA, 22 bp, Homo sapiens
gagaaagcttctttcccacagg

SEQ ID NO: 91592 - DNA, 22 bp, Homo sapiens
ctgctgtttctcaaaattaagt

SEQ ID NO: 91593 - DNA, 22 bp, Homo sapiens
tccgggagctgaacgtcttgcg

SEQ ID NO: 91594 - DNA, 22 bp, Homo sapiens
tattgtccaataggatgttcct

SEQ ID NO: 91595 - DNA, 22 bp, Homo sapiens
ctcctccacccgctggggccca

SEQ ID NO: 91596 - DNA, 22 bp, Homo sapiens
tttcttaggctctaaaatgact

SEQ ID NO: 91597 - DNA, 22 bp, Homo sapiens
aaagtgctgaaattacaggtgt

SEQ ID NO: 91598 - DNA, 22 bp, Homo sapiens
ttcaatatgatattagctgtgg

SEQ ID NO: 91599 - DNA, 22 bp, Homo sapiens
gaggtaggtgtaggaggcctgc

SEQ ID NO: 91600 - DNA, 22 bp, Homo sapiens
tagtaagttctcgcattgttat

SEQ ID NO: 91601 - DNA, 22 bp, Homo sapiens
caggagtgtctccacacagcaa

SEQ ID NO: 91602 - DNA, 19 bp, Homo sapiens
ccacagcctgctgtcttcc

SEQ ID NO: 91603 - DNA, 16 bp, Homo sapiens
cttggtgttggcagag

SEQ ID NO: 91604 - DNA, 22 bp, Homo sapiens
ataaagctattcctctcttttt

SEQ ID NO: 91605 - DNA, 22 bp, Homo sapiens
catctgctgttccttggactca

SEQ ID NO: 91606 - DNA, 22 bp, Homo sapiens
tcggggtctttgacacgctctg

SEQ ID NO: 91607 - DNA, 22 bp, Homo sapiens
aatgttacgatcaacaacacat

SEQ ID NO: 91608 - DNA, 22 bp, Homo sapiens
atgatggctaggctggttttga

SEQ ID NO: 91609 - DNA, 22 bp, Homo sapiens
agtcacagggggcccctgcaac

SEQ ID NO: 91610 - DNA, 22 bp, Homo sapiens
aaagtgctggtattacaggtgt

SEQ ID NO: 91611 - DNA, 22 bp, Homo sapiens
tagcccctgcctttgaacctgg

SEQ ID NO: 91612 - DNA, 22 bp, Homo sapiens
gagaaatatggctcagttccac

SEQ ID NO: 91613 - DNA, 23 bp, Homo sapiens
aatatcaaggtgatgttcccaga

SEQ ID NO: 91614 - DNA, 22 bp, Homo sapiens
tcacattttcaaaagctggtgc

SEQ ID NO: 91615 - DNA, 22 bp, Homo sapiens
gactatctgccaggtcccaggg

SEQ ID NO: 91616 - DNA, 22 bp, Homo sapiens
gggaagtgatggagccaggatt

SEQ ID NO: 91617 - DNA, 22 bp, Homo sapiens
agagtggagagaaacaactctg

SEQ ID NO: 91618 - DNA, 22 bp, Homo sapiens
aagctctttccactaaaccact

SEQ ID NO: 91619 - DNA, 22 bp, Homo sapiens
tgggactcactcttttggccag

SEQ ID NO: 91620 - DNA, 22 bp, Homo sapiens
ttatagcagcatgatttatagt

SEQ ID NO: 91621 - DNA, 22 bp, Homo sapiens
ggaaggcagaggtgtcgtgggg

SEQ ID NO: 91622 - DNA, 22 bp, Homo sapiens
gccgggaccaaggccacggagc

SEQ ID NO: 91623 - DNA, 22 bp, Homo sapiens
ttccatttggcacttcactgag

SEQ ID NO: 91624 - DNA, 22 bp, Homo sapiens
gctgggttttcttccgggccta

SEQ ID NO: 91625 - DNA, 22 bp, Homo sapiens
tttccctttagcctgagaatcc

SEQ ID NO: 91626 - DNA, 22 bp, Homo sapiens
gacaggaggcagagctcaggtg

SEQ ID NO: 91627 - DNA, 22 bp, Homo sapiens
acacttggagcaacacttatgg

SEQ ID NO: 91628 - DNA, 22 bp, Homo sapiens
tgcctgtggaaaggctggtgct

SEQ ID NO: 91629 - DNA, 22 bp, Homo sapiens
tggtggctcacacctgtaatcc

SEQ ID NO: 91630 - DNA, 22 bp, Homo sapiens
gaccttgtgatccccctgcctt

SEQ ID NO: 91631 - DNA, 22 bp, Homo sapiens
tggttcctcaagcgctggcggc

SEQ ID NO: 91632 - DNA, 22 bp, Homo sapiens
aaggctccagtgaatgctggca

SEQ ID NO: 91633 - DNA, 22 bp, Homo sapiens
tgcatattatgtgtatctgtct

SEQ ID NO: 91634 - DNA, 19 bp, Homo sapiens
agtcctggcctgggggacc

SEQ ID NO: 91635 - DNA, 22 bp, Homo sapiens
agtcccaacagcttacaaggaa

SEQ ID NO: 91636 - DNA, 22 bp, Homo sapiens
tggaagctcaaggcagggtgag

SEQ ID NO: 91637 - DNA, 22 bp, Homo sapiens
gtgcatgtcggggtgcatgtca

SEQ ID NO: 91638 - DNA, 20 bp, Homo sapiens
tgatatggtttggctgtgtt

SEQ ID NO: 91639 - DNA, 20 bp, Homo sapiens
tggcctctgagatgccacgg

SEQ ID NO: 91640 - DNA, 22 bp, Homo sapiens
tcttcccagaggaggtgccagc

SEQ ID NO: 91641 - DNA, 22 bp, Homo sapiens
tcagtgcacccaattctctcca

SEQ ID NO: 91642 - DNA, 22 bp, Homo sapiens
gctgctctccaagcctccttga

SEQ ID NO: 91643 - DNA, 22 bp, Homo sapiens
gaaagagaacctgggcctagat

SEQ ID NO: 91644 - DNA, 19 bp, Homo sapiens
ctctgggcaagtcacttaa

SEQ ID NO: 91645 - DNA, 22 bp, Homo sapiens
gctggcagacttcctctggaac

SEQ ID NO: 91646 - DNA, 22 bp, Homo sapiens
tctgtgcctgcttccccaccca

SEQ ID NO: 91647 - DNA, 22 bp, Homo sapiens
ctctcctattgtgtggtaagga

SEQ ID NO: 91648 - DNA, 22 bp, Homo sapiens
ttataagactgtagtgagtatt

SEQ ID NO: 91649 - DNA, 22 bp, Homo sapiens
gcaccaggtgcagccgggcccc

SEQ ID NO: 91650 - DNA, 22 bp, Homo sapiens
aaaactacatttgacattttgt

SEQ ID NO: 91651 - DNA, 22 bp, Homo sapiens
aacttgatcctgctgggtacta

SEQ ID NO: 91652 - DNA, 22 bp, Homo sapiens
ctcactgcaacctccgcctcct

SEQ ID NO: 91653 - DNA, 22 bp, Homo sapiens
gcaggcagaggtggaggagaca

SEQ ID NO: 91654 - DNA, 22 bp, Homo sapiens
acctcctggcctcaagcaatcc

SEQ ID NO: 91655 - DNA, 22 bp, Homo sapiens
gccagagttgaggcagtttatt

SEQ ID NO: 91656 - DNA, 22 bp, Homo sapiens
acccaggctggagtgcagtggg

SEQ ID NO: 91657 - DNA, 22 bp, Homo sapiens
tgaacatgctgttgatggcctg

SEQ ID NO: 91658 - DNA, 20 bp, Homo sapiens
ttcatgggagcaaagaggcc

SEQ ID NO: 91659 - DNA, 22 bp, Homo sapiens
attgtcgtcaatggacacatag

SEQ ID NO: 91660 - DNA, 22 bp, Homo sapiens
atgtgggccgtgcgggtgtcct

SEQ ID NO: 91661 - DNA, 22 bp, Homo sapiens
cttgtcagccaattgtggattt

SEQ ID NO: 91662 - DNA, 22 bp, Homo sapiens
tgctgagcgcatccggcggccg

SEQ ID NO: 91663 - DNA, 22 bp, Homo sapiens
ccgggcctcgggacaccgggta

SEQ ID NO: 91664 - DNA, 22 bp, Homo sapiens
aagctgcagcacagagaggtgg

SEQ ID NO: 91665 - DNA, 22 bp, Homo sapiens
gctgtcttgctcactcttgcag

SEQ ID NO: 91666 - DNA, 22 bp, Homo sapiens
aggaatgacaggcctcccgcag

SEQ ID NO: 91667 - DNA, 22 bp, Homo sapiens
gctgcagggagctggaaggctc

SEQ ID NO: 91668 - DNA, 22 bp, Homo sapiens
tccgaggccaaagctgtgaata

SEQ ID NO: 91669 - DNA, 22 bp, Homo sapiens
aagtgctgggattacaggtgtc

SEQ ID NO: 91670 - DNA, 22 bp, Homo sapiens
ttctcaagaacatatgtagggt

SEQ ID NO: 91671 - DNA, 22 bp, Homo sapiens
ggtgacagtggttaaaatttgt

SEQ ID NO: 91672 - DNA, 22 bp, Homo sapiens
cccagcaggtcggtgctgcctg

SEQ ID NO: 91673 - DNA, 21 bp, Homo sapiens
gggcagaggggcctcctgggt

SEQ ID NO: 91674 - DNA, 22 bp, Homo sapiens
gagacacaggcacagaagaggc

SEQ ID NO: 91675 - DNA, 21 bp, Homo sapiens
accactgcctccaaggttcag

SEQ ID NO: 91676 - DNA, 22 bp, Homo sapiens
tgccatagcaatggtaagctga

SEQ ID NO: 91677 - DNA, 22 bp, Homo sapiens
ctacaaaagtaattgtggtttt

SEQ ID NO: 91678 - DNA, 22 bp, Homo sapiens
gtcagatctttggggatgctgt

SEQ ID NO: 91679 - DNA, 22 bp, Homo sapiens
cccagcgagtttgccggtgaac

SEQ ID NO: 91680 - DNA, 22 bp, Homo sapiens
ggtccccccatggtgagcactg

SEQ ID NO: 91681 - DNA, 22 bp, Homo sapiens
gaagaggttcaacgtggtcatc

SEQ ID NO: 91682 - DNA, 22 bp, Homo sapiens
acttgccccagaattgctgctg

SEQ ID NO: 91683 - DNA, 22 bp, Homo sapiens
taaaatttgtccctgagtgttg

SEQ ID NO: 91684 - DNA, 22 bp, Homo sapiens
ctatacagcagcttactagtta

SEQ ID NO: 91685 - DNA, 22 bp, Homo sapiens
gaggttggggctgcagtgagct

SEQ ID NO: 91686 - DNA, 22 bp, Homo sapiens
tgagaacggatactaagggctg

SEQ ID NO: 91687 - DNA, 22 bp, Homo sapiens
aatgcaccttggcagggattca

SEQ ID NO: 91688 - DNA, 22 bp, Homo sapiens
tggtggctaccaggtcctgggg

SEQ ID NO: 91689 - DNA, 22 bp, Homo sapiens
ggtgaagtaatgaaacagggag

SEQ ID NO: 91690 - DNA, 22 bp, Homo sapiens
ctgggaggcggaggttgcagtg

SEQ ID NO: 91691 - DNA, 18 bp, Homo sapiens
tcctttctccctcatctt

SEQ ID NO: 91692 - DNA, 22 bp, Homo sapiens
ggcaaggggtcaggctgagaca

SEQ ID NO: 91693 - DNA, 22 bp, Homo sapiens
actttaaaactgatcatcagag

SEQ ID NO: 91694 - DNA, 22 bp, Homo sapiens
gcccggcagtcacacacccagg

SEQ ID NO: 91695 - DNA, 22 bp, Homo sapiens
cagagctgtccaaaccctgaca

SEQ ID NO: 91696 - DNA, 22 bp, Homo sapiens
aaagattaaatcaaattggtca

SEQ ID NO: 91697 - DNA, 22 bp, Homo sapiens
tagcacagcttcttgatgtcac

SEQ ID NO: 91698 - DNA, 22 bp, Homo sapiens
atcaaatacaaagggcataagg

SEQ ID NO: 91699 - DNA, 22 bp, Homo sapiens
cacactgtctttatgagctgta

SEQ ID NO: 91700 - DNA, 23 bp, Homo sapiens
gggggccgtcctggggattatag

SEQ ID NO: 91701 - DNA, 22 bp, Homo sapiens
atttacaggtagaattttaagt

SEQ ID NO: 91702 - DNA, 22 bp, Homo sapiens
ggctcttccgccaccagccaca

SEQ ID NO: 91703 - DNA, 22 bp, Homo sapiens
gtaggtcagacataagaggaca

SEQ ID NO: 91704 - DNA, 22 bp, Homo sapiens
caggaaggggctcactctggcc

SEQ ID NO: 91705 - DNA, 16 bp, Homo sapiens
gcagaggaaaggggag

SEQ ID NO: 91706 - DNA, 22 bp, Homo sapiens
aaagtgctgggattataggcat

SEQ ID NO: 91707 - DNA, 22 bp, Homo sapiens
tgaatgtgatgctaaacatatg

SEQ ID NO: 91708 - DNA, 22 bp, Homo sapiens
attataggcttgagccaccgtg

SEQ ID NO: 91709 - DNA, 23 bp, Homo sapiens
aagttagtttcaataaagcaatt

SEQ ID NO: 91710 - DNA, 22 bp, Homo sapiens
ttgagagttctgaatgagtaac

SEQ ID NO: 91711 - DNA, 22 bp, Homo sapiens
taggcatgcaaataaatgtgca

SEQ ID NO: 91712 - DNA, 22 bp, Homo sapiens
ataaaatttgctactgttaaat

SEQ ID NO: 91713 - DNA, 22 bp, Homo sapiens
ggagacagggttgaaccacgca

SEQ ID NO: 91714 - DNA, 21 bp, Homo sapiens
tttcttaggctctaaaatgac

SEQ ID NO: 91715 - DNA, 22 bp, Homo sapiens
tgtagtagcattcacgaagtgt

SEQ ID NO: 91716 - DNA, 22 bp, Homo sapiens
gtaaaaaggccaagcccttgtg

SEQ ID NO: 91717 - DNA, 22 bp, Homo sapiens
agactttaacaatgggtatgaa

SEQ ID NO: 91718 - DNA, 22 bp, Homo sapiens
aaagtgctgggattacaagcgt

SEQ ID NO: 91719 - DNA, 22 bp, Homo sapiens
ctcagctgcagcctggctggca

SEQ ID NO: 91720 - DNA, 22 bp, Homo sapiens
tcgtgatctgtccacctcggcc

SEQ ID NO: 91721 - DNA, 22 bp, Homo sapiens
ctggagtagccggacgggtctg

SEQ ID NO: 91722 - DNA, 22 bp, Homo sapiens
cctggcctttgaacgctagact

SEQ ID NO: 91723 - DNA, 22 bp, Homo sapiens
gcccagccacagtcactttcat

SEQ ID NO: 91724 - DNA, 22 bp, Homo sapiens
gctgggacaacaggtgagcacc

SEQ ID NO: 91725 - DNA, 22 bp, Homo sapiens
ctgggctagaaggaccaggatg

SEQ ID NO: 91726 - DNA, 22 bp, Homo sapiens
caggaggattgcttgaggccag

SEQ ID NO: 91727 - DNA, 22 bp, Homo sapiens
tacactgctgggcagtgaatga

SEQ ID NO: 91728 - DNA, 20 bp, Homo sapiens
tttgcgaggccaaggcgggc

SEQ ID NO: 91729 - DNA, 22 bp, Homo sapiens
attaaagctatccagtcatgaa

SEQ ID NO: 91730 - DNA, 22 bp, Homo sapiens
tgggaagaggagcactggaatg

SEQ ID NO: 91731 - DNA, 22 bp, Homo sapiens
tgggcagggagctggaaccaca

SEQ ID NO: 91732 - DNA, 22 bp, Homo sapiens
aagccggctgggccgaggctgc

SEQ ID NO: 91733 - DNA, 22 bp, Homo sapiens
ctgggcaaattgtgccagctat

SEQ ID NO: 91734 - DNA, 22 bp, Homo sapiens
ggagagggtaggggtcctgccc

SEQ ID NO: 91735 - DNA, 22 bp, Homo sapiens
gttcagatttgactggtttctc

SEQ ID NO: 91736 - DNA, 22 bp, Homo sapiens
ggtgctggacacgtggcactcc

SEQ ID NO: 91737 - DNA, 22 bp, Homo sapiens
tgcttgtgacagaactgtgtcc

SEQ ID NO: 91738 - DNA, 22 bp, Homo sapiens
atgtttttggaaatgggaacat

SEQ ID NO: 91739 - DNA, 22 bp, Homo sapiens
tccagcccaggctggagtgtag

SEQ ID NO: 91740 - DNA, 22 bp, Homo sapiens
tttagattgtgacctcccccca

SEQ ID NO: 91741 - DNA, 22 bp, Homo sapiens
actaggggctcaggcccaggga

SEQ ID NO: 91742 - DNA, 22 bp, Homo sapiens
tttgttttcaatgtgtcattca

SEQ ID NO: 91743 - DNA, 22 bp, Homo sapiens
acaattctgatggtttcccagt

SEQ ID NO: 91744 - DNA, 22 bp, Homo sapiens
tgtgaagaattaatgtgaatca

SEQ ID NO: 91745 - DNA, 22 bp, Homo sapiens
cacttcaacctctgagtcctgg

SEQ ID NO: 91746 - DNA, 22 bp, Homo sapiens
ctcctgagctctgaggaagctt

SEQ ID NO: 91747 - DNA, 22 bp, Homo sapiens
ggagtgaatcactagatgcaga

SEQ ID NO: 91748 - DNA, 22 bp, Homo sapiens
agcctgcgatcccacctggcct

SEQ ID NO: 91749 - DNA, 22 bp, Homo sapiens
cacccaggctggagagcagtgg

SEQ ID NO: 91750 - DNA, 22 bp, Homo sapiens
aggaatgacagatgtccgcacc

SEQ ID NO: 91751 - DNA, 22 bp, Homo sapiens
tggtgccatcatagctcactgc

SEQ ID NO: 91752 - DNA, 22 bp, Homo sapiens
aactatgttaataagtttcatt

SEQ ID NO: 91753 - DNA, 22 bp, Homo sapiens
actctgctctgtatttcactgt

SEQ ID NO: 91754 - DNA, 22 bp, Homo sapiens
gcagcagtgctttggaatcctg

SEQ ID NO: 91755 - DNA, 22 bp, Homo sapiens
gctcgcgccgcaccggtccacc

SEQ ID NO: 91756 - DNA, 19 bp, Homo sapiens
gatttaaacgtggctctat

SEQ ID NO: 91757 - DNA, 22 bp, Homo sapiens
agtgaggggcagctgagtgggc

SEQ ID NO: 91758 - DNA, 22 bp, Homo sapiens
ttctccgctaagttctctgcag

SEQ ID NO: 91759 - DNA, 22 bp, Homo sapiens
tcttgaattgtactcccataag

SEQ ID NO: 91760 - DNA, 22 bp, Homo sapiens
atgccactgcgctccagcctgg

SEQ ID NO: 91761 - DNA, 22 bp, Homo sapiens
aaatgtaagtctttgtttctta

SEQ ID NO: 91762 - DNA, 22 bp, Homo sapiens
tgtccaggttagcttcaaacac

SEQ ID NO: 91763 - DNA, 22 bp, Homo sapiens
aacagctttgtatacagtaact

SEQ ID NO: 91764 - DNA, 22 bp, Homo sapiens
cccgggaggcagaggttgcagt

SEQ ID NO: 91765 - DNA, 22 bp, Homo sapiens
ctgttcccggtggccgggccag

SEQ ID NO: 91766 - DNA, 22 bp, Homo sapiens
ttctgtggttgaaaggagagat

SEQ ID NO: 91767 - DNA, 22 bp, Homo sapiens
caaagtgctgggattacaggtg

SEQ ID NO: 91768 - DNA, 22 bp, Homo sapiens
gcccgcagagatctttaacaaa

SEQ ID NO: 91769 - DNA, 22 bp, Homo sapiens
gctccaaagtacagtgacttac

SEQ ID NO: 91770 - DNA, 22 bp, Homo sapiens
ttccagttcactccatttctgg

SEQ ID NO: 91771 - DNA, 21 bp, Homo sapiens
agcgtcaatatcgtcaacagg

SEQ ID NO: 91772 - DNA, 22 bp, Homo sapiens
aacgcccagccttgatcaaatg

SEQ ID NO: 91773 - DNA, 22 bp, Homo sapiens
gcagcaacgcggccctactgct

SEQ ID NO: 91774 - DNA, 22 bp, Homo sapiens
aagtgcttccatgtttgagtgt

SEQ ID NO: 91775 - DNA, 21 bp, Homo sapiens
cactccacttagaacagggtt

SEQ ID NO: 91776 - DNA, 22 bp, Homo sapiens
tgctcttcacagtttcagcatc

SEQ ID NO: 91777 - DNA, 22 bp, Homo sapiens
gaatgctaagcatgtgggagtt

SEQ ID NO: 91778 - DNA, 19 bp, Homo sapiens
tcctggggaggggcatggc

SEQ ID NO: 91779 - DNA, 22 bp, Homo sapiens
caggtgcctcaggatgagacaa

SEQ ID NO: 91780 - DNA, 22 bp, Homo sapiens
cctcctgcacctccaggaactc

SEQ ID NO: 91781 - DNA, 22 bp, Homo sapiens
ctggtagtttgcaaaatggtgt

SEQ ID NO: 91782 - DNA, 22 bp, Homo sapiens
tggacaacatagtgagacctca

SEQ ID NO: 91783 - DNA, 22 bp, Homo sapiens
tccggtccgggtactcctctct

SEQ ID NO: 91784 - DNA, 22 bp, Homo sapiens
tgtctccaccatcatcttacca

SEQ ID NO: 91785 - DNA, 22 bp, Homo sapiens
gggagctgaaggagccggcggg

SEQ ID NO: 91786 - DNA, 20 bp, Homo sapiens
gaccagatcccttaccagct

SEQ ID NO: 91787 - DNA, 22 bp, Homo sapiens
atatgggggggcgtgcagagga

SEQ ID NO: 91788 - DNA, 22 bp, Homo sapiens
tctctggactcgagcttactca

SEQ ID NO: 91789 - DNA, 22 bp, Homo sapiens
actgcacttcaccctgggtgac

SEQ ID NO: 91790 - DNA, 22 bp, Homo sapiens
ggggaccctcaggactgcgtct

SEQ ID NO: 91791 - DNA, 22 bp, Homo sapiens
tttctttatcatagcatctttg

SEQ ID NO: 91792 - DNA, 22 bp, Homo sapiens
caggctggagtgcagtggcgct

SEQ ID NO: 91793 - DNA, 22 bp, Homo sapiens
acccaggctggagtgcagtgat

SEQ ID NO: 91794 - DNA, 22 bp, Homo sapiens
taatgtaaacacagagacagaa

SEQ ID NO: 91795 - DNA, 23 bp, Homo sapiens
aaacttgctatggctgaaatcat

SEQ ID NO: 91796 - DNA, 22 bp, Homo sapiens
gggggctccaggcgagaatgtg

SEQ ID NO: 91797 - DNA, 22 bp, Homo sapiens
gcctctgagctcctttgaccac

SEQ ID NO: 91798 - DNA, 22 bp, Homo sapiens
tggcagtggcgggactcagggc

SEQ ID NO: 91799 - DNA, 22 bp, Homo sapiens
gtggggacgggatggctcactg

SEQ ID NO: 91800 - DNA, 22 bp, Homo sapiens
tgatttatgcattatactgttg

SEQ ID NO: 91801 - DNA, 22 bp, Homo sapiens
tgggaagggtcaacagctggaa

SEQ ID NO: 91802 - DNA, 22 bp, Homo sapiens
aacagcttgctgcaccttaata

SEQ ID NO: 91803 - DNA, 22 bp, Homo sapiens
ctcagcactgacccaggagatg

SEQ ID NO: 91804 - DNA, 22 bp, Homo sapiens
aaaagcaattgcagttcttgcc

SEQ ID NO: 91805 - DNA, 22 bp, Homo sapiens
gctggaggatggactggaagaa

SEQ ID NO: 91806 - DNA, 22 bp, Homo sapiens
gctgcactttgactgctggggt

SEQ ID NO: 91807 - DNA, 18 bp, Homo sapiens
actctttctgcccacagg

SEQ ID NO: 91808 - DNA, 22 bp, Homo sapiens
agcttgggcaacacagcaagac

SEQ ID NO: 91809 - DNA, 22 bp, Homo sapiens
tccttaggcaatttgggagagt

SEQ ID NO: 91810 - DNA, 22 bp, Homo sapiens
cttggtgccacagcagcttgcg

SEQ ID NO: 91811 - DNA, 23 bp, Homo sapiens
tcagaacagttcttggtgcatag

SEQ ID NO: 91812 - DNA, 22 bp, Homo sapiens
ttattttaccttcctctgagct

SEQ ID NO: 91813 - DNA, 22 bp, Homo sapiens
gtcacctcgctgtcttcctgag

SEQ ID NO: 91814 - DNA, 22 bp, Homo sapiens
tcaaaaagttgaagagttgggg

SEQ ID NO: 91815 - DNA, 22 bp, Homo sapiens
tctggctccaggaccgggcaca

SEQ ID NO: 91816 - DNA, 22 bp, Homo sapiens
tggatctcggcaatgcgggact

SEQ ID NO: 91817 - DNA, 22 bp, Homo sapiens
cagccccacacggtctagctct

SEQ ID NO: 91818 - DNA, 22 bp, Homo sapiens
aaagcctcccaggttatgagta

SEQ ID NO: 91819 - DNA, 22 bp, Homo sapiens
ggtctcatctttcagcgtcgag

SEQ ID NO: 91820 - DNA, 22 bp, Homo sapiens
cttagatgaagtcacagaaccc

SEQ ID NO: 91821 - DNA, 22 bp, Homo sapiens
aacccgggaggcagaggttgtg

SEQ ID NO: 91822 - DNA, 22 bp, Homo sapiens
agaagccaccagctgaggaaga

SEQ ID NO: 91823 - DNA, 22 bp, Homo sapiens
aaagtgctgggattacaggcct

SEQ ID NO: 91824 - DNA, 22 bp, Homo sapiens
gcggcccgagcaggacgggtgg

SEQ ID NO: 91825 - DNA, 22 bp, Homo sapiens
ggtccccgtggaggctggagcg

SEQ ID NO: 91826 - DNA, 23 bp, Homo sapiens
tgttccagatacgccttttcctc

SEQ ID NO: 91827 - DNA, 17 bp, Homo sapiens
caggtgttctgtttttc

SEQ ID NO: 91828 - DNA, 22 bp, Homo sapiens
taattcttcaggccttttgtct

SEQ ID NO: 91829 - DNA, 22 bp, Homo sapiens
aggagcagaccgtagtcctgca

SEQ ID NO: 91830 - DNA, 21 bp, Homo sapiens
gtggttctagagaaacagaat

SEQ ID NO: 91831 - DNA, 17 bp, Homo sapiens
cagtcgaggaggacctg

SEQ ID NO: 91832 - DNA, 22 bp, Homo sapiens
ttggagagtgatattcagatgc

SEQ ID NO: 91833 - DNA, 22 bp, Homo sapiens
aaggccttgccgaaggatgcca

SEQ ID NO: 91834 - DNA, 22 bp, Homo sapiens
aaggaaagctgtggttctgaga

SEQ ID NO: 91835 - DNA, 22 bp, Homo sapiens
ctgggatccacgggctcccaag

SEQ ID NO: 91836 - DNA, 22 bp, Homo sapiens
ccctgcctacagggttttcttt

SEQ ID NO: 91837 - DNA, 22 bp, Homo sapiens
atgaaaacggaccagagctatt

SEQ ID NO: 91838 - DNA, 22 bp, Homo sapiens
aagtccaggtcctcattccatc

SEQ ID NO: 91839 - DNA, 22 bp, Homo sapiens
agcacctgtcaagtccaggctg

SEQ ID NO: 91840 - DNA, 22 bp, Homo sapiens
agtgcaggccccaggccaggcc

SEQ ID NO: 91841 - DNA, 22 bp, Homo sapiens
ggagaagcagcttcttgatgaa

SEQ ID NO: 91842 - DNA, 22 bp, Homo sapiens
gcagggaggtttgctgacctgg

SEQ ID NO: 91843 - DNA, 22 bp, Homo sapiens
taacaaagtattgtttgtgtat

SEQ ID NO: 91844 - DNA, 22 bp, Homo sapiens
ccaccagctgcatatgcacgta

SEQ ID NO: 91845 - DNA, 22 bp, Homo sapiens
tgccgcagtgcggggagggccc

SEQ ID NO: 91846 - DNA, 22 bp, Homo sapiens
agcccggcttccccggttgcta

SEQ ID NO: 91847 - DNA, 21 bp, Homo sapiens
ggccgccgccttgtgctctgc

SEQ ID NO: 91848 - DNA, 22 bp, Homo sapiens
tggcacagcctccatgtcgtcc

SEQ ID NO: 91849 - DNA, 22 bp, Homo sapiens
ggaggcggaggttgcagtgagt

SEQ ID NO: 91850 - DNA, 22 bp, Homo sapiens
ggaggtggaggttgcagtgagc

SEQ ID NO: 91851 - DNA, 22 bp, Homo sapiens
ctgtggttggagtgcagtgaga

SEQ ID NO: 91852 - DNA, 22 bp, Homo sapiens
aaggtgggcagatcacaaggtc

SEQ ID NO: 91853 - DNA, 22 bp, Homo sapiens
aacactctctgttggtaaggct

SEQ ID NO: 91854 - DNA, 22 bp, Homo sapiens
tctgtcttagccatctcaggct

SEQ ID NO: 91855 - DNA, 23 bp, Homo sapiens
tctctgcatgtcctgagcacatc

SEQ ID NO: 91856 - DNA, 22 bp, Homo sapiens
gcccaggctggagtgcagtggc

SEQ ID NO: 91857 - DNA, 22 bp, Homo sapiens
cagctacaaatacttttgtatg

SEQ ID NO: 91858 - DNA, 22 bp, Homo sapiens
ccacgtccagctaattttcgta

SEQ ID NO: 91859 - DNA, 22 bp, Homo sapiens
agggagcaaaggtttcagggtt

SEQ ID NO: 91860 - DNA, 22 bp, Homo sapiens
tactgtgtgcccagccgagctg

SEQ ID NO: 91861 - DNA, 22 bp, Homo sapiens
gagtggggggtccgtctcagtg

SEQ ID NO: 91862 - DNA, 22 bp, Homo sapiens
ctttgcttgacactgtgattgt

SEQ ID NO: 91863 - DNA, 22 bp, Homo sapiens
ttgttgtcattgtagaggattt

SEQ ID NO: 91864 - DNA, 22 bp, Homo sapiens
ctgtctgtagacatttttggtt

SEQ ID NO: 91865 - DNA, 22 bp, Homo sapiens
ggttccccaggcggcccttgga

SEQ ID NO: 91866 - DNA, 22 bp, Homo sapiens
ccacgcatccctccacagagag

SEQ ID NO: 91867 - DNA, 22 bp, Homo sapiens
tttctggcagcgggacaggggt

SEQ ID NO: 91868 - DNA, 22 bp, Homo sapiens
gggccctgcgactcgcggcgga

SEQ ID NO: 91869 - DNA, 22 bp, Homo sapiens
agcactgatttaaactggattt

SEQ ID NO: 91870 - DNA, 22 bp, Homo sapiens
tgtctctgtgactccttccgcc

SEQ ID NO: 91871 - DNA, 22 bp, Homo sapiens
actgggaagtcagagagaggct

SEQ ID NO: 91872 - DNA, 17 bp, Homo sapiens
gagacccccactacacc

SEQ ID NO: 91873 - DNA, 22 bp, Homo sapiens
tgaggcaggaggttgagaactg

SEQ ID NO: 91874 - DNA, 22 bp, Homo sapiens
tcgcccaggctggaagtgcagt

SEQ ID NO: 91875 - DNA, 22 bp, Homo sapiens
ttgcaattgctatggagagcgt

SEQ ID NO: 91876 - DNA, 18 bp, Homo sapiens
gcagctagccaggggggc

SEQ ID NO: 91877 - DNA, 22 bp, Homo sapiens
tttagcgtagctgacagctaat

SEQ ID NO: 91878 - DNA, 21 bp, Homo sapiens
tgaaggggtggcagtgtgctt

SEQ ID NO: 91879 - DNA, 19 bp, Homo sapiens
taaaacgtgcatggcagca

SEQ ID NO: 91880 - DNA, 22 bp, Homo sapiens
gccagggttcgaatccgtatgg

SEQ ID NO: 91881 - DNA, 22 bp, Homo sapiens
taagggaacagcttcaaactca

SEQ ID NO: 91882 - DNA, 22 bp, Homo sapiens
tgtgtctcaagtcagagcatca

SEQ ID NO: 91883 - DNA, 20 bp, Homo sapiens
aaactaaaggtgtttggttt

SEQ ID NO: 91884 - DNA, 18 bp, Homo sapiens
acctgattggcgcagccc

SEQ ID NO: 91885 - DNA, 22 bp, Homo sapiens
cagggccagcgtctcgggctat

SEQ ID NO: 91886 - DNA, 22 bp, Homo sapiens
gaccctctagatggaagcactg

SEQ ID NO: 91887 - DNA, 22 bp, Homo sapiens
ctgggctcaagtgatccaccca

SEQ ID NO: 91888 - DNA, 22 bp, Homo sapiens
ggctgagttgagaggattactt

SEQ ID NO: 91889 - DNA, 22 bp, Homo sapiens
gctgcagacttctcatctcatt

SEQ ID NO: 91890 - DNA, 22 bp, Homo sapiens
atcagtgtgtcaaaagcacaaa

SEQ ID NO: 91891 - DNA, 22 bp, Homo sapiens
ggggcaggagcccttcttcagc

SEQ ID NO: 91892 - DNA, 22 bp, Homo sapiens
acatcctcccgatctactggct

SEQ ID NO: 91893 - DNA, 22 bp, Homo sapiens
ttgctctgactggagtgcagtg

SEQ ID NO: 91894 - DNA, 21 bp, Homo sapiens
aggcttggatctagacaggcc

SEQ ID NO: 91895 - DNA, 22 bp, Homo sapiens
gcaggtctgttgattacagtca

SEQ ID NO: 91896 - DNA, 22 bp, Homo sapiens
cccgggttgtccgcgcgtccgg

SEQ ID NO: 91897 - DNA, 22 bp, Homo sapiens
aggctcagatccttgtgtcctg

SEQ ID NO: 91898 - DNA, 18 bp, Homo sapiens
taatccatatgctttgcc

SEQ ID NO: 91899 - DNA, 22 bp, Homo sapiens
aaatatcttaggagtatatgag

SEQ ID NO: 91900 - DNA, 22 bp, Homo sapiens
gaagccttgaactgcaaacccc

SEQ ID NO: 91901 - DNA, 22 bp, Homo sapiens
atgttattgatgcctgaggctt

SEQ ID NO: 91902 - DNA, 22 bp, Homo sapiens
ttcccacattctttacattcat

SEQ ID NO: 91903 - DNA, 19 bp, Homo sapiens
aatgctgcttctttttgca

SEQ ID NO: 91904 - DNA, 22 bp, Homo sapiens
tcctcagcttttatttcacttg

SEQ ID NO: 91905 - DNA, 22 bp, Homo sapiens
ggcagggagtggagactcccta

SEQ ID NO: 91906 - DNA, 22 bp, Homo sapiens
ctcacctccaggagctgctggc

SEQ ID NO: 91907 - DNA, 23 bp, Homo sapiens
catctagcatccagtgagtagtg

SEQ ID NO: 91908 - DNA, 22 bp, Homo sapiens
cgccccggacgtctgaccaaac

SEQ ID NO: 91909 - DNA, 22 bp, Homo sapiens
aaccagatgcttccccagatgc

SEQ ID NO: 91910 - DNA, 22 bp, Homo sapiens
gagtgtgtcggtcagcgtggcg

SEQ ID NO: 91911 - DNA, 22 bp, Homo sapiens
gtgagactcgcctttgtgtagc

SEQ ID NO: 91912 - DNA, 22 bp, Homo sapiens
cctacctggggcaggcctcggg

SEQ ID NO: 91913 - DNA, 22 bp, Homo sapiens
tgtgtgcatgcttggggcagca

SEQ ID NO: 91914 - DNA, 17 bp, Homo sapiens
aggaggccctggcgttt

SEQ ID NO: 91915 - DNA, 22 bp, Homo sapiens
aggggagccagggctgcgagtt

SEQ ID NO: 91916 - DNA, 22 bp, Homo sapiens
agtgggtgacagttaacaggtt

SEQ ID NO: 91917 - DNA, 22 bp, Homo sapiens
cccaggcttttctcttgcccca

SEQ ID NO: 91918 - DNA, 20 bp, Homo sapiens
gccgactgccttgtgagcct

SEQ ID NO: 91919 - DNA, 22 bp, Homo sapiens
aatgcaatgcagcacctccttg

SEQ ID NO: 91920 - DNA, 22 bp, Homo sapiens
ccgggttgaggttcccatagat

SEQ ID NO: 91921 - DNA, 22 bp, Homo sapiens
agacactgttctcacatgcttg

SEQ ID NO: 91922 - DNA, 22 bp, Homo sapiens
tttcttctatgtgtgatatttt

SEQ ID NO: 91923 - DNA, 22 bp, Homo sapiens
atggcaccttccccagagctca

SEQ ID NO: 91924 - DNA, 22 bp, Homo sapiens
ctgcactgacttccccggctgc

SEQ ID NO: 91925 - DNA, 22 bp, Homo sapiens
tctgagccagggtctcctccct

SEQ ID NO: 91926 - DNA, 23 bp, Homo sapiens
aattatctatttcaaatttagca

SEQ ID NO: 91927 - DNA, 22 bp, Homo sapiens
ctctgcaagtccagcccctggc

SEQ ID NO: 91928 - DNA, 22 bp, Homo sapiens
gagcccgagcgcgtacccggcg

SEQ ID NO: 91929 - DNA, 22 bp, Homo sapiens
tctgtgagaaccagtgccaggg

SEQ ID NO: 91930 - DNA, 22 bp, Homo sapiens
ctccagattccgtttattcagg

SEQ ID NO: 91931 - DNA, 22 bp, Homo sapiens
atgaatgccacgatttcatcct

SEQ ID NO: 91932 - DNA, 22 bp, Homo sapiens
cactgcacttcagcctgggtga

SEQ ID NO: 91933 - DNA, 22 bp, Homo sapiens
gaatttaagaggatgaatctgt

SEQ ID NO: 91934 - DNA, 22 bp, Homo sapiens
ctgggcacagcgttgggctctt

SEQ ID NO: 91935 - DNA, 22 bp, Homo sapiens
cgctgcgaggcgcccttgttgc

SEQ ID NO: 91936 - DNA, 22 bp, Homo sapiens
ggaggagcatgagagggtagtg

SEQ ID NO: 91937 - DNA, 18 bp, Homo sapiens
agtgtcagctgcagctca

SEQ ID NO: 91938 - DNA, 22 bp, Homo sapiens
ttggccatctaagcccagccac

SEQ ID NO: 91939 - DNA, 22 bp, Homo sapiens
gatgcgggcccgctccactgcc

SEQ ID NO: 91940 - DNA, 22 bp, Homo sapiens
tgtatagttgagtcaagtttca

SEQ ID NO: 91941 - DNA, 22 bp, Homo sapiens
ggccagaagttggaaaagagcc

SEQ ID NO: 91942 - DNA, 22 bp, Homo sapiens
tgcccaggctggagtgcagtgg

SEQ ID NO: 91943 - DNA, 22 bp, Homo sapiens
gccacctcggctttctctgctc

SEQ ID NO: 91944 - DNA, 22 bp, Homo sapiens
agcctctctgttagtcactggg

SEQ ID NO: 91945 - DNA, 22 bp, Homo sapiens
agatttatgtggtcacactcag

SEQ ID NO: 91946 - DNA, 22 bp, Homo sapiens
cacatgaaggctggggtcgtga

SEQ ID NO: 91947 - DNA, 22 bp, Homo sapiens
catggggcccatgtgctccaag

SEQ ID NO: 91948 - DNA, 22 bp, Homo sapiens
ctggagcaaaagtgactcctct

SEQ ID NO: 91949 - DNA, 22 bp, Homo sapiens
ccagcagagcatggggaggaag

SEQ ID NO: 91950 - DNA, 22 bp, Homo sapiens
tggggagtgatgcctcggataa

SEQ ID NO: 91951 - DNA, 20 bp, Homo sapiens
tgagacccgctgacaagttc

SEQ ID NO: 91952 - DNA, 22 bp, Homo sapiens
gtctttcttaaacaacagaaca

SEQ ID NO: 91953 - DNA, 23 bp, Homo sapiens
cctgcctccccatcagttataca

SEQ ID NO: 91954 - DNA, 22 bp, Homo sapiens
ttccgagggctcggcggccgcc

SEQ ID NO: 91955 - DNA, 22 bp, Homo sapiens
atttagaactttgtttgccaat

SEQ ID NO: 91956 - DNA, 22 bp, Homo sapiens
gtctgaatacgtacttgtgaag

SEQ ID NO: 91957 - DNA, 22 bp, Homo sapiens
ttcaggcccagcacagcgcgtg

SEQ ID NO: 91958 - DNA, 22 bp, Homo sapiens
gaggccacggaagggagctgtg

SEQ ID NO: 91959 - DNA, 22 bp, Homo sapiens
atgccactgcactccagcctag

SEQ ID NO: 91960 - DNA, 22 bp, Homo sapiens
ctgggaggcggagcttgcagtg

SEQ ID NO: 91961 - DNA, 21 bp, Homo sapiens
caatggcgagatcttggctca

SEQ ID NO: 91962 - DNA, 22 bp, Homo sapiens
gtgcctgcaggtgccggcttca

SEQ ID NO: 91963 - DNA, 23 bp, Homo sapiens
tgcaatggcatgatttcagctca

SEQ ID NO: 91964 - DNA, 22 bp, Homo sapiens
ccagatgtccctctcaggtttg

SEQ ID NO: 91965 - DNA, 22 bp, Homo sapiens
atatatttgagaatattcatga

SEQ ID NO: 91966 - DNA, 22 bp, Homo sapiens
tagcagtgtctaggtaggccat

SEQ ID NO: 91967 - DNA, 22 bp, Homo sapiens
cctcatcgtttccagaatgtgg

SEQ ID NO: 91968 - DNA, 22 bp, Homo sapiens
atggcagcggagctggaaatga

SEQ ID NO: 91969 - DNA, 22 bp, Homo sapiens
cccatggcttaggagggagtgt

SEQ ID NO: 91970 - DNA, 22 bp, Homo sapiens
atgcgagtgatgcagagtggct

SEQ ID NO: 91971 - DNA, 22 bp, Homo sapiens
gaagagctgacagtgtcatcct

SEQ ID NO: 91972 - DNA, 22 bp, Homo sapiens
cagagagaatcttggcagctga

SEQ ID NO: 91973 - DNA, 22 bp, Homo sapiens
tctgtcacccagagtgcagtgg

SEQ ID NO: 91974 - DNA, 23 bp, Homo sapiens
cagagctggctcagagctgcctg

SEQ ID NO: 91975 - DNA, 22 bp, Homo sapiens
ttcctgcgcccttctcgcccgc

SEQ ID NO: 91976 - DNA, 22 bp, Homo sapiens
ctgtatttcttggacagttgct

SEQ ID NO: 91977 - DNA, 22 bp, Homo sapiens
cccagcagtagagctcatatgg

SEQ ID NO: 91978 - DNA, 22 bp, Homo sapiens
gtgacaggccactgcggctctg

SEQ ID NO: 91979 - DNA, 22 bp, Homo sapiens
acgcccggtctccatagttttt

SEQ ID NO: 91980 - DNA, 22 bp, Homo sapiens
aactctatttaccctactaaac

SEQ ID NO: 91981 - DNA, 22 bp, Homo sapiens
ccctaaaagtctcattttccag

SEQ ID NO: 91982 - DNA, 20 bp, Homo sapiens
ataaaataactgccacaaga

SEQ ID NO: 91983 - DNA, 22 bp, Homo sapiens
tatttcttttcgtgacttattg

SEQ ID NO: 91984 - DNA, 22 bp, Homo sapiens
actgcaacacctcctgggttca

SEQ ID NO: 91985 - DNA, 22 bp, Homo sapiens
aattttctggtgtgtaatgaag

SEQ ID NO: 91986 - DNA, 23 bp, Homo sapiens
aggcgagctcttctccagcacgt

SEQ ID NO: 91987 - DNA, 22 bp, Homo sapiens
cccaggaattggaggctgcagt

SEQ ID NO: 91988 - DNA, 22 bp, Homo sapiens
atgtggcaccgatctttagcca

SEQ ID NO: 91989 - DNA, 23 bp, Homo sapiens
ggctgggagctccgggtgcacgt

SEQ ID NO: 91990 - DNA, 22 bp, Homo sapiens
gaaggtggcgagcggattgctg

SEQ ID NO: 91991 - DNA, 22 bp, Homo sapiens
aggctccctgaatcgcccgttc

SEQ ID NO: 91992 - DNA, 22 bp, Homo sapiens
ttcctcaggctgctttcacata

SEQ ID NO: 91993 - DNA, 22 bp, Homo sapiens
tggaggcgagagcgcgcgggct

SEQ ID NO: 91994 - DNA, 22 bp, Homo sapiens
ttgtgtgtactggttatgggca

SEQ ID NO: 91995 - DNA, 22 bp, Homo sapiens
gcagcctcaaactccccagctc

SEQ ID NO: 91996 - DNA, 22 bp, Homo sapiens
gtgagccgagtatagttcatag

SEQ ID NO: 91997 - DNA, 22 bp, Homo sapiens
cgtcatcacggcaagcatctcc

SEQ ID NO: 91998 - DNA, 22 bp, Homo sapiens
tgagatgaataactcctgctaa

SEQ ID NO: 91999 - DNA, 22 bp, Homo sapiens
atggggagctcaccacctgttt

SEQ ID NO: 92000 - DNA, 22 bp, Homo sapiens
ggatgcacgaaggcgcctcgga

SEQ ID NO: 92001 - DNA, 22 bp, Homo sapiens
acatgtttaagtttgttatatg

SEQ ID NO: 92002 - DNA, 22 bp, Homo sapiens
aaggttcctctctccacccagc

SEQ ID NO: 92003 - DNA, 22 bp, Homo sapiens
cattcatctatcaaatggtacc

SEQ ID NO: 92004 - DNA, 20 bp, Homo sapiens
tgcagcacgggccctttcca

SEQ ID NO: 92005 - DNA, 21 bp, Homo sapiens
ctacttaagtaggggattagg

SEQ ID NO: 92006 - DNA, 22 bp, Homo sapiens
gaaactctcgcatcctgggaac

SEQ ID NO: 92007 - DNA, 22 bp, Homo sapiens
ctacccttaagtttctgtgggg

SEQ ID NO: 92008 - DNA, 22 bp, Homo sapiens
cccaggaggtggagcttgcagt

SEQ ID NO: 92009 - DNA, 22 bp, Homo sapiens
cactgcactccagcttgggtga

SEQ ID NO: 92010 - DNA, 22 bp, Homo sapiens
ggaactcctgctccaagcagct

SEQ ID NO: 92011 - DNA, 22 bp, Homo sapiens
tagcataacaggtaagagtgag

SEQ ID NO: 92012 - DNA, 18 bp, Homo sapiens
acacttcctggtggtgtg

SEQ ID NO: 92013 - DNA, 22 bp, Homo sapiens
ctgcagtatgagctacccaggt

SEQ ID NO: 92014 - DNA, 22 bp, Homo sapiens
ggattgcaacaagctagtttag

SEQ ID NO: 92015 - DNA, 22 bp, Homo sapiens
atcccaggcggcacaggttgca

SEQ ID NO: 92016 - DNA, 22 bp, Homo sapiens
ccattgtaaattctgtggaagt

SEQ ID NO: 92017 - DNA, 22 bp, Homo sapiens
ttcactgcaacctccgcctccc

SEQ ID NO: 92018 - DNA, 22 bp, Homo sapiens
tatctaataaatctgataagta

SEQ ID NO: 92019 - DNA, 22 bp, Homo sapiens
ttttcctttgattcccagatgt

SEQ ID NO: 92020 - DNA, 22 bp, Homo sapiens
actgtgaacggactgaagccca

SEQ ID NO: 92021 - DNA, 22 bp, Homo sapiens
tccattatacttctgattcaaa

SEQ ID NO: 92022 - DNA, 22 bp, Homo sapiens
agtcttagaactacagtgccta

SEQ ID NO: 92023 - DNA, 22 bp, Homo sapiens
aaagtgctgggattccaggcgt

SEQ ID NO: 92024 - DNA, 22 bp, Homo sapiens
agctacctgatccttcttctga

SEQ ID NO: 92025 - DNA, 22 bp, Homo sapiens
tgaaatgtgttctagtgttttg

SEQ ID NO: 92026 - DNA, 22 bp, Homo sapiens
ccagaggagttgaggctttggg

SEQ ID NO: 92027 - DNA, 22 bp, Homo sapiens
ccatgtggtgggaaggagaatg

SEQ ID NO: 92028 - DNA, 17 bp, Homo sapiens
acctattgatctgtcac

SEQ ID NO: 92029 - DNA, 22 bp, Homo sapiens
gagatcggtaaagagcatgcac

SEQ ID NO: 92030 - DNA, 22 bp, Homo sapiens
gcctccggagttgcagtgtctt

SEQ ID NO: 92031 - DNA, 21 bp, Homo sapiens
tcacgtggtcacatgagcttt

SEQ ID NO: 92032 - DNA, 22 bp, Homo sapiens
tgtgtgagtaaggctgagagag

SEQ ID NO: 92033 - DNA, 22 bp, Homo sapiens
ctctttggatagaattacaaag

SEQ ID NO: 92034 - DNA, 22 bp, Homo sapiens
ttccatttggagctcgcagcct

SEQ ID NO: 92035 - DNA, 22 bp, Homo sapiens
tatctattatgttctatgtgtc

SEQ ID NO: 92036 - DNA, 22 bp, Homo sapiens
ccagtgtgcaatctctggctta

SEQ ID NO: 92037 - DNA, 22 bp, Homo sapiens
cgccaggcttggtagctcatgc

SEQ ID NO: 92038 - DNA, 22 bp, Homo sapiens
cccaggaggttgaggctgcagt

SEQ ID NO: 92039 - DNA, 22 bp, Homo sapiens
atgcagttccacaggcgcatgg

SEQ ID NO: 92040 - DNA, 22 bp, Homo sapiens
caaagtgctaggattacaggcc

SEQ ID NO: 92041 - DNA, 22 bp, Homo sapiens
tagatgaccttgtgttaggcaa

SEQ ID NO: 92042 - DNA, 22 bp, Homo sapiens
tcttcccccgtgctccagtgca

SEQ ID NO: 92043 - DNA, 21 bp, Homo sapiens
agctgcctccacttctgaggc

SEQ ID NO: 92044 - DNA, 22 bp, Homo sapiens
acccaggctggcgtgcagtggc

SEQ ID NO: 92045 - DNA, 22 bp, Homo sapiens
gctccctggtagccatgctctc

SEQ ID NO: 92046 - DNA, 22 bp, Homo sapiens
ctggcaagaaatatatatctta

SEQ ID NO: 92047 - DNA, 22 bp, Homo sapiens
gggaaggaaagttattagcaga

SEQ ID NO: 92048 - DNA, 22 bp, Homo sapiens
tgctttgtgacagattagtttt

SEQ ID NO: 92049 - DNA, 22 bp, Homo sapiens
tgggagaaagaaccctgagtga

SEQ ID NO: 92050 - DNA, 22 bp, Homo sapiens
gtccccgccgtcgctcaggctg

SEQ ID NO: 92051 - DNA, 22 bp, Homo sapiens
cagccccatggtgtgctccagc

SEQ ID NO: 92052 - DNA, 22 bp, Homo sapiens
aggccagcctgcccaaagctgc

SEQ ID NO: 92053 - DNA, 22 bp, Homo sapiens
atgcagaagactgaaaagctga

SEQ ID NO: 92054 - DNA, 22 bp, Homo sapiens
tggcacagactgggccaaggaa

SEQ ID NO: 92055 - DNA, 22 bp, Homo sapiens
ggagaggcttccagagtcgtgc

SEQ ID NO: 92056 - DNA, 22 bp, Homo sapiens
taggtataggattctaggttgg

SEQ ID NO: 92057 - DNA, 16 bp, Homo sapiens
aggtggagaagttcac

SEQ ID NO: 92058 - DNA, 22 bp, Homo sapiens
ggccaattccaggagccggcgg

SEQ ID NO: 92059 - DNA, 22 bp, Homo sapiens
tttatgtagttacggactatca

SEQ ID NO: 92060 - DNA, 22 bp, Homo sapiens
gagcactcaggacactcatagg

SEQ ID NO: 92061 - DNA, 22 bp, Homo sapiens
cctgcctatgagacgttttgcc

SEQ ID NO: 92062 - DNA, 22 bp, Homo sapiens
tccagctctgctgtgcgccggt

SEQ ID NO: 92063 - DNA, 22 bp, Homo sapiens
tatactctgagaaacgtgtcac

SEQ ID NO: 92064 - DNA, 16 bp, Homo sapiens
tgggtgggaggagcgg

SEQ ID NO: 92065 - DNA, 22 bp, Homo sapiens
aaaatatgtataactcttctgc

SEQ ID NO: 92066 - DNA, 22 bp, Homo sapiens
tattgacagtgactattggtag

SEQ ID NO: 92067 - DNA, 22 bp, Homo sapiens
tccacgtgagcttcgtgtgcag

SEQ ID NO: 92068 - DNA, 22 bp, Homo sapiens
gagtcggaggcaggagacctgg

SEQ ID NO: 92069 - DNA, 22 bp, Homo sapiens
gggttcttatagtatcagagct

SEQ ID NO: 92070 - DNA, 22 bp, Homo sapiens
caggagttcaaggttgcagtga

SEQ ID NO: 92071 - DNA, 22 bp, Homo sapiens
taagagaatgttgtggctaggt

SEQ ID NO: 92072 - DNA, 22 bp, Homo sapiens
gcccaggagttcaagtctagtg

SEQ ID NO: 92073 - DNA, 22 bp, Homo sapiens
ccccacaactcatgttgaaact

SEQ ID NO: 92074 - DNA, 22 bp, Homo sapiens
actggacagaggaaatatggag

SEQ ID NO: 92075 - DNA, 22 bp, Homo sapiens
gtcactcaggctggagttcagt

SEQ ID NO: 92076 - DNA, 22 bp, Homo sapiens
gatattcctgaaggacagggtt

SEQ ID NO: 92077 - DNA, 22 bp, Homo sapiens
aagtggcagttcaggaagcaga

SEQ ID NO: 92078 - DNA, 22 bp, Homo sapiens
aagcagaatagaggcccttccc

SEQ ID NO: 92079 - DNA, 22 bp, Homo sapiens
acttgtgttaccaaggtttggt

SEQ ID NO: 92080 - DNA, 22 bp, Homo sapiens
gaggctgaggttgcagtgagct

SEQ ID NO: 92081 - DNA, 23 bp, Homo sapiens
ggagtgcaatggcgccatctcgg

SEQ ID NO: 92082 - DNA, 22 bp, Homo sapiens
cccgactagctgggattacagg

SEQ ID NO: 92083 - DNA, 22 bp, Homo sapiens
cccgtgtgtgcgaggctcccgc

SEQ ID NO: 92084 - DNA, 22 bp, Homo sapiens
tacaaaggaggtgcatagaaca

SEQ ID NO: 92085 - DNA, 22 bp, Homo sapiens
ttggagatatcacaccttcaca

SEQ ID NO: 92086 - DNA, 22 bp, Homo sapiens
gggaacagcttgggctctgcca

SEQ ID NO: 92087 - DNA, 22 bp, Homo sapiens
aatatcatctctcttttctgca

SEQ ID NO: 92088 - DNA, 22 bp, Homo sapiens
tctggctctggagtccacctgc

SEQ ID NO: 92089 - DNA, 19 bp, Homo sapiens
agccagccagcaggtatgc

SEQ ID NO: 92090 - DNA, 22 bp, Homo sapiens
tgtgagttcttagaaagtcagt

SEQ ID NO: 92091 - DNA, 19 bp, Homo sapiens
gcataaatacactattgtc

SEQ ID NO: 92092 - DNA, 22 bp, Homo sapiens
aatggtttctgaagttaggcag

SEQ ID NO: 92093 - DNA, 21 bp, Homo sapiens
cctcaagtgcctcctgctgct

SEQ ID NO: 92094 - DNA, 22 bp, Homo sapiens
tcaggcagtagaattgcttgaa

SEQ ID NO: 92095 - DNA, 22 bp, Homo sapiens
ggaggcggaagttgcagtgagc

SEQ ID NO: 92096 - DNA, 22 bp, Homo sapiens
gaggctgaggttgcagtgagcc

SEQ ID NO: 92097 - DNA, 22 bp, Homo sapiens
tggctaacaaggtgaaaccccg

SEQ ID NO: 92098 - DNA, 22 bp, Homo sapiens
tgtttcttacgtttttagaggc

SEQ ID NO: 92099 - DNA, 19 bp, Homo sapiens
gctgttaaggaccctcgga

SEQ ID NO: 92100 - DNA, 22 bp, Homo sapiens
ccctctacagggaagcgctttc

SEQ ID NO: 92101 - DNA, 22 bp, Homo sapiens
agaggggcccggttctccgtct

SEQ ID NO: 92102 - DNA, 22 bp, Homo sapiens
aagcacaatgaacatcttagat

SEQ ID NO: 92103 - DNA, 22 bp, Homo sapiens
gggcggggtggctcatgcctgt

SEQ ID NO: 92104 - DNA, 22 bp, Homo sapiens
tcttaattctgtgtcttcacta

SEQ ID NO: 92105 - DNA, 22 bp, Homo sapiens
gtttctctgtctgttacattgg

SEQ ID NO: 92106 - DNA, 22 bp, Homo sapiens
ctgcgtgcatgtctgcgtgcat

SEQ ID NO: 92107 - DNA, 22 bp, Homo sapiens
gatttttatataaagtgagaaa

SEQ ID NO: 92108 - DNA, 22 bp, Homo sapiens
ttttatctgtgacatctggcag

SEQ ID NO: 92109 - DNA, 22 bp, Homo sapiens
ctggctctcaggctggtcccca

SEQ ID NO: 92110 - DNA, 22 bp, Homo sapiens
atggaccagagcctcattctgt

SEQ ID NO: 92111 - DNA, 22 bp, Homo sapiens
cagcagcagtgttctagaatct

SEQ ID NO: 92112 - DNA, 22 bp, Homo sapiens
ttttgcaatgagatgcttgtca

SEQ ID NO: 92113 - DNA, 22 bp, Homo sapiens
ggctcatatcccggccatcatt

SEQ ID NO: 92114 - DNA, 22 bp, Homo sapiens
cagggaaagtcccaccccacac

SEQ ID NO: 92115 - DNA, 22 bp, Homo sapiens
tcaggggcttgaggtgcatgtc

SEQ ID NO: 92116 - DNA, 22 bp, Homo sapiens
cctcggtttccacatctgtaca

SEQ ID NO: 92117 - DNA, 22 bp, Homo sapiens
tgcccaggctggagtacagtgg

SEQ ID NO: 92118 - DNA, 22 bp, Homo sapiens
tggctcactgtagccttgacct

SEQ ID NO: 92119 - DNA, 22 bp, Homo sapiens
ctgagccaaggggacagtgaca

SEQ ID NO: 92120 - DNA, 22 bp, Homo sapiens
tttattggatatttacaagata

SEQ ID NO: 92121 - DNA, 22 bp, Homo sapiens
attggtagttttgtatttctct

SEQ ID NO: 92122 - DNA, 22 bp, Homo sapiens
cttgtcttgcacacggttgcca

SEQ ID NO: 92123 - DNA, 22 bp, Homo sapiens
ttatagcagcatgatttacaat

SEQ ID NO: 92124 - DNA, 18 bp, Homo sapiens
gcctggcttcggagccgc

SEQ ID NO: 92125 - DNA, 22 bp, Homo sapiens
ggaggcagaatagagtgtgggt

SEQ ID NO: 92126 - DNA, 22 bp, Homo sapiens
ccagttccagtgctcacatcca

SEQ ID NO: 92127 - DNA, 22 bp, Homo sapiens
ggctcacgcaattatcccggcc

SEQ ID NO: 92128 - DNA, 20 bp, Homo sapiens
agagtgagactccatctcag

SEQ ID NO: 92129 - DNA, 22 bp, Homo sapiens
gcctcagtctcccgagtagctg

SEQ ID NO: 92130 - DNA, 22 bp, Homo sapiens
aggaattcaagaccagctgggc

SEQ ID NO: 92131 - DNA, 22 bp, Homo sapiens
tcaagcaaagtttagctggtta

SEQ ID NO: 92132 - DNA, 22 bp, Homo sapiens
cgatgaatatttaacgctgtga

SEQ ID NO: 92133 - DNA, 22 bp, Homo sapiens
accctggacatcttgtcatagc

SEQ ID NO: 92134 - DNA, 22 bp, Homo sapiens
agagtgcaaccgaaacaagcag

SEQ ID NO: 92135 - DNA, 22 bp, Homo sapiens
agctcctgaaaatccagactgg

SEQ ID NO: 92136 - DNA, 22 bp, Homo sapiens
cattgcactcctgcctgggcaa

SEQ ID NO: 92137 - DNA, 22 bp, Homo sapiens
cacagggcttctcatggggtgc

SEQ ID NO: 92138 - DNA, 22 bp, Homo sapiens
aggtgtctggacttgtgaagca

SEQ ID NO: 92139 - DNA, 22 bp, Homo sapiens
acagagcaataacagggagagg

SEQ ID NO: 92140 - DNA, 22 bp, Homo sapiens
gcctccccaagcagcagggatt

SEQ ID NO: 92141 - DNA, 22 bp, Homo sapiens
tgggcgacagagcaagactccg

SEQ ID NO: 92142 - DNA, 22 bp, Homo sapiens
aaggagcacacaatctagaacc

SEQ ID NO: 92143 - DNA, 20 bp, Homo sapiens
tgttgattggtgtcatctca

SEQ ID NO: 92144 - DNA, 22 bp, Homo sapiens
gtttctggagtgactataactg

SEQ ID NO: 92145 - DNA, 22 bp, Homo sapiens
gtgattttctcctcctagaagt

SEQ ID NO: 92146 - DNA, 22 bp, Homo sapiens
agtgagagtattaatgtgaact

SEQ ID NO: 92147 - DNA, 22 bp, Homo sapiens
gatcctgggcccttctgggtca

SEQ ID NO: 92148 - DNA, 22 bp, Homo sapiens
aaagtaattgtggttcttgcca

SEQ ID NO: 92149 - DNA, 22 bp, Homo sapiens
ttgtgagtagtgccgcaataaa

SEQ ID NO: 92150 - DNA, 22 bp, Homo sapiens
atgccaggaacaaacagtggtg

SEQ ID NO: 92151 - DNA, 22 bp, Homo sapiens
gcaggagaacaaagcaagctgc

SEQ ID NO: 92152 - DNA, 22 bp, Homo sapiens
tatgaggtaggtattatactta

SEQ ID NO: 92153 - DNA, 22 bp, Homo sapiens
gattgtggaagtcagtggttct

SEQ ID NO: 92154 - DNA, 22 bp, Homo sapiens
taacaactgctgaggtatttga

SEQ ID NO: 92155 - DNA, 22 bp, Homo sapiens
tggcccgaagatccgagggtca

SEQ ID NO: 92156 - DNA, 22 bp, Homo sapiens
gctcccaccttaaccttcacat

SEQ ID NO: 92157 - DNA, 22 bp, Homo sapiens
cattgcactccagcctgggcca

SEQ ID NO: 92158 - DNA, 22 bp, Homo sapiens
tgaaatcttcactaagtctctt

SEQ ID NO: 92159 - DNA, 22 bp, Homo sapiens
aggtgggcggattcatgaggtc

SEQ ID NO: 92160 - DNA, 22 bp, Homo sapiens
gagggggctagcgcagtgccca

SEQ ID NO: 92161 - DNA, 22 bp, Homo sapiens
tccaggctttggggcaggagcg

SEQ ID NO: 92162 - DNA, 22 bp, Homo sapiens
agatttggtgtctggttgatat

SEQ ID NO: 92163 - DNA, 22 bp, Homo sapiens
aaagaaggtagggctggtgact

SEQ ID NO: 92164 - DNA, 22 bp, Homo sapiens
atttaagggatttggagaccaa

SEQ ID NO: 92165 - DNA, 22 bp, Homo sapiens
ctgcaagctacccctagcatca

SEQ ID NO: 92166 - DNA, 22 bp, Homo sapiens
ggggccttttctgaatgtggaa

SEQ ID NO: 92167 - DNA, 22 bp, Homo sapiens
cgccgcctgctgcagcagctgt

SEQ ID NO: 92168 - DNA, 17 bp, Homo sapiens
tgtagcttctccttctc

SEQ ID NO: 92169 - DNA, 22 bp, Homo sapiens
ggaggctgagaggtcgcagtgg

SEQ ID NO: 92170 - DNA, 22 bp, Homo sapiens
tgagggaatattgatagatccg

SEQ ID NO: 92171 - DNA, 22 bp, Homo sapiens
caaagcaggaagctcctgacag

SEQ ID NO: 92172 - DNA, 22 bp, Homo sapiens
gtgagaaatgacaaatgtgtcg

SEQ ID NO: 92173 - DNA, 22 bp, Homo sapiens
tcctgccttgcctgggacatca

SEQ ID NO: 92174 - DNA, 22 bp, Homo sapiens
gcggtttaggccaacctccctg

SEQ ID NO: 92175 - DNA, 22 bp, Homo sapiens
cctacagttatattcttgattg

SEQ ID NO: 92176 - DNA, 21 bp, Homo sapiens
cagagctgtccaaaccctgac

SEQ ID NO: 92177 - DNA, 22 bp, Homo sapiens
tggaaagaaagtaaaggcgtat

SEQ ID NO: 92178 - DNA, 22 bp, Homo sapiens
ggggaaggaaagttattagcag

SEQ ID NO: 92179 - DNA, 22 bp, Homo sapiens
atgaggcaggtggaggctgcca

SEQ ID NO: 92180 - DNA, 22 bp, Homo sapiens
gtgaaatatttaacgtccaggt

SEQ ID NO: 92181 - DNA, 22 bp, Homo sapiens
caaatgtataaatgtactttct

SEQ ID NO: 92182 - DNA, 23 bp, Homo sapiens
cagggccctgctcaatttctcca

SEQ ID NO: 92183 - DNA, 22 bp, Homo sapiens
aagtcagacagctgagctgcct

SEQ ID NO: 92184 - DNA, 22 bp, Homo sapiens
actccacatttgaacacagttc

SEQ ID NO: 92185 - DNA, 22 bp, Homo sapiens
cggggaagcggttctggcggta

SEQ ID NO: 92186 - DNA, 22 bp, Homo sapiens
ggcgctcagtgttgccccagag

SEQ ID NO: 92187 - DNA, 22 bp, Homo sapiens
tgatcaaaacattactccacca

SEQ ID NO: 92188 - DNA, 22 bp, Homo sapiens
ttccgctgtttagttgaagttt

SEQ ID NO: 92189 - DNA, 22 bp, Homo sapiens
caggctgatcagggctgggatg

SEQ ID NO: 92190 - DNA, 22 bp, Homo sapiens
agcttagtggttgtatgagtta

SEQ ID NO: 92191 - DNA, 17 bp, Homo sapiens
tggctctgtcctcagct

SEQ ID NO: 92192 - DNA, 22 bp, Homo sapiens
tgaagactcagaagctaagata

SEQ ID NO: 92193 - DNA, 22 bp, Homo sapiens
ggctgtgtggccgtgggctcta

SEQ ID NO: 92194 - DNA, 22 bp, Homo sapiens
caggaaagggatgggctgccac

SEQ ID NO: 92195 - DNA, 22 bp, Homo sapiens
gaggcagaggttgttgcagtga

SEQ ID NO: 92196 - DNA, 22 bp, Homo sapiens
ctgggatgcggaggttgcggtg

SEQ ID NO: 92197 - DNA, 22 bp, Homo sapiens
ttgaaattttaggccttgcaat

SEQ ID NO: 92198 - DNA, 22 bp, Homo sapiens
gtgggtggacggtgcttttgtt

SEQ ID NO: 92199 - DNA, 22 bp, Homo sapiens
cagctcacccatcacgtctgct

SEQ ID NO: 92200 - DNA, 22 bp, Homo sapiens
tccagctgttccatcagctctt

SEQ ID NO: 92201 - DNA, 22 bp, Homo sapiens
agaaagtgcttccctttggact

SEQ ID NO: 92202 - DNA, 22 bp, Homo sapiens
agaaaatttaaagagacacaca

SEQ ID NO: 92203 - DNA, 22 bp, Homo sapiens
tggtatgaccgtggtgcaagca

SEQ ID NO: 92204 - DNA, 22 bp, Homo sapiens
gctagtgcagggaaatctttgg

SEQ ID NO: 92205 - DNA, 22 bp, Homo sapiens
tggtggggccagacttcagctc

SEQ ID NO: 92206 - DNA, 22 bp, Homo sapiens
tgctggaggccagaagtctgag

SEQ ID NO: 92207 - DNA, 22 bp, Homo sapiens
gtctccggccgccctggtgctg

SEQ ID NO: 92208 - DNA, 22 bp, Homo sapiens
gaatgcagatggctggtgtatg

SEQ ID NO: 92209 - DNA, 22 bp, Homo sapiens
gtggcccaggctggagtgcagt

SEQ ID NO: 92210 - DNA, 22 bp, Homo sapiens
gccctgccctctcggcactcgc

SEQ ID NO: 92211 - DNA, 22 bp, Homo sapiens
ttttccttcatatcccttatgt

SEQ ID NO: 92212 - DNA, 22 bp, Homo sapiens
ttctttcagaacacaagtgatt

SEQ ID NO: 92213 - DNA, 22 bp, Homo sapiens
tggagaattctatgttgagggg

SEQ ID NO: 92214 - DNA, 22 bp, Homo sapiens
gggcctgtgtgttcaggagcct

SEQ ID NO: 92215 - DNA, 22 bp, Homo sapiens
aggccaggaatccttgtcccag

SEQ ID NO: 92216 - DNA, 22 bp, Homo sapiens
ttcctaagtcctgccagcagtc

SEQ ID NO: 92217 - DNA, 22 bp, Homo sapiens
acagtccagcctagtatgtata

SEQ ID NO: 92218 - DNA, 22 bp, Homo sapiens
tttgaagggcacgacaatagtt

SEQ ID NO: 92219 - DNA, 22 bp, Homo sapiens
ttcatatgtgaactcagtgatg

SEQ ID NO: 92220 - DNA, 21 bp, Homo sapiens
tccttcagtctagatgattgt

SEQ ID NO: 92221 - DNA, 22 bp, Homo sapiens
acaaagtgctgacattacaggc

SEQ ID NO: 92222 - DNA, 22 bp, Homo sapiens
ggctagggatctagaccaggac

SEQ ID NO: 92223 - DNA, 22 bp, Homo sapiens
agatggggtttcatcatgttgg

SEQ ID NO: 92224 - DNA, 22 bp, Homo sapiens
gaccttgtgatccacctgcctt

SEQ ID NO: 92225 - DNA, 22 bp, Homo sapiens
cggccgcagcagtgtcggccca

SEQ ID NO: 92226 - DNA, 22 bp, Homo sapiens
agggaattcactggaacgccct

SEQ ID NO: 92227 - DNA, 22 bp, Homo sapiens
gcaaacaaggacatacatcctg

SEQ ID NO: 92228 - DNA, 22 bp, Homo sapiens
gacctcgtgatccgccctcctt

SEQ ID NO: 92229 - DNA, 22 bp, Homo sapiens
agtgccaaatcgagggctctga

SEQ ID NO: 92230 - DNA, 22 bp, Homo sapiens
caccagagtgggtgagggtgat

SEQ ID NO: 92231 - DNA, 22 bp, Homo sapiens
aagccaggttccatggaggagc

SEQ ID NO: 92232 - DNA, 22 bp, Homo sapiens
ctcctgcttcacgggcaccgcc

SEQ ID NO: 92233 - DNA, 22 bp, Homo sapiens
actcaagtggccttgatggctt

SEQ ID NO: 92234 - DNA, 22 bp, Homo sapiens
cccaggaggtggagttcacagt

SEQ ID NO: 92235 - DNA, 22 bp, Homo sapiens
aggagagctggtgtctggaatc

SEQ ID NO: 92236 - DNA, 22 bp, Homo sapiens
gtcttagatttcaccgataatg

SEQ ID NO: 92237 - DNA, 22 bp, Homo sapiens
ctggccagatgttacgtccaat

SEQ ID NO: 92238 - DNA, 22 bp, Homo sapiens
caggctgctgacaggcttggag

SEQ ID NO: 92239 - DNA, 22 bp, Homo sapiens
gtgggggctggaaatcttgcca

SEQ ID NO: 92240 - DNA, 22 bp, Homo sapiens
acagattagctggggccattga

SEQ ID NO: 92241 - DNA, 22 bp, Homo sapiens
tccgccaggactgagggcccat

SEQ ID NO: 92242 - DNA, 22 bp, Homo sapiens
gaggcagaagttgcagtgagca

SEQ ID NO: 92243 - DNA, 22 bp, Homo sapiens
gggcggatcacctgaggtcagg

SEQ ID NO: 92244 - DNA, 22 bp, Homo sapiens
gccctgagaagaagtcggaggg

SEQ ID NO: 92245 - DNA, 22 bp, Homo sapiens
tcctcagaatcacctggcagct

SEQ ID NO: 92246 - DNA, 22 bp, Homo sapiens
ggaggtgggctaaggactctct

SEQ ID NO: 92247 - DNA, 22 bp, Homo sapiens
acctctgtacctcctctgacag

SEQ ID NO: 92248 - DNA, 22 bp, Homo sapiens
taagatgtttacagtatggaga

SEQ ID NO: 92249 - DNA, 22 bp, Homo sapiens
tgtggtgccgagagtctggacg

SEQ ID NO: 92250 - DNA, 22 bp, Homo sapiens
agtgaccgaggcacttggcaac

SEQ ID NO: 92251 - DNA, 22 bp, Homo sapiens
gggccctgggattcagagcaag

SEQ ID NO: 92252 - DNA, 22 bp, Homo sapiens
gcaaaaagtagtgctggttagg

SEQ ID NO: 92253 - DNA, 21 bp, Homo sapiens
acacaggcagtgtcccgaggt

SEQ ID NO: 92254 - DNA, 22 bp, Homo sapiens
ccactattactgtgtggcagtc

SEQ ID NO: 92255 - DNA, 22 bp, Homo sapiens
tgcaaatgtgttttaaaccaaa

SEQ ID NO: 92256 - DNA, 22 bp, Homo sapiens
accactgcccatggtgaaaact

SEQ ID NO: 92257 - DNA, 22 bp, Homo sapiens
ttccggaaggttctctagaatt

SEQ ID NO: 92258 - DNA, 22 bp, Homo sapiens
acttttcttatcagaaaggcca

SEQ ID NO: 92259 - DNA, 22 bp, Homo sapiens
aggccagcctcaggcagggacc

SEQ ID NO: 92260 - DNA, 22 bp, Homo sapiens
tcgtgaggctctgcatcgcaca

SEQ ID NO: 92261 - DNA, 22 bp, Homo sapiens
gcaggaggttgagccaggactg

SEQ ID NO: 92262 - DNA, 22 bp, Homo sapiens
tcgcccagctcatctcccacaa

SEQ ID NO: 92263 - DNA, 22 bp, Homo sapiens
ggactgggaatcagggagatgc

SEQ ID NO: 92264 - DNA, 22 bp, Homo sapiens
aatggaatacctaggtggccca

SEQ ID NO: 92265 - DNA, 22 bp, Homo sapiens
agcgtgaattagttggtacaca

SEQ ID NO: 92266 - DNA, 20 bp, Homo sapiens
caaatccctgctctgtgctg

SEQ ID NO: 92267 - DNA, 22 bp, Homo sapiens
atgtccttcctgagatccctgt

SEQ ID NO: 92268 - DNA, 22 bp, Homo sapiens
gccgggttcaagccattctcct

SEQ ID NO: 92269 - DNA, 22 bp, Homo sapiens
tcaccaggctggagtgcagtgg

SEQ ID NO: 92270 - DNA, 22 bp, Homo sapiens
cccaggaggtcgaagctgcagt

SEQ ID NO: 92271 - DNA, 22 bp, Homo sapiens
cccagaaggtcgaggctgcagt

SEQ ID NO: 92272 - DNA, 22 bp, Homo sapiens
tgggtgagcggctgcacacccg

SEQ ID NO: 92273 - DNA, 22 bp, Homo sapiens
ttctacagtgactgcagccata

SEQ ID NO: 92274 - DNA, 22 bp, Homo sapiens
tccaggattgcaggtgcacaac

SEQ ID NO: 92275 - DNA, 22 bp, Homo sapiens
gggtctcctaatggaggatgac

SEQ ID NO: 92276 - DNA, 22 bp, Homo sapiens
gggaggttgaggctgcagtgag

SEQ ID NO: 92277 - DNA, 22 bp, Homo sapiens
aggcaggaggatcatggatgca

SEQ ID NO: 92278 - DNA, 22 bp, Homo sapiens
aggtggtgtttggttacatgag

SEQ ID NO: 92279 - DNA, 22 bp, Homo sapiens
tgggcaggggccctgcttccgt

SEQ ID NO: 92280 - DNA, 22 bp, Homo sapiens
acaaacagagttgaaaaatagg

SEQ ID NO: 92281 - DNA, 22 bp, Homo sapiens
ggagttgattttggatatatta

SEQ ID NO: 92282 - DNA, 22 bp, Homo sapiens
tacatgctccttatgagaatct

SEQ ID NO: 92283 - DNA, 22 bp, Homo sapiens
ctggagggctgcagcgaggctg

SEQ ID NO: 92284 - DNA, 22 bp, Homo sapiens
tgagagcctgtgttcaaatgcc

SEQ ID NO: 92285 - DNA, 22 bp, Homo sapiens
taactaggattacaagcgtgcg

SEQ ID NO: 92286 - DNA, 22 bp, Homo sapiens
tcccagaaccctgccaggtcct

SEQ ID NO: 92287 - DNA, 22 bp, Homo sapiens
ggacaagcctgtgagtgggttt

SEQ ID NO: 92288 - DNA, 22 bp, Homo sapiens
tgaaatgattatatggtgtttg

SEQ ID NO: 92289 - DNA, 22 bp, Homo sapiens
agcctattccaggatgagctca

SEQ ID NO: 92290 - DNA, 22 bp, Homo sapiens
tcgccccgaggcagccctatgc

SEQ ID NO: 92291 - DNA, 22 bp, Homo sapiens
accatgttggccaagctggtct

SEQ ID NO: 92292 - DNA, 22 bp, Homo sapiens
aggcactgtgcagtcccaagca

SEQ ID NO: 92293 - DNA, 22 bp, Homo sapiens
gcgagcctctggagtcctctgg

SEQ ID NO: 92294 - DNA, 22 bp, Homo sapiens
ggccgtgctccaaagtcatcgt

SEQ ID NO: 92295 - DNA, 22 bp, Homo sapiens
gtggctcacacctgtaatccca

SEQ ID NO: 92296 - DNA, 22 bp, Homo sapiens
cacgggagacgtgatcttggac

SEQ ID NO: 92297 - DNA, 22 bp, Homo sapiens
ggtggttcacgcctataatccc

SEQ ID NO: 92298 - DNA, 22 bp, Homo sapiens
gctggtagacctcactgcactc

SEQ ID NO: 92299 - DNA, 22 bp, Homo sapiens
gcccgcgccagcctctccatct

SEQ ID NO: 92300 - DNA, 22 bp, Homo sapiens
atcatcctagaaggaagctagg

SEQ ID NO: 92301 - DNA, 22 bp, Homo sapiens
agctgctgagccaggctgatgt

SEQ ID NO: 92302 - DNA, 22 bp, Homo sapiens
tgtgggtggcatcgtcctggcc

SEQ ID NO: 92303 - DNA, 19 bp, Homo sapiens
tcctgcccaccagccaggg

SEQ ID NO: 92304 - DNA, 22 bp, Homo sapiens
tttacacagaggacactgggct

SEQ ID NO: 92305 - DNA, 22 bp, Homo sapiens
agctttgtttgctcacccgccg

SEQ ID NO: 92306 - DNA, 22 bp, Homo sapiens
aaaacctcagttctgctcttaa

SEQ ID NO: 92307 - DNA, 22 bp, Homo sapiens
gtgtggtcgaagttctcccgga

SEQ ID NO: 92308 - DNA, 22 bp, Homo sapiens
ttttcatttttgtagatgcaag

SEQ ID NO: 92309 - DNA, 22 bp, Homo sapiens
cactgcactccagcccgggcaa

SEQ ID NO: 92310 - DNA, 22 bp, Homo sapiens
ctctcgccagcggggctgcgct

SEQ ID NO: 92311 - DNA, 22 bp, Homo sapiens
tgactcagtacatctggagttg

SEQ ID NO: 92312 - DNA, 22 bp, Homo sapiens
tgtgacctcatcttaactggaa

SEQ ID NO: 92313 - DNA, 22 bp, Homo sapiens
tgctccagcaccaagagctcca

SEQ ID NO: 92314 - DNA, 22 bp, Homo sapiens
agttgggtttgtgtcagttgca

SEQ ID NO: 92315 - DNA, 22 bp, Homo sapiens
ggctttgacatgctgaattaaa

SEQ ID NO: 92316 - DNA, 23 bp, Homo sapiens
aaaacagcttcctccagtggctc

SEQ ID NO: 92317 - DNA, 22 bp, Homo sapiens
ctgcccgcaccatccccgggct

SEQ ID NO: 92318 - DNA, 22 bp, Homo sapiens
ggcagggcaggaaagtcaggaa

SEQ ID NO: 92319 - DNA, 22 bp, Homo sapiens
ccaggcaggcgatggtgcagtg

SEQ ID NO: 92320 - DNA, 22 bp, Homo sapiens
attctaatggcagagactcctg

SEQ ID NO: 92321 - DNA, 22 bp, Homo sapiens
gggagctgagctggaagagaat

SEQ ID NO: 92322 - DNA, 22 bp, Homo sapiens
gaattcttttctttctgaaagt

SEQ ID NO: 92323 - DNA, 22 bp, Homo sapiens
aaggggaagagaccgcagagtc

SEQ ID NO: 92324 - DNA, 22 bp, Homo sapiens
ctgcatgtttacatttttgaga

SEQ ID NO: 92325 - DNA, 22 bp, Homo sapiens
gagcactgatttatttttgtct

SEQ ID NO: 92326 - DNA, 22 bp, Homo sapiens
gagctgggcctgcgagtgctgc

SEQ ID NO: 92327 - DNA, 22 bp, Homo sapiens
tttttagtagaggtgggtttca

SEQ ID NO: 92328 - DNA, 22 bp, Homo sapiens
gctgaggctcctcgggaggaca

SEQ ID NO: 92329 - DNA, 22 bp, Homo sapiens
ctggcctcggcagcaggaacag

SEQ ID NO: 92330 - DNA, 22 bp, Homo sapiens
tgtaatattgtagtgacagtac

SEQ ID NO: 92331 - DNA, 22 bp, Homo sapiens
gggggctaccgtctctggagct

SEQ ID NO: 92332 - DNA, 22 bp, Homo sapiens
acatgagactgggtttgtaggg

SEQ ID NO: 92333 - DNA, 22 bp, Homo sapiens
atacataattacttccgatgtt

SEQ ID NO: 92334 - DNA, 22 bp, Homo sapiens
gaggtggctgcttgctgggaaa

SEQ ID NO: 92335 - DNA, 22 bp, Homo sapiens
aggctctcaccctctgaccaga

SEQ ID NO: 92336 - DNA, 19 bp, Homo sapiens
cgcctggcaggccctgcgc

SEQ ID NO: 92337 - DNA, 22 bp, Homo sapiens
tgttcttaggtatttgacagtc

SEQ ID NO: 92338 - DNA, 22 bp, Homo sapiens
gcgggccaccttggagagcgct

SEQ ID NO: 92339 - DNA, 22 bp, Homo sapiens
gttgtgaatagtgccgcaataa

SEQ ID NO: 92340 - DNA, 22 bp, Homo sapiens
ctggcaggagcattcacagagg

SEQ ID NO: 92341 - DNA, 22 bp, Homo sapiens
gccaatgacagtctcagttctg

SEQ ID NO: 92342 - DNA, 22 bp, Homo sapiens
ggtgttgcagttgaagactggt

SEQ ID NO: 92343 - DNA, 18 bp, Homo sapiens
atggtctcatactgggag

SEQ ID NO: 92344 - DNA, 22 bp, Homo sapiens
tttctataaaaagtgctaggat

SEQ ID NO: 92345 - DNA, 22 bp, Homo sapiens
agagcggggatagttaatattc

SEQ ID NO: 92346 - DNA, 22 bp, Homo sapiens
gtgtatgttctacttaatatta

SEQ ID NO: 92347 - DNA, 19 bp, Homo sapiens
tccaggggctccacctcct

SEQ ID NO: 92348 - DNA, 22 bp, Homo sapiens
aacattgaacttggcacaccca

SEQ ID NO: 92349 - DNA, 22 bp, Homo sapiens
agaacagaggccttatgtttca

SEQ ID NO: 92350 - DNA, 22 bp, Homo sapiens
cctctgatgggcacagggtggc

SEQ ID NO: 92351 - DNA, 23 bp, Homo sapiens
attttttgtctttgtaactagat

SEQ ID NO: 92352 - DNA, 22 bp, Homo sapiens
cttggggaagccactgatccct

SEQ ID NO: 92353 - DNA, 22 bp, Homo sapiens
cagcagcagtggctgcagaaca

SEQ ID NO: 92354 - DNA, 22 bp, Homo sapiens
tatccgtgatgtttataaacca

SEQ ID NO: 92355 - DNA, 22 bp, Homo sapiens
ggtgacgaatccatagcatcga

SEQ ID NO: 92356 - DNA, 22 bp, Homo sapiens
ctgcaccctcaaactcctgggc

SEQ ID NO: 92357 - DNA, 22 bp, Homo sapiens
cactgcactccagcctgggcaa

SEQ ID NO: 92358 - DNA, 22 bp, Homo sapiens
actgcgtggggagctgtgacta

SEQ ID NO: 92359 - DNA, 22 bp, Homo sapiens
ggaggtggagctggaagttcca

SEQ ID NO: 92360 - DNA, 22 bp, Homo sapiens
ttgattatagactcactaatct

SEQ ID NO: 92361 - DNA, 22 bp, Homo sapiens
agatgctgctccacaggccagg

SEQ ID NO: 92362 - DNA, 22 bp, Homo sapiens
atttctctgcagtgttcggaat

SEQ ID NO: 92363 - DNA, 22 bp, Homo sapiens
agaacctcaattatttttgcac

SEQ ID NO: 92364 - DNA, 23 bp, Homo sapiens
atcattaacagtgcaggggtagg

SEQ ID NO: 92365 - DNA, 22 bp, Homo sapiens
tagtggatgggtaaagtatttt

SEQ ID NO: 92366 - DNA, 22 bp, Homo sapiens
agcttgacagacagatggtagc

SEQ ID NO: 92367 - DNA, 22 bp, Homo sapiens
gtagaccatttatctggggagt

SEQ ID NO: 92368 - DNA, 22 bp, Homo sapiens
acccccaagaggggccttcagc

SEQ ID NO: 92369 - DNA, 22 bp, Homo sapiens
ctacattaaattggcttactta

SEQ ID NO: 92370 - DNA, 22 bp, Homo sapiens
tctgccttgtttgagctttgac

SEQ ID NO: 92371 - DNA, 22 bp, Homo sapiens
tgtgtgattgcaggagatgtgg

SEQ ID NO: 92372 - DNA, 22 bp, Homo sapiens
tcctccactttgtctagcaaca

SEQ ID NO: 92373 - DNA, 22 bp, Homo sapiens
gatatcatgggaaggtgtactt

SEQ ID NO: 92374 - DNA, 22 bp, Homo sapiens
tttgctattgtgaatagtgcca

SEQ ID NO: 92375 - DNA, 19 bp, Homo sapiens
aggaatggaattaattctg

SEQ ID NO: 92376 - DNA, 22 bp, Homo sapiens
ggctcaatgcaacttctgcctc

SEQ ID NO: 92377 - DNA, 22 bp, Homo sapiens
agggatggagtgcggcccggac

SEQ ID NO: 92378 - DNA, 22 bp, Homo sapiens
ataatacatggttgatcttttc

SEQ ID NO: 92379 - DNA, 23 bp, Homo sapiens
caccactttctccttctccttgg

SEQ ID NO: 92380 - DNA, 22 bp, Homo sapiens
accctgctttatgccgtcctct

SEQ ID NO: 92381 - DNA, 21 bp, Homo sapiens
ccagagcctgagaggattatg

SEQ ID NO: 92382 - DNA, 22 bp, Homo sapiens
tctgggtccgggactgtggatg

SEQ ID NO: 92383 - DNA, 22 bp, Homo sapiens
tgggaggccgaggcaggtggat

SEQ ID NO: 92384 - DNA, 22 bp, Homo sapiens
tagatgtgttgcctggagttgt

SEQ ID NO: 92385 - DNA, 22 bp, Homo sapiens
ttatacagggagtttccctgca

SEQ ID NO: 92386 - DNA, 22 bp, Homo sapiens
caggctgaagtgcagtggtgtg

SEQ ID NO: 92387 - DNA, 22 bp, Homo sapiens
atgccactgcgctctagcctgg

SEQ ID NO: 92388 - DNA, 22 bp, Homo sapiens
gctgggctgcgtcggggaagcc

SEQ ID NO: 92389 - DNA, 23 bp, Homo sapiens
tttctgatgagggatgtggtatg

SEQ ID NO: 92390 - DNA, 22 bp, Homo sapiens
acctagaatttaaaacattgct

SEQ ID NO: 92391 - DNA, 22 bp, Homo sapiens
tgccttgtccttcgtcagggct

SEQ ID NO: 92392 - DNA, 22 bp, Homo sapiens
caggaggttgagggtgcagtga

SEQ ID NO: 92393 - DNA, 22 bp, Homo sapiens
ccaaagaaacccaagctcaggg

SEQ ID NO: 92394 - DNA, 19 bp, Homo sapiens
catggtgaaaccccgtctc

SEQ ID NO: 92395 - DNA, 22 bp, Homo sapiens
attgtggtgtcagttataggca

SEQ ID NO: 92396 - DNA, 22 bp, Homo sapiens
ttttctgtttgcttcaagacat

SEQ ID NO: 92397 - DNA, 22 bp, Homo sapiens
tctcttgagctcagttctgatg

SEQ ID NO: 92398 - DNA, 22 bp, Homo sapiens
tgcagcaccgtcccactggcta

SEQ ID NO: 92399 - DNA, 22 bp, Homo sapiens
atcatccaagcgtagttcttct

SEQ ID NO: 92400 - DNA, 22 bp, Homo sapiens
ttccatacgactgaggtctcgg

SEQ ID NO: 92401 - DNA, 22 bp, Homo sapiens
ctgctcttgagggactgcggtc

SEQ ID NO: 92402 - DNA, 22 bp, Homo sapiens
gggaagtgagctggaatcaagg

SEQ ID NO: 92403 - DNA, 22 bp, Homo sapiens
ggagagcagggaggctgctctg

SEQ ID NO: 92404 - DNA, 22 bp, Homo sapiens
tcaccaggctagagtgcagtgg

SEQ ID NO: 92405 - DNA, 22 bp, Homo sapiens
aacaattactaccaaggcctgt

SEQ ID NO: 92406 - DNA, 22 bp, Homo sapiens
gctcactgcaagctctgcctcc

SEQ ID NO: 92407 - DNA, 22 bp, Homo sapiens
attcacagggggagaagggtat

SEQ ID NO: 92408 - DNA, 22 bp, Homo sapiens
cactgcactccatcctgggaaa

SEQ ID NO: 92409 - DNA, 22 bp, Homo sapiens
aggagaagccaagttgtgagca

SEQ ID NO: 92410 - DNA, 22 bp, Homo sapiens
agagaggtctcaggagaaacca

SEQ ID NO: 92411 - DNA, 22 bp, Homo sapiens
gctcccaggatgaggagccagg

SEQ ID NO: 92412 - DNA, 22 bp, Homo sapiens
cactgcactccagcctgggaga

SEQ ID NO: 92413 - DNA, 22 bp, Homo sapiens
ggctgcaggttggttggcagct

SEQ ID NO: 92414 - DNA, 22 bp, Homo sapiens
tgtctgttattggtgtataaga

SEQ ID NO: 92415 - DNA, 22 bp, Homo sapiens
gcacagagagggaaggtaactt

SEQ ID NO: 92416 - DNA, 22 bp, Homo sapiens
cctccctgccggctggactagt

SEQ ID NO: 92417 - DNA, 22 bp, Homo sapiens
aggagggtgggaagcagtttta

SEQ ID NO: 92418 - DNA, 22 bp, Homo sapiens
ggccactgacctacatctgggg

SEQ ID NO: 92419 - DNA, 22 bp, Homo sapiens
agtccaaagcagatgagggcca

SEQ ID NO: 92420 - DNA, 22 bp, Homo sapiens
ccagcatccatgctccctcggg

SEQ ID NO: 92421 - DNA, 22 bp, Homo sapiens
tttctcctcatgactggttgtg

SEQ ID NO: 92422 - DNA, 22 bp, Homo sapiens
gctgaggtggaggaaggagacc

SEQ ID NO: 92423 - DNA, 22 bp, Homo sapiens
atggaatgtttatacacagttg

SEQ ID NO: 92424 - DNA, 19 bp, Homo sapiens
taggaccctggtggccccc

SEQ ID NO: 92425 - DNA, 22 bp, Homo sapiens
agcaacccgtccttgggggact

SEQ ID NO: 92426 - DNA, 22 bp, Homo sapiens
tgccgctccaggtctcgcggtg

SEQ ID NO: 92427 - DNA, 22 bp, Homo sapiens
cctgagtagctggaattaaagg

SEQ ID NO: 92428 - DNA, 22 bp, Homo sapiens
cccaggctggagtgtaatggtg

SEQ ID NO: 92429 - DNA, 22 bp, Homo sapiens
taattgtaaagtagtagtacag

SEQ ID NO: 92430 - DNA, 22 bp, Homo sapiens
cagagatgtgatccagctgtct

SEQ ID NO: 92431 - DNA, 22 bp, Homo sapiens
cgtctctggcccggcccctggg

SEQ ID NO: 92432 - DNA, 22 bp, Homo sapiens
gaattttattactagtcaactg

SEQ ID NO: 92433 - DNA, 22 bp, Homo sapiens
caggagtgttgattgctcagga

SEQ ID NO: 92434 - DNA, 22 bp, Homo sapiens
ttattgaaggaactgaaataaa

SEQ ID NO: 92435 - DNA, 23 bp, Homo sapiens
ctcaccaagcgccgccgctgtgt

SEQ ID NO: 92436 - DNA, 20 bp, Homo sapiens
tgaggcccagcagagtcggg

SEQ ID NO: 92437 - DNA, 20 bp, Homo sapiens
tgttctgtcgtctttcttca

SEQ ID NO: 92438 - DNA, 22 bp, Homo sapiens
atacaatgattggttctcaccc

SEQ ID NO: 92439 - DNA, 22 bp, Homo sapiens
ggtgaggggctcctctgcccgg

SEQ ID NO: 92440 - DNA, 22 bp, Homo sapiens
ctcagggccaaggatgctgttg

SEQ ID NO: 92441 - DNA, 22 bp, Homo sapiens
gcagctgacatctggctgggcc

SEQ ID NO: 92442 - DNA, 18 bp, Homo sapiens
gaggtagataagattttc

SEQ ID NO: 92443 - DNA, 22 bp, Homo sapiens
ggcagcactgcagcttgttggg

SEQ ID NO: 92444 - DNA, 22 bp, Homo sapiens
tacgcctgtaatcccagcactt

SEQ ID NO: 92445 - DNA, 22 bp, Homo sapiens
aagatgcggttgaccatggtgt

SEQ ID NO: 92446 - DNA, 22 bp, Homo sapiens
tatgccactgctctccatccta

SEQ ID NO: 92447 - DNA, 21 bp, Homo sapiens
cttccccaggctggtctgtat

SEQ ID NO: 92448 - DNA, 22 bp, Homo sapiens
cattggccttttatcctagagg

SEQ ID NO: 92449 - DNA, 22 bp, Homo sapiens
gtcagaggggcagctgccaggc

SEQ ID NO: 92450 - DNA, 22 bp, Homo sapiens
aaggagaaatggtagatgtgca

SEQ ID NO: 92451 - DNA, 22 bp, Homo sapiens
gaatcccaatctgttattgaca

SEQ ID NO: 92452 - DNA, 21 bp, Homo sapiens
tgcaatccagcctgggcgaca

SEQ ID NO: 92453 - DNA, 22 bp, Homo sapiens
tttttgggtccaggctgtatct

SEQ ID NO: 92454 - DNA, 22 bp, Homo sapiens
ggcctctcttgggacagctgtc

SEQ ID NO: 92455 - DNA, 22 bp, Homo sapiens
gccaggttgctgacgacgatct

SEQ ID NO: 92456 - DNA, 22 bp, Homo sapiens
atgttgtgtttgactgttaccc

SEQ ID NO: 92457 - DNA, 22 bp, Homo sapiens
cattgcacaccagcctgggcaa

SEQ ID NO: 92458 - DNA, 22 bp, Homo sapiens
gtgtgtctcccaagaaggccca

SEQ ID NO: 92459 - DNA, 22 bp, Homo sapiens
ctgaggggtcgtgggagcccag

SEQ ID NO: 92460 - DNA, 23 bp, Homo sapiens
aatggtcttcctccacccctctg

SEQ ID NO: 92461 - DNA, 22 bp, Homo sapiens
ccttttgctctcccatccagaa

SEQ ID NO: 92462 - DNA, 22 bp, Homo sapiens
gaatcccttgcattatcccttt

SEQ ID NO: 92463 - DNA, 22 bp, Homo sapiens
gcgtggcttagagtggggtacc

SEQ ID NO: 92464 - DNA, 22 bp, Homo sapiens
aaaagtaattgtggttttggcc

SEQ ID NO: 92465 - DNA, 22 bp, Homo sapiens
cgagtgtccctaccatttccta

SEQ ID NO: 92466 - DNA, 22 bp, Homo sapiens
tgctgtgaggttgagaaggaag

SEQ ID NO: 92467 - DNA, 19 bp, Homo sapiens
agaaccactgctctcttca

SEQ ID NO: 92468 - DNA, 22 bp, Homo sapiens
aaacttttttaggttcataggc

SEQ ID NO: 92469 - DNA, 22 bp, Homo sapiens
aggagccagtggagttcctgcc

SEQ ID NO: 92470 - DNA, 22 bp, Homo sapiens
tgagcattacctgaggccactg

SEQ ID NO: 92471 - DNA, 22 bp, Homo sapiens
ttcagacaggcagctgggctgg

SEQ ID NO: 92472 - DNA, 22 bp, Homo sapiens
gcttcggggtccaagcgcgtgt

SEQ ID NO: 92473 - DNA, 22 bp, Homo sapiens
cattgcaacttcaaactcctgg

SEQ ID NO: 92474 - DNA, 22 bp, Homo sapiens
atcatgttttaattagcaaact

SEQ ID NO: 92475 - DNA, 22 bp, Homo sapiens
acacccaggctggcgtgcagtg

SEQ ID NO: 92476 - DNA, 22 bp, Homo sapiens
actgtacctcaaactctggaac

SEQ ID NO: 92477 - DNA, 21 bp, Homo sapiens
ggtgtgggatggactgaacca

SEQ ID NO: 92478 - DNA, 18 bp, Homo sapiens
tctgtgggatcagtgagg

SEQ ID NO: 92479 - DNA, 22 bp, Homo sapiens
tgtcagtgtctatgaagaattt

SEQ ID NO: 92480 - DNA, 22 bp, Homo sapiens
atgtgagtgctatgatagacag

SEQ ID NO: 92481 - DNA, 22 bp, Homo sapiens
gaaaggagagggttaaggagct

SEQ ID NO: 92482 - DNA, 22 bp, Homo sapiens
acccagtctggagtgcagtgac

SEQ ID NO: 92483 - DNA, 22 bp, Homo sapiens
cccaggctggagtgcagtggcg

SEQ ID NO: 92484 - DNA, 22 bp, Homo sapiens
gcgggtgatcacctgaggtcag

SEQ ID NO: 92485 - DNA, 21 bp, Homo sapiens
ggcaagaaacacaatcaagta

SEQ ID NO: 92486 - DNA, 20 bp, Homo sapiens
ccagagctgatggctgcccg

SEQ ID NO: 92487 - DNA, 22 bp, Homo sapiens
agagggcattaactctgtcttg

SEQ ID NO: 92488 - DNA, 22 bp, Homo sapiens
tatccaattcaccattgatggg

SEQ ID NO: 92489 - DNA, 22 bp, Homo sapiens
gctaatcaatgttaaggctgtg

SEQ ID NO: 92490 - DNA, 22 bp, Homo sapiens
cagaccagaaggaagccgacaa

SEQ ID NO: 92491 - DNA, 22 bp, Homo sapiens
agggaaatctcagctctaaaat

SEQ ID NO: 92492 - DNA, 22 bp, Homo sapiens
ccctgatagcccctatcatcag

SEQ ID NO: 92493 - DNA, 22 bp, Homo sapiens
tcaggagtgccagtaccttttg

SEQ ID NO: 92494 - DNA, 22 bp, Homo sapiens
aagaagagaactggcatcctaa

SEQ ID NO: 92495 - DNA, 22 bp, Homo sapiens
tcacccaggctggagtgtagtg

SEQ ID NO: 92496 - DNA, 22 bp, Homo sapiens
ggctcactgcaacctctgcctc

SEQ ID NO: 92497 - DNA, 22 bp, Homo sapiens
agagtactgcctcagttatgaa

SEQ ID NO: 92498 - DNA, 22 bp, Homo sapiens
gctcttgtcaaaaattagttga

SEQ ID NO: 92499 - DNA, 22 bp, Homo sapiens
tacagaagcttttgaaaagatg

SEQ ID NO: 92500 - DNA, 22 bp, Homo sapiens
cactgcaacctccatcttctgg

SEQ ID NO: 92501 - DNA, 22 bp, Homo sapiens
cccgggaggtggaggttgcagt

SEQ ID NO: 92502 - DNA, 22 bp, Homo sapiens
tcccagattcctgctcttatat

SEQ ID NO: 92503 - DNA, 22 bp, Homo sapiens
gcttctggtgaggcctcaggaa

SEQ ID NO: 92504 - DNA, 22 bp, Homo sapiens
attgtgtcctcattgaccttca

SEQ ID NO: 92505 - DNA, 22 bp, Homo sapiens
ttcagtttcaagtccctctggg

SEQ ID NO: 92506 - DNA, 22 bp, Homo sapiens
tcccagctactctagaggctga

SEQ ID NO: 92507 - DNA, 22 bp, Homo sapiens
tgttgcccaggttctctcctgc

SEQ ID NO: 92508 - DNA, 23 bp, Homo sapiens
ctggggctttcaaatctgggcag

SEQ ID NO: 92509 - DNA, 20 bp, Homo sapiens
ggggaagtcactgcagtcag

SEQ ID NO: 92510 - DNA, 22 bp, Homo sapiens
ggaggcccagaaggaagcccag

SEQ ID NO: 92511 - DNA, 22 bp, Homo sapiens
cccaggaggcagaagttgcagt

SEQ ID NO: 92512 - DNA, 22 bp, Homo sapiens
ttcttggggttccacaatggga

SEQ ID NO: 92513 - DNA, 22 bp, Homo sapiens
tacaaaaaattgatactgacga

SEQ ID NO: 92514 - DNA, 22 bp, Homo sapiens
actgcacttcagcctgggtgtc

SEQ ID NO: 92515 - DNA, 22 bp, Homo sapiens
taagtgagggagctgggacttg

SEQ ID NO: 92516 - DNA, 22 bp, Homo sapiens
acaggatcgccctgttgcccag

SEQ ID NO: 92517 - DNA, 22 bp, Homo sapiens
tatgttgcaccaacctaataat

SEQ ID NO: 92518 - DNA, 22 bp, Homo sapiens
tcaacgcatgctccaagaaaga

SEQ ID NO: 92519 - DNA, 22 bp, Homo sapiens
tttggtattgcacactgtcttc

SEQ ID NO: 92520 - DNA, 22 bp, Homo sapiens
gccagaagcacatgagaggtga

SEQ ID NO: 92521 - DNA, 22 bp, Homo sapiens
gccccaagtccctatgtttcca

SEQ ID NO: 92522 - DNA, 22 bp, Homo sapiens
ccccagtggaggtgagggtcct

SEQ ID NO: 92523 - DNA, 22 bp, Homo sapiens
tccagctgaggtggcctctgtg

SEQ ID NO: 92524 - DNA, 22 bp, Homo sapiens
tacctcaagttccaggaaagcg

SEQ ID NO: 92525 - DNA, 22 bp, Homo sapiens
gacccttagaatgtgatcttat

SEQ ID NO: 92526 - DNA, 22 bp, Homo sapiens
acttttaaatgagtttcagttg

SEQ ID NO: 92527 - DNA, 22 bp, Homo sapiens
aagccctggacggcccttcccc

SEQ ID NO: 92528 - DNA, 22 bp, Homo sapiens
gccactgagcccggccattgtt

SEQ ID NO: 92529 - DNA, 22 bp, Homo sapiens
tgagacgaagtcttgctctgtt

SEQ ID NO: 92530 - DNA, 22 bp, Homo sapiens
gtgcagttgtggacatgacaac

SEQ ID NO: 92531 - DNA, 22 bp, Homo sapiens
tgcagaaacaagccatcattca

SEQ ID NO: 92532 - DNA, 21 bp, Homo sapiens
ggagtttttctggaagggact

SEQ ID NO: 92533 - DNA, 22 bp, Homo sapiens
gcctcctgagtagctgggattg

SEQ ID NO: 92534 - DNA, 22 bp, Homo sapiens
gctgtgtatcagatgccacggg

SEQ ID NO: 92535 - DNA, 22 bp, Homo sapiens
cccacacacatttatgatagga

SEQ ID NO: 92536 - DNA, 20 bp, Homo sapiens
attagctcaggtgaggtcat

SEQ ID NO: 92537 - DNA, 22 bp, Homo sapiens
tggctgtgtccctgtccagagt

SEQ ID NO: 92538 - DNA, 22 bp, Homo sapiens
actgcactccagcctgggtaac

SEQ ID NO: 92539 - DNA, 22 bp, Homo sapiens
actgcactccaacctgggtgac

SEQ ID NO: 92540 - DNA, 22 bp, Homo sapiens
ccaggctggagtgcagtggcac

SEQ ID NO: 92541 - DNA, 22 bp, Homo sapiens
atgtttttaaatagacttacag

SEQ ID NO: 92542 - DNA, 22 bp, Homo sapiens
ggcaatagttgtgggttcttta

SEQ ID NO: 92543 - DNA, 22 bp, Homo sapiens
tttgcttcacaagtatggttct

SEQ ID NO: 92544 - DNA, 21 bp, Homo sapiens
tgaaggtgttcatgatgcggt

SEQ ID NO: 92545 - DNA, 23 bp, Homo sapiens
tgtgggcgcattgtaagggtagc

SEQ ID NO: 92546 - DNA, 22 bp, Homo sapiens
ttatgatttgccacagattggt

SEQ ID NO: 92547 - DNA, 22 bp, Homo sapiens
tggttaagtccagaaaggaagc

SEQ ID NO: 92548 - DNA, 23 bp, Homo sapiens
aagtggttttgaacccggaccct

SEQ ID NO: 92549 - DNA, 22 bp, Homo sapiens
aaggctgagacagcacaggtcc

SEQ ID NO: 92550 - DNA, 21 bp, Homo sapiens
caaaagagactgattcttgga

SEQ ID NO: 92551 - DNA, 22 bp, Homo sapiens
gcgcggcctcacccctcggtga

SEQ ID NO: 92552 - DNA, 22 bp, Homo sapiens
agctcaccacaacctccgcctc

SEQ ID NO: 92553 - DNA, 22 bp, Homo sapiens
tcagtgccatgggcagacaggc

SEQ ID NO: 92554 - DNA, 22 bp, Homo sapiens
cctcccctcagacagagactgg

SEQ ID NO: 92555 - DNA, 22 bp, Homo sapiens
tcacccctccattctctcatgt

SEQ ID NO: 92556 - DNA, 22 bp, Homo sapiens
tatgtttggcctggcaatttca

SEQ ID NO: 92557 - DNA, 22 bp, Homo sapiens
agtgaaaacctaatcatgcagt

SEQ ID NO: 92558 - DNA, 23 bp, Homo sapiens
tcctcgcaggagggagatgatgc

SEQ ID NO: 92559 - DNA, 22 bp, Homo sapiens
ggagtgactctcggggccacta

SEQ ID NO: 92560 - DNA, 22 bp, Homo sapiens
tgatgtggccccacttagctgt

SEQ ID NO: 92561 - DNA, 22 bp, Homo sapiens
cccattcttcatacaagtctaa

SEQ ID NO: 92562 - DNA, 21 bp, Homo sapiens
gacactgcttactctgaccta

SEQ ID NO: 92563 - DNA, 22 bp, Homo sapiens
aaagaggcaatcaatgtagcaa

SEQ ID NO: 92564 - DNA, 22 bp, Homo sapiens
tggaaacacccacgcatgcata

SEQ ID NO: 92565 - DNA, 22 bp, Homo sapiens
caattgacaatgacagtgtcaa

SEQ ID NO: 92566 - DNA, 22 bp, Homo sapiens
cactgcactccagcctgggtca

SEQ ID NO: 92567 - DNA, 22 bp, Homo sapiens
gtggtgtaggtcacagttagga

SEQ ID NO: 92568 - DNA, 22 bp, Homo sapiens
ttcagcactgactgagtggtta

SEQ ID NO: 92569 - DNA, 22 bp, Homo sapiens
tttaagaagttatgttataaat

SEQ ID NO: 92570 - DNA, 22 bp, Homo sapiens
cactgcaccctcaaactcctgg

SEQ ID NO: 92571 - DNA, 22 bp, Homo sapiens
cccgggaggcggaggttgcagt

SEQ ID NO: 92572 - DNA, 22 bp, Homo sapiens
tgcttttagctagtaactagta

SEQ ID NO: 92573 - DNA, 22 bp, Homo sapiens
tcactgtagcctcaactcttgg

SEQ ID NO: 92574 - DNA, 22 bp, Homo sapiens
tgtatattctgcctaaaagctt

SEQ ID NO: 92575 - DNA, 22 bp, Homo sapiens
gctttgcccctttagtgggtgc

SEQ ID NO: 92576 - DNA, 22 bp, Homo sapiens
agtgtattctgcatgggagact

SEQ ID NO: 92577 - DNA, 22 bp, Homo sapiens
agtctagtaggatctctgggct

SEQ ID NO: 92578 - DNA, 22 bp, Homo sapiens
tttcaacagatctgtcttcagg

SEQ ID NO: 92579 - DNA, 22 bp, Homo sapiens
gagaggtggaggttgcagtgag

SEQ ID NO: 92580 - DNA, 22 bp, Homo sapiens
tagaagaaagtgaagctgggga

SEQ ID NO: 92581 - DNA, 22 bp, Homo sapiens
agagaagagtcttgtcaaatta

SEQ ID NO: 92582 - DNA, 22 bp, Homo sapiens
tgaggcactccaggatgctgtt

SEQ ID NO: 92583 - DNA, 22 bp, Homo sapiens
gggccggagctgggtcccgcgc

SEQ ID NO: 92584 - DNA, 22 bp, Homo sapiens
cgagagttagctaggagtcaca

SEQ ID NO: 92585 - DNA, 22 bp, Homo sapiens
aggaaaatggaccagagttgtt

SEQ ID NO: 92586 - DNA, 22 bp, Homo sapiens
gattgggggtcaggctcaggtc

SEQ ID NO: 92587 - DNA, 22 bp, Homo sapiens
tccaaggtcagcgagagtcact

SEQ ID NO: 92588 - DNA, 22 bp, Homo sapiens
ccctgtgggaactcctgagttg

SEQ ID NO: 92589 - DNA, 22 bp, Homo sapiens
attgcactccagcctgggtgac

SEQ ID NO: 92590 - DNA, 22 bp, Homo sapiens
cccaggagttggaggctgcagt

SEQ ID NO: 92591 - DNA, 22 bp, Homo sapiens
aatctgagggaacttgaactcc

SEQ ID NO: 92592 - DNA, 22 bp, Homo sapiens
gctgctgggatcctgggtctca

SEQ ID NO: 92593 - DNA, 22 bp, Homo sapiens
catgcacttacctgaaattcaa

SEQ ID NO: 92594 - DNA, 22 bp, Homo sapiens
ttgctcttgaaaattgatgctg

SEQ ID NO: 92595 - DNA, 23 bp, Homo sapiens
acagcaagaggaccagatgtgag

SEQ ID NO: 92596 - DNA, 20 bp, Homo sapiens
tccaaagaagttcacattta

SEQ ID NO: 92597 - DNA, 22 bp, Homo sapiens
gagtgcagtggcgtgatctctg

SEQ ID NO: 92598 - DNA, 22 bp, Homo sapiens
ggctttctgtctgcgtctgtgt

SEQ ID NO: 92599 - DNA, 22 bp, Homo sapiens
ttcaccctggaccagaaattgg

SEQ ID NO: 92600 - DNA, 22 bp, Homo sapiens
aaagtgcaaggattacaggcat

SEQ ID NO: 92601 - DNA, 21 bp, Homo sapiens
tctgatggtagatgagatgtg

SEQ ID NO: 92602 - DNA, 22 bp, Homo sapiens
acgcctgtaatcccagcacttt

SEQ ID NO: 92603 - DNA, 22 bp, Homo sapiens
gaggctgcagctatcagacatt

SEQ ID NO: 92604 - DNA, 22 bp, Homo sapiens
gagccagactgcctgaagctca

SEQ ID NO: 92605 - DNA, 22 bp, Homo sapiens
agggtggcactggtggctctat

SEQ ID NO: 92606 - DNA, 22 bp, Homo sapiens
gctctctgcagcctccttggag

SEQ ID NO: 92607 - DNA, 17 bp, Homo sapiens
gaggccaaggcaggcgg

SEQ ID NO: 92608 - DNA, 18 bp, Homo sapiens
ccctgccagctcccagca

SEQ ID NO: 92609 - DNA, 22 bp, Homo sapiens
gtggctgcagcggctgtggaga

SEQ ID NO: 92610 - DNA, 22 bp, Homo sapiens
ggctgggcctctccctcagctg

SEQ ID NO: 92611 - DNA, 22 bp, Homo sapiens
aggtcagagcaatgtattgctt

SEQ ID NO: 92612 - DNA, 22 bp, Homo sapiens
tgcctcagctgaggccgctcca

SEQ ID NO: 92613 - DNA, 22 bp, Homo sapiens
ctccagttggccccagttggtt

SEQ ID NO: 92614 - DNA, 23 bp, Homo sapiens
ttctgggctgtggaagcctcggg

SEQ ID NO: 92615 - DNA, 22 bp, Homo sapiens
agaggtgagtcattacctagtg

SEQ ID NO: 92616 - DNA, 22 bp, Homo sapiens
gtagatgagctcacatgacctt

SEQ ID NO: 92617 - DNA, 22 bp, Homo sapiens
aaggggtgcaagttaatcagca

SEQ ID NO: 92618 - DNA, 22 bp, Homo sapiens
ggcaatatggtgaaaccccatc

SEQ ID NO: 92619 - DNA, 22 bp, Homo sapiens
ctcttcctagtgtgcagcgtgg

SEQ ID NO: 92620 - DNA, 21 bp, Homo sapiens
tcgacctgctgggctcgggct

SEQ ID NO: 92621 - DNA, 22 bp, Homo sapiens
atgcaggcagacactgtgggca

SEQ ID NO: 92622 - DNA, 22 bp, Homo sapiens
tacactgtttgaactgtggtcg

SEQ ID NO: 92623 - DNA, 22 bp, Homo sapiens
gcccagtggtaaaagcaggcct

SEQ ID NO: 92624 - DNA, 22 bp, Homo sapiens
taaggcaggaactggctgtttt

SEQ ID NO: 92625 - DNA, 22 bp, Homo sapiens
ttttaagttggattgctaagta

SEQ ID NO: 92626 - DNA, 18 bp, Homo sapiens
gctgtggaagtctttata

SEQ ID NO: 92627 - DNA, 18 bp, Homo sapiens
cagctgccagctcatgga

SEQ ID NO: 92628 - DNA, 19 bp, Homo sapiens
ctctggagtcattgctccc

SEQ ID NO: 92629 - DNA, 22 bp, Homo sapiens
tcttgggcatgtgtttgatttc

SEQ ID NO: 92630 - DNA, 22 bp, Homo sapiens
gtgccccagacacgcatgtggg

SEQ ID NO: 92631 - DNA, 19 bp, Homo sapiens
tctgaagaattagagagca

SEQ ID NO: 92632 - DNA, 22 bp, Homo sapiens
gtcctgacggctgattggcctg

SEQ ID NO: 92633 - DNA, 22 bp, Homo sapiens
actcagtacatctggagttggc

SEQ ID NO: 92634 - DNA, 22 bp, Homo sapiens
aggccctattcaatggggccca

SEQ ID NO: 92635 - DNA, 22 bp, Homo sapiens
caagccattctcctgcctcagc

SEQ ID NO: 92636 - DNA, 22 bp, Homo sapiens
agcacctccagagcttgaagct

SEQ ID NO: 92637 - DNA, 22 bp, Homo sapiens
ggctgggcaggtctgcacaggg

SEQ ID NO: 92638 - DNA, 22 bp, Homo sapiens
tgtggctctcatgcactcccag

SEQ ID NO: 92639 - DNA, 22 bp, Homo sapiens
agcaggagtttgatgcttttat

SEQ ID NO: 92640 - DNA, 22 bp, Homo sapiens
attacctatttcattttctgtc

SEQ ID NO: 92641 - DNA, 22 bp, Homo sapiens
ctgggcagctgtatcagggagt

SEQ ID NO: 92642 - DNA, 22 bp, Homo sapiens
ctggcccaggtggtcgttgagg

SEQ ID NO: 92643 - DNA, 22 bp, Homo sapiens
agagtccctcttcccaggaggc

SEQ ID NO: 92644 - DNA, 22 bp, Homo sapiens
ccgcaaggcagaggttgcagtg

SEQ ID NO: 92645 - DNA, 22 bp, Homo sapiens
ctgtggctctcagaggctgctg

SEQ ID NO: 92646 - DNA, 22 bp, Homo sapiens
atgagaaagttaatcatcatga

SEQ ID NO: 92647 - DNA, 23 bp, Homo sapiens
cttcacaggttcaggggattaag

SEQ ID NO: 92648 - DNA, 22 bp, Homo sapiens
catggcggtcaggatgtaggtg

SEQ ID NO: 92649 - DNA, 22 bp, Homo sapiens
gtgaccatcatctcagctagtt

SEQ ID NO: 92650 - DNA, 22 bp, Homo sapiens
ttgatgtaggtttatctattgt

SEQ ID NO: 92651 - DNA, 22 bp, Homo sapiens
cttcagctgcagttatgtttag

SEQ ID NO: 92652 - DNA, 22 bp, Homo sapiens
ggtgagcagctgtctgtatgga

SEQ ID NO: 92653 - DNA, 22 bp, Homo sapiens
ctcactgcaagctctgcctccc

SEQ ID NO: 92654 - DNA, 22 bp, Homo sapiens
tgcaatccccgcctcaacagga

SEQ ID NO: 92655 - DNA, 22 bp, Homo sapiens
caggtagaggctgccatcagct

SEQ ID NO: 92656 - DNA, 22 bp, Homo sapiens
agaaaacataggagacaggaaa

SEQ ID NO: 92657 - DNA, 22 bp, Homo sapiens
cgggcagcggcgtggccatggt

SEQ ID NO: 92658 - DNA, 22 bp, Homo sapiens
ttgcccagagtcacccagctca

SEQ ID NO: 92659 - DNA, 22 bp, Homo sapiens
tttattctgtgctacatgaaga

SEQ ID NO: 92660 - DNA, 22 bp, Homo sapiens
gttgaggagcaagcatgtgtct

SEQ ID NO: 92661 - DNA, 22 bp, Homo sapiens
cagccctcctaccctgccaggc

SEQ ID NO: 92662 - DNA, 18 bp, Homo sapiens
gaggatggaaggagatgc

SEQ ID NO: 92663 - DNA, 22 bp, Homo sapiens
aagaatgagctcaaagatctta

SEQ ID NO: 92664 - DNA, 22 bp, Homo sapiens
catctgtctgcatgctctgggt

SEQ ID NO: 92665 - DNA, 22 bp, Homo sapiens
ctggcctggcgcagtggctcac

SEQ ID NO: 92666 - DNA, 22 bp, Homo sapiens
tcactacaacctccgcctcctg

SEQ ID NO: 92667 - DNA, 22 bp, Homo sapiens
ctgggcgcgtcccctgaggcgg

SEQ ID NO: 92668 - DNA, 22 bp, Homo sapiens
aaggaatttgaggctgcagtga

SEQ ID NO: 92669 - DNA, 22 bp, Homo sapiens
tctgcaccatcgtatgcttaat

SEQ ID NO: 92670 - DNA, 22 bp, Homo sapiens
tgcaatctcggcactttgggag

SEQ ID NO: 92671 - DNA, 22 bp, Homo sapiens
gggtacagttcttccagtgtca

SEQ ID NO: 92672 - DNA, 22 bp, Homo sapiens
attttttgttaactcaggatag

SEQ ID NO: 92673 - DNA, 22 bp, Homo sapiens
gggacatctttctagtcagggt

SEQ ID NO: 92674 - DNA, 22 bp, Homo sapiens
gtgatggaagtcttgttccggg

SEQ ID NO: 92675 - DNA, 22 bp, Homo sapiens
agtccctctgggagcaggactg

SEQ ID NO: 92676 - DNA, 22 bp, Homo sapiens
tgaaggggttcagcatgggggt

SEQ ID NO: 92677 - DNA, 23 bp, Homo sapiens
tcggtgggcgtggaggccgaggc

SEQ ID NO: 92678 - DNA, 22 bp, Homo sapiens
gaagatgttatggagagctcag

SEQ ID NO: 92679 - DNA, 22 bp, Homo sapiens
gccaggacctcagatgcagggc

SEQ ID NO: 92680 - DNA, 22 bp, Homo sapiens
aatgtgagccaatgcccgtggg

SEQ ID NO: 92681 - DNA, 22 bp, Homo sapiens
gaggctgaggcggatggatcac

SEQ ID NO: 92682 - DNA, 22 bp, Homo sapiens
caaagtgctgggattataggca

SEQ ID NO: 92683 - DNA, 22 bp, Homo sapiens
actcctacatattagcattaac

SEQ ID NO: 92684 - DNA, 22 bp, Homo sapiens
aggtaaatgtcagagcctttaa

SEQ ID NO: 92685 - DNA, 22 bp, Homo sapiens
agatggagtctcactcttgttg

SEQ ID NO: 92686 - DNA, 19 bp, Homo sapiens
gggaatgatggaagacttc

SEQ ID NO: 92687 - DNA, 22 bp, Homo sapiens
acagattcactgcactggccat

SEQ ID NO: 92688 - DNA, 22 bp, Homo sapiens
agtgctgtcagttttatagata

SEQ ID NO: 92689 - DNA, 22 bp, Homo sapiens
aagaataagaggatttagaaca

SEQ ID NO: 92690 - DNA, 22 bp, Homo sapiens
agcttgtagaaggccacgagca

SEQ ID NO: 92691 - DNA, 22 bp, Homo sapiens
aagcccttggcgcacaccgggc

SEQ ID NO: 92692 - DNA, 22 bp, Homo sapiens
agaggccggccgagcccatggg

SEQ ID NO: 92693 - DNA, 22 bp, Homo sapiens
ttgatacccaagtgttatgggt

SEQ ID NO: 92694 - DNA, 22 bp, Homo sapiens
agagagcccgggccagggcaca

SEQ ID NO: 92695 - DNA, 19 bp, Homo sapiens
ctgtccttggctgcactgt

SEQ ID NO: 92696 - DNA, 22 bp, Homo sapiens
ctgctcctgtccagcagggcca

SEQ ID NO: 92697 - DNA, 22 bp, Homo sapiens
agatgtgtttctagttcctgca

SEQ ID NO: 92698 - DNA, 22 bp, Homo sapiens
ggagaggggaacttgttgcttg

SEQ ID NO: 92699 - DNA, 22 bp, Homo sapiens
aatgttgtgcatgtattttgta

SEQ ID NO: 92700 - DNA, 22 bp, Homo sapiens
tagattcagatatttaggacaa

SEQ ID NO: 92701 - DNA, 22 bp, Homo sapiens
aggaaggcttctttggtcttct

SEQ ID NO: 92702 - DNA, 22 bp, Homo sapiens
ggggtggatttcaggcggtgtc

SEQ ID NO: 92703 - DNA, 22 bp, Homo sapiens
atggagcaacagacctatcaca

SEQ ID NO: 92704 - DNA, 22 bp, Homo sapiens
ctaggaccactgtaacaaagta

SEQ ID NO: 92705 - DNA, 22 bp, Homo sapiens
atggcagaatatctgcatcgca

SEQ ID NO: 92706 - DNA, 22 bp, Homo sapiens
ccgaggtcctggacttggccct

SEQ ID NO: 92707 - DNA, 22 bp, Homo sapiens
tacataggtacagcctttttta

SEQ ID NO: 92708 - DNA, 22 bp, Homo sapiens
gtgcgcttcttcctgagccagg

SEQ ID NO: 92709 - DNA, 22 bp, Homo sapiens
ggaactgaatgtctcggtataa

SEQ ID NO: 92710 - DNA, 22 bp, Homo sapiens
tcagtggagagcttccaggatt

SEQ ID NO: 92711 - DNA, 22 bp, Homo sapiens
actttatttcctattgcatcca

SEQ ID NO: 92712 - DNA, 22 bp, Homo sapiens
gacagctgcatcctcagacaca

SEQ ID NO: 92713 - DNA, 22 bp, Homo sapiens
tgaatatgtgactttgatttca

SEQ ID NO: 92714 - DNA, 22 bp, Homo sapiens
cttgtagaattgaaatggtctc

SEQ ID NO: 92715 - DNA, 20 bp, Homo sapiens
tcactgtaacatttgggggg

SEQ ID NO: 92716 - DNA, 22 bp, Homo sapiens
caagcttgtttctcctgggggt

SEQ ID NO: 92717 - DNA, 22 bp, Homo sapiens
tgtccagctcgagacactatct

SEQ ID NO: 92718 - DNA, 22 bp, Homo sapiens
gggagaagaatgtgtcaattgt

SEQ ID NO: 92719 - DNA, 22 bp, Homo sapiens
actgaataaggtgaatgctctg

SEQ ID NO: 92720 - DNA, 21 bp, Homo sapiens
gttgtggttggggctgcagct

SEQ ID NO: 92721 - DNA, 22 bp, Homo sapiens
ctggagggtggagagaagtctc

SEQ ID NO: 92722 - DNA, 22 bp, Homo sapiens
tggctccacaggccagggtgtg

SEQ ID NO: 92723 - DNA, 22 bp, Homo sapiens
ttgctttgtttaaaagtggtat

SEQ ID NO: 92724 - DNA, 22 bp, Homo sapiens
tgtacaatgctgaggtttgggg

SEQ ID NO: 92725 - DNA, 22 bp, Homo sapiens
caggagttttaaatctagcatg

SEQ ID NO: 92726 - DNA, 22 bp, Homo sapiens
tcatcagcaccctatgtccttt

SEQ ID NO: 92727 - DNA, 22 bp, Homo sapiens
aggaggggttctcgggtgctga

SEQ ID NO: 92728 - DNA, 22 bp, Homo sapiens
aaggggtgagcagaggcttcgc

SEQ ID NO: 92729 - DNA, 22 bp, Homo sapiens
ctgaacttattgagtgcttgct

SEQ ID NO: 92730 - DNA, 22 bp, Homo sapiens
agtgctgggctatctactgcta

SEQ ID NO: 92731 - DNA, 22 bp, Homo sapiens
ttggaaacgtcaccttttcctt

SEQ ID NO: 92732 - DNA, 22 bp, Homo sapiens
ttgaataatatgcttcgttctc

SEQ ID NO: 92733 - DNA, 17 bp, Homo sapiens
catcaaagaaatttcca

SEQ ID NO: 92734 - DNA, 22 bp, Homo sapiens
gtttacttgtgccttggcttaa

SEQ ID NO: 92735 - DNA, 22 bp, Homo sapiens
ataaaaactgacccatcctttg

SEQ ID NO: 92736 - DNA, 22 bp, Homo sapiens
ctgagatctttatacgaggcac

SEQ ID NO: 92737 - DNA, 23 bp, Homo sapiens
tcctgtcaagtgcttgttcctgc

SEQ ID NO: 92738 - DNA, 22 bp, Homo sapiens
atttagtagagaaattaagaaa

SEQ ID NO: 92739 - DNA, 22 bp, Homo sapiens
gtgcgggcctgggggtttctct

SEQ ID NO: 92740 - DNA, 22 bp, Homo sapiens
ggaggacaggggctgcagcaca

SEQ ID NO: 92741 - DNA, 22 bp, Homo sapiens
ggccggggcctgctcgcctgtg

SEQ ID NO: 92742 - DNA, 22 bp, Homo sapiens
aaggagtctgggccattcagag

SEQ ID NO: 92743 - DNA, 22 bp, Homo sapiens
ttgtgaatagtgccgcaataaa

SEQ ID NO: 92744 - DNA, 22 bp, Homo sapiens
gtcatggtgctagcgggaatgt

SEQ ID NO: 92745 - DNA, 22 bp, Homo sapiens
caattgtcagtgctgtttaaat

SEQ ID NO: 92746 - DNA, 22 bp, Homo sapiens
tagggcaatatttcccagaaaa

SEQ ID NO: 92747 - DNA, 22 bp, Homo sapiens
gtagtctgaacagtaattttgt

SEQ ID NO: 92748 - DNA, 22 bp, Homo sapiens
tagtgtctcttcctgtttgaaa

SEQ ID NO: 92749 - DNA, 22 bp, Homo sapiens
gtggtgagattgctggatcaaa

SEQ ID NO: 92750 - DNA, 22 bp, Homo sapiens
atgccactgcactccagcctgg

SEQ ID NO: 92751 - DNA, 22 bp, Homo sapiens
ggtagactgtcaaacactagcc

SEQ ID NO: 92752 - DNA, 22 bp, Homo sapiens
ccagactcatctgccattgctg

SEQ ID NO: 92753 - DNA, 22 bp, Homo sapiens
acatatgcgatcataggatgca

SEQ ID NO: 92754 - DNA, 22 bp, Homo sapiens
tgcacgtgtgagcattcacatg

SEQ ID NO: 92755 - DNA, 22 bp, Homo sapiens
gaggccactgtccctgccttcc

SEQ ID NO: 92756 - DNA, 22 bp, Homo sapiens
tgtgcctagttctgtatttaca

SEQ ID NO: 92757 - DNA, 22 bp, Homo sapiens
attggccagacttatccttcag

SEQ ID NO: 92758 - DNA, 22 bp, Homo sapiens
gctactgattgaccttggagag

SEQ ID NO: 92759 - DNA, 22 bp, Homo sapiens
cagtgacgtaaactgcatgtgc

SEQ ID NO: 92760 - DNA, 22 bp, Homo sapiens
gccatcatatcccctgtgacct

SEQ ID NO: 92761 - DNA, 22 bp, Homo sapiens
gccccagcctcccgagtagctg

SEQ ID NO: 92762 - DNA, 22 bp, Homo sapiens
cgcccaggctggagtgcagtgg

SEQ ID NO: 92763 - DNA, 22 bp, Homo sapiens
gcacttcaccactgtcctggtt

SEQ ID NO: 92764 - DNA, 22 bp, Homo sapiens
ctgctgagagccccagctgaga

SEQ ID NO: 92765 - DNA, 22 bp, Homo sapiens
gttgctcaggcaggagtacagt

SEQ ID NO: 92766 - DNA, 22 bp, Homo sapiens
ctggagagaatgtggaatgatt

SEQ ID NO: 92767 - DNA, 22 bp, Homo sapiens
gtacaaatgcaggtttgttaca

SEQ ID NO: 92768 - DNA, 22 bp, Homo sapiens
accctccccaagaggtcgtgcc

SEQ ID NO: 92769 - DNA, 22 bp, Homo sapiens
gctgtatgtgaggccacagtga

SEQ ID NO: 92770 - DNA, 22 bp, Homo sapiens
ggtgacctcacctggtcccacc

SEQ ID NO: 92771 - DNA, 22 bp, Homo sapiens
ccactgcacttcagcctgggtg

SEQ ID NO: 92772 - DNA, 23 bp, Homo sapiens
cgggttcacgccattctcctgcc

SEQ ID NO: 92773 - DNA, 22 bp, Homo sapiens
cttctcttcctttgtcaactga

SEQ ID NO: 92774 - DNA, 22 bp, Homo sapiens
aaaggctttaaaatgtacatat

SEQ ID NO: 92775 - DNA, 22 bp, Homo sapiens
ttagatttacaagcactgttta

SEQ ID NO: 92776 - DNA, 22 bp, Homo sapiens
tctgccgtgcgaggtcccacca

SEQ ID NO: 92777 - DNA, 22 bp, Homo sapiens
cccagggagagcgcggaggcgg

SEQ ID NO: 92778 - DNA, 22 bp, Homo sapiens
gaactttgcgcagttcccgggg

SEQ ID NO: 92779 - DNA, 22 bp, Homo sapiens
gcggggggaggaacatcttgca

SEQ ID NO: 92780 - DNA, 22 bp, Homo sapiens
caggccctgtgctgggtgatgt

SEQ ID NO: 92781 - DNA, 22 bp, Homo sapiens
gctctgagtcacactgccctgt

SEQ ID NO: 92782 - DNA, 22 bp, Homo sapiens
ccagcctggttcagaattggct

SEQ ID NO: 92783 - DNA, 22 bp, Homo sapiens
ttaccacagtgcctgtctaatg

SEQ ID NO: 92784 - DNA, 22 bp, Homo sapiens
ccctggctgataccggaaaggc

SEQ ID NO: 92785 - DNA, 22 bp, Homo sapiens
tcctttgcttctgtcattctcc

SEQ ID NO: 92786 - DNA, 22 bp, Homo sapiens
gcttcaaactgagcttcaagtg

SEQ ID NO: 92787 - DNA, 22 bp, Homo sapiens
tacatagctcctagtgatgcat

SEQ ID NO: 92788 - DNA, 22 bp, Homo sapiens
caaagtgctaggattacaggcg

SEQ ID NO: 92789 - DNA, 22 bp, Homo sapiens
gcttggctttactagggggaca

SEQ ID NO: 92790 - DNA, 22 bp, Homo sapiens
ttcagcttgctgactgcggcag

SEQ ID NO: 92791 - DNA, 22 bp, Homo sapiens
tctggtgtcagtattctttgaa

SEQ ID NO: 92792 - DNA, 22 bp, Homo sapiens
tgcagcacttgccaaactaact

SEQ ID NO: 92793 - DNA, 22 bp, Homo sapiens
gtctatgatattttgttatagc

SEQ ID NO: 92794 - DNA, 22 bp, Homo sapiens
ccctggaggttgaggctgcagt

SEQ ID NO: 92795 - DNA, 22 bp, Homo sapiens
cagtaatagaggctttgagtct

SEQ ID NO: 92796 - DNA, 22 bp, Homo sapiens
aaagctaaggtagcattggaga

SEQ ID NO: 92797 - DNA, 22 bp, Homo sapiens
gacctccgtgtacacctcccag

SEQ ID NO: 92798 - DNA, 22 bp, Homo sapiens
tcggagctgtagatgaaaccct

SEQ ID NO: 92799 - DNA, 23 bp, Homo sapiens
tgagtgtgaaaatcctggagatg

SEQ ID NO: 92800 - DNA, 22 bp, Homo sapiens
aagataagagggaggtgcctca

SEQ ID NO: 92801 - DNA, 22 bp, Homo sapiens
gctcccagtctgatggaggaga

SEQ ID NO: 92802 - DNA, 22 bp, Homo sapiens
ctgtggctcaggcctgtaagcc

SEQ ID NO: 92803 - DNA, 22 bp, Homo sapiens
actctggccatcttggaccttg

SEQ ID NO: 92804 - DNA, 22 bp, Homo sapiens
acggtgctgggtattggggttc

SEQ ID NO: 92805 - DNA, 22 bp, Homo sapiens
ccaggctggagtatagtggcgc

SEQ ID NO: 92806 - DNA, 22 bp, Homo sapiens
ccaggctagagtgcaatggcat

SEQ ID NO: 92807 - DNA, 22 bp, Homo sapiens
aaaggtcaaaatcgtgacattg

SEQ ID NO: 92808 - DNA, 22 bp, Homo sapiens
tgaggcaggaggattgcaggat

SEQ ID NO: 92809 - DNA, 22 bp, Homo sapiens
ctcagcactttggaaggctgat

SEQ ID NO: 92810 - DNA, 22 bp, Homo sapiens
cacactgtctttcagaatggtt

SEQ ID NO: 92811 - DNA, 22 bp, Homo sapiens
tgaggtgccacccaagagcctt

SEQ ID NO: 92812 - DNA, 22 bp, Homo sapiens
gaatgaacaaatgtggtggaga

SEQ ID NO: 92813 - DNA, 22 bp, Homo sapiens
ggctccctgcaacctccgcctc

SEQ ID NO: 92814 - DNA, 22 bp, Homo sapiens
accccagaggcggaggctgcag

SEQ ID NO: 92815 - DNA, 22 bp, Homo sapiens
gactacaggccggcatcagaga

SEQ ID NO: 92816 - DNA, 22 bp, Homo sapiens
tacaaagtcttgggttctaggc

SEQ ID NO: 92817 - DNA, 22 bp, Homo sapiens
cgtgatgaatggtgagacccgc

SEQ ID NO: 92818 - DNA, 22 bp, Homo sapiens
gcaaagaatgcagatttgcctc

SEQ ID NO: 92819 - DNA, 22 bp, Homo sapiens
ggcgccagcactgcagcgcctc

SEQ ID NO: 92820 - DNA, 19 bp, Homo sapiens
gcagacaggtccagagagg

SEQ ID NO: 92821 - DNA, 22 bp, Homo sapiens
tttgattgcaatagttttatga

SEQ ID NO: 92822 - DNA, 20 bp, Homo sapiens
tgtttgtgtggggccttggc

SEQ ID NO: 92823 - DNA, 22 bp, Homo sapiens
tacccagtgccaccctctgagg

SEQ ID NO: 92824 - DNA, 22 bp, Homo sapiens
tggattccacgcctgctcctgt

SEQ ID NO: 92825 - DNA, 22 bp, Homo sapiens
gaggagggagctggaagctctt

SEQ ID NO: 92826 - DNA, 22 bp, Homo sapiens
ctgctttggacaactattcttg

SEQ ID NO: 92827 - DNA, 22 bp, Homo sapiens
tctctcaggctggagtgcagtg

SEQ ID NO: 92828 - DNA, 22 bp, Homo sapiens
tctcctggtacccttcctagca

SEQ ID NO: 92829 - DNA, 22 bp, Homo sapiens
aagtgctgggattataggcatg

SEQ ID NO: 92830 - DNA, 22 bp, Homo sapiens
ctctgcctgtctcatcctgcaa

SEQ ID NO: 92831 - DNA, 22 bp, Homo sapiens
gactttctgatgtaaacattta

SEQ ID NO: 92832 - DNA, 22 bp, Homo sapiens
tttgtagcagcatgatttataa

SEQ ID NO: 92833 - DNA, 21 bp, Homo sapiens
ctcccagggtgactgttcaac

SEQ ID NO: 92834 - DNA, 22 bp, Homo sapiens
caagacttcaccgctctgtgct

SEQ ID NO: 92835 - DNA, 22 bp, Homo sapiens
gggaggaggaatgttttgtgta

SEQ ID NO: 92836 - DNA, 22 bp, Homo sapiens
aagtcacttcttaggaaaggag

SEQ ID NO: 92837 - DNA, 22 bp, Homo sapiens
aaaaagtattggccatggttga

SEQ ID NO: 92838 - DNA, 22 bp, Homo sapiens
tgtctcatctcttaaccccact

SEQ ID NO: 92839 - DNA, 22 bp, Homo sapiens
agcccagaggctgggcgtgcat

SEQ ID NO: 92840 - DNA, 22 bp, Homo sapiens
gtcaggactctgacccgtcccg

SEQ ID NO: 92841 - DNA, 22 bp, Homo sapiens
cgggttcacgccattctcctgc

SEQ ID NO: 92842 - DNA, 22 bp, Homo sapiens
caggcactgtgctgagctctgc

SEQ ID NO: 92843 - DNA, 22 bp, Homo sapiens
caggaaggcgcggctgtgcctg

SEQ ID NO: 92844 - DNA, 22 bp, Homo sapiens
tcatcagggatattggcctgaa

SEQ ID NO: 92845 - DNA, 22 bp, Homo sapiens
tgctgctcagaacccctgggct

SEQ ID NO: 92846 - DNA, 22 bp, Homo sapiens
tgtacacatggtgtacactccc

SEQ ID NO: 92847 - DNA, 22 bp, Homo sapiens
acgcccagactcccatactttg

SEQ ID NO: 92848 - DNA, 22 bp, Homo sapiens
tcgggctcgctctcctagcgga

SEQ ID NO: 92849 - DNA, 22 bp, Homo sapiens
atatacacatctttttaaatat

SEQ ID NO: 92850 - DNA, 22 bp, Homo sapiens
gttggagtgcagcttgtgcgat

SEQ ID NO: 92851 - DNA, 18 bp, Homo sapiens
catgggtgacaggtggat

SEQ ID NO: 92852 - DNA, 22 bp, Homo sapiens
tgggtggcagcttcagcatgtt

SEQ ID NO: 92853 - DNA, 22 bp, Homo sapiens
gttgcctaggctggagtgcagt

SEQ ID NO: 92854 - DNA, 20 bp, Homo sapiens
gagattaactgagaatctag

SEQ ID NO: 92855 - DNA, 20 bp, Homo sapiens
ggccggggagctctccaggg

SEQ ID NO: 92856 - DNA, 22 bp, Homo sapiens
aagtgatgctacgactttgaca

SEQ ID NO: 92857 - DNA, 22 bp, Homo sapiens
gccaccctggacgcactgttcg

SEQ ID NO: 92858 - DNA, 18 bp, Homo sapiens
cagcctctgattggttgc

SEQ ID NO: 92859 - DNA, 22 bp, Homo sapiens
accgggctaatttttgtatctt

SEQ ID NO: 92860 - DNA, 22 bp, Homo sapiens
aggagatggagctcagtgggca

SEQ ID NO: 92861 - DNA, 22 bp, Homo sapiens
tgaaggacagcagtggctccaa

SEQ ID NO: 92862 - DNA, 23 bp, Homo sapiens
ttttgcaataagtcactggaata

SEQ ID NO: 92863 - DNA, 23 bp, Homo sapiens
caccccaccctgaggaggaggga

SEQ ID NO: 92864 - DNA, 22 bp, Homo sapiens
ctgggaggcagaggttgcagtg

SEQ ID NO: 92865 - DNA, 19 bp, Homo sapiens
tctcaattctccccactgc

SEQ ID NO: 92866 - DNA, 21 bp, Homo sapiens
cgggaaggaggttctgaccct

SEQ ID NO: 92867 - DNA, 22 bp, Homo sapiens
tgagggctgtctgaagcttggg

SEQ ID NO: 92868 - DNA, 22 bp, Homo sapiens
gggcggggggagctggaatgaa

SEQ ID NO: 92869 - DNA, 22 bp, Homo sapiens
gagggtggtggcttaaggtgct

SEQ ID NO: 92870 - DNA, 22 bp, Homo sapiens
tgggaggccaaggcaggcggat

SEQ ID NO: 92871 - DNA, 22 bp, Homo sapiens
catccaggctgaagtgcagtgg

SEQ ID NO: 92872 - DNA, 22 bp, Homo sapiens
tcagccagccagctacaggctt

SEQ ID NO: 92873 - DNA, 22 bp, Homo sapiens
catggcattgcataacggggct

SEQ ID NO: 92874 - DNA, 22 bp, Homo sapiens
taagggttcagaatgcagtggt

SEQ ID NO: 92875 - DNA, 22 bp, Homo sapiens
tctcccaagcctggcaggggca

SEQ ID NO: 92876 - DNA, 19 bp, Homo sapiens
tgcctgctgtattccagag

SEQ ID NO: 92877 - DNA, 22 bp, Homo sapiens
ctcatcagaaatacctgacaaa

SEQ ID NO: 92878 - DNA, 22 bp, Homo sapiens
ttcccttaaattatggcatcta

SEQ ID NO: 92879 - DNA, 22 bp, Homo sapiens
tgccgcactcggccaccagctg

SEQ ID NO: 92880 - DNA, 22 bp, Homo sapiens
aggggaatgggtagactgttga

SEQ ID NO: 92881 - DNA, 22 bp, Homo sapiens
gtgcccagcagcagcgtccccg

SEQ ID NO: 92882 - DNA, 22 bp, Homo sapiens
tgaactcctgacctcatgatcc

SEQ ID NO: 92883 - DNA, 22 bp, Homo sapiens
ccagcagccaccttctcgaaat

SEQ ID NO: 92884 - DNA, 22 bp, Homo sapiens
atattagtttggagactacaat

SEQ ID NO: 92885 - DNA, 22 bp, Homo sapiens
tctgcgcgctgctggtaccgaa

SEQ ID NO: 92886 - DNA, 22 bp, Homo sapiens
ctccaccccgtgccggtgctgg

SEQ ID NO: 92887 - DNA, 22 bp, Homo sapiens
gagccaagctcttctccatgag

SEQ ID NO: 92888 - DNA, 22 bp, Homo sapiens
gatgtgtttccaggatttgttt

SEQ ID NO: 92889 - DNA, 20 bp, Homo sapiens
agacaccccctgacagggaa

SEQ ID NO: 92890 - DNA, 22 bp, Homo sapiens
actcccagaacatgctcttctt

SEQ ID NO: 92891 - DNA, 22 bp, Homo sapiens
cccaggaggcggaggttgcagt

SEQ ID NO: 92892 - DNA, 22 bp, Homo sapiens
gagggccctggctggctccagc

SEQ ID NO: 92893 - DNA, 23 bp, Homo sapiens
tagatgtattaagtgcattttca

SEQ ID NO: 92894 - DNA, 20 bp, Homo sapiens
gaaatgtacacattaccaca

SEQ ID NO: 92895 - DNA, 22 bp, Homo sapiens
ctcattgcaacctccgcctccc

SEQ ID NO: 92896 - DNA, 22 bp, Homo sapiens
aaacttgagccaagggcttggg

SEQ ID NO: 92897 - DNA, 22 bp, Homo sapiens
gaggtgctgctgtacttcttgc

SEQ ID NO: 92898 - DNA, 22 bp, Homo sapiens
gcagggcacaaggacgcacagg

SEQ ID NO: 92899 - DNA, 22 bp, Homo sapiens
taacctctctgtgcctcagttt

SEQ ID NO: 92900 - DNA, 22 bp, Homo sapiens
gaggccaactttggagaacagg

SEQ ID NO: 92901 - DNA, 22 bp, Homo sapiens
tcgaaggaggcactcagacatg

SEQ ID NO: 92902 - DNA, 22 bp, Homo sapiens
atgtaaactactgactacacta

SEQ ID NO: 92903 - DNA, 22 bp, Homo sapiens
tgagaattacaaatgagtcaca

SEQ ID NO: 92904 - DNA, 22 bp, Homo sapiens
atgcacacgtaccctacaaggc

SEQ ID NO: 92905 - DNA, 22 bp, Homo sapiens
tttttccacataccctaggcca

SEQ ID NO: 92906 - DNA, 18 bp, Homo sapiens
tcttccaacactgacacc

SEQ ID NO: 92907 - DNA, 22 bp, Homo sapiens
tttgaagactactgggagtgaa

SEQ ID NO: 92908 - DNA, 22 bp, Homo sapiens
ctagggtcaggggcctgcgtcg

SEQ ID NO: 92909 - DNA, 22 bp, Homo sapiens
cccaaaggttgaggctgcagtg

SEQ ID NO: 92910 - DNA, 22 bp, Homo sapiens
tttgcattgcattaagtattct

SEQ ID NO: 92911 - DNA, 22 bp, Homo sapiens
gtggattacaagacagttgaga

SEQ ID NO: 92912 - DNA, 22 bp, Homo sapiens
gtcctgtgagattcatgctcaa

SEQ ID NO: 92913 - DNA, 22 bp, Homo sapiens
ttgctttcccaaggcagaacat

SEQ ID NO: 92914 - DNA, 22 bp, Homo sapiens
cctttaggagtgaggaccgagc

SEQ ID NO: 92915 - DNA, 22 bp, Homo sapiens
gcctccagcccacgcaggcctg

SEQ ID NO: 92916 - DNA, 22 bp, Homo sapiens
ctgctcagtaatagtcctatct

SEQ ID NO: 92917 - DNA, 22 bp, Homo sapiens
ctgtcctgccagtcctggactc

SEQ ID NO: 92918 - DNA, 22 bp, Homo sapiens
aattgaaaatattgtagaccat

SEQ ID NO: 92919 - DNA, 21 bp, Homo sapiens
atgtagggtttgccttctcta

SEQ ID NO: 92920 - DNA, 19 bp, Homo sapiens
cataatacagtggatctga

SEQ ID NO: 92921 - DNA, 22 bp, Homo sapiens
tccttagacaaagagtgggctt

SEQ ID NO: 92922 - DNA, 22 bp, Homo sapiens
gagcccaggagtttgatgctgc

SEQ ID NO: 92923 - DNA, 22 bp, Homo sapiens
tgtgtctgtgtatacacggcat

SEQ ID NO: 92924 - DNA, 23 bp, Homo sapiens
tcaagcaattctcctgcctcggc

SEQ ID NO: 92925 - DNA, 22 bp, Homo sapiens
cttatcagattatctgggctgt

SEQ ID NO: 92926 - DNA, 22 bp, Homo sapiens
ttagcttttgagaatgatttct

SEQ ID NO: 92927 - DNA, 22 bp, Homo sapiens
cctgcacatgtgtgcgcctgta

SEQ ID NO: 92928 - DNA, 22 bp, Homo sapiens
ttatttaaaagtggtaagattc

SEQ ID NO: 92929 - DNA, 22 bp, Homo sapiens
cgaggaggaaacgcggagaact

SEQ ID NO: 92930 - DNA, 22 bp, Homo sapiens
acaggggaatttactgtcatta

SEQ ID NO: 92931 - DNA, 22 bp, Homo sapiens
ggctgatgggcatgagctgtca

SEQ ID NO: 92932 - DNA, 22 bp, Homo sapiens
aaagtgctgggattacaggcat

SEQ ID NO: 92933 - DNA, 22 bp, Homo sapiens
cactgggcgtgtcctgggtgag

SEQ ID NO: 92934 - DNA, 22 bp, Homo sapiens
gcaggtctatcaggctgcaggt

SEQ ID NO: 92935 - DNA, 22 bp, Homo sapiens
tagcagaagttgcaaactaggg

SEQ ID NO: 92936 - DNA, 22 bp, Homo sapiens
tcatgcctggaatctcaccact

SEQ ID NO: 92937 - DNA, 22 bp, Homo sapiens
atttgattgtgtctgagacgat

SEQ ID NO: 92938 - DNA, 22 bp, Homo sapiens
catgatctggtcctactgtggg

SEQ ID NO: 92939 - DNA, 22 bp, Homo sapiens
cgtctggcttctccacggtaaa

SEQ ID NO: 92940 - DNA, 22 bp, Homo sapiens
cccccagctctgctgggtcccg

SEQ ID NO: 92941 - DNA, 22 bp, Homo sapiens
ttaccaaatgaaatagagattt

SEQ ID NO: 92942 - DNA, 22 bp, Homo sapiens
aacatagaataaatgagttagg

SEQ ID NO: 92943 - DNA, 22 bp, Homo sapiens
gctgtggcctggcgcagagctg

SEQ ID NO: 92944 - DNA, 22 bp, Homo sapiens
gggcagagagctggaactcctt

SEQ ID NO: 92945 - DNA, 22 bp, Homo sapiens
tgcagcactgttcacaatagcc

SEQ ID NO: 92946 - DNA, 22 bp, Homo sapiens
tgtgactgaggctccaagctag

SEQ ID NO: 92947 - DNA, 22 bp, Homo sapiens
gctgtgcagaggtgagaatcca

SEQ ID NO: 92948 - DNA, 22 bp, Homo sapiens
ctctctgggcccagttggcacc

SEQ ID NO: 92949 - DNA, 22 bp, Homo sapiens
gtggagagagataagcctggtc

SEQ ID NO: 92950 - DNA, 22 bp, Homo sapiens
tcgcaccattgcactccagcca

SEQ ID NO: 92951 - DNA, 22 bp, Homo sapiens
ctggcaggtggaggttgcagtg

SEQ ID NO: 92952 - DNA, 22 bp, Homo sapiens
cgggcgcactccgggcagctgt

SEQ ID NO: 92953 - DNA, 19 bp, Homo sapiens
tgctaccgtgggatgctta

SEQ ID NO: 92954 - DNA, 22 bp, Homo sapiens
accctctagagggaagcacttt

SEQ ID NO: 92955 - DNA, 22 bp, Homo sapiens
cagcagtgtacaaggtgtcaga

SEQ ID NO: 92956 - DNA, 22 bp, Homo sapiens
ggtgggagccaacacccttctg

SEQ ID NO: 92957 - DNA, 22 bp, Homo sapiens
gacccaggggcagggagaaagt

SEQ ID NO: 92958 - DNA, 22 bp, Homo sapiens
gctccccaaaagctccaggaaa

SEQ ID NO: 92959 - DNA, 22 bp, Homo sapiens
cacccaggctggaatgcagtgg

SEQ ID NO: 92960 - DNA, 22 bp, Homo sapiens
cacccaggctggagtgcagtga

SEQ ID NO: 92961 - DNA, 22 bp, Homo sapiens
agcccgcatctcgctaaagata

SEQ ID NO: 92962 - DNA, 22 bp, Homo sapiens
ttgtaacaggtactaaataact

SEQ ID NO: 92963 - DNA, 22 bp, Homo sapiens
tctaaacttgtaaacaagcata

SEQ ID NO: 92964 - DNA, 22 bp, Homo sapiens
ttggaatgcacactgagcctgc

SEQ ID NO: 92965 - DNA, 22 bp, Homo sapiens
ccccaggacgtggccctcatag

SEQ ID NO: 92966 - DNA, 22 bp, Homo sapiens
tgggggtgtcctggtgcacaca

SEQ ID NO: 92967 - DNA, 22 bp, Homo sapiens
agaatgggggctacaggccaca

SEQ ID NO: 92968 - DNA, 22 bp, Homo sapiens
ctgggagtggtgacagctctcg

SEQ ID NO: 92969 - DNA, 22 bp, Homo sapiens
ggttgcaaactcctgggatcaa

SEQ ID NO: 92970 - DNA, 22 bp, Homo sapiens
ttcaatagaaagtccctagtta

SEQ ID NO: 92971 - DNA, 22 bp, Homo sapiens
agccagggtctctcgctctgtt

SEQ ID NO: 92972 - DNA, 22 bp, Homo sapiens
tcccacaggtggagcttgcagt

SEQ ID NO: 92973 - DNA, 22 bp, Homo sapiens
tcacatgtgtacagtcctccca

SEQ ID NO: 92974 - DNA, 22 bp, Homo sapiens
gaggggctgccctggtgtcagg

SEQ ID NO: 92975 - DNA, 22 bp, Homo sapiens
gtacagaggttgctggaggctc

SEQ ID NO: 92976 - DNA, 22 bp, Homo sapiens
acattacctggcatttgatctt

SEQ ID NO: 92977 - DNA, 22 bp, Homo sapiens
agtgggccggacagcccaggcc

SEQ ID NO: 92978 - DNA, 22 bp, Homo sapiens
agctcaatgcaacctccgcctc

SEQ ID NO: 92979 - DNA, 22 bp, Homo sapiens
ctgtcctggggaaagccagccc

SEQ ID NO: 92980 - DNA, 22 bp, Homo sapiens
ttccatcattaacaccacaagg

SEQ ID NO: 92981 - DNA, 22 bp, Homo sapiens
aaggatacttttagagcctgag

SEQ ID NO: 92982 - DNA, 22 bp, Homo sapiens
ttaaacatttatggaggcagca

SEQ ID NO: 92983 - DNA, 19 bp, Homo sapiens
gcctcatttccacctcccc

SEQ ID NO: 92984 - DNA, 22 bp, Homo sapiens
tgtgttaaggtgcatctagtgc

SEQ ID NO: 92985 - DNA, 18 bp, Homo sapiens
gtcaggcatgaatctggg

SEQ ID NO: 92986 - DNA, 22 bp, Homo sapiens
gtggaatttttacctatgaatg

SEQ ID NO: 92987 - DNA, 22 bp, Homo sapiens
atttattcctttatggctggag

SEQ ID NO: 92988 - DNA, 22 bp, Homo sapiens
tccgggcaactgaagggaggtt

SEQ ID NO: 92989 - DNA, 22 bp, Homo sapiens
gcccaggctggagttcagtggt

SEQ ID NO: 92990 - DNA, 22 bp, Homo sapiens
tgagtggacacctgcttcttta

SEQ ID NO: 92991 - DNA, 22 bp, Homo sapiens
ggtggcagtagcactgggcctg

SEQ ID NO: 92992 - DNA, 22 bp, Homo sapiens
cagaatcaagtccaattagcac

SEQ ID NO: 92993 - DNA, 22 bp, Homo sapiens
gagagaagggggatatgagcct

SEQ ID NO: 92994 - DNA, 22 bp, Homo sapiens
gctcatgactgtaatcccagca

SEQ ID NO: 92995 - DNA, 22 bp, Homo sapiens
tcgtacagcagactgaagtcct

SEQ ID NO: 92996 - DNA, 22 bp, Homo sapiens
ataataacaatgccagatgcct

SEQ ID NO: 92997 - DNA, 22 bp, Homo sapiens
tcttgcacttcatgaatatgtt

SEQ ID NO: 92998 - DNA, 22 bp, Homo sapiens
agccaagcactcaactcctgga

SEQ ID NO: 92999 - DNA, 22 bp, Homo sapiens
aagagggctgcaatcttattgc

SEQ ID NO: 93000 - DNA, 22 bp, Homo sapiens
ttagccaggggagcagcttgtc

SEQ ID NO: 93001 - DNA, 22 bp, Homo sapiens
tcacccaggctggactgcagtg

SEQ ID NO: 93002 - DNA, 22 bp, Homo sapiens
ggtgtccgcgctgtagaaggtc

SEQ ID NO: 93003 - DNA, 19 bp, Homo sapiens
ctgctgccggagactcgtc

SEQ ID NO: 93004 - DNA, 23 bp, Homo sapiens
tctgtgtctccacccaaatctca

SEQ ID NO: 93005 - DNA, 22 bp, Homo sapiens
caggctggagtacaattgtgtg

SEQ ID NO: 93006 - DNA, 22 bp, Homo sapiens
aaagtaattgcagtttctgcca

SEQ ID NO: 93007 - DNA, 22 bp, Homo sapiens
aaaagtaattgcggtttttgct

SEQ ID NO: 93008 - DNA, 22 bp, Homo sapiens
ctgaggtgtgaaatggtggcaa

SEQ ID NO: 93009 - DNA, 22 bp, Homo sapiens
cagatgtacatgaagggcaatg

SEQ ID NO: 93010 - DNA, 22 bp, Homo sapiens
atacaaaatatatactggagac

SEQ ID NO: 93011 - DNA, 22 bp, Homo sapiens
actgcaacctccgcctgccagg

SEQ ID NO: 93012 - DNA, 22 bp, Homo sapiens
gcagaggacacaggagggcaag

SEQ ID NO: 93013 - DNA, 22 bp, Homo sapiens
ttcactggtcctttataggaac

SEQ ID NO: 93014 - DNA, 22 bp, Homo sapiens
gggaggctctgctcagcccccg

SEQ ID NO: 93015 - DNA, 22 bp, Homo sapiens
ccaggagttggaagctgccatg

SEQ ID NO: 93016 - DNA, 22 bp, Homo sapiens
cagagggttgatgtgaggctta

SEQ ID NO: 93017 - DNA, 22 bp, Homo sapiens
tggcacgacaattggcaccaat

SEQ ID NO: 93018 - DNA, 22 bp, Homo sapiens
tccgggaggcagaggttgcagt

SEQ ID NO: 93019 - DNA, 22 bp, Homo sapiens
actgcaacctccacctcctggg

SEQ ID NO: 93020 - DNA, 22 bp, Homo sapiens
tgtctattcccccacctccgtt

SEQ ID NO: 93021 - DNA, 22 bp, Homo sapiens
agaggaagtaatcaggacctgc

SEQ ID NO: 93022 - DNA, 22 bp, Homo sapiens
gtggcagagccaaggctggagc

SEQ ID NO: 93023 - DNA, 22 bp, Homo sapiens
aggccagcagcatgacggcatc

SEQ ID NO: 93024 - DNA, 22 bp, Homo sapiens
gaaggaagtcattagtgcagac

SEQ ID NO: 93025 - DNA, 22 bp, Homo sapiens
gtgcgtcctgggggctgggtcg

SEQ ID NO: 93026 - DNA, 22 bp, Homo sapiens
aagaaatgctgatgttggatgg

SEQ ID NO: 93027 - DNA, 22 bp, Homo sapiens
ccctggaggcggagcttgcagt

SEQ ID NO: 93028 - DNA, 22 bp, Homo sapiens
ctgaatccacacaaggtgatgg

SEQ ID NO: 93029 - DNA, 22 bp, Homo sapiens
tggtagtcggcctcggtggctc

SEQ ID NO: 93030 - DNA, 22 bp, Homo sapiens
gcctcctgtcccaggctgagga

SEQ ID NO: 93031 - DNA, 22 bp, Homo sapiens
ggggccttggatctgtgccccg

SEQ ID NO: 93032 - DNA, 22 bp, Homo sapiens
gttctgagtcctcctttgaagg

SEQ ID NO: 93033 - DNA, 22 bp, Homo sapiens
taggctgggggtaggaattgag

SEQ ID NO: 93034 - DNA, 22 bp, Homo sapiens
ggtaacttagctcatggctgtg

SEQ ID NO: 93035 - DNA, 22 bp, Homo sapiens
ggggtctcactatgttacccag

SEQ ID NO: 93036 - DNA, 22 bp, Homo sapiens
gagctcatccccatggtccgtc

SEQ ID NO: 93037 - DNA, 22 bp, Homo sapiens
ggaggtgactggatcatgggca

SEQ ID NO: 93038 - DNA, 22 bp, Homo sapiens
tcacccaggctggagtgcagtg

SEQ ID NO: 93039 - DNA, 22 bp, Homo sapiens
tctcccaggcaggagtgcagtg

SEQ ID NO: 93040 - DNA, 22 bp, Homo sapiens
ggcatggacgtctctgaggcca

SEQ ID NO: 93041 - DNA, 22 bp, Homo sapiens
ggctgtggcagctggaagtggt

SEQ ID NO: 93042 - DNA, 22 bp, Homo sapiens
tgcttctgactaagctgcatga

SEQ ID NO: 93043 - DNA, 22 bp, Homo sapiens
ctggttatctcggccacagaga

SEQ ID NO: 93044 - DNA, 22 bp, Homo sapiens
ccctgccttgtctgggctaggt

SEQ ID NO: 93045 - DNA, 22 bp, Homo sapiens
cttgtagacccctggactcacg

SEQ ID NO: 93046 - DNA, 22 bp, Homo sapiens
gctgccttgccctcttcccata

SEQ ID NO: 93047 - DNA, 22 bp, Homo sapiens
gacaggcttccactatgttgcc

SEQ ID NO: 93048 - DNA, 22 bp, Homo sapiens
aggtggagaagagatgggcagt

SEQ ID NO: 93049 - DNA, 22 bp, Homo sapiens
ggctcactgcaaactgtgcctc

SEQ ID NO: 93050 - DNA, 22 bp, Homo sapiens
tctgagtggactgtcctgcagg

SEQ ID NO: 93051 - DNA, 22 bp, Homo sapiens
agtgcactggcaccatctcagc

SEQ ID NO: 93052 - DNA, 22 bp, Homo sapiens
aaccaggtgactcatggtgagc

SEQ ID NO: 93053 - DNA, 22 bp, Homo sapiens
ttgccttgttattctctcagaa

SEQ ID NO: 93054 - DNA, 22 bp, Homo sapiens
tttgatccgttgctggtgagga

SEQ ID NO: 93055 - DNA, 22 bp, Homo sapiens
aagtgctgggattacaggtgtg

SEQ ID NO: 93056 - DNA, 22 bp, Homo sapiens
gaggcaaagcatgtggctcagg

SEQ ID NO: 93057 - DNA, 19 bp, Homo sapiens
gctggatggatcctggagt

SEQ ID NO: 93058 - DNA, 20 bp, Homo sapiens
gctgaggtggaggaaggaga

SEQ ID NO: 93059 - DNA, 22 bp, Homo sapiens
tgagtgtggggaatgtcatgag

SEQ ID NO: 93060 - DNA, 22 bp, Homo sapiens
ctggctgggagcgagctgctca

SEQ ID NO: 93061 - DNA, 21 bp, Homo sapiens
tacaatgcacaggagagcctc

SEQ ID NO: 93062 - DNA, 22 bp, Homo sapiens
aggctgagataggtggatcatt

SEQ ID NO: 93063 - DNA, 22 bp, Homo sapiens
tatgtgtttgacaccctgcaag

SEQ ID NO: 93064 - DNA, 22 bp, Homo sapiens
gctgctctcagagctcatgctg

SEQ ID NO: 93065 - DNA, 22 bp, Homo sapiens
agttatgtcctcagcaaatcaa

SEQ ID NO: 93066 - DNA, 22 bp, Homo sapiens
gcctggattccttgtttctcag

SEQ ID NO: 93067 - DNA, 22 bp, Homo sapiens
cactgcaacctccacctcctgg

SEQ ID NO: 93068 - DNA, 19 bp, Homo sapiens
tcctgcctggggccgcctg

SEQ ID NO: 93069 - DNA, 22 bp, Homo sapiens
tcccgcttcttccgaatcgcga

SEQ ID NO: 93070 - DNA, 22 bp, Homo sapiens
tcctgggacaagccgtggaagt

SEQ ID NO: 93071 - DNA, 22 bp, Homo sapiens
aaagagactggtggcattttgc

SEQ ID NO: 93072 - DNA, 22 bp, Homo sapiens
actgcactccagcctgggtgac

SEQ ID NO: 93073 - DNA, 22 bp, Homo sapiens
tgtgactaggcctgagctcttg

SEQ ID NO: 93074 - DNA, 22 bp, Homo sapiens
gtcagtaggaacctagggtcaa

SEQ ID NO: 93075 - DNA, 22 bp, Homo sapiens
tcagcctccgaaagtgctggga

SEQ ID NO: 93076 - DNA, 22 bp, Homo sapiens
aagaaggcggaccagaagggag

SEQ ID NO: 93077 - DNA, 18 bp, Homo sapiens
ggtgagggagctggaagc

SEQ ID NO: 93078 - DNA, 22 bp, Homo sapiens
tcagcctgctccaagtgctgcc

SEQ ID NO: 93079 - DNA, 22 bp, Homo sapiens
aaaagtcttggggaaggccagg

SEQ ID NO: 93080 - DNA, 22 bp, Homo sapiens
tgcagattcaaatgaaatgcaa

SEQ ID NO: 93081 - DNA, 22 bp, Homo sapiens
gcagcgaggtgatgaaatagct

SEQ ID NO: 93082 - DNA, 22 bp, Homo sapiens
ctggcagatagtaagtgatcaa

SEQ ID NO: 93083 - DNA, 22 bp, Homo sapiens
ctgtgcgtaagtagccaaaata

SEQ ID NO: 93084 - DNA, 23 bp, Homo sapiens
aatgggtgcaactatccatgaca

SEQ ID NO: 93085 - DNA, 22 bp, Homo sapiens
gcttttcatgacaactcagcga

SEQ ID NO: 93086 - DNA, 22 bp, Homo sapiens
ttactttaagggtgtcttatta

SEQ ID NO: 93087 - DNA, 22 bp, Homo sapiens
aacatacgagcagtttatagag

SEQ ID NO: 93088 - DNA, 22 bp, Homo sapiens
tggtggctcacgtctgtaatct

SEQ ID NO: 93089 - DNA, 22 bp, Homo sapiens
tcttggccactaccacctggag

SEQ ID NO: 93090 - DNA, 22 bp, Homo sapiens
gggagaggttacccgagcaact

SEQ ID NO: 93091 - DNA, 22 bp, Homo sapiens
acaaggcactttatgaagagga

SEQ ID NO: 93092 - DNA, 22 bp, Homo sapiens
tcttcatgtcatggtatattga

SEQ ID NO: 93093 - DNA, 22 bp, Homo sapiens
ttctagtgtccttggacttgct

SEQ ID NO: 93094 - DNA, 22 bp, Homo sapiens
ctgctctgctgatcagtgtctc

SEQ ID NO: 93095 - DNA, 21 bp, Homo sapiens
cagggccaatcctgacctcta

SEQ ID NO: 93096 - DNA, 22 bp, Homo sapiens
tgggtactcctattagttcagt

SEQ ID NO: 93097 - DNA, 22 bp, Homo sapiens
tcaggtccaagatggccatcca

SEQ ID NO: 93098 - DNA, 22 bp, Homo sapiens
tctttcttgtgggtgccctttt

SEQ ID NO: 93099 - DNA, 22 bp, Homo sapiens
cctcttctaggacgtccttgtg

SEQ ID NO: 93100 - DNA, 22 bp, Homo sapiens
gagaaatgcatgcatgtcatca

SEQ ID NO: 93101 - DNA, 22 bp, Homo sapiens
gaatatcccgctatgcaaagta

SEQ ID NO: 93102 - DNA, 22 bp, Homo sapiens
gggccatgagaggttcatcaac

SEQ ID NO: 93103 - DNA, 22 bp, Homo sapiens
gctcggtggccagcctgaggcc

SEQ ID NO: 93104 - DNA, 22 bp, Homo sapiens
ggcctcttatctggctcctgca

SEQ ID NO: 93105 - DNA, 22 bp, Homo sapiens
agcataagttggtacagccact

SEQ ID NO: 93106 - DNA, 22 bp, Homo sapiens
atgggatgatcacctgagctca

SEQ ID NO: 93107 - DNA, 22 bp, Homo sapiens
ggagagtggattccagctgtat

SEQ ID NO: 93108 - DNA, 22 bp, Homo sapiens
gtgtcaggccctgcattatgtg

SEQ ID NO: 93109 - DNA, 22 bp, Homo sapiens
agaggacagagtgctggattta

SEQ ID NO: 93110 - DNA, 22 bp, Homo sapiens
cttcatagtgagtttaatgatg

SEQ ID NO: 93111 - DNA, 22 bp, Homo sapiens
agcagcttgaggctggattcca

SEQ ID NO: 93112 - DNA, 22 bp, Homo sapiens
tagatctgatacaattcatctg

SEQ ID NO: 93113 - DNA, 22 bp, Homo sapiens
gtgaattacatgtatttttaag

SEQ ID NO: 93114 - DNA, 22 bp, Homo sapiens
tgctccatgcgctcggccggcg

SEQ ID NO: 93115 - DNA, 22 bp, Homo sapiens
ttcattttctttcacgctgctg

SEQ ID NO: 93116 - DNA, 22 bp, Homo sapiens
tgccctctttctgtacagctcc

SEQ ID NO: 93117 - DNA, 22 bp, Homo sapiens
tacaggcatgtagcatggtgat

SEQ ID NO: 93118 - DNA, 22 bp, Homo sapiens
tgggctgcaggggttgagagct

SEQ ID NO: 93119 - DNA, 22 bp, Homo sapiens
atgaccagccgagataaacaga

SEQ ID NO: 93120 - DNA, 22 bp, Homo sapiens
tatttaataaaactatggcatg

SEQ ID NO: 93121 - DNA, 22 bp, Homo sapiens
tcaggaggcggaggttgcagtg

SEQ ID NO: 93122 - DNA, 22 bp, Homo sapiens
cattgcactccagcctgggcaa

SEQ ID NO: 93123 - DNA, 22 bp, Homo sapiens
gtgtggaatggagtttttgccc

SEQ ID NO: 93124 - DNA, 22 bp, Homo sapiens
ggacagaaaccatatgagtgta

SEQ ID NO: 93125 - DNA, 22 bp, Homo sapiens
cacctctcatttctacagattc

SEQ ID NO: 93126 - DNA, 22 bp, Homo sapiens
tctgctttcttactaaaaatga

SEQ ID NO: 93127 - DNA, 22 bp, Homo sapiens
tcgtctgtgaaattgggataag

SEQ ID NO: 93128 - DNA, 22 bp, Homo sapiens
aaggtatatctgatccatgagg

SEQ ID NO: 93129 - DNA, 22 bp, Homo sapiens
atgggttcaagtgattctcctg

SEQ ID NO: 93130 - DNA, 22 bp, Homo sapiens
tggtatgtaaattgtaactcaa

SEQ ID NO: 93131 - DNA, 22 bp, Homo sapiens
tgagccaagttcacaccattgc

SEQ ID NO: 93132 - DNA, 22 bp, Homo sapiens
gcgctcagaaaagattttcttc

SEQ ID NO: 93133 - DNA, 22 bp, Homo sapiens
ttagggttacaccagcctcctg

SEQ ID NO: 93134 - DNA, 22 bp, Homo sapiens
ttgctaccattgataccagcac

SEQ ID NO: 93135 - DNA, 22 bp, Homo sapiens
ccgtggtcacctgagctccttg

SEQ ID NO: 93136 - DNA, 22 bp, Homo sapiens
ccgaggctggagtgcagtggcg

SEQ ID NO: 93137 - DNA, 22 bp, Homo sapiens
gctaggttggggaagttctcct

SEQ ID NO: 93138 - DNA, 23 bp, Homo sapiens
ctcaaccctagtaagggagtagg

SEQ ID NO: 93139 - DNA, 22 bp, Homo sapiens
ccaggaggcggaggttgcagcg

SEQ ID NO: 93140 - DNA, 22 bp, Homo sapiens
gaataatcatgaaattcagtga

SEQ ID NO: 93141 - DNA, 22 bp, Homo sapiens
catgtgaattccaaagctaggt

SEQ ID NO: 93142 - DNA, 22 bp, Homo sapiens
gctagtgtttgccagcgtagcc

SEQ ID NO: 93143 - DNA, 22 bp, Homo sapiens
gactggaaagcctgtcctcaga

SEQ ID NO: 93144 - DNA, 22 bp, Homo sapiens
aatgtcaaaggctatacattca

SEQ ID NO: 93145 - DNA, 22 bp, Homo sapiens
ggtttgacagcttggggctgtc

SEQ ID NO: 93146 - DNA, 22 bp, Homo sapiens
ggcaagagggcagatggagtgc

SEQ ID NO: 93147 - DNA, 22 bp, Homo sapiens
aaagtgctgggattacaggtgt

SEQ ID NO: 93148 - DNA, 19 bp, Homo sapiens
agataagagttgactgtgg

SEQ ID NO: 93149 - DNA, 22 bp, Homo sapiens
gcgccccatctacagtactttt

SEQ ID NO: 93150 - DNA, 22 bp, Homo sapiens
aagtaaatatctgtagtcttta

SEQ ID NO: 93151 - DNA, 22 bp, Homo sapiens
tgaggcaggagaatcacatgaa

SEQ ID NO: 93152 - DNA, 22 bp, Homo sapiens
cccatttcttgagttcagctct

SEQ ID NO: 93153 - DNA, 22 bp, Homo sapiens
gaggaggcttccgggaggcacg

SEQ ID NO: 93154 - DNA, 22 bp, Homo sapiens
attaagtgactaaagtaatgct

SEQ ID NO: 93155 - DNA, 22 bp, Homo sapiens
attttctatgttgtaattgtta

SEQ ID NO: 93156 - DNA, 22 bp, Homo sapiens
tcactgcaacctccacctcccg

SEQ ID NO: 93157 - DNA, 22 bp, Homo sapiens
acctggccagtggggccgcgct

SEQ ID NO: 93158 - DNA, 22 bp, Homo sapiens
gaccactggggtgagggccatc

SEQ ID NO: 93159 - DNA, 22 bp, Homo sapiens
tgtcctgtgattccagctcttc

SEQ ID NO: 93160 - DNA, 22 bp, Homo sapiens
cggctgggttcggctgcaggcc

SEQ ID NO: 93161 - DNA, 22 bp, Homo sapiens
ggggcagagaataaaaacctaa

SEQ ID NO: 93162 - DNA, 22 bp, Homo sapiens
tgacacccatctgtgccagtcc

SEQ ID NO: 93163 - DNA, 22 bp, Homo sapiens
ttccacattccttacattcata

SEQ ID NO: 93164 - DNA, 22 bp, Homo sapiens
cggcatgggcgtccccctcact

SEQ ID NO: 93165 - DNA, 22 bp, Homo sapiens
aagagggaaattgttggctgct

SEQ ID NO: 93166 - DNA, 22 bp, Homo sapiens
aggaaggactccatggtccgtc

SEQ ID NO: 93167 - DNA, 22 bp, Homo sapiens
ttttctaacatctagtaatttg

SEQ ID NO: 93168 - DNA, 22 bp, Homo sapiens
ctgaagagaaagggagctcttc

SEQ ID NO: 93169 - DNA, 22 bp, Homo sapiens
gtgtgggctgcagaggcacagc

SEQ ID NO: 93170 - DNA, 22 bp, Homo sapiens
gaaaaggcctggggcaaagtgt

SEQ ID NO: 93171 - DNA, 22 bp, Homo sapiens
ggagtgaagtggcgcgatctcg

SEQ ID NO: 93172 - DNA, 22 bp, Homo sapiens
ccaattttattcttctgcaagt

SEQ ID NO: 93173 - DNA, 21 bp, Homo sapiens
gaccccagaccagcagacaca

SEQ ID NO: 93174 - DNA, 18 bp, Homo sapiens
cccggctaatttttggta

SEQ ID NO: 93175 - DNA, 22 bp, Homo sapiens
ttttgcaacacaggctacttca

SEQ ID NO: 93176 - DNA, 22 bp, Homo sapiens
ttggaatgttttaatataaatt

SEQ ID NO: 93177 - DNA, 19 bp, Homo sapiens
ccagagagctaggtacaga

SEQ ID NO: 93178 - DNA, 22 bp, Homo sapiens
gtggccgccaggtcctcgtcca

SEQ ID NO: 93179 - DNA, 19 bp, Homo sapiens
atcccaaggagctgggact

SEQ ID NO: 93180 - DNA, 22 bp, Homo sapiens
tatagcagcatgatttatagtc

SEQ ID NO: 93181 - DNA, 22 bp, Homo sapiens
aagcctggcacattggagtctg

SEQ ID NO: 93182 - DNA, 22 bp, Homo sapiens
taacaatacccattctaattac

SEQ ID NO: 93183 - DNA, 22 bp, Homo sapiens
ggcaaaaaccataattactttt

SEQ ID NO: 93184 - DNA, 22 bp, Homo sapiens
tatgccgcagccggatttcccc

SEQ ID NO: 93185 - DNA, 22 bp, Homo sapiens
taactctgaatcctcacagcag

SEQ ID NO: 93186 - DNA, 22 bp, Homo sapiens
cagcctgtagtctggtccaggt

SEQ ID NO: 93187 - DNA, 22 bp, Homo sapiens
ggcatctggatctgcttctccc

SEQ ID NO: 93188 - DNA, 22 bp, Homo sapiens
tgttccgaccgtggggtttgat

SEQ ID NO: 93189 - DNA, 22 bp, Homo sapiens
atgatactctaggtgatttaca

SEQ ID NO: 93190 - DNA, 22 bp, Homo sapiens
tgttgagtatatacctacaagt

SEQ ID NO: 93191 - DNA, 23 bp, Homo sapiens
ttaacaggatctcgggcaagagg

SEQ ID NO: 93192 - DNA, 22 bp, Homo sapiens
cactgcactccagcactccagc

SEQ ID NO: 93193 - DNA, 22 bp, Homo sapiens
agggctctgagtgggaaagagg

SEQ ID NO: 93194 - DNA, 22 bp, Homo sapiens
ttctcaaagtgtgctccctgga

SEQ ID NO: 93195 - DNA, 22 bp, Homo sapiens
agttggagtgaacatgagattg

SEQ ID NO: 93196 - DNA, 22 bp, Homo sapiens
aagatacagacagagccaaaat

SEQ ID NO: 93197 - DNA, 22 bp, Homo sapiens
ggcaggaggtgagtggcgggtg

SEQ ID NO: 93198 - DNA, 22 bp, Homo sapiens
ggagaagaggagctggaagcct

SEQ ID NO: 93199 - DNA, 22 bp, Homo sapiens
gagatggagtctttttctgtca

SEQ ID NO: 93200 - DNA, 18 bp, Homo sapiens
ccctcttgcacaaagcaa

SEQ ID NO: 93201 - DNA, 22 bp, Homo sapiens
ttaaatattatgttgtctgcaa

SEQ ID NO: 93202 - DNA, 22 bp, Homo sapiens
acgtagcactgagagatgcagg

SEQ ID NO: 93203 - DNA, 17 bp, Homo sapiens
aatctgtttacagtcag

SEQ ID NO: 93204 - DNA, 22 bp, Homo sapiens
tgcctaggctggagtgcagtga

SEQ ID NO: 93205 - DNA, 22 bp, Homo sapiens
ctcgccccggcacagtgtccgt

SEQ ID NO: 93206 - DNA, 22 bp, Homo sapiens
gacactgcacttggggcccaca

SEQ ID NO: 93207 - DNA, 22 bp, Homo sapiens
cacagctgaagtagccatgtgg

SEQ ID NO: 93208 - DNA, 22 bp, Homo sapiens
ttgagggtctggatctgctgct

SEQ ID NO: 93209 - DNA, 22 bp, Homo sapiens
gagatatgttggcagctggtat

SEQ ID NO: 93210 - DNA, 22 bp, Homo sapiens
cccagtttcaactttccagtgg

SEQ ID NO: 93211 - DNA, 22 bp, Homo sapiens
tgagaaacacaggcatgaatag

SEQ ID NO: 93212 - DNA, 22 bp, Homo sapiens
atgccactgcacttcagcctgg

SEQ ID NO: 93213 - DNA, 22 bp, Homo sapiens
tcttttgtgattctttagttac

SEQ ID NO: 93214 - DNA, 22 bp, Homo sapiens
ctgcagggagaggggacagcct

SEQ ID NO: 93215 - DNA, 22 bp, Homo sapiens
tggaatggaaacaaactgagga

SEQ ID NO: 93216 - DNA, 22 bp, Homo sapiens
ttagaggaaagactgggactaa

SEQ ID NO: 93217 - DNA, 22 bp, Homo sapiens
acaggtcctcaagtcagctggg

SEQ ID NO: 93218 - DNA, 22 bp, Homo sapiens
tgctgggggtagctctgcgtag

SEQ ID NO: 93219 - DNA, 22 bp, Homo sapiens
aagccctggcgggtggagggcc

SEQ ID NO: 93220 - DNA, 22 bp, Homo sapiens
ggagaacatatctcccacattg

SEQ ID NO: 93221 - DNA, 22 bp, Homo sapiens
gcccttctgctgttaggtagcc

SEQ ID NO: 93222 - DNA, 22 bp, Homo sapiens
ctttggaacacccagctctgtg

SEQ ID NO: 93223 - DNA, 22 bp, Homo sapiens
ttgacacagtcaacttgatttt

SEQ ID NO: 93224 - DNA, 22 bp, Homo sapiens
gggcctcaggttctggagaagg

SEQ ID NO: 93225 - DNA, 19 bp, Homo sapiens
tgtccgtggccttctggat

SEQ ID NO: 93226 - DNA, 22 bp, Homo sapiens
cagtcacaagcgtacctaattt

SEQ ID NO: 93227 - DNA, 22 bp, Homo sapiens
aaagttctctatggtgtaaaaa

SEQ ID NO: 93228 - DNA, 22 bp, Homo sapiens
ttcatagtgtttccttccagtg

SEQ ID NO: 93229 - DNA, 22 bp, Homo sapiens
cagtcactggaatagctgagga

SEQ ID NO: 93230 - DNA, 22 bp, Homo sapiens
tctgcaacattcctctccccac

SEQ ID NO: 93231 - DNA, 22 bp, Homo sapiens
cagccagtgtgaccgaggagga

SEQ ID NO: 93232 - DNA, 22 bp, Homo sapiens
cctgtggcgggggccagtgcct

SEQ ID NO: 93233 - DNA, 22 bp, Homo sapiens
ctgagctcaagcgatcctccca

SEQ ID NO: 93234 - DNA, 22 bp, Homo sapiens
cttgcctttgtcttcaaaggct

SEQ ID NO: 93235 - DNA, 22 bp, Homo sapiens
tatcactacacctggctaatta

SEQ ID NO: 93236 - DNA, 22 bp, Homo sapiens
accagcctggccaacatggcaa

SEQ ID NO: 93237 - DNA, 22 bp, Homo sapiens
aggactgggtgcagagggcatc

SEQ ID NO: 93238 - DNA, 22 bp, Homo sapiens
ctctgctgtgccgccagggcct

SEQ ID NO: 93239 - DNA, 22 bp, Homo sapiens
ctgagcagatgaccagccccag

SEQ ID NO: 93240 - DNA, 22 bp, Homo sapiens
caattcccagctgccgggctgc

SEQ ID NO: 93241 - DNA, 22 bp, Homo sapiens
gccagtgcctcgccgcgctcct

SEQ ID NO: 93242 - DNA, 22 bp, Homo sapiens
caccgcggagtgatggagaaac

SEQ ID NO: 93243 - DNA, 17 bp, Homo sapiens
tcggtttgccaggcttc

SEQ ID NO: 93244 - DNA, 22 bp, Homo sapiens
tgcacgtgggctctctgctctt

SEQ ID NO: 93245 - DNA, 22 bp, Homo sapiens
atagagtgatgtaaggtatgtg

SEQ ID NO: 93246 - DNA, 22 bp, Homo sapiens
tgttatcctcagctcacctcta

SEQ ID NO: 93247 - DNA, 22 bp, Homo sapiens
agcattccacactgaagtctgc

SEQ ID NO: 93248 - DNA, 22 bp, Homo sapiens
ttgagcaggatggctatgcaca

SEQ ID NO: 93249 - DNA, 20 bp, Homo sapiens
tgtcattcttctttcacagg

SEQ ID NO: 93250 - DNA, 22 bp, Homo sapiens
gccaccccataggtgttaggtg

SEQ ID NO: 93251 - DNA, 22 bp, Homo sapiens
tagagatggggtcttgctatga

SEQ ID NO: 93252 - DNA, 23 bp, Homo sapiens
gcagaggagcaagctggacacca

SEQ ID NO: 93253 - DNA, 22 bp, Homo sapiens
gccaaggccctgtctgttttac

SEQ ID NO: 93254 - DNA, 22 bp, Homo sapiens
tcacttcgtaaacccctcccat

SEQ ID NO: 93255 - DNA, 22 bp, Homo sapiens
tgatctggtcctactgtgggca

SEQ ID NO: 93256 - DNA, 22 bp, Homo sapiens
gtggagggtgattgccggctgt

SEQ ID NO: 93257 - DNA, 17 bp, Homo sapiens
gggcagggactcctggg

SEQ ID NO: 93258 - DNA, 22 bp, Homo sapiens
agacaaagaaaccgtagaagca

SEQ ID NO: 93259 - DNA, 22 bp, Homo sapiens
gggcttggcacatgggctcagc

SEQ ID NO: 93260 - DNA, 22 bp, Homo sapiens
tctgcggtccccttctcgccct

SEQ ID NO: 93261 - DNA, 22 bp, Homo sapiens
gcccagagttcaaggctgcagt

SEQ ID NO: 93262 - DNA, 22 bp, Homo sapiens
gtggaggagaggcgccttgcgg

SEQ ID NO: 93263 - DNA, 22 bp, Homo sapiens
tatgtaagttgcaaatgaagga

SEQ ID NO: 93264 - DNA, 22 bp, Homo sapiens
ttcaaagcagagggtcaataca

SEQ ID NO: 93265 - DNA, 22 bp, Homo sapiens
atgcacctgaactccatcagct

SEQ ID NO: 93266 - DNA, 22 bp, Homo sapiens
ccttttatagatcagtgtgtta

SEQ ID NO: 93267 - DNA, 22 bp, Homo sapiens
tcatctaagagtcttacattta

SEQ ID NO: 93268 - DNA, 22 bp, Homo sapiens
agaaacgcctgtgaaattatct

SEQ ID NO: 93269 - DNA, 20 bp, Homo sapiens
ttgttagaggaatgccatag

SEQ ID NO: 93270 - DNA, 22 bp, Homo sapiens
gactactcaaactttctctata

SEQ ID NO: 93271 - DNA, 22 bp, Homo sapiens
ctctggagtgtctggccagggt

SEQ ID NO: 93272 - DNA, 22 bp, Homo sapiens
cattctaggcctggcttgggcc

SEQ ID NO: 93273 - DNA, 22 bp, Homo sapiens
aggtggggaggagtgtctcttt

SEQ ID NO: 93274 - DNA, 22 bp, Homo sapiens
tgggtgctctgcgaccgtaggg

SEQ ID NO: 93275 - DNA, 22 bp, Homo sapiens
caggctggagtgcaatgacgcc

SEQ ID NO: 93276 - DNA, 22 bp, Homo sapiens
tccagcagtccatgtgagacac

SEQ ID NO: 93277 - DNA, 22 bp, Homo sapiens
gtgtaagtatctttgtatcttt

SEQ ID NO: 93278 - DNA, 22 bp, Homo sapiens
cttgcctacttgtcaaccagca

SEQ ID NO: 93279 - DNA, 22 bp, Homo sapiens
tcctcctgtctaccagttcctg

SEQ ID NO: 93280 - DNA, 22 bp, Homo sapiens
caggggcgggtaaaaggcctcc

SEQ ID NO: 93281 - DNA, 22 bp, Homo sapiens
gggctgagacgatggggtcttc

SEQ ID NO: 93282 - DNA, 22 bp, Homo sapiens
cactctcacatgccctgtcagt

SEQ ID NO: 93283 - DNA, 22 bp, Homo sapiens
acccaggctggagtgcagtggc

SEQ ID NO: 93284 - DNA, 22 bp, Homo sapiens
ccgggagcaggcgccaccgcca

SEQ ID NO: 93285 - DNA, 22 bp, Homo sapiens
attgcacttcagcctgggtgac

SEQ ID NO: 93286 - DNA, 22 bp, Homo sapiens
agcccaggctggagtgcagtgg

SEQ ID NO: 93287 - DNA, 22 bp, Homo sapiens
cacagagatggtctggcaggtg

SEQ ID NO: 93288 - DNA, 22 bp, Homo sapiens
cagtctctaaatcaatctgaat

SEQ ID NO: 93289 - DNA, 22 bp, Homo sapiens
ggaggagacagtaaaaagcacg

SEQ ID NO: 93290 - DNA, 22 bp, Homo sapiens
cctaggagttcgaagctgcagt

SEQ ID NO: 93291 - DNA, 22 bp, Homo sapiens
cttggaggtggaagttgcagtg

SEQ ID NO: 93292 - DNA, 22 bp, Homo sapiens
aggacaaaggaccagatctgga

SEQ ID NO: 93293 - DNA, 22 bp, Homo sapiens
cgttaataggtgcaaggtaagg

SEQ ID NO: 93294 - DNA, 22 bp, Homo sapiens
ttttggctctgtctgtatcttt

SEQ ID NO: 93295 - DNA, 22 bp, Homo sapiens
atccccctcttggatggcggca

SEQ ID NO: 93296 - DNA, 22 bp, Homo sapiens
ttgtgctctgtgttatttaagg

SEQ ID NO: 93297 - DNA, 22 bp, Homo sapiens
aaaagtaattgtggtttttgct

SEQ ID NO: 93298 - DNA, 22 bp, Homo sapiens
aaggctgaggcagtgaggcaga

SEQ ID NO: 93299 - DNA, 22 bp, Homo sapiens
gcaggcaggcttccttgaactg

SEQ ID NO: 93300 - DNA, 20 bp, Homo sapiens
caagggtttgcattggcttt

SEQ ID NO: 93301 - DNA, 22 bp, Homo sapiens
gaggcctcatgaggtgagcatt

SEQ ID NO: 93302 - DNA, 22 bp, Homo sapiens
caggctggagttcagtggtgtg

SEQ ID NO: 93303 - DNA, 22 bp, Homo sapiens
cctgggcctctcaaagtgctgg

SEQ ID NO: 93304 - DNA, 22 bp, Homo sapiens
cctccccacagcccaggagact

SEQ ID NO: 93305 - DNA, 22 bp, Homo sapiens
tgtgctctgactttctcctggt

SEQ ID NO: 93306 - DNA, 22 bp, Homo sapiens
ccagggtggcgtagatgctggg

SEQ ID NO: 93307 - DNA, 22 bp, Homo sapiens
cggagtcttgctatgttgccca

SEQ ID NO: 93308 - DNA, 22 bp, Homo sapiens
gcaccactacactccagcctgg

SEQ ID NO: 93309 - DNA, 22 bp, Homo sapiens
agggcagagctgtctaaatggc

SEQ ID NO: 93310 - DNA, 22 bp, Homo sapiens
ttctccctgtcctatcaagact

SEQ ID NO: 93311 - DNA, 21 bp, Homo sapiens
taggtgggagccccagtatgc

SEQ ID NO: 93312 - DNA, 22 bp, Homo sapiens
ccatcacagtccccatcgtgat

SEQ ID NO: 93313 - DNA, 19 bp, Homo sapiens
gctgaggtggaggaaggag

SEQ ID NO: 93314 - DNA, 22 bp, Homo sapiens
cttgtattaggaagaatgcttt

SEQ ID NO: 93315 - DNA, 22 bp, Homo sapiens
gaagtattactctgaatgtatt

SEQ ID NO: 93316 - DNA, 22 bp, Homo sapiens
ggagttccagaccagactggcc

SEQ ID NO: 93317 - DNA, 19 bp, Homo sapiens
tgtgactggttgtctcgct

SEQ ID NO: 93318 - DNA, 22 bp, Homo sapiens
tcaagcaattctcctgcctcag

SEQ ID NO: 93319 - DNA, 18 bp, Homo sapiens
tcttcatctcctgagctg

SEQ ID NO: 93320 - DNA, 21 bp, Homo sapiens
cagaggcctatcacagactcc

SEQ ID NO: 93321 - DNA, 22 bp, Homo sapiens
tataccatgtgtgcacactccc

SEQ ID NO: 93322 - DNA, 22 bp, Homo sapiens
gaggtggatgttgcagtgagct

SEQ ID NO: 93323 - DNA, 18 bp, Homo sapiens
tccctcagaattatagaa

SEQ ID NO: 93324 - DNA, 23 bp, Homo sapiens
tgctggagaagcaaagttctgag

SEQ ID NO: 93325 - DNA, 22 bp, Homo sapiens
taatgtataacaaatactcatc

SEQ ID NO: 93326 - DNA, 22 bp, Homo sapiens
ggccaggcgatgacccctccac

SEQ ID NO: 93327 - DNA, 22 bp, Homo sapiens
gtaatctcagctacttgggagg

SEQ ID NO: 93328 - DNA, 22 bp, Homo sapiens
tccttgtaacgttgggctgggg

SEQ ID NO: 93329 - DNA, 22 bp, Homo sapiens
acacagggctgcgcctgacccc

SEQ ID NO: 93330 - DNA, 22 bp, Homo sapiens
cggctggtgtcgggcacagcaa

SEQ ID NO: 93331 - DNA, 22 bp, Homo sapiens
tctgctctgtggcttcagctaa

SEQ ID NO: 93332 - DNA, 21 bp, Homo sapiens
ggtgacacgtggccccgctct

SEQ ID NO: 93333 - DNA, 22 bp, Homo sapiens
tgagccatgggactccaaggga

SEQ ID NO: 93334 - DNA, 22 bp, Homo sapiens
ctgctgagccgcacccaggagc

SEQ ID NO: 93335 - DNA, 22 bp, Homo sapiens
accgggaagtcctgcactgggc

SEQ ID NO: 93336 - DNA, 16 bp, Homo sapiens
aggctcagaggctgga

SEQ ID NO: 93337 - DNA, 22 bp, Homo sapiens
actgcactccagcccgggtgac

SEQ ID NO: 93338 - DNA, 22 bp, Homo sapiens
gcttccacctactaaatgccac

SEQ ID NO: 93339 - DNA, 20 bp, Homo sapiens
tcagccattccttacctttc

SEQ ID NO: 93340 - DNA, 22 bp, Homo sapiens
cccattcatcctcgcttccttc

SEQ ID NO: 93341 - DNA, 22 bp, Homo sapiens
gcatacatgggtgcagggacat

SEQ ID NO: 93342 - DNA, 22 bp, Homo sapiens
taagtcgtggatgattcttcgg

SEQ ID NO: 93343 - DNA, 22 bp, Homo sapiens
atggctgcctgggcgctggccg

SEQ ID NO: 93344 - DNA, 22 bp, Homo sapiens
agcccaggagtttgaggctgtg

SEQ ID NO: 93345 - DNA, 22 bp, Homo sapiens
cccaggaggcagagcttgcagt

SEQ ID NO: 93346 - DNA, 22 bp, Homo sapiens
aggggatggagctggaaggcag

SEQ ID NO: 93347 - DNA, 22 bp, Homo sapiens
gctgcagtgagccaagatcgtg

SEQ ID NO: 93348 - DNA, 22 bp, Homo sapiens
gggttcagtccctcttgctact

SEQ ID NO: 93349 - DNA, 22 bp, Homo sapiens
tagcaaaggatgactatgtacc

SEQ ID NO: 93350 - DNA, 22 bp, Homo sapiens
tacttttctataggtttgaaat

SEQ ID NO: 93351 - DNA, 22 bp, Homo sapiens
aggcaaggtgctacagacagtg

SEQ ID NO: 93352 - DNA, 22 bp, Homo sapiens
actgatcaagggtttaatttta

SEQ ID NO: 93353 - DNA, 22 bp, Homo sapiens
tgctgaataagacgtggcttgt

SEQ ID NO: 93354 - DNA, 22 bp, Homo sapiens
agatcacagtggcaactccctt

SEQ ID NO: 93355 - DNA, 22 bp, Homo sapiens
aagacttgaccaggttgaaggc

SEQ ID NO: 93356 - DNA, 22 bp, Homo sapiens
acaggggcaagggctcacggcc

SEQ ID NO: 93357 - DNA, 22 bp, Homo sapiens
agattcaggcatgtcttcattt

SEQ ID NO: 93358 - DNA, 22 bp, Homo sapiens
actttcttggtcccatgtttga

SEQ ID NO: 93359 - DNA, 18 bp, Homo sapiens
acttcccagatgagggga

SEQ ID NO: 93360 - DNA, 22 bp, Homo sapiens
cccagcaggaggaggttgcagt

SEQ ID NO: 93361 - DNA, 22 bp, Homo sapiens
gggaaatctcgtcctctattta

SEQ ID NO: 93362 - DNA, 19 bp, Homo sapiens
tctcacagctctactatgt

SEQ ID NO: 93363 - DNA, 22 bp, Homo sapiens
catgtaaagaatttcacacaag

SEQ ID NO: 93364 - DNA, 22 bp, Homo sapiens
tcctgggccctccggatcaggt

SEQ ID NO: 93365 - DNA, 22 bp, Homo sapiens
gcgagggcacgcggttgaaggc

SEQ ID NO: 93366 - DNA, 22 bp, Homo sapiens
gccatcctgatgacaggccact

SEQ ID NO: 93367 - DNA, 22 bp, Homo sapiens
caaatgaatatttccatgggtt

SEQ ID NO: 93368 - DNA, 22 bp, Homo sapiens
cacccaggttggagtgcagtgg

SEQ ID NO: 93369 - DNA, 22 bp, Homo sapiens
gtctgctcatgctaccgcgggc

SEQ ID NO: 93370 - DNA, 21 bp, Homo sapiens
gctgctcgagatccagtgctt

SEQ ID NO: 93371 - DNA, 22 bp, Homo sapiens
tgagatggagccactgcactct

SEQ ID NO: 93372 - DNA, 21 bp, Homo sapiens
agatcctggggtctggggagg

SEQ ID NO: 93373 - DNA, 21 bp, Homo sapiens
atctcgggcttctcgcccagc

SEQ ID NO: 93374 - DNA, 22 bp, Homo sapiens
tgcctcaagccctccactgcac

SEQ ID NO: 93375 - DNA, 22 bp, Homo sapiens
tccaaagtgttgggattatagg

SEQ ID NO: 93376 - DNA, 22 bp, Homo sapiens
ggggatggaggcgtgtggtcct

SEQ ID NO: 93377 - DNA, 22 bp, Homo sapiens
actgcacttcagcctgggtgac

SEQ ID NO: 93378 - DNA, 22 bp, Homo sapiens
agcccaggttgaggctgcagtg

SEQ ID NO: 93379 - DNA, 20 bp, Homo sapiens
gggcagagccagccagtccc

SEQ ID NO: 93380 - DNA, 22 bp, Homo sapiens
aggtttctttatgctgctagaa

SEQ ID NO: 93381 - DNA, 22 bp, Homo sapiens
aggaggcagtctgtcccttagc

SEQ ID NO: 93382 - DNA, 22 bp, Homo sapiens
ccaagcagagcagcctctctgg

SEQ ID NO: 93383 - DNA, 22 bp, Homo sapiens
gagagtgagatcctcctgggga

SEQ ID NO: 93384 - DNA, 22 bp, Homo sapiens
cttcactttaagccaatcatga

SEQ ID NO: 93385 - DNA, 22 bp, Homo sapiens
aagtcacactagacaactgagg

SEQ ID NO: 93386 - DNA, 22 bp, Homo sapiens
agcttttagctcctggttgcaa

SEQ ID NO: 93387 - DNA, 22 bp, Homo sapiens
agggactatttacccatctcac

SEQ ID NO: 93388 - DNA, 22 bp, Homo sapiens
cgcccaggctggagtgcagtga

SEQ ID NO: 93389 - DNA, 22 bp, Homo sapiens
gagatgggcgagaaggtggact

SEQ ID NO: 93390 - DNA, 22 bp, Homo sapiens
ccctgctgtcaggtgctgggag

SEQ ID NO: 93391 - DNA, 22 bp, Homo sapiens
tgttgattagtgtttagactta

SEQ ID NO: 93392 - DNA, 22 bp, Homo sapiens
ggcttggaccagtcacagtggt

SEQ ID NO: 93393 - DNA, 18 bp, Homo sapiens
agagtgttctcagtgaaa

SEQ ID NO: 93394 - DNA, 22 bp, Homo sapiens
gcttagtcaattataaataggc

SEQ ID NO: 93395 - DNA, 20 bp, Homo sapiens
gtgtggccaggagctgcgct

SEQ ID NO: 93396 - DNA, 17 bp, Homo sapiens
tctgagaatgctggagg

SEQ ID NO: 93397 - DNA, 22 bp, Homo sapiens
cttaatctcacctgcaaagtcc

SEQ ID NO: 93398 - DNA, 22 bp, Homo sapiens
caggctggagtgcagtggggcg

SEQ ID NO: 93399 - DNA, 22 bp, Homo sapiens
ttacaaagtttaaggtggcact

SEQ ID NO: 93400 - DNA, 22 bp, Homo sapiens
gccttgccgctcagcagtgggg

SEQ ID NO: 93401 - DNA, 22 bp, Homo sapiens
gggctgtaggagctggaatggg

SEQ ID NO: 93402 - DNA, 22 bp, Homo sapiens
agctttggttgccatgatctga

SEQ ID NO: 93403 - DNA, 22 bp, Homo sapiens
accctactaaatgtggtatgtc

SEQ ID NO: 93404 - DNA, 22 bp, Homo sapiens
cctggcaggtggcgccctcggc

SEQ ID NO: 93405 - DNA, 22 bp, Homo sapiens
attttctctttgtatatgctag

SEQ ID NO: 93406 - DNA, 22 bp, Homo sapiens
taggccacagagaggagatttc

SEQ ID NO: 93407 - DNA, 22 bp, Homo sapiens
aaagagccgctgatgtcagccc

SEQ ID NO: 93408 - DNA, 15 bp, Homo sapiens
gcctctgagagccac

SEQ ID NO: 93409 - DNA, 22 bp, Homo sapiens
cagtagatttggtaaactagga

SEQ ID NO: 93410 - DNA, 22 bp, Homo sapiens
ctatggtctggaccgaggtcct

SEQ ID NO: 93411 - DNA, 22 bp, Homo sapiens
tctaattttggcattttaacct

SEQ ID NO: 93412 - DNA, 22 bp, Homo sapiens
acactggttggttgaatttact

SEQ ID NO: 93413 - DNA, 22 bp, Homo sapiens
ttgcttcagagggagacacttt

SEQ ID NO: 93414 - DNA, 22 bp, Homo sapiens
ctgagctcacgccattctcctt

SEQ ID NO: 93415 - DNA, 22 bp, Homo sapiens
ctgaagcagggagtgatgaagt

SEQ ID NO: 93416 - DNA, 23 bp, Homo sapiens
ccaagactgttaggagtggggag

SEQ ID NO: 93417 - DNA, 22 bp, Homo sapiens
cgcaccactgaattccagcctg

SEQ ID NO: 93418 - DNA, 21 bp, Homo sapiens
gccagcggccgccctccagga

SEQ ID NO: 93419 - DNA, 22 bp, Homo sapiens
cgctgataaacgtcacgttccc

SEQ ID NO: 93420 - DNA, 18 bp, Homo sapiens
tcactgtgtgtcttgggt

SEQ ID NO: 93421 - DNA, 22 bp, Homo sapiens
tggtctgctgaacagccgtatc

SEQ ID NO: 93422 - DNA, 22 bp, Homo sapiens
tgtcatagtgtggtagcagtgg

SEQ ID NO: 93423 - DNA, 22 bp, Homo sapiens
tggaacaagggcgtggcggtcg

SEQ ID NO: 93424 - DNA, 22 bp, Homo sapiens
ttgggctgaaccctgcagctga

SEQ ID NO: 93425 - DNA, 22 bp, Homo sapiens
acccatccagtgtccctgctag

SEQ ID NO: 93426 - DNA, 22 bp, Homo sapiens
attgggatgccggctgataaga

SEQ ID NO: 93427 - DNA, 22 bp, Homo sapiens
gccctgggcaaggttctggcca

SEQ ID NO: 93428 - DNA, 22 bp, Homo sapiens
aagaagcaggtcacagacaggg

SEQ ID NO: 93429 - DNA, 22 bp, Homo sapiens
ttgtaagtcacaccagggcagg

SEQ ID NO: 93430 - DNA, 22 bp, Homo sapiens
tgtgactggttgtcccgctttc

SEQ ID NO: 93431 - DNA, 22 bp, Homo sapiens
taggtttaggagtgaaggtgaa

SEQ ID NO: 93432 - DNA, 22 bp, Homo sapiens
cacctgccaaatggggatgctg

SEQ ID NO: 93433 - DNA, 22 bp, Homo sapiens
tctgtgttgagaaggatcatga

SEQ ID NO: 93434 - DNA, 22 bp, Homo sapiens
cagaagatctcttagtggaggg

SEQ ID NO: 93435 - DNA, 22 bp, Homo sapiens
gcccaggctggagtgcagtggt

SEQ ID NO: 93436 - DNA, 22 bp, Homo sapiens
agctggaagtgcatttctcact

SEQ ID NO: 93437 - DNA, 22 bp, Homo sapiens
aaatgcctcattttctctcact

SEQ ID NO: 93438 - DNA, 22 bp, Homo sapiens
tttatagcagcatgatttatag

SEQ ID NO: 93439 - DNA, 21 bp, Homo sapiens
gggcctggctgcgcaggacgg

SEQ ID NO: 93440 - DNA, 22 bp, Homo sapiens
tgggccgtggagcactctgaga

SEQ ID NO: 93441 - DNA, 22 bp, Homo sapiens
tcagggctgcagaagaggcagg

SEQ ID NO: 93442 - DNA, 22 bp, Homo sapiens
gtgcaaacatcatagagtgtac

SEQ ID NO: 93443 - DNA, 23 bp, Homo sapiens
ggaagctcacgtagtcctgcact

SEQ ID NO: 93444 - DNA, 22 bp, Homo sapiens
ctggcaggttatagagctgccc

SEQ ID NO: 93445 - DNA, 22 bp, Homo sapiens
gtggcccatcacgtttcgcctt

SEQ ID NO: 93446 - DNA, 22 bp, Homo sapiens
aggaatgacatagaaaggggag

SEQ ID NO: 93447 - DNA, 22 bp, Homo sapiens
tgacagtgaataagtctcttaa

SEQ ID NO: 93448 - DNA, 22 bp, Homo sapiens
caccaagaatcttcacttttta

SEQ ID NO: 93449 - DNA, 22 bp, Homo sapiens
acacttctttgtcacctgcttc

SEQ ID NO: 93450 - DNA, 22 bp, Homo sapiens
tcacttagatggggatcatcac

SEQ ID NO: 93451 - DNA, 22 bp, Homo sapiens
agggaagcagcagccgcctgtc

SEQ ID NO: 93452 - DNA, 22 bp, Homo sapiens
cattctgaccctatgatttaag

SEQ ID NO: 93453 - DNA, 22 bp, Homo sapiens
acgggctgggacggggaagctc

SEQ ID NO: 93454 - DNA, 22 bp, Homo sapiens
ttcaggaagtgctgcctggtgt

SEQ ID NO: 93455 - DNA, 22 bp, Homo sapiens
aatcacacaaaggcaacttttg

SEQ ID NO: 93456 - DNA, 22 bp, Homo sapiens
ccagccgcggtgagggtggctg

SEQ ID NO: 93457 - DNA, 20 bp, Homo sapiens
aggaaaaatggaaactggag

SEQ ID NO: 93458 - DNA, 22 bp, Homo sapiens
gtgggggagatgcttaggtccg

SEQ ID NO: 93459 - DNA, 22 bp, Homo sapiens
taatgcacatagaagtacttag

SEQ ID NO: 93460 - DNA, 22 bp, Homo sapiens
gctggggaggcagcagagaaca

SEQ ID NO: 93461 - DNA, 23 bp, Homo sapiens
aaataggagtatctggatcatga

SEQ ID NO: 93462 - DNA, 22 bp, Homo sapiens
gagcaggaaggccagaagggtc

SEQ ID NO: 93463 - DNA, 22 bp, Homo sapiens
actcatgtaagcggaatgtagt

SEQ ID NO: 93464 - DNA, 22 bp, Homo sapiens
agtgctgtctccttcccccggg

SEQ ID NO: 93465 - DNA, 22 bp, Homo sapiens
tcccaagtagatgggaatacag

SEQ ID NO: 93466 - DNA, 22 bp, Homo sapiens
tctcgctctgtcgcccaggctg

SEQ ID NO: 93467 - DNA, 22 bp, Homo sapiens
caaagtgctaggattataggtg

SEQ ID NO: 93468 - DNA, 22 bp, Homo sapiens
tagggtacatgtgcacaacatg

SEQ ID NO: 93469 - DNA, 22 bp, Homo sapiens
cagcccgccctgaactttcggg

SEQ ID NO: 93470 - DNA, 22 bp, Homo sapiens
tccagtttccaatcactgcacg

SEQ ID NO: 93471 - DNA, 22 bp, Homo sapiens
actgccaatggtagtttgatgg

SEQ ID NO: 93472 - DNA, 22 bp, Homo sapiens
gagagagctctgtgcctgggat

SEQ ID NO: 93473 - DNA, 22 bp, Homo sapiens
ggatgttgattgaatggccatt

SEQ ID NO: 93474 - DNA, 22 bp, Homo sapiens
tcaccgaggctggagtgcagtg

SEQ ID NO: 93475 - DNA, 22 bp, Homo sapiens
ttgttcttgtctttgccttcac

SEQ ID NO: 93476 - DNA, 22 bp, Homo sapiens
acgtgcaggatctggttggcga

SEQ ID NO: 93477 - DNA, 22 bp, Homo sapiens
tttgtcttatccaatctctcag

SEQ ID NO: 93478 - DNA, 22 bp, Homo sapiens
agggtcctgggtgcagttgctt

SEQ ID NO: 93479 - DNA, 19 bp, Homo sapiens
ggctgccttctgctcatct

SEQ ID NO: 93480 - DNA, 22 bp, Homo sapiens
gggcagcagccactcatttagc

SEQ ID NO: 93481 - DNA, 22 bp, Homo sapiens
ccagactgcttgcttcccagcc

SEQ ID NO: 93482 - DNA, 22 bp, Homo sapiens
cccagagcatgtgctgcctttg

SEQ ID NO: 93483 - DNA, 22 bp, Homo sapiens
tgccgtggggctgaggctggag

SEQ ID NO: 93484 - DNA, 22 bp, Homo sapiens
gagaatgatgatttccaatttc

SEQ ID NO: 93485 - DNA, 22 bp, Homo sapiens
cccaggaggtggaggctgcagt

SEQ ID NO: 93486 - DNA, 22 bp, Homo sapiens
cggctcactgcagctccgcctc

SEQ ID NO: 93487 - DNA, 18 bp, Homo sapiens
tgtccctgcaaataacat

SEQ ID NO: 93488 - DNA, 22 bp, Homo sapiens
accattgcactctagcctgggc

SEQ ID NO: 93489 - DNA, 22 bp, Homo sapiens
ctccaggctcgtccaagatcga

SEQ ID NO: 93490 - DNA, 22 bp, Homo sapiens
gggaagagggagctggaatgat

SEQ ID NO: 93491 - DNA, 22 bp, Homo sapiens
aactcactttgtggcttctgaa

SEQ ID NO: 93492 - DNA, 22 bp, Homo sapiens
ctcactgcaagctccacctctt

SEQ ID NO: 93493 - DNA, 22 bp, Homo sapiens
ttgtgaatggtgccgcaataaa

SEQ ID NO: 93494 - DNA, 22 bp, Homo sapiens
agcctgggccctgcctcttctc

SEQ ID NO: 93495 - DNA, 22 bp, Homo sapiens
tagggggctttgctgcttgaca

SEQ ID NO: 93496 - DNA, 20 bp, Homo sapiens
tttcttgtcggctgttgctg

SEQ ID NO: 93497 - DNA, 22 bp, Homo sapiens
gggaggcacgaggcgcgcagtg

SEQ ID NO: 93498 - DNA, 18 bp, Homo sapiens
tggttccttgaaggggca

SEQ ID NO: 93499 - DNA, 22 bp, Homo sapiens
cagtgccagctgcttggcctac

SEQ ID NO: 93500 - DNA, 22 bp, Homo sapiens
ttatgggagcaattggggaggt

SEQ ID NO: 93501 - DNA, 22 bp, Homo sapiens
cctgggctctgtcagaattggg

SEQ ID NO: 93502 - DNA, 22 bp, Homo sapiens
cctgggaggctgaggctgcagt

SEQ ID NO: 93503 - DNA, 22 bp, Homo sapiens
attgataaattgcaatggggct

SEQ ID NO: 93504 - DNA, 22 bp, Homo sapiens
tggacaggcaagcaagacatac

SEQ ID NO: 93505 - DNA, 18 bp, Homo sapiens
gctttctatgcgacagta

SEQ ID NO: 93506 - DNA, 22 bp, Homo sapiens
gaggcaggaggattgcttgagc

SEQ ID NO: 93507 - DNA, 22 bp, Homo sapiens
tgtgctcagtctttggctggga

SEQ ID NO: 93508 - DNA, 22 bp, Homo sapiens
gggtccctggaattacttgaca

SEQ ID NO: 93509 - DNA, 22 bp, Homo sapiens
tctagttctagatccctgagga

SEQ ID NO: 93510 - DNA, 22 bp, Homo sapiens
atcctagaatcagcccttgctg

SEQ ID NO: 93511 - DNA, 22 bp, Homo sapiens
tctcatttacttccacaggctg

SEQ ID NO: 93512 - DNA, 22 bp, Homo sapiens
tgatcagcatcttcccagctcg

SEQ ID NO: 93513 - DNA, 22 bp, Homo sapiens
cgggcaaggcgagactaggccc

SEQ ID NO: 93514 - DNA, 22 bp, Homo sapiens
cccaggaggcagagatagcagt

SEQ ID NO: 93515 - DNA, 22 bp, Homo sapiens
attctcaaaacataacttcact

SEQ ID NO: 93516 - DNA, 21 bp, Homo sapiens
ccgtgctcggctatggaccac

SEQ ID NO: 93517 - DNA, 22 bp, Homo sapiens
aattcacatccgaccaggtcaa

SEQ ID NO: 93518 - DNA, 22 bp, Homo sapiens
actgggctcaagtgattgtcct

SEQ ID NO: 93519 - DNA, 22 bp, Homo sapiens
aaaagcaattgcgggttttgcc

SEQ ID NO: 93520 - DNA, 22 bp, Homo sapiens
tgaccaggctggagtgcagtgg

SEQ ID NO: 93521 - DNA, 22 bp, Homo sapiens
gaaaattattgaaaatggctct

SEQ ID NO: 93522 - DNA, 22 bp, Homo sapiens
ctgctaaacctctctgagagct

SEQ ID NO: 93523 - DNA, 22 bp, Homo sapiens
ttatttgtggcatatgagacga

SEQ ID NO: 93524 - DNA, 21 bp, Homo sapiens
acctgagctccacctcctgcc

SEQ ID NO: 93525 - DNA, 22 bp, Homo sapiens
accaggcccgctgctatggtgg

SEQ ID NO: 93526 - DNA, 22 bp, Homo sapiens
attcatcagctaatggacattt

SEQ ID NO: 93527 - DNA, 22 bp, Homo sapiens
ccaggctgctgttggtgtccgc

SEQ ID NO: 93528 - DNA, 22 bp, Homo sapiens
ggagtgctttgaagccttcatt

SEQ ID NO: 93529 - DNA, 22 bp, Homo sapiens
accctggaggtggaggtgcagt

SEQ ID NO: 93530 - DNA, 22 bp, Homo sapiens
ttgtgttaaggtgcatctagtg

SEQ ID NO: 93531 - DNA, 22 bp, Homo sapiens
gttgaaatcctaaccccctagt

SEQ ID NO: 93532 - DNA, 22 bp, Homo sapiens
cctgcttaacattgccatgaca

SEQ ID NO: 93533 - DNA, 22 bp, Homo sapiens
acccatacacacatatttatgt

SEQ ID NO: 93534 - DNA, 22 bp, Homo sapiens
cacagcctcctctggctcacgg

SEQ ID NO: 93535 - DNA, 22 bp, Homo sapiens
tgcctctgaggaagattgtgtt

SEQ ID NO: 93536 - DNA, 22 bp, Homo sapiens
ccaggagttggaggttgcagtg

SEQ ID NO: 93537 - DNA, 22 bp, Homo sapiens
ctcccagccttcgccagtctga

SEQ ID NO: 93538 - DNA, 22 bp, Homo sapiens
aaggccctgtctccaaatacag

SEQ ID NO: 93539 - DNA, 22 bp, Homo sapiens
gaaagacatagttgcaagatgg

SEQ ID NO: 93540 - DNA, 22 bp, Homo sapiens
atccatttgacataatttcagc

SEQ ID NO: 93541 - DNA, 22 bp, Homo sapiens
gtggctcacgcctgtaatccca

SEQ ID NO: 93542 - DNA, 22 bp, Homo sapiens
cagggatggcgctggctgcccg

SEQ ID NO: 93543 - DNA, 22 bp, Homo sapiens
tccccaagcaggcaatctcccg

SEQ ID NO: 93544 - DNA, 22 bp, Homo sapiens
gagccaggaggcagagactgca

SEQ ID NO: 93545 - DNA, 22 bp, Homo sapiens
ccagctttatagcttcaaagga

SEQ ID NO: 93546 - DNA, 22 bp, Homo sapiens
ggcgtgggcgaggtgctctatc

SEQ ID NO: 93547 - DNA, 22 bp, Homo sapiens
gcaggcagatcacctgtcagga

SEQ ID NO: 93548 - DNA, 22 bp, Homo sapiens
aaggccctggcaggaagcagga

SEQ ID NO: 93549 - DNA, 22 bp, Homo sapiens
tcgctgaggctgcacggctgcc

SEQ ID NO: 93550 - DNA, 22 bp, Homo sapiens
acccagccatgttcagttctct

SEQ ID NO: 93551 - DNA, 22 bp, Homo sapiens
gctggtgagcaaaggagaagga

SEQ ID NO: 93552 - DNA, 22 bp, Homo sapiens
gatagtcacctcccttaacttt

SEQ ID NO: 93553 - DNA, 22 bp, Homo sapiens
tgtagatatagaaaaagactga

SEQ ID NO: 93554 - DNA, 22 bp, Homo sapiens
taaatcttctacatcatcataa

SEQ ID NO: 93555 - DNA, 22 bp, Homo sapiens
aagcatttcaggtagagatatt

SEQ ID NO: 93556 - DNA, 22 bp, Homo sapiens
gctgtatgtttatttgggaatt

SEQ ID NO: 93557 - DNA, 22 bp, Homo sapiens
ctgctccccagcctgcgccttt

SEQ ID NO: 93558 - DNA, 22 bp, Homo sapiens
gatgtagacacttggaggctta

SEQ ID NO: 93559 - DNA, 22 bp, Homo sapiens
tcctggcttgtcacatctacgt

SEQ ID NO: 93560 - DNA, 22 bp, Homo sapiens
aaagtgctgaaattacaggggt

SEQ ID NO: 93561 - DNA, 22 bp, Homo sapiens
gggttgaggcggatgtcggcgg

SEQ ID NO: 93562 - DNA, 21 bp, Homo sapiens
acatggactgtgaatggggac

SEQ ID NO: 93563 - DNA, 22 bp, Homo sapiens
aagaggtaaccatagcaaccac

SEQ ID NO: 93564 - DNA, 21 bp, Homo sapiens
aggcatgagccctgcatggac

SEQ ID NO: 93565 - DNA, 22 bp, Homo sapiens
ttggaggcaatgggaaggaggc

SEQ ID NO: 93566 - DNA, 22 bp, Homo sapiens
tgatgcaattagattgtaattt

SEQ ID NO: 93567 - DNA, 22 bp, Homo sapiens
aaggcaggatgggaaaagattt

SEQ ID NO: 93568 - DNA, 22 bp, Homo sapiens
tggtacacatgtccaaggtcag

SEQ ID NO: 93569 - DNA, 22 bp, Homo sapiens
gctgtctgtcttcacatctcgc

SEQ ID NO: 93570 - DNA, 22 bp, Homo sapiens
tgccaggcgtggtggtgcgcac

SEQ ID NO: 93571 - DNA, 22 bp, Homo sapiens
atctggttcttcttaggcatca

SEQ ID NO: 93572 - DNA, 19 bp, Homo sapiens
gtgtccatggagcatggag

SEQ ID NO: 93573 - DNA, 22 bp, Homo sapiens
ggtgtagctctgtgtcccactg

SEQ ID NO: 93574 - DNA, 22 bp, Homo sapiens
agtgagtttagggtgcaggtgt

SEQ ID NO: 93575 - DNA, 22 bp, Homo sapiens
aacactgctgctgggttctgtg

SEQ ID NO: 93576 - DNA, 22 bp, Homo sapiens
ctgggtggcagagcctgcagtg

SEQ ID NO: 93577 - DNA, 22 bp, Homo sapiens
agagctaagaaacagaattgct

SEQ ID NO: 93578 - DNA, 22 bp, Homo sapiens
tacagctgctggtgctccatgc

SEQ ID NO: 93579 - DNA, 22 bp, Homo sapiens
agcccttagtacatttctcaag

SEQ ID NO: 93580 - DNA, 22 bp, Homo sapiens
gcggcaggagtaaaggaggaag

SEQ ID NO: 93581 - DNA, 22 bp, Homo sapiens
ccaggaggtggaggttgcggtg

SEQ ID NO: 93582 - DNA, 22 bp, Homo sapiens
tagtatagattgaagcagatca

SEQ ID NO: 93583 - DNA, 22 bp, Homo sapiens
cttccgtgtcagttccaggtgg

SEQ ID NO: 93584 - DNA, 22 bp, Homo sapiens
cttcctttgctgttcggaggtt

SEQ ID NO: 93585 - DNA, 20 bp, Homo sapiens
gtctccactgggggttaacc

SEQ ID NO: 93586 - DNA, 22 bp, Homo sapiens
gcctcctggggtgccatcatct

SEQ ID NO: 93587 - DNA, 21 bp, Homo sapiens
gcccacagtgaggaggatccc

SEQ ID NO: 93588 - DNA, 22 bp, Homo sapiens
gccgggtgcagcgggcccgcca

SEQ ID NO: 93589 - DNA, 22 bp, Homo sapiens
ggtgggaggactgtttgaggca

SEQ ID NO: 93590 - DNA, 22 bp, Homo sapiens
tgagccaggagtttgaggctgt

SEQ ID NO: 93591 - DNA, 19 bp, Homo sapiens
ttcacattggaagaagtag

SEQ ID NO: 93592 - DNA, 22 bp, Homo sapiens
agagggatcaccctgtttctgg

SEQ ID NO: 93593 - DNA, 22 bp, Homo sapiens
gttattgaggtggagtctcact

SEQ ID NO: 93594 - DNA, 22 bp, Homo sapiens
ccacactccccgcaggcgtagg

SEQ ID NO: 93595 - DNA, 22 bp, Homo sapiens
tcatctgaagattgctgttcaa

SEQ ID NO: 93596 - DNA, 22 bp, Homo sapiens
tgcatctgcctggagtagcgcc

SEQ ID NO: 93597 - DNA, 22 bp, Homo sapiens
caggaattcatagcattgttct

SEQ ID NO: 93598 - DNA, 22 bp, Homo sapiens
ggagtgactcacagctgggaca

SEQ ID NO: 93599 - DNA, 22 bp, Homo sapiens
aagtgtgtgagcctgtcaggct

SEQ ID NO: 93600 - DNA, 22 bp, Homo sapiens
ggctagcaaggtagcagaatgc

SEQ ID NO: 93601 - DNA, 22 bp, Homo sapiens
tcacatctaattccatttctgc

SEQ ID NO: 93602 - DNA, 20 bp, Homo sapiens
ttggatgtgcatggccgtgc

SEQ ID NO: 93603 - DNA, 22 bp, Homo sapiens
ccacccttgggttcggaggccg

SEQ ID NO: 93604 - DNA, 22 bp, Homo sapiens
tactgcactccagcctgggtga

SEQ ID NO: 93605 - DNA, 21 bp, Homo sapiens
cgcagagcgaacttgcggcgc

SEQ ID NO: 93606 - DNA, 22 bp, Homo sapiens
ctcctggaggatagtgactggg

SEQ ID NO: 93607 - DNA, 22 bp, Homo sapiens
gtagttctgcagtgtcacctga

SEQ ID NO: 93608 - DNA, 22 bp, Homo sapiens
tgtcttggttcttctgaaacac

SEQ ID NO: 93609 - DNA, 22 bp, Homo sapiens
ggctgggctccgggagcatgcg

SEQ ID NO: 93610 - DNA, 22 bp, Homo sapiens
agggctgcccagtgtgagagct

SEQ ID NO: 93611 - DNA, 22 bp, Homo sapiens
tagctgggactactggccctgc

SEQ ID NO: 93612 - DNA, 22 bp, Homo sapiens
gaggctggacgtgcatttctac

SEQ ID NO: 93613 - DNA, 16 bp, Homo sapiens
ccacctgcagctctca

SEQ ID NO: 93614 - DNA, 19 bp, Homo sapiens
tggctctgtcgaaggcaca

SEQ ID NO: 93615 - DNA, 22 bp, Homo sapiens
ggggtgggcgtgcagggacacc

SEQ ID NO: 93616 - DNA, 22 bp, Homo sapiens
ggacctgaacataaaacgaggc

SEQ ID NO: 93617 - DNA, 22 bp, Homo sapiens
aaattcttttgtgcggtgaagt

SEQ ID NO: 93618 - DNA, 22 bp, Homo sapiens
caggaagaccagggctgtggct

SEQ ID NO: 93619 - DNA, 22 bp, Homo sapiens
attgtactacaccatagtactg

SEQ ID NO: 93620 - DNA, 22 bp, Homo sapiens
atggccgcctgtccttcccgcc

SEQ ID NO: 93621 - DNA, 22 bp, Homo sapiens
gaatttcctctaaacccctgag

SEQ ID NO: 93622 - DNA, 22 bp, Homo sapiens
aacagtgctgttataaatgtac

SEQ ID NO: 93623 - DNA, 22 bp, Homo sapiens
acaggcacctgccaccacatct

SEQ ID NO: 93624 - DNA, 21 bp, Homo sapiens
aggcaccacatctccctcccc

SEQ ID NO: 93625 - DNA, 22 bp, Homo sapiens
cggtcaggtgcagcgttggcac

SEQ ID NO: 93626 - DNA, 22 bp, Homo sapiens
tggggacttgccttgttgctca

SEQ ID NO: 93627 - DNA, 22 bp, Homo sapiens
cttgagtcatataaagacagag

SEQ ID NO: 93628 - DNA, 22 bp, Homo sapiens
cagctgttcattgttgccaccc

SEQ ID NO: 93629 - DNA, 22 bp, Homo sapiens
agtttccatcccacacttgctt

SEQ ID NO: 93630 - DNA, 22 bp, Homo sapiens
ggagggcagagtcccctgctga

SEQ ID NO: 93631 - DNA, 22 bp, Homo sapiens
agtgaagctggagaaaggcagt

SEQ ID NO: 93632 - DNA, 22 bp, Homo sapiens
attcacatttagcctctgacat

SEQ ID NO: 93633 - DNA, 22 bp, Homo sapiens
cccacgtcgaacttgctccaga

SEQ ID NO: 93634 - DNA, 22 bp, Homo sapiens
cccgtgtggatgcgctggtgct

SEQ ID NO: 93635 - DNA, 22 bp, Homo sapiens
ttagtattaggatcatatttga

SEQ ID NO: 93636 - DNA, 22 bp, Homo sapiens
ttggatgggcattaggaaagtc

SEQ ID NO: 93637 - DNA, 22 bp, Homo sapiens
gaacactgctgttgggttctga

SEQ ID NO: 93638 - DNA, 22 bp, Homo sapiens
gtgggacaaggatgaagatatt

SEQ ID NO: 93639 - DNA, 22 bp, Homo sapiens
gaccttgtgatctgcccacctt

SEQ ID NO: 93640 - DNA, 22 bp, Homo sapiens
ttatttttaaaagttcacacag

SEQ ID NO: 93641 - DNA, 22 bp, Homo sapiens
aggtcacgtcctgtgatgtcat

SEQ ID NO: 93642 - DNA, 22 bp, Homo sapiens
cagcctggtccccggctcaccc

SEQ ID NO: 93643 - DNA, 22 bp, Homo sapiens
gctgaaggcccggaggacaggg

SEQ ID NO: 93644 - DNA, 22 bp, Homo sapiens
taattataacagttacatctta

SEQ ID NO: 93645 - DNA, 21 bp, Homo sapiens
tcctgtaagcttgggtggctc

SEQ ID NO: 93646 - DNA, 22 bp, Homo sapiens
ttacatgtttatgtggtacatg

SEQ ID NO: 93647 - DNA, 22 bp, Homo sapiens
cagggtgacaagtggcaaggag

SEQ ID NO: 93648 - DNA, 22 bp, Homo sapiens
gattgagtctgaggatgctgca

SEQ ID NO: 93649 - DNA, 22 bp, Homo sapiens
atccccctgtatctggaagaat

SEQ ID NO: 93650 - DNA, 22 bp, Homo sapiens
agtgcagtggttaggagccagg

SEQ ID NO: 93651 - DNA, 22 bp, Homo sapiens
aattacagtcggagcagcactg

SEQ ID NO: 93652 - DNA, 22 bp, Homo sapiens
gaccttgtgatccagccacctt

SEQ ID NO: 93653 - DNA, 22 bp, Homo sapiens
ctgaggcaggatggcctggctg

SEQ ID NO: 93654 - DNA, 22 bp, Homo sapiens
taggtagctttggcgtttcttg

SEQ ID NO: 93655 - DNA, 22 bp, Homo sapiens
ggtgggagagctctgtctccag

SEQ ID NO: 93656 - DNA, 22 bp, Homo sapiens
ggaatgaatttccagctgggtc

SEQ ID NO: 93657 - DNA, 22 bp, Homo sapiens
agtgaatgtccccgcgggtcag

SEQ ID NO: 93658 - DNA, 22 bp, Homo sapiens
gggtggagagaaagaaacgtga

SEQ ID NO: 93659 - DNA, 23 bp, Homo sapiens
tcaactgctctgggaaggtcccc

SEQ ID NO: 93660 - DNA, 22 bp, Homo sapiens
aagcctgaacattactagttgt

SEQ ID NO: 93661 - DNA, 22 bp, Homo sapiens
aacggctgtggctggcggcagc

SEQ ID NO: 93662 - DNA, 22 bp, Homo sapiens
gccctgttgtcggacgtcaagg

SEQ ID NO: 93663 - DNA, 22 bp, Homo sapiens
ctgcatccatgttgctgcaaag

SEQ ID NO: 93664 - DNA, 22 bp, Homo sapiens
tctcagggctcagagctcaggc

SEQ ID NO: 93665 - DNA, 22 bp, Homo sapiens
gttcaagaccagcctggccaac

SEQ ID NO: 93666 - DNA, 22 bp, Homo sapiens
atcattatcctcctatttgcct

SEQ ID NO: 93667 - DNA, 22 bp, Homo sapiens
ctgattaaaaacaggttctgag

SEQ ID NO: 93668 - DNA, 22 bp, Homo sapiens
acagacaagtagttcagacaag

SEQ ID NO: 93669 - DNA, 22 bp, Homo sapiens
gcaaatgctaaagtgtagagac

SEQ ID NO: 93670 - DNA, 22 bp, Homo sapiens
cttatagtatgatgttgagaat

SEQ ID NO: 93671 - DNA, 22 bp, Homo sapiens
tgctcgccccacatgccctcat

SEQ ID NO: 93672 - DNA, 22 bp, Homo sapiens
tgcgatggcgtagacaaatccc

SEQ ID NO: 93673 - DNA, 22 bp, Homo sapiens
tcacagagttaaaagtttcttt

SEQ ID NO: 93674 - DNA, 22 bp, Homo sapiens
ggagtgcagtggtgggatctca

SEQ ID NO: 93675 - DNA, 22 bp, Homo sapiens
ttggaagacaatgctgattctc

SEQ ID NO: 93676 - DNA, 22 bp, Homo sapiens
tctcgatctcctgaccttgtga

SEQ ID NO: 93677 - DNA, 22 bp, Homo sapiens
gactacaggtgtgtgccaccat

SEQ ID NO: 93678 - DNA, 22 bp, Homo sapiens
tagactggtgaattagggggaa

SEQ ID NO: 93679 - DNA, 22 bp, Homo sapiens
agagtactgctgctgggtactg

SEQ ID NO: 93680 - DNA, 22 bp, Homo sapiens
tgggaaagctgcagaaattctc

SEQ ID NO: 93681 - DNA, 22 bp, Homo sapiens
atatgcagtctcttgcccttct

SEQ ID NO: 93682 - DNA, 22 bp, Homo sapiens
tcttttgtgattcttcagttac

SEQ ID NO: 93683 - DNA, 19 bp, Homo sapiens
gcctatgtcttcaaatcat

SEQ ID NO: 93684 - DNA, 22 bp, Homo sapiens
cagcaggaggtgagtagcaggt

SEQ ID NO: 93685 - DNA, 22 bp, Homo sapiens
cactcagctgagccctcagccc

SEQ ID NO: 93686 - DNA, 22 bp, Homo sapiens
gggcgccgtgggaaacagccgg

SEQ ID NO: 93687 - DNA, 22 bp, Homo sapiens
acccagggctcaagcgtaggca

SEQ ID NO: 93688 - DNA, 22 bp, Homo sapiens
tcagcaatcctcccacaggtgg

SEQ ID NO: 93689 - DNA, 22 bp, Homo sapiens
ctgccgttgtgaagctcttaga

SEQ ID NO: 93690 - DNA, 22 bp, Homo sapiens
ccacagaattctgtctccagga

SEQ ID NO: 93691 - DNA, 22 bp, Homo sapiens
gcacacggcagcctcctcctga

SEQ ID NO: 93692 - DNA, 22 bp, Homo sapiens
gcccagagtttgaagatacagt

SEQ ID NO: 93693 - DNA, 22 bp, Homo sapiens
tcactttaagcgggaggcagag

SEQ ID NO: 93694 - DNA, 22 bp, Homo sapiens
cagcttggaggaggatctaaga

SEQ ID NO: 93695 - DNA, 22 bp, Homo sapiens
aaatgcacaaagattttgcact

SEQ ID NO: 93696 - DNA, 22 bp, Homo sapiens
tgtcttcaggagtaaatatcat

SEQ ID NO: 93697 - DNA, 22 bp, Homo sapiens
aattgcactttagcaatggtga

SEQ ID NO: 93698 - DNA, 18 bp, Homo sapiens
gaaagatgaacttttttc

SEQ ID NO: 93699 - DNA, 22 bp, Homo sapiens
gagcagtaggagaaccctgagc

SEQ ID NO: 93700 - DNA, 21 bp, Homo sapiens
ccaccaggtcttctgctcggg

SEQ ID NO: 93701 - DNA, 22 bp, Homo sapiens
atttttctctttccactgagat

SEQ ID NO: 93702 - DNA, 22 bp, Homo sapiens
ttgtgaaacattcatggatttg

SEQ ID NO: 93703 - DNA, 22 bp, Homo sapiens
aaaatcttgtgacttaggaagg

SEQ ID NO: 93704 - DNA, 22 bp, Homo sapiens
atctccgccatcgcgaacgcct

SEQ ID NO: 93705 - DNA, 22 bp, Homo sapiens
gaccttgtgctccgaggcgggc

SEQ ID NO: 93706 - DNA, 22 bp, Homo sapiens
accctcaacaaattcactctat

SEQ ID NO: 93707 - DNA, 22 bp, Homo sapiens
ctgatcctcctttaagtagctg

SEQ ID NO: 93708 - DNA, 22 bp, Homo sapiens
aatatgcactctgatttagcag

SEQ ID NO: 93709 - DNA, 23 bp, Homo sapiens
ggggcctgcaccggtctgcgcgg

SEQ ID NO: 93710 - DNA, 22 bp, Homo sapiens
ccaggttggagttcagtggcgc

SEQ ID NO: 93711 - DNA, 22 bp, Homo sapiens
atgccacttcattccagcctcg

SEQ ID NO: 93712 - DNA, 22 bp, Homo sapiens
tactttaatatatgtgaagttc

SEQ ID NO: 93713 - DNA, 22 bp, Homo sapiens
tagaactacaagcattaaaagt

SEQ ID NO: 93714 - DNA, 22 bp, Homo sapiens
tggaatgcagtgggagcttacc

SEQ ID NO: 93715 - DNA, 22 bp, Homo sapiens
gcttggccagcagccgggatgc

SEQ ID NO: 93716 - DNA, 20 bp, Homo sapiens
tatttctgggcaaccattta

SEQ ID NO: 93717 - DNA, 22 bp, Homo sapiens
aaagtgctcggattacaggtat

SEQ ID NO: 93718 - DNA, 22 bp, Homo sapiens
ccaggaggcagaagttgcagtg

SEQ ID NO: 93719 - DNA, 22 bp, Homo sapiens
agaccactaaaactttctctat

SEQ ID NO: 93720 - DNA, 22 bp, Homo sapiens
ggctgtggagctgcagagttgg

SEQ ID NO: 93721 - DNA, 22 bp, Homo sapiens
acagcacttgggttttcctgtt

SEQ ID NO: 93722 - DNA, 22 bp, Homo sapiens
attgaaaataaggccagaaaca

SEQ ID NO: 93723 - DNA, 22 bp, Homo sapiens
tgggccacacacagaagaatca

SEQ ID NO: 93724 - DNA, 22 bp, Homo sapiens
ctgggaggtggaggttgcattg

SEQ ID NO: 93725 - DNA, 22 bp, Homo sapiens
gcccagcacctctctcagggtt

SEQ ID NO: 93726 - DNA, 22 bp, Homo sapiens
cagagactggagtgcagtggcg

SEQ ID NO: 93727 - DNA, 22 bp, Homo sapiens
actgcactccagcctcggggtc

SEQ ID NO: 93728 - DNA, 22 bp, Homo sapiens
tccagggccatctccatgaggc

SEQ ID NO: 93729 - DNA, 22 bp, Homo sapiens
gtgcagagaggaccttggggag

SEQ ID NO: 93730 - DNA, 22 bp, Homo sapiens
tgagccgtggtctctgagggtg

SEQ ID NO: 93731 - DNA, 22 bp, Homo sapiens
attctggacaaggcaagctcct

SEQ ID NO: 93732 - DNA, 18 bp, Homo sapiens
gagtcgtcggagagtctg

SEQ ID NO: 93733 - DNA, 22 bp, Homo sapiens
ggtcccaggttgacagggagac

SEQ ID NO: 93734 - DNA, 21 bp, Homo sapiens
ggcctcccggaccgcagcgcc

SEQ ID NO: 93735 - DNA, 22 bp, Homo sapiens
caatccatcaattacacaggct

SEQ ID NO: 93736 - DNA, 22 bp, Homo sapiens
gtcactgtatccaggttccagc

SEQ ID NO: 93737 - DNA, 22 bp, Homo sapiens
agagcacagggttttgtgccgg

SEQ ID NO: 93738 - DNA, 22 bp, Homo sapiens
tgcctccctggcaagtctctcc

SEQ ID NO: 93739 - DNA, 22 bp, Homo sapiens
caggccggggcggcgccatctt

SEQ ID NO: 93740 - DNA, 22 bp, Homo sapiens
tttctcggcagagatgatgggc

SEQ ID NO: 93741 - DNA, 22 bp, Homo sapiens
cagtgggtcctgcgtctgccag

SEQ ID NO: 93742 - DNA, 22 bp, Homo sapiens
cttagagatgggttttacttag

SEQ ID NO: 93743 - DNA, 20 bp, Homo sapiens
ctgggtggcaagcaaggggg

SEQ ID NO: 93744 - DNA, 22 bp, Homo sapiens
tgtcaatatgtaataactgaat

SEQ ID NO: 93745 - DNA, 22 bp, Homo sapiens
gcgttggggaccccgaagctgg

SEQ ID NO: 93746 - DNA, 22 bp, Homo sapiens
ctgggaggcagaggttgtagtg

SEQ ID NO: 93747 - DNA, 22 bp, Homo sapiens
cctggccgacatggtgaaacgc

SEQ ID NO: 93748 - DNA, 22 bp, Homo sapiens
agctggagatgagtgacgtgcc

SEQ ID NO: 93749 - DNA, 22 bp, Homo sapiens
atattacacacggtatcacggg

SEQ ID NO: 93750 - DNA, 22 bp, Homo sapiens
agcctggcggtcgtcggtcagg

SEQ ID NO: 93751 - DNA, 22 bp, Homo sapiens
gtgagcagagatcgcgtgattg

SEQ ID NO: 93752 - DNA, 22 bp, Homo sapiens
ggcatagatttctttaggttta

SEQ ID NO: 93753 - DNA, 22 bp, Homo sapiens
atgtgctgagtgtgtatataca

SEQ ID NO: 93754 - DNA, 22 bp, Homo sapiens
tgcaccctcatcagtcaaatgg

SEQ ID NO: 93755 - DNA, 22 bp, Homo sapiens
tgaaatgtgtaatgtggatgcc

SEQ ID NO: 93756 - DNA, 22 bp, Homo sapiens
tggagagttctgtagatatcta

SEQ ID NO: 93757 - DNA, 22 bp, Homo sapiens
aactaatacattaatacatgtg

SEQ ID NO: 93758 - DNA, 22 bp, Homo sapiens
gctgcgccggatcccacgttcc

SEQ ID NO: 93759 - DNA, 22 bp, Homo sapiens
aggctctgtcaggcggagcagc

SEQ ID NO: 93760 - DNA, 22 bp, Homo sapiens
ttgggttagaacggtaacatac

SEQ ID NO: 93761 - DNA, 22 bp, Homo sapiens
gtatgtgctgagctttccccgc

SEQ ID NO: 93762 - DNA, 22 bp, Homo sapiens
ggcagcttgtcctggaggatgg

SEQ ID NO: 93763 - DNA, 22 bp, Homo sapiens
aaaagagcttggttgattttgc

SEQ ID NO: 93764 - DNA, 22 bp, Homo sapiens
aagaggttgtctgtgatgagtt

SEQ ID NO: 93765 - DNA, 22 bp, Homo sapiens
gcaggtggatcaccacgtcagg

SEQ ID NO: 93766 - DNA, 22 bp, Homo sapiens
gtggtgagagtaggtgtcctct

SEQ ID NO: 93767 - DNA, 22 bp, Homo sapiens
tacagctgcaagggtttctggg

SEQ ID NO: 93768 - DNA, 22 bp, Homo sapiens
aatggcactttataaatgttaa

SEQ ID NO: 93769 - DNA, 22 bp, Homo sapiens
tgattatgcatgagacagtact

SEQ ID NO: 93770 - DNA, 22 bp, Homo sapiens
aaagtgctgggattacaagtgt

SEQ ID NO: 93771 - DNA, 22 bp, Homo sapiens
tggccagctttgactgtaaacc

SEQ ID NO: 93772 - DNA, 22 bp, Homo sapiens
ctttaattgtagctcccataat

SEQ ID NO: 93773 - DNA, 22 bp, Homo sapiens
ttctatttttgtggaactgtag

SEQ ID NO: 93774 - DNA, 22 bp, Homo sapiens
tgcgcatgcgtggctctccggc

SEQ ID NO: 93775 - DNA, 22 bp, Homo sapiens
agacgctattttgaggggtcta

SEQ ID NO: 93776 - DNA, 22 bp, Homo sapiens
gccggggctggggagagacatg

SEQ ID NO: 93777 - DNA, 20 bp, Homo sapiens
tcaggtgacacacgtggcac

SEQ ID NO: 93778 - DNA, 22 bp, Homo sapiens
cccttggggtggaggttgcagt

SEQ ID NO: 93779 - DNA, 22 bp, Homo sapiens
gctcactgcaacctctgcctcc

SEQ ID NO: 93780 - DNA, 22 bp, Homo sapiens
gtgacacccgcatgccactgtg

SEQ ID NO: 93781 - DNA, 22 bp, Homo sapiens
acgcagtttgtggacatttttt

SEQ ID NO: 93782 - DNA, 22 bp, Homo sapiens
tagctcaaaggttaagtgtgga

SEQ ID NO: 93783 - DNA, 22 bp, Homo sapiens
atcacagggtgaggattagacc

SEQ ID NO: 93784 - DNA, 23 bp, Homo sapiens
agctataaaatctgtgacagcag

SEQ ID NO: 93785 - DNA, 22 bp, Homo sapiens
ctgatctcaagtgatccaccca

SEQ ID NO: 93786 - DNA, 22 bp, Homo sapiens
tataaactcctcttgcattcct

SEQ ID NO: 93787 - DNA, 22 bp, Homo sapiens
ctggtctggctacccagcgaat

SEQ ID NO: 93788 - DNA, 22 bp, Homo sapiens
attgcactccagcctgggggac

SEQ ID NO: 93789 - DNA, 22 bp, Homo sapiens
atgaattgaggaaaacagtcgt

SEQ ID NO: 93790 - DNA, 22 bp, Homo sapiens
cagtcctgaatactggacggtg

SEQ ID NO: 93791 - DNA, 22 bp, Homo sapiens
tcactgcaacctccacctcctg

SEQ ID NO: 93792 - DNA, 22 bp, Homo sapiens
gggctagcctcttccctgctcc

SEQ ID NO: 93793 - DNA, 21 bp, Homo sapiens
ctctgaatcctgcttctcagt

SEQ ID NO: 93794 - DNA, 22 bp, Homo sapiens
atggggggatgaaggagtccaa

SEQ ID NO: 93795 - DNA, 22 bp, Homo sapiens
tgtaagtagtaatggaaggaca

SEQ ID NO: 93796 - DNA, 22 bp, Homo sapiens
ctagttctagatccctgaggaa

SEQ ID NO: 93797 - DNA, 22 bp, Homo sapiens
caggaagctgtgaaggagacgg

SEQ ID NO: 93798 - DNA, 22 bp, Homo sapiens
aattatggtcactgttcctggg

SEQ ID NO: 93799 - DNA, 22 bp, Homo sapiens
ctgaggagaggtggcctgtgtt

SEQ ID NO: 93800 - DNA, 22 bp, Homo sapiens
gagcctcagggttttgttgaca

SEQ ID NO: 93801 - DNA, 22 bp, Homo sapiens
agtggctgagtgactgtgactc

SEQ ID NO: 93802 - DNA, 22 bp, Homo sapiens
cccacaggtgtgagcttgctgg

SEQ ID NO: 93803 - DNA, 22 bp, Homo sapiens
tacatttataaggcttctctgt

SEQ ID NO: 93804 - DNA, 22 bp, Homo sapiens
tcccttgggagtggtgaccaca

SEQ ID NO: 93805 - DNA, 22 bp, Homo sapiens
caagggaattgtgtgtgagagg

SEQ ID NO: 93806 - DNA, 22 bp, Homo sapiens
agcccttggtattttccgatcc

SEQ ID NO: 93807 - DNA, 22 bp, Homo sapiens
ccaggagctggagggtgcagtg

SEQ ID NO: 93808 - DNA, 22 bp, Homo sapiens
tggccaccaccaatacttgcct

SEQ ID NO: 93809 - DNA, 22 bp, Homo sapiens
catggcagctcctccagtgtga

SEQ ID NO: 93810 - DNA, 22 bp, Homo sapiens
gaagttctttatagcagtgtga

SEQ ID NO: 93811 - DNA, 22 bp, Homo sapiens
gccagccagaaacgtcacactg

SEQ ID NO: 93812 - DNA, 22 bp, Homo sapiens
cactgcactccagcctcggtga

SEQ ID NO: 93813 - DNA, 22 bp, Homo sapiens
ggaccggtggcttcctcgggtc

SEQ ID NO: 93814 - DNA, 22 bp, Homo sapiens
agatttctgggcttcaccacct

SEQ ID NO: 93815 - DNA, 22 bp, Homo sapiens
aactagaaaaagactttctgag

SEQ ID NO: 93816 - DNA, 21 bp, Homo sapiens
gctcctggtgctgcgtggcgc

SEQ ID NO: 93817 - DNA, 22 bp, Homo sapiens
tcaggaggtccgcccgggaggg

SEQ ID NO: 93818 - DNA, 22 bp, Homo sapiens
gggaagatagtgttgagggccc

SEQ ID NO: 93819 - DNA, 22 bp, Homo sapiens
tgtgtcagaaggcaatggggat

SEQ ID NO: 93820 - DNA, 22 bp, Homo sapiens
ttgtccttcttcattcagtccc

SEQ ID NO: 93821 - DNA, 21 bp, Homo sapiens
tcttttctcagctttgtggtt

SEQ ID NO: 93822 - DNA, 22 bp, Homo sapiens
ccagagctgattcctgggactt

SEQ ID NO: 93823 - DNA, 22 bp, Homo sapiens
aggggcgtgctcttccccgacg

SEQ ID NO: 93824 - DNA, 22 bp, Homo sapiens
aaatcgcttgaacccaggaagt

SEQ ID NO: 93825 - DNA, 22 bp, Homo sapiens
ccctcgtgcatccatcatttag

SEQ ID NO: 93826 - DNA, 22 bp, Homo sapiens
ccctctgcatacaggcgaggag

SEQ ID NO: 93827 - DNA, 22 bp, Homo sapiens
ccaagcaaataatcacccacta

SEQ ID NO: 93828 - DNA, 22 bp, Homo sapiens
ttaggatttgaaaaggggcaga

SEQ ID NO: 93829 - DNA, 22 bp, Homo sapiens
cctagagccgcacctcctccac

SEQ ID NO: 93830 - DNA, 22 bp, Homo sapiens
ttctgcagtgttaacaatgtca

SEQ ID NO: 93831 - DNA, 22 bp, Homo sapiens
caccaggaggacaggcccctac

SEQ ID NO: 93832 - DNA, 22 bp, Homo sapiens
aaagatcacgtcccaggactcg

SEQ ID NO: 93833 - DNA, 22 bp, Homo sapiens
agaagcattggaccaggggccc

SEQ ID NO: 93834 - DNA, 22 bp, Homo sapiens
tgagcttccctcctgcactaca

SEQ ID NO: 93835 - DNA, 22 bp, Homo sapiens
ttgggctcaggagtttgagacc

SEQ ID NO: 93836 - DNA, 22 bp, Homo sapiens
aggtggaaatggctttcctagg

SEQ ID NO: 93837 - DNA, 22 bp, Homo sapiens
gaatgcttggaacctgaagttc

SEQ ID NO: 93838 - DNA, 22 bp, Homo sapiens
gcagagatctgagaaggctgcc

SEQ ID NO: 93839 - DNA, 19 bp, Homo sapiens
gctgaaggaggtgcctgca

SEQ ID NO: 93840 - DNA, 22 bp, Homo sapiens
aaacccagggttttgtcttccc

SEQ ID NO: 93841 - DNA, 22 bp, Homo sapiens
gagcccaggaagtggaggctga

SEQ ID NO: 93842 - DNA, 22 bp, Homo sapiens
aagaggtagcagtcacaaaaga

SEQ ID NO: 93843 - DNA, 22 bp, Homo sapiens
ttgggacagctgtggtagtgag

SEQ ID NO: 93844 - DNA, 18 bp, Homo sapiens
tttctcagactctctttc

SEQ ID NO: 93845 - DNA, 22 bp, Homo sapiens
ctcggcaggtggaggttgtagt

SEQ ID NO: 93846 - DNA, 20 bp, Homo sapiens
gggtgtgtgcagggcctggt

SEQ ID NO: 93847 - DNA, 22 bp, Homo sapiens
gccctgtgcaggtgtgcagcag

SEQ ID NO: 93848 - DNA, 22 bp, Homo sapiens
ctggctggagtgcaggtgagtg

SEQ ID NO: 93849 - DNA, 22 bp, Homo sapiens
ggaaggggtgggtgagcctcag

SEQ ID NO: 93850 - DNA, 22 bp, Homo sapiens
gcaccgccttggaccgcccgct

SEQ ID NO: 93851 - DNA, 21 bp, Homo sapiens
tctgagactgggttagaatgt

SEQ ID NO: 93852 - DNA, 22 bp, Homo sapiens
aatgtgaggccttggtagttat

SEQ ID NO: 93853 - DNA, 22 bp, Homo sapiens
gggagcaagccggaggtactgt

SEQ ID NO: 93854 - DNA, 22 bp, Homo sapiens
agagattcctttggggaaagca

SEQ ID NO: 93855 - DNA, 22 bp, Homo sapiens
agccaggatggtctcgatcggc

SEQ ID NO: 93856 - DNA, 22 bp, Homo sapiens
tagagcaatgctctactccttg

SEQ ID NO: 93857 - DNA, 22 bp, Homo sapiens
gggcggatcatttgaggtcagg

SEQ ID NO: 93858 - DNA, 19 bp, Homo sapiens
gggcaaagtgatcgtcctg

SEQ ID NO: 93859 - DNA, 22 bp, Homo sapiens
tgaggcaggagttcaggctgcg

SEQ ID NO: 93860 - DNA, 22 bp, Homo sapiens
cctggagagctcgggccaggca

SEQ ID NO: 93861 - DNA, 22 bp, Homo sapiens
ctgggggcagcaagaagccatg

SEQ ID NO: 93862 - DNA, 22 bp, Homo sapiens
ggccctggcagccacgaaagcc

SEQ ID NO: 93863 - DNA, 22 bp, Homo sapiens
cacctcaggcagcaaagtctca

SEQ ID NO: 93864 - DNA, 22 bp, Homo sapiens
ggttccacctggcgaggggtat

SEQ ID NO: 93865 - DNA, 22 bp, Homo sapiens
gggcagatcacctgaggtcagg

SEQ ID NO: 93866 - DNA, 22 bp, Homo sapiens
tttaatcaggcaaagcataata

SEQ ID NO: 93867 - DNA, 22 bp, Homo sapiens
gcaggtccagtcaccagagaga

SEQ ID NO: 93868 - DNA, 22 bp, Homo sapiens
ctctggcaattgctgctgactc

SEQ ID NO: 93869 - DNA, 22 bp, Homo sapiens
gcagtggcatgatgtgggctca

SEQ ID NO: 93870 - DNA, 22 bp, Homo sapiens
gaaccacaatgtgaagaaggag

SEQ ID NO: 93871 - DNA, 22 bp, Homo sapiens
cgtgaggggggtaaggcgtccg

SEQ ID NO: 93872 - DNA, 22 bp, Homo sapiens
ggatgttctggggttctcttgt

SEQ ID NO: 93873 - DNA, 22 bp, Homo sapiens
ctgaaggatgtgtggtgggagt

SEQ ID NO: 93874 - DNA, 22 bp, Homo sapiens
cccaggatggggctgcagttat

SEQ ID NO: 93875 - DNA, 22 bp, Homo sapiens
tgtgtggattcatctcaaagag

SEQ ID NO: 93876 - DNA, 22 bp, Homo sapiens
tggcccttgttcaaatatgtca

SEQ ID NO: 93877 - DNA, 22 bp, Homo sapiens
tgtgggagaaggaagcaagctg

SEQ ID NO: 93878 - DNA, 22 bp, Homo sapiens
ctgtggctctttagttgagcac

SEQ ID NO: 93879 - DNA, 22 bp, Homo sapiens
gtatccatgggggattggttcc

SEQ ID NO: 93880 - DNA, 22 bp, Homo sapiens
tttctcttcactgtgtgcctca

SEQ ID NO: 93881 - DNA, 22 bp, Homo sapiens
tccctgaggatggttgtattta

SEQ ID NO: 93882 - DNA, 22 bp, Homo sapiens
ggtcgctgtgtaggttcagcta

SEQ ID NO: 93883 - DNA, 22 bp, Homo sapiens
gcagaagcacaggtgacgggcc

SEQ ID NO: 93884 - DNA, 22 bp, Homo sapiens
ttgtgaatagtgccgctataaa

SEQ ID NO: 93885 - DNA, 18 bp, Homo sapiens
ggaaaaggagtgtctagc

SEQ ID NO: 93886 - DNA, 22 bp, Homo sapiens
cagaggaacgtttggattgatt

SEQ ID NO: 93887 - DNA, 22 bp, Homo sapiens
gacttctgaattcctatcaggt

SEQ ID NO: 93888 - DNA, 22 bp, Homo sapiens
ccaggtgtgctctgcagtggat

SEQ ID NO: 93889 - DNA, 20 bp, Homo sapiens
agcagagtgcccatcccgga

SEQ ID NO: 93890 - DNA, 22 bp, Homo sapiens
gtgctgacaggagcctggcggt

SEQ ID NO: 93891 - DNA, 22 bp, Homo sapiens
tggggcatgtgaacctggatgt

SEQ ID NO: 93892 - DNA, 22 bp, Homo sapiens
tgaggaaacttacaaggcagaa

SEQ ID NO: 93893 - DNA, 22 bp, Homo sapiens
tcctcagtcacggtagcacatt

SEQ ID NO: 93894 - DNA, 22 bp, Homo sapiens
cagcagagaaattacatatttg

SEQ ID NO: 93895 - DNA, 22 bp, Homo sapiens
cactgcaagctctgccacctgg

SEQ ID NO: 93896 - DNA, 22 bp, Homo sapiens
ccctgctgtgtagcggaggaac

SEQ ID NO: 93897 - DNA, 22 bp, Homo sapiens
aacctcaaactcttgggcttaa

SEQ ID NO: 93898 - DNA, 22 bp, Homo sapiens
agctttacctgccttggggcac

SEQ ID NO: 93899 - DNA, 22 bp, Homo sapiens
ttcattcttttacatgtgaata

SEQ ID NO: 93900 - DNA, 22 bp, Homo sapiens
agaaactctggaagaactttta

SEQ ID NO: 93901 - DNA, 22 bp, Homo sapiens
tggcctcggcatccagcaagag

SEQ ID NO: 93902 - DNA, 22 bp, Homo sapiens
ctgtatctgtgttggatgagtt

SEQ ID NO: 93903 - DNA, 18 bp, Homo sapiens
tccagttttcccagcatc

SEQ ID NO: 93904 - DNA, 22 bp, Homo sapiens
cttgacactgtcactcaggcca

SEQ ID NO: 93905 - DNA, 22 bp, Homo sapiens
atggagttctgccagcgctgct

SEQ ID NO: 93906 - DNA, 22 bp, Homo sapiens
gttgaggtgatgccagccctgc

SEQ ID NO: 93907 - DNA, 22 bp, Homo sapiens
ggcgccgcactcggtgcagccg

SEQ ID NO: 93908 - DNA, 22 bp, Homo sapiens
ctgcagtctacctggattttta

SEQ ID NO: 93909 - DNA, 22 bp, Homo sapiens
tacaacaatttccacattagaa

SEQ ID NO: 93910 - DNA, 22 bp, Homo sapiens
aggagggagcttaagccaggca

SEQ ID NO: 93911 - DNA, 22 bp, Homo sapiens
gcagtggggcaatcatagctca

SEQ ID NO: 93912 - DNA, 22 bp, Homo sapiens
gggggaagaaagaacatggcat

SEQ ID NO: 93913 - DNA, 22 bp, Homo sapiens
tcacagagaaatgtggcacaaa

SEQ ID NO: 93914 - DNA, 22 bp, Homo sapiens
acagcagcaatagcagtgacat

SEQ ID NO: 93915 - DNA, 22 bp, Homo sapiens
gcgagtgccgagagggcagggc

SEQ ID NO: 93916 - DNA, 22 bp, Homo sapiens
tggaagggagctggaatttgga

SEQ ID NO: 93917 - DNA, 22 bp, Homo sapiens
cagcccaggactgcaggtgttt

SEQ ID NO: 93918 - DNA, 22 bp, Homo sapiens
actgatggcagggtaggggtca

SEQ ID NO: 93919 - DNA, 22 bp, Homo sapiens
gggcgcatcacctgaggtcagg

SEQ ID NO: 93920 - DNA, 22 bp, Homo sapiens
gccagggttgccaatgggggca

SEQ ID NO: 93921 - DNA, 22 bp, Homo sapiens
cggccaggcacagtggcccacg

SEQ ID NO: 93922 - DNA, 20 bp, Homo sapiens
agagatggggtatcaccgta

SEQ ID NO: 93923 - DNA, 22 bp, Homo sapiens
ccaccgccatggcgttgtacag

SEQ ID NO: 93924 - DNA, 22 bp, Homo sapiens
ttcctagggcagagccgctggg

SEQ ID NO: 93925 - DNA, 22 bp, Homo sapiens
gctgccgacccacaggggttaa

SEQ ID NO: 93926 - DNA, 22 bp, Homo sapiens
cagtggaggccttgggaccttt

SEQ ID NO: 93927 - DNA, 22 bp, Homo sapiens
tcagtgatttctggggtgaggg

SEQ ID NO: 93928 - DNA, 22 bp, Homo sapiens
cttctgagatgttgttttacag

SEQ ID NO: 93929 - DNA, 22 bp, Homo sapiens
ctcattgcagctgcattactgt

SEQ ID NO: 93930 - DNA, 19 bp, Homo sapiens
gcccagcgaaggggatgac

SEQ ID NO: 93931 - DNA, 22 bp, Homo sapiens
caaagggaaaagccatgtgggc

SEQ ID NO: 93932 - DNA, 22 bp, Homo sapiens
actaaagctcacagagttgaac

SEQ ID NO: 93933 - DNA, 23 bp, Homo sapiens
cagagctggcttcatgggtgtgc

SEQ ID NO: 93934 - DNA, 20 bp, Homo sapiens
tcccccactgtttctgctac

SEQ ID NO: 93935 - DNA, 22 bp, Homo sapiens
aggagctcagctaagttggaga

SEQ ID NO: 93936 - DNA, 17 bp, Homo sapiens
catccgtgagctcggca

SEQ ID NO: 93937 - DNA, 22 bp, Homo sapiens
actgccctccagcctgggtgac

SEQ ID NO: 93938 - DNA, 22 bp, Homo sapiens
ctgggcctggggctgttgagag

SEQ ID NO: 93939 - DNA, 22 bp, Homo sapiens
gttgagtgggttaggatgctga

SEQ ID NO: 93940 - DNA, 22 bp, Homo sapiens
atgtgtcaggtacactcattag

SEQ ID NO: 93941 - DNA, 22 bp, Homo sapiens
ctctgatgtcgagtaaggtgtg

SEQ ID NO: 93942 - DNA, 22 bp, Homo sapiens
tgccctggctcttcttgttcca

SEQ ID NO: 93943 - DNA, 22 bp, Homo sapiens
tgttcttgagcctttagaccta

SEQ ID NO: 93944 - DNA, 22 bp, Homo sapiens
aacttaggaaaataaggcatga

SEQ ID NO: 93945 - DNA, 22 bp, Homo sapiens
gggactggagtagaggccggtg

SEQ ID NO: 93946 - DNA, 18 bp, Homo sapiens
aggagcggctgcggctgc

SEQ ID NO: 93947 - DNA, 22 bp, Homo sapiens
tcagtgcagggtgggagagaga

SEQ ID NO: 93948 - DNA, 22 bp, Homo sapiens
aatggctctgatgttgttgtga

SEQ ID NO: 93949 - DNA, 22 bp, Homo sapiens
tgactacaacctccacctcccg

SEQ ID NO: 93950 - DNA, 22 bp, Homo sapiens
taggtttactgaattagtggaa

SEQ ID NO: 93951 - DNA, 18 bp, Homo sapiens
gatatggaaggccatgcc

SEQ ID NO: 93952 - DNA, 18 bp, Homo sapiens
cagggctgtggggtcact

SEQ ID NO: 93953 - DNA, 22 bp, Homo sapiens
aggcgcctgcgggatccttgcc

SEQ ID NO: 93954 - DNA, 22 bp, Homo sapiens
tagatttgtttccttctctcca

SEQ ID NO: 93955 - DNA, 22 bp, Homo sapiens
cccaggccctggcagagcttgt

SEQ ID NO: 93956 - DNA, 22 bp, Homo sapiens
tcctggcaaagatgttggtgtt

SEQ ID NO: 93957 - DNA, 22 bp, Homo sapiens
attaagactgcccatgttttta

SEQ ID NO: 93958 - DNA, 22 bp, Homo sapiens
tgctcattggcgatctgaggga

SEQ ID NO: 93959 - DNA, 22 bp, Homo sapiens
actgcactccagcctgggtgat

SEQ ID NO: 93960 - DNA, 22 bp, Homo sapiens
ggcaaaaagttcccatcagtgt

SEQ ID NO: 93961 - DNA, 22 bp, Homo sapiens
gtcagtgtcttaacagagatta

SEQ ID NO: 93962 - DNA, 22 bp, Homo sapiens
ttgagtgtactttagtcatctg

SEQ ID NO: 93963 - DNA, 22 bp, Homo sapiens
ttgtacttgccatagaacaaca

SEQ ID NO: 93964 - DNA, 22 bp, Homo sapiens
ctgtctgaatcctaagcttcct

SEQ ID NO: 93965 - DNA, 22 bp, Homo sapiens
agcctggtttaagcattttata

SEQ ID NO: 93966 - DNA, 22 bp, Homo sapiens
gaccatcctggccaacgtggta

SEQ ID NO: 93967 - DNA, 22 bp, Homo sapiens
gagagcaggaggcagcgggacg

SEQ ID NO: 93968 - DNA, 22 bp, Homo sapiens
ttttctcttccctctggacctg

SEQ ID NO: 93969 - DNA, 22 bp, Homo sapiens
ttttctagggtgctaaatgaac

SEQ ID NO: 93970 - DNA, 22 bp, Homo sapiens
aagaaatgtgaatattgaatag

SEQ ID NO: 93971 - DNA, 22 bp, Homo sapiens
tggagaagattggtcaccattc

SEQ ID NO: 93972 - DNA, 18 bp, Homo sapiens
ttcacaagggcttggttt

SEQ ID NO: 93973 - DNA, 22 bp, Homo sapiens
tggcaccagggaacaagcattt

SEQ ID NO: 93974 - DNA, 22 bp, Homo sapiens
aactcaggagtttaaggctgca

SEQ ID NO: 93975 - DNA, 21 bp, Homo sapiens
gttcaaatcctgacactacac

SEQ ID NO: 93976 - DNA, 22 bp, Homo sapiens
aatgtcctctttagagggttac

SEQ ID NO: 93977 - DNA, 22 bp, Homo sapiens
agtattacatggccaatctcct

SEQ ID NO: 93978 - DNA, 22 bp, Homo sapiens
ataaaagatcccttctgagctc

SEQ ID NO: 93979 - DNA, 22 bp, Homo sapiens
ttctttgcccatgtttcctaag

SEQ ID NO: 93980 - DNA, 22 bp, Homo sapiens
cccaggaggcagatgttgcagt

SEQ ID NO: 93981 - DNA, 22 bp, Homo sapiens
ctatgaccccagcatgaataag

SEQ ID NO: 93982 - DNA, 22 bp, Homo sapiens
tacagggattgttttaatcacc

SEQ ID NO: 93983 - DNA, 22 bp, Homo sapiens
gatgctgagagattggagacta

SEQ ID NO: 93984 - DNA, 22 bp, Homo sapiens
taggctgggaagaaagattctc

SEQ ID NO: 93985 - DNA, 22 bp, Homo sapiens
aaacactcatgtgttactctcc

SEQ ID NO: 93986 - DNA, 22 bp, Homo sapiens
ttggtttccttaacagcctaaa

SEQ ID NO: 93987 - DNA, 23 bp, Homo sapiens
aacgacagctacaggcatcccac

SEQ ID NO: 93988 - DNA, 22 bp, Homo sapiens
ctcactgcaagctcagcctccc

SEQ ID NO: 93989 - DNA, 22 bp, Homo sapiens
agcttgtgtttttctaagtatc

SEQ ID NO: 93990 - DNA, 22 bp, Homo sapiens
gcgggttgaagggcgcatcgaa

SEQ ID NO: 93991 - DNA, 22 bp, Homo sapiens
tcaggctcaggttaggggccaa

SEQ ID NO: 93992 - DNA, 17 bp, Homo sapiens
aggtgggtggatcacct

SEQ ID NO: 93993 - DNA, 22 bp, Homo sapiens
agtccgcctgctgccgtggcag

SEQ ID NO: 93994 - DNA, 22 bp, Homo sapiens
gcttctcaattctcaccctcca

SEQ ID NO: 93995 - DNA, 22 bp, Homo sapiens
caggctgtccaggctcctttgg

SEQ ID NO: 93996 - DNA, 22 bp, Homo sapiens
tggagggcatgctgtccatggg

SEQ ID NO: 93997 - DNA, 21 bp, Homo sapiens
cagtggcacgatttcggctca

SEQ ID NO: 93998 - DNA, 22 bp, Homo sapiens
aggaggaagggaagacaagtaa

SEQ ID NO: 93999 - DNA, 22 bp, Homo sapiens
tgcctactagtactattttgtg

SEQ ID NO: 94000 - DNA, 22 bp, Homo sapiens
cacagtcctgccagagggcctt

SEQ ID NO: 94001 - DNA, 22 bp, Homo sapiens
tgtctattaattccacataaaa

SEQ ID NO: 94002 - DNA, 22 bp, Homo sapiens
atcaagtgaagggctcttgaag

SEQ ID NO: 94003 - DNA, 22 bp, Homo sapiens
gggacgacaggctctgtggtag

SEQ ID NO: 94004 - DNA, 22 bp, Homo sapiens
atacaaagtattgatcctgagt

SEQ ID NO: 94005 - DNA, 22 bp, Homo sapiens
cactgcactccagcctgggtga

SEQ ID NO: 94006 - DNA, 22 bp, Homo sapiens
cttcttgttgttagggtcctgt

SEQ ID NO: 94007 - DNA, 22 bp, Homo sapiens
atgaaatatcttgaagaaattc

SEQ ID NO: 94008 - DNA, 22 bp, Homo sapiens
gcaggtggatcacctgaggtca

SEQ ID NO: 94009 - DNA, 22 bp, Homo sapiens
agctggtgctcggggagctggc

SEQ ID NO: 94010 - DNA, 17 bp, Homo sapiens
aatgtccttggaccaca

SEQ ID NO: 94011 - DNA, 22 bp, Homo sapiens
gtggttttattcgttcctctgt

SEQ ID NO: 94012 - DNA, 22 bp, Homo sapiens
aacccgagggccccaggctcgg

SEQ ID NO: 94013 - DNA, 22 bp, Homo sapiens
cacattggcaaacggggttgca

SEQ ID NO: 94014 - DNA, 22 bp, Homo sapiens
cagggtgctgcaccatccctca

SEQ ID NO: 94015 - DNA, 22 bp, Homo sapiens
gggaatgtagcaaatctgcaat

SEQ ID NO: 94016 - DNA, 22 bp, Homo sapiens
gtgctggggagataggaagaga

SEQ ID NO: 94017 - DNA, 22 bp, Homo sapiens
atgtctgtttgctgagcccggc

SEQ ID NO: 94018 - DNA, 22 bp, Homo sapiens
ttggaacatgccggggtccagg

SEQ ID NO: 94019 - DNA, 22 bp, Homo sapiens
actcatgtcctaggagtaaagc

SEQ ID NO: 94020 - DNA, 22 bp, Homo sapiens
tgaacgcaggtccacatggctc

SEQ ID NO: 94021 - DNA, 22 bp, Homo sapiens
tgtctggtgggttgacaggcag

SEQ ID NO: 94022 - DNA, 22 bp, Homo sapiens
atgattgaccatctgctgggct

SEQ ID NO: 94023 - DNA, 22 bp, Homo sapiens
cggtctcccgtgtgtgtgcgct

SEQ ID NO: 94024 - DNA, 22 bp, Homo sapiens
ggcatggtggtacacatctgta

SEQ ID NO: 94025 - DNA, 22 bp, Homo sapiens
agtatgtcagagtgaaaatggt

SEQ ID NO: 94026 - DNA, 22 bp, Homo sapiens
acactgcagatgaaagcataag

SEQ ID NO: 94027 - DNA, 22 bp, Homo sapiens
cagcagcccacgcgtgctgtcc

SEQ ID NO: 94028 - DNA, 22 bp, Homo sapiens
tttgtggcaggagcggagaccg

SEQ ID NO: 94029 - DNA, 22 bp, Homo sapiens
tgtagatattaattattccttt

SEQ ID NO: 94030 - DNA, 22 bp, Homo sapiens
gcctggccaacgtggtgaaacc

SEQ ID NO: 94031 - DNA, 22 bp, Homo sapiens
gatctggaatctgaaggctgag

SEQ ID NO: 94032 - DNA, 21 bp, Homo sapiens
ccgccacctctaagctgggtc

SEQ ID NO: 94033 - DNA, 22 bp, Homo sapiens
tatgttaacatgttaggaactg

SEQ ID NO: 94034 - DNA, 22 bp, Homo sapiens
tgatatgtaactactccttata

SEQ ID NO: 94035 - DNA, 20 bp, Homo sapiens
tgtttactctagagggtaga

SEQ ID NO: 94036 - DNA, 22 bp, Homo sapiens
ggcctgcctcacagtcagcacc

SEQ ID NO: 94037 - DNA, 22 bp, Homo sapiens
gaaatctttgccttagctgtgt

SEQ ID NO: 94038 - DNA, 22 bp, Homo sapiens
ctgtgaagggacggatgctgct

SEQ ID NO: 94039 - DNA, 22 bp, Homo sapiens
aatgagatggaattcccgccta

SEQ ID NO: 94040 - DNA, 22 bp, Homo sapiens
acagttaataagtagtaagtca

SEQ ID NO: 94041 - DNA, 22 bp, Homo sapiens
aagacactcattatcactggtt

SEQ ID NO: 94042 - DNA, 22 bp, Homo sapiens
gagcctgagcaatgtgatgttt

SEQ ID NO: 94043 - DNA, 22 bp, Homo sapiens
tcctgggaggcggaggttgcag

SEQ ID NO: 94044 - DNA, 22 bp, Homo sapiens
aagggggcggcagccagtggaa

SEQ ID NO: 94045 - DNA, 22 bp, Homo sapiens
tccaccatgtaacaagctctgt

SEQ ID NO: 94046 - DNA, 22 bp, Homo sapiens
accccaggaagtggaggtcatg

SEQ ID NO: 94047 - DNA, 22 bp, Homo sapiens
atcttctcatgtgtaatgaggt

SEQ ID NO: 94048 - DNA, 22 bp, Homo sapiens
tggcactgaagctggaaagcct

SEQ ID NO: 94049 - DNA, 22 bp, Homo sapiens
tttgtgaataggttggcttcca

SEQ ID NO: 94050 - DNA, 22 bp, Homo sapiens
cggccaagccggggccccgaag

SEQ ID NO: 94051 - DNA, 22 bp, Homo sapiens
aggcaggaaaatcgcttgaacc

SEQ ID NO: 94052 - DNA, 22 bp, Homo sapiens
gaggttggttccaaccctccca

SEQ ID NO: 94053 - DNA, 22 bp, Homo sapiens
cctgggccctcaccgccggtgg

SEQ ID NO: 94054 - DNA, 22 bp, Homo sapiens
gagggagggactagcattctct

SEQ ID NO: 94055 - DNA, 22 bp, Homo sapiens
cacagagctggaaaggctgggc

SEQ ID NO: 94056 - DNA, 23 bp, Homo sapiens
aggatgtaggatgtatggcagag

SEQ ID NO: 94057 - DNA, 22 bp, Homo sapiens
catgcctgcctggtgggcgtgg

SEQ ID NO: 94058 - DNA, 22 bp, Homo sapiens
gacctcatgatccacctgcctt

SEQ ID NO: 94059 - DNA, 22 bp, Homo sapiens
gcccagtagttcaaggttgcag

SEQ ID NO: 94060 - DNA, 19 bp, Homo sapiens
acccagcccaggagtggca

SEQ ID NO: 94061 - DNA, 22 bp, Homo sapiens
agggggctccttggtgtgcaga

SEQ ID NO: 94062 - DNA, 22 bp, Homo sapiens
agggagcattgtgacatatcac

SEQ ID NO: 94063 - DNA, 22 bp, Homo sapiens
gcctgacttgtgtattttacat

SEQ ID NO: 94064 - DNA, 22 bp, Homo sapiens
tggcccagtatgtataatctta

SEQ ID NO: 94065 - DNA, 19 bp, Homo sapiens
agggttacccgctgccacc

SEQ ID NO: 94066 - DNA, 22 bp, Homo sapiens
agggaaattaatgtgagcaatg

SEQ ID NO: 94067 - DNA, 22 bp, Homo sapiens
gagcacagtaaagcagtgtcac

SEQ ID NO: 94068 - DNA, 22 bp, Homo sapiens
gtagggctcagtaaatactttg

SEQ ID NO: 94069 - DNA, 22 bp, Homo sapiens
gcctgtcccgcaccggagcccg

SEQ ID NO: 94070 - DNA, 22 bp, Homo sapiens
agacggattacctgaggtcagg

SEQ ID NO: 94071 - DNA, 22 bp, Homo sapiens
ggaggggatttagtagatgcta

SEQ ID NO: 94072 - DNA, 22 bp, Homo sapiens
ccagagtcccttgcagctcagt

SEQ ID NO: 94073 - DNA, 22 bp, Homo sapiens
cccaccagacctgcaccggcac

SEQ ID NO: 94074 - DNA, 22 bp, Homo sapiens
gtagcccacctggggagggcga

SEQ ID NO: 94075 - DNA, 22 bp, Homo sapiens
aagcgccatggttcctgcgcag

SEQ ID NO: 94076 - DNA, 22 bp, Homo sapiens
gccctagcgccagctcagcacc

SEQ ID NO: 94077 - DNA, 22 bp, Homo sapiens
caccaggctggagtgcagtggc

SEQ ID NO: 94078 - DNA, 22 bp, Homo sapiens
ttgcttcttagatattcctctc

SEQ ID NO: 94079 - DNA, 22 bp, Homo sapiens
ctactggccatctgatctacaa

SEQ ID NO: 94080 - DNA, 22 bp, Homo sapiens
tgatttacagtagtgtctaaac

SEQ ID NO: 94081 - DNA, 20 bp, Homo sapiens
ttgagcttttagtacagaca

SEQ ID NO: 94082 - DNA, 21 bp, Homo sapiens
aaactgaccttgcctgagaca

SEQ ID NO: 94083 - DNA, 22 bp, Homo sapiens
ggtgccagatgaggcccgcgat

SEQ ID NO: 94084 - DNA, 22 bp, Homo sapiens
agtcaaagatgaccgagttcct

SEQ ID NO: 94085 - DNA, 22 bp, Homo sapiens
agcaagattgaggcttcctcag

SEQ ID NO: 94086 - DNA, 22 bp, Homo sapiens
ggcgtttcaccatgttgaccag

SEQ ID NO: 94087 - DNA, 21 bp, Homo sapiens
tgtaagtttcatctgaattgg

SEQ ID NO: 94088 - DNA, 22 bp, Homo sapiens
ctcactgcaagctccgcctccc

SEQ ID NO: 94089 - DNA, 22 bp, Homo sapiens
gcgtctcaaggcccccaggcca

SEQ ID NO: 94090 - DNA, 22 bp, Homo sapiens
aacccgggaggcggaggttgtg

SEQ ID NO: 94091 - DNA, 22 bp, Homo sapiens
ctgatccctccatagggcacag

SEQ ID NO: 94092 - DNA, 22 bp, Homo sapiens
ggcctcgcggcttctggtggct

SEQ ID NO: 94093 - DNA, 22 bp, Homo sapiens
agcgccactgcactccagcctg

SEQ ID NO: 94094 - DNA, 22 bp, Homo sapiens
tagaggccgaatgctgagctgg

SEQ ID NO: 94095 - DNA, 22 bp, Homo sapiens
actccacaccacgggggccgcc

SEQ ID NO: 94096 - DNA, 22 bp, Homo sapiens
cagtggcgtgatctctgctcac

SEQ ID NO: 94097 - DNA, 22 bp, Homo sapiens
tggttcgtctcttttacagttc

SEQ ID NO: 94098 - DNA, 22 bp, Homo sapiens
gatatcattgagcccaggagtt

SEQ ID NO: 94099 - DNA, 22 bp, Homo sapiens
gaggctgaggcaggaggatcac

SEQ ID NO: 94100 - DNA, 22 bp, Homo sapiens
tctgtgctaggcagcctggccc

SEQ ID NO: 94101 - DNA, 22 bp, Homo sapiens
ggggaaagccagccctgcttcc

SEQ ID NO: 94102 - DNA, 22 bp, Homo sapiens
aaccaccattctctcctcttcc

SEQ ID NO: 94103 - DNA, 22 bp, Homo sapiens
ggtggctgcaatggctaacttc

SEQ ID NO: 94104 - DNA, 22 bp, Homo sapiens
tctgttgactcctagcagccat

SEQ ID NO: 94105 - DNA, 22 bp, Homo sapiens
caaatactacgattcttgcagt

SEQ ID NO: 94106 - DNA, 22 bp, Homo sapiens
tgacatttcctagtgctttgtg

SEQ ID NO: 94107 - DNA, 22 bp, Homo sapiens
ttgatcaaatcagctactgagg

SEQ ID NO: 94108 - DNA, 22 bp, Homo sapiens
gtccacagctctgaggtctccc

SEQ ID NO: 94109 - DNA, 22 bp, Homo sapiens
aggacagagggaccagagccca

SEQ ID NO: 94110 - DNA, 22 bp, Homo sapiens
ggtttattgttaataagtttga

SEQ ID NO: 94111 - DNA, 22 bp, Homo sapiens
cttgatctacatagtgaaaccc

SEQ ID NO: 94112 - DNA, 22 bp, Homo sapiens
aggatttctgtgcctggaaaat

SEQ ID NO: 94113 - DNA, 22 bp, Homo sapiens
gtgttgatgacattttagaaac

SEQ ID NO: 94114 - DNA, 22 bp, Homo sapiens
gatggaggagatggcagggtgc

SEQ ID NO: 94115 - DNA, 22 bp, Homo sapiens
gtacactccccctgtgaagttg

SEQ ID NO: 94116 - DNA, 22 bp, Homo sapiens
ccatgtacatgaacacggcggc

SEQ ID NO: 94117 - DNA, 21 bp, Homo sapiens
gaacccagcagcagtgctctg

SEQ ID NO: 94118 - DNA, 22 bp, Homo sapiens
cgggaaggtggaggttgcagtg

SEQ ID NO: 94119 - DNA, 22 bp, Homo sapiens
tgaggctccttgtagagagtgg

SEQ ID NO: 94120 - DNA, 22 bp, Homo sapiens
cccaggggttctgagcagcagc

SEQ ID NO: 94121 - DNA, 22 bp, Homo sapiens
ggtcgagtcacttgttgccttt

SEQ ID NO: 94122 - DNA, 22 bp, Homo sapiens
cagcacatgctcatcagggaag

SEQ ID NO: 94123 - DNA, 22 bp, Homo sapiens
ggccctgggccctctagcttgt

SEQ ID NO: 94124 - DNA, 20 bp, Homo sapiens
acgtggccaccagtggctta

SEQ ID NO: 94125 - DNA, 22 bp, Homo sapiens
atggccctaatgagttggtgtt

SEQ ID NO: 94126 - DNA, 22 bp, Homo sapiens
gtggggtagatctttctcagga

SEQ ID NO: 94127 - DNA, 22 bp, Homo sapiens
gaggcacagagtaggtgcacac

SEQ ID NO: 94128 - DNA, 22 bp, Homo sapiens
gtggcattgccttctgcaggaa

SEQ ID NO: 94129 - DNA, 22 bp, Homo sapiens
gctgctttgtctgtaaaatgga

SEQ ID NO: 94130 - DNA, 22 bp, Homo sapiens
atagttttaaaacctcaggaag

SEQ ID NO: 94131 - DNA, 22 bp, Homo sapiens
caggtgttggaagggcagtggg

SEQ ID NO: 94132 - DNA, 22 bp, Homo sapiens
gcctgtgtggatgcgccggtgc

SEQ ID NO: 94133 - DNA, 22 bp, Homo sapiens
tccctagtcgcatctgtggaga

SEQ ID NO: 94134 - DNA, 22 bp, Homo sapiens
caaagtgctgggattacaggct

SEQ ID NO: 94135 - DNA, 22 bp, Homo sapiens
gttccaggtggtcacagagctc

SEQ ID NO: 94136 - DNA, 22 bp, Homo sapiens
tgcagtttaaacttggcaactt

SEQ ID NO: 94137 - DNA, 22 bp, Homo sapiens
gttcatcactcagagacctccc

SEQ ID NO: 94138 - DNA, 22 bp, Homo sapiens
ttaggcaattttgtcattgtgt

SEQ ID NO: 94139 - DNA, 22 bp, Homo sapiens
tctcaagcttgttggtatgttt

SEQ ID NO: 94140 - DNA, 22 bp, Homo sapiens
ctgctttaaaactgatacatga

SEQ ID NO: 94141 - DNA, 22 bp, Homo sapiens
ggatgtgtcactctcaggaggt

SEQ ID NO: 94142 - DNA, 22 bp, Homo sapiens
aggggttggacataagacagaa

SEQ ID NO: 94143 - DNA, 19 bp, Homo sapiens
atctgccttagtgctgctg

SEQ ID NO: 94144 - DNA, 22 bp, Homo sapiens
acacttggctctgagtcactac

SEQ ID NO: 94145 - DNA, 22 bp, Homo sapiens
gcaggctgtctaaagttagagt

SEQ ID NO: 94146 - DNA, 22 bp, Homo sapiens
ttacttaaacagaaatgcagaa

SEQ ID NO: 94147 - DNA, 22 bp, Homo sapiens
atcgcaagtttaaaaatctttg

SEQ ID NO: 94148 - DNA, 22 bp, Homo sapiens
aatgaattgcagtactgacttg

SEQ ID NO: 94149 - DNA, 22 bp, Homo sapiens
cgtcttggagatattctgggct

SEQ ID NO: 94150 - DNA, 22 bp, Homo sapiens
gcggggcccggacccagcctct

SEQ ID NO: 94151 - DNA, 22 bp, Homo sapiens
ggccctggtcctaggggtggaa

SEQ ID NO: 94152 - DNA, 22 bp, Homo sapiens
tggcaatgtggaatggtccagg

SEQ ID NO: 94153 - DNA, 22 bp, Homo sapiens
tcttacccggcaacgtgtgtcg

SEQ ID NO: 94154 - DNA, 21 bp, Homo sapiens
aggagcattgttgtggtggag

SEQ ID NO: 94155 - DNA, 22 bp, Homo sapiens
gatggcacacagacatccccgc

SEQ ID NO: 94156 - DNA, 22 bp, Homo sapiens
agggctggagccacagctggga

SEQ ID NO: 94157 - DNA, 20 bp, Homo sapiens
ggcagagggcctgggagaag

SEQ ID NO: 94158 - DNA, 22 bp, Homo sapiens
aaattgcaaaagtacttttagg

SEQ ID NO: 94159 - DNA, 22 bp, Homo sapiens
tatgaagtctctgatgttgagt

SEQ ID NO: 94160 - DNA, 22 bp, Homo sapiens
agtggaccagaagactgaagct

SEQ ID NO: 94161 - DNA, 22 bp, Homo sapiens
agtggccagcagcctagcctag

SEQ ID NO: 94162 - DNA, 22 bp, Homo sapiens
tgggaaagtctttatttctctt

SEQ ID NO: 94163 - DNA, 22 bp, Homo sapiens
ttaagggccattatggatgggt

SEQ ID NO: 94164 - DNA, 22 bp, Homo sapiens
ggaggcggaggctgcagtgagc

SEQ ID NO: 94165 - DNA, 22 bp, Homo sapiens
tggggtcccaactctgattgat

SEQ ID NO: 94166 - DNA, 22 bp, Homo sapiens
tgattaatatcaccaccattgg

SEQ ID NO: 94167 - DNA, 22 bp, Homo sapiens
ctgtccctgagcaactcctgtt

SEQ ID NO: 94168 - DNA, 22 bp, Homo sapiens
gaccttgtgatccacccgcttt

SEQ ID NO: 94169 - DNA, 22 bp, Homo sapiens
ggagttcacgatgttggccagg

SEQ ID NO: 94170 - DNA, 22 bp, Homo sapiens
gtgctccctccttcctcaagga

SEQ ID NO: 94171 - DNA, 22 bp, Homo sapiens
cactgcagcctcgctctcctga

SEQ ID NO: 94172 - DNA, 22 bp, Homo sapiens
gtcggccacgcaggtgcggtag

SEQ ID NO: 94173 - DNA, 15 bp, Homo sapiens
catatcactgggaat

SEQ ID NO: 94174 - DNA, 22 bp, Homo sapiens
caggaggacatactggctcaca

SEQ ID NO: 94175 - DNA, 22 bp, Homo sapiens
cctgtcataatgtccgatgtca

SEQ ID NO: 94176 - DNA, 22 bp, Homo sapiens
aggtgaacccaggtgcttcacg

SEQ ID NO: 94177 - DNA, 22 bp, Homo sapiens
cgagagatgggttggcaggggc

SEQ ID NO: 94178 - DNA, 22 bp, Homo sapiens
aagtcgtggcaggcttgcacga

SEQ ID NO: 94179 - DNA, 22 bp, Homo sapiens
aaaggacacacaggaggtgtct

SEQ ID NO: 94180 - DNA, 22 bp, Homo sapiens
gtctcctccctttcattcacct

SEQ ID NO: 94181 - DNA, 22 bp, Homo sapiens
ttgaccactgaatggttctgaa

SEQ ID NO: 94182 - DNA, 22 bp, Homo sapiens
gtttctggcgccggggcaggcc

SEQ ID NO: 94183 - DNA, 22 bp, Homo sapiens
ttctgggcacacaggccctggt

SEQ ID NO: 94184 - DNA, 22 bp, Homo sapiens
cccaggggttcaaggctgcagt

SEQ ID NO: 94185 - DNA, 22 bp, Homo sapiens
aggcctgaggaccagataaatg

SEQ ID NO: 94186 - DNA, 22 bp, Homo sapiens
atgcctgtaatcccagcacttt

SEQ ID NO: 94187 - DNA, 22 bp, Homo sapiens
ccctcccagatgggcttgaggt

SEQ ID NO: 94188 - DNA, 21 bp, Homo sapiens
agaacccagcagcactgttct

SEQ ID NO: 94189 - DNA, 22 bp, Homo sapiens
aaatggaagctatttatgattc

SEQ ID NO: 94190 - DNA, 22 bp, Homo sapiens
caggtgtgccgggagcagtttg

SEQ ID NO: 94191 - DNA, 22 bp, Homo sapiens
caggctggagtgcagtggcgcc

SEQ ID NO: 94192 - DNA, 22 bp, Homo sapiens
taaagggtaggttttactgtaa

SEQ ID NO: 94193 - DNA, 22 bp, Homo sapiens
cagctgctgttcagttttgttt

SEQ ID NO: 94194 - DNA, 22 bp, Homo sapiens
tttggactgcatgatgatctgg

SEQ ID NO: 94195 - DNA, 22 bp, Homo sapiens
ggaggaggggtgactgaatgct

SEQ ID NO: 94196 - DNA, 22 bp, Homo sapiens
caggtgagaggcggtcctgcat

SEQ ID NO: 94197 - DNA, 22 bp, Homo sapiens
gcttggaagtaggattgggaga

SEQ ID NO: 94198 - DNA, 22 bp, Homo sapiens
tcccattgcccaggtagtgtac

SEQ ID NO: 94199 - DNA, 22 bp, Homo sapiens
ttcaaatgatggcagtcctggc

SEQ ID NO: 94200 - DNA, 22 bp, Homo sapiens
taatatctacttcatagagttt

SEQ ID NO: 94201 - DNA, 22 bp, Homo sapiens
tcactgcactccagcactcagg

SEQ ID NO: 94202 - DNA, 22 bp, Homo sapiens
tgccagctgcttgtcccccaca

SEQ ID NO: 94203 - DNA, 22 bp, Homo sapiens
taggcaagtggaccagaggttt

SEQ ID NO: 94204 - DNA, 22 bp, Homo sapiens
ttgcttcctctagtttcttgaa

SEQ ID NO: 94205 - DNA, 22 bp, Homo sapiens
ctgctcttcacactacacccgt

SEQ ID NO: 94206 - DNA, 22 bp, Homo sapiens
cctgtgcttggccagagaggtt

SEQ ID NO: 94207 - DNA, 22 bp, Homo sapiens
tcctggatggcctgcaggcggt

SEQ ID NO: 94208 - DNA, 22 bp, Homo sapiens
cccattgtggttgttgaggata

SEQ ID NO: 94209 - DNA, 22 bp, Homo sapiens
ctgccgtgtttttcatgttaaa

SEQ ID NO: 94210 - DNA, 22 bp, Homo sapiens
tccttgtaaaggagctctaaca

SEQ ID NO: 94211 - DNA, 22 bp, Homo sapiens
atacctgtgtatccacaagcgt

SEQ ID NO: 94212 - DNA, 22 bp, Homo sapiens
ggcatcttgttgctcaaatcta

SEQ ID NO: 94213 - DNA, 22 bp, Homo sapiens
ttctcttttcaccagttgctaa

SEQ ID NO: 94214 - DNA, 21 bp, Homo sapiens
tctgccagctgaagaggtgga

SEQ ID NO: 94215 - DNA, 22 bp, Homo sapiens
cgcatgagacctgccggccatc

SEQ ID NO: 94216 - DNA, 22 bp, Homo sapiens
cccaggaggtcaaggctgcagt

SEQ ID NO: 94217 - DNA, 22 bp, Homo sapiens
tcccaagtactaccaatctaat

SEQ ID NO: 94218 - DNA, 22 bp, Homo sapiens
tgaaggtggctgtttgtgcata

SEQ ID NO: 94219 - DNA, 22 bp, Homo sapiens
tggagtgaagggttggcacggt

SEQ ID NO: 94220 - DNA, 22 bp, Homo sapiens
aaaaatcacttttataggcagc

SEQ ID NO: 94221 - DNA, 22 bp, Homo sapiens
gagccaagattgtgtccctgca

SEQ ID NO: 94222 - DNA, 22 bp, Homo sapiens
tggagccagcggcctgctgagg

SEQ ID NO: 94223 - DNA, 22 bp, Homo sapiens
ccaggaggcggaggttgcagtg

SEQ ID NO: 94224 - DNA, 22 bp, Homo sapiens
gaccttgtgatctgcctgcctt

SEQ ID NO: 94225 - DNA, 23 bp, Homo sapiens
gtgcgccaggacaacctgacgga

SEQ ID NO: 94226 - DNA, 17 bp, Homo sapiens
tgtatttatcatgtcag

SEQ ID NO: 94227 - DNA, 22 bp, Homo sapiens
tccaagatctacagcagtttag

SEQ ID NO: 94228 - DNA, 22 bp, Homo sapiens
agtggagcttttcctatcagag

SEQ ID NO: 94229 - DNA, 22 bp, Homo sapiens
gtgggctgcccttgaggtcagc

SEQ ID NO: 94230 - DNA, 22 bp, Homo sapiens
atgaggcaggagtgcagtggca

SEQ ID NO: 94231 - DNA, 22 bp, Homo sapiens
ctgagggtcaacttgattgtat

SEQ ID NO: 94232 - DNA, 22 bp, Homo sapiens
cacccaggctggagtgcagtgg

SEQ ID NO: 94233 - DNA, 22 bp, Homo sapiens
tgtgtttctgagaatcccacct

SEQ ID NO: 94234 - DNA, 23 bp, Homo sapiens
atgacactcctgtgcgcaccctg

SEQ ID NO: 94235 - DNA, 22 bp, Homo sapiens
cctggaggcggaggttgcagtg

SEQ ID NO: 94236 - DNA, 22 bp, Homo sapiens
caaccccactacacgttggaga

SEQ ID NO: 94237 - DNA, 23 bp, Homo sapiens
gctcatcaggcttagagtcaagg

SEQ ID NO: 94238 - DNA, 22 bp, Homo sapiens
ttctgcaggctgtacaagaagc

SEQ ID NO: 94239 - DNA, 22 bp, Homo sapiens
gtggcagaccttcccttctcct

SEQ ID NO: 94240 - DNA, 22 bp, Homo sapiens
ccaggggttggaggttgcagtg

SEQ ID NO: 94241 - DNA, 22 bp, Homo sapiens
atttgtgggactataatgcagg

SEQ ID NO: 94242 - DNA, 18 bp, Homo sapiens
acgtgctgtgccttttgc

SEQ ID NO: 94243 - DNA, 22 bp, Homo sapiens
gccaggaaagggaattccctga

SEQ ID NO: 94244 - DNA, 21 bp, Homo sapiens
tatcagagacattgagaggca

SEQ ID NO: 94245 - DNA, 22 bp, Homo sapiens
gtggctcacgtctgtcatctca

SEQ ID NO: 94246 - DNA, 22 bp, Homo sapiens
tgacagaactcattctcaccaa

SEQ ID NO: 94247 - DNA, 22 bp, Homo sapiens
aggaaaacagaccaaggagctc

SEQ ID NO: 94248 - DNA, 22 bp, Homo sapiens
aggtctcttgctgtctctgggc

SEQ ID NO: 94249 - DNA, 22 bp, Homo sapiens
atttcagcagcccatgtttgga

SEQ ID NO: 94250 - DNA, 22 bp, Homo sapiens
aacccgtgatcctgactcccct

SEQ ID NO: 94251 - DNA, 22 bp, Homo sapiens
agatacattgttctaagcattg

SEQ ID NO: 94252 - DNA, 17 bp, Homo sapiens
ggctgcagtccaggagg

SEQ ID NO: 94253 - DNA, 22 bp, Homo sapiens
cctgggggccaggaaggtgtga

SEQ ID NO: 94254 - DNA, 22 bp, Homo sapiens
gtatcacttttgagagtgagaa

SEQ ID NO: 94255 - DNA, 22 bp, Homo sapiens
ccaggggggcgtagatgctggg

SEQ ID NO: 94256 - DNA, 22 bp, Homo sapiens
cagggggctcaaaggagagtgc

SEQ ID NO: 94257 - DNA, 22 bp, Homo sapiens
aacgcccgtggttgccaaggta

SEQ ID NO: 94258 - DNA, 22 bp, Homo sapiens
gagaggaagccttctgtacttg

SEQ ID NO: 94259 - DNA, 22 bp, Homo sapiens
gcctcaaatgtggagcactatt

SEQ ID NO: 94260 - DNA, 22 bp, Homo sapiens
actgcactcctgcctgggtaac

SEQ ID NO: 94261 - DNA, 22 bp, Homo sapiens
agattctaccagagctagtttg

SEQ ID NO: 94262 - DNA, 22 bp, Homo sapiens
gcaaatacatgttgagcaccta

SEQ ID NO: 94263 - DNA, 22 bp, Homo sapiens
gctggccacagatccccaggga

SEQ ID NO: 94264 - DNA, 22 bp, Homo sapiens
accccttggagtccgcgcccag

SEQ ID NO: 94265 - DNA, 22 bp, Homo sapiens
tgcgggtcccagggtcacaggc

SEQ ID NO: 94266 - DNA, 21 bp, Homo sapiens
tggcggggacttgtggctgcc

SEQ ID NO: 94267 - DNA, 22 bp, Homo sapiens
tacccagtctggagtgcagtga

SEQ ID NO: 94268 - DNA, 23 bp, Homo sapiens
acctgtctgcctcccaccatcaa

SEQ ID NO: 94269 - DNA, 22 bp, Homo sapiens
accattgccccctagtgtctgt

SEQ ID NO: 94270 - DNA, 22 bp, Homo sapiens
tgcccagggtggagtgcagtgg

SEQ ID NO: 94271 - DNA, 22 bp, Homo sapiens
tgacaggaaacatgcagtgatt

SEQ ID NO: 94272 - DNA, 22 bp, Homo sapiens
aggctgaggcaagaggatcact

SEQ ID NO: 94273 - DNA, 22 bp, Homo sapiens
ggttcagggctaccagtgggtg

SEQ ID NO: 94274 - DNA, 22 bp, Homo sapiens
tagcagcatttttgtagagtat

SEQ ID NO: 94275 - DNA, 22 bp, Homo sapiens
aatttgtataaaatggtgtttt

SEQ ID NO: 94276 - DNA, 22 bp, Homo sapiens
actgttttctgtaaagggccag

SEQ ID NO: 94277 - DNA, 22 bp, Homo sapiens
ttgaggactgtggtccccaaag

SEQ ID NO: 94278 - DNA, 22 bp, Homo sapiens
actgttgaagtgccagcttgat

SEQ ID NO: 94279 - DNA, 22 bp, Homo sapiens
tgcaataactactttaatgttg

SEQ ID NO: 94280 - DNA, 22 bp, Homo sapiens
taagcctgcatgaaccatgaga

SEQ ID NO: 94281 - DNA, 19 bp, Homo sapiens
catctggatgattctcctg

SEQ ID NO: 94282 - DNA, 22 bp, Homo sapiens
aaattgtaatgacttcacttga

SEQ ID NO: 94283 - DNA, 22 bp, Homo sapiens
tcaggcaatctgacagctggag

SEQ ID NO: 94284 - DNA, 22 bp, Homo sapiens
tgaaatgttaaacaagtggctc

SEQ ID NO: 94285 - DNA, 22 bp, Homo sapiens
accctaataatcacagactagt

SEQ ID NO: 94286 - DNA, 22 bp, Homo sapiens
cactgggcacttgggttgcttc

SEQ ID NO: 94287 - DNA, 22 bp, Homo sapiens
tggagtgcaatagtaataaggt

SEQ ID NO: 94288 - DNA, 22 bp, Homo sapiens
agaggaggctctgggatcgtcc

SEQ ID NO: 94289 - DNA, 22 bp, Homo sapiens
caaggtgccatgctgggcgggg

SEQ ID NO: 94290 - DNA, 22 bp, Homo sapiens
gctctagtaggaatgtccctct

SEQ ID NO: 94291 - DNA, 22 bp, Homo sapiens
aggagctgtcagagtgccagag

SEQ ID NO: 94292 - DNA, 22 bp, Homo sapiens
ttggatccatctcaggcatagg

SEQ ID NO: 94293 - DNA, 22 bp, Homo sapiens
atcacaaaggtctcagagcaca

SEQ ID NO: 94294 - DNA, 22 bp, Homo sapiens
cctctgtgtgatgcgcaaagta

SEQ ID NO: 94295 - DNA, 22 bp, Homo sapiens
cagcgtctcgttgtgggcctcg

SEQ ID NO: 94296 - DNA, 22 bp, Homo sapiens
caagtctgacctctgggtgaag

SEQ ID NO: 94297 - DNA, 22 bp, Homo sapiens
tgagagttctctcttcaggtgg

SEQ ID NO: 94298 - DNA, 22 bp, Homo sapiens
ttgaaggtcaccccgtagccat

SEQ ID NO: 94299 - DNA, 22 bp, Homo sapiens
ttgatgagaccattgccgcgtc

SEQ ID NO: 94300 - DNA, 22 bp, Homo sapiens
gtgggccactgggaggcaaggg

SEQ ID NO: 94301 - DNA, 22 bp, Homo sapiens
tgccaccccggaccccgaagtg

SEQ ID NO: 94302 - DNA, 22 bp, Homo sapiens
tgttcagaacaaaggtaaatga

SEQ ID NO: 94303 - DNA, 22 bp, Homo sapiens
aaagtgctgggattacaggcgt

SEQ ID NO: 94304 - DNA, 22 bp, Homo sapiens
aaagtgctgagattacaagcgt

SEQ ID NO: 94305 - DNA, 22 bp, Homo sapiens
gggaaactttcacaatgtccag

SEQ ID NO: 94306 - DNA, 22 bp, Homo sapiens
gtggcctggctggcaccacctc

SEQ ID NO: 94307 - DNA, 22 bp, Homo sapiens
tcacagagatgaacttttgata

SEQ ID NO: 94308 - DNA, 22 bp, Homo sapiens
tttgctttgtttaaaagtggta

SEQ ID NO: 94309 - DNA, 22 bp, Homo sapiens
tctgttgcaatgtgcatggtga

SEQ ID NO: 94310 - DNA, 22 bp, Homo sapiens
tcaaatgaagacagttgacttg

SEQ ID NO: 94311 - DNA, 22 bp, Homo sapiens
cttagctgcgggccctcctcgc

SEQ ID NO: 94312 - DNA, 22 bp, Homo sapiens
atccaccctgtggtggctttct

SEQ ID NO: 94313 - DNA, 22 bp, Homo sapiens
aaagtgctgggattacaggctt

SEQ ID NO: 94314 - DNA, 22 bp, Homo sapiens
cagggcctcctaaggcatctaa

SEQ ID NO: 94315 - DNA, 22 bp, Homo sapiens
gaaaaggcagagttccggggaa

SEQ ID NO: 94316 - DNA, 22 bp, Homo sapiens
tttaatcataagaaggaaaata

SEQ ID NO: 94317 - DNA, 22 bp, Homo sapiens
acctggacacctgctgtcatct

SEQ ID NO: 94318 - DNA, 22 bp, Homo sapiens
atagaatatgacttttagatcc

SEQ ID NO: 94319 - DNA, 22 bp, Homo sapiens
agccctggtttgcagcatttgc

SEQ ID NO: 94320 - DNA, 22 bp, Homo sapiens
cacttgttggtggtgaaatcac

SEQ ID NO: 94321 - DNA, 23 bp, Homo sapiens
tctacaaagctgtgtcaggaccc

SEQ ID NO: 94322 - DNA, 22 bp, Homo sapiens
attgagaagaaaatctaatata

SEQ ID NO: 94323 - DNA, 22 bp, Homo sapiens
aggggaggtgtccccaaatctc

SEQ ID NO: 94324 - DNA, 22 bp, Homo sapiens
atgggctgtccattgctggctg

SEQ ID NO: 94325 - DNA, 22 bp, Homo sapiens
gtagcagagggcccaggtaact

SEQ ID NO: 94326 - DNA, 20 bp, Homo sapiens
ctcttccggaggggcgctcc

SEQ ID NO: 94327 - DNA, 22 bp, Homo sapiens
cacatttttactgccaacttaa

SEQ ID NO: 94328 - DNA, 22 bp, Homo sapiens
cctgcgcgtctgggtctgtctc

SEQ ID NO: 94329 - DNA, 22 bp, Homo sapiens
gacggagctggttgctgcggct

SEQ ID NO: 94330 - DNA, 22 bp, Homo sapiens
gctgctaagcgtttctgttcca

SEQ ID NO: 94331 - DNA, 22 bp, Homo sapiens
atgttggagtcgtaaggcatgg

SEQ ID NO: 94332 - DNA, 22 bp, Homo sapiens
ggagtgcagtggcgtgagctcg

SEQ ID NO: 94333 - DNA, 22 bp, Homo sapiens
gtgagatggagttggtgtcttt

SEQ ID NO: 94334 - DNA, 22 bp, Homo sapiens
cctggctctgccacttactgcc

SEQ ID NO: 94335 - DNA, 22 bp, Homo sapiens
gggcagagactcagaaacagaa

SEQ ID NO: 94336 - DNA, 22 bp, Homo sapiens
cagagctggtgtgtcctggcat

SEQ ID NO: 94337 - DNA, 22 bp, Homo sapiens
cattccttaacgtggggagtct

SEQ ID NO: 94338 - DNA, 22 bp, Homo sapiens
tagcccaggctggagtgcaggg

SEQ ID NO: 94339 - DNA, 22 bp, Homo sapiens
tgagaaacttgccaagcatctc

SEQ ID NO: 94340 - DNA, 17 bp, Homo sapiens
cgggcatggagggcagg

SEQ ID NO: 94341 - DNA, 22 bp, Homo sapiens
gagacgtggcctttgcctgagc

SEQ ID NO: 94342 - DNA, 22 bp, Homo sapiens
cggggttcatccatgctgtggc

SEQ ID NO: 94343 - DNA, 22 bp, Homo sapiens
taggcctggatctctgggagca

SEQ ID NO: 94344 - DNA, 22 bp, Homo sapiens
gaggtgggcggatcacaaggtc

SEQ ID NO: 94345 - DNA, 22 bp, Homo sapiens
acccaggagacggaggtgcagt

SEQ ID NO: 94346 - DNA, 22 bp, Homo sapiens
caggcaggtcagtgaagaagga

SEQ ID NO: 94347 - DNA, 22 bp, Homo sapiens
tgtctcttttcaagctaccctt

SEQ ID NO: 94348 - DNA, 22 bp, Homo sapiens
ggactgctgtttacctggcttt

SEQ ID NO: 94349 - DNA, 22 bp, Homo sapiens
cagctggtgtcaggcactgcag

SEQ ID NO: 94350 - DNA, 22 bp, Homo sapiens
aataaacaaatccttccttccc

SEQ ID NO: 94351 - DNA, 20 bp, Homo sapiens
ctgtggaattttaccatgcg

SEQ ID NO: 94352 - DNA, 19 bp, Homo sapiens
aggctaaagagtcttgcgt

SEQ ID NO: 94353 - DNA, 22 bp, Homo sapiens
ccagggatgcagaggttgcagt

SEQ ID NO: 94354 - DNA, 22 bp, Homo sapiens
gtgggggcaggcagtgctagga

SEQ ID NO: 94355 - DNA, 22 bp, Homo sapiens
tttatagcagcatgatttataa

SEQ ID NO: 94356 - DNA, 22 bp, Homo sapiens
cctgcgggctgtgctgaagcct

SEQ ID NO: 94357 - DNA, 22 bp, Homo sapiens
ccaggctggagtgcaatggcat

SEQ ID NO: 94358 - DNA, 22 bp, Homo sapiens
acccgggaggcaggagtcatag

SEQ ID NO: 94359 - DNA, 22 bp, Homo sapiens
gcttacaggtgaggcagcaaga

SEQ ID NO: 94360 - DNA, 22 bp, Homo sapiens
tatcagtccagggttttgtgac

SEQ ID NO: 94361 - DNA, 22 bp, Homo sapiens
agtggagacaggacagtcgata

SEQ ID NO: 94362 - DNA, 22 bp, Homo sapiens
ctgaggcctctcccactccagc

SEQ ID NO: 94363 - DNA, 22 bp, Homo sapiens
tgtgagcagagacatgaaaagc

SEQ ID NO: 94364 - DNA, 22 bp, Homo sapiens
atggtttattagctgcacaggc

SEQ ID NO: 94365 - DNA, 22 bp, Homo sapiens
cagggtttcaccatgttagcag

SEQ ID NO: 94366 - DNA, 21 bp, Homo sapiens
ttgttcctatctgcctcctgc

SEQ ID NO: 94367 - DNA, 22 bp, Homo sapiens
ggtaccaccaattcagctgcca

SEQ ID NO: 94368 - DNA, 22 bp, Homo sapiens
gagccaggggtcagctccgagg

SEQ ID NO: 94369 - DNA, 22 bp, Homo sapiens
tggaagaatatgggggtacaga

SEQ ID NO: 94370 - DNA, 22 bp, Homo sapiens
cccaggccccagggcttgtcag

SEQ ID NO: 94371 - DNA, 22 bp, Homo sapiens
tattctcatcatcactggagct

SEQ ID NO: 94372 - DNA, 22 bp, Homo sapiens
ctgctttgcatagctgccagag

SEQ ID NO: 94373 - DNA, 22 bp, Homo sapiens
ggctctgcttgaggccagcctg

SEQ ID NO: 94374 - DNA, 22 bp, Homo sapiens
attgtaaatagtgccacaataa

SEQ ID NO: 94375 - DNA, 22 bp, Homo sapiens
agtgactggtgtgaagttaaat

SEQ ID NO: 94376 - DNA, 22 bp, Homo sapiens
caggcagggagctggaaaggat

SEQ ID NO: 94377 - DNA, 22 bp, Homo sapiens
ttaattctgcctttcatgtaac

SEQ ID NO: 94378 - DNA, 22 bp, Homo sapiens
gtcccataagtagtgcaacttg

SEQ ID NO: 94379 - DNA, 20 bp, Homo sapiens
caggtccagcacgtgcacgg

SEQ ID NO: 94380 - DNA, 22 bp, Homo sapiens
aacctgggcttgaacagtgcct

SEQ ID NO: 94381 - DNA, 22 bp, Homo sapiens
ttcctttctctggactgcagcc

SEQ ID NO: 94382 - DNA, 22 bp, Homo sapiens
attcactgaatttcatgattat

SEQ ID NO: 94383 - DNA, 22 bp, Homo sapiens
ggaagaaaggtggacaacaggt

SEQ ID NO: 94384 - DNA, 22 bp, Homo sapiens
tcaccttgtgatctccctgcct

SEQ ID NO: 94385 - DNA, 22 bp, Homo sapiens
gagccaggtcgggccgcggcga

SEQ ID NO: 94386 - DNA, 22 bp, Homo sapiens
gaggtaacactgttcagtgggc

SEQ ID NO: 94387 - DNA, 22 bp, Homo sapiens
tgacttcctgcactcaggtgat

SEQ ID NO: 94388 - DNA, 22 bp, Homo sapiens
atgcccaatgtcacaatttttg

SEQ ID NO: 94389 - DNA, 22 bp, Homo sapiens
tggctcctcacgtcctcagagc

SEQ ID NO: 94390 - DNA, 22 bp, Homo sapiens
ggcggagcttgcagtgagccga

SEQ ID NO: 94391 - DNA, 22 bp, Homo sapiens
gttactcttgagaggctgaggt

SEQ ID NO: 94392 - DNA, 22 bp, Homo sapiens
gagagtctagtgcacctagttt

SEQ ID NO: 94393 - DNA, 22 bp, Homo sapiens
agagcagctcgctacctctcta

SEQ ID NO: 94394 - DNA, 19 bp, Homo sapiens
gttttgcaggcagagggga

SEQ ID NO: 94395 - DNA, 22 bp, Homo sapiens
actgcgctccagcctgggtgac

SEQ ID NO: 94396 - DNA, 22 bp, Homo sapiens
ggttgtagttggaggttgtata

SEQ ID NO: 94397 - DNA, 22 bp, Homo sapiens
ccggctcggcgaccaggctgaa

SEQ ID NO: 94398 - DNA, 22 bp, Homo sapiens
ctcattgcccagatccccacag

SEQ ID NO: 94399 - DNA, 22 bp, Homo sapiens
aaattagtcatgttgtattact

SEQ ID NO: 94400 - DNA, 22 bp, Homo sapiens
catgagatttgggaggggccag

SEQ ID NO: 94401 - DNA, 22 bp, Homo sapiens
accagcacttccagaggtcagg

SEQ ID NO: 94402 - DNA, 22 bp, Homo sapiens
aggaatggtgctcagcagaaat

SEQ ID NO: 94403 - DNA, 22 bp, Homo sapiens
ttttaatactgctattgtagga

SEQ ID NO: 94404 - DNA, 23 bp, Homo sapiens
gacagagtgagaccttgtcttac

SEQ ID NO: 94405 - DNA, 22 bp, Homo sapiens
tgacttgtctctttgggagaca

SEQ ID NO: 94406 - DNA, 22 bp, Homo sapiens
gccagatttacagatttgccct

SEQ ID NO: 94407 - DNA, 22 bp, Homo sapiens
agtgggtgacagtgaacacgta

SEQ ID NO: 94408 - DNA, 21 bp, Homo sapiens
tactgtagccttgcactgtag

SEQ ID NO: 94409 - DNA, 22 bp, Homo sapiens
tggtagtgactcccccagggct

SEQ ID NO: 94410 - DNA, 22 bp, Homo sapiens
tcagaacatgtttgagtaagac

SEQ ID NO: 94411 - DNA, 22 bp, Homo sapiens
ttgctcagtggcagggctggta

SEQ ID NO: 94412 - DNA, 22 bp, Homo sapiens
aggctcgcatgccctgcaccac

SEQ ID NO: 94413 - DNA, 22 bp, Homo sapiens
cggatcctcagtcgtgcgggag

SEQ ID NO: 94414 - DNA, 22 bp, Homo sapiens
ctgatattctattttgcttgct

SEQ ID NO: 94415 - DNA, 17 bp, Homo sapiens
cccgttctcttcgctgg

SEQ ID NO: 94416 - DNA, 22 bp, Homo sapiens
ctacttgttcactgtaggtcgc

SEQ ID NO: 94417 - DNA, 22 bp, Homo sapiens
caggcagggagctggaaaggat

SEQ ID NO: 94418 - DNA, 22 bp, Homo sapiens
taggctgggggtaggaattgag

SEQ ID NO: 94419 - DNA, 22 bp, Homo sapiens
tgatctggtcctactgtgggca

SEQ ID NO: 94420 - DNA, 22 bp, Homo sapiens
aaaagaggaactcttatatact

SEQ ID NO: 94421 - DNA, 22 bp, Homo sapiens
gcccgcgccagcctctccatct

SEQ ID NO: 94422 - DNA, 22 bp, Homo sapiens
ttctcccatctcagtcttacat

SEQ ID NO: 94423 - DNA, 22 bp, Homo sapiens
tcccgcccttgtacttgccgag

SEQ ID NO: 94424 - DNA, 22 bp, Homo sapiens
acccgggaggcaggagtcatag

SEQ ID NO: 94425 - DNA, 22 bp, Homo sapiens
tgggaaagctgcagaaattctc

SEQ ID NO: 94426 - DNA, 22 bp, Homo sapiens
gagagtctaggaacctcatata

SEQ ID NO: 94427 - DNA, 22 bp, Homo sapiens
atctccgaaagtcttgtcaccc

SEQ ID NO: 94428 - DNA, 22 bp, Homo sapiens
tacctcaagttccaggaaagcg

SEQ ID NO: 94429 - DNA, 22 bp, Homo sapiens
atcagagtgtaagttctttcct

SEQ ID NO: 94430 - DNA, 22 bp, Homo sapiens
tggctgtgtccctgtccagagt

SEQ ID NO: 94431 - DNA, 22 bp, Homo sapiens
ttgtgctcctatgagaatctaa

SEQ ID NO: 94432 - DNA, 22 bp, Homo sapiens
agcctctcagagtgctgggatt

SEQ ID NO: 94433 - DNA, 22 bp, Homo sapiens
acccagggctcaagcgtaggca

SEQ ID NO: 94434 - DNA, 22 bp, Homo sapiens
cacctgtacagggccgggctgg

SEQ ID NO: 94435 - DNA, 22 bp, Homo sapiens
ctggagggtggagagaagtctc

SEQ ID NO: 94436 - DNA, 22 bp, Homo sapiens
atgcccaatgtcacaatttttg

SEQ ID NO: 94437 - DNA, 22 bp, Homo sapiens
tttgagatggagtcttgctctg

SEQ ID NO: 94438 - DNA, 22 bp, Homo sapiens
agagctaagaaacagaattgct

SEQ ID NO: 94439 - DNA, 22 bp, Homo sapiens
agaggccgggtgcctgctcaga

SEQ ID NO: 94440 - DNA, 22 bp, Homo sapiens
tctgctctgtggcttcagctaa

SEQ ID NO: 94441 - DNA, 22 bp, Homo sapiens
acaaagtgctgacattacaggc

SEQ ID NO: 94442 - DNA, 22 bp, Homo sapiens
ctcctgaattgtccctcacagc

SEQ ID NO: 94443 - DNA, 22 bp, Homo sapiens
agccagactgtgatgtgattaa

SEQ ID NO: 94444 - DNA, 22 bp, Homo sapiens
aggtaaagacagtgaaagaggg

SEQ ID NO: 94445 - DNA, 22 bp, Homo sapiens
cacccaggttggagtgcagtgg

SEQ ID NO: 94446 - DNA, 22 bp, Homo sapiens
ctgagctcacgccattctcctt

SEQ ID NO: 94447 - DNA, 22 bp, Homo sapiens
gacaattgcttttgccgaataa

SEQ ID NO: 94448 - DNA, 22 bp, Homo sapiens
tctcgctctgtcgcccaggctg

SEQ ID NO: 94449 - DNA, 22 bp, Homo sapiens
aagatattcaaagatttattag

SEQ ID NO: 94450 - DNA, 22 bp, Homo sapiens
ggcccagacccaagagtggtgg

SEQ ID NO: 94451 - DNA, 22 bp, Homo sapiens
tgggaagggtcaacagctggaa

SEQ ID NO: 94452 - DNA, 22 bp, Homo sapiens
agatttctgggcttcaccacct

SEQ ID NO: 94453 - DNA, 22 bp, Homo sapiens
ggtcccaggttgacagggagac

SEQ ID NO: 94454 - DNA, 22 bp, Homo sapiens
tctgacattagattaattggaa

SEQ ID NO: 94455 - DNA, 22 bp, Homo sapiens
ttcatagtgtttccttccagtg

SEQ ID NO: 94456 - DNA, 22 bp, Homo sapiens
ttacgcagctgctccaggaagc

SEQ ID NO: 94457 - DNA, 22 bp, Homo sapiens
gcccagtggtaaaagcaggcct

SEQ ID NO: 94458 - DNA, 22 bp, Homo sapiens
gtcaccttgaacaggctactca

SEQ ID NO: 94459 - DNA, 22 bp, Homo sapiens
gccaggcgggtctcaaactcct

SEQ ID NO: 94460 - DNA, 22 bp, Homo sapiens
ctcttcctagtgtgcagcgtgg

SEQ ID NO: 94461 - DNA, 22 bp, Homo sapiens
gagtcggaggcaggagacctgg

SEQ ID NO: 94462 - DNA, 22 bp, Homo sapiens
cgggttcacgccattctcctgc

SEQ ID NO: 94463 - DNA, 22 bp, Homo sapiens
cagaggctggcggccgccccga

SEQ ID NO: 94464 - DNA, 22 bp, Homo sapiens
agccggccatgtggtcttgtgc

SEQ ID NO: 94465 - DNA, 22 bp, Homo sapiens
tgagggcctcatacctgattct

SEQ ID NO: 94466 - DNA, 22 bp, Homo sapiens
ttatgatttgccacagattggt

SEQ ID NO: 94467 - DNA, 22 bp, Homo sapiens
aacccagggtggaggttgcagt

SEQ ID NO: 94468 - DNA, 22 bp, Homo sapiens
aaagcctcccaggttatgagta

SEQ ID NO: 94469 - DNA, 22 bp, Homo sapiens
gccctgggcaaggttctggcca

SEQ ID NO: 94470 - DNA, 22 bp, Homo sapiens
cccaggccctggcagagcttgt

SEQ ID NO: 94471 - DNA, 22 bp, Homo sapiens
cacagcctcctctggctcacgg

SEQ ID NO: 94472 - DNA, 22 bp, Homo sapiens
ccaggggggcgtagatgctggg

SEQ ID NO: 94473 - DNA, 22 bp, Homo sapiens
actaggggctcaggcccaggga

SEQ ID NO: 94474 - DNA, 22 bp, Homo sapiens
gaccaagatacagcatcataga

SEQ ID NO: 94475 - DNA, 23 bp, Homo sapiens
atgggccaagcaagacccatgac

SEQ ID NO: 94476 - DNA, 22 bp, Homo sapiens
tgtgaatggacaattaaatcta

SEQ ID NO: 94477 - DNA, 22 bp, Homo sapiens
tcacagctcactgtagcctcga

SEQ ID NO: 94478 - DNA, 22 bp, Homo sapiens
gacccggctccaggcccagcag

SEQ ID NO: 94479 - DNA, 22 bp, Homo sapiens
ctgggagtggtgacagctctcg

SEQ ID NO: 94480 - DNA, 22 bp, Homo sapiens
tgcgatgcaacagcttggcgga

SEQ ID NO: 94481 - DNA, 22 bp, Homo sapiens
gcccaggaggcagaggttgtgg

SEQ ID NO: 94482 - DNA, 22 bp, Homo sapiens
atgtcttctctgtaggtaaatt

SEQ ID NO: 94483 - DNA, 22 bp, Homo sapiens
gagacacaggcacagaagaggc

SEQ ID NO: 94484 - DNA, 22 bp, Homo sapiens
tccattatacttctgattcaaa

SEQ ID NO: 94485 - DNA, 22 bp, Homo sapiens
gggcggatcatttgaggtcagg

SEQ ID NO: 94486 - DNA, 22 bp, Homo sapiens
taggttttcctaaaattctggt

SEQ ID NO: 94487 - DNA, 22 bp, Homo sapiens
ccctggaggcggagcttgcagt

SEQ ID NO: 94488 - DNA, 22 bp, Homo sapiens
gagtcgagcagaaagccgtcgg

SEQ ID NO: 94489 - DNA, 22 bp, Homo sapiens
cagggcctcctaaggcatctaa

SEQ ID NO: 94490 - DNA, 22 bp, Homo sapiens
attggtggtgaggacatgccag

SEQ ID NO: 94491 - DNA, 20 bp, Homo sapiens
agcagagtgcccatcccgga

SEQ ID NO: 94492 - DNA, 22 bp, Homo sapiens
actcaaatagcaacggtgagaa

SEQ ID NO: 94493 - DNA, 22 bp, Homo sapiens
tctgcctagaaacagtgtttgc

SEQ ID NO: 94494 - DNA, 21 bp, Homo sapiens
tgactgaggcttcttcacaca

SEQ ID NO: 94495 - DNA, 21 bp, Homo sapiens
cctcaagtgcctcctgctgct

SEQ ID NO: 94496 - DNA, 22 bp, Homo sapiens
gttggagtgcagcttgtgcgat

SEQ ID NO: 94497 - DNA, 22 bp, Homo sapiens
ttgaaaagttttgaaacactct

SEQ ID NO: 94498 - DNA, 22 bp, Homo sapiens
ccttctagcaaatcaacataaa

SEQ ID NO: 94499 - DNA, 22 bp, Homo sapiens
tggcatctttgtcccagaagct

SEQ ID NO: 94500 - DNA, 22 bp, Homo sapiens
ccccatgaagtagggtctctga

SEQ ID NO: 94501 - DNA, 22 bp, Homo sapiens
cactgcactccagctgggtgac

SEQ ID NO: 94502 - DNA, 21 bp, Homo sapiens
tgctccaggagggggcagtcc

SEQ ID NO: 94503 - DNA, 22 bp, Homo sapiens
gcaggtccagtcaccagagaga

SEQ ID NO: 94504 - DNA, 22 bp, Homo sapiens
tcacccaggctggagtgcagtg

SEQ ID NO: 94505 - DNA, 22 bp, Homo sapiens
tctcccaggcaggagtgcagtg

SEQ ID NO: 94506 - DNA, 22 bp, Homo sapiens
tatgtgtttgacaccctgcaag

SEQ ID NO: 94507 - DNA, 22 bp, Homo sapiens
agaaaatttaaagagacacaca

SEQ ID NO: 94508 - DNA, 22 bp, Homo sapiens
gaccatcctggccaacgtggta

SEQ ID NO: 94509 - DNA, 22 bp, Homo sapiens
gcttggaagtaggattgggaga

SEQ ID NO: 94510 - DNA, 22 bp, Homo sapiens
agggctggagccacagctggga

SEQ ID NO: 94511 - DNA, 18 bp, Homo sapiens
cttgttcttctcttggcg

SEQ ID NO: 94512 - DNA, 22 bp, Homo sapiens
tctttggtttctgtctctgtaa

SEQ ID NO: 94513 - DNA, 22 bp, Homo sapiens
ggctagggatctagaccaggac

SEQ ID NO: 94514 - DNA, 22 bp, Homo sapiens
tggaatggaaacaaactgagga

SEQ ID NO: 94515 - DNA, 22 bp, Homo sapiens
tcgtctgtgaaattgggataag

SEQ ID NO: 94516 - DNA, 22 bp, Homo sapiens
caggaaggcgcggctgtgcctg

SEQ ID NO: 94517 - DNA, 22 bp, Homo sapiens
acgaggaagcgacccttgcccg

SEQ ID NO: 94518 - DNA, 22 bp, Homo sapiens
attaagtgactaaagtaatgct

SEQ ID NO: 94519 - DNA, 22 bp, Homo sapiens
gataccagacagggagggagaa

SEQ ID NO: 94520 - DNA, 22 bp, Homo sapiens
accactgcccatggtgaaaact

SEQ ID NO: 94521 - DNA, 22 bp, Homo sapiens
gtggagggtgattgccggctgt

SEQ ID NO: 94522 - DNA, 22 bp, Homo sapiens
ctctcgccagcggggctgcgct

SEQ ID NO: 94523 - DNA, 22 bp, Homo sapiens
tccgcccgcacgtatggagtgg

SEQ ID NO: 94524 - DNA, 22 bp, Homo sapiens
acagtgcttagcacagagtaga

SEQ ID NO: 94525 - DNA, 22 bp, Homo sapiens
aggctctgtcaggcggagcagc

SEQ ID NO: 94526 - DNA, 22 bp, Homo sapiens
atataatttttggttagctcaa

SEQ ID NO: 94527 - DNA, 22 bp, Homo sapiens
tccaggctttggggcaggagcg

SEQ ID NO: 94528 - DNA, 22 bp, Homo sapiens
tgttgattagtgtttagactta

SEQ ID NO: 94529 - DNA, 19 bp, Homo sapiens
aggctaaagagtcttgcgt

SEQ ID NO: 94530 - DNA, 22 bp, Homo sapiens
atttttctctttccactgagat

SEQ ID NO: 94531 - DNA, 22 bp, Homo sapiens
gcggggggaggaacatcttgca

SEQ ID NO: 94532 - DNA, 22 bp, Homo sapiens
catgagataatttttctccagt

SEQ ID NO: 94533 - DNA, 22 bp, Homo sapiens
actattagcatatcatgaatgg

SEQ ID NO: 94534 - DNA, 22 bp, Homo sapiens
gtggagagagataagcctggtc

SEQ ID NO: 94535 - DNA, 22 bp, Homo sapiens
cccaggaattggaggctgcagt

SEQ ID NO: 94536 - DNA, 22 bp, Homo sapiens
tgtgacctcatcttaactggaa

SEQ ID NO: 94537 - DNA, 22 bp, Homo sapiens
ctcactgcaagctctgcctccc

SEQ ID NO: 94538 - DNA, 22 bp, Homo sapiens
tgtaagtagtaatggaaggaca

SEQ ID NO: 94539 - DNA, 22 bp, Homo sapiens
aataaaatggtcagttttctca

SEQ ID NO: 94540 - DNA, 22 bp, Homo sapiens
tttgtgaataggttggcttcca

SEQ ID NO: 94541 - DNA, 22 bp, Homo sapiens
ttgagggtctggatctgctgct

SEQ ID NO: 94542 - DNA, 22 bp, Homo sapiens
tccgtggggcctgtggcttccg

SEQ ID NO: 94543 - DNA, 20 bp, Homo sapiens
caaatccctgctctgtgctg

SEQ ID NO: 94544 - DNA, 22 bp, Homo sapiens
gctgcagggagctggaaggctc

SEQ ID NO: 94545 - DNA, 22 bp, Homo sapiens
agcagcttgaggctggattcca

SEQ ID NO: 94546 - DNA, 22 bp, Homo sapiens
cctggaggcggaggttgcagtg

SEQ ID NO: 94547 - DNA, 22 bp, Homo sapiens
ggacctgaacataaaacgaggc

SEQ ID NO: 94548 - DNA, 22 bp, Homo sapiens
tctagttctagatccctgagga

SEQ ID NO: 94549 - DNA, 22 bp, Homo sapiens
tcttgaacttctgcacactcag

SEQ ID NO: 94550 - DNA, 22 bp, Homo sapiens
gtgtaagtatctttgtatcttt

SEQ ID NO: 94551 - DNA, 22 bp, Homo sapiens
taacaatacccattctaattac

SEQ ID NO: 94552 - DNA, 22 bp, Homo sapiens
ccactgtgcccagcctcatggg

SEQ ID NO: 94553 - DNA, 22 bp, Homo sapiens
tgttcctctgaacttcttccaa

SEQ ID NO: 94554 - DNA, 22 bp, Homo sapiens
tccggtccgggtactcctctct

SEQ ID NO: 94555 - DNA, 22 bp, Homo sapiens
gaagccttgaactgcaaacccc

SEQ ID NO: 94556 - DNA, 22 bp, Homo sapiens
aaagaaatagatggcatttaaa

SEQ ID NO: 94557 - DNA, 22 bp, Homo sapiens
ccctggaggttgaggctgcagt

SEQ ID NO: 94558 - DNA, 22 bp, Homo sapiens
aataaacaaatccttccttccc

SEQ ID NO: 94559 - DNA, 22 bp, Homo sapiens
ttacttaaacagaaatgcagaa

SEQ ID NO: 94560 - DNA, 22 bp, Homo sapiens
ggtcccatgactgacacagcag

SEQ ID NO: 94561 - DNA, 19 bp, Homo sapiens
ttccatctatcttcttact

SEQ ID NO: 94562 - DNA, 22 bp, Homo sapiens
gaagattgaaggctgggaatta

SEQ ID NO: 94563 - DNA, 22 bp, Homo sapiens
ggcaggaggtgagtggcgggtg

SEQ ID NO: 94564 - DNA, 22 bp, Homo sapiens
gagcactgatttatttttgtct

SEQ ID NO: 94565 - DNA, 22 bp, Homo sapiens
tgaagttgttaaggttgccatt

SEQ ID NO: 94566 - DNA, 22 bp, Homo sapiens
tgccaggcgtggtggtgcgcac

SEQ ID NO: 94567 - DNA, 16 bp, Homo sapiens
gcagaggaaaggggag

SEQ ID NO: 94568 - DNA, 22 bp, Homo sapiens
tggagccagagcgcagcctggg

SEQ ID NO: 94569 - DNA, 22 bp, Homo sapiens
tcaacagtggcaaagaggcacg

SEQ ID NO: 94570 - DNA, 22 bp, Homo sapiens
gatgcgggcccgctccactgcc

SEQ ID NO: 94571 - DNA, 22 bp, Homo sapiens
caagcgtggctgctctgatgga

SEQ ID NO: 94572 - DNA, 22 bp, Homo sapiens
aggggttggacataagacagaa

SEQ ID NO: 94573 - DNA, 22 bp, Homo sapiens
atgccactgcactccagcctag

SEQ ID NO: 94574 - DNA, 22 bp, Homo sapiens
ttgtggttgactaaatttgtaa

SEQ ID NO: 94575 - DNA, 22 bp, Homo sapiens
cgctgcagaagcgtgttcagga

SEQ ID NO: 94576 - DNA, 22 bp, Homo sapiens
acagcagagcctggtacttact

SEQ ID NO: 94577 - DNA, 22 bp, Homo sapiens
ctgggaggcagaggttgtagtg

SEQ ID NO: 94578 - DNA, 21 bp, Homo sapiens
tttcttaggctctaaaatgac

SEQ ID NO: 94579 - DNA, 22 bp, Homo sapiens
agaggaggctctgggatcgtcc

SEQ ID NO: 94580 - DNA, 22 bp, Homo sapiens
ttcctggtctatttagaattgc

SEQ ID NO: 94581 - DNA, 22 bp, Homo sapiens
acagcagcaatagcagtgacat

SEQ ID NO: 94582 - DNA, 22 bp, Homo sapiens
cctgcgcgtctgggtctgtctc

SEQ ID NO: 94583 - DNA, 22 bp, Homo sapiens
aggtggaaatggctttcctagg

SEQ ID NO: 94584 - DNA, 22 bp, Homo sapiens
gtcatcatcaggcagatgctgc

SEQ ID NO: 94585 - DNA, 17 bp, Homo sapiens
gggcagggactcctggg

SEQ ID NO: 94586 - DNA, 22 bp, Homo sapiens
tgtgagttcttagaaagtcagt

SEQ ID NO: 94587 - DNA, 22 bp, Homo sapiens
cctgggaggctgaggctgcagt

SEQ ID NO: 94588 - DNA, 22 bp, Homo sapiens
gcctggagaaaggaaggtggga

SEQ ID NO: 94589 - DNA, 22 bp, Homo sapiens
cactgcactccagcctgcgcaa

SEQ ID NO: 94590 - DNA, 22 bp, Homo sapiens
atacaccaccttggatctttca

SEQ ID NO: 94591 - DNA, 22 bp, Homo sapiens
agaaagagatgaatgctttaag

SEQ ID NO: 94592 - DNA, 22 bp, Homo sapiens
ttctttgaatagatgttcccag

SEQ ID NO: 94593 - DNA, 22 bp, Homo sapiens
attttctatgttgtaattgtta

SEQ ID NO: 94594 - DNA, 22 bp, Homo sapiens
actacagtgtgataagaggggc

SEQ ID NO: 94595 - DNA, 22 bp, Homo sapiens
cgtcatcacggcaagcatctcc

SEQ ID NO: 94596 - DNA, 22 bp, Homo sapiens
gtggcatctcagaggccaagaa

SEQ ID NO: 94597 - DNA, 22 bp, Homo sapiens
tcatctaagagtcttacattta

SEQ ID NO: 94598 - DNA, 22 bp, Homo sapiens
tctcgatctcctgaccttgtga

SEQ ID NO: 94599 - DNA, 22 bp, Homo sapiens
ccaggcagcctgctccattctg

SEQ ID NO: 94600 - DNA, 22 bp, Homo sapiens
ccaggagctggagggtgcagtg

SEQ ID NO: 94601 - DNA, 22 bp, Homo sapiens
gcgagaaactaagtgccctttg

SEQ ID NO: 94602 - DNA, 22 bp, Homo sapiens
gcaactgaacatgtgtgtggcc

SEQ ID NO: 94603 - DNA, 20 bp, Homo sapiens
aaactaaaggtgtttggttt

SEQ ID NO: 94604 - DNA, 22 bp, Homo sapiens
gttgaaatcctaaccccctagt

SEQ ID NO: 94605 - DNA, 22 bp, Homo sapiens
ctgcagggagaggggacagcct

SEQ ID NO: 94606 - DNA, 22 bp, Homo sapiens
ggcatggacgtctctgaggcca

SEQ ID NO: 94607 - DNA, 22 bp, Homo sapiens
ccagtgtgcaatctctggctta

SEQ ID NO: 94608 - DNA, 22 bp, Homo sapiens
ttatagcagcatgatttataat

SEQ ID NO: 94609 - DNA, 18 bp, Homo sapiens
actctgcggaggccccag

SEQ ID NO: 94610 - DNA, 22 bp, Homo sapiens
agcagcagtatccttccccggc

SEQ ID NO: 94611 - DNA, 22 bp, Homo sapiens
accctgctttatgccgtcctct

SEQ ID NO: 94612 - DNA, 22 bp, Homo sapiens
gtaatagtctcaaactcctgga

SEQ ID NO: 94613 - DNA, 22 bp, Homo sapiens
ctgccgtgtttttcatgttaaa

SEQ ID NO: 94614 - DNA, 22 bp, Homo sapiens
taatggattaacgtccctgtcg

SEQ ID NO: 94615 - DNA, 22 bp, Homo sapiens
tgccgcagtgcggggagggccc

SEQ ID NO: 94616 - DNA, 22 bp, Homo sapiens
tcagtggtgaagtggtgcacca

SEQ ID NO: 94617 - DNA, 22 bp, Homo sapiens
ggggtgtggacggctgtgccag

SEQ ID NO: 94618 - DNA, 22 bp, Homo sapiens
ttgtggttaaccgcacattttt

SEQ ID NO: 94619 - DNA, 22 bp, Homo sapiens
tgctcccaaacctgacaggctc

SEQ ID NO: 94620 - DNA, 22 bp, Homo sapiens
gttacagtcaggagatattttg

SEQ ID NO: 94621 - DNA, 22 bp, Homo sapiens
gatcctgggcccttctgggtca

SEQ ID NO: 94622 - DNA, 22 bp, Homo sapiens
ccaaagtgctgggattacaggc

SEQ ID NO: 94623 - DNA, 22 bp, Homo sapiens
tgtgcccaacgtgcaggtttgt

SEQ ID NO: 94624 - DNA, 22 bp, Homo sapiens
ccaggcaggcgatggtgcagtg

SEQ ID NO: 94625 - DNA, 22 bp, Homo sapiens
tcagtgatttctggggtgaggg

SEQ ID NO: 94626 - DNA, 22 bp, Homo sapiens
ctatggtctggaccgaggtcct

SEQ ID NO: 94627 - DNA, 20 bp, Homo sapiens
ttctccagtgcggtagccat

SEQ ID NO: 94628 - DNA, 22 bp, Homo sapiens
tgagccatgggactccaaggga

SEQ ID NO: 94629 - DNA, 22 bp, Homo sapiens
caggaggagggcagccgcctcc

SEQ ID NO: 94630 - DNA, 22 bp, Homo sapiens
cttgcctacttgtcaaccagca

SEQ ID NO: 94631 - DNA, 22 bp, Homo sapiens
tctgcaacattcctctccccac

SEQ ID NO: 94632 - DNA, 22 bp, Homo sapiens
cctgtcataatgtccgatgtca

SEQ ID NO: 94633 - DNA, 22 bp, Homo sapiens
aagatgcggttgaccatggtgt

SEQ ID NO: 94634 - DNA, 22 bp, Homo sapiens
aaatgcctcattttctctcact

SEQ ID NO: 94635 - DNA, 22 bp, Homo sapiens
cactgcaacctccacctcctgg

SEQ ID NO: 94636 - DNA, 22 bp, Homo sapiens
ctgaacttattgagtgcttgct

SEQ ID NO: 94637 - DNA, 22 bp, Homo sapiens
caggtgtgccgggagcagtttg

SEQ ID NO: 94638 - DNA, 22 bp, Homo sapiens
tctagcaagctcgtgctcaagg

SEQ ID NO: 94639 - DNA, 22 bp, Homo sapiens
ctgtccctgagcaactcctgtt

SEQ ID NO: 94640 - DNA, 22 bp, Homo sapiens
gcaggatgagtgagtacattta

SEQ ID NO: 94641 - DNA, 22 bp, Homo sapiens
ggcagggagtggagactcccta

SEQ ID NO: 94642 - DNA, 23 bp, Homo sapiens
tgaatgtttattctcggtgcaga

SEQ ID NO: 94643 - DNA, 22 bp, Homo sapiens
gaccttgtgatccacctgcctt

SEQ ID NO: 94644 - DNA, 22 bp, Homo sapiens
cagccctcctaccctgccaggc

SEQ ID NO: 94645 - DNA, 22 bp, Homo sapiens
ccctgcctacagggttttcttt

SEQ ID NO: 94646 - DNA, 22 bp, Homo sapiens
taaagattgctcaaaactgtga

SEQ ID NO: 94647 - DNA, 22 bp, Homo sapiens
tggctgagttacgaacagagca

SEQ ID NO: 94648 - DNA, 22 bp, Homo sapiens
tttgtcttatccaatctctcag

SEQ ID NO: 94649 - DNA, 22 bp, Homo sapiens
tctgagctgggtcttgacagct

SEQ ID NO: 94650 - DNA, 22 bp, Homo sapiens
actgttgaagtgccagcttgat

SEQ ID NO: 94651 - DNA, 22 bp, Homo sapiens
atacttctttagcatattgaac

SEQ ID NO: 94652 - DNA, 22 bp, Homo sapiens
aggctctcaccctctgaccaga

SEQ ID NO: 94653 - DNA, 22 bp, Homo sapiens
gacccaggggcagggagaaagt

SEQ ID NO: 94654 - DNA, 22 bp, Homo sapiens
atgatggctaggctggttttga

SEQ ID NO: 94655 - DNA, 23 bp, Homo sapiens
aatgggtgcaactatccatgaca

SEQ ID NO: 94656 - DNA, 22 bp, Homo sapiens
tctgtcttagccatctcaggct

SEQ ID NO: 94657 - DNA, 22 bp, Homo sapiens
gaaagacatagttgcaagatgg

SEQ ID NO: 94658 - DNA, 22 bp, Homo sapiens
actgcacttcagcctgggtgac

SEQ ID NO: 94659 - DNA, 22 bp, Homo sapiens
cacagagctggaaaggctgggc

SEQ ID NO: 94660 - DNA, 22 bp, Homo sapiens
gcaagacctatctagttgctgt

SEQ ID NO: 94661 - DNA, 21 bp, Homo sapiens
tcacgtggtcacatgagcttt

SEQ ID NO: 94662 - DNA, 22 bp, Homo sapiens
tgcaatctcggcactttgggag

SEQ ID NO: 94663 - DNA, 23 bp, Homo sapiens
ggctgggagctccgggtgcacgt

SEQ ID NO: 94664 - DNA, 22 bp, Homo sapiens
tttgttttcaatgtgtcattca

SEQ ID NO: 94665 - DNA, 22 bp, Homo sapiens
gaccttgtgatccccctgcctt

SEQ ID NO: 94666 - DNA, 22 bp, Homo sapiens
ggcaatatggtgaaaccccatc

SEQ ID NO: 94667 - DNA, 22 bp, Homo sapiens
gtgtggctgaaatcaaggcagg

SEQ ID NO: 94668 - DNA, 22 bp, Homo sapiens
aggctagaggcttctggcttca

SEQ ID NO: 94669 - DNA, 22 bp, Homo sapiens
tcctcagaatcacctggcagct

SEQ ID NO: 94670 - DNA, 19 bp, Homo sapiens
ggagccgccgcccttcatt

SEQ ID NO: 94671 - DNA, 22 bp, Homo sapiens
gcaggtggatcaccacgtcagg

SEQ ID NO: 94672 - DNA, 18 bp, Homo sapiens
tcctttctccctcatctt

SEQ ID NO: 94673 - DNA, 22 bp, Homo sapiens
tcctgaagaaggcagatatttg

SEQ ID NO: 94674 - DNA, 22 bp, Homo sapiens
ccaaggtgggaggattgcttga

SEQ ID NO: 94675 - DNA, 22 bp, Homo sapiens
cagcaggaggtgagtagcaggt

SEQ ID NO: 94676 - DNA, 19 bp, Homo sapiens
catggtgaaaccccgtctc

SEQ ID NO: 94677 - DNA, 22 bp, Homo sapiens
aaccccgctcaggctgggtgag

SEQ ID NO: 94678 - DNA, 22 bp, Homo sapiens
cttatttgcccatgtttcttta

SEQ ID NO: 94679 - DNA, 22 bp, Homo sapiens
accatgttggccaagctggtct

SEQ ID NO: 94680 - DNA, 22 bp, Homo sapiens
agcccaggctggagtgcagtgg

SEQ ID NO: 94681 - DNA, 21 bp, Homo sapiens
ctggaggcaggtggtgccagg

SEQ ID NO: 94682 - DNA, 22 bp, Homo sapiens
cagtggcaggatttcagctcag

SEQ ID NO: 94683 - DNA, 22 bp, Homo sapiens
cacccaggcaaggattctgcaa

SEQ ID NO: 94684 - DNA, 22 bp, Homo sapiens
ttcgactctgtgcctgaagagc

SEQ ID NO: 94685 - DNA, 22 bp, Homo sapiens
ccactgcactccagcctgccaa

SEQ ID NO: 94686 - DNA, 22 bp, Homo sapiens
ccaagctacttaggagtctgag

SEQ ID NO: 94687 - DNA, 22 bp, Homo sapiens
gagcagtaggagaaccctgagc

SEQ ID NO: 94688 - DNA, 22 bp, Homo sapiens
tcactgcaacctccacctcctg

SEQ ID NO: 94689 - DNA, 22 bp, Homo sapiens
aagttactggcaagggctgcag

SEQ ID NO: 94690 - DNA, 18 bp, Homo sapiens
tccctcagaattatagaa

SEQ ID NO: 94691 - DNA, 22 bp, Homo sapiens
gcccaggaggagaggctgcagt

SEQ ID NO: 94692 - DNA, 22 bp, Homo sapiens
aggaatgacatagaaaggggag

SEQ ID NO: 94693 - DNA, 22 bp, Homo sapiens
cttcctttgctgttcggaggtt

SEQ ID NO: 94694 - DNA, 22 bp, Homo sapiens
ccagctttatagcttcaaagga

SEQ ID NO: 94695 - DNA, 23 bp, Homo sapiens
tgcatggggctatactgctgttc

SEQ ID NO: 94696 - DNA, 22 bp, Homo sapiens
ccaccgccatggcgttgtacag

SEQ ID NO: 94697 - DNA, 22 bp, Homo sapiens
cccaggggttcaaggctgcagt

SEQ ID NO: 94698 - DNA, 22 bp, Homo sapiens
gactacaggtgtgtgccaccat

SEQ ID NO: 94699 - DNA, 22 bp, Homo sapiens
caggctggagtacaattgtgtg

SEQ ID NO: 94700 - DNA, 22 bp, Homo sapiens
gaccttgtgatctgcctgcctt

SEQ ID NO: 94701 - DNA, 22 bp, Homo sapiens
agcttgtgctggaattacatgt

SEQ ID NO: 94702 - DNA, 22 bp, Homo sapiens
gttctgagtcctcctttgaagg

SEQ ID NO: 94703 - DNA, 23 bp, Homo sapiens
tcatcttcctcatttctccaggg

SEQ ID NO: 94704 - DNA, 20 bp, Homo sapiens
catgtgtcagttctcaccca

SEQ ID NO: 94705 - DNA, 22 bp, Homo sapiens
tggttttagggaatcaatctat

SEQ ID NO: 94706 - DNA, 22 bp, Homo sapiens
tttgtggcaggagcggagaccg

SEQ ID NO: 94707 - DNA, 22 bp, Homo sapiens
ctttggcaatgtcattttcaat

SEQ ID NO: 94708 - DNA, 22 bp, Homo sapiens
ggaggtggaggttgcagtgagc

SEQ ID NO: 94709 - DNA, 22 bp, Homo sapiens
ggaggcggaggttgcagtgagt

SEQ ID NO: 94710 - DNA, 22 bp, Homo sapiens
gtatgtgaggttggtttccagg

SEQ ID NO: 94711 - DNA, 22 bp, Homo sapiens
attaagactgcccatgttttta

SEQ ID NO: 94712 - DNA, 21 bp, Homo sapiens
accaccctgtttatccagagg

SEQ ID NO: 94713 - DNA, 22 bp, Homo sapiens
tcacagtgttaaacctttcttt

SEQ ID NO: 94714 - DNA, 22 bp, Homo sapiens
aacagcttgctgcaccttaata

SEQ ID NO: 94715 - DNA, 23 bp, Homo sapiens
ccaagactgttaggagtggggag

SEQ ID NO: 94716 - DNA, 22 bp, Homo sapiens
aggaccatcctaaggtaggcaa

SEQ ID NO: 94717 - DNA, 22 bp, Homo sapiens
cctcgacctccccaggctcagg

SEQ ID NO: 94718 - DNA, 22 bp, Homo sapiens
cttcatcagctggcttactgtt

SEQ ID NO: 94719 - DNA, 22 bp, Homo sapiens
cttccttctcactagcagcgcc

SEQ ID NO: 94720 - DNA, 22 bp, Homo sapiens
cagagagaatcttggcagctga

SEQ ID NO: 94721 - DNA, 17 bp, Homo sapiens
cccgttctcttcgctgg

SEQ ID NO: 94722 - DNA, 22 bp, Homo sapiens
gtccaagagtcaagaagggggc

SEQ ID NO: 94723 - DNA, 19 bp, Homo sapiens
ttctggtctggaatcaagg

SEQ ID NO: 94724 - DNA, 22 bp, Homo sapiens
gaatttcctctaaacccctgag

SEQ ID NO: 94725 - DNA, 22 bp, Homo sapiens
caggtgtcggtcaggcggtttt

SEQ ID NO: 94726 - DNA, 22 bp, Homo sapiens
cactgcactccatcctgggaaa

SEQ ID NO: 94727 - DNA, 22 bp, Homo sapiens
actttatttcctattgcatcca

SEQ ID NO: 94728 - DNA, 22 bp, Homo sapiens
cactgggcgtgtcctgggtgag

SEQ ID NO: 94729 - DNA, 22 bp, Homo sapiens
tcctagttctctgccagtcgct

SEQ ID NO: 94730 - DNA, 22 bp, Homo sapiens
ggagggcagagtcccctgctga

SEQ ID NO: 94731 - DNA, 22 bp, Homo sapiens
ggcaatagttgtgggttcttta

SEQ ID NO: 94732 - DNA, 22 bp, Homo sapiens
gaggctgaggcaggaggatcac

SEQ ID NO: 94733 - DNA, 22 bp, Homo sapiens
ataaaatttgctactgttaaat

SEQ ID NO: 94734 - DNA, 22 bp, Homo sapiens
gcagaagcacaggtgacgggcc

SEQ ID NO: 94735 - DNA, 22 bp, Homo sapiens
cactgcactccagcctgggtca

SEQ ID NO: 94736 - DNA, 22 bp, Homo sapiens
ctgagggtcaacttgattgtat

SEQ ID NO: 94737 - DNA, 22 bp, Homo sapiens
cccaggaggtggagttcacagt

SEQ ID NO: 94738 - DNA, 22 bp, Homo sapiens
ctcctggaggatagtgactggg

SEQ ID NO: 94739 - DNA, 22 bp, Homo sapiens
tacaaaaaattgatactgacga

SEQ ID NO: 94740 - DNA, 22 bp, Homo sapiens
tgtgaagaattaatgtgaatca

SEQ ID NO: 94741 - DNA, 22 bp, Homo sapiens
caaggtgccatgctgggcgggg

SEQ ID NO: 94742 - DNA, 22 bp, Homo sapiens
tggtggggccagacttcagctc

SEQ ID NO: 94743 - DNA, 22 bp, Homo sapiens
tggctcactgtagccttgacct

SEQ ID NO: 94744 - DNA, 22 bp, Homo sapiens
atagggcctaaaaagtattgct

SEQ ID NO: 94745 - DNA, 20 bp, Homo sapiens
atgctttcttgtgtgctgct

SEQ ID NO: 94746 - DNA, 22 bp, Homo sapiens
caggctggagtgcagtggcgct

SEQ ID NO: 94747 - DNA, 22 bp, Homo sapiens
gtgtttggtcagacgtccgggg

SEQ ID NO: 94748 - DNA, 22 bp, Homo sapiens
ggttttatcctacccacacagc

SEQ ID NO: 94749 - DNA, 22 bp, Homo sapiens
gtagcagagggcccaggtaact

SEQ ID NO: 94750 - DNA, 22 bp, Homo sapiens
catggggcccatgtgctccaag

SEQ ID NO: 94751 - DNA, 22 bp, Homo sapiens
taagaaatttagttatagaatg

SEQ ID NO: 94752 - DNA, 22 bp, Homo sapiens
agaggccggccgagcccatggg

SEQ ID NO: 94753 - DNA, 22 bp, Homo sapiens
cagagctggtgtgtcctggcat

SEQ ID NO: 94754 - DNA, 22 bp, Homo sapiens
gctggaggatggactggaagaa

SEQ ID NO: 94755 - DNA, 22 bp, Homo sapiens
gttattgaggtggagtctcact

SEQ ID NO: 94756 - DNA, 22 bp, Homo sapiens
ttcttctaaatgtgcttattaa

SEQ ID NO: 94757 - DNA, 22 bp, Homo sapiens
agaaatatgctgattagatgaa

SEQ ID NO: 94758 - DNA, 22 bp, Homo sapiens
attgtgaatagtgccgcagtaa

SEQ ID NO: 94759 - DNA, 22 bp, Homo sapiens
ctgggcaaattgtgccagctat

SEQ ID NO: 94760 - DNA, 22 bp, Homo sapiens
ggctctgcttgaggccagcctg

SEQ ID NO: 94761 - DNA, 22 bp, Homo sapiens
ccatgaattcactccatgctag

SEQ ID NO: 94762 - DNA, 22 bp, Homo sapiens
tggtcgaccagttggaaagtaa

SEQ ID NO: 94763 - DNA, 22 bp, Homo sapiens
gttaggtagaagtttactttga

SEQ ID NO: 94764 - DNA, 22 bp, Homo sapiens
tgtgcctagttctgtatttaca

SEQ ID NO: 94765 - DNA, 22 bp, Homo sapiens
gcccaggctggagtgcagtggc

SEQ ID NO: 94766 - DNA, 22 bp, Homo sapiens
tggggaaaatgcttgtagtcag

SEQ ID NO: 94767 - DNA, 22 bp, Homo sapiens
catttctgggagacatgctaga

SEQ ID NO: 94768 - DNA, 22 bp, Homo sapiens
cactctcacatgccctgtcagt

SEQ ID NO: 94769 - DNA, 22 bp, Homo sapiens
atttgtgggactataatgcagg

SEQ ID NO: 94770 - DNA, 23 bp, Homo sapiens
tctcccaagcctggcaggggcac

SEQ ID NO: 94771 - DNA, 22 bp, Homo sapiens
gctccccaaaagctccaggaaa

SEQ ID NO: 94772 - DNA, 22 bp, Homo sapiens
cggcccgctgcgagtgcaccgt

SEQ ID NO: 94773 - DNA, 22 bp, Homo sapiens
ggaggctgagaggtcgcagtgg

SEQ ID NO: 94774 - DNA, 22 bp, Homo sapiens
cagacttacctaaggtcacaca

SEQ ID NO: 94775 - DNA, 22 bp, Homo sapiens
ccctggctgataccggaaaggc

SEQ ID NO: 94776 - DNA, 21 bp, Homo sapiens
gttgtggttggggctgcagct

SEQ ID NO: 94777 - DNA, 22 bp, Homo sapiens
aaagtgctgggattccaggcgt

SEQ ID NO: 94778 - DNA, 22 bp, Homo sapiens
tttaaaaaactagtctgagtct

SEQ ID NO: 94779 - DNA, 22 bp, Homo sapiens
atttcacttagtgtaatgtctt

SEQ ID NO: 94780 - DNA, 19 bp, Homo sapiens
gatttaaacgtggctctat

SEQ ID NO: 94781 - DNA, 22 bp, Homo sapiens
gaaaattattgaaaatggctct

SEQ ID NO: 94782 - DNA, 22 bp, Homo sapiens
tcctgccttgcctgggacatca

SEQ ID NO: 94783 - DNA, 22 bp, Homo sapiens
tgcactccaggctgggtgacag

SEQ ID NO: 94784 - DNA, 21 bp, Homo sapiens
gggcagaggggcctcctgggt

SEQ ID NO: 94785 - DNA, 22 bp, Homo sapiens
gaggtgggcggatcacaaggtc

SEQ ID NO: 94786 - DNA, 22 bp, Homo sapiens
tccaactttctcctccggcttg

SEQ ID NO: 94787 - DNA, 22 bp, Homo sapiens
gatttttatataaagtgagaaa

SEQ ID NO: 94788 - DNA, 22 bp, Homo sapiens
ctctggagtgtctggccagggt

SEQ ID NO: 94789 - DNA, 22 bp, Homo sapiens
cagcctgccgtcagccaggtag

SEQ ID NO: 94790 - DNA, 22 bp, Homo sapiens
tgagatgaataactcctgctaa

SEQ ID NO: 94791 - DNA, 22 bp, Homo sapiens
ggccaggcgatgacccctccac

SEQ ID NO: 94792 - DNA, 22 bp, Homo sapiens
ggctgagtctgtgacccatgcg

SEQ ID NO: 94793 - DNA, 22 bp, Homo sapiens
ctagcctgggatttgaacttat

SEQ ID NO: 94794 - DNA, 19 bp, Homo sapiens
agtcctggcctgggggacc

SEQ ID NO: 94795 - DNA, 22 bp, Homo sapiens
gtggggtagatctttctcagga

SEQ ID NO: 94796 - DNA, 22 bp, Homo sapiens
agcagcagtgttctggaattct

SEQ ID NO: 94797 - DNA, 22 bp, Homo sapiens
ccagtgtgcattatcatgtgtc

SEQ ID NO: 94798 - DNA, 22 bp, Homo sapiens
cactccagtctgggaacaaagc

SEQ ID NO: 94799 - DNA, 22 bp, Homo sapiens
atcatcatgcccacttgagact

SEQ ID NO: 94800 - DNA, 22 bp, Homo sapiens
attctcaaaacataacttcact

SEQ ID NO: 94801 - DNA, 22 bp, Homo sapiens
taggcatgcaaataaatgtgca

SEQ ID NO: 94802 - DNA, 22 bp, Homo sapiens
tttacacagaggacactgggct

SEQ ID NO: 94803 - DNA, 22 bp, Homo sapiens
gagatcggtaaagagcatgcac

SEQ ID NO: 94804 - DNA, 22 bp, Homo sapiens
gtctgctcatgctaccgcgggc

SEQ ID NO: 94805 - DNA, 22 bp, Homo sapiens
tcactgcaacctccacctcccg

SEQ ID NO: 94806 - DNA, 20 bp, Homo sapiens
aaattactgccacacatttc

SEQ ID NO: 94807 - DNA, 22 bp, Homo sapiens
ggctcactgcaacctctgcctc

SEQ ID NO: 94808 - DNA, 22 bp, Homo sapiens
atccatttgacataatttcagc

SEQ ID NO: 94809 - DNA, 21 bp, Homo sapiens
cggaaaggactagggctcaga

SEQ ID NO: 94810 - DNA, 22 bp, Homo sapiens
ctgggaggcggaggttgtagtg

SEQ ID NO: 94811 - DNA, 22 bp, Homo sapiens
aggcaaggtgctacagacagtg

SEQ ID NO: 94812 - DNA, 22 bp, Homo sapiens
caggaaagggatgggctgccac

SEQ ID NO: 94813 - DNA, 22 bp, Homo sapiens
actgcacttcaccctgggtgac

SEQ ID NO: 94814 - DNA, 22 bp, Homo sapiens
cccaggcttttctcttgcccca

SEQ ID NO: 94815 - DNA, 22 bp, Homo sapiens
caggcaggtcagtgaagaagga

SEQ ID NO: 94816 - DNA, 22 bp, Homo sapiens
ctgagcctcctgcttctatttc

SEQ ID NO: 94817 - DNA, 22 bp, Homo sapiens
catcatcaaaagtgacagagaa

SEQ ID NO: 94818 - DNA, 22 bp, Homo sapiens
cagggtttcaccatgttagcag

SEQ ID NO: 94819 - DNA, 22 bp, Homo sapiens
gacagacacaattgatccatga

SEQ ID NO: 94820 - DNA, 18 bp, Homo sapiens
atggtctcatactgggag

SEQ ID NO: 94821 - DNA, 22 bp, Homo sapiens
agccctggtttgcagcatttgc

SEQ ID NO: 94822 - DNA, 23 bp, Homo sapiens
attttttgtctttgtaactagat

SEQ ID NO: 94823 - DNA, 22 bp, Homo sapiens
tggcagtggcgggactcagggc

SEQ ID NO: 94824 - DNA, 22 bp, Homo sapiens
gagcccaggaagtggaggctga

SEQ ID NO: 94825 - DNA, 22 bp, Homo sapiens
ctgctccccagcctgcgccttt

SEQ ID NO: 94826 - DNA, 22 bp, Homo sapiens
acctggaggcagaggttgcagt

SEQ ID NO: 94827 - DNA, 22 bp, Homo sapiens
tcttgaattgtactcccataag

SEQ ID NO: 94828 - DNA, 22 bp, Homo sapiens
tgaatgtgatgctaaacatatg

SEQ ID NO: 94829 - DNA, 22 bp, Homo sapiens
gggccctgggattcagagcaag

SEQ ID NO: 94830 - DNA, 22 bp, Homo sapiens
tgttcttgagcctttagaccta

SEQ ID NO: 94831 - DNA, 22 bp, Homo sapiens
ggtagggctgcaatggtagtga

SEQ ID NO: 94832 - DNA, 22 bp, Homo sapiens
tcactacaacctccgcctcctg

SEQ ID NO: 94833 - DNA, 22 bp, Homo sapiens
atacctgtgtatccacaagcgt

SEQ ID NO: 94834 - DNA, 22 bp, Homo sapiens
aatgttacgatcaacaacacat

SEQ ID NO: 94835 - DNA, 22 bp, Homo sapiens
taatcctgtcttgaccatcagg

SEQ ID NO: 94836 - DNA, 22 bp, Homo sapiens
tggtacaatcacagctcactgt

SEQ ID NO: 94837 - DNA, 22 bp, Homo sapiens
gggctcgaagcgctggtggttg

SEQ ID NO: 94838 - DNA, 22 bp, Homo sapiens
taagcctgcatgaaccatgaga

SEQ ID NO: 94839 - DNA, 22 bp, Homo sapiens
tatttcacatctatgaagtgag

SEQ ID NO: 94840 - DNA, 22 bp, Homo sapiens
tcatggcttttattatgttgag

SEQ ID NO: 94841 - DNA, 22 bp, Homo sapiens
caggagatgacagggaagaacc

SEQ ID NO: 94842 - DNA, 22 bp, Homo sapiens
aatggcactttataaatgttaa

SEQ ID NO: 94843 - DNA, 22 bp, Homo sapiens
aggacttagaacattatgtact

SEQ ID NO: 94844 - DNA, 22 bp, Homo sapiens
tgttctctaagccacccatttt

SEQ ID NO: 94845 - DNA, 20 bp, Homo sapiens
caggtccagcacgtgcacgg

SEQ ID NO: 94846 - DNA, 22 bp, Homo sapiens
aatgccttggagagcctagagg

SEQ ID NO: 94847 - DNA, 20 bp, Homo sapiens
agcggctggcggaggacacg

SEQ ID NO: 94848 - DNA, 22 bp, Homo sapiens
ccggtcccaggtgccccggtga

SEQ ID NO: 94849 - DNA, 22 bp, Homo sapiens
agcccttagtacatttctcaag

SEQ ID NO: 94850 - DNA, 22 bp, Homo sapiens
atgattgaccatctgctgggct

SEQ ID NO: 94851 - DNA, 22 bp, Homo sapiens
tctgttttgcataatgttcttt

SEQ ID NO: 94852 - DNA, 22 bp, Homo sapiens
tcagtttttctatactttgtag

SEQ ID NO: 94853 - DNA, 22 bp, Homo sapiens
attttttgttaactcaggatag

SEQ ID NO: 94854 - DNA, 22 bp, Homo sapiens
ggctgggcaggtctgcacaggg

SEQ ID NO: 94855 - DNA, 22 bp, Homo sapiens
tgtgctctgactttctcctggt

SEQ ID NO: 94856 - DNA, 22 bp, Homo sapiens
ggaggcagaatagagtgtgggt

SEQ ID NO: 94857 - DNA, 22 bp, Homo sapiens
gaccttcttgctgtgtcctaac

SEQ ID NO: 94858 - DNA, 22 bp, Homo sapiens
acctggacacctgctgtcatct

SEQ ID NO: 94859 - DNA, 22 bp, Homo sapiens
tacaacaatttccacattagaa

SEQ ID NO: 94860 - DNA, 22 bp, Homo sapiens
attacctatttcattttctgtc

SEQ ID NO: 94861 - DNA, 22 bp, Homo sapiens
ttttaatactgctattgtagga

SEQ ID NO: 94862 - DNA, 22 bp, Homo sapiens
acagtcaaatgtctatcttctt

SEQ ID NO: 94863 - DNA, 22 bp, Homo sapiens
gaggctgaggttgcagtgagct

SEQ ID NO: 94864 - DNA, 22 bp, Homo sapiens
ccaggctggagtatagtggcgc

SEQ ID NO: 94865 - DNA, 19 bp, Homo sapiens
tccaggggctccacctcct

SEQ ID NO: 94866 - DNA, 22 bp, Homo sapiens
cttcagctgcagttatgtttag

SEQ ID NO: 94867 - DNA, 22 bp, Homo sapiens
tgctcgccccacatgccctcat

SEQ ID NO: 94868 - DNA, 22 bp, Homo sapiens
cgggaaggtggaggttgcagtg

SEQ ID NO: 94869 - DNA, 22 bp, Homo sapiens
tagagtgtcataacagtgccca

SEQ ID NO: 94870 - DNA, 22 bp, Homo sapiens
cactgcactccagcttgggtga

SEQ ID NO: 94871 - DNA, 22 bp, Homo sapiens
tacatttataaggcttctctgt

SEQ ID NO: 94872 - DNA, 22 bp, Homo sapiens
ctccagattccgtttattcagg

SEQ ID NO: 94873 - DNA, 20 bp, Homo sapiens
taagcatagttgtcagggtc

SEQ ID NO: 94874 - DNA, 22 bp, Homo sapiens
gctgaggctcctcgggaggaca

SEQ ID NO: 94875 - DNA, 23 bp, Homo sapiens
gcctgccgcctggctgagaactg

SEQ ID NO: 94876 - DNA, 22 bp, Homo sapiens
cagcagcccacgcgtgctgtcc

SEQ ID NO: 94877 - DNA, 19 bp, Homo sapiens
tggctctgtcgaaggcaca

SEQ ID NO: 94878 - DNA, 22 bp, Homo sapiens
tgtctgttattggtgtataaga

SEQ ID NO: 94879 - DNA, 22 bp, Homo sapiens
actgcaacctccgcctgccagg

SEQ ID NO: 94880 - DNA, 22 bp, Homo sapiens
ctgggaggtggaggttgcattg

SEQ ID NO: 94881 - DNA, 23 bp, Homo sapiens
gcctgggagttgcgatctgcccg

SEQ ID NO: 94882 - DNA, 22 bp, Homo sapiens
tgactacaacctccacctcccg

SEQ ID NO: 94883 - DNA, 22 bp, Homo sapiens
ttttggccacatccttttgagt

SEQ ID NO: 94884 - DNA, 22 bp, Homo sapiens
ccagaggagttgaggctttggg

SEQ ID NO: 94885 - DNA, 22 bp, Homo sapiens
acagaagcctttggccatttga

SEQ ID NO: 94886 - DNA, 22 bp, Homo sapiens
tctgttgactcctagcagccat

SEQ ID NO: 94887 - DNA, 22 bp, Homo sapiens
ctggagggctgcagcgaggctg

SEQ ID NO: 94888 - DNA, 22 bp, Homo sapiens
cctgagtagctggaattaaagg

SEQ ID NO: 94889 - DNA, 21 bp, Homo sapiens
cccgcacagcggtaggccgcc

SEQ ID NO: 94890 - DNA, 22 bp, Homo sapiens
tctcccaagcctggcaggggca

SEQ ID NO: 94891 - DNA, 22 bp, Homo sapiens
tgggcagggagctggaaccaca

SEQ ID NO: 94892 - DNA, 22 bp, Homo sapiens
gctagtgcagggaaatctttgg

SEQ ID NO: 94893 - DNA, 22 bp, Homo sapiens
ggctgggctccgggagcatgcg

SEQ ID NO: 94894 - DNA, 22 bp, Homo sapiens
gaggttggggctgcagtgagct

SEQ ID NO: 94895 - DNA, 22 bp, Homo sapiens
tgagatggagccactgcactct

SEQ ID NO: 94896 - DNA, 19 bp, Homo sapiens
cccaggaagcggaggttgc

SEQ ID NO: 94897 - DNA, 22 bp, Homo sapiens
tcacccaggctggactgcagtg

SEQ ID NO: 94898 - DNA, 22 bp, Homo sapiens
ttgggctcaggagtttgagacc

SEQ ID NO: 94899 - DNA, 22 bp, Homo sapiens
ctatacagcagcttactagtta

SEQ ID NO: 94900 - DNA, 22 bp, Homo sapiens
ttccctccatttcattttataa

SEQ ID NO: 94901 - DNA, 22 bp, Homo sapiens
gctcttgtcaaaaattagttga

SEQ ID NO: 94902 - DNA, 21 bp, Homo sapiens
gaacccagcagcagtgctctg

SEQ ID NO: 94903 - DNA, 19 bp, Homo sapiens
aggaatggaattaattctg

SEQ ID NO: 94904 - DNA, 22 bp, Homo sapiens
gtctcttgttatcatttctgag

SEQ ID NO: 94905 - DNA, 22 bp, Homo sapiens
ggggaaagccagccctgcttcc

SEQ ID NO: 94906 - DNA, 22 bp, Homo sapiens
cagccccacacggtctagctct

SEQ ID NO: 94907 - DNA, 22 bp, Homo sapiens
tcttcccccgtgctccagtgca

SEQ ID NO: 94908 - DNA, 20 bp, Homo sapiens
tttctgtgagaaacactgtt

SEQ ID NO: 94909 - DNA, 22 bp, Homo sapiens
tgacttgtctctttgggagaca

SEQ ID NO: 94910 - DNA, 22 bp, Homo sapiens
gagcctggagctggaacgaagc

SEQ ID NO: 94911 - DNA, 22 bp, Homo sapiens
aaaatatgtataactcttctgc

SEQ ID NO: 94912 - DNA, 22 bp, Homo sapiens
actatagatgctggcgaggctg

SEQ ID NO: 94913 - DNA, 21 bp, Homo sapiens
caatggcgagatcttggctca

SEQ ID NO: 94914 - DNA, 22 bp, Homo sapiens
atgccacttcattccagcctcg

SEQ ID NO: 94915 - DNA, 22 bp, Homo sapiens
tgtgttcagaatttgctgcttt

SEQ ID NO: 94916 - DNA, 22 bp, Homo sapiens
caggctgctgcctagaatgaca

SEQ ID NO: 94917 - DNA, 22 bp, Homo sapiens
actggacagaggaaatatggag

SEQ ID NO: 94918 - DNA, 22 bp, Homo sapiens
actcaagtcataggcttctttc

SEQ ID NO: 94919 - DNA, 22 bp, Homo sapiens
atacaaaaattagccgggagta

SEQ ID NO: 94920 - DNA, 22 bp, Homo sapiens
ttcccagtcaaacgaaggactt

SEQ ID NO: 94921 - DNA, 22 bp, Homo sapiens
aacccaggagacaggttgcagt

SEQ ID NO: 94922 - DNA, 22 bp, Homo sapiens
cctcccctcagacagagactgg

SEQ ID NO: 94923 - DNA, 21 bp, Homo sapiens
atgtagggtttgccttctcta

SEQ ID NO: 94924 - DNA, 22 bp, Homo sapiens
gcgagtgccgagagggcagggc

SEQ ID NO: 94925 - DNA, 22 bp, Homo sapiens
caggctggagtgcagtggtgcc

SEQ ID NO: 94926 - DNA, 22 bp, Homo sapiens
caaaatgcatctgagaccaggc

SEQ ID NO: 94927 - DNA, 22 bp, Homo sapiens
atgtacataaaatgtataatga

SEQ ID NO: 94928 - DNA, 22 bp, Homo sapiens
cgggcagtgtggctccagagtc

SEQ ID NO: 94929 - DNA, 22 bp, Homo sapiens
aggcgaagggaccagacggtag

SEQ ID NO: 94930 - DNA, 22 bp, Homo sapiens
atattacacacggtatcacggg

SEQ ID NO: 94931 - DNA, 22 bp, Homo sapiens
ccggaggaggacgagcccgcgg

SEQ ID NO: 94932 - DNA, 22 bp, Homo sapiens
aaagcagaggttgcagtgagct

SEQ ID NO: 94933 - DNA, 22 bp, Homo sapiens
catgtgtccacccttgaacaca

SEQ ID NO: 94934 - DNA, 22 bp, Homo sapiens
ttttggctctgtctgtatcttt

SEQ ID NO: 94935 - DNA, 22 bp, Homo sapiens
ttttccttcatatcccttatgt

SEQ ID NO: 94936 - DNA, 22 bp, Homo sapiens
cagtggcgtgatctctgctcac

SEQ ID NO: 94937 - DNA, 22 bp, Homo sapiens
acaaagccagattctggagcac

SEQ ID NO: 94938 - DNA, 22 bp, Homo sapiens
ctgggaggcggagcttgcagtg

SEQ ID NO: 94939 - DNA, 22 bp, Homo sapiens
gaggtggatgttgcagtgagct

SEQ ID NO: 94940 - DNA, 22 bp, Homo sapiens
ctctgtggtggagtgggtcacc

SEQ ID NO: 94941 - DNA, 22 bp, Homo sapiens
agtacccttttcactgtcacaa

SEQ ID NO: 94942 - DNA, 22 bp, Homo sapiens
agccagggacgctgcaggctac

SEQ ID NO: 94943 - DNA, 22 bp, Homo sapiens
atgaccagccgagataaacaga

SEQ ID NO: 94944 - DNA, 22 bp, Homo sapiens
tcacatctaattccatttctgc

SEQ ID NO: 94945 - DNA, 22 bp, Homo sapiens
atttattcctttatggctggag

SEQ ID NO: 94946 - DNA, 19 bp, Homo sapiens
tctcacagctctactatgt

SEQ ID NO: 94947 - DNA, 22 bp, Homo sapiens
gagatggagtctttttctgtca

SEQ ID NO: 94948 - DNA, 22 bp, Homo sapiens
atgcacacgtaccctacaaggc

SEQ ID NO: 94949 - DNA, 22 bp, Homo sapiens
cttagatgaagtcacagaaccc

SEQ ID NO: 94950 - DNA, 22 bp, Homo sapiens
gaggacaagctgtgagtggggt

SEQ ID NO: 94951 - DNA, 22 bp, Homo sapiens
acacggcactttaggaaggggc

SEQ ID NO: 94952 - DNA, 22 bp, Homo sapiens
cccagcaggtcggtgctgcctg

SEQ ID NO: 94953 - DNA, 22 bp, Homo sapiens
gggacaatggaggcctctctcc

SEQ ID NO: 94954 - DNA, 22 bp, Homo sapiens
cctacggaggacaggttagcca

SEQ ID NO: 94955 - DNA, 19 bp, Homo sapiens
gctggatggatcctggagt

SEQ ID NO: 94956 - DNA, 22 bp, Homo sapiens
cggaagagggacagcgccagcc

SEQ ID NO: 94957 - DNA, 22 bp, Homo sapiens
cccaactactctcaggcagctt

SEQ ID NO: 94958 - DNA, 22 bp, Homo sapiens
cactgcactccagcctcggtga

SEQ ID NO: 94959 - DNA, 22 bp, Homo sapiens
aaggctgagacagcacaggtcc

SEQ ID NO: 94960 - DNA, 22 bp, Homo sapiens
gccctccagcctgtggaaccgg

SEQ ID NO: 94961 - DNA, 22 bp, Homo sapiens
actgggaagtcagagagaggct

SEQ ID NO: 94962 - DNA, 22 bp, Homo sapiens
aggtgcccatgagctccatggc

SEQ ID NO: 94963 - DNA, 22 bp, Homo sapiens
agcaagattgaggcttcctcag

SEQ ID NO: 94964 - DNA, 22 bp, Homo sapiens
ggaatgaatttccagctgggtc

SEQ ID NO: 94965 - DNA, 22 bp, Homo sapiens
agctagtatttcattgaggatt

SEQ ID NO: 94966 - DNA, 22 bp, Homo sapiens
ttgacctatgtttcttcatctg

SEQ ID NO: 94967 - DNA, 22 bp, Homo sapiens
tgagatggagtctcgctctgtt

SEQ ID NO: 94968 - DNA, 22 bp, Homo sapiens
gaccagtcattactcatgccct

SEQ ID NO: 94969 - DNA, 22 bp, Homo sapiens
ttgctctgactggagtgcagtg

SEQ ID NO: 94970 - DNA, 22 bp, Homo sapiens
ctgggcacagcgttgggctctt

SEQ ID NO: 94971 - DNA, 22 bp, Homo sapiens
agcatgcgcttgatcagctcca

SEQ ID NO: 94972 - DNA, 22 bp, Homo sapiens
tatttaataaaactatggcatg

SEQ ID NO: 94973 - DNA, 22 bp, Homo sapiens
gctgtgtatcagatgccacggg

SEQ ID NO: 94974 - DNA, 22 bp, Homo sapiens
gtcgtggagctcacagtgtgcc

SEQ ID NO: 94975 - DNA, 22 bp, Homo sapiens
ggtttgacagcttggggctgtc

SEQ ID NO: 94976 - DNA, 22 bp, Homo sapiens
taggctgggaagaaagattctc

SEQ ID NO: 94977 - DNA, 22 bp, Homo sapiens
tgtgagttattttcaggagttt

SEQ ID NO: 94978 - DNA, 22 bp, Homo sapiens
cacagacagtgtccctttgttg

SEQ ID NO: 94979 - DNA, 22 bp, Homo sapiens
tatttccttgagacggagtctc

SEQ ID NO: 94980 - DNA, 22 bp, Homo sapiens
tgggaagaggagcactggaatg

SEQ ID NO: 94981 - DNA, 22 bp, Homo sapiens
gtgtgtcccttggaacctcagc

SEQ ID NO: 94982 - DNA, 22 bp, Homo sapiens
gcgtctcaaggcccccaggcca

SEQ ID NO: 94983 - DNA, 22 bp, Homo sapiens
gattcactcatattttacgttt

SEQ ID NO: 94984 - DNA, 22 bp, Homo sapiens
acgatgatgaaagagaacattc

SEQ ID NO: 94985 - DNA, 21 bp, Homo sapiens
ctggccactgcacctcttcct

SEQ ID NO: 94986 - DNA, 19 bp, Homo sapiens
taccatccaagctggtttg

SEQ ID NO: 94987 - DNA, 22 bp, Homo sapiens
acgcccagactcccatactttg

SEQ ID NO: 94988 - DNA, 22 bp, Homo sapiens
ctgggaggcggaggttgcagtg

SEQ ID NO: 94989 - DNA, 22 bp, Homo sapiens
tgtcagtgtctatgaagaattt

SEQ ID NO: 94990 - DNA, 22 bp, Homo sapiens
ttctccgctaagttctctgcag

SEQ ID NO: 94991 - DNA, 20 bp, Homo sapiens
ataaaataactgccacaaga

SEQ ID NO: 94992 - DNA, 19 bp, Homo sapiens
tgagggtgagctttggaga

SEQ ID NO: 94993 - DNA, 19 bp, Homo sapiens
acacagggatcagagggtt

SEQ ID NO: 94994 - DNA, 22 bp, Homo sapiens
gggcatggtggcaggcacctgt

SEQ ID NO: 94995 - DNA, 22 bp, Homo sapiens
tttcttctatgtgtgatatttt

SEQ ID NO: 94996 - DNA, 19 bp, Homo sapiens
agcggttctcaaagtcagg

SEQ ID NO: 94997 - DNA, 22 bp, Homo sapiens
aacagctttgtatacagtaact

SEQ ID NO: 94998 - DNA, 22 bp, Homo sapiens
gctcactgcaacctccgccttc

SEQ ID NO: 94999 - DNA, 20 bp, Homo sapiens
tgtcttccagcaggtgttta

SEQ ID NO: 95000 - DNA, 22 bp, Homo sapiens
agatgtgtttctagttcctgca

SEQ ID NO: 95001 - DNA, 22 bp, Homo sapiens
tcctcagcttttatttcacttg

SEQ ID NO: 95002 - DNA, 21 bp, Homo sapiens
gccatttcacacagacatttg

SEQ ID NO: 95003 - DNA, 22 bp, Homo sapiens
ccttttatagatcagtgtgtta

SEQ ID NO: 95004 - DNA, 17 bp, Homo sapiens
tggctctgtcctcagct

SEQ ID NO: 95005 - DNA, 22 bp, Homo sapiens
gggagctgagctggaagagaat

SEQ ID NO: 95006 - DNA, 22 bp, Homo sapiens
gggcagagagctggaactcctt

SEQ ID NO: 95007 - DNA, 22 bp, Homo sapiens
gttgaggagcaagcatgtgtct

SEQ ID NO: 95008 - DNA, 22 bp, Homo sapiens
ccacagtcctggcttctgtctg

SEQ ID NO: 95009 - DNA, 22 bp, Homo sapiens
aaaatcctgctgactcgagatg

SEQ ID NO: 95010 - DNA, 22 bp, Homo sapiens
agttattactctttaacatatt

SEQ ID NO: 95011 - DNA, 22 bp, Homo sapiens
cttgcctttgtcttcaaaggct

SEQ ID NO: 95012 - DNA, 22 bp, Homo sapiens
gggaggttgaggctgcagtgag

SEQ ID NO: 95013 - DNA, 22 bp, Homo sapiens
ttggagtgacagatgaggaaac

SEQ ID NO: 95014 - DNA, 22 bp, Homo sapiens
ccccaggacgtggccctcatag

SEQ ID NO: 95015 - DNA, 22 bp, Homo sapiens
ataaaaactgacccatcctttg

SEQ ID NO: 95016 - DNA, 22 bp, Homo sapiens
agatgtttataactcatgagtg

SEQ ID NO: 95017 - DNA, 22 bp, Homo sapiens
ttatttttaaaagttcacacag

SEQ ID NO: 95018 - DNA, 22 bp, Homo sapiens
gtgtgacctcatcttaactgga

SEQ ID NO: 95019 - DNA, 22 bp, Homo sapiens
ggccagcctggggctcccagac

SEQ ID NO: 95020 - DNA, 22 bp, Homo sapiens
aacccgggaggcggaggttgtg

SEQ ID NO: 95021 - DNA, 22 bp, Homo sapiens
tacgcctgtaatcccagcactt

SEQ ID NO: 95022 - DNA, 22 bp, Homo sapiens
agatttatgtggtcacactcag

SEQ ID NO: 95023 - DNA, 22 bp, Homo sapiens
ggaggtggagctggaagttcca

SEQ ID NO: 95024 - DNA, 22 bp, Homo sapiens
gctgggctgcgtcggggaagcc

SEQ ID NO: 95025 - DNA, 22 bp, Homo sapiens
agggccagcactcctggcagga

SEQ ID NO: 95026 - DNA, 22 bp, Homo sapiens
ttctgattgctgatgaggccca

SEQ ID NO: 95027 - DNA, 22 bp, Homo sapiens
caggaattcatagcattgttct

SEQ ID NO: 95028 - DNA, 22 bp, Homo sapiens
tggtatttctgtgcccagctca

SEQ ID NO: 95029 - DNA, 22 bp, Homo sapiens
aagaggtttaactgactcacag

SEQ ID NO: 95030 - DNA, 22 bp, Homo sapiens
tcgtgaggctctgcatcgcaca

SEQ ID NO: 95031 - DNA, 22 bp, Homo sapiens
tccttttgagctcctatgtggg

SEQ ID NO: 95032 - DNA, 22 bp, Homo sapiens
agctggtgtgccagttccagtt

SEQ ID NO: 95033 - DNA, 22 bp, Homo sapiens
gtggttgtttccaggtttgaaa

SEQ ID NO: 95034 - DNA, 22 bp, Homo sapiens
aaagttctctatggtgtaaaaa

SEQ ID NO: 95035 - DNA, 19 bp, Homo sapiens
atgtacccagtgtcaatcc

SEQ ID NO: 95036 - DNA, 17 bp, Homo sapiens
aatctgtttacagtcag

SEQ ID NO: 95037 - DNA, 22 bp, Homo sapiens
accatgtcatttattggccaaa

SEQ ID NO: 95038 - DNA, 22 bp, Homo sapiens
agacgctattttgaggggtcta

SEQ ID NO: 95039 - DNA, 22 bp, Homo sapiens
agcattccacactgaagtctgc

SEQ ID NO: 95040 - DNA, 22 bp, Homo sapiens
gcccagccacagtcactttcat

SEQ ID NO: 95041 - DNA, 22 bp, Homo sapiens
tcgcaccattgcactccagcca

SEQ ID NO: 95042 - DNA, 22 bp, Homo sapiens
agaggaagtaatcaggacctgc

SEQ ID NO: 95043 - DNA, 22 bp, Homo sapiens
ctgaaggatgtgtggtgggagt

SEQ ID NO: 95044 - DNA, 22 bp, Homo sapiens
ccattgtaaattctgtggaagt

SEQ ID NO: 95045 - DNA, 22 bp, Homo sapiens
gctgaaggcccggaggacaggg

SEQ ID NO: 95046 - DNA, 22 bp, Homo sapiens
ctcgcatccaggataccctgag

SEQ ID NO: 95047 - DNA, 22 bp, Homo sapiens
gctcatgactgtaatcccagca

SEQ ID NO: 95048 - DNA, 22 bp, Homo sapiens
accctcaagatggaagcagttt

SEQ ID NO: 95049 - DNA, 22 bp, Homo sapiens
taggcaagtggaccagaggttt

SEQ ID NO: 95050 - DNA, 22 bp, Homo sapiens
ctgagctcaagcgatcctccca

SEQ ID NO: 95051 - DNA, 22 bp, Homo sapiens
aggtagaaggaccagaatttat

SEQ ID NO: 95052 - DNA, 22 bp, Homo sapiens
taggtttaggagtgaaggtgaa

SEQ ID NO: 95053 - DNA, 22 bp, Homo sapiens
agcccaggttgaggctgcagtg

SEQ ID NO: 95054 - DNA, 19 bp, Homo sapiens
tctgccgagctagaccact

SEQ ID NO: 95055 - DNA, 22 bp, Homo sapiens
taacatttaaatttttcacata

SEQ ID NO: 95056 - DNA, 22 bp, Homo sapiens
cagctgctgttcagttttgttt

SEQ ID NO: 95057 - DNA, 22 bp, Homo sapiens
tgagatgtaaggtatgcttact

SEQ ID NO: 95058 - DNA, 23 bp, Homo sapiens
ctgagcaaagggggaagctgctt

SEQ ID NO: 95059 - DNA, 22 bp, Homo sapiens
ccaggtgtgctctgcagtggat

SEQ ID NO: 95060 - DNA, 22 bp, Homo sapiens
tctaatccttgctacctgggtg

SEQ ID NO: 95061 - DNA, 22 bp, Homo sapiens
ctcagccccagcccagatagca

SEQ ID NO: 95062 - DNA, 22 bp, Homo sapiens
taactctgaatcctcacagcag

SEQ ID NO: 95063 - DNA, 22 bp, Homo sapiens
ctagggtgtgcagattttgcct

SEQ ID NO: 95064 - DNA, 22 bp, Homo sapiens
tggtattacttctagacacaag

SEQ ID NO: 95065 - DNA, 22 bp, Homo sapiens
caggctggagttcagtggtgtg

SEQ ID NO: 95066 - DNA, 22 bp, Homo sapiens
cctagatgggatggcggccggg

SEQ ID NO: 95067 - DNA, 21 bp, Homo sapiens
ttgttcctatctgcctcctgc

SEQ ID NO: 95068 - DNA, 22 bp, Homo sapiens
gaaggtggcgagcggattgctg

SEQ ID NO: 95069 - DNA, 22 bp, Homo sapiens
ggcagagcttgcagtgagccga

SEQ ID NO: 95070 - DNA, 22 bp, Homo sapiens
ctgccaggattctgtgaacccc

SEQ ID NO: 95071 - DNA, 22 bp, Homo sapiens
atgccactgcacttcagcctgg

SEQ ID NO: 95072 - DNA, 22 bp, Homo sapiens
cactgcagcctctgcctctcag

SEQ ID NO: 95073 - DNA, 22 bp, Homo sapiens
ctattgtttctatgctctgagg

SEQ ID NO: 95074 - DNA, 22 bp, Homo sapiens
agcctgcgatcccacctggcct

SEQ ID NO: 95075 - DNA, 22 bp, Homo sapiens
tcgcccaggctggaagtgcagt

SEQ ID NO: 95076 - DNA, 22 bp, Homo sapiens
ctgctgagccgcacccaggagc

SEQ ID NO: 95077 - DNA, 22 bp, Homo sapiens
tgtacacatggtgtacactccc

SEQ ID NO: 95078 - DNA, 22 bp, Homo sapiens
tttgaagactactgggagtgaa

SEQ ID NO: 95079 - DNA, 22 bp, Homo sapiens
ggagagcttggagtgcgatttt

SEQ ID NO: 95080 - DNA, 20 bp, Homo sapiens
aactcctagcctcaagtgat

SEQ ID NO: 95081 - DNA, 21 bp, Homo sapiens
accctgctttatgccgtcctc

SEQ ID NO: 95082 - DNA, 22 bp, Homo sapiens
cagagctgtccaaaccctgaca

SEQ ID NO: 95083 - DNA, 23 bp, Homo sapiens
gacagagtgagaccttgtcttac

SEQ ID NO: 95084 - DNA, 22 bp, Homo sapiens
ccaaagtgctaggattacaggc

SEQ ID NO: 95085 - DNA, 22 bp, Homo sapiens
gagcccaggagtttgatgctgc

SEQ ID NO: 95086 - DNA, 22 bp, Homo sapiens
agtgcaggccccaggccaggcc

SEQ ID NO: 95087 - DNA, 22 bp, Homo sapiens
catgatctggtcctactgtggg

SEQ ID NO: 95088 - DNA, 22 bp, Homo sapiens
gtatagaaacccagaaagatag

SEQ ID NO: 95089 - DNA, 22 bp, Homo sapiens
agcgctgtgggcgtgcgaggag

SEQ ID NO: 95090 - DNA, 22 bp, Homo sapiens
aggcaagggggcgccaccttcc

SEQ ID NO: 95091 - DNA, 22 bp, Homo sapiens
gtgggccagcttttctcctggg

SEQ ID NO: 95092 - DNA, 22 bp, Homo sapiens
aggagctgtcagagtgccagag

SEQ ID NO: 95093 - DNA, 22 bp, Homo sapiens
taccagggaacagggatattaa

SEQ ID NO: 95094 - DNA, 22 bp, Homo sapiens
tctgcgcgctgctggtaccgaa

SEQ ID NO: 95095 - DNA, 22 bp, Homo sapiens
tgacagaggagctggaatgatt

SEQ ID NO: 95096 - DNA, 22 bp, Homo sapiens
gggcggatcacctgaggtcagg

SEQ ID NO: 95097 - DNA, 22 bp, Homo sapiens
ctccagttggccccagttggtt

SEQ ID NO: 95098 - DNA, 19 bp, Homo sapiens
ttcagcattatattctagc

SEQ ID NO: 95099 - DNA, 22 bp, Homo sapiens
cagtgcacgggccagtcctgcc

SEQ ID NO: 95100 - DNA, 22 bp, Homo sapiens
ctcccagccttcgccagtctga

SEQ ID NO: 95101 - DNA, 22 bp, Homo sapiens
gccaggacctcagatgcagggc

SEQ ID NO: 95102 - DNA, 22 bp, Homo sapiens
aacccgggaggtggaggttatg

SEQ ID NO: 95103 - DNA, 19 bp, Homo sapiens
gactccaactttaagcatg

SEQ ID NO: 95104 - DNA, 22 bp, Homo sapiens
cccacgtcgaacttgctccaga

SEQ ID NO: 95105 - DNA, 22 bp, Homo sapiens
tttattctgtgctacatgaaga

SEQ ID NO: 95106 - DNA, 22 bp, Homo sapiens
aaaagtcttggggaaggccagg

SEQ ID NO: 95107 - DNA, 22 bp, Homo sapiens
atagagtgatgtaaggtatgtg

SEQ ID NO: 95108 - DNA, 18 bp, Homo sapiens
tgtccctgcaaataacat

SEQ ID NO: 95109 - DNA, 22 bp, Homo sapiens
gttcaagaccagcctggccaac

SEQ ID NO: 95110 - DNA, 22 bp, Homo sapiens
ctgagccaaggggacagtgaca

SEQ ID NO: 95111 - DNA, 22 bp, Homo sapiens
ttgagatggagtcttgctctct

SEQ ID NO: 95112 - DNA, 22 bp, Homo sapiens
agcctagggttctgatgtcact

SEQ ID NO: 95113 - DNA, 22 bp, Homo sapiens
tgagatggagtctcactctgtt

SEQ ID NO: 95114 - DNA, 19 bp, Homo sapiens
tcctgcctggggccgcctg

SEQ ID NO: 95115 - DNA, 22 bp, Homo sapiens
cctggctgacagcttaattcca

SEQ ID NO: 95116 - DNA, 22 bp, Homo sapiens
ggatgcacgaaggcgcctcgga

SEQ ID NO: 95117 - DNA, 22 bp, Homo sapiens
atcctagaatcagcccttgctg

SEQ ID NO: 95118 - DNA, 22 bp, Homo sapiens
ggtgtgtctgccaggaactgca

SEQ ID NO: 95119 - DNA, 22 bp, Homo sapiens
ggggaaggaaagttattagcag

SEQ ID NO: 95120 - DNA, 22 bp, Homo sapiens
attataggcttgagccaccgtg

SEQ ID NO: 95121 - DNA, 22 bp, Homo sapiens
acagagcaataacagggagagg

SEQ ID NO: 95122 - DNA, 22 bp, Homo sapiens
gctgctctccaagcctccttga

SEQ ID NO: 95123 - DNA, 22 bp, Homo sapiens
cctgacaggcggaggctgcagt

SEQ ID NO: 95124 - DNA, 22 bp, Homo sapiens
ttgcccagagtcacccagctca

SEQ ID NO: 95125 - DNA, 22 bp, Homo sapiens
ccggctactcgggaggctgacg

SEQ ID NO: 95126 - DNA, 22 bp, Homo sapiens
ttcctagggcagagccgctggg

SEQ ID NO: 95127 - DNA, 22 bp, Homo sapiens
gggctagcctcttccctgctcc

SEQ ID NO: 95128 - DNA, 23 bp, Homo sapiens
ggagtgcaatggcgccatctcgg

SEQ ID NO: 95129 - DNA, 22 bp, Homo sapiens
ggtccccgtggaggctggagcg

SEQ ID NO: 95130 - DNA, 22 bp, Homo sapiens
gtgttaaccagctaaactttgc

SEQ ID NO: 95131 - DNA, 22 bp, Homo sapiens
ggcttgaagggaggaaagcagg

SEQ ID NO: 95132 - DNA, 22 bp, Homo sapiens
gctcgtacaccagcgtggaggt

SEQ ID NO: 95133 - DNA, 22 bp, Homo sapiens
cacccaggctggagagcagtgg

SEQ ID NO: 95134 - DNA, 22 bp, Homo sapiens
cactgcactccagcctgggaga

SEQ ID NO: 95135 - DNA, 22 bp, Homo sapiens
gtatccatgggggattggttcc

SEQ ID NO: 95136 - DNA, 22 bp, Homo sapiens
gctcactgcaagctccgcctcc

SEQ ID NO: 95137 - DNA, 22 bp, Homo sapiens
ctgggtggcagagcctgcagtg

SEQ ID NO: 95138 - DNA, 22 bp, Homo sapiens
gtcgtggtcagacaccagaaaa

SEQ ID NO: 95139 - DNA, 22 bp, Homo sapiens
aacctcaaactcttgggcttaa

SEQ ID NO: 95140 - DNA, 22 bp, Homo sapiens
gctcactgcctgggcaacaaga

SEQ ID NO: 95141 - DNA, 22 bp, Homo sapiens
gagctactgaaatattgatttt

SEQ ID NO: 95142 - DNA, 22 bp, Homo sapiens
acaattctgatggtttcccagt

SEQ ID NO: 95143 - DNA, 22 bp, Homo sapiens
aggggatgcctagtggagtctc

SEQ ID NO: 95144 - DNA, 22 bp, Homo sapiens
ttgatgagaccattgccgcgtc

SEQ ID NO: 95145 - DNA, 22 bp, Homo sapiens
acacagggctgcgcctgacccc

SEQ ID NO: 95146 - DNA, 22 bp, Homo sapiens
gggcaggggtcagtggccccaa

SEQ ID NO: 95147 - DNA, 22 bp, Homo sapiens
caggctggagtgcagtggggcg

SEQ ID NO: 95148 - DNA, 22 bp, Homo sapiens
gtgtgtccaaggcacggatgac

SEQ ID NO: 95149 - DNA, 20 bp, Homo sapiens
gctgaggggtctatggcata

SEQ ID NO: 95150 - DNA, 22 bp, Homo sapiens
gctgatagactgaatgttggga

SEQ ID NO: 95151 - DNA, 22 bp, Homo sapiens
actgcacttcagcctgggtgtc

SEQ ID NO: 95152 - DNA, 22 bp, Homo sapiens
agggtgaatctcacaactctta

SEQ ID NO: 95153 - DNA, 19 bp, Homo sapiens
ccctcttgcacaaagcaaa

SEQ ID NO: 95154 - DNA, 22 bp, Homo sapiens
tgtagctctccagccagcaagg

SEQ ID NO: 95155 - DNA, 22 bp, Homo sapiens
ccaggctgctgttggtgtccgc

SEQ ID NO: 95156 - DNA, 22 bp, Homo sapiens
ctgctaaacctctctgagagct

SEQ ID NO: 95157 - DNA, 22 bp, Homo sapiens
gaggccacggaagggagctgtg

SEQ ID NO: 95158 - DNA, 21 bp, Homo sapiens
aggcttggatctagacaggcc

SEQ ID NO: 95159 - DNA, 22 bp, Homo sapiens
tggaaaactttggtggtgaggg

SEQ ID NO: 95160 - DNA, 22 bp, Homo sapiens
ctggctgggagcgagctgctca

SEQ ID NO: 95161 - DNA, 22 bp, Homo sapiens
ttggaatgcacactgagcctgc

SEQ ID NO: 95162 - DNA, 22 bp, Homo sapiens
ggaagtcctcatacctgattct

SEQ ID NO: 95163 - DNA, 22 bp, Homo sapiens
tgggaaagtctttatttctctt

SEQ ID NO: 95164 - DNA, 21 bp, Homo sapiens
cagaggcctatcacagactcc

SEQ ID NO: 95165 - DNA, 22 bp, Homo sapiens
gggaggttctgttcgcacttga

SEQ ID NO: 95166 - DNA, 22 bp, Homo sapiens
atggagttctgccagcgctgct

SEQ ID NO: 95167 - DNA, 22 bp, Homo sapiens
tttacttcatttccagtgagga

SEQ ID NO: 95168 - DNA, 22 bp, Homo sapiens
attgtggtgtcagttataggca

SEQ ID NO: 95169 - DNA, 22 bp, Homo sapiens
attcttcctcatcaatctgtag

SEQ ID NO: 95170 - DNA, 21 bp, Homo sapiens
tctgatggtagatgagatgtg

SEQ ID NO: 95171 - DNA, 22 bp, Homo sapiens
tggagttggccgcccggaccga

SEQ ID NO: 95172 - DNA, 22 bp, Homo sapiens
cttctgagatgttgttttacag

SEQ ID NO: 95173 - DNA, 22 bp, Homo sapiens
cagctggcgactctcctcgatg

SEQ ID NO: 95174 - DNA, 22 bp, Homo sapiens
aaaaagtattggccatggttga

SEQ ID NO: 95175 - DNA, 22 bp, Homo sapiens
tgcctagttctgtatttacagt

SEQ ID NO: 95176 - DNA, 22 bp, Homo sapiens
agaaaacataggagacaggaaa

SEQ ID NO: 95177 - DNA, 22 bp, Homo sapiens
actttaaaactgatcatcagag

SEQ ID NO: 95178 - DNA, 23 bp, Homo sapiens
agagtgcagagatatgcttgtgt

SEQ ID NO: 95179 - DNA, 22 bp, Homo sapiens
ttgtaacaggtactaaataact

SEQ ID NO: 95180 - DNA, 20 bp, Homo sapiens
tttgagaccagtctgcccaa

SEQ ID NO: 95181 - DNA, 16 bp, Homo sapiens
tgcggcaacttgcggc

SEQ ID NO: 95182 - DNA, 22 bp, Homo sapiens
ggccactgctctccagcctggg

SEQ ID NO: 95183 - DNA, 22 bp, Homo sapiens
ggaggagcatgagagggtagtg

SEQ ID NO: 95184 - DNA, 22 bp, Homo sapiens
cagtggctggttagggacagga

SEQ ID NO: 95185 - DNA, 22 bp, Homo sapiens
gaaggaagtcattagtgcagac

SEQ ID NO: 95186 - DNA, 21 bp, Homo sapiens
cgcagagcgaacttgcggcgc

SEQ ID NO: 95187 - DNA, 22 bp, Homo sapiens
gtggattacaagacagttgaga

SEQ ID NO: 95188 - DNA, 22 bp, Homo sapiens
tgtacttgaacttgactgtaga

SEQ ID NO: 95189 - DNA, 22 bp, Homo sapiens
gccagcagcttcttctcatcct

SEQ ID NO: 95190 - DNA, 22 bp, Homo sapiens
gacaattagatcattcctttga

SEQ ID NO: 95191 - DNA, 22 bp, Homo sapiens
ttcacagcttaataaggctcag

SEQ ID NO: 95192 - DNA, 22 bp, Homo sapiens
caggaggacatactggctcaca

SEQ ID NO: 95193 - DNA, 22 bp, Homo sapiens
gtggttttattcgttcctctgt

SEQ ID NO: 95194 - DNA, 22 bp, Homo sapiens
aaagcagaactgagagagctgg

SEQ ID NO: 95195 - DNA, 22 bp, Homo sapiens
actgccaatggtagtttgatgg

SEQ ID NO: 95196 - DNA, 22 bp, Homo sapiens
gcccagagttcaaggctgcagt

SEQ ID NO: 95197 - DNA, 22 bp, Homo sapiens
gctggctgacagatttggggtg

SEQ ID NO: 95198 - DNA, 22 bp, Homo sapiens
gctcactgcaacctccacctcc

SEQ ID NO: 95199 - DNA, 22 bp, Homo sapiens
taaatacttagttttgtgtcta

SEQ ID NO: 95200 - DNA, 22 bp, Homo sapiens
caggagctcaagaccaccctgg

SEQ ID NO: 95201 - DNA, 22 bp, Homo sapiens
aggagccgggcctgggccctgc

SEQ ID NO: 95202 - DNA, 22 bp, Homo sapiens
tgtagtagcattcacgaagtgt

SEQ ID NO: 95203 - DNA, 22 bp, Homo sapiens
gggaagtgatggagccaggatt

SEQ ID NO: 95204 - DNA, 16 bp, Homo sapiens
gcgcctcctcggcctc

SEQ ID NO: 95205 - DNA, 20 bp, Homo sapiens
gtctccactgggggttaacc

SEQ ID NO: 95206 - DNA, 22 bp, Homo sapiens
gtgggcggggcctctcaagctg

SEQ ID NO: 95207 - DNA, 22 bp, Homo sapiens
tgagtggacacctgcttcttta

SEQ ID NO: 95208 - DNA, 23 bp, Homo sapiens
gttttacaggtgagaaaatggag

SEQ ID NO: 95209 - DNA, 22 bp, Homo sapiens
ttattgaaggaactgaaataaa

SEQ ID NO: 95210 - DNA, 22 bp, Homo sapiens
aggacaaaggaccagatctgga

SEQ ID NO: 95211 - DNA, 22 bp, Homo sapiens
gcaggcaggcttccttgaactg

SEQ ID NO: 95212 - DNA, 22 bp, Homo sapiens
cctggagagctcgggccaggca

SEQ ID NO: 95213 - DNA, 22 bp, Homo sapiens
ggcagggcaggaaagtcaggaa

SEQ ID NO: 95214 - DNA, 22 bp, Homo sapiens
ggttcagagcctgcccagtata

SEQ ID NO: 95215 - DNA, 22 bp, Homo sapiens
tgacatgtatatcttacgctat

SEQ ID NO: 95216 - DNA, 22 bp, Homo sapiens
agggaagaggaccagagtctct

SEQ ID NO: 95217 - DNA, 22 bp, Homo sapiens
actgcactccaacctgggtgac

SEQ ID NO: 95218 - DNA, 22 bp, Homo sapiens
cagtggaggccttgggaccttt

SEQ ID NO: 95219 - DNA, 22 bp, Homo sapiens
gatgatcatctgtaaagttaga

SEQ ID NO: 95220 - DNA, 22 bp, Homo sapiens
aggggatggagctggaaggcag

SEQ ID NO: 95221 - DNA, 22 bp, Homo sapiens
gtggagaggaacccagctctgt

SEQ ID NO: 95222 - DNA, 22 bp, Homo sapiens
tgctgagcttccactgcttctg

SEQ ID NO: 95223 - DNA, 22 bp, Homo sapiens
cacgcacgctgggtggaggcgc

SEQ ID NO: 95224 - DNA, 22 bp, Homo sapiens
agcttgtagaaggccacgagca

SEQ ID NO: 95225 - DNA, 22 bp, Homo sapiens
aaggggaagagaccgcagagtc

SEQ ID NO: 95226 - DNA, 22 bp, Homo sapiens
ccaaagaaacccaagctcaggg

SEQ ID NO: 95227 - DNA, 22 bp, Homo sapiens
atacaaaatatatactggagac

SEQ ID NO: 95228 - DNA, 22 bp, Homo sapiens
agagcagctcgctacctctcta

SEQ ID NO: 95229 - DNA, 22 bp, Homo sapiens
gcttggccagcagccgggatgc

SEQ ID NO: 95230 - DNA, 22 bp, Homo sapiens
ttactttaagggtgtcttatta

SEQ ID NO: 95231 - DNA, 22 bp, Homo sapiens
ttatttaaaagtggtaagattc

SEQ ID NO: 95232 - DNA, 22 bp, Homo sapiens
ggcctcttatctggctcctgca

SEQ ID NO: 95233 - DNA, 22 bp, Homo sapiens
ggaggctgaggcaggcggatca

SEQ ID NO: 95234 - DNA, 22 bp, Homo sapiens
aagattttcagtgcctaaaaca

SEQ ID NO: 95235 - DNA, 22 bp, Homo sapiens
catataaatacaacatgtgtta

SEQ ID NO: 95236 - DNA, 19 bp, Homo sapiens
agagtattgaatttgccct

SEQ ID NO: 95237 - DNA, 22 bp, Homo sapiens
ttctcatgaaactcgcttcctc

SEQ ID NO: 95238 - DNA, 22 bp, Homo sapiens
cagcagcattgctctggattcc

SEQ ID NO: 95239 - DNA, 22 bp, Homo sapiens
tgaggctccttgtagagagtgg

SEQ ID NO: 95240 - DNA, 14 bp, Homo sapiens
gcaggcggatcact

SEQ ID NO: 95241 - DNA, 22 bp, Homo sapiens
acacttggagcaacacttatgg

SEQ ID NO: 95242 - DNA, 22 bp, Homo sapiens
ccggtgttcaaagtctggtatg

SEQ ID NO: 95243 - DNA, 22 bp, Homo sapiens
tgtgcctactgatagagccaag

SEQ ID NO: 95244 - DNA, 22 bp, Homo sapiens
ctgaccaacatggtgaaacctt

SEQ ID NO: 95245 - DNA, 17 bp, Homo sapiens
tgtagcttctccttctc

SEQ ID NO: 95246 - DNA, 18 bp, Homo sapiens
cccggctaatttttggta

SEQ ID NO: 95247 - DNA, 22 bp, Homo sapiens
gccctgccctctcggcactcgc

SEQ ID NO: 95248 - DNA, 22 bp, Homo sapiens
tgctgagcgcatccggcggccg

SEQ ID NO: 95249 - DNA, 22 bp, Homo sapiens
tggctaacaaggtgaaaccccg

SEQ ID NO: 95250 - DNA, 22 bp, Homo sapiens
ttgtcttttgtgggaaatatgg

SEQ ID NO: 95251 - DNA, 22 bp, Homo sapiens
ccaaagtgctggggttacaggc

SEQ ID NO: 95252 - DNA, 22 bp, Homo sapiens
cccgtgtgtgcgaggctcccgc

SEQ ID NO: 95253 - DNA, 22 bp, Homo sapiens
atacagggacatccagtttttc

SEQ ID NO: 95254 - DNA, 22 bp, Homo sapiens
gtccccgccgtcgctcaggctg

SEQ ID NO: 95255 - DNA, 22 bp, Homo sapiens
gttggctatgagagctttagtg

SEQ ID NO: 95256 - DNA, 22 bp, Homo sapiens
gttgtgaatagtgccgcaataa

SEQ ID NO: 95257 - DNA, 22 bp, Homo sapiens
ttcctggtcactgctgttccct

SEQ ID NO: 95258 - DNA, 23 bp, Homo sapiens
actcgtggaattctctgcgatcg

SEQ ID NO: 95259 - DNA, 22 bp, Homo sapiens
ggagtgaagtggcgcgatctcg

SEQ ID NO: 95260 - DNA, 22 bp, Homo sapiens
gtcctggggattatagagtgtt

SEQ ID NO: 95261 - DNA, 22 bp, Homo sapiens
ggagaagaggagctggaagcct

SEQ ID NO: 95262 - DNA, 22 bp, Homo sapiens
taaatgttgtaagtacatctaa

SEQ ID NO: 95263 - DNA, 22 bp, Homo sapiens
tctgcatattgttaatggaatg

SEQ ID NO: 95264 - DNA, 22 bp, Homo sapiens
aagcagaatagaggcccttccc

SEQ ID NO: 95265 - DNA, 22 bp, Homo sapiens
atggaaggctttatgactcaaa

SEQ ID NO: 95266 - DNA, 22 bp, Homo sapiens
aagtcgtggcaggcttgcacga

SEQ ID NO: 95267 - DNA, 22 bp, Homo sapiens
aaaaatcacttttataggcagc

SEQ ID NO: 95268 - DNA, 22 bp, Homo sapiens
acccaggagacggaggtgcagt

SEQ ID NO: 95269 - DNA, 22 bp, Homo sapiens
ctggggaacgcagcgagcagcg

SEQ ID NO: 95270 - DNA, 22 bp, Homo sapiens
cggggccctggggctgaaggtc

SEQ ID NO: 95271 - DNA, 22 bp, Homo sapiens
ttgatcaaatcagctactgagg

SEQ ID NO: 95272 - DNA, 22 bp, Homo sapiens
cactgcactccagcccgggcaa

SEQ ID NO: 95273 - DNA, 22 bp, Homo sapiens
tttaggttttttcacgtggcta

SEQ ID NO: 95274 - DNA, 22 bp, Homo sapiens
tgtctcttttcaagctaccctt

SEQ ID NO: 95275 - DNA, 22 bp, Homo sapiens
taatgtataacaaatactcatc

SEQ ID NO: 95276 - DNA, 21 bp, Homo sapiens
ggcctcccggaccgcagcgcc

SEQ ID NO: 95277 - DNA, 22 bp, Homo sapiens
ggctctgcgcctgcggggactt

SEQ ID NO: 95278 - DNA, 22 bp, Homo sapiens
agcctattccaggatgagctca

SEQ ID NO: 95279 - DNA, 22 bp, Homo sapiens
gcagaggacacaggagggcaag

SEQ ID NO: 95280 - DNA, 22 bp, Homo sapiens
acaaacagagttgaaaaatagg

SEQ ID NO: 95281 - DNA, 22 bp, Homo sapiens
cacagctgaagtagccatgtgg

SEQ ID NO: 95282 - DNA, 22 bp, Homo sapiens
cctcttctaggacgtccttgtg

SEQ ID NO: 95283 - DNA, 22 bp, Homo sapiens
aggagatggagctcagtgggca

SEQ ID NO: 95284 - DNA, 22 bp, Homo sapiens
atgccactgcgctccagcctgg

SEQ ID NO: 95285 - DNA, 22 bp, Homo sapiens
agtgctgtctccttcccccggg

SEQ ID NO: 95286 - DNA, 22 bp, Homo sapiens
tacaggcatgtagcatggtgat

SEQ ID NO: 95287 - DNA, 22 bp, Homo sapiens
tcatcttcctcatttctccagg

SEQ ID NO: 95288 - DNA, 22 bp, Homo sapiens
cacctcaggcagcaaagtctca

SEQ ID NO: 95289 - DNA, 22 bp, Homo sapiens
aatgcaatgcagcacctccttg

SEQ ID NO: 95290 - DNA, 22 bp, Homo sapiens
gaggcaggaggattgcttgagc

SEQ ID NO: 95291 - DNA, 18 bp, Homo sapiens
cccaggttggcctacaga

SEQ ID NO: 95292 - DNA, 22 bp, Homo sapiens
tggagggcatgctgtccatggg

SEQ ID NO: 95293 - DNA, 22 bp, Homo sapiens
ggaaaggcctgggtgtcctggg

SEQ ID NO: 95294 - DNA, 22 bp, Homo sapiens
cactgcacttcagcctgggtga

SEQ ID NO: 95295 - DNA, 22 bp, Homo sapiens
gacaggaggcagagctcaggtg

SEQ ID NO: 95296 - DNA, 22 bp, Homo sapiens
tgttcagaacaaaggtaaatga

SEQ ID NO: 95297 - DNA, 22 bp, Homo sapiens
catcccctgatgctcttgagta

SEQ ID NO: 95298 - DNA, 22 bp, Homo sapiens
aggaggggttctcgggtgctga

SEQ ID NO: 95299 - DNA, 22 bp, Homo sapiens
catgtgtcttgctgccctccat

SEQ ID NO: 95300 - DNA, 22 bp, Homo sapiens
caggaggattgcttgaggccag

SEQ ID NO: 95301 - DNA, 22 bp, Homo sapiens
agaggctgcacttgctcatgat

SEQ ID NO: 95302 - DNA, 22 bp, Homo sapiens
aggactgggtgcagagggcatc

SEQ ID NO: 95303 - DNA, 22 bp, Homo sapiens
tagtatagattgaagcagatca

SEQ ID NO: 95304 - DNA, 22 bp, Homo sapiens
ttcttctttccaattacatggt

SEQ ID NO: 95305 - DNA, 22 bp, Homo sapiens
tcttccagatggttctttagct

SEQ ID NO: 95306 - DNA, 22 bp, Homo sapiens
cccaggaggtcgaagctgcagt

SEQ ID NO: 95307 - DNA, 18 bp, Homo sapiens
cagggctgtggggtcact

SEQ ID NO: 95308 - DNA, 22 bp, Homo sapiens
tggggtacttgtatcaaagcac

SEQ ID NO: 95309 - DNA, 22 bp, Homo sapiens
agacaaagaaaccgtagaagca

SEQ ID NO: 95310 - DNA, 22 bp, Homo sapiens
ttggagatatcacaccttcaca

SEQ ID NO: 95311 - DNA, 22 bp, Homo sapiens
gcacagagagggaaggtaactt

SEQ ID NO: 95312 - DNA, 20 bp, Homo sapiens
ttgagcttttagtacagaca

SEQ ID NO: 95313 - DNA, 22 bp, Homo sapiens
tggagaattctatgttgagggg

SEQ ID NO: 95314 - DNA, 20 bp, Homo sapiens
acctcctggcgggcatcctc

SEQ ID NO: 95315 - DNA, 22 bp, Homo sapiens
gcttagtcaattataaataggc

SEQ ID NO: 95316 - DNA, 22 bp, Homo sapiens
gcctccggagttgcagtgtctt

SEQ ID NO: 95317 - DNA, 22 bp, Homo sapiens
tgtcttcgctacaatgaaaagg

SEQ ID NO: 95318 - DNA, 22 bp, Homo sapiens
tttaagaagttatgttataaat

SEQ ID NO: 95319 - DNA, 22 bp, Homo sapiens
tcccgcatgccgccggtgaaca

SEQ ID NO: 95320 - DNA, 17 bp, Homo sapiens
ggctgcagtccaggagg

SEQ ID NO: 95321 - DNA, 22 bp, Homo sapiens
cccaggctggagtgtaatggtg

SEQ ID NO: 95322 - DNA, 22 bp, Homo sapiens
tttgcattgcattaagtattct

SEQ ID NO: 95323 - DNA, 22 bp, Homo sapiens
agccacacttgccaggggaagg

SEQ ID NO: 95324 - DNA, 22 bp, Homo sapiens
agcccaggagtttgaggctgtg

SEQ ID NO: 95325 - DNA, 22 bp, Homo sapiens
atgttggagtcgtaaggcatgg

SEQ ID NO: 95326 - DNA, 22 bp, Homo sapiens
ttacctctagctctttgcttgt

SEQ ID NO: 95327 - DNA, 22 bp, Homo sapiens
gtctccccagggccctcttcat

SEQ ID NO: 95328 - DNA, 22 bp, Homo sapiens
gcatgtgtctttatagcagcat

SEQ ID NO: 95329 - DNA, 22 bp, Homo sapiens
tctgagctccatgcaggaggct

SEQ ID NO: 95330 - DNA, 22 bp, Homo sapiens
gcgtccccatcatccagccgta

SEQ ID NO: 95331 - DNA, 22 bp, Homo sapiens
cctgacgaaaggcgtgctggag

SEQ ID NO: 95332 - DNA, 22 bp, Homo sapiens
cacggtggcccacaggtgcaag

SEQ ID NO: 95333 - DNA, 22 bp, Homo sapiens
tggcacttttcccagttttggt

SEQ ID NO: 95334 - DNA, 22 bp, Homo sapiens
tattttgtgccatgcactgcct

SEQ ID NO: 95335 - DNA, 22 bp, Homo sapiens
ccaggaggtggaggttgcggtg

SEQ ID NO: 95336 - DNA, 22 bp, Homo sapiens
ccttacctgattgctggcatcc

SEQ ID NO: 95337 - DNA, 22 bp, Homo sapiens
aactatgttaataagtttcatt

SEQ ID NO: 95338 - DNA, 22 bp, Homo sapiens
aaggtggaggttgcagtgagct

SEQ ID NO: 95339 - DNA, 21 bp, Homo sapiens
ttgctgttttcccaatgcagt

SEQ ID NO: 95340 - DNA, 21 bp, Homo sapiens
gttcttgcaggatttccttcc

SEQ ID NO: 95341 - DNA, 22 bp, Homo sapiens
cgcggtggcggcctccagcgcc

SEQ ID NO: 95342 - DNA, 22 bp, Homo sapiens
ttttctaacatctagtaatttg

SEQ ID NO: 95343 - DNA, 22 bp, Homo sapiens
cgcagggccgcgagcgggacca

SEQ ID NO: 95344 - DNA, 22 bp, Homo sapiens
tgtgggagaaggaagcaagctg

SEQ ID NO: 95345 - DNA, 22 bp, Homo sapiens
ccaaagtgctgggattacaggt

SEQ ID NO: 95346 - DNA, 21 bp, Homo sapiens
tctctttctggaagcttccct

SEQ ID NO: 95347 - DNA, 22 bp, Homo sapiens
gagcaccgcctccacgatgccc

SEQ ID NO: 95348 - DNA, 22 bp, Homo sapiens
tcactcaggctggagtgcagtg

SEQ ID NO: 95349 - DNA, 22 bp, Homo sapiens
acatttatataactcactagga

SEQ ID NO: 95350 - DNA, 22 bp, Homo sapiens
ggcctctcttgggacagctgtc

SEQ ID NO: 95351 - DNA, 22 bp, Homo sapiens
tggaagggagctggaatttgga

SEQ ID NO: 95352 - DNA, 22 bp, Homo sapiens
tgatctaggttggcttcaactg

SEQ ID NO: 95353 - DNA, 22 bp, Homo sapiens
actgcactccagcctgggtgat

SEQ ID NO: 95354 - DNA, 22 bp, Homo sapiens
aggccaggaatccttgtcccag

SEQ ID NO: 95355 - DNA, 22 bp, Homo sapiens
tgggtgctctgcgaccgtaggg

SEQ ID NO: 95356 - DNA, 22 bp, Homo sapiens
aaccaggtgactcatggtgagc

SEQ ID NO: 95357 - DNA, 22 bp, Homo sapiens
tcagccccacggggtcagccaa

SEQ ID NO: 95358 - DNA, 22 bp, Homo sapiens
gagagagctctgtgcctgggat

SEQ ID NO: 95359 - DNA, 22 bp, Homo sapiens
agctcctgaaaatccagactgg

SEQ ID NO: 95360 - DNA, 22 bp, Homo sapiens
aggacagagggaccagagccca

SEQ ID NO: 95361 - DNA, 19 bp, Homo sapiens
ctccttgccatttcttttc

SEQ ID NO: 95362 - DNA, 22 bp, Homo sapiens
tcttcctgtcaatgagaattaa

SEQ ID NO: 95363 - DNA, 17 bp, Homo sapiens
cgggcatggagggcagg

SEQ ID NO: 95364 - DNA, 22 bp, Homo sapiens
ggctttgacatgctgaattaaa

SEQ ID NO: 95365 - DNA, 22 bp, Homo sapiens
ggctcactgcaacttccgcctc

SEQ ID NO: 95366 - DNA, 17 bp, Homo sapiens
tgcatgtcctttgttcc

SEQ ID NO: 95367 - DNA, 22 bp, Homo sapiens
agctgattccactttttcccca

SEQ ID NO: 95368 - DNA, 22 bp, Homo sapiens
tcacagctctgtcaattttata

SEQ ID NO: 95369 - DNA, 22 bp, Homo sapiens
ttatttaatgtgatctgaagag

SEQ ID NO: 95370 - DNA, 18 bp, Homo sapiens
gaaagatgaacttttttc

SEQ ID NO: 95371 - DNA, 22 bp, Homo sapiens
cagcagcagtgttctagaatct

SEQ ID NO: 95372 - DNA, 22 bp, Homo sapiens
ttgagacacagtttcactctgt

SEQ ID NO: 95373 - DNA, 22 bp, Homo sapiens
gccgggaccaaggccacggagc

SEQ ID NO: 95374 - DNA, 22 bp, Homo sapiens
cgcaccactgaattccagcctg

SEQ ID NO: 95375 - DNA, 22 bp, Homo sapiens
atgaaatatcttgaagaaattc

SEQ ID NO: 95376 - DNA, 22 bp, Homo sapiens
tatttcttttcgtgacttattg

SEQ ID NO: 95377 - DNA, 22 bp, Homo sapiens
cacccaggctggagtgcagtga

SEQ ID NO: 95378 - DNA, 22 bp, Homo sapiens
aactcactttgtggcttctgaa

SEQ ID NO: 95379 - DNA, 22 bp, Homo sapiens
tgatcagcatcttcccagctcg

SEQ ID NO: 95380 - DNA, 22 bp, Homo sapiens
gcccatgaggtggaggctgcag

SEQ ID NO: 95381 - DNA, 22 bp, Homo sapiens
cttccccaggacctctgctaaa

SEQ ID NO: 95382 - DNA, 22 bp, Homo sapiens
agcaacctgccagtcactcagt

SEQ ID NO: 95383 - DNA, 22 bp, Homo sapiens
tccagcagtccatgtgagacac

SEQ ID NO: 95384 - DNA, 22 bp, Homo sapiens
cactgctacctctgcctcccgg

SEQ ID NO: 95385 - DNA, 18 bp, Homo sapiens
ccctcttgcacaaagcaa

SEQ ID NO: 95386 - DNA, 19 bp, Homo sapiens
tgtgatattgttagtaata

SEQ ID NO: 95387 - DNA, 22 bp, Homo sapiens
aggctgagataggtggatcatt

SEQ ID NO: 95388 - DNA, 22 bp, Homo sapiens
cagatgtacatgaagggcaatg

SEQ ID NO: 95389 - DNA, 22 bp, Homo sapiens
gcaccgccttggaccgcccgct

SEQ ID NO: 95390 - DNA, 22 bp, Homo sapiens
tgtttgagttctagcgcattta

SEQ ID NO: 95391 - DNA, 22 bp, Homo sapiens
atgagagctgatgactttacaa

SEQ ID NO: 95392 - DNA, 22 bp, Homo sapiens
catgtgaattccaaagctaggt

SEQ ID NO: 95393 - DNA, 22 bp, Homo sapiens
cccagttgttgccggctctgga

SEQ ID NO: 95394 - DNA, 22 bp, Homo sapiens
ctctgctgtgccgccagggcct

SEQ ID NO: 95395 - DNA, 22 bp, Homo sapiens
gaacgggtgcagccatgggccc

SEQ ID NO: 95396 - DNA, 22 bp, Homo sapiens
tgtggcacatacacaggagggc

SEQ ID NO: 95397 - DNA, 22 bp, Homo sapiens
aactctatttaccctactaaac

SEQ ID NO: 95398 - DNA, 22 bp, Homo sapiens
gagaacagaagcattcctaatt

SEQ ID NO: 95399 - DNA, 22 bp, Homo sapiens
cactccagcctcagtgacagag

SEQ ID NO: 95400 - DNA, 22 bp, Homo sapiens
gaccttgtgatccgcccgcctt

SEQ ID NO: 95401 - DNA, 22 bp, Homo sapiens
gggaaggccttgtcagcggatt

SEQ ID NO: 95402 - DNA, 22 bp, Homo sapiens
cttaatctcacctgcaaagtcc

SEQ ID NO: 95403 - DNA, 22 bp, Homo sapiens
gtgacaggccactgcggctctg

SEQ ID NO: 95404 - DNA, 22 bp, Homo sapiens
gcccaggagttcaagtctagtg

SEQ ID NO: 95405 - DNA, 22 bp, Homo sapiens
ggctgtggcagctggaagtggt

SEQ ID NO: 95406 - DNA, 22 bp, Homo sapiens
ctcagcttttcccggataggtg

SEQ ID NO: 95407 - DNA, 22 bp, Homo sapiens
acccagtgttgggcagaactgt

SEQ ID NO: 95408 - DNA, 22 bp, Homo sapiens
tgagccaggagtttgaggctgt

SEQ ID NO: 95409 - DNA, 22 bp, Homo sapiens
atattgttagtaatatttcgaa

SEQ ID NO: 95410 - DNA, 22 bp, Homo sapiens
cccaggggttctgagcagcagc

SEQ ID NO: 95411 - DNA, 22 bp, Homo sapiens
ggttctctaactttgactggag

SEQ ID NO: 95412 - DNA, 22 bp, Homo sapiens
actgcaacacctcctgggttca

SEQ ID NO: 95413 - DNA, 22 bp, Homo sapiens
tagtgccctcccctttgggata

SEQ ID NO: 95414 - DNA, 22 bp, Homo sapiens
aagtgatgctacgactttgaca

SEQ ID NO: 95415 - DNA, 22 bp, Homo sapiens
tgagatcattgacttgttcctg

SEQ ID NO: 95416 - DNA, 22 bp, Homo sapiens
agcccggcttccccggttgcta

SEQ ID NO: 95417 - DNA, 22 bp, Homo sapiens
cgtggggcgggtggacacttgc

SEQ ID NO: 95418 - DNA, 22 bp, Homo sapiens
gtcacctcgctgtcttcctgag

SEQ ID NO: 95419 - DNA, 22 bp, Homo sapiens
acaggcttacaggctgcaagta

SEQ ID NO: 95420 - DNA, 22 bp, Homo sapiens
agtcttagaactacagtgccta

SEQ ID NO: 95421 - DNA, 22 bp, Homo sapiens
cctcgcggcactcgggccggat

SEQ ID NO: 95422 - DNA, 22 bp, Homo sapiens
tgatcaaaacattactccacca

SEQ ID NO: 95423 - DNA, 22 bp, Homo sapiens
tatccaattcaccattgatggg

SEQ ID NO: 95424 - DNA, 18 bp, Homo sapiens
tttctcagactctctttc

SEQ ID NO: 95425 - DNA, 22 bp, Homo sapiens
tcctccccaaagcccagcctgg

SEQ ID NO: 95426 - DNA, 22 bp, Homo sapiens
agaagcagaaactgggcttgtg

SEQ ID NO: 95427 - DNA, 22 bp, Homo sapiens
tgaggcaggagttcaggctgcg

SEQ ID NO: 95428 - DNA, 22 bp, Homo sapiens
atcatccaagcgtagttcttct

SEQ ID NO: 95429 - DNA, 22 bp, Homo sapiens
tatcacatttggagatttatga

SEQ ID NO: 95430 - DNA, 20 bp, Homo sapiens
ggcagagggcctgggagaag

SEQ ID NO: 95431 - DNA, 22 bp, Homo sapiens
acaagcgggccacagtgctggt

SEQ ID NO: 95432 - DNA, 22 bp, Homo sapiens
actgcactccagcctgggtgac

SEQ ID NO: 95433 - DNA, 22 bp, Homo sapiens
ggcagcactgcagcttgttggg

SEQ ID NO: 95434 - DNA, 19 bp, Homo sapiens
catctggatgattctcctg

SEQ ID NO: 95435 - DNA, 23 bp, Homo sapiens
ttgtcctctggatcggtttggtt

SEQ ID NO: 95436 - DNA, 22 bp, Homo sapiens
ttattttaccttcctctgagct

SEQ ID NO: 95437 - DNA, 22 bp, Homo sapiens
ccttttgctctcccatccagaa

SEQ ID NO: 95438 - DNA, 22 bp, Homo sapiens
acctctgtacctcctctgacag

SEQ ID NO: 95439 - DNA, 22 bp, Homo sapiens
tgaggaaacttacaaggcagaa

SEQ ID NO: 95440 - DNA, 22 bp, Homo sapiens
tggcctcggcatccagcaagag

SEQ ID NO: 95441 - DNA, 22 bp, Homo sapiens
ctcattgcaacctccgcctccc

SEQ ID NO: 95442 - DNA, 22 bp, Homo sapiens
cactctcagcataatgaatgtg

SEQ ID NO: 95443 - DNA, 22 bp, Homo sapiens
aggctgaggcaagaggatcact

SEQ ID NO: 95444 - DNA, 21 bp, Homo sapiens
tgcttgttctctgtccttgca

SEQ ID NO: 95445 - DNA, 20 bp, Homo sapiens
acgtggccaccagtggctta

SEQ ID NO: 95446 - DNA, 21 bp, Homo sapiens
acctgagctccacctcctgcc

SEQ ID NO: 95447 - DNA, 22 bp, Homo sapiens
tggatctcggcaatgcgggact

SEQ ID NO: 95448 - DNA, 22 bp, Homo sapiens
tccagcttataggtagatttaa

SEQ ID NO: 95449 - DNA, 22 bp, Homo sapiens
cactcacccggtccttcccagt

SEQ ID NO: 95450 - DNA, 22 bp, Homo sapiens
tctgttgcaatgtgcatggtga

SEQ ID NO: 95451 - DNA, 22 bp, Homo sapiens
ctgctctgctgatcagtgtctc

SEQ ID NO: 95452 - DNA, 22 bp, Homo sapiens
gttgctcaggcaggagtacagt

SEQ ID NO: 95453 - DNA, 22 bp, Homo sapiens
gaatgctaagcatgtgggagtt

SEQ ID NO: 95454 - DNA, 22 bp, Homo sapiens
ttgtacttgccatagaacaaca

SEQ ID NO: 95455 - DNA, 23 bp, Homo sapiens
acagtcgtaggtatccttttcct

SEQ ID NO: 95456 - DNA, 22 bp, Homo sapiens
tgggaaggggagctggaaagga

SEQ ID NO: 95457 - DNA, 22 bp, Homo sapiens
ttccggacgcccgtcttccagc

SEQ ID NO: 95458 - DNA, 19 bp, Homo sapiens
aggcttcaggccacatgct

SEQ ID NO: 95459 - DNA, 22 bp, Homo sapiens
taattcttcaggccttttgtct

SEQ ID NO: 95460 - DNA, 22 bp, Homo sapiens
aggagccagtggagttcctgcc

SEQ ID NO: 95461 - DNA, 22 bp, Homo sapiens
cccgacctcgcaaagcgcactc

SEQ ID NO: 95462 - DNA, 22 bp, Homo sapiens
tgggattcaccatgggcttcag

SEQ ID NO: 95463 - DNA, 22 bp, Homo sapiens
aagcctggcacattggagtctg

SEQ ID NO: 95464 - DNA, 22 bp, Homo sapiens
ggttccacctggcgaggggtat

SEQ ID NO: 95465 - DNA, 19 bp, Homo sapiens
gcagacaggtccagagagg

SEQ ID NO: 95466 - DNA, 22 bp, Homo sapiens
agatcacagtggcaactccctt

SEQ ID NO: 95467 - DNA, 22 bp, Homo sapiens
gcaggaggttgagccaggactg

SEQ ID NO: 95468 - DNA, 22 bp, Homo sapiens
tatgtttggcctggcaatttca

SEQ ID NO: 95469 - DNA, 22 bp, Homo sapiens
ggggtgggcgtgcagggacacc

SEQ ID NO: 95470 - DNA, 22 bp, Homo sapiens
tagatgtgttgcctggagttgt

SEQ ID NO: 95471 - DNA, 22 bp, Homo sapiens
agtgaaaacctaatcatgcagt

SEQ ID NO: 95472 - DNA, 22 bp, Homo sapiens
ggagtgaatcactagatgcaga

SEQ ID NO: 95473 - DNA, 22 bp, Homo sapiens
acaggggcaagggctcacggcc

SEQ ID NO: 95474 - DNA, 22 bp, Homo sapiens
gaggcagaggttgcagtgagct

SEQ ID NO: 95475 - DNA, 22 bp, Homo sapiens
tggcaggcgggagccatagagg

SEQ ID NO: 95476 - DNA, 19 bp, Homo sapiens
ttcacattggaagaagtag

SEQ ID NO: 95477 - DNA, 22 bp, Homo sapiens
gcaggtggatcacctgaggtca

SEQ ID NO: 95478 - DNA, 22 bp, Homo sapiens
ggtgagttctcagcttattgca

SEQ ID NO: 95479 - DNA, 22 bp, Homo sapiens
tcccagaaccctgccaggtcct

SEQ ID NO: 95480 - DNA, 23 bp, Homo sapiens
aaataggagtatctggatcatga

SEQ ID NO: 95481 - DNA, 22 bp, Homo sapiens
tgggcaggggccctgcttccgt

SEQ ID NO: 95482 - DNA, 22 bp, Homo sapiens
ggaggcggaagttgcagtgagc

SEQ ID NO: 95483 - DNA, 22 bp, Homo sapiens
gggaagagggagctggaatgat

SEQ ID NO: 95484 - DNA, 22 bp, Homo sapiens
ctgggaggcagaggttgcagtg

SEQ ID NO: 95485 - DNA, 20 bp, Homo sapiens
gctctgtggtttgagtctcc

SEQ ID NO: 95486 - DNA, 22 bp, Homo sapiens
tgtcatagtgtggtagcagtgg

SEQ ID NO: 95487 - DNA, 22 bp, Homo sapiens
agtgctgggctatctactgcta

SEQ ID NO: 95488 - DNA, 23 bp, Homo sapiens
aaactacaacgccaggcactgag

SEQ ID NO: 95489 - DNA, 22 bp, Homo sapiens
gctcggtggccagcctgaggcc

SEQ ID NO: 95490 - DNA, 19 bp, Homo sapiens
ttttggaaatgtgaacagc

SEQ ID NO: 95491 - DNA, 21 bp, Homo sapiens
ccgccgctgatagctctgggc

SEQ ID NO: 95492 - DNA, 22 bp, Homo sapiens
aaagactcactttcagctctgg

SEQ ID NO: 95493 - DNA, 22 bp, Homo sapiens
caggctggagtgcaatgacgcc

SEQ ID NO: 95494 - DNA, 18 bp, Homo sapiens
gaggatggaaggagatgc

SEQ ID NO: 95495 - DNA, 22 bp, Homo sapiens
atatatttgagaatattcatga

SEQ ID NO: 95496 - DNA, 22 bp, Homo sapiens
aaggcaggatgggaaaagattt

SEQ ID NO: 95497 - DNA, 22 bp, Homo sapiens
gcccagtagttcaaggttgcag

SEQ ID NO: 95498 - DNA, 22 bp, Homo sapiens
accttcaggtgagcacacagat

SEQ ID NO: 95499 - DNA, 22 bp, Homo sapiens
cagcctggtccccggctcaccc

SEQ ID NO: 95500 - DNA, 22 bp, Homo sapiens
gggtacagttcttccagtgtca

SEQ ID NO: 95501 - DNA, 22 bp, Homo sapiens
actgcaacctccacctcctggg

SEQ ID NO: 95502 - DNA, 22 bp, Homo sapiens
ctctggaggtggaggttgcagt

SEQ ID NO: 95503 - DNA, 22 bp, Homo sapiens
tgctccagcaccaagagctcca

SEQ ID NO: 95504 - DNA, 22 bp, Homo sapiens
acattaaaattgggtggggtaa

SEQ ID NO: 95505 - DNA, 23 bp, Homo sapiens
agctctgctcgggcatgccctgc

SEQ ID NO: 95506 - DNA, 22 bp, Homo sapiens
atttggcagtataaattctggc

SEQ ID NO: 95507 - DNA, 22 bp, Homo sapiens
agacagggtgatcgcttgagcc

SEQ ID NO: 95508 - DNA, 22 bp, Homo sapiens
cttagagatgggttttacttag

SEQ ID NO: 95509 - DNA, 22 bp, Homo sapiens
gtgggctgcccttgaggtcagc

SEQ ID NO: 95510 - DNA, 22 bp, Homo sapiens
caaccccactacacgttggaga

SEQ ID NO: 95511 - DNA, 22 bp, Homo sapiens
agtcacagggggcccctgcaac

SEQ ID NO: 95512 - DNA, 22 bp, Homo sapiens
ctgtggctctcagaggctgctg

SEQ ID NO: 95513 - DNA, 23 bp, Homo sapiens
aattatctatttcaaatttagca

SEQ ID NO: 95514 - DNA, 22 bp, Homo sapiens
gactacaggccggcatcagaga

SEQ ID NO: 95515 - DNA, 22 bp, Homo sapiens
ataattcgtataaggggaaaag

SEQ ID NO: 95516 - DNA, 22 bp, Homo sapiens
tcgctgaggctgcacggctgcc

SEQ ID NO: 95517 - DNA, 22 bp, Homo sapiens
aactcaaagatgcatgacgctt

SEQ ID NO: 95518 - DNA, 22 bp, Homo sapiens
ggcaagagggcagatggagtgc

SEQ ID NO: 95519 - DNA, 22 bp, Homo sapiens
cgtgccactgcactctagcctg

SEQ ID NO: 95520 - DNA, 22 bp, Homo sapiens
cagcccaggactgcaggtgttt

SEQ ID NO: 95521 - DNA, 22 bp, Homo sapiens
tgtgacaagcattgtatattgg

SEQ ID NO: 95522 - DNA, 22 bp, Homo sapiens
tagaggctttcagcggtaggtc

SEQ ID NO: 95523 - DNA, 22 bp, Homo sapiens
ttgccttcctgcccagcttctg

SEQ ID NO: 95524 - DNA, 22 bp, Homo sapiens
ccggcgtctcttccacttccta

SEQ ID NO: 95525 - DNA, 22 bp, Homo sapiens
tactgtactgcagttctgcaaa

SEQ ID NO: 95526 - DNA, 22 bp, Homo sapiens
atgccactgcactccagcctgg

SEQ ID NO: 95527 - DNA, 22 bp, Homo sapiens
tagatacctgctggacctcatt

SEQ ID NO: 95528 - DNA, 22 bp, Homo sapiens
gccaggttgctgacgacgatct

SEQ ID NO: 95529 - DNA, 22 bp, Homo sapiens
tacccagtgccaccctctgagg

SEQ ID NO: 95530 - DNA, 22 bp, Homo sapiens
ctcgttgctgaagccaaagtca

SEQ ID NO: 95531 - DNA, 22 bp, Homo sapiens
tggcttccccggagtgacatgt

SEQ ID NO: 95532 - DNA, 22 bp, Homo sapiens
tcactgcaagctctgccttccg

SEQ ID NO: 95533 - DNA, 22 bp, Homo sapiens
cgccgcctgctgcagcagctgt

SEQ ID NO: 95534 - DNA, 22 bp, Homo sapiens
ggggcaggagcccttcttcagc

SEQ ID NO: 95535 - DNA, 22 bp, Homo sapiens
gcatatgatcacgtgtgtcggt

SEQ ID NO: 95536 - DNA, 22 bp, Homo sapiens
agccacacagcttaatgacaga

SEQ ID NO: 95537 - DNA, 22 bp, Homo sapiens
cgtgatgaatggtgagacccgc

SEQ ID NO: 95538 - DNA, 22 bp, Homo sapiens
cctacagttatattcttgattg

SEQ ID NO: 95539 - DNA, 22 bp, Homo sapiens
gaggagctgcccgtgtgtctgc

SEQ ID NO: 95540 - DNA, 22 bp, Homo sapiens
tagactggtgaattagggggaa

SEQ ID NO: 95541 - DNA, 22 bp, Homo sapiens
atcttgccagtctccaaatcaa

SEQ ID NO: 95542 - DNA, 22 bp, Homo sapiens
cctgcctatgagacgttttgcc

SEQ ID NO: 95543 - DNA, 22 bp, Homo sapiens
cactgcccaccaagtggctggt

SEQ ID NO: 95544 - DNA, 22 bp, Homo sapiens
ttaaatattatgttgtctgcaa

SEQ ID NO: 95545 - DNA, 22 bp, Homo sapiens
cccaggctggagtgcagtggcg

SEQ ID NO: 95546 - DNA, 22 bp, Homo sapiens
gtcccgcattgggcattcctgg

SEQ ID NO: 95547 - DNA, 22 bp, Homo sapiens
gggttcagtccctcttgctact

SEQ ID NO: 95548 - DNA, 19 bp, Homo sapiens
ccttgtctggtgaaggact

SEQ ID NO: 95549 - DNA, 22 bp, Homo sapiens
taggtttactgaattagtggaa

SEQ ID NO: 95550 - DNA, 22 bp, Homo sapiens
tgcagtggcgccatctcagctc

SEQ ID NO: 95551 - DNA, 22 bp, Homo sapiens
aggtggagaagagatgggcagt

SEQ ID NO: 95552 - DNA, 22 bp, Homo sapiens
aagcagagaatctgggagcgag

SEQ ID NO: 95553 - DNA, 22 bp, Homo sapiens
ctgcttctccctgagatagtgt

SEQ ID NO: 95554 - DNA, 22 bp, Homo sapiens
tacgttttaaacacggagccag

SEQ ID NO: 95555 - DNA, 22 bp, Homo sapiens
ctctccattccctacagttttc

SEQ ID NO: 95556 - DNA, 22 bp, Homo sapiens
ataaaagatcccttctgagctc

SEQ ID NO: 95557 - DNA, 22 bp, Homo sapiens
tccactgctacaacctcccaga

SEQ ID NO: 95558 - DNA, 22 bp, Homo sapiens
ttcttttaattgtgggggagtg

SEQ ID NO: 95559 - DNA, 22 bp, Homo sapiens
ctaggtgatccactgctctctt

SEQ ID NO: 95560 - DNA, 21 bp, Homo sapiens
gtggttctagagaaacagaat

SEQ ID NO: 95561 - DNA, 22 bp, Homo sapiens
atgccactgcgctctagcctgg

SEQ ID NO: 95562 - DNA, 22 bp, Homo sapiens
gaccttgtgatctgcccacctt

SEQ ID NO: 95563 - DNA, 22 bp, Homo sapiens
tgcttttagctagtaactagta

SEQ ID NO: 95564 - DNA, 22 bp, Homo sapiens
gatggtgcaggtgaagtgctgg

SEQ ID NO: 95565 - DNA, 22 bp, Homo sapiens
tcacagagttaaaagtttcttt

SEQ ID NO: 95566 - DNA, 22 bp, Homo sapiens
ggctctgcagcttggggtcctg

SEQ ID NO: 95567 - DNA, 22 bp, Homo sapiens
gcacatccaatgattgttttga

SEQ ID NO: 95568 - DNA, 22 bp, Homo sapiens
tgtgtggattcatctcaaagag

SEQ ID NO: 95569 - DNA, 22 bp, Homo sapiens
gtggctgcagcggctgtggaga

SEQ ID NO: 95570 - DNA, 22 bp, Homo sapiens
ctgggctagaaggaccaggatg

SEQ ID NO: 95571 - DNA, 22 bp, Homo sapiens
caccttactccctctggatgcc

SEQ ID NO: 95572 - DNA, 22 bp, Homo sapiens
acaggggattgattggaagtct

SEQ ID NO: 95573 - DNA, 18 bp, Homo sapiens
ccctgccagctcccagca

SEQ ID NO: 95574 - DNA, 22 bp, Homo sapiens
agtgagagtattaatgtgaact

SEQ ID NO: 95575 - DNA, 22 bp, Homo sapiens
tgtctattcccccacctccgtt

SEQ ID NO: 95576 - DNA, 22 bp, Homo sapiens
gagcagtgccaaagaatttgcg

SEQ ID NO: 95577 - DNA, 22 bp, Homo sapiens
gaggcctgggcaagggggtctg

SEQ ID NO: 95578 - DNA, 22 bp, Homo sapiens
gaggctgaggttgcagtgagcc

SEQ ID NO: 95579 - DNA, 22 bp, Homo sapiens
caggctggagtgcagtggcgcc

SEQ ID NO: 95580 - DNA, 23 bp, Homo sapiens
atgtttgcagtaacccatcctgg

SEQ ID NO: 95581 - DNA, 20 bp, Homo sapiens
tttcttgtcggctgttgctg

SEQ ID NO: 95582 - DNA, 22 bp, Homo sapiens
gaggctggacgtgcatttctac

SEQ ID NO: 95583 - DNA, 22 bp, Homo sapiens
cccagttttctgattgaagagc

SEQ ID NO: 95584 - DNA, 22 bp, Homo sapiens
acactgcagatgaaagcataag

SEQ ID NO: 95585 - DNA, 22 bp, Homo sapiens
agcagctttcacctccccgcct

SEQ ID NO: 95586 - DNA, 22 bp, Homo sapiens
gaggctgaggcggatggatcac

SEQ ID NO: 95587 - DNA, 22 bp, Homo sapiens
ctgctgagagccccagctgaga

SEQ ID NO: 95588 - DNA, 22 bp, Homo sapiens
gtgagtaaaggttcattgaatt

SEQ ID NO: 95589 - DNA, 22 bp, Homo sapiens
tgggccgtggagcactctgaga

SEQ ID NO: 95590 - DNA, 22 bp, Homo sapiens
agtcccaacagcttacaaggaa

SEQ ID NO: 95591 - DNA, 23 bp, Homo sapiens
cagtgtgacaaaacttattactt

SEQ ID NO: 95592 - DNA, 22 bp, Homo sapiens
agatgtgagaatcaagtgacca

SEQ ID NO: 95593 - DNA, 22 bp, Homo sapiens
acatgagactgggtttgtaggg

SEQ ID NO: 95594 - DNA, 22 bp, Homo sapiens
gctctgccagcccaaggcgcag

SEQ ID NO: 95595 - DNA, 22 bp, Homo sapiens
agcaacctcatgagagtgaaat

SEQ ID NO: 95596 - DNA, 22 bp, Homo sapiens
gcaaaagtacagccggatttct

SEQ ID NO: 95597 - DNA, 22 bp, Homo sapiens
gagcaggaaggccagaagggtc

SEQ ID NO: 95598 - DNA, 22 bp, Homo sapiens
gtcaccagtgctaagaggtgga

SEQ ID NO: 95599 - DNA, 22 bp, Homo sapiens
tgtttcctttctggtgagcata

SEQ ID NO: 95600 - DNA, 22 bp, Homo sapiens
tttctttatcatagcatctttg

SEQ ID NO: 95601 - DNA, 22 bp, Homo sapiens
ggtttgttggggtccaggccca

SEQ ID NO: 95602 - DNA, 22 bp, Homo sapiens
ggctgagttgagaggattactt

SEQ ID NO: 95603 - DNA, 16 bp, Homo sapiens
ccacctgcagctctca

SEQ ID NO: 95604 - DNA, 22 bp, Homo sapiens
tgagacgaagtcttgctctgtt

SEQ ID NO: 95605 - DNA, 22 bp, Homo sapiens
aaacttttttaggttcataggc

SEQ ID NO: 95606 - DNA, 22 bp, Homo sapiens
agccaggatggtctcgatcggc

SEQ ID NO: 95607 - DNA, 18 bp, Homo sapiens
gcctggcttcggagccgc

SEQ ID NO: 95608 - DNA, 22 bp, Homo sapiens
gaggactgaaacttacaggaaa

SEQ ID NO: 95609 - DNA, 22 bp, Homo sapiens
ggagagggtaggggtcctgccc

SEQ ID NO: 95610 - DNA, 22 bp, Homo sapiens
ttgttgtcattgtagaggattt

SEQ ID NO: 95611 - DNA, 22 bp, Homo sapiens
atgctatgtaactggcagatag

SEQ ID NO: 95612 - DNA, 22 bp, Homo sapiens
gtgcgcttcttcctgagccagg

SEQ ID NO: 95613 - DNA, 22 bp, Homo sapiens
ctggagtagccggacgggtctg

SEQ ID NO: 95614 - DNA, 22 bp, Homo sapiens
ctgtggctcaggcctgtaagcc

SEQ ID NO: 95615 - DNA, 17 bp, Homo sapiens
catcaaagaaatttcca

SEQ ID NO: 95616 - DNA, 22 bp, Homo sapiens
ctgtccatattcaaggggtagg

SEQ ID NO: 95617 - DNA, 22 bp, Homo sapiens
ttatagcagcatgatttatagt

SEQ ID NO: 95618 - DNA, 22 bp, Homo sapiens
tcctgggatcaagtgatcctcc

SEQ ID NO: 95619 - DNA, 22 bp, Homo sapiens
cactgcactccagcactccagc

SEQ ID NO: 95620 - DNA, 22 bp, Homo sapiens
gtagctctgtttaaagttcttt

SEQ ID NO: 95621 - DNA, 22 bp, Homo sapiens
gagagtctagtgcacctagttt

SEQ ID NO: 95622 - DNA, 22 bp, Homo sapiens
ttgtgctcctgtgagaatctag

SEQ ID NO: 95623 - DNA, 22 bp, Homo sapiens
acttttaaatgagtttcagttg

SEQ ID NO: 95624 - DNA, 22 bp, Homo sapiens
cagcagcagtggctgcagaaca

SEQ ID NO: 95625 - DNA, 22 bp, Homo sapiens
tgtccccacctaaatcttatct

SEQ ID NO: 95626 - DNA, 22 bp, Homo sapiens
ccaaagtgctgagattacaggt

SEQ ID NO: 95627 - DNA, 22 bp, Homo sapiens
ttggaaacgtcaccttttcctt

SEQ ID NO: 95628 - DNA, 22 bp, Homo sapiens
ccggctcggcgaccaggctgaa

SEQ ID NO: 95629 - DNA, 22 bp, Homo sapiens
aaaaaattatcatagttcctga

SEQ ID NO: 95630 - DNA, 22 bp, Homo sapiens
agagggatcaccctgtttctgg

SEQ ID NO: 95631 - DNA, 20 bp, Homo sapiens
aaaatatgtataactcttct

SEQ ID NO: 95632 - DNA, 21 bp, Homo sapiens
acatggactgtgaatggggac

SEQ ID NO: 95633 - DNA, 22 bp, Homo sapiens
actgtgaacggactgaagccca

SEQ ID NO: 95634 - DNA, 18 bp, Homo sapiens
tctggaacaacttcatgt

SEQ ID NO: 95635 - DNA, 22 bp, Homo sapiens
gaattcttttctttctgaaagt

SEQ ID NO: 95636 - DNA, 22 bp, Homo sapiens
acggggctagagaaggtttctt

SEQ ID NO: 95637 - DNA, 22 bp, Homo sapiens
gaggcaggcagattgcttgagg

SEQ ID NO: 95638 - DNA, 22 bp, Homo sapiens
aggaaaatggaccagagttgtt

SEQ ID NO: 95639 - DNA, 22 bp, Homo sapiens
agagttgctccattagaactta

SEQ ID NO: 95640 - DNA, 22 bp, Homo sapiens
aaagaggcaatcaatgtagcaa

SEQ ID NO: 95641 - DNA, 22 bp, Homo sapiens
ggagaggcttccagagtcgtgc

SEQ ID NO: 95642 - DNA, 22 bp, Homo sapiens
aggaattcaagaccagctgggc

SEQ ID NO: 95643 - DNA, 22 bp, Homo sapiens
gcgctgcgcctcctcttccgca

SEQ ID NO: 95644 - DNA, 22 bp, Homo sapiens
atcctccagctcctgcttctgc

SEQ ID NO: 95645 - DNA, 22 bp, Homo sapiens
ctcactgcaagctctgcctcca

SEQ ID NO: 95646 - DNA, 22 bp, Homo sapiens
tgaacatgctgttgatggcctg

SEQ ID NO: 95647 - DNA, 22 bp, Homo sapiens
agaagccaccagctgaggaaga

SEQ ID NO: 95648 - DNA, 22 bp, Homo sapiens
gccggggctggggagagacatg

SEQ ID NO: 95649 - DNA, 22 bp, Homo sapiens
cactgcactccagcctgggtga

SEQ ID NO: 95650 - DNA, 22 bp, Homo sapiens
gcttctgagttcttgcttaata

SEQ ID NO: 95651 - DNA, 22 bp, Homo sapiens
tcctttaaacaaccagctctca

SEQ ID NO: 95652 - DNA, 22 bp, Homo sapiens
tgagtagagaattcagctaagg

SEQ ID NO: 95653 - DNA, 22 bp, Homo sapiens
tgtatgaggcatacatcaggca

SEQ ID NO: 95654 - DNA, 22 bp, Homo sapiens
gaggcaaagcatgtggctcagg

SEQ ID NO: 95655 - DNA, 18 bp, Homo sapiens
gctctgcaggtgctcggt

SEQ ID NO: 95656 - DNA, 22 bp, Homo sapiens
aagtcagacagctgagctgcct

SEQ ID NO: 95657 - DNA, 22 bp, Homo sapiens
tgcctcagctgaggccgctcca

SEQ ID NO: 95658 - DNA, 22 bp, Homo sapiens
actctgctctgtatttcactgt

SEQ ID NO: 95659 - DNA, 22 bp, Homo sapiens
gagaggtggaggttgcagtgag

SEQ ID NO: 95660 - DNA, 22 bp, Homo sapiens
tcatcagcaccctatgtccttt

SEQ ID NO: 95661 - DNA, 22 bp, Homo sapiens
aatgttgtgcatgtattttgta

SEQ ID NO: 95662 - DNA, 22 bp, Homo sapiens
gctgcagtgagccaagatcgtg

SEQ ID NO: 95663 - DNA, 22 bp, Homo sapiens
gtctttatttgagattgtcatt

SEQ ID NO: 95664 - DNA, 22 bp, Homo sapiens
gggctctcccacaacgtgccag

SEQ ID NO: 95665 - DNA, 22 bp, Homo sapiens
aagcatttcaggtagagatatt

SEQ ID NO: 95666 - DNA, 22 bp, Homo sapiens
gcagggcacaaggacgcacagg

SEQ ID NO: 95667 - DNA, 22 bp, Homo sapiens
aagtggactaatacaaggacta

SEQ ID NO: 95668 - DNA, 22 bp, Homo sapiens
ttttcctttgattcccagatgt

SEQ ID NO: 95669 - DNA, 22 bp, Homo sapiens
gaggtgtcatcaggcagctctg

SEQ ID NO: 95670 - DNA, 22 bp, Homo sapiens
gacaggtgctaagggacctggc

SEQ ID NO: 95671 - DNA, 22 bp, Homo sapiens
catctgctgttccttggactca

SEQ ID NO: 95672 - DNA, 22 bp, Homo sapiens
tcccccaggctggagtgcagtg

SEQ ID NO: 95673 - DNA, 22 bp, Homo sapiens
gggtggtggccagcagtgggca

SEQ ID NO: 95674 - DNA, 22 bp, Homo sapiens
gccagggttcgaatccgtatgg

SEQ ID NO: 95675 - DNA, 22 bp, Homo sapiens
tcctttgcttctgtcattctcc

SEQ ID NO: 95676 - DNA, 22 bp, Homo sapiens
aggctgtgtggataatattggg

SEQ ID NO: 95677 - DNA, 22 bp, Homo sapiens
gcaggcagaggtggaggagaca

SEQ ID NO: 95678 - DNA, 22 bp, Homo sapiens
ccagcagagcatggggaggaag

SEQ ID NO: 95679 - DNA, 23 bp, Homo sapiens
aggatgtaggatgtatggcagag

SEQ ID NO: 95680 - DNA, 22 bp, Homo sapiens
ttttcagaattagcataccatt

SEQ ID NO: 95681 - DNA, 22 bp, Homo sapiens
tttctcttcactgtgtgcctca

SEQ ID NO: 95682 - DNA, 22 bp, Homo sapiens
aaggaggcctggcagatgaaga

SEQ ID NO: 95683 - DNA, 22 bp, Homo sapiens
gaagccagtgtttgaagaattt

SEQ ID NO: 95684 - DNA, 22 bp, Homo sapiens
taggctaggctgaaggttttgg

SEQ ID NO: 95685 - DNA, 22 bp, Homo sapiens
gccaggctgaggctctggaaga

SEQ ID NO: 95686 - DNA, 22 bp, Homo sapiens
ccagaggtgctctttggaagtg

SEQ ID NO: 95687 - DNA, 22 bp, Homo sapiens
gctcactgcaagctctgcctcc

SEQ ID NO: 95688 - DNA, 22 bp, Homo sapiens
tggagagttctgtagatatcta

SEQ ID NO: 95689 - DNA, 19 bp, Homo sapiens
ccacagcctgctgtcttcc

SEQ ID NO: 95690 - DNA, 22 bp, Homo sapiens
atggggggatgaaggagtccaa

SEQ ID NO: 95691 - DNA, 22 bp, Homo sapiens
gcaggctgtctaaagttagagt

SEQ ID NO: 95692 - DNA, 22 bp, Homo sapiens
tatgtcactcggctcggcccac

SEQ ID NO: 95693 - DNA, 22 bp, Homo sapiens
atgattgaaaatgacattgcca

SEQ ID NO: 95694 - DNA, 22 bp, Homo sapiens
tatcagtccagggttttgtgac

SEQ ID NO: 95695 - DNA, 22 bp, Homo sapiens
atgaaaacggaccagagctatt

SEQ ID NO: 95696 - DNA, 22 bp, Homo sapiens
atcttcccaggctggggagagg

SEQ ID NO: 95697 - DNA, 22 bp, Homo sapiens
ctctggaccctcctgctgagag

SEQ ID NO: 95698 - DNA, 22 bp, Homo sapiens
ctgtgctccctctggcgccccg

SEQ ID NO: 95699 - DNA, 22 bp, Homo sapiens
ccccatttgaactccttcaact

SEQ ID NO: 95700 - DNA, 22 bp, Homo sapiens
gcctgcagggcctgggcctacc

SEQ ID NO: 95701 - DNA, 22 bp, Homo sapiens
ggaggcggaggctgcagtgagc

SEQ ID NO: 95702 - DNA, 22 bp, Homo sapiens
ctgcttctagcaccaagtccct

SEQ ID NO: 95703 - DNA, 22 bp, Homo sapiens
ttggaacatgccggggtccagg

SEQ ID NO: 95704 - DNA, 22 bp, Homo sapiens
aggtcaagagtaaatttgggta

SEQ ID NO: 95705 - DNA, 22 bp, Homo sapiens
tggggccatctcacccactgtt

SEQ ID NO: 95706 - DNA, 22 bp, Homo sapiens
tgaaatgtgttctagtgttttg

SEQ ID NO: 95707 - DNA, 20 bp, Homo sapiens
attagctcaggtgaggtcat

SEQ ID NO: 95708 - DNA, 22 bp, Homo sapiens
ttcctggaaattatgctcacct

SEQ ID NO: 95709 - DNA, 22 bp, Homo sapiens
gatagtcacctcccttaacttt

SEQ ID NO: 95710 - DNA, 22 bp, Homo sapiens
ccaggctggagtgcagtggcac

SEQ ID NO: 95711 - DNA, 22 bp, Homo sapiens
cggctcactgcagctccgcctc

SEQ ID NO: 95712 - DNA, 22 bp, Homo sapiens
catagagtgatgtaaggtatgt

SEQ ID NO: 95713 - DNA, 22 bp, Homo sapiens
cataaaaggtagcagtttgaaa

SEQ ID NO: 95714 - DNA, 22 bp, Homo sapiens
ccagcagccaccttctcgaaat

SEQ ID NO: 95715 - DNA, 22 bp, Homo sapiens
gatctggaatctgaaggctgag

SEQ ID NO: 95716 - DNA, 22 bp, Homo sapiens
catctgtaaagtaggaatattg

SEQ ID NO: 95717 - DNA, 22 bp, Homo sapiens
agtccgcctgctgccgtggcag

SEQ ID NO: 95718 - DNA, 22 bp, Homo sapiens
ggtggcagtagcactgggcctg

SEQ ID NO: 95719 - DNA, 22 bp, Homo sapiens
cacccaggctggagtgcagtgg

SEQ ID NO: 95720 - DNA, 22 bp, Homo sapiens
gagccaggggtcagctccgagg

SEQ ID NO: 95721 - DNA, 22 bp, Homo sapiens
tgatctcctgaccttgtaatcc

SEQ ID NO: 95722 - DNA, 22 bp, Homo sapiens
atgatactctaggtgatttaca

SEQ ID NO: 95723 - DNA, 22 bp, Homo sapiens
aatttaagaacatttcaggact

SEQ ID NO: 95724 - DNA, 22 bp, Homo sapiens
catgagatttgggaggggccag

SEQ ID NO: 95725 - DNA, 22 bp, Homo sapiens
ttattagagtgctttgagaaag

SEQ ID NO: 95726 - DNA, 22 bp, Homo sapiens
agttcaacaccagcctgaccaa

SEQ ID NO: 95727 - DNA, 22 bp, Homo sapiens
acaagaagtaaaggtcggatgc

SEQ ID NO: 95728 - DNA, 19 bp, Homo sapiens
agggagtttatatttgcac

SEQ ID NO: 95729 - DNA, 22 bp, Homo sapiens
ttgtgtgtactggttatgggca

SEQ ID NO: 95730 - DNA, 22 bp, Homo sapiens
tcccctctttctggaaacacaa

SEQ ID NO: 95731 - DNA, 23 bp, Homo sapiens
agaaagtcatggccaggtttgat

SEQ ID NO: 95732 - DNA, 22 bp, Homo sapiens
gtcactcaggctggagttcagt

SEQ ID NO: 95733 - DNA, 22 bp, Homo sapiens
gtttgagatgggttattgctct

SEQ ID NO: 95734 - DNA, 22 bp, Homo sapiens
ccgggagcaggcgccaccgcca

SEQ ID NO: 95735 - DNA, 22 bp, Homo sapiens
actttcttggtcccatgtttga

SEQ ID NO: 95736 - DNA, 22 bp, Homo sapiens
tcttcatgtcatggtatattga

SEQ ID NO: 95737 - DNA, 22 bp, Homo sapiens
atgagaaagttaatcatcatga

SEQ ID NO: 95738 - DNA, 22 bp, Homo sapiens
tctgtggcccaagtgatggctg

SEQ ID NO: 95739 - DNA, 22 bp, Homo sapiens
aggtggggaggagtgtctcttt

SEQ ID NO: 95740 - DNA, 22 bp, Homo sapiens
ttaggctgttcttgtgttgtta

SEQ ID NO: 95741 - DNA, 22 bp, Homo sapiens
tgccagattgtggcatggcact

SEQ ID NO: 95742 - DNA, 22 bp, Homo sapiens
gaatatcccgctatgcaaagta

SEQ ID NO: 95743 - DNA, 22 bp, Homo sapiens
ctttaaggtgatgagagatgct

SEQ ID NO: 95744 - DNA, 22 bp, Homo sapiens
ttacatgtttatgggggtacat

SEQ ID NO: 95745 - DNA, 22 bp, Homo sapiens
tggcgcgacgtgccccctgctt

SEQ ID NO: 95746 - DNA, 22 bp, Homo sapiens
gctcaagacccctctgtgactg

SEQ ID NO: 95747 - DNA, 22 bp, Homo sapiens
ggagcagggaattacagcgcag

SEQ ID NO: 95748 - DNA, 22 bp, Homo sapiens
gcaggcagatcacctgtcagga

SEQ ID NO: 95749 - DNA, 22 bp, Homo sapiens
gaaatctttgccttagctgtgt

SEQ ID NO: 95750 - DNA, 22 bp, Homo sapiens
cagcccgccctgaactttcggg

SEQ ID NO: 95751 - DNA, 22 bp, Homo sapiens
ttgtagtctaggatagattttt

SEQ ID NO: 95752 - DNA, 22 bp, Homo sapiens
tgcacgtgggctctctgctctt

SEQ ID NO: 95753 - DNA, 22 bp, Homo sapiens
ctcctctttagccccagctgga

SEQ ID NO: 95754 - DNA, 22 bp, Homo sapiens
ggcttcagtggccagagatgat

SEQ ID NO: 95755 - DNA, 22 bp, Homo sapiens
agtggcctggagccccgcctgg

SEQ ID NO: 95756 - DNA, 22 bp, Homo sapiens
agcctggcctgggcaggcacat

SEQ ID NO: 95757 - DNA, 22 bp, Homo sapiens
cgccaggcttggtagctcatgc

SEQ ID NO: 95758 - DNA, 22 bp, Homo sapiens
gtgggggagatgcttaggtccg

SEQ ID NO: 95759 - DNA, 22 bp, Homo sapiens
agagggtgggcacgtgatggat

SEQ ID NO: 95760 - DNA, 22 bp, Homo sapiens
taatggttttttggagactgct

SEQ ID NO: 95761 - DNA, 22 bp, Homo sapiens
ggaggcggaggttgcagtgagc

SEQ ID NO: 95762 - DNA, 22 bp, Homo sapiens
ctggcaggttatagagctgccc

SEQ ID NO: 95763 - DNA, 22 bp, Homo sapiens
ctcactgcaacctctgcctccc

SEQ ID NO: 95764 - DNA, 22 bp, Homo sapiens
cgcaggtgaaagaggctgggca

SEQ ID NO: 95765 - DNA, 22 bp, Homo sapiens
caggtggtcaggcaaggacacg

SEQ ID NO: 95766 - DNA, 22 bp, Homo sapiens
gaggcagaagttgcagtgagca

SEQ ID NO: 95767 - DNA, 17 bp, Homo sapiens
gtaaggcttgcagatgc

SEQ ID NO: 95768 - DNA, 22 bp, Homo sapiens
atggtactggggtcccggagtt

SEQ ID NO: 95769 - DNA, 22 bp, Homo sapiens
gggagctggagctggaagactc

SEQ ID NO: 95770 - DNA, 22 bp, Homo sapiens
gtcttagatttcaccgataatg

SEQ ID NO: 95771 - DNA, 22 bp, Homo sapiens
ctctggactttttgtggattct

SEQ ID NO: 95772 - DNA, 22 bp, Homo sapiens
cagcagagaaattacatatttg

SEQ ID NO: 95773 - DNA, 22 bp, Homo sapiens
ctcagcttggcctggacgtagc

SEQ ID NO: 95774 - DNA, 22 bp, Homo sapiens
gcctccggagtcacagtgtctt

SEQ ID NO: 95775 - DNA, 22 bp, Homo sapiens
caagtctgacctctgggtgaag

SEQ ID NO: 95776 - DNA, 22 bp, Homo sapiens
gattgtggaagtcagtggttct

SEQ ID NO: 95777 - DNA, 22 bp, Homo sapiens
ttccagctaactcacatccctt

SEQ ID NO: 95778 - DNA, 22 bp, Homo sapiens
tataaagagtctcaaagaagtt

SEQ ID NO: 95779 - DNA, 22 bp, Homo sapiens
cctgccctgctcactgtcggta

SEQ ID NO: 95780 - DNA, 22 bp, Homo sapiens
accaggttggtgtccttctggc

SEQ ID NO: 95781 - DNA, 18 bp, Homo sapiens
tgagaggctattttttgc

SEQ ID NO: 95782 - DNA, 22 bp, Homo sapiens
ccaaagtgctaggattacaggt

SEQ ID NO: 95783 - DNA, 22 bp, Homo sapiens
ctccttctgggcctggcagtgg

SEQ ID NO: 95784 - DNA, 22 bp, Homo sapiens
tctgcggtccccttctcgccct

SEQ ID NO: 95785 - DNA, 22 bp, Homo sapiens
ccctggcagtgctcctttagac

SEQ ID NO: 95786 - DNA, 22 bp, Homo sapiens
ccagcctggttcagaattggct

SEQ ID NO: 95787 - DNA, 22 bp, Homo sapiens
ttgcactccagcccgagcaaca

SEQ ID NO: 95788 - DNA, 22 bp, Homo sapiens
aacccgggaggcagaggttgtg

SEQ ID NO: 95789 - DNA, 22 bp, Homo sapiens
ggccctggcagccacgaaagcc

SEQ ID NO: 95790 - DNA, 22 bp, Homo sapiens
ggtctcttgtccaaggtcacac

SEQ ID NO: 95791 - DNA, 22 bp, Homo sapiens
aaggaaagctgtggttctgaga

SEQ ID NO: 95792 - DNA, 22 bp, Homo sapiens
ggggttaacagtattgctcatg

SEQ ID NO: 95793 - DNA, 22 bp, Homo sapiens
ggggccgaccgcggttcaggcc

SEQ ID NO: 95794 - DNA, 22 bp, Homo sapiens
gggtgtagaaagaaccctctgg

SEQ ID NO: 95795 - DNA, 22 bp, Homo sapiens
ccagaagcagagcctgaggcag

SEQ ID NO: 95796 - DNA, 22 bp, Homo sapiens
tttgaggttagctagcagatca

SEQ ID NO: 95797 - DNA, 22 bp, Homo sapiens
acgcctgtaatcccagcacttt

SEQ ID NO: 95798 - DNA, 22 bp, Homo sapiens
aatttaagagcatagctccaac

SEQ ID NO: 95799 - DNA, 22 bp, Homo sapiens
tcccagattcctgctcttatat

SEQ ID NO: 95800 - DNA, 22 bp, Homo sapiens
tttgaacagtagcttaggtgtg

SEQ ID NO: 95801 - DNA, 22 bp, Homo sapiens
agcccgcatctcgctaaagata

SEQ ID NO: 95802 - DNA, 22 bp, Homo sapiens
gctgctctcagagctcatgctg

SEQ ID NO: 95803 - DNA, 22 bp, Homo sapiens
acattaaacttgcttggctgta

SEQ ID NO: 95804 - DNA, 22 bp, Homo sapiens
tgagcaggcgcagcaggaggtc

SEQ ID NO: 95805 - DNA, 22 bp, Homo sapiens
ggtgttgcagttgaagactggt

SEQ ID NO: 95806 - DNA, 22 bp, Homo sapiens
tgtcctcatcctccagtctgtc

SEQ ID NO: 95807 - DNA, 22 bp, Homo sapiens
tccttgactgtgaggaactagc

SEQ ID NO: 95808 - DNA, 22 bp, Homo sapiens
ttctttcagaacacaagtgatt

SEQ ID NO: 95809 - DNA, 22 bp, Homo sapiens
gtgcttccatctagagggtcac

SEQ ID NO: 95810 - DNA, 22 bp, Homo sapiens
ccaaagtgctgggattcaggca

SEQ ID NO: 95811 - DNA, 22 bp, Homo sapiens
gcccaggctggagtgcagtggt

SEQ ID NO: 95812 - DNA, 22 bp, Homo sapiens
tgcctaggctggagtgcaatgg

SEQ ID NO: 95813 - DNA, 22 bp, Homo sapiens
caccagtgtttacctgtgacaa

SEQ ID NO: 95814 - DNA, 22 bp, Homo sapiens
gcctccagcccacgcaggcctg

SEQ ID NO: 95815 - DNA, 22 bp, Homo sapiens
tcggggtctttgacacgctctg

SEQ ID NO: 95816 - DNA, 22 bp, Homo sapiens
accattgccccctagtgtctgt

SEQ ID NO: 95817 - DNA, 22 bp, Homo sapiens
acagtatagggcttatattgta

SEQ ID NO: 95818 - DNA, 20 bp, Homo sapiens
tcacatcctctcccaacatg

SEQ ID NO: 95819 - DNA, 22 bp, Homo sapiens
ccagagctgattcctgggactt

SEQ ID NO: 95820 - DNA, 22 bp, Homo sapiens
tttggtgttccggtcattgctg

SEQ ID NO: 95821 - DNA, 22 bp, Homo sapiens
gggaggcagtgctggaggctgg

SEQ ID NO: 95822 - DNA, 22 bp, Homo sapiens
agcttgacagacagatggtagc

SEQ ID NO: 95823 - DNA, 22 bp, Homo sapiens
aaaagcaattgcagttcttgcc

SEQ ID NO: 95824 - DNA, 22 bp, Homo sapiens
cctagagctctgctttatctaa

SEQ ID NO: 95825 - DNA, 22 bp, Homo sapiens
gctcactgcaacctctgcctcc

SEQ ID NO: 95826 - DNA, 19 bp, Homo sapiens
atcttcattttacaggcag

SEQ ID NO: 95827 - DNA, 22 bp, Homo sapiens
acatttttcacatttgtagggt

SEQ ID NO: 95828 - DNA, 22 bp, Homo sapiens
attataggcttgagccaccgtg

SEQ ID NO: 95829 - DNA, 22 bp, Homo sapiens
agttgcagacgcagagatgttg

SEQ ID NO: 95830 - DNA, 22 bp, Homo sapiens
atttcacttagtgtaatgtctt

SEQ ID NO: 95831 - DNA, 22 bp, Homo sapiens
tagaataatctgaggaaatgct

SEQ ID NO: 95832 - DNA, 22 bp, Homo sapiens
tggtatgtaaattgtaactcaa

SEQ ID NO: 95833 - DNA, 22 bp, Homo sapiens
tatgctctgagacctttgtgca

SEQ ID NO: 95834 - DNA, 22 bp, Homo sapiens
agacagggtgatcgcttgagcc

SEQ ID NO: 95835 - DNA, 22 bp, Homo sapiens
tagatgaccttgtgttaggcaa

SEQ ID NO: 95836 - DNA, 22 bp, Homo sapiens
ggccgtgctccaaagtcatcgt

SEQ ID NO: 95837 - DNA, 22 bp, Homo sapiens
cgtcagggttgagcaggtagat

SEQ ID NO: 95838 - DNA, 22 bp, Homo sapiens
gaagggaactgggtctccttgt

SEQ ID NO: 95839 - DNA, 22 bp, Homo sapiens
tttcttctatgtgtgatatttt

SEQ ID NO: 95840 - DNA, 22 bp, Homo sapiens
atgccactgcacttcagcctgg

SEQ ID NO: 95841 - DNA, 22 bp, Homo sapiens
tgggaagggtcaacagctggaa

SEQ ID NO: 95842 - DNA, 22 bp, Homo sapiens
gggaagagggagctggaatgat

SEQ ID NO: 95843 - DNA, 22 bp, Homo sapiens
atcaaatacaaagggcataagg

SEQ ID NO: 95844 - DNA, 22 bp, Homo sapiens
ctgggaggcggagcttgcagtg

SEQ ID NO: 95845 - DNA, 22 bp, Homo sapiens
gactacaggtgtgtgccaccat

SEQ ID NO: 95846 - DNA, 22 bp, Homo sapiens
agatcacagtggcaactccctt

SEQ ID NO: 95847 - DNA, 22 bp, Homo sapiens
ggagtgactcacagctgggaca

SEQ ID NO: 95848 - DNA, 22 bp, Homo sapiens
cggtcaggtgcagcgttggcac

SEQ ID NO: 95849 - DNA, 22 bp, Homo sapiens
ttatttttaaaagttcacacag

SEQ ID NO: 95850 - DNA, 23 bp, Homo sapiens
tgttccagatacgccttttcctc

SEQ ID NO: 95851 - DNA, 22 bp, Homo sapiens
gcaaaagtacagccggatttct

SEQ ID NO: 95852 - DNA, 22 bp, Homo sapiens
ctcactgcaagctctgcctccc

SEQ ID NO: 95853 - DNA, 22 bp, Homo sapiens
aaggcaggatgggaaaagattt

SEQ ID NO: 95854 - DNA, 22 bp, Homo sapiens
tactgtgtgcccagccgagctg

SEQ ID NO: 95855 - DNA, 22 bp, Homo sapiens
ggagagcagggaggctgctctg

SEQ ID NO: 95856 - DNA, 22 bp, Homo sapiens
tgggaagaggagcactggaatg

SEQ ID NO: 95857 - DNA, 22 bp, Homo sapiens
tccagggagagccgctgctcca

SEQ ID NO: 95858 - DNA, 22 bp, Homo sapiens
gcctggattccttgtttctcag

SEQ ID NO: 95859 - DNA, 17 bp, Homo sapiens
tgcatgtcctttgttcc

SEQ ID NO: 95860 - DNA, 22 bp, Homo sapiens
atagagtgatgtaaggtatgtg

SEQ ID NO: 95861 - DNA, 22 bp, Homo sapiens
ctgggaggcggaggttgcagtg

SEQ ID NO: 95862 - DNA, 22 bp, Homo sapiens
aggaaaatggaccagagttgtt

SEQ ID NO: 95863 - DNA, 22 bp, Homo sapiens
tgtcagggatttccaactcccc

SEQ ID NO: 95864 - DNA, 22 bp, Homo sapiens
atttgtgggactataatgcagg

SEQ ID NO: 95865 - DNA, 22 bp, Homo sapiens
tccagctgaggtggcctctgtg

SEQ ID NO: 95866 - DNA, 22 bp, Homo sapiens
tttgtagcagcatgatttataa

SEQ ID NO: 95867 - DNA, 22 bp, Homo sapiens
gaatatcccgctatgcaaagta

SEQ ID NO: 95868 - DNA, 22 bp, Homo sapiens
tcactgcaacctccacctcctg

SEQ ID NO: 95869 - DNA, 22 bp, Homo sapiens
cattgcaacttcaaactcctgg

SEQ ID NO: 95870 - DNA, 22 bp, Homo sapiens
aaagaaggtagggctggtgact

SEQ ID NO: 95871 - DNA, 22 bp, Homo sapiens
gcaggaggttgagccaggactg

SEQ ID NO: 95872 - DNA, 22 bp, Homo sapiens
tgttgattagtgtttagactta

SEQ ID NO: 95873 - DNA, 22 bp, Homo sapiens
tgtctggtgggttgacaggcag

SEQ ID NO: 95874 - DNA, 22 bp, Homo sapiens
tggatctcggcaatgcgggact

SEQ ID NO: 95875 - DNA, 22 bp, Homo sapiens
ggaggcggaggctgcagtgagc

SEQ ID NO: 95876 - DNA, 22 bp, Homo sapiens
tgtgagaaatataggccgtgct

SEQ ID NO: 95877 - DNA, 22 bp, Homo sapiens
gtgttaaccagctaaactttgc

SEQ ID NO: 95878 - DNA, 22 bp, Homo sapiens
tttctggcagcgggacaggggt

SEQ ID NO: 95879 - DNA, 22 bp, Homo sapiens
aacttaggaaaataaggcatga

SEQ ID NO: 95880 - DNA, 22 bp, Homo sapiens
ggatgacagatgcaggctttga

SEQ ID NO: 95881 - DNA, 22 bp, Homo sapiens
cggctcactgcagctccgcctc

SEQ ID NO: 95882 - DNA, 18 bp, Homo sapiens
agtgtcagctgcagctca

SEQ ID NO: 95883 - DNA, 22 bp, Homo sapiens
gtctttatttgagattgtcatt

SEQ ID NO: 95884 - DNA, 21 bp, Homo sapiens
ctggaggcaggtggtgccagg

SEQ ID NO: 95885 - DNA, 22 bp, Homo sapiens
ggagtgactctcggggccacta

SEQ ID NO: 95886 - DNA, 22 bp, Homo sapiens
ctttggagaaaagttcttgggc

SEQ ID NO: 95887 - DNA, 22 bp, Homo sapiens
tttattctgtgctacatgaaga

SEQ ID NO: 95888 - DNA, 22 bp, Homo sapiens
aggtcacgtcctgtgatgtcat

SEQ ID NO: 95889 - DNA, 22 bp, Homo sapiens
atctggttttggctgtgtccct

SEQ ID NO: 95890 - DNA, 22 bp, Homo sapiens
tgaggaaacttacaaggcagaa

SEQ ID NO: 95891 - DNA, 22 bp, Homo sapiens
gcgagtgccgagagggcagggc

SEQ ID NO: 95892 - DNA, 22 bp, Homo sapiens
cgctgcagaagcgtgttcagga

SEQ ID NO: 95893 - DNA, 22 bp, Homo sapiens
atgccactgcgctctagcctgg

SEQ ID NO: 95894 - DNA, 23 bp, Homo sapiens
actctcaggttctttccagcagg

SEQ ID NO: 95895 - DNA, 22 bp, Homo sapiens
aggaggaagggaagacaagtaa

SEQ ID NO: 95896 - DNA, 22 bp, Homo sapiens
cagtgcagccaaggacaggcac

SEQ ID NO: 95897 - DNA, 22 bp, Homo sapiens
acggtgctgggtattggggttc

SEQ ID NO: 95898 - DNA, 22 bp, Homo sapiens
taggcaagtggaccagaggttt

SEQ ID NO: 95899 - DNA, 22 bp, Homo sapiens
gatctgtgtgattggatgcatt

SEQ ID NO: 95900 - DNA, 22 bp, Homo sapiens
gaagaaggtggcccaggggtag

SEQ ID NO: 95901 - DNA, 22 bp, Homo sapiens
cactgcaagctccgcctcccgg

SEQ ID NO: 95902 - DNA, 22 bp, Homo sapiens
cacagcctcctctggctcacgg

SEQ ID NO: 95903 - DNA, 22 bp, Homo sapiens
gacaggaggcagagctcaggtg

SEQ ID NO: 95904 - DNA, 22 bp, Homo sapiens
gtaggtcagacataagaggaca

SEQ ID NO: 95905 - DNA, 22 bp, Homo sapiens
catataaatacaacatgtgtta

SEQ ID NO: 95906 - DNA, 21 bp, Homo sapiens
ttagaagctaatgcagctggt

SEQ ID NO: 95907 - DNA, 21 bp, Homo sapiens
gtggttctagagaaacagaat

SEQ ID NO: 95908 - DNA, 22 bp, Homo sapiens
acaattctgatggtttcccagt

SEQ ID NO: 95909 - DNA, 22 bp, Homo sapiens
acgcctgtaatcccagcacttt

SEQ ID NO: 95910 - DNA, 22 bp, Homo sapiens
ccagggatgcagaggttgcagt

SEQ ID NO: 95911 - DNA, 23 bp, Homo sapiens
attttttgtctttgtaactagat

SEQ ID NO: 95912 - DNA, 22 bp, Homo sapiens
tgaatgtgatgctaaacatatg

SEQ ID NO: 95913 - DNA, 22 bp, Homo sapiens
acattaaacttgcttggctgta

SEQ ID NO: 95914 - DNA, 22 bp, Homo sapiens
ctgctcttcacactacacccgt

SEQ ID NO: 95915 - DNA, 22 bp, Homo sapiens
ggaggcggaagttgcagtgagc

SEQ ID NO: 95916 - DNA, 22 bp, Homo sapiens
gtcttagatttcaccgataatg

SEQ ID NO: 95917 - DNA, 22 bp, Homo sapiens
agctgaaacttcccattaattg

SEQ ID NO: 95918 - DNA, 22 bp, Homo sapiens
cccagttgttgccggctctgga

SEQ ID NO: 95919 - DNA, 22 bp, Homo sapiens
aactctatttaccctactaaac

SEQ ID NO: 95920 - DNA, 22 bp, Homo sapiens
ggaggctgagaggtcgcagtgg

SEQ ID NO: 95921 - DNA, 22 bp, Homo sapiens
tttctttatcatagcatctttg

SEQ ID NO: 95922 - DNA, 22 bp, Homo sapiens
aatgctctttaacctattctga

SEQ ID NO: 95923 - DNA, 22 bp, Homo sapiens
gctgtgtatcagatgccacggg

SEQ ID NO: 95924 - DNA, 22 bp, Homo sapiens
tcacgtgagggacctgtgtctg

SEQ ID NO: 95925 - DNA, 22 bp, Homo sapiens
tcaggaggcggaggttgcagtg

SEQ ID NO: 95926 - DNA, 22 bp, Homo sapiens
ttggagttctgggcacagctgc

SEQ ID NO: 95927 - DNA, 20 bp, Homo sapiens
cttctggctggtcaaggact

SEQ ID NO: 95928 - DNA, 22 bp, Homo sapiens
tacggtcagtccgtgccccaag

SEQ ID NO: 95929 - DNA, 22 bp, Homo sapiens
gcaaagaatgcagatttgcctc

SEQ ID NO: 95930 - DNA, 22 bp, Homo sapiens
tccattatacttctgattcaaa

SEQ ID NO: 95931 - DNA, 20 bp, Homo sapiens
tgtttgtgtggggccttggc

SEQ ID NO: 95932 - DNA, 22 bp, Homo sapiens
gccaggttgctgacgacgatct

SEQ ID NO: 95933 - DNA, 22 bp, Homo sapiens
tgctcttcacagtttcagcatc

SEQ ID NO: 95934 - DNA, 22 bp, Homo sapiens
aataaacaaatccttccttccc

SEQ ID NO: 95935 - DNA, 22 bp, Homo sapiens
atattgaaccctacagactgta

SEQ ID NO: 95936 - DNA, 22 bp, Homo sapiens
cccacgtcgaacttgctccaga

SEQ ID NO: 95937 - DNA, 22 bp, Homo sapiens
tctgacattttgagaatgacat

SEQ ID NO: 95938 - DNA, 22 bp, Homo sapiens
ctcactgcaacctctgcctccc

SEQ ID NO: 95939 - DNA, 22 bp, Homo sapiens
taaaatttgtccctgagtgttg

SEQ ID NO: 95940 - DNA, 22 bp, Homo sapiens
ctcactgcaagctcagcctccc

SEQ ID NO: 95941 - DNA, 22 bp, Homo sapiens
ggaggtggaggttgcagtgagc

SEQ ID NO: 95942 - DNA, 22 bp, Homo sapiens
ggaggcggaggttgcagtgagt

SEQ ID NO: 95943 - DNA, 22 bp, Homo sapiens
gtctctatcatagctgaaccct

SEQ ID NO: 95944 - DNA, 22 bp, Homo sapiens
aggtggaaatggctttcctagg

SEQ ID NO: 95945 - DNA, 22 bp, Homo sapiens
gcagggtttagcacctgtagct

SEQ ID NO: 95946 - DNA, 22 bp, Homo sapiens
gaagattgaaggctgggaatta

SEQ ID NO: 95947 - DNA, 22 bp, Homo sapiens
ttctcttttcaccagttgctaa

SEQ ID NO: 95948 - DNA, 22 bp, Homo sapiens
agcatgcgcttgatcagctcca

SEQ ID NO: 95949 - DNA, 22 bp, Homo sapiens
catgtctgagtcatggtacttc

SEQ ID NO: 95950 - DNA, 22 bp, Homo sapiens
tcttaagcagagaagaagttga

SEQ ID NO: 95951 - DNA, 22 bp, Homo sapiens
cgggttcacgccattctcctgc

SEQ ID NO: 95952 - DNA, 22 bp, Homo sapiens
ctcgcgttccagctgcgggccg

SEQ ID NO: 95953 - DNA, 22 bp, Homo sapiens
atatatttgagaatattcatga

SEQ ID NO: 95954 - DNA, 19 bp, Homo sapiens
gactcacaccttccgctgt

SEQ ID NO: 95955 - DNA, 22 bp, Homo sapiens
agatttatgtggtcacactcag

SEQ ID NO: 95956 - DNA, 22 bp, Homo sapiens
gcccaggctggagtgcagtggt

SEQ ID NO: 95957 - DNA, 22 bp, Homo sapiens
cacagagatggtctggcaggtg

SEQ ID NO: 95958 - DNA, 22 bp, Homo sapiens
aataaaatggtcagttttctca

SEQ ID NO: 95959 - DNA, 22 bp, Homo sapiens
tggcaagaactgcaattgcttt

SEQ ID NO: 95960 - DNA, 22 bp, Homo sapiens
tggcaagaaccgcaattacttt

SEQ ID NO: 95961 - DNA, 20 bp, Homo sapiens
tccaaagaagttcacattta

SEQ ID NO: 95962 - DNA, 22 bp, Homo sapiens
tttaaaaaactagtctgagtct

SEQ ID NO: 95963 - DNA, 22 bp, Homo sapiens
acagagacacggaagctaaaga

SEQ ID NO: 95964 - DNA, 22 bp, Homo sapiens
atgattgaaaatgacattgcca

SEQ ID NO: 95965 - DNA, 22 bp, Homo sapiens
ccagtgtatttttgggacctgc

SEQ ID NO: 95966 - DNA, 22 bp, Homo sapiens
ttgtgttggcgaaagcatgtca

SEQ ID NO: 95967 - DNA, 22 bp, Homo sapiens
ctgctcttgagggactgcggtc

SEQ ID NO: 95968 - DNA, 22 bp, Homo sapiens
cttggaggtggaagttgcagtg

SEQ ID NO: 95969 - DNA, 22 bp, Homo sapiens
tctctcaggctggagtgcagtg

SEQ ID NO: 95970 - DNA, 22 bp, Homo sapiens
gggacatctttctagtcagggt

SEQ ID NO: 95971 - DNA, 22 bp, Homo sapiens
gaggaggcttccgggaggcacg

SEQ ID NO: 95972 - DNA, 22 bp, Homo sapiens
aaggagaaatggtagatgtgca

SEQ ID NO: 95973 - DNA, 22 bp, Homo sapiens
gcagggttttatagatctcttc

SEQ ID NO: 95974 - DNA, 22 bp, Homo sapiens
gtaaaaaggccaagcccttgtg

SEQ ID NO: 95975 - DNA, 22 bp, Homo sapiens
caggcaggtcagtgaagaagga

SEQ ID NO: 95976 - DNA, 22 bp, Homo sapiens
tgctgggattacagtcatgagc

SEQ ID NO: 95977 - DNA, 22 bp, Homo sapiens
tgaaatgtgtaatgtggatgcc

SEQ ID NO: 95978 - DNA, 22 bp, Homo sapiens
gaaggaagtcattagtgcagac

SEQ ID NO: 95979 - DNA, 22 bp, Homo sapiens
caggaagctgtgaaggagacgg

SEQ ID NO: 95980 - DNA, 22 bp, Homo sapiens
actttaaaactgatcatcagag

SEQ ID NO: 95981 - DNA, 23 bp, Homo sapiens
aggatgtaggatgtatggcagag

SEQ ID NO: 95982 - DNA, 22 bp, Homo sapiens
tccagctgttccatcagctctt

SEQ ID NO: 95983 - DNA, 22 bp, Homo sapiens
actcccagaacatgctcttctt

SEQ ID NO: 95984 - DNA, 22 bp, Homo sapiens
aggcaaggtgctacagacagtg

SEQ ID NO: 95985 - DNA, 22 bp, Homo sapiens
tggtcgaccagttggaaagtaa

SEQ ID NO: 95986 - DNA, 22 bp, Homo sapiens
ttaaatattatgttgtctgcaa

SEQ ID NO: 95987 - DNA, 22 bp, Homo sapiens
ggacaagcctgtgagtgggttt

SEQ ID NO: 95988 - DNA, 22 bp, Homo sapiens
aggaattcaagaccagctgggc

SEQ ID NO: 95989 - DNA, 22 bp, Homo sapiens
gagcaggaaggccagaagggtc

SEQ ID NO: 95990 - DNA, 22 bp, Homo sapiens
cctgggaggctgaggctgcagt

SEQ ID NO: 95991 - DNA, 21 bp, Homo sapiens
tgttttccaccttgaggcaag

SEQ ID NO: 95992 - DNA, 22 bp, Homo sapiens
cagagagaatcttggcagctga

SEQ ID NO: 95993 - DNA, 22 bp, Homo sapiens
ttctgtgaatcttttttcccac

SEQ ID NO: 95994 - DNA, 22 bp, Homo sapiens
tagaatgtaaattccaagggca

SEQ ID NO: 95995 - DNA, 22 bp, Homo sapiens
tttgcttgttcaagatttctgt

SEQ ID NO: 95996 - DNA, 22 bp, Homo sapiens
gggttgtagagctggaagggga

SEQ ID NO: 95997 - DNA, 22 bp, Homo sapiens
ttccatttggcacttcactgag

SEQ ID NO: 95998 - DNA, 20 bp, Homo sapiens
ttcatgggagcaaagaggcc

SEQ ID NO: 95999 - DNA, 20 bp, Homo sapiens
aaaatatgtataactcttct

SEQ ID NO: 96000 - DNA, 22 bp, Homo sapiens
gcccaggctggagtgcagtggc

SEQ ID NO: 96001 - DNA, 22 bp, Homo sapiens
tcactgcaacctccacctcccg

SEQ ID NO: 96002 - DNA, 16 bp, Homo sapiens
atgctgctattagagg

SEQ ID NO: 96003 - DNA, 22 bp, Homo sapiens
tggtatgaccgtggtgcaagca

SEQ ID NO: 96004 - DNA, 22 bp, Homo sapiens
ctggggaacgcagcgagcagcg

SEQ ID NO: 96005 - DNA, 22 bp, Homo sapiens
gtggagagagataagcctggtc

SEQ ID NO: 96006 - DNA, 22 bp, Homo sapiens
agaatagaattctcatagaatt

SEQ ID NO: 96007 - DNA, 22 bp, Homo sapiens
ctcactgcaagctctgcctcca

SEQ ID NO: 96008 - DNA, 22 bp, Homo sapiens
actgtacctcaaactctggaac

SEQ ID NO: 96009 - DNA, 22 bp, Homo sapiens
ttccagctaactcacatccctt

SEQ ID NO: 96010 - DNA, 21 bp, Homo sapiens
tttgtggaattctcactcttc

SEQ ID NO: 96011 - DNA, 22 bp, Homo sapiens
atgaaatatcttgaagaaattc

SEQ ID NO: 96012 - DNA, 22 bp, Homo sapiens
agcctggtttaagcattttata

SEQ ID NO: 96013 - DNA, 22 bp, Homo sapiens
tccagcttataggtagatttaa

SEQ ID NO: 96014 - DNA, 22 bp, Homo sapiens
ctggaaggcagaggttgcagtg

SEQ ID NO: 96015 - DNA, 22 bp, Homo sapiens
gggaaggccttgtcagcggatt

SEQ ID NO: 96016 - DNA, 23 bp, Homo sapiens
aaataggagtatctggatcatga

SEQ ID NO: 96017 - DNA, 22 bp, Homo sapiens
ataccaccatctatgaaaggta

SEQ ID NO: 96018 - DNA, 22 bp, Homo sapiens
ctgggaggcagaggttgcagtg

SEQ ID NO: 96019 - DNA, 22 bp, Homo sapiens
cttctcggccgtgtggatgcgc

SEQ ID NO: 96020 - DNA, 22 bp, Homo sapiens
agtcaggggatctagacttgaa

SEQ ID NO: 96021 - DNA, 22 bp, Homo sapiens
tgagacgaagtcttgctctgtt

SEQ ID NO: 96022 - DNA, 22 bp, Homo sapiens
gggaggttgaggctgcagtgag

SEQ ID NO: 96023 - DNA, 22 bp, Homo sapiens
cggagtcttgctatgttgccca

SEQ ID NO: 96024 - DNA, 22 bp, Homo sapiens
gaatttcctctaaacccctgag

SEQ ID NO: 96025 - DNA, 22 bp, Homo sapiens
ttagggttacaccagcctcctg

SEQ ID NO: 96026 - DNA, 22 bp, Homo sapiens
ggaaggcagaggtgtcgtgggg

SEQ ID NO: 96027 - DNA, 22 bp, Homo sapiens
cttagatgaagtcacagaaccc

SEQ ID NO: 96028 - DNA, 22 bp, Homo sapiens
gagagcaggaggcagcgggacg

SEQ ID NO: 96029 - DNA, 22 bp, Homo sapiens
ttctcagtgaagtttagaacat

SEQ ID NO: 96030 - DNA, 22 bp, Homo sapiens
tctttggtttctgtctctgtaa

SEQ ID NO: 96031 - DNA, 22 bp, Homo sapiens
ataaaatttgctactgttaaat

SEQ ID NO: 96032 - DNA, 22 bp, Homo sapiens
tctttgctccacactctagaga

SEQ ID NO: 96033 - DNA, 22 bp, Homo sapiens
gcaggagaacaaagcaagctgc

SEQ ID NO: 96034 - DNA, 22 bp, Homo sapiens
agggctggagccacagctggga

SEQ ID NO: 96035 - DNA, 22 bp, Homo sapiens
aggaaggactccatggtccgtc

SEQ ID NO: 96036 - DNA, 22 bp, Homo sapiens
agcataagttggtacagccact

SEQ ID NO: 96037 - DNA, 22 bp, Homo sapiens
tgtgtggattcatctcaaagag

SEQ ID NO: 96038 - DNA, 22 bp, Homo sapiens
tggaagacaatttgaaaacatt

SEQ ID NO: 96039 - DNA, 22 bp, Homo sapiens
cagcagcagtggctgcagaaca

SEQ ID NO: 96040 - DNA, 22 bp, Homo sapiens
ctgagggtcaacttgattgtat

SEQ ID NO: 96041 - DNA, 19 bp, Homo sapiens
ccagagagctaggtacaga

SEQ ID NO: 96042 - DNA, 22 bp, Homo sapiens
cctgagtagctggaattaaagg

SEQ ID NO: 96043 - DNA, 22 bp, Homo sapiens
agctggagatgagtgacgtgcc

SEQ ID NO: 96044 - DNA, 22 bp, Homo sapiens
taacatttaaatttttcacata

SEQ ID NO: 96045 - DNA, 22 bp, Homo sapiens
tcagggattgcaaaattcatcc

SEQ ID NO: 96046 - DNA, 22 bp, Homo sapiens
atacctgtgtatccacaagcgt

SEQ ID NO: 96047 - DNA, 22 bp, Homo sapiens
attgtggactgatcagggctag

SEQ ID NO: 96048 - DNA, 22 bp, Homo sapiens
tctgcaacattcctctccccac

SEQ ID NO: 96049 - DNA, 22 bp, Homo sapiens
tttctcttcactgtgtgcctca

SEQ ID NO: 96050 - DNA, 22 bp, Homo sapiens
gcaactgaacatgtgtgtggcc

SEQ ID NO: 96051 - DNA, 22 bp, Homo sapiens
ggaggcggaggttgcagtgagc

SEQ ID NO: 96052 - DNA, 22 bp, Homo sapiens
aagaaatgtgaatattgaatag

SEQ ID NO: 96053 - DNA, 22 bp, Homo sapiens
tgttcttgagcctttagaccta

SEQ ID NO: 96054 - DNA, 22 bp, Homo sapiens
cactgcaagcaagctccgcctc

SEQ ID NO: 96055 - DNA, 22 bp, Homo sapiens
agaaatatgctgattagatgaa

SEQ ID NO: 96056 - DNA, 22 bp, Homo sapiens
ctggcaggtggaggttgcagtg

SEQ ID NO: 96057 - DNA, 22 bp, Homo sapiens
agcgccgcccctgctggtgttg

SEQ ID NO: 96058 - DNA, 22 bp, Homo sapiens
agatttatgtggtcacactcag

SEQ ID NO: 96059 - DNA, 22 bp, Homo sapiens
aggtcacccgtttgactatcca

SEQ ID NO: 96060 - DNA, 22 bp, Homo sapiens
ttttcatttttgtagatgcaag

SEQ ID NO: 96061 - DNA, 22 bp, Homo sapiens
cccaggagttggaggctgcagt

SEQ ID NO: 96062 - DNA, 22 bp, Homo sapiens
tgggggagctcagtccagccca

SEQ ID NO: 96063 - DNA, 22 bp, Homo sapiens
cactgcaacctccacctcctgg

SEQ ID NO: 96064 - DNA, 22 bp, Homo sapiens
ctgaggtgtgaaatggtggcaa

SEQ ID NO: 96065 - DNA, 22 bp, Homo sapiens
atctggttcttcttaggcatca

SEQ ID NO: 96066 - DNA, 22 bp, Homo sapiens
gtggttttattcgttcctctgt

SEQ ID NO: 96067 - DNA, 22 bp, Homo sapiens
gctcccagtctgatggaggaga

SEQ ID NO: 96068 - DNA, 22 bp, Homo sapiens
ctgctttaaaactgatacatga

SEQ ID NO: 96069 - DNA, 23 bp, Homo sapiens
aggaaagcattcatttttaccat

SEQ ID NO: 96070 - DNA, 22 bp, Homo sapiens
tctgctttcttactaaaaatga

SEQ ID NO: 96071 - DNA, 19 bp, Homo sapiens
tcctggggaggggcatggc

SEQ ID NO: 96072 - DNA, 22 bp, Homo sapiens
tcagccccacggggtcagccaa

SEQ ID NO: 96073 - DNA, 22 bp, Homo sapiens
accacctcatcaagctggattg

SEQ ID NO: 96074 - DNA, 22 bp, Homo sapiens
ttctcatgaaactcgcttcctc

SEQ ID NO: 96075 - DNA, 21 bp, Homo sapiens
tgttttccaccttgaggcaag

SEQ ID NO: 96076 - DNA, 22 bp, Homo sapiens
ggctgggctccgggagcatgcg

SEQ ID NO: 96077 - DNA, 22 bp, Homo sapiens
cggaagagggacagcgccagcc

SEQ ID NO: 96078 - DNA, 22 bp, Homo sapiens
tgagcaggcgcagcaggaggtc

SEQ ID NO: 96079 - DNA, 22 bp, Homo sapiens
ttggaacatgccggggtccagg

SEQ ID NO: 96080 - DNA, 22 bp, Homo sapiens
agtttgggtggaacagagtcgt

SEQ ID NO: 96081 - DNA, 22 bp, Homo sapiens
cagagctggtgtgtcctggcat

SEQ ID NO: 96082 - DNA, 22 bp, Homo sapiens
acccaggctggcgtgcagtggc

SEQ ID NO: 96083 - DNA, 22 bp, Homo sapiens
gctgtccagcccttgttcacct

SEQ ID NO: 96084 - DNA, 22 bp, Homo sapiens
aggggaatgggtagactgttga

SEQ ID NO: 96085 - DNA, 23 bp, Homo sapiens
ggctgggagctccgggtgcacgt

SEQ ID NO: 96086 - DNA, 22 bp, Homo sapiens
cccagttgttgccggctctgga

SEQ ID NO: 96087 - DNA, 22 bp, Homo sapiens
ttccagctaactcacatccctt

SEQ ID NO: 96088 - DNA, 22 bp, Homo sapiens
ctgggtggcagagcctgcagtg

SEQ ID NO: 96089 - DNA, 22 bp, Homo sapiens
aggtggagaagagatgggcagt

SEQ ID NO: 96090 - DNA, 22 bp, Homo sapiens
gcagagtgctgtcgtacgcccc

SEQ ID NO: 96091 - DNA, 22 bp, Homo sapiens
cccagggaggcccaggctctgc

SEQ ID NO: 96092 - DNA, 22 bp, Homo sapiens
tcccagattcctgctcttatat

SEQ ID NO: 96093 - DNA, 22 bp, Homo sapiens
gagaggaagccttctgtacttg

SEQ ID NO: 96094 - DNA, 22 bp, Homo sapiens
caattgacaatgacagtgtcaa

SEQ ID NO: 96095 - DNA, 22 bp, Homo sapiens
ggtgccaggctgtagtcagggt

SEQ ID NO: 96096 - DNA, 22 bp, Homo sapiens
gtgctggggagataggaagaga

SEQ ID NO: 96097 - DNA, 22 bp, Homo sapiens
tcctcctgtctaccagttcctg

SEQ ID NO: 96098 - DNA, 22 bp, Homo sapiens
tggggaaaatgcttgtagtcag

SEQ ID NO: 96099 - DNA, 22 bp, Homo sapiens
aactatgttaataagtttcatt

SEQ ID NO: 96100 - DNA, 22 bp, Homo sapiens
ctgaagagaaagggagctcttc

SEQ ID NO: 96101 - DNA, 22 bp, Homo sapiens
agaagcagaaactgggcttgtg

SEQ ID NO: 96102 - DNA, 22 bp, Homo sapiens
cacctagggtttcgcctttctt

SEQ ID NO: 96103 - DNA, 22 bp, Homo sapiens
actgcaacacctcctgggttca

SEQ ID NO: 96104 - DNA, 22 bp, Homo sapiens
gggaaggaaagttattagcaga

SEQ ID NO: 96105 - DNA, 22 bp, Homo sapiens
gggtggaaagtatttggggacc

SEQ ID NO: 96106 - DNA, 22 bp, Homo sapiens
ccctggaggttgaggctgcagt

SEQ ID NO: 96107 - DNA, 22 bp, Homo sapiens
tttggcttctcctaccacctct

SEQ ID NO: 96108 - DNA, 22 bp, Homo sapiens
cccaggaattggaggctgcagt

SEQ ID NO: 96109 - DNA, 22 bp, Homo sapiens
cccaggaggcctgcctggccgg

SEQ ID NO: 96110 - DNA, 22 bp, Homo sapiens
cactctcagcataatgaatgtg

SEQ ID NO: 96111 - DNA, 22 bp, Homo sapiens
caacatggtaaaaccccgtctc

SEQ ID NO: 96112 - DNA, 22 bp, Homo sapiens
gggctgagacgatggggtcttc

SEQ ID NO: 96113 - DNA, 21 bp, Homo sapiens
aggcttggatctagacaggcc

SEQ ID NO: 96114 - DNA, 22 bp, Homo sapiens
ggaagaaaggtggacaacaggt

SEQ ID NO: 96115 - DNA, 22 bp, Homo sapiens
gatctcaaagcagtgtgggttg

SEQ ID NO: 96116 - DNA, 22 bp, Homo sapiens
ttcatatttctttaaggacttt

SEQ ID NO: 96117 - DNA, 18 bp, Homo sapiens
acacttcctggtggtgtg

SEQ ID NO: 96118 - DNA, 22 bp, Homo sapiens
aatgttacgatcaacaacacat

SEQ ID NO: 96119 - DNA, 22 bp, Homo sapiens
tctcttggagagtccatcatca

SEQ ID NO: 96120 - DNA, 17 bp, Homo sapiens
ctggagcagacaaaagg

SEQ ID NO: 96121 - DNA, 23 bp, Homo sapiens
tcccatctattgtgatcaatgcc

SEQ ID NO: 96122 - DNA, 22 bp, Homo sapiens
tgcacgtgggctctctgctctt

SEQ ID NO: 96123 - DNA, 22 bp, Homo sapiens
agggccagcactcctggcagga

SEQ ID NO: 96124 - DNA, 22 bp, Homo sapiens
ccaggaggcggaaggtacagtg

SEQ ID NO: 96125 - DNA, 22 bp, Homo sapiens
catccatagcttgatctgttcc

SEQ ID NO: 96126 - DNA, 22 bp, Homo sapiens
gctcactgcaagctccgcctcc

SEQ ID NO: 96127 - DNA, 22 bp, Homo sapiens
ctgtcctgccagtcctggactc

SEQ ID NO: 96128 - DNA, 17 bp, Homo sapiens
tgggttggggatttgga

SEQ ID NO: 96129 - DNA, 22 bp, Homo sapiens
ctgtccatggtccttattacca

SEQ ID NO: 96130 - DNA, 22 bp, Homo sapiens
gcaggcagaggtggaggagaca

SEQ ID NO: 96131 - DNA, 22 bp, Homo sapiens
tagatgaccttgtgttaggcaa

SEQ ID NO: 96132 - DNA, 22 bp, Homo sapiens
gctggagaggatcccaaagcca

SEQ ID NO: 96133 - DNA, 19 bp, Homo sapiens
gactcacaccttccgctgt

SEQ ID NO: 96134 - DNA, 22 bp, Homo sapiens
gtccctgagcctggcatttccc

SEQ ID NO: 96135 - DNA, 22 bp, Homo sapiens
ggggtgggcgtgcagggacacc

SEQ ID NO: 96136 - DNA, 22 bp, Homo sapiens
cagggatggcgctggctgcccg

SEQ ID NO: 96137 - DNA, 22 bp, Homo sapiens
aagaatgagctcaaagatctta

SEQ ID NO: 96138 - DNA, 20 bp, Homo sapiens
ctgggtggcaagcaaggggg

SEQ ID NO: 96139 - DNA, 22 bp, Homo sapiens
cccaaagcagttgatgtaccag

SEQ ID NO: 96140 - DNA, 22 bp, Homo sapiens
ggaggggatttagtagatgcta

SEQ ID NO: 96141 - DNA, 22 bp, Homo sapiens
tgaggtgccacccaagagcctt

SEQ ID NO: 96142 - DNA, 22 bp, Homo sapiens
acatcctcccgatctactggct

SEQ ID NO: 96143 - DNA, 22 bp, Homo sapiens
tatgttgcaccaacctaataat

SEQ ID NO: 96144 - DNA, 22 bp, Homo sapiens
ggcaggaggtgagtggcgggtg

SEQ ID NO: 96145 - DNA, 22 bp, Homo sapiens
attataggcttgagccaccgtg

SEQ ID NO: 96146 - DNA, 22 bp, Homo sapiens
cctggagagctcgggccaggca

SEQ ID NO: 96147 - DNA, 22 bp, Homo sapiens
tgggaagggtcaacagctggaa

SEQ ID NO: 96148 - DNA, 22 bp, Homo sapiens
ctgggcagctgtatcagggagt

SEQ ID NO: 96149 - DNA, 22 bp, Homo sapiens
tttgggttcagacatgattaca

SEQ ID NO: 96150 - DNA, 22 bp, Homo sapiens
ggctgtggcagctggaagtggt

SEQ ID NO: 96151 - DNA, 22 bp, Homo sapiens
cacccaggctggagtgcagtga

SEQ ID NO: 96152 - DNA, 22 bp, Homo sapiens
ctgaggctggagtgcagtggtg

SEQ ID NO: 96153 - DNA, 22 bp, Homo sapiens
gagctgggcctgcgagtgctgc

SEQ ID NO: 96154 - DNA, 22 bp, Homo sapiens
tcactgcaacctccacctcctg

SEQ ID NO: 96155 - DNA, 22 bp, Homo sapiens
ggacaagcctgtgagtgggttt

SEQ ID NO: 96156 - DNA, 22 bp, Homo sapiens
aggggatggagctggaaggcag

SEQ ID NO: 96157 - DNA, 22 bp, Homo sapiens
ggtggcagtagcactgggcctg

SEQ ID NO: 96158 - DNA, 22 bp, Homo sapiens
aacccgggaggcagaggttgtg

SEQ ID NO: 96159 - DNA, 22 bp, Homo sapiens
gagagagctctgtgcctgggat

SEQ ID NO: 96160 - DNA, 22 bp, Homo sapiens
ttttcctggagatggagttgtt

SEQ ID NO: 96161 - DNA, 22 bp, Homo sapiens
cacccaggctggagtgcagtgg

SEQ ID NO: 96162 - DNA, 22 bp, Homo sapiens
aggactgggtgcagagggcatc

SEQ ID NO: 96163 - DNA, 22 bp, Homo sapiens
ctgtccatattcaaggggtagg

SEQ ID NO: 96164 - DNA, 22 bp, Homo sapiens
gggctgggattgcttgctgtga

SEQ ID NO: 96165 - DNA, 16 bp, Homo sapiens
gcagaggaaaggggag

SEQ ID NO: 96166 - DNA, 22 bp, Homo sapiens
gacaggtgctaagggacctggc

SEQ ID NO: 96167 - DNA, 22 bp, Homo sapiens
ccctgccttgtctgggctaggt

SEQ ID NO: 96168 - DNA, 22 bp, Homo sapiens
gggaaatctcgtcctctattta

SEQ ID NO: 96169 - DNA, 22 bp, Homo sapiens
caggagtgtctccacacagcaa

SEQ ID NO: 96170 - DNA, 22 bp, Homo sapiens
ttttccttcatatcccttatgt

SEQ ID NO: 96171 - DNA, 22 bp, Homo sapiens
cctgagtagctggaattaaagg

SEQ ID NO: 96172 - DNA, 22 bp, Homo sapiens
attgattttcagactatgcgag

SEQ ID NO: 96173 - DNA, 22 bp, Homo sapiens
tgtttgagttctagcgcattta

SEQ ID NO: 96174 - DNA, 22 bp, Homo sapiens
tagggcaatatttcccagaaaa

SEQ ID NO: 96175 - DNA, 22 bp, Homo sapiens
cccaggaggttgaggctgcagt

SEQ ID NO: 96176 - DNA, 22 bp, Homo sapiens
gtagggctcagtaaatactttg

SEQ ID NO: 96177 - DNA, 22 bp, Homo sapiens
tttggtgtgcaccttgcggtgc

SEQ ID NO: 96178 - DNA, 22 bp, Homo sapiens
atattacacacggtatcacggg

SEQ ID NO: 96179 - DNA, 22 bp, Homo sapiens
aggaatgacagatgtccgcacc

SEQ ID NO: 96180 - DNA, 22 bp, Homo sapiens
gggacatctttctagtcagggt

SEQ ID NO: 96181 - DNA, 22 bp, Homo sapiens
ggctgagtctgtgacccatgcg

SEQ ID NO: 96182 - DNA, 22 bp, Homo sapiens
ggtgacagtggttaaaatttgt

SEQ ID NO: 96183 - DNA, 22 bp, Homo sapiens
agggctggagccacagctggga

SEQ ID NO: 96184 - DNA, 22 bp, Homo sapiens
ctatggtctggaccgaggtcct

SEQ ID NO: 96185 - DNA, 17 bp, Homo sapiens
cccgttctcttcgctgg

SEQ ID NO: 96186 - DNA, 22 bp, Homo sapiens
ccaggaggtggaggttgcggtg

SEQ ID NO: 96187 - DNA, 22 bp, Homo sapiens
gcctggagaaaggaaggtggga

SEQ ID NO: 96188 - DNA, 22 bp, Homo sapiens
tttgcttgttcaagatttctgt

SEQ ID NO: 96189 - DNA, 22 bp, Homo sapiens
gccggggctggggagagacatg

SEQ ID NO: 96190 - DNA, 22 bp, Homo sapiens
ccgggcctcgggacaccgggta

SEQ ID NO: 96191 - DNA, 22 bp, Homo sapiens
gcaggtggatcaccacgtcagg

SEQ ID NO: 96192 - DNA, 22 bp, Homo sapiens
agcttgggcaacacagcaagac

SEQ ID NO: 96193 - DNA, 22 bp, Homo sapiens
ttgaggcaggtccgggtccttc

SEQ ID NO: 96194 - DNA, 22 bp, Homo sapiens
aaatcccatcggagaggaggat

SEQ ID NO: 96195 - DNA, 22 bp, Homo sapiens
cacagtcctgccagagggcctt

SEQ ID NO: 96196 - DNA, 22 bp, Homo sapiens
aagagggaaattgttggctgct

SEQ ID NO: 96197 - DNA, 22 bp, Homo sapiens
aggcaagggggcgccaccttcc

SEQ ID NO: 96198 - DNA, 22 bp, Homo sapiens
tggttgcctctcagagattccg

SEQ ID NO: 96199 - DNA, 22 bp, Homo sapiens
ctggagagaatgtggaatgatt

SEQ ID NO: 96200 - DNA, 22 bp, Homo sapiens
tgggcaggggccctgcttccgt

SEQ ID NO: 96201 - DNA, 22 bp, Homo sapiens
agaagccaccagctgaggaaga

SEQ ID NO: 96202 - DNA, 22 bp, Homo sapiens
actgcaacctccacctcctggg

SEQ ID NO: 96203 - DNA, 21 bp, Homo sapiens
gggcagaggggcctcctgggt

SEQ ID NO: 96204 - DNA, 22 bp, Homo sapiens
gctcactgcaacctccgccttc

SEQ ID NO: 96205 - DNA, 22 bp, Homo sapiens
tctgacattttgagaatgacat

SEQ ID NO: 96206 - DNA, 22 bp, Homo sapiens
tcactgcaacctccacctcccg

SEQ ID NO: 96207 - DNA, 22 bp, Homo sapiens
ggaggtgggctaaggactctct

SEQ ID NO: 96208 - DNA, 22 bp, Homo sapiens
aggtggaaatggctttcctagg

SEQ ID NO: 96209 - DNA, 22 bp, Homo sapiens
caacatggcgaaaccccatctc

SEQ ID NO: 96210 - DNA, 22 bp, Homo sapiens
ggtcagaggtcccagaagaagc

SEQ ID NO: 96211 - DNA, 22 bp, Homo sapiens
gtggcagagccaaggctggagc

SEQ ID NO: 96212 - DNA, 22 bp, Homo sapiens
catgcggctctttccaaaccgg

SEQ ID NO: 96213 - DNA, 22 bp, Homo sapiens
tcatctaagagtcttacattta

SEQ ID NO: 96214 - DNA, 22 bp, Homo sapiens
ggaggacaggggctgcagcaca

SEQ ID NO: 96215 - DNA, 20 bp, Homo sapiens
aggaaaaatggaaactggag

SEQ ID NO: 96216 - DNA, 22 bp, Homo sapiens
gacttttgaataaggtaggata

SEQ ID NO: 96217 - DNA, 22 bp, Homo sapiens
tctgacattagattaattggaa

SEQ ID NO: 96218 - DNA, 22 bp, Homo sapiens
cagccacttgtgatgctgggga

SEQ ID NO: 96219 - DNA, 22 bp, Homo sapiens
cggcatgggcgtccccctcact

SEQ ID NO: 96220 - DNA, 22 bp, Homo sapiens
atgaatgccacgatttcatcct

SEQ ID NO: 96221 - DNA, 22 bp, Homo sapiens
ccaggaggtggagattgcagtg

SEQ ID NO: 96222 - DNA, 22 bp, Homo sapiens
tggggtacttgtatcaaagcac

SEQ ID NO: 96223 - DNA, 21 bp, Homo sapiens
tcgtgcagcagctgaggcttg

SEQ ID NO: 96224 - DNA, 22 bp, Homo sapiens
gaggtgggtgtatcacaggtca

SEQ ID NO: 96225 - DNA, 20 bp, Homo sapiens
ataaaataactgccacaaga

SEQ ID NO: 96226 - DNA, 22 bp, Homo sapiens
aggctgagataggtggatcatt

SEQ ID NO: 96227 - DNA, 22 bp, Homo sapiens
tgggaaggggagctggaaagga

SEQ ID NO: 96228 - DNA, 22 bp, Homo sapiens
tggcactgaagctggaaagcct

SEQ ID NO: 96229 - DNA, 22 bp, Homo sapiens
caggccagggttgagaagagaa

SEQ ID NO: 96230 - DNA, 20 bp, Homo sapiens
tttgagaccagtctgcccaa

SEQ ID NO: 96231 - DNA, 22 bp, Homo sapiens
aagcatttcaggtagagatatt

SEQ ID NO: 96232 - DNA, 22 bp, Homo sapiens
gcgagggcacgcggttgaaggc

SEQ ID NO: 96233 - DNA, 22 bp, Homo sapiens
aggtggcagatgggggtgctcg

SEQ ID NO: 96234 - DNA, 22 bp, Homo sapiens
aacccgggaggcggaggttgtg

SEQ ID NO: 96235 - DNA, 22 bp, Homo sapiens
tccaggtgggctgcacccaggc

SEQ ID NO: 96236 - DNA, 22 bp, Homo sapiens
aggcaggaggatcatggatgca

SEQ ID NO: 96237 - DNA, 23 bp, Homo sapiens
cagagctggctcagagctgcctg

SEQ ID NO: 96238 - DNA, 22 bp, Homo sapiens
ttttcctttgattcccagatgt

SEQ ID NO: 96239 - DNA, 22 bp, Homo sapiens
cctactctgagcgcctccgcat

SEQ ID NO: 96240 - DNA, 22 bp, Homo sapiens
caggaggacatactggctcaca

SEQ ID NO: 96241 - DNA, 22 bp, Homo sapiens
tggacaggcaagcaagacatac

SEQ ID NO: 96242 - DNA, 18 bp, Homo sapiens
ggtgagggagctggaagc

SEQ ID NO: 96243 - DNA, 22 bp, Homo sapiens
gctggggaggcagcagagaaca

SEQ ID NO: 96244 - DNA, 22 bp, Homo sapiens
agaacagaggccttatgtttca

SEQ ID NO: 96245 - DNA, 22 bp, Homo sapiens
ttatttaaaagtggtaagattc

SEQ ID NO: 96246 - DNA, 22 bp, Homo sapiens
cggctgggttcggctgcaggcc

SEQ ID NO: 96247 - DNA, 22 bp, Homo sapiens
ttgtgaatagtgccgctataaa

SEQ ID NO: 96248 - DNA, 22 bp, Homo sapiens
cagagagaatcttggcagctga

SEQ ID NO: 96249 - DNA, 22 bp, Homo sapiens
gcgaggaggggtgctgggcccc

SEQ ID NO: 96250 - DNA, 22 bp, Homo sapiens
gggcagagactcagaaacagaa

SEQ ID NO: 96251 - DNA, 22 bp, Homo sapiens
catcaagtggttctccaggttg

SEQ ID NO: 96252 - DNA, 22 bp, Homo sapiens
gctgacccctacaggttgtgtt

SEQ ID NO: 96253 - DNA, 22 bp, Homo sapiens
atgggctgtccattgctggctg

SEQ ID NO: 96254 - DNA, 22 bp, Homo sapiens
agggaagaggaccagagtctct

SEQ ID NO: 96255 - DNA, 22 bp, Homo sapiens
gagtggggggtccgtctcagtg

SEQ ID NO: 96256 - DNA, 22 bp, Homo sapiens
actgcactcctgcctgggtaac

SEQ ID NO: 96257 - DNA, 22 bp, Homo sapiens
ggctcactgcaacttccgcctc

SEQ ID NO: 96258 - DNA, 18 bp, Homo sapiens
tctggaacaacttcatgt

SEQ ID NO: 96259 - DNA, 22 bp, Homo sapiens
aggccgaggcgggcggatcacc

SEQ ID NO: 96260 - DNA, 22 bp, Homo sapiens
atctcagttcaggctccactgt

SEQ ID NO: 96261 - DNA, 22 bp, Homo sapiens
aggtggggaggagtgtctcttt

SEQ ID NO: 96262 - DNA, 22 bp, Homo sapiens
tgggtgagcggctgcacacccg

SEQ ID NO: 96263 - DNA, 22 bp, Homo sapiens
aacccgggaggtggaggttatg

SEQ ID NO: 96264 - DNA, 22 bp, Homo sapiens
aatgttgcagagtgattgtcca

SEQ ID NO: 96265 - DNA, 22 bp, Homo sapiens
ctgagggtcaacttgattgtat

SEQ ID NO: 96266 - DNA, 22 bp, Homo sapiens
atttacaggtagaattttaagt

SEQ ID NO: 96267 - DNA, 22 bp, Homo sapiens
ggcagggcaggaaagtcaggaa

SEQ ID NO: 96268 - DNA, 22 bp, Homo sapiens
attctggacaaggcaagctcct

SEQ ID NO: 96269 - DNA, 22 bp, Homo sapiens
acttttaaatgagtttcagttg

SEQ ID NO: 96270 - DNA, 22 bp, Homo sapiens
actaggggctcaggcccaggga

SEQ ID NO: 96271 - DNA, 22 bp, Homo sapiens
gtggagaggaacccagctctgt

SEQ ID NO: 96272 - DNA, 22 bp, Homo sapiens
ggagcatgcgctctgtgaccga

SEQ ID NO: 96273 - DNA, 22 bp, Homo sapiens
agatcacagtggcaactccctt

SEQ ID NO: 96274 - DNA, 22 bp, Homo sapiens
ggttcccggatctccgagtccc

SEQ ID NO: 96275 - DNA, 22 bp, Homo sapiens
aaggagcacacaatctagaacc

SEQ ID NO: 96276 - DNA, 22 bp, Homo sapiens
atatatttgagaatattcatga

SEQ ID NO: 96277 - DNA, 22 bp, Homo sapiens
ctttaattgtagctcccataat

SEQ ID NO: 96278 - DNA, 19 bp, Homo sapiens
ctgtccttggctgcactgt

SEQ ID NO: 96279 - DNA, 22 bp, Homo sapiens
acccaggctggagtgcagtgat

SEQ ID NO: 96280 - DNA, 22 bp, Homo sapiens
tgggcagggagctggaaccaca

SEQ ID NO: 96281 - DNA, 22 bp, Homo sapiens
aggatcagggtggtggaagtca

SEQ ID NO: 96282 - DNA, 22 bp, Homo sapiens
ctttttcactgtgtcctcacac

SEQ ID NO: 96283 - DNA, 22 bp, Homo sapiens
cctcgacctccccaggctcagg

SEQ ID NO: 96284 - DNA, 22 bp, Homo sapiens
caggaggattgcttgaggccag

SEQ ID NO: 96285 - DNA, 22 bp, Homo sapiens
ccaggaggcggaggttgcagtg

SEQ ID NO: 96286 - DNA, 22 bp, Homo sapiens
gccagtggtcactgaggaagaa

SEQ ID NO: 96287 - DNA, 22 bp, Homo sapiens
ttgtcttttgtgggaaatatgg

SEQ ID NO: 96288 - DNA, 22 bp, Homo sapiens
ccaggaggttgaggctgcagtg

SEQ ID NO: 96289 - DNA, 22 bp, Homo sapiens
tagccgggtgtggtggaactcc

SEQ ID NO: 96290 - DNA, 22 bp, Homo sapiens
ggggaccctcaggactgcgtct

SEQ ID NO: 96291 - DNA, 22 bp, Homo sapiens
tgattcatcagaataggagttt

SEQ ID NO: 96292 - DNA, 22 bp, Homo sapiens
cggtcaggtgcagcgttggcac

SEQ ID NO: 96293 - DNA, 22 bp, Homo sapiens
agttgggtttgtgtcagttgca

SEQ ID NO: 96294 - DNA, 23 bp, Homo sapiens
tgaggcaggcggatcacgaggtc

SEQ ID NO: 96295 - DNA, 20 bp, Homo sapiens
tctgccacgtctggtgactg

SEQ ID NO: 96296 - DNA, 22 bp, Homo sapiens
ggctcaatgcaacttctgcctc

SEQ ID NO: 96297 - DNA, 18 bp, Homo sapiens
atgagaggtgtcagaaga

SEQ ID NO: 96298 - DNA, 22 bp, Homo sapiens
aacactctctgttggtaaggct

SEQ ID NO: 96299 - DNA, 22 bp, Homo sapiens
tctcctggtacccttcctagca

SEQ ID NO: 96300 - DNA, 22 bp, Homo sapiens
ctctggagtgtctggccagggt

SEQ ID NO: 96301 - DNA, 22 bp, Homo sapiens
tgttgattagtgtttagactta

SEQ ID NO: 96302 - DNA, 22 bp, Homo sapiens
gctcactgcaagctctgcctcc

SEQ ID NO: 96303 - DNA, 22 bp, Homo sapiens
catcaagtaggtcctttcaaga

SEQ ID NO: 96304 - DNA, 22 bp, Homo sapiens
catagcggtattccacgtggtt

SEQ ID NO: 96305 - DNA, 22 bp, Homo sapiens
gaaagagaacctgggcctagat

SEQ ID NO: 96306 - DNA, 19 bp, Homo sapiens
ccagagagctaggtacaga

SEQ ID NO: 96307 - DNA, 22 bp, Homo sapiens
gggcagagagctggaactcctt

SEQ ID NO: 96308 - DNA, 22 bp, Homo sapiens
tcattgagttgcacttttacta

SEQ ID NO: 96309 - DNA, 21 bp, Homo sapiens
agggttttatagatctcttcc

SEQ ID NO: 96310 - DNA, 22 bp, Homo sapiens
tgaggcaggagttcaggctgcg

SEQ ID NO: 96311 - DNA, 22 bp, Homo sapiens
ggagagcagggaggctgctctg

SEQ ID NO: 96312 - DNA, 22 bp, Homo sapiens
ttctggaaggatgtttctatct

SEQ ID NO: 96313 - DNA, 22 bp, Homo sapiens
gagtagaactggttatctaata

SEQ ID NO: 96314 - DNA, 22 bp, Homo sapiens
agagcacagccaccatttacaa

SEQ ID NO: 96315 - DNA, 22 bp, Homo sapiens
ggctgggcaggtctgcacaggg

SEQ ID NO: 96316 - DNA, 22 bp, Homo sapiens
gaggaggcttccgggaggcacg

SEQ ID NO: 96317 - DNA, 22 bp, Homo sapiens
aactctatttaccctactaaac

SEQ ID NO: 96318 - DNA, 22 bp, Homo sapiens
ggaggcagaatagagtgtgggt

SEQ ID NO: 96319 - DNA, 22 bp, Homo sapiens
ttggagaggcagtcttgctctg

SEQ ID NO: 96320 - DNA, 22 bp, Homo sapiens
tttgaggttagctagcagatca

SEQ ID NO: 96321 - DNA, 22 bp, Homo sapiens
tgtgcctgttcccactttgcct

SEQ ID NO: 96322 - DNA, 22 bp, Homo sapiens
tctaccctgcggtcttggggca

SEQ ID NO: 96323 - DNA, 22 bp, Homo sapiens
cacccaggttggagtgcagtgg

SEQ ID NO: 96324 - DNA, 22 bp, Homo sapiens
aggaaagcttggcaaactaaat

SEQ ID NO: 96325 - DNA, 22 bp, Homo sapiens
tctggcttcgcagctcccagcc

SEQ ID NO: 96326 - DNA, 22 bp, Homo sapiens
atttttggctgttgtcagaggt

SEQ ID NO: 96327 - DNA, 22 bp, Homo sapiens
agaggacagagtgctggattta

SEQ ID NO: 96328 - DNA, 22 bp, Homo sapiens
ctgaggcaggcagatcacttga

SEQ ID NO: 96329 - DNA, 22 bp, Homo sapiens
cccaggaggtggaggctgcagt

SEQ ID NO: 96330 - DNA, 22 bp, Homo sapiens
ggcggaggttgcagtaagccga

SEQ ID NO: 96331 - DNA, 22 bp, Homo sapiens
acccagggctcaagcgtaggca

SEQ ID NO: 96332 - DNA, 22 bp, Homo sapiens
tagcagcaaagcaggatctgct

SEQ ID NO: 96333 - DNA, 22 bp, Homo sapiens
ccggcgaccgctgtcggaggcg

SEQ ID NO: 96334 - DNA, 22 bp, Homo sapiens
aggcaaggtgctacagacagtg

SEQ ID NO: 96335 - DNA, 22 bp, Homo sapiens
tggcaaattccaaagttaattc

SEQ ID NO: 96336 - DNA, 22 bp, Homo sapiens
catggcactgagcaggtatgca

SEQ ID NO: 96337 - DNA, 22 bp, Homo sapiens
tctttgctccacactctagaga

SEQ ID NO: 96338 - DNA, 22 bp, Homo sapiens
aggagcagaccgtagtcctgca

SEQ ID NO: 96339 - DNA, 22 bp, Homo sapiens
gggcaggggtcagtggccccaa

SEQ ID NO: 96340 - DNA, 22 bp, Homo sapiens
tgaggcaggagaatcacatgaa

SEQ ID NO: 96341 - DNA, 22 bp, Homo sapiens
gcagagccatgggaggtttttg

SEQ ID NO: 96342 - DNA, 22 bp, Homo sapiens
acccaggctggagtgcagtggc

SEQ ID NO: 96343 - DNA, 22 bp, Homo sapiens
atatgggggggcgtgcagagga

SEQ ID NO: 96344 - DNA, 22 bp, Homo sapiens
atatattttttgagacagagtc

SEQ ID NO: 96345 - DNA, 22 bp, Homo sapiens
cagaggaacgtttggattgatt

SEQ ID NO: 96346 - DNA, 22 bp, Homo sapiens
ttggtccactgtgaaattggga

SEQ ID NO: 96347 - DNA, 23 bp, Homo sapiens
cagagctggcttcatgggtgtgc

SEQ ID NO: 96348 - DNA, 22 bp, Homo sapiens
gaggcaggcagattgcttgagg

SEQ ID NO: 96349 - DNA, 22 bp, Homo sapiens
aggcactgtgcagtcccaagca

SEQ ID NO: 96350 - DNA, 22 bp, Homo sapiens
cttctgagatgttgttttacag

SEQ ID NO: 96351 - DNA, 22 bp, Homo sapiens
aggctgaggcaagaggatcact

SEQ ID NO: 96352 - DNA, 22 bp, Homo sapiens
caggaaggggctcactctggcc

SEQ ID NO: 96353 - DNA, 22 bp, Homo sapiens
ttctgggcacacaggccctggt

SEQ ID NO: 96354 - DNA, 22 bp, Homo sapiens
actccacaccacgggggccgcc

SEQ ID NO: 96355 - DNA, 22 bp, Homo sapiens
ggtcttttctgctgcaggttgt

SEQ ID NO: 96356 - DNA, 17 bp, Homo sapiens
ggctgcagtccaggagg

SEQ ID NO: 96357 - DNA, 22 bp, Homo sapiens
ttatggttcaggtgagggtgta

SEQ ID NO: 96358 - DNA, 22 bp, Homo sapiens
ctgaggaaggctgggggcatcc

SEQ ID NO: 96359 - DNA, 23 bp, Homo sapiens
ggggcctgcaccggtctgcgcgg

SEQ ID NO: 96360 - DNA, 22 bp, Homo sapiens
agctgaacgtgcttctgcagca

SEQ ID NO: 96361 - DNA, 22 bp, Homo sapiens
acctggaggcagaggttgcagt

SEQ ID NO: 96362 - DNA, 21 bp, Homo sapiens
cccgcacagcggtaggccgcc

SEQ ID NO: 96363 - DNA, 22 bp, Homo sapiens
ggtccccccatggtgagcactg

SEQ ID NO: 96364 - DNA, 22 bp, Homo sapiens
acccaggctggagtgcagtggg

SEQ ID NO: 96365 - DNA, 22 bp, Homo sapiens
aaattgcaaaagtacttttagg

SEQ ID NO: 96366 - DNA, 22 bp, Homo sapiens
gaggcaggaggattgcttgagc

SEQ ID NO: 96367 - DNA, 22 bp, Homo sapiens
aggtcaagggagctgagggcca

SEQ ID NO: 96368 - DNA, 17 bp, Homo sapiens
cgggcatggagggcagg

SEQ ID NO: 96369 - DNA, 22 bp, Homo sapiens
ggaggagcatgagagggtagtg

SEQ ID NO: 96370 - DNA, 22 bp, Homo sapiens
agcccaggagtttgaggctgtg

SEQ ID NO: 96371 - DNA, 22 bp, Homo sapiens
tagcataacaggtaagagtgag

SEQ ID NO: 96372 - DNA, 22 bp, Homo sapiens
tgcatattatgtgtatctgtct

SEQ ID NO: 96373 - DNA, 22 bp, Homo sapiens
gcccccgtagtagatgaggcgc

SEQ ID NO: 96374 - DNA, 22 bp, Homo sapiens
tgcacgtgtgagcattcacatg

SEQ ID NO: 96375 - DNA, 22 bp, Homo sapiens
gccgggaccaaggccacggagc

SEQ ID NO: 96376 - DNA, 19 bp, Homo sapiens
ggagtttccaatgggtaaa

SEQ ID NO: 96377 - DNA, 21 bp, Homo sapiens
gggcactgaaagggaatagca

SEQ ID NO: 96378 - DNA, 16 bp, Homo sapiens
tgggtgggaggagcgg

SEQ ID NO: 96379 - DNA, 22 bp, Homo sapiens
tcgctgaggctgcacggctgcc

SEQ ID NO: 96380 - DNA, 22 bp, Homo sapiens
actgggcagcagctcgagccgc

SEQ ID NO: 96381 - DNA, 22 bp, Homo sapiens
gatgcgggcccgctccactgcc

SEQ ID NO: 96382 - DNA, 22 bp, Homo sapiens
tcaggaggcggaggttgcagtg

SEQ ID NO: 96383 - DNA, 22 bp, Homo sapiens
ggtgggagagcttgctttgatg

SEQ ID NO: 96384 - DNA, 22 bp, Homo sapiens
ctcactgcaagctcagcctccc

SEQ ID NO: 96385 - DNA, 22 bp, Homo sapiens
acggcaggctcagagctggaat

SEQ ID NO: 96386 - DNA, 22 bp, Homo sapiens
ctgaggcaggagagttgcttga

SEQ ID NO: 96387 - DNA, 22 bp, Homo sapiens
agccggccatgtggtcttgtgc

SEQ ID NO: 96388 - DNA, 22 bp, Homo sapiens
aagcacaatgaacatcttagat

SEQ ID NO: 96389 - DNA, 20 bp, Homo sapiens
tcacatcctctcccaacatg

SEQ ID NO: 96390 - DNA, 19 bp, Homo sapiens
ttcacattggaagaagtag

SEQ ID NO: 96391 - DNA, 23 bp, Homo sapiens
actcgtggaattctctgcgatcg

SEQ ID NO: 96392 - DNA, 22 bp, Homo sapiens
atgaggcaggtggaggctgcca

SEQ ID NO: 96393 - DNA, 22 bp, Homo sapiens
gtgggtggacggtgcttttgtt

SEQ ID NO: 96394 - DNA, 17 bp, Homo sapiens
gaaatcggacgatttta

SEQ ID NO: 96395 - DNA, 22 bp, Homo sapiens
tgggttttatatgtggtggaca

SEQ ID NO: 96396 - DNA, 22 bp, Homo sapiens
ccaggaggcggaggttgcagcg

SEQ ID NO: 96397 - DNA, 21 bp, Homo sapiens
gtggttctagagaaacagaat

SEQ ID NO: 96398 - DNA, 22 bp, Homo sapiens
aaacatggccattcagactgtg

SEQ ID NO: 96399 - DNA, 22 bp, Homo sapiens
ggcaagagggcagatggagtgc

SEQ ID NO: 96400 - DNA, 22 bp, Homo sapiens
tccaggtgacagagacaggata

SEQ ID NO: 96401 - DNA, 22 bp, Homo sapiens
agaggaagtaatcaggacctgc

SEQ ID NO: 96402 - DNA, 22 bp, Homo sapiens
aggtgacaggacaggagctggt

SEQ ID NO: 96403 - DNA, 22 bp, Homo sapiens
tgctggaggccagaagtctgag

SEQ ID NO: 96404 - DNA, 19 bp, Homo sapiens
gggcaaagtgatcgtcctg

SEQ ID NO: 96405 - DNA, 22 bp, Homo sapiens
aggtgggcggattcatgaggtc

SEQ ID NO: 96406 - DNA, 22 bp, Homo sapiens
ggaatgcactagactgtgaaac

SEQ ID NO: 96407 - DNA, 22 bp, Homo sapiens
tcttggccactaccacctggag

SEQ ID NO: 96408 - DNA, 22 bp, Homo sapiens
gcagaggacacaggagggcaag

SEQ ID NO: 96409 - DNA, 22 bp, Homo sapiens
gctcactgcaacctctgcctcc

SEQ ID NO: 96410 - DNA, 22 bp, Homo sapiens
caggtggcagtgcctgcattct

SEQ ID NO: 96411 - DNA, 22 bp, Homo sapiens
gccctgccctctcggcactcgc

SEQ ID NO: 96412 - DNA, 22 bp, Homo sapiens
actgttgaagtgccagcttgat

SEQ ID NO: 96413 - DNA, 22 bp, Homo sapiens
tccttaggcaatttgggagagt

SEQ ID NO: 96414 - DNA, 22 bp, Homo sapiens
tggtggcactgacatcagacac

SEQ ID NO: 96415 - DNA, 22 bp, Homo sapiens
ctgctgggatagaagtatctca

SEQ ID NO: 96416 - DNA, 22 bp, Homo sapiens
ttagggttacaccagcctcctg

SEQ ID NO: 96417 - DNA, 22 bp, Homo sapiens
acactccagggagggagggaat

SEQ ID NO: 96418 - DNA, 22 bp, Homo sapiens
gagctctgactgctgggtgaca

SEQ ID NO: 96419 - DNA, 22 bp, Homo sapiens
ggtgtgattatgacatgtgact

SEQ ID NO: 96420 - DNA, 22 bp, Homo sapiens
cgcaggtgaaagaggctgggca

SEQ ID NO: 96421 - DNA, 22 bp, Homo sapiens
ggatgttgattgaatggccatt

SEQ ID NO: 96422 - DNA, 22 bp, Homo sapiens
aggtctcttgctgtctctgggc

SEQ ID NO: 96423 - DNA, 22 bp, Homo sapiens
agcaggagtttgatgcttttat

SEQ ID NO: 96424 - DNA, 22 bp, Homo sapiens
gtaggtcagacataagaggaca

SEQ ID NO: 96425 - DNA, 22 bp, Homo sapiens
tcttaagcagagaagaagttga

SEQ ID NO: 96426 - DNA, 22 bp, Homo sapiens
ggggtggatttcaggcggtgtc

SEQ ID NO: 96427 - DNA, 22 bp, Homo sapiens
gaggcagaggttgttgcagtga

SEQ ID NO: 96428 - DNA, 22 bp, Homo sapiens
actgcactccagcctgggtaac

SEQ ID NO: 96429 - DNA, 20 bp, Homo sapiens
ggcagagggcctgggagaag

SEQ ID NO: 96430 - DNA, 19 bp, Homo sapiens
gtgtccatggagcatggag

SEQ ID NO: 96431 - DNA, 22 bp, Homo sapiens
agcccaggttgaggctgcagtg

SEQ ID NO: 96432 - DNA, 22 bp, Homo sapiens
gctggaggatggactggaagaa

SEQ ID NO: 96433 - DNA, 22 bp, Homo sapiens
ggaggaggggtgactgaatgct

SEQ ID NO: 96434 - DNA, 22 bp, Homo sapiens
gaggagggagctggaagctctt

SEQ ID NO: 96435 - DNA, 22 bp, Homo sapiens
gcacatccaatgattgttttga

SEQ ID NO: 96436 - DNA, 22 bp, Homo sapiens
tggtcgaccagttggaaagtaa

SEQ ID NO: 96437 - DNA, 22 bp, Homo sapiens
gtctgctcatgctaccgcgggc

SEQ ID NO: 96438 - DNA, 22 bp, Homo sapiens
ttatttttaaaagttcacacag

SEQ ID NO: 96439 - DNA, 22 bp, Homo sapiens
ggagtgactcacagctgggaca

SEQ ID NO: 96440 - DNA, 22 bp, Homo sapiens
aggagctgtcagagtgccagag

SEQ ID NO: 96441 - DNA, 22 bp, Homo sapiens
tcacaaatgtttgcatgtgtct

SEQ ID NO: 96442 - DNA, 22 bp, Homo sapiens
caggaaggcgcggctgtgcctg

SEQ ID NO: 96443 - DNA, 23 bp, Homo sapiens
ctgaatgcgacatttctctccac

SEQ ID NO: 96444 - DNA, 22 bp, Homo sapiens
atgaggcaggagtgcagtggca

SEQ ID NO: 96445 - DNA, 22 bp, Homo sapiens
gtgggctgcccttgaggtcagc

SEQ ID NO: 96446 - DNA, 22 bp, Homo sapiens
ggaggactcaggtctggccatg

SEQ ID NO: 96447 - DNA, 19 bp, Homo sapiens
ggagccgccgcccttcatt

SEQ ID NO: 96448 - DNA, 22 bp, Homo sapiens
tttgttttcaatgtgtcattca

SEQ ID NO: 96449 - DNA, 21 bp, Homo sapiens
ttagaagctaatgcagctggt

SEQ ID NO: 96450 - DNA, 22 bp, Homo sapiens
agggatggagtgcggcccggac

SEQ ID NO: 96451 - DNA, 22 bp, Homo sapiens
tgaggaaacttacaaggcagaa

SEQ ID NO: 96452 - DNA, 22 bp, Homo sapiens
ttgggctgaaccctgcagctga

SEQ ID NO: 96453 - DNA, 22 bp, Homo sapiens
ttggagagtgatattcagatgc

SEQ ID NO: 96454 - DNA, 22 bp, Homo sapiens
aggagggagcttaagccaggca

SEQ ID NO: 96455 - DNA, 22 bp, Homo sapiens
tggagagttctgtagatatcta

SEQ ID NO: 96456 - DNA, 22 bp, Homo sapiens
gcagggcacaaggacgcacagg

SEQ ID NO: 96457 - DNA, 22 bp, Homo sapiens
caccaggctggagtgcagtggc

SEQ ID NO: 96458 - DNA, 22 bp, Homo sapiens
gacggagctggttgctgcggct

SEQ ID NO: 96459 - DNA, 22 bp, Homo sapiens
aggccaggaatccttgtcccag

SEQ ID NO: 96460 - DNA, 22 bp, Homo sapiens
ttgtgaatggtgccgcaataaa

SEQ ID NO: 96461 - DNA, 22 bp, Homo sapiens
gaaatggtcaagctgcaggata

SEQ ID NO: 96462 - DNA, 22 bp, Homo sapiens
tgcagtttaaacttggcaactt

SEQ ID NO: 96463 - DNA, 22 bp, Homo sapiens
aagccgggcctgagaaatgaca

SEQ ID NO: 96464 - DNA, 17 bp, Homo sapiens
gggcagggactcctggg

SEQ ID NO: 96465 - DNA, 22 bp, Homo sapiens
ctgtccctgagcaactcctgtt

SEQ ID NO: 96466 - DNA, 22 bp, Homo sapiens
tcaatcacgtgttccatgttct

SEQ ID NO: 96467 - DNA, 22 bp, Homo sapiens
gccgtccacctcgatggccact

SEQ ID NO: 96468 - DNA, 22 bp, Homo sapiens
tccagcttataggtagatttaa

SEQ ID NO: 96469 - DNA, 22 bp, Homo sapiens
ggcagagcttgcagtgagccga

SEQ ID NO: 96470 - DNA, 22 bp, Homo sapiens
gacaggaggcagagctcaggtg

SEQ ID NO: 96471 - DNA, 23 bp, Homo sapiens
gcagaggagcaagctggacacca

SEQ ID NO: 96472 - DNA, 22 bp, Homo sapiens
tggctgagttacgaacagagca

SEQ ID NO: 96473 - DNA, 22 bp, Homo sapiens
aataaaatggtcagttttctca

SEQ ID NO: 96474 - DNA, 22 bp, Homo sapiens
gcaggaggttgagccaggactg

SEQ ID NO: 96475 - DNA, 22 bp, Homo sapiens
ggcagggagtggagactcccta

SEQ ID NO: 96476 - DNA, 22 bp, Homo sapiens
ttgtgaatagtgccgcaataaa

SEQ ID NO: 96477 - DNA, 22 bp, Homo sapiens
tgatcagcatcttcccagctcg

SEQ ID NO: 96478 - DNA, 22 bp, Homo sapiens
gcgggccaccttggagagcgct

SEQ ID NO: 96479 - DNA, 22 bp, Homo sapiens
cattctctctacttgttttcaa

SEQ ID NO: 96480 - DNA, 22 bp, Homo sapiens
aagcagagaatctgggagcgag

SEQ ID NO: 96481 - DNA, 22 bp, Homo sapiens
agaggaggctctgggatcgtcc

SEQ ID NO: 96482 - DNA, 19 bp, Homo sapiens
tcctgcctggggccgcctg

SEQ ID NO: 96483 - DNA, 22 bp, Homo sapiens
tctggagataagcagcaatgaa

SEQ ID NO: 96484 - DNA, 22 bp, Homo sapiens
ggtgcagaggagccagctgggg

SEQ ID NO: 96485 - DNA, 22 bp, Homo sapiens
cttagatgaagtcacagaaccc

SEQ ID NO: 96486 - DNA, 22 bp, Homo sapiens
ctgaggcaggatggcctggctg

SEQ ID NO: 96487 - DNA, 22 bp, Homo sapiens
gacttctgaattcctatcaggt

SEQ ID NO: 96488 - DNA, 22 bp, Homo sapiens
cccagggagagcgcggaggcgg

SEQ ID NO: 96489 - DNA, 22 bp, Homo sapiens
ggaggtggaggttgcagtgagc

SEQ ID NO: 96490 - DNA, 22 bp, Homo sapiens
gcaggtggatcacctgaggtca

SEQ ID NO: 96491 - DNA, 22 bp, Homo sapiens
tggattcacaccattctcctgc

SEQ ID NO: 96492 - DNA, 22 bp, Homo sapiens
ccaggaggcagaagttgcagtg

SEQ ID NO: 96493 - DNA, 18 bp, Homo sapiens
cagggctgtggggtcact

SEQ ID NO: 96494 - DNA, 22 bp, Homo sapiens
ggaggagacagtaaaaagcacg

SEQ ID NO: 96495 - DNA, 22 bp, Homo sapiens
catctgtctgcatgctctgggt

SEQ ID NO: 96496 - DNA, 22 bp, Homo sapiens
cccaggaggtcgaagctgcagt

SEQ ID NO: 96497 - DNA, 22 bp, Homo sapiens
ccctggctggctctgcccggac

SEQ ID NO: 96498 - DNA, 22 bp, Homo sapiens
ttggttttgaaatagcttattg

SEQ ID NO: 96499 - DNA, 22 bp, Homo sapiens
agcccaggctggagtgcagtgg

SEQ ID NO: 96500 - DNA, 22 bp, Homo sapiens
agcgaggtgagtcctccagctc

SEQ ID NO: 96501 - DNA, 22 bp, Homo sapiens
agacagggtgatcgcttgagcc

SEQ ID NO: 96502 - DNA, 22 bp, Homo sapiens
tgggggtgtcctggtgcacaca

SEQ ID NO: 96503 - DNA, 22 bp, Homo sapiens
gcaggcagatcacctgtcagga

SEQ ID NO: 96504 - DNA, 22 bp, Homo sapiens
ctgccctggggggcctccttgc

SEQ ID NO: 96505 - DNA, 22 bp, Homo sapiens
tatcagtccagggttttgtgac

SEQ ID NO: 96506 - DNA, 22 bp, Homo sapiens
cccaggaggtcaaggctgcagt

SEQ ID NO: 96507 - DNA, 22 bp, Homo sapiens
ggctgagttgagaggattactt

SEQ ID NO: 96508 - DNA, 22 bp, Homo sapiens
gatatcattgagcccaggagtt

SEQ ID NO: 96509 - DNA, 22 bp, Homo sapiens
ttagatttgtagtgagttcaga

SEQ ID NO: 96510 - DNA, 22 bp, Homo sapiens
gaggtaggtgtaggaggcctgc

SEQ ID NO: 96511 - DNA, 22 bp, Homo sapiens
tccaccatgtaacaagctctgt

SEQ ID NO: 96512 - DNA, 22 bp, Homo sapiens
ttctgtgaatcttttttcccac

SEQ ID NO: 96513 - DNA, 22 bp, Homo sapiens
ttttggctctgtctgtatcttt

SEQ ID NO: 96514 - DNA, 17 bp, Homo sapiens
ttgaatgcattacttgg

SEQ ID NO: 96515 - DNA, 22 bp, Homo sapiens
ggggcattgtgtctgggttcct

SEQ ID NO: 96516 - DNA, 22 bp, Homo sapiens
accacccagccagcttctccct

SEQ ID NO: 96517 - DNA, 22 bp, Homo sapiens
agcctggtttaagcattttata

SEQ ID NO: 96518 - DNA, 22 bp, Homo sapiens
tagccgggtgttgtgtcatgca

SEQ ID NO: 96519 - DNA, 22 bp, Homo sapiens
tctcctggagcccagatgctgg

SEQ ID NO: 96520 - DNA, 22 bp, Homo sapiens
caacatggtgaaaccccgtctc

SEQ ID NO: 96521 - DNA, 22 bp, Homo sapiens
ccctggaggcggagcttgcagt

SEQ ID NO: 96522 - DNA, 21 bp, Homo sapiens
aagaggaagcattatggcata

SEQ ID NO: 96523 - DNA, 22 bp, Homo sapiens
tcttggattttaatggatcaaa

SEQ ID NO: 96524 - DNA, 22 bp, Homo sapiens
cggagtcttgctatgttgccca

SEQ ID NO: 96525 - DNA, 23 bp, Homo sapiens
aaacttgctatggctgaaatcat

SEQ ID NO: 96526 - DNA, 22 bp, Homo sapiens
agggctctgagtgggaaagagg

SEQ ID NO: 96527 - DNA, 22 bp, Homo sapiens
gtggagagagataagcctggtc

SEQ ID NO: 96528 - DNA, 22 bp, Homo sapiens
tttaaaaaactagtctgagtct

SEQ ID NO: 96529 - DNA, 22 bp, Homo sapiens
gggagaggttacccgagcaact

SEQ ID NO: 96530 - DNA, 22 bp, Homo sapiens
cgggcaaggcgagactaggccc

SEQ ID NO: 96531 - DNA, 22 bp, Homo sapiens
tcacattttcaaaagctggtgc

SEQ ID NO: 96532 - DNA, 22 bp, Homo sapiens
tcaggaggtccgcccgggaggg

SEQ ID NO: 96533 - DNA, 22 bp, Homo sapiens
cctaggagttcgaagctgcagt

SEQ ID NO: 96534 - DNA, 22 bp, Homo sapiens
tccgggcaactgaagggaggtt

SEQ ID NO: 96535 - DNA, 22 bp, Homo sapiens
tctagctctgcttatcatggct

SEQ ID NO: 96536 - DNA, 18 bp, Homo sapiens
gatcgggggcgccccaag

SEQ ID NO: 96537 - DNA, 22 bp, Homo sapiens
agagaagagtcttgtcaaatta

SEQ ID NO: 96538 - DNA, 22 bp, Homo sapiens
tgaggcacaggcagtgcccccg

SEQ ID NO: 96539 - DNA, 22 bp, Homo sapiens
cggcatccccacttcctcctgc

SEQ ID NO: 96540 - DNA, 22 bp, Homo sapiens
caccagagtgggtgagggtgat

SEQ ID NO: 96541 - DNA, 22 bp, Homo sapiens
aggctctgtcaggcggagcagc

SEQ ID NO: 96542 - DNA, 22 bp, Homo sapiens
tgggagcagcctcagcttcggg

SEQ ID NO: 96543 - DNA, 22 bp, Homo sapiens
cctggcaggtggcgccctcggc

SEQ ID NO: 96544 - DNA, 22 bp, Homo sapiens
catccaggctgaagtgcagtgg

SEQ ID NO: 96545 - DNA, 18 bp, Homo sapiens
gcctggcttcggagccgc

SEQ ID NO: 96546 - DNA, 23 bp, Homo sapiens
ccagtgattgcctggaaggaggt

SEQ ID NO: 96547 - DNA, 22 bp, Homo sapiens
agcccaggagtttgaggctgtg

SEQ ID NO: 96548 - DNA, 23 bp, Homo sapiens
gcagaggagcaagctggacacca

SEQ ID NO: 96549 - DNA, 22 bp, Homo sapiens
cgggcaaggcgagactaggccc

SEQ ID NO: 96550 - DNA, 22 bp, Homo sapiens
tggatctcggcaatgcgggact

SEQ ID NO: 96551 - DNA, 22 bp, Homo sapiens
tggccggggctgatggacagtg

SEQ ID NO: 96552 - DNA, 22 bp, Homo sapiens
ggctgtggcagctggaagtggt

SEQ ID NO: 96553 - DNA, 22 bp, Homo sapiens
catggcattgcataacggggct

SEQ ID NO: 96554 - DNA, 22 bp, Homo sapiens
gacccaggggcagggagaaagt

SEQ ID NO: 96555 - DNA, 22 bp, Homo sapiens
tgcgcggctcagtcatctccag

SEQ ID NO: 96556 - DNA, 22 bp, Homo sapiens
catccaggctggagtacagtgg

SEQ ID NO: 96557 - DNA, 22 bp, Homo sapiens
tgaggcactccaggatgctgtt

SEQ ID NO: 96558 - DNA, 22 bp, Homo sapiens
catggcagctcctccagtgtga

SEQ ID NO: 96559 - DNA, 22 bp, Homo sapiens
aatccaggtggcggaggttgtg

SEQ ID NO: 96560 - DNA, 22 bp, Homo sapiens
gcccaggaggagaggctgcagt

SEQ ID NO: 96561 - DNA, 22 bp, Homo sapiens
tcctcagaatcacctggcagct

SEQ ID NO: 96562 - DNA, 22 bp, Homo sapiens
cggctgggttcggctgcaggcc

SEQ ID NO: 96563 - DNA, 18 bp, Homo sapiens
cagctgccagctcatgga

SEQ ID NO: 96564 - DNA, 22 bp, Homo sapiens
tgagccagaggaggctgtgtgg

SEQ ID NO: 96565 - DNA, 22 bp, Homo sapiens
tggccttgagagatcaaaaggt

SEQ ID NO: 96566 - DNA, 20 bp, Homo sapiens
ggcagagggcctgggagaag

SEQ ID NO: 96567 - DNA, 22 bp, Homo sapiens
taggcactgtgtttgtaggagt

SEQ ID NO: 96568 - DNA, 22 bp, Homo sapiens
ctgagccaaggggacagtgaca

SEQ ID NO: 96569 - DNA, 22 bp, Homo sapiens
gcccgcagagatctttaacaaa

SEQ ID NO: 96570 - DNA, 22 bp, Homo sapiens
agcccaggctggagtgcagtgg

SEQ ID NO: 96571 - DNA, 22 bp, Homo sapiens
gcccaggagttcaagtctagtg

SEQ ID NO: 96572 - DNA, 22 bp, Homo sapiens
gccagtggtcactgaggaagaa

SEQ ID NO: 96573 - DNA, 22 bp, Homo sapiens
gaggcctgggcaagggggtctg

SEQ ID NO: 96574 - DNA, 22 bp, Homo sapiens
gagcaccgcctccacgatgccc

SEQ ID NO: 96575 - DNA, 22 bp, Homo sapiens
cactccagcctcagtgacagag

SEQ ID NO: 96576 - DNA, 22 bp, Homo sapiens
cagaccagaaggaagccgacaa

SEQ ID NO: 96577 - DNA, 22 bp, Homo sapiens
tggcactgaagctggaaagcct

SEQ ID NO: 96578 - DNA, 22 bp, Homo sapiens
actaggggctcaggcccaggga

SEQ ID NO: 96579 - DNA, 22 bp, Homo sapiens
aatggctctgatgttgttgtga

SEQ ID NO: 96580 - DNA, 22 bp, Homo sapiens
gatggcctcatggctgcaggcc

SEQ ID NO: 96581 - DNA, 22 bp, Homo sapiens
agcccaggttgaggctgcagtg

SEQ ID NO: 96582 - DNA, 22 bp, Homo sapiens
gcccagtggtaaaagcaggcct

SEQ ID NO: 96583 - DNA, 22 bp, Homo sapiens
cccttggggtggaggttgcagt

SEQ ID NO: 96584 - DNA, 22 bp, Homo sapiens
cacgggagacgtgatcttggac

SEQ ID NO: 96585 - DNA, 22 bp, Homo sapiens
tatggcattgttggtgatgata

SEQ ID NO: 96586 - DNA, 22 bp, Homo sapiens
ttgtgttaaggtgcatctagtg

SEQ ID NO: 96587 - DNA, 22 bp, Homo sapiens
cactgcaacctccacctcctgg

SEQ ID NO: 96588 - DNA, 22 bp, Homo sapiens
gagtagaactggttatctaata

SEQ ID NO: 96589 - DNA, 22 bp, Homo sapiens
ttatttgtggcatatgagacga

SEQ ID NO: 96590 - DNA, 22 bp, Homo sapiens
ttgttgtcattgtagaggattt

SEQ ID NO: 96591 - DNA, 22 bp, Homo sapiens
atatatttgagaatattcatga

SEQ ID NO: 96592 - DNA, 22 bp, Homo sapiens
aggtctgtttaacaaagtcagg

SEQ ID NO: 96593 - DNA, 22 bp, Homo sapiens
ggagtgaatcactagatgcaga

SEQ ID NO: 96594 - DNA, 22 bp, Homo sapiens
ttacttaaacagaaatgcagaa

SEQ ID NO: 96595 - DNA, 23 bp, Homo sapiens
ctcaccaagcgccgccgctgtgt

SEQ ID NO: 96596 - DNA, 22 bp, Homo sapiens
tttcttaggctctaaaatgact

SEQ ID NO: 96597 - DNA, 22 bp, Homo sapiens
tccaccatgtaacaagctctgt

SEQ ID NO: 96598 - DNA, 22 bp, Homo sapiens
actttatttcctattgcatcca

SEQ ID NO: 96599 - DNA, 22 bp, Homo sapiens
aatgttgtgcatgtattttgta

SEQ ID NO: 96600 - DNA, 22 bp, Homo sapiens
tggaatggaaacaaactgagga

SEQ ID NO: 96601 - DNA, 22 bp, Homo sapiens
tccattatacttctgattcaaa

SEQ ID NO: 96602 - DNA, 22 bp, Homo sapiens
cagctacaaatacttttgtatg

SEQ ID NO: 96603 - DNA, 22 bp, Homo sapiens
tgcagtacagtataatcttgct

SEQ ID NO: 96604 - DNA, 22 bp, Homo sapiens
tgttatcagagagaggtgctgt

SEQ ID NO: 96605 - DNA, 22 bp, Homo sapiens
atgttgtgtttgactgttaccc

SEQ ID NO: 96606 - DNA, 20 bp, Homo sapiens
ttgttagaggaatgccatag

SEQ ID NO: 96607 - DNA, 19 bp, Homo sapiens
tctcaattctccccactgc

SEQ ID NO: 96608 - DNA, 22 bp, Homo sapiens
tcctcattcttggtgcatcaaa

SEQ ID NO: 96609 - DNA, 22 bp, Homo sapiens
tgctcattggcgatctgaggga

SEQ ID NO: 96610 - DNA, 22 bp, Homo sapiens
ttgatgtaggtttatctattgt

SEQ ID NO: 96611 - DNA, 22 bp, Homo sapiens
tttgttttcaatgtgtcattca

SEQ ID NO: 96612 - DNA, 22 bp, Homo sapiens
cttgtcagccaattgtggattt

SEQ ID NO: 96613 - DNA, 22 bp, Homo sapiens
tcactgcaacctccacctcccg

SEQ ID NO: 96614 - DNA, 22 bp, Homo sapiens
tagcttatcccacagtgcccag

SEQ ID NO: 96615 - DNA, 22 bp, Homo sapiens
tatctaataaatctgataagta

SEQ ID NO: 96616 - DNA, 22 bp, Homo sapiens
ggaactgaatgtctcggtataa

SEQ ID NO: 96617 - DNA, 22 bp, Homo sapiens
acatttatataactcactagga

SEQ ID NO: 96618 - DNA, 22 bp, Homo sapiens
aaagaaatagatggcatttaaa

SEQ ID NO: 96619 - DNA, 21 bp, Homo sapiens
tctgatggtagatgagatgtg

SEQ ID NO: 96620 - DNA, 22 bp, Homo sapiens
tgaatatgtgactttgatttca

SEQ ID NO: 96621 - DNA, 22 bp, Homo sapiens
gtagtctgaacagtaattttgt

SEQ ID NO: 96622 - DNA, 22 bp, Homo sapiens
tgttagtcagacacacctaaat

SEQ ID NO: 96623 - DNA, 16 bp, Homo sapiens
cgagtgaagccttttc

SEQ ID NO: 96624 - DNA, 22 bp, Homo sapiens
ataccaccatctatgaaaggta

SEQ ID NO: 96625 - DNA, 22 bp, Homo sapiens
ttatttaaaagtggtaagattc

SEQ ID NO: 96626 - DNA, 22 bp, Homo sapiens
ctacaaaagtaattgtggtttt

SEQ ID NO: 96627 - DNA, 22 bp, Homo sapiens
agggaattcactggaacgccct

SEQ ID NO: 96628 - DNA, 22 bp, Homo sapiens
agatgaatccacacatggcaaa

SEQ ID NO: 96629 - DNA, 22 bp, Homo sapiens
agatttggtgtctggttgatat

SEQ ID NO: 96630 - DNA, 22 bp, Homo sapiens
aagaataagaggatttagaaca

SEQ ID NO: 96631 - DNA, 22 bp, Homo sapiens
tggcagtggcgggactcagggc

SEQ ID NO: 96632 - DNA, 22 bp, Homo sapiens
taatgtataacaaatactcatc

SEQ ID NO: 96633 - DNA, 22 bp, Homo sapiens
tagtgaatgggggttatgagac

SEQ ID NO: 96634 - DNA, 22 bp, Homo sapiens
tgggagtgtaaattagttcaac

SEQ ID NO: 96635 - DNA, 22 bp, Homo sapiens
aactcaaagatgcatgacgctt

SEQ ID NO: 96636 - DNA, 22 bp, Homo sapiens
aaatttgtattccttttccgta

SEQ ID NO: 96637 - DNA, 20 bp, Homo sapiens
ttcatgggagcaaagaggcc

SEQ ID NO: 96638 - DNA, 22 bp, Homo sapiens
accaccttcctgcgtgtctctt

SEQ ID NO: 96639 - DNA, 22 bp, Homo sapiens
ataaaatttgctactgttaaat

SEQ ID NO: 96640 - DNA, 22 bp, Homo sapiens
tcactgcaacctccacctcctg

SEQ ID NO: 96641 - DNA, 22 bp, Homo sapiens
gaaccattgttgaaaagaatag

SEQ ID NO: 96642 - DNA, 22 bp, Homo sapiens
ttaccaaatgaaatagagattt

SEQ ID NO: 96643 - DNA, 22 bp, Homo sapiens
tgtactgtatcattgcaacttt

SEQ ID NO: 96644 - DNA, 22 bp, Homo sapiens
gtctgaatacgtacttgtgaag

SEQ ID NO: 96645 - DNA, 20 bp, Homo sapiens
attagctcaggtgaggtcat

SEQ ID NO: 96646 - DNA, 22 bp, Homo sapiens
gtgagttcccggatctgttcca

SEQ ID NO: 96647 - DNA, 22 bp, Homo sapiens
ttcttcatgggttcttttagga

SEQ ID NO: 96648 - DNA, 22 bp, Homo sapiens
tgagtacaagcagtgctttctc

SEQ ID NO: 96649 - DNA, 22 bp, Homo sapiens
taagagaatgttgtggctaggt

SEQ ID NO: 96650 - DNA, 22 bp, Homo sapiens
ttattagagtgctttgagaaag

SEQ ID NO: 96651 - DNA, 22 bp, Homo sapiens
ggagtgaagtggcgcgatctcg

SEQ ID NO: 96652 - DNA, 22 bp, Homo sapiens
ttgtctaatgagctccacttca

SEQ ID NO: 96653 - DNA, 22 bp, Homo sapiens
tgagtgacattttatattgcca

SEQ ID NO: 96654 - DNA, 22 bp, Homo sapiens
tctcacatgcaaacagtccaca

SEQ ID NO: 96655 - DNA, 19 bp, Homo sapiens
tgttgtctaccatgaagtc

SEQ ID NO: 96656 - DNA, 22 bp, Homo sapiens
cacttgttggtggtgaaatcac

SEQ ID NO: 96657 - DNA, 22 bp, Homo sapiens
gaatttcctctaaacccctgag

SEQ ID NO: 96658 - DNA, 22 bp, Homo sapiens
ctctccattccctacagttttc

SEQ ID NO: 96659 - DNA, 21 bp, Homo sapiens
tttcttaggctctaaaatgac

SEQ ID NO: 96660 - DNA, 22 bp, Homo sapiens
atctagattaggtataagagct

SEQ ID NO: 96661 - DNA, 22 bp, Homo sapiens
aagagaattctggttttcctat

SEQ ID NO: 96662 - DNA, 22 bp, Homo sapiens
atatgcagtctcttgcccttct

SEQ ID NO: 96663 - DNA, 22 bp, Homo sapiens
tgttttaagggtcaactgtcac

SEQ ID NO: 96664 - DNA, 22 bp, Homo sapiens
atcttgttaaaaagcagattct

SEQ ID NO: 96665 - DNA, 22 bp, Homo sapiens
tttaaaaaactagtctgagtct

SEQ ID NO: 96666 - DNA, 22 bp, Homo sapiens
tcatctaagagtcttacattta

SEQ ID NO: 96667 - DNA, 22 bp, Homo sapiens
tgagatcattgacttgttcctg

SEQ ID NO: 96668 - DNA, 22 bp, Homo sapiens
tctcccaggcaggagtgcagtg

SEQ ID NO: 96669 - DNA, 22 bp, Homo sapiens
aggaattcaagaccagctgggc

SEQ ID NO: 96670 - DNA, 23 bp, Homo sapiens
gttttacaggtgagaaaatggag

SEQ ID NO: 96671 - DNA, 22 bp, Homo sapiens
aggccagcctcaggcagggacc

SEQ ID NO: 96672 - DNA, 22 bp, Homo sapiens
ctgtcaggtttcccggctcacg

SEQ ID NO: 96673 - DNA, 19 bp, Homo sapiens
tttgatagggcataatata

SEQ ID NO: 96674 - DNA, 22 bp, Homo sapiens
tttcataatactgtacatgaaa

SEQ ID NO: 96675 - DNA, 22 bp, Homo sapiens
tcgcaccattgcactccagcca

SEQ ID NO: 96676 - DNA, 22 bp, Homo sapiens
gaattttattactagtcaactg

SEQ ID NO: 96677 - DNA, 22 bp, Homo sapiens
tagcatgtcagtcgccacacgt

SEQ ID NO: 96678 - DNA, 22 bp, Homo sapiens
tttcttaggctctaaaatgact

SEQ ID NO: 96679 - DNA, 22 bp, Homo sapiens
gctgacccctacaggttgtgtt

SEQ ID NO: 96680 - DNA, 22 bp, Homo sapiens
gtcccctgtccagggccagcca

SEQ ID NO: 96681 - DNA, 22 bp, Homo sapiens
agtgactggtgtgaagttaaat

SEQ ID NO: 96682 - DNA, 22 bp, Homo sapiens
taatactgtatactgcaaattt

SEQ ID NO: 96683 - DNA, 22 bp, Homo sapiens
cactgcactccagcctgggtga

SEQ ID NO: 96684 - DNA, 22 bp, Homo sapiens
taattataacagttacatctta

SEQ ID NO: 96685 - DNA, 22 bp, Homo sapiens
gccggggctggggagagacatg

SEQ ID NO: 96686 - DNA, 20 bp, Homo sapiens
gataatatttactaggtact

SEQ ID NO: 96687 - DNA, 22 bp, Homo sapiens
cgtgagcaaaatggacactccc

SEQ ID NO: 96688 - DNA, 22 bp, Homo sapiens
tttatagtagcatgatttataa

SEQ ID NO: 96689 - DNA, 22 bp, Homo sapiens
agatcacagtggcaactccctt

SEQ ID NO: 96690 - DNA, 22 bp, Homo sapiens
agatttatgtggtcacactcag

SEQ ID NO: 96691 - DNA, 22 bp, Homo sapiens
cttgtagacccctggactcacg

SEQ ID NO: 96692 - DNA, 22 bp, Homo sapiens
agttggagtgaacatgagattg

SEQ ID NO: 96693 - DNA, 22 bp, Homo sapiens
aagaggtttaactgactcacag

SEQ ID NO: 96694 - DNA, 22 bp, Homo sapiens
ggaggacaggggctgcagcaca

SEQ ID NO: 96695 - DNA, 22 bp, Homo sapiens
tgtttgagttctagcgcattta

SEQ ID NO: 96696 - DNA, 22 bp, Homo sapiens
aagaggttgtctgtgatgagtt

SEQ ID NO: 96697 - DNA, 22 bp, Homo sapiens
atatatttgagaatattcatga

SEQ ID NO: 96698 - DNA, 22 bp, Homo sapiens
cactgcactccagcctgggaga

SEQ ID NO: 96699 - DNA, 19 bp, Homo sapiens
gactcacaccttccgctgt

SEQ ID NO: 96700 - DNA, 22 bp, Homo sapiens
aaccccgctcaggctgggtgag

SEQ ID NO: 96701 - DNA, 22 bp, Homo sapiens
tcgaagattctttttgttagta

SEQ ID NO: 96702 - DNA, 22 bp, Homo sapiens
gtgagaaatgacaaatgtgtcg

SEQ ID NO: 96703 - DNA, 22 bp, Homo sapiens
ctgtaatcccagctactcggga

SEQ ID NO: 96704 - DNA, 22 bp, Homo sapiens
tgcagaaacaagccatcattca

SEQ ID NO: 96705 - DNA, 22 bp, Homo sapiens
tggcctcggcatccagcaagag

SEQ ID NO: 96706 - DNA, 22 bp, Homo sapiens
ggacaagcctgtgagtgggttt

SEQ ID NO: 96707 - DNA, 20 bp, Homo sapiens
gttaggaggttggacatgga

SEQ ID NO: 96708 - DNA, 22 bp, Homo sapiens
tctttctacatcatttgcttct

SEQ ID NO: 96709 - DNA, 22 bp, Homo sapiens
cactgcactccagcctgggcaa

SEQ ID NO: 96710 - DNA, 22 bp, Homo sapiens
gggccatgagaggttcatcaac

SEQ ID NO: 96711 - DNA, 20 bp, Homo sapiens
atgaatattttggtctttcc

SEQ ID NO: 96712 - DNA, 22 bp, Homo sapiens
aagtggactaatacaaggacta

SEQ ID NO: 96713 - DNA, 22 bp, Homo sapiens
taatgtataacaaatactcatc

SEQ ID NO: 96714 - DNA, 22 bp, Homo sapiens
agcccaggagtttgaggctgtg

SEQ ID NO: 96715 - DNA, 22 bp, Homo sapiens
ggcaggaggtgagtggcgggtg

SEQ ID NO: 96716 - DNA, 16 bp, Homo sapiens
aaactgacggcatctg

SEQ ID NO: 96717 - DNA, 22 bp, Homo sapiens
ttttctaacatctagtaatttg

SEQ ID NO: 96718 - DNA, 22 bp, Homo sapiens
ctccagattccgtttattcagg

SEQ ID NO: 96719 - DNA, 19 bp, Homo sapiens
agggaatccggctgaggga

SEQ ID NO: 96720 - DNA, 22 bp, Homo sapiens
aatattatcaaaagctttttca

SEQ ID NO: 96721 - DNA, 22 bp, Homo sapiens
gaagtgtagtcttgagccccca

SEQ ID NO: 96722 - DNA, 22 bp, Homo sapiens
atgagaaagttaatcatcatga

SEQ ID NO: 96723 - DNA, 22 bp, Homo sapiens
gacagctgcatcctcagacaca

SEQ ID NO: 96724 - DNA, 22 bp, Homo sapiens
gaaatctttgccttagctgtgt

SEQ ID NO: 96725 - DNA, 21 bp, Homo sapiens
ccgccgctgatagctctgggc

SEQ ID NO: 96726 - DNA, 22 bp, Homo sapiens
acgcctgtaatcccagcacttt

SEQ ID NO: 96727 - DNA, 22 bp, Homo sapiens
cacttgttggtggtgaaatcac

SEQ ID NO: 96728 - DNA, 22 bp, Homo sapiens
caattttcaattccttcagata

SEQ ID NO: 96729 - DNA, 22 bp, Homo sapiens
gaagcctcaacatctctgcgtc

SEQ ID NO: 96730 - DNA, 22 bp, Homo sapiens
aaattagtcatgttgtattact

SEQ ID NO: 96731 - DNA, 22 bp, Homo sapiens
cgcaccactgaattccagcctg

SEQ ID NO: 96732 - DNA, 22 bp, Homo sapiens
ggtgttgcagttgaagactggt

SEQ ID NO: 96733 - DNA, 22 bp, Homo sapiens
tcgctgcatgaagccaggccag

SEQ ID NO: 96734 - DNA, 22 bp, Homo sapiens
tggggagtgatgcctcggataa

SEQ ID NO: 96735 - DNA, 22 bp, Homo sapiens
gatgatcatctgtaaagttaga

SEQ ID NO: 96736 - DNA, 22 bp, Homo sapiens
gtagaccatttatctggggagt

SEQ ID NO: 96737 - DNA, 22 bp, Homo sapiens
gcccagcccagaaaggttcgga

SEQ ID NO: 96738 - DNA, 22 bp, Homo sapiens
tattccagccgcttgagctcgc

SEQ ID NO: 96739 - DNA, 22 bp, Homo sapiens
attttctctttgtatatgctag

SEQ ID NO: 96740 - DNA, 22 bp, Homo sapiens
aattttctggtgtgtaatgaag

SEQ ID NO: 96741 - DNA, 20 bp, Homo sapiens
aaaatatgtataactcttct

SEQ ID NO: 96742 - DNA, 22 bp, Homo sapiens
cataatttctaccagggccata

SEQ ID NO: 96743 - DNA, 22 bp, Homo sapiens
gaaaattattgaaaatggctct

SEQ ID NO: 96744 - DNA, 22 bp, Homo sapiens
cactgcactccagcctgggtca

SEQ ID NO: 96745 - DNA, 22 bp, Homo sapiens
ggggaccctcaggactgcgtct

SEQ ID NO: 96746 - DNA, 22 bp, Homo sapiens
tgggccgtggagcactctgaga

SEQ ID NO: 96747 - DNA, 22 bp, Homo sapiens
tgtgacctcatcttaactggaa

SEQ ID NO: 96748 - DNA, 22 bp, Homo sapiens
aagaaggcggaccagaagggag

SEQ ID NO: 96749 - DNA, 22 bp, Homo sapiens
atggagttctgccagcgctgct

SEQ ID NO: 96750 - DNA, 22 bp, Homo sapiens
gtgacaatattagctcaggggc

SEQ ID NO: 96751 - DNA, 22 bp, Homo sapiens
gggaaatctcgtcctctattta

SEQ ID NO: 96752 - DNA, 22 bp, Homo sapiens
ggctcacgcaattatcccggcc

SEQ ID NO: 96753 - DNA, 22 bp, Homo sapiens
tttaatcaggcaaagcataata

SEQ ID NO: 96754 - DNA, 22 bp, Homo sapiens
gcccagccacagtcactttcat

SEQ ID NO: 96755 - DNA, 22 bp, Homo sapiens
tttatagtagcatgatttatag

SEQ ID NO: 96756 - DNA, 22 bp, Homo sapiens
atataatttttggttagctcaa

SEQ ID NO: 96757 - DNA, 22 bp, Homo sapiens
tgatttatgcattatactgttg

SEQ ID NO: 96758 - DNA, 22 bp, Homo sapiens
ggtccccccatggtgagcactg

SEQ ID NO: 96759 - DNA, 22 bp, Homo sapiens
ctggcaggttatagagctgccc

SEQ ID NO: 96760 - DNA, 22 bp, Homo sapiens
caggcagggagctggaaaggat

SEQ ID NO: 96761 - DNA, 22 bp, Homo sapiens
aggaattcaagaccagctgggc

SEQ ID NO: 96762 - DNA, 22 bp, Homo sapiens
caggaagctgtgaaggagacgg

SEQ ID NO: 96763 - DNA, 22 bp, Homo sapiens
ttgagcccaggaggcctgggtg

SEQ ID NO: 96764 - DNA, 22 bp, Homo sapiens
ccaagctacttaggagtctgag

SEQ ID NO: 96765 - DNA, 22 bp, Homo sapiens
agtggaccagaagactgaagct

SEQ ID NO: 96766 - DNA, 22 bp, Homo sapiens
cccaggccccagggcttgtcag

SEQ ID NO: 96767 - DNA, 22 bp, Homo sapiens
gggaaacaacaaagtatctatg

SEQ ID NO: 96768 - DNA, 22 bp, Homo sapiens
aaagcctcccaggttatgagta

SEQ ID NO: 96769 - DNA, 16 bp, Homo sapiens
atgctgctattagagg

SEQ ID NO: 96770 - DNA, 23 bp, Homo sapiens
gcagaggagcaagctggacacca

SEQ ID NO: 96771 - DNA, 22 bp, Homo sapiens
tatgaagtctctgatgttgagt

SEQ ID NO: 96772 - DNA, 22 bp, Homo sapiens
gggcagagagctggaactcctt

SEQ ID NO: 96773 - DNA, 22 bp, Homo sapiens
aaaatatgtataactcttctgc

SEQ ID NO: 96774 - DNA, 22 bp, Homo sapiens
cagccccacacggtctagctct

SEQ ID NO: 96775 - DNA, 22 bp, Homo sapiens
aataaaatggtcagttttctca

SEQ ID NO: 96776 - DNA, 22 bp, Homo sapiens
taagggttcagaatgcagtggt

SEQ ID NO: 96777 - DNA, 22 bp, Homo sapiens
tgaggcaggagttcaggctgcg

SEQ ID NO: 96778 - DNA, 22 bp, Homo sapiens
ggaggcagaatagagtgtgggt

SEQ ID NO: 96779 - DNA, 22 bp, Homo sapiens
gctgctgcttgaaggctcggag

SEQ ID NO: 96780 - DNA, 22 bp, Homo sapiens
ggtttattgttaataagtttga

SEQ ID NO: 96781 - DNA, 22 bp, Homo sapiens
tagaggccgaatgctgagctgg

SEQ ID NO: 96782 - DNA, 22 bp, Homo sapiens
tccctctacagggaagcgcttt

SEQ ID NO: 96783 - DNA, 22 bp, Homo sapiens
ataaaatttgctactgttaaat

SEQ ID NO: 96784 - DNA, 22 bp, Homo sapiens
gcccaggctggagtgcagtggt

SEQ ID NO: 96785 - DNA, 22 bp, Homo sapiens
actccacaccacgggggccgcc

SEQ ID NO: 96786 - DNA, 22 bp, Homo sapiens
cccaggccctggcagagcttgt

SEQ ID NO: 96787 - DNA, 22 bp, Homo sapiens
atgcacctgaactccatcagct

SEQ ID NO: 96788 - DNA, 22 bp, Homo sapiens
gggaagagggagctggaatgat

SEQ ID NO: 96789 - DNA, 22 bp, Homo sapiens
tgagccatgggactccaaggga

SEQ ID NO: 96790 - DNA, 22 bp, Homo sapiens
gcccagtagttcaaggttgcag

SEQ ID NO: 96791 - DNA, 22 bp, Homo sapiens
cactgcactccagcccgggcaa

SEQ ID NO: 96792 - DNA, 22 bp, Homo sapiens
tttcttctatgtgtgatatttt

SEQ ID NO: 96793 - DNA, 22 bp, Homo sapiens
agctggtgctcggggagctggc

SEQ ID NO: 96794 - DNA, 22 bp, Homo sapiens
tgagaaacttgccaagcatctc

SEQ ID NO: 96795 - DNA, 22 bp, Homo sapiens
tagcccctgcctttgaacctgg

SEQ ID NO: 96796 - DNA, 22 bp, Homo sapiens
gcagaggacacaggagggcaag

SEQ ID NO: 96797 - DNA, 20 bp, Homo sapiens
aggaaaaatggaaactggag

SEQ ID NO: 96798 - DNA, 22 bp, Homo sapiens
tgcaagctgacatccagagaga

SEQ ID NO: 96799 - DNA, 22 bp, Homo sapiens
ctgaggaggctaatttgaggat

SEQ ID NO: 96800 - DNA, 22 bp, Homo sapiens
gccctagcgccagctcagcacc

SEQ ID NO: 96801 - DNA, 22 bp, Homo sapiens
cactgcacttcagcctgggtga

SEQ ID NO: 96802 - DNA, 22 bp, Homo sapiens
ctgagcctcctgcttctatttc

SEQ ID NO: 96803 - DNA, 22 bp, Homo sapiens
gcccaggctggagtgcagtggc

SEQ ID NO: 96804 - DNA, 22 bp, Homo sapiens
aggaaataggaccagacaaagc

SEQ ID NO: 96805 - DNA, 22 bp, Homo sapiens
cactgcactccatcctgggaaa

SEQ ID NO: 96806 - DNA, 22 bp, Homo sapiens
gctgcagtgagccaagatcgtg

SEQ ID NO: 96807 - DNA, 22 bp, Homo sapiens
cctagagctctgctttatctaa

SEQ ID NO: 96808 - DNA, 22 bp, Homo sapiens
gggcagagactcagaaacagaa

SEQ ID NO: 96809 - DNA, 20 bp, Homo sapiens
tatttctgggcaaccattta

SEQ ID NO: 96810 - DNA, 22 bp, Homo sapiens
tgcaccctcatcagtcaaatgg

SEQ ID NO: 96811 - DNA, 22 bp, Homo sapiens
ttatgatttgccacagattggt

SEQ ID NO: 96812 - DNA, 22 bp, Homo sapiens
gcttctggtgaggcctcaggaa

SEQ ID NO: 96813 - DNA, 22 bp, Homo sapiens
cctgtatttaaaaatattctaa

SEQ ID NO: 96814 - DNA, 22 bp, Homo sapiens
tccggtccgggtactcctctct

SEQ ID NO: 96815 - DNA, 22 bp, Homo sapiens
tcggcgctggaacgcagtagct

SEQ ID NO: 96816 - DNA, 23 bp, Homo sapiens
ttaacaggatctcgggcaagagg

SEQ ID NO: 96817 - DNA, 22 bp, Homo sapiens
agggctggagccacagctggga

SEQ ID NO: 96818 - DNA, 22 bp, Homo sapiens
aggctctgtcaggcggagcagc

SEQ ID NO: 96819 - DNA, 22 bp, Homo sapiens
cttagctgcgggccctcctcgc

SEQ ID NO: 96820 - DNA, 22 bp, Homo sapiens
catgtctgtgtacacatgcaca

SEQ ID NO: 96821 - DNA, 22 bp, Homo sapiens
aagtcctactacctattgtgca

SEQ ID NO: 96822 - DNA, 22 bp, Homo sapiens
actccacaccacgggggccgcc

SEQ ID NO: 96823 - DNA, 22 bp, Homo sapiens
ggctcctgggggtgctcctgcc

SEQ ID NO: 96824 - DNA, 22 bp, Homo sapiens
tacaaaaaattgatactgacga

SEQ ID NO: 96825 - DNA, 22 bp, Homo sapiens
catataaatacaacatgtgtta

SEQ ID NO: 96826 - DNA, 22 bp, Homo sapiens
ttttggccacatccttttgagt

SEQ ID NO: 96827 - DNA, 22 bp, Homo sapiens
atacttctttagcatattgaac

SEQ ID NO: 96828 - DNA, 22 bp, Homo sapiens
atgccacttcattccagcctcg

SEQ ID NO: 96829 - DNA, 22 bp, Homo sapiens
ctgcactgacttccccggctgc

SEQ ID NO: 96830 - DNA, 22 bp, Homo sapiens
tggcacgacaattggcaccaat

SEQ ID NO: 96831 - DNA, 22 bp, Homo sapiens
ggcctcgcggcttctggtggct

SEQ ID NO: 96832 - DNA, 19 bp, Homo sapiens
aggaatggaattaattctg

SEQ ID NO: 96833 - DNA, 22 bp, Homo sapiens
cccagcgagtttgccggtgaac

SEQ ID NO: 96834 - DNA, 21 bp, Homo sapiens
tactgtagccttgcactgtag

SEQ ID NO: 96835 - DNA, 22 bp, Homo sapiens
ttattttaccttcctctgagct

SEQ ID NO: 96836 - DNA, 22 bp, Homo sapiens
acagaactgggaaatgcacata

SEQ ID NO: 96837 - DNA, 22 bp, Homo sapiens
agtgactggtgtgaagttaaat

SEQ ID NO: 96838 - DNA, 22 bp, Homo sapiens
gaccctgtttctacaaataatt

SEQ ID NO: 96839 - DNA, 22 bp, Homo sapiens
tagcagtgtctaggtaggccat

SEQ ID NO: 96840 - DNA, 22 bp, Homo sapiens
agacagggtgatcgcttgagcc

SEQ ID NO: 96841 - DNA, 22 bp, Homo sapiens
ggggaccctcaggactgcgtct

SEQ ID NO: 96842 - DNA, 22 bp, Homo sapiens
ccggtcccaggtgccccggtga

SEQ ID NO: 96843 - DNA, 22 bp, Homo sapiens
gtatgtgaggttggtttccagg

SEQ ID NO: 96844 - DNA, 22 bp, Homo sapiens
tttcagatggaggtttaggaca

SEQ ID NO: 96845 - DNA, 22 bp, Homo sapiens
tcagggctgcagaagaggcagg

SEQ ID NO: 96846 - DNA, 22 bp, Homo sapiens
tccccaagcaggcaatctcccg

SEQ ID NO: 96847 - DNA, 22 bp, Homo sapiens
agtatgtcagagtgaaaatggt

SEQ ID NO: 96848 - DNA, 22 bp, Homo sapiens
tgatctggtcctactgtgggca

SEQ ID NO: 96849 - DNA, 21 bp, Homo sapiens
cccgtgccttcagcagtcctg

SEQ ID NO: 96850 - DNA, 22 bp, Homo sapiens
actttaaaactgatcatcagag

SEQ ID NO: 96851 - DNA, 22 bp, Homo sapiens
cactgcactccagcctgggtca

SEQ ID NO: 96852 - DNA, 22 bp, Homo sapiens
gggcagagagctggaactcctt

SEQ ID NO: 96853 - DNA, 22 bp, Homo sapiens
atgcccaatgtcacaatttttg

SEQ ID NO: 96854 - DNA, 22 bp, Homo sapiens
tggagaattctatgttgagggg

SEQ ID NO: 96855 - DNA, 22 bp, Homo sapiens
tccataaattttatgaacatat

SEQ ID NO: 96856 - DNA, 23 bp, Homo sapiens
acagcaagaggaccagatgtgag

SEQ ID NO: 96857 - DNA, 22 bp, Homo sapiens
atgccactgcactccagcctgg

SEQ ID NO: 96858 - DNA, 22 bp, Homo sapiens
aaagattaaatcaaattggtca

SEQ ID NO: 96859 - DNA, 22 bp, Homo sapiens
aacccgggaggcagaggttgtg

SEQ ID NO: 96860 - DNA, 22 bp, Homo sapiens
ttccaatagtgtgaccttatag

SEQ ID NO: 96861 - DNA, 20 bp, Homo sapiens
tcacatcctctcccaacatg

SEQ ID NO: 96862 - DNA, 22 bp, Homo sapiens
atatatttgagaatattcatga

SEQ ID NO: 96863 - DNA, 22 bp, Homo sapiens
ttatttaatgtgatctgaagag

SEQ ID NO: 96864 - DNA, 22 bp, Homo sapiens
gggagtgggtttggcctaggcc

SEQ ID NO: 96865 - DNA, 22 bp, Homo sapiens
ccggctactcgggaggctgacg

SEQ ID NO: 96866 - DNA, 22 bp, Homo sapiens
aagatacagacagagccaaaat

SEQ ID NO: 96867 - DNA, 22 bp, Homo sapiens
ccaggaggttgaggctgcagtg

SEQ ID NO: 96868 - DNA, 22 bp, Homo sapiens
atcaaatacaaagggcataagg

SEQ ID NO: 96869 - DNA, 22 bp, Homo sapiens
aagaagcattctttcattggtt

SEQ ID NO: 96870 - DNA, 22 bp, Homo sapiens
gcggcggagacagcaggaagcc

SEQ ID NO: 96871 - DNA, 22 bp, Homo sapiens
atgtttttaaatagacttacag

SEQ ID NO: 96872 - DNA, 22 bp, Homo sapiens
cactgcactccagcctgggtga

SEQ ID NO: 96873 - DNA, 20 bp, Homo sapiens
aaattactgccacacatttc

SEQ ID NO: 96874 - DNA, 22 bp, Homo sapiens
ggctagcaaggtagcagaatgc

SEQ ID NO: 96875 - DNA, 22 bp, Homo sapiens
ccgggcctcgggacaccgggta

SEQ ID NO: 96876 - DNA, 22 bp, Homo sapiens
tgcgcggctcagtcatctccag

SEQ ID NO: 96877 - DNA, 22 bp, Homo sapiens
tctgtagtaggttgtagttctt

SEQ ID NO: 96878 - DNA, 20 bp, Homo sapiens
ctgcgggctcggccgacccc

SEQ ID NO: 96879 - DNA, 22 bp, Homo sapiens
tcaggtgccttggctaattgtt

SEQ ID NO: 96880 - DNA, 22 bp, Homo sapiens
tgtcatagtgtggtagcagtgg

SEQ ID NO: 96881 - DNA, 19 bp, Homo sapiens
agggaatccggctgaggga

SEQ ID NO: 96882 - DNA, 23 bp, Homo sapiens
atgtttgcagtaacccatcctgg

SEQ ID NO: 96883 - DNA, 22 bp, Homo sapiens
acccgcgagtctcactgccgct

SEQ ID NO: 96884 - DNA, 22 bp, Homo sapiens
ctgcaccgtgtctcgggctgcc

SEQ ID NO: 96885 - DNA, 22 bp, Homo sapiens
cataatttctaccagggccata

SEQ ID NO: 96886 - DNA, 22 bp, Homo sapiens
ttgagggtctggatctgctgct

SEQ ID NO: 96887 - DNA, 22 bp, Homo sapiens
tctcctggtacccttcctagca

SEQ ID NO: 96888 - DNA, 19 bp, Homo sapiens
catggtgaaaccccgtctc

SEQ ID NO: 96889 - DNA, 22 bp, Homo sapiens
aacatagaataaatgagttagg

SEQ ID NO: 96890 - DNA, 21 bp, Homo sapiens
gctcctggtgctgcgtggcgc

SEQ ID NO: 96891 - DNA, 22 bp, Homo sapiens
agattcaggcatgtcttcattt

SEQ ID NO: 96892 - DNA, 22 bp, Homo sapiens
ttttcatttttgtagatgcaag

SEQ ID NO: 96893 - DNA, 22 bp, Homo sapiens
aaaaaattatcatagttcctga

SEQ ID NO: 96894 - DNA, 22 bp, Homo sapiens
atgcagaagactgaaaagctga

SEQ ID NO: 96895 - DNA, 22 bp, Homo sapiens
actgttttctgtaaagggccag

SEQ ID NO: 96896 - DNA, 22 bp, Homo sapiens
aactatgttaataagtttcatt

SEQ ID NO: 96897 - DNA, 22 bp, Homo sapiens
agagtgtaccaaatatcctaca

SEQ ID NO: 96898 - DNA, 22 bp, Homo sapiens
tcaaattgtcatcttgataatg

SEQ ID NO: 96899 - DNA, 23 bp, Homo sapiens
aattatctatttcaaatttagca

SEQ ID NO: 96900 - DNA, 22 bp, Homo sapiens
gggaggttgaggctgcagtgag

SEQ ID NO: 96901 - DNA, 22 bp, Homo sapiens
cacgcacgctgggtggaggcgc

SEQ ID NO: 96902 - DNA, 22 bp, Homo sapiens
tggctaacaaggtgaaaccccg

SEQ ID NO: 96903 - DNA, 23 bp, Homo sapiens
aggaaagcattcatttttaccat

SEQ ID NO: 96904 - DNA, 22 bp, Homo sapiens
ggctcctggcaatgtaacttta

SEQ ID NO: 96905 - DNA, 22 bp, Homo sapiens
gttatataagacaaatcagagt

SEQ ID NO: 96906 - DNA, 22 bp, Homo sapiens
gatataggttcatagtgttaca

SEQ ID NO: 96907 - DNA, 22 bp, Homo sapiens
tgtgaaagatactaggcagagg

SEQ ID NO: 96908 - DNA, 22 bp, Homo sapiens
gcgtctcaaggcccccaggcca

SEQ ID NO: 96909 - DNA, 21 bp, Homo sapiens
tgactgaggcttcttcacaca

SEQ ID NO: 96910 - DNA, 22 bp, Homo sapiens
ggtgacagtggttaaaatttgt

SEQ ID NO: 96911 - DNA, 22 bp, Homo sapiens
tgaagctttaggatgggttcat

SEQ ID NO: 96912 - DNA, 22 bp, Homo sapiens
ggcgccgcactcggtgcagccg

SEQ ID NO: 96913 - DNA, 22 bp, Homo sapiens
gccggggctggggagagacatg

SEQ ID NO: 96914 - DNA, 22 bp, Homo sapiens
tggagaagattggtcaccattc

SEQ ID NO: 96915 - DNA, 22 bp, Homo sapiens
gaacccggggaggttgcagtga

SEQ ID NO: 96916 - DNA, 22 bp, Homo sapiens
caggcactgtgctgagctctgc

SEQ ID NO: 96917 - DNA, 22 bp, Homo sapiens
tgacatttcctagtgctttgtg

SEQ ID NO: 96918 - DNA, 22 bp, Homo sapiens
gtcgtggagctcacagtgtgcc

SEQ ID NO: 96919 - DNA, 22 bp, Homo sapiens
accctctagagggaagcacttt

SEQ ID NO: 96920 - DNA, 22 bp, Homo sapiens
ctacattaaattggcttactta

SEQ ID NO: 96921 - DNA, 22 bp, Homo sapiens
gaaaaggcagagttccggggaa

SEQ ID NO: 96922 - DNA, 22 bp, Homo sapiens
gtggattacaagacagttgaga

SEQ ID NO: 96923 - DNA, 22 bp, Homo sapiens
attgtcagtttaatatagtcaa

SEQ ID NO: 96924 - DNA, 22 bp, Homo sapiens
aatggaatacctaggtggccca

SEQ ID NO: 96925 - DNA, 22 bp, Homo sapiens
attttctatgttgtaattgtta

SEQ ID NO: 96926 - DNA, 22 bp, Homo sapiens
gcacatgcatgcatattcctgg

SEQ ID NO: 96927 - DNA, 22 bp, Homo sapiens
ccagatgtccctctcaggtttg

SEQ ID NO: 96928 - DNA, 22 bp, Homo sapiens
ttctgcaggctgtacaagaagc

SEQ ID NO: 96929 - DNA, 22 bp, Homo sapiens
tctgcaggaagctggcggctga

SEQ ID NO: 96930 - DNA, 22 bp, Homo sapiens
ttctgtggttgaaaggagagat

SEQ ID NO: 96931 - DNA, 22 bp, Homo sapiens
ttaataaagtatgaattggaaa

SEQ ID NO: 96932 - DNA, 22 bp, Homo sapiens
agtattctggaattctatgtga

SEQ ID NO: 96933 - DNA, 22 bp, Homo sapiens
atatattttttgagacagagtc

SEQ ID NO: 96934 - DNA, 22 bp, Homo sapiens
agttggcttcaaaggcagagag

SEQ ID NO: 96935 - DNA, 22 bp, Homo sapiens
ctgctcagtaatagtcctatct

SEQ ID NO: 96936 - DNA, 22 bp, Homo sapiens
catggcggtcaggatgtaggtg

SEQ ID NO: 96937 - DNA, 22 bp, Homo sapiens
tggcaccagggaacaagcattt

SEQ ID NO: 96938 - DNA, 22 bp, Homo sapiens
tggaaacacccacgcatgcata

SEQ ID NO: 96939 - DNA, 22 bp, Homo sapiens
gctggccacagatccccaggga

SEQ ID NO: 96940 - DNA, 22 bp, Homo sapiens
gttattgaggtggagtctcact

SEQ ID NO: 96941 - DNA, 22 bp, Homo sapiens
tggcacagactgggccaaggaa

SEQ ID NO: 96942 - DNA, 22 bp, Homo sapiens
ctctcgccagcggggctgcgct

SEQ ID NO: 96943 - DNA, 22 bp, Homo sapiens
aagtaaatatctgtagtcttta

SEQ ID NO: 96944 - DNA, 22 bp, Homo sapiens
taaagattgctcaaaactgtga

SEQ ID NO: 96945 - DNA, 22 bp, Homo sapiens
ctgtggctctcagaggctgctg

SEQ ID NO: 96946 - DNA, 22 bp, Homo sapiens
aagccggctgggccgaggctgc

SEQ ID NO: 96947 - DNA, 22 bp, Homo sapiens
aggtaaagacagtgaaagaggg

SEQ ID NO: 96948 - DNA, 21 bp, Homo sapiens
gccatttcacacagacatttg

SEQ ID NO: 96949 - DNA, 22 bp, Homo sapiens
gagacgtggcctttgcctgagc

SEQ ID NO: 96950 - DNA, 22 bp, Homo sapiens
cttgtgcatttcattcctcagg

SEQ ID NO: 96951 - DNA, 18 bp, Homo sapiens
gatatggaaggccatgcc

SEQ ID NO: 96952 - DNA, 22 bp, Homo sapiens
gtgaaatatttaacgtccaggt

SEQ ID NO: 96953 - DNA, 22 bp, Homo sapiens
acatggcgggagtttcagatac

SEQ ID NO: 96954 - DNA, 22 bp, Homo sapiens
tgtctggtgggttgacaggcag

SEQ ID NO: 96955 - DNA, 22 bp, Homo sapiens
gtctttatttgagattgtcatt

SEQ ID NO: 96956 - DNA, 22 bp, Homo sapiens
tgttgattagtgtttagactta

SEQ ID NO: 96957 - DNA, 22 bp, Homo sapiens
caggctggagttcagtggtgtg

SEQ ID NO: 96958 - DNA, 22 bp, Homo sapiens
gcaaacaaggacatacatcctg

SEQ ID NO: 96959 - DNA, 22 bp, Homo sapiens
gctcaagccttctgcccacctc

SEQ ID NO: 96960 - DNA, 22 bp, Homo sapiens
gcttcggggtccaagcgcgtgt

SEQ ID NO: 96961 - DNA, 22 bp, Homo sapiens
acagacaagtagttcagacaag

SEQ ID NO: 96962 - DNA, 22 bp, Homo sapiens
gctcactgcctgggcaacaaga

SEQ ID NO: 96963 - DNA, 22 bp, Homo sapiens
tctggctccaggaccgggcaca

SEQ ID NO: 96964 - DNA, 22 bp, Homo sapiens
cctgcgcgtctgggtctgtctc

SEQ ID NO: 96965 - DNA, 22 bp, Homo sapiens
gggcagatcacctgaggtcagg

SEQ ID NO: 96966 - DNA, 22 bp, Homo sapiens
cgtgtacagtctatcttttttc

SEQ ID NO: 96967 - DNA, 22 bp, Homo sapiens
atgccactgcactccagcctag

SEQ ID NO: 96968 - DNA, 18 bp, Homo sapiens
atggtctcatactgggag

SEQ ID NO: 96969 - DNA, 22 bp, Homo sapiens
tttgtcttatccaatctctcag

SEQ ID NO: 96970 - DNA, 22 bp, Homo sapiens
catagcggtattccacgtggtt

SEQ ID NO: 96971 - DNA, 22 bp, Homo sapiens
aggggtgacacatatcagtgca

SEQ ID NO: 96972 - DNA, 22 bp, Homo sapiens
gagagtctaggaacctcatata

SEQ ID NO: 96973 - DNA, 22 bp, Homo sapiens
acgcccggtctccatagttttt

SEQ ID NO: 96974 - DNA, 21 bp, Homo sapiens
atatcaatacagcaggacttc

SEQ ID NO: 96975 - DNA, 22 bp, Homo sapiens
aaaactacatttgacattttgt

SEQ ID NO: 96976 - DNA, 23 bp, Homo sapiens
caccactttctccttctccttgg

SEQ ID NO: 96977 - DNA, 22 bp, Homo sapiens
cctgccctgctcactgtcggta

SEQ ID NO: 96978 - DNA, 22 bp, Homo sapiens
ggctctgtaagtgttgcaggta

SEQ ID NO: 96979 - DNA, 22 bp, Homo sapiens
gaaaattattgaaaatggctct

SEQ ID NO: 96980 - DNA, 21 bp, Homo sapiens
gggcctggctgcgcaggacgg

SEQ ID NO: 96981 - DNA, 22 bp, Homo sapiens
ggtccccccatggtgagcactg

SEQ ID NO: 96982 - DNA, 22 bp, Homo sapiens
ttctgcagtgttaacaatgtca

SEQ ID NO: 96983 - DNA, 22 bp, Homo sapiens
ttatttgtggcatatgagacga

SEQ ID NO: 96984 - DNA, 22 bp, Homo sapiens
cactgcactccagcccgggcaa

SEQ ID NO: 96985 - DNA, 22 bp, Homo sapiens
tcctcgatgggcaggaagatct

SEQ ID NO: 96986 - DNA, 22 bp, Homo sapiens
tttatgtagttacggactatca

SEQ ID NO: 96987 - DNA, 22 bp, Homo sapiens
gcaggtccagtcaccagagaga

SEQ ID NO: 96988 - DNA, 22 bp, Homo sapiens
ttccacaatggttaagctcgtt

SEQ ID NO: 96989 - DNA, 22 bp, Homo sapiens
ggggtactggctggagccccac

SEQ ID NO: 96990 - DNA, 22 bp, Homo sapiens
aagtcacactagacaactgagg

SEQ ID NO: 96991 - DNA, 22 bp, Homo sapiens
gactttgctgtgtcagcttcag

SEQ ID NO: 96992 - DNA, 22 bp, Homo sapiens
ctgtccctgagcaactcctgtt

SEQ ID NO: 96993 - DNA, 22 bp, Homo sapiens
aacatacgagcagtttatagag

SEQ ID NO: 96994 - DNA, 22 bp, Homo sapiens
ctggctctcaggctggtcccca

SEQ ID NO: 96995 - DNA, 22 bp, Homo sapiens
tttgtgaataggttggcttcca

SEQ ID NO: 96996 - DNA, 22 bp, Homo sapiens
gctgcagtgagccaagatcgtg

SEQ ID NO: 96997 - DNA, 22 bp, Homo sapiens
agaacagaggccttatgtttca

SEQ ID NO: 96998 - DNA, 19 bp, Homo sapiens
catctggatgattctcctg

SEQ ID NO: 96999 - DNA, 22 bp, Homo sapiens
ctatggtgatagaaatcagaat

SEQ ID NO: 97000 - DNA, 22 bp, Homo sapiens
tggaatggaaacaaactgagga

SEQ ID NO: 97001 - DNA, 22 bp, Homo sapiens
tctcaagcttgttggtatgttt

SEQ ID NO: 97002 - DNA, 20 bp, Homo sapiens
ataaaataactgccacaaga

SEQ ID NO: 97003 - DNA, 20 bp, Homo sapiens
gtctccactgggggttaacc

SEQ ID NO: 97004 - DNA, 22 bp, Homo sapiens
tttattctgtgctacatgaaga

SEQ ID NO: 97005 - DNA, 22 bp, Homo sapiens
cgcgctgcagacagcggaggcc

SEQ ID NO: 97006 - DNA, 22 bp, Homo sapiens
ccgccgtgcaggccgcgacgtg

SEQ ID NO: 97007 - DNA, 19 bp, Homo sapiens
ttcacattggaagaagtag

SEQ ID NO: 97008 - DNA, 22 bp, Homo sapiens
ttgacccgagtccttcttgggg

SEQ ID NO: 97009 - DNA, 22 bp, Homo sapiens
ataaaaactgacccatcctttg

SEQ ID NO: 97010 - DNA, 22 bp, Homo sapiens
ataaaatttgctactgttaaat

SEQ ID NO: 97011 - DNA, 22 bp, Homo sapiens
ttatttttaaaagttcacacag

SEQ ID NO: 97012 - DNA, 22 bp, Homo sapiens
aggacaaaggaccagatctgga

SEQ ID NO: 97013 - DNA, 22 bp, Homo sapiens
ttttaatactgctattgtagga

SEQ ID NO: 97014 - DNA, 22 bp, Homo sapiens
gagcaccgcctccacgatgccc

SEQ ID NO: 97015 - DNA, 16 bp, Homo sapiens
tgggtgggaggagcgg

SEQ ID NO: 97016 - DNA, 22 bp, Homo sapiens
ctgctgagagccccagctgaga

SEQ ID NO: 97017 - DNA, 22 bp, Homo sapiens
gaattttattactagtcaactg

SEQ ID NO: 97018 - DNA, 22 bp, Homo sapiens
ggctcagatggtttgttctaga

SEQ ID NO: 97019 - DNA, 22 bp, Homo sapiens
aaagaaatagatggcatttaaa

SEQ ID NO: 97020 - DNA, 22 bp, Homo sapiens
atgaaatatcttgaagaaattc

SEQ ID NO: 97021 - DNA, 22 bp, Homo sapiens
gagcctcgtggcggccactgcg

SEQ ID NO: 97022 - DNA, 22 bp, Homo sapiens
atgtatatgcatgcattcaaag

SEQ ID NO: 97023 - DNA, 22 bp, Homo sapiens
agaaatatgctgattagatgaa

SEQ ID NO: 97024 - DNA, 22 bp, Homo sapiens
taatatctacttcatagagttt

SEQ ID NO: 97025 - DNA, 22 bp, Homo sapiens
tttagcgtagctgacagctaat

SEQ ID NO: 97026 - DNA, 22 bp, Homo sapiens
cagaatcaagtccaattagcac

SEQ ID NO: 97027 - DNA, 22 bp, Homo sapiens
tgtatattctgcctaaaagctt

SEQ ID NO: 97028 - DNA, 22 bp, Homo sapiens
agccaggatggtctcgatcggc

SEQ ID NO: 97029 - DNA, 22 bp, Homo sapiens
tgatatgtaactactccttata

SEQ ID NO: 97030 - DNA, 22 bp, Homo sapiens
ctgcagggagaggggacagcct

SEQ ID NO: 97031 - DNA, 22 bp, Homo sapiens
aataaaatggtcagttttctca

SEQ ID NO: 97032 - DNA, 22 bp, Homo sapiens
ccagcatccatgctccctcggg

SEQ ID NO: 97033 - DNA, 22 bp, Homo sapiens
atacaaaatatatactggagac

SEQ ID NO: 97034 - DNA, 22 bp, Homo sapiens
gcaaatgctaaagtgtagagac

SEQ ID NO: 97035 - DNA, 22 bp, Homo sapiens
catttctgggagacatgctaga

SEQ ID NO: 97036 - DNA, 22 bp, Homo sapiens
acggggctagagaaggtttctt

SEQ ID NO: 97037 - DNA, 22 bp, Homo sapiens
agtttccatcccacacttgctt

SEQ ID NO: 97038 - DNA, 22 bp, Homo sapiens
ctctccattccctacagttttc

SEQ ID NO: 97039 - DNA, 22 bp, Homo sapiens
gaatgtgtactgagtgcccctt

SEQ ID NO: 97040 - DNA, 22 bp, Homo sapiens
gacctggtccttgtactttgaa

SEQ ID NO: 97041 - DNA, 22 bp, Homo sapiens
aaaagagcttggttgattttgc

SEQ ID NO: 97042 - DNA, 22 bp, Homo sapiens
agctcctgaaaatccagactgg

SEQ ID NO: 97043 - DNA, 22 bp, Homo sapiens
agatgtgtttctagttcctgca

SEQ ID NO: 97044 - DNA, 17 bp, Homo sapiens
aggaggccctggcgttt

SEQ ID NO: 97045 - DNA, 22 bp, Homo sapiens
aaatcccatcggagaggaggat

SEQ ID NO: 97046 - DNA, 22 bp, Homo sapiens
atgccactgcgctccagcctgg

SEQ ID NO: 97047 - DNA, 22 bp, Homo sapiens
attaagtgactaaagtaatgct

SEQ ID NO: 97048 - DNA, 22 bp, Homo sapiens
taaatacttagttttgtgtcta

SEQ ID NO: 97049 - DNA, 22 bp, Homo sapiens
tcacatctaattccatttctgc

SEQ ID NO: 97050 - DNA, 22 bp, Homo sapiens
tggacaacatagtgagacctca

SEQ ID NO: 97051 - DNA, 22 bp, Homo sapiens
ggaggcagaatagagtgtgggt

SEQ ID NO: 97052 - DNA, 22 bp, Homo sapiens
cactgcactccagcctgggaga

SEQ ID NO: 97053 - DNA, 22 bp, Homo sapiens
atgtttttggaaatgggaacat

SEQ ID NO: 97054 - DNA, 16 bp, Homo sapiens
atgctgctattagagg

SEQ ID NO: 97055 - DNA, 22 bp, Homo sapiens
ggcatagatttctttaggttta

SEQ ID NO: 97056 - DNA, 22 bp, Homo sapiens
atggccgcctgtccttcccgcc

SEQ ID NO: 97057 - DNA, 22 bp, Homo sapiens
gcctccggagtcacagtgtctt

SEQ ID NO: 97058 - DNA, 22 bp, Homo sapiens
gcatacatgggtgcagggacat

SEQ ID NO: 97059 - DNA, 22 bp, Homo sapiens
agggctgcccagtgtgagagct

SEQ ID NO: 97060 - DNA, 22 bp, Homo sapiens
agaaaacataggagacaggaaa

SEQ ID NO: 97061 - DNA, 22 bp, Homo sapiens
gctcgcgccgcaccggtccacc

SEQ ID NO: 97062 - DNA, 22 bp, Homo sapiens
tccgggagctgaacgtcttgcg

SEQ ID NO: 97063 - DNA, 22 bp, Homo sapiens
aacccgggaggtggaggttatg

SEQ ID NO: 97064 - DNA, 22 bp, Homo sapiens
ggggtgggcgtgcagggacacc

SEQ ID NO: 97065 - DNA, 20 bp, Homo sapiens
aactcctagcctcaagtgat

SEQ ID NO: 97066 - DNA, 22 bp, Homo sapiens
aggaaagcttggcaaactaaat

SEQ ID NO: 97067 - DNA, 22 bp, Homo sapiens
agcctgcgatcccacctggcct

SEQ ID NO: 97068 - DNA, 22 bp, Homo sapiens
gagccaggggtcagctccgagg

SEQ ID NO: 97069 - DNA, 22 bp, Homo sapiens
tgcatattatgtgtatctgtct

SEQ ID NO: 97070 - DNA, 22 bp, Homo sapiens
gagatggagtctttttctgtca

SEQ ID NO: 97071 - DNA, 21 bp, Homo sapiens
ctggaggcaggtggtgccagg

SEQ ID NO: 97072 - DNA, 22 bp, Homo sapiens
gggctagcctcttccctgctcc

SEQ ID NO: 97073 - DNA, 22 bp, Homo sapiens
ttcagtttcaagtccctctggg

SEQ ID NO: 97074 - DNA, 22 bp, Homo sapiens
cactgctacctctgcctcccgg

SEQ ID NO: 97075 - DNA, 22 bp, Homo sapiens
tttcttaggctctaaaatgact

SEQ ID NO: 97076 - DNA, 22 bp, Homo sapiens
tgtttctgtatgatcaatattg

SEQ ID NO: 97077 - DNA, 22 bp, Homo sapiens
ctggcaggttatagagctgccc

SEQ ID NO: 97078 - DNA, 20 bp, Homo sapiens
tgatatggtttggctgtgtt

SEQ ID NO: 97079 - DNA, 22 bp, Homo sapiens
ctgaggaggctaatttgaggat

SEQ ID NO: 97080 - DNA, 22 bp, Homo sapiens
ttgagcccaggaggcctgggtg

SEQ ID NO: 97081 - DNA, 22 bp, Homo sapiens
cccattcatcctcgcttccttc

SEQ ID NO: 97082 - DNA, 22 bp, Homo sapiens
tgttttaagggtcaactgtcac

SEQ ID NO: 97083 - DNA, 22 bp, Homo sapiens
taatgcacatagaagtacttag

SEQ ID NO: 97084 - DNA, 22 bp, Homo sapiens
tgatatgggaaaagggctcgga

SEQ ID NO: 97085 - DNA, 22 bp, Homo sapiens
tggcacaggatctcagcggcca

SEQ ID NO: 97086 - DNA, 22 bp, Homo sapiens
ccaggaggcggaaggtacagtg

SEQ ID NO: 97087 - DNA, 22 bp, Homo sapiens
gcaccgccttggaccgcccgct

SEQ ID NO: 97088 - DNA, 22 bp, Homo sapiens
actgcactcctgcctgggtaac

SEQ ID NO: 97089 - DNA, 22 bp, Homo sapiens
aggaaataggaccagacaaagc

SEQ ID NO: 97090 - DNA, 22 bp, Homo sapiens
aaaatggtctcagctggcacca

SEQ ID NO: 97091 - DNA, 22 bp, Homo sapiens
aaatgcaacgggctttccttat

SEQ ID NO: 97092 - DNA, 22 bp, Homo sapiens
gccagatttacagatttgccct

SEQ ID NO: 97093 - DNA, 22 bp, Homo sapiens
gcggccttgtggcggagcaggc

SEQ ID NO: 97094 - DNA, 22 bp, Homo sapiens
taagaaatttagttatagaatg

SEQ ID NO: 97095 - DNA, 22 bp, Homo sapiens
atacaaagtattgatcctgagt

SEQ ID NO: 97096 - DNA, 20 bp, Homo sapiens
gggcagagccagccagtccc

SEQ ID NO: 97097 - DNA, 22 bp, Homo sapiens
tttaaaaaactagtctgagtct

SEQ ID NO: 97098 - DNA, 22 bp, Homo sapiens
accatgttggccaagctggtct

SEQ ID NO: 97099 - DNA, 22 bp, Homo sapiens
aagaggtagcagtcacaaaaga

SEQ ID NO: 97100 - DNA, 19 bp, Homo sapiens
tcctgcccaccagccaggg

SEQ ID NO: 97101 - DNA, 19 bp, Homo sapiens
gcataaatacactattgtc

SEQ ID NO: 97102 - DNA, 22 bp, Homo sapiens
taaaggtagtgtgacatattgt

SEQ ID NO: 97103 - DNA, 22 bp, Homo sapiens
actgttgaagtgccagcttgat

SEQ ID NO: 97104 - DNA, 22 bp, Homo sapiens
gaaggaagtcattagtgcagac

SEQ ID NO: 97105 - DNA, 22 bp, Homo sapiens
aacagaatgcaggggatgctgc

SEQ ID NO: 97106 - DNA, 22 bp, Homo sapiens
gggcgcatcacctgaggtcagg

SEQ ID NO: 97107 - DNA, 22 bp, Homo sapiens
actgcactccagcctgggtaac

SEQ ID NO: 97108 - DNA, 22 bp, Homo sapiens
taaatcttctacatcatcataa

SEQ ID NO: 97109 - DNA, 22 bp, Homo sapiens
gaccatcctggccaacgtggta

SEQ ID NO: 97110 - DNA, 22 bp, Homo sapiens
aagaactgtttacaattttcac

SEQ ID NO: 97111 - DNA, 22 bp, Homo sapiens
accctcaacaaattcactctat

SEQ ID NO: 97112 - DNA, 22 bp, Homo sapiens
cgcgaggtggaggttgcagtga

SEQ ID NO: 97113 - DNA, 22 bp, Homo sapiens
aagaggtaaccatagcaaccac

SEQ ID NO: 97114 - DNA, 22 bp, Homo sapiens
gcacagagagggaaggtaactt

SEQ ID NO: 97115 - DNA, 17 bp, Homo sapiens
ggctgcagtccaggagg

SEQ ID NO: 97116 - DNA, 22 bp, Homo sapiens
aagcacaatgaacatcttagat

SEQ ID NO: 97117 - DNA, 22 bp, Homo sapiens
aaaaatcacttttataggcagc

SEQ ID NO: 97118 - DNA, 22 bp, Homo sapiens
ttcatagtgtttccttccagtg

SEQ ID NO: 97119 - DNA, 22 bp, Homo sapiens
tttcaggacacctttaaaaacg

SEQ ID NO: 97120 - DNA, 22 bp, Homo sapiens
cggccgcagcagtgtcggccca

SEQ ID NO: 97121 - DNA, 22 bp, Homo sapiens
gcaaaagtacagccggatttct

SEQ ID NO: 97122 - DNA, 22 bp, Homo sapiens
tgcgaccctagccccctcactt

SEQ ID NO: 97123 - DNA, 22 bp, Homo sapiens
aacccgggaggcggaggttgtg

SEQ ID NO: 97124 - DNA, 22 bp, Homo sapiens
ttcattttctttcacgctgctg

SEQ ID NO: 97125 - DNA, 22 bp, Homo sapiens
ggtcgctgtgtaggttcagcta

SEQ ID NO: 97126 - DNA, 22 bp, Homo sapiens
gaggagggagctggaagctctt

SEQ ID NO: 97127 - DNA, 20 bp, Homo sapiens
cagtgcattgcttctgattt

SEQ ID NO: 97128 - DNA, 22 bp, Homo sapiens
catttacatttaaggttaatat

SEQ ID NO: 97129 - DNA, 22 bp, Homo sapiens
tccaagatctacagcagtttag

SEQ ID NO: 97130 - DNA, 22 bp, Homo sapiens
agggcgacaatggagagcgttt

SEQ ID NO: 97131 - DNA, 22 bp, Homo sapiens
tcaaatgctgtattgtagtaat

SEQ ID NO: 97132 - DNA, 22 bp, Homo sapiens
accactgcccatggtgaaaact

SEQ ID NO: 97133 - DNA, 23 bp, Homo sapiens
ccagtgattgcctggaaggaggt

SEQ ID NO: 97134 - DNA, 22 bp, Homo sapiens
tttgttttcaatgtgtcattca

SEQ ID NO: 97135 - DNA, 22 bp, Homo sapiens
cggggttcatccatgctgtggc

SEQ ID NO: 97136 - DNA, 22 bp, Homo sapiens
gaatgcagatggctggtgtatg

SEQ ID NO: 97137 - DNA, 22 bp, Homo sapiens
cagatgtacatgaagggcaatg

SEQ ID NO: 97138 - DNA, 22 bp, Homo sapiens
aggctcagatccttgtgtcctg

SEQ ID NO: 97139 - DNA, 22 bp, Homo sapiens
cctgcacatgtgtgcgcctgta

SEQ ID NO: 97140 - DNA, 22 bp, Homo sapiens
gggaggctctgctcagcccccg

SEQ ID NO: 97141 - DNA, 22 bp, Homo sapiens
ttgtgctctgtgttatttaagg

SEQ ID NO: 97142 - DNA, 20 bp, Homo sapiens
ctcttccggaggggcgctcc

SEQ ID NO: 97143 - DNA, 22 bp, Homo sapiens
cagtgacgtaaactgcatgtgc

SEQ ID NO: 97144 - DNA, 22 bp, Homo sapiens
atccccctcttggatggcggca

SEQ ID NO: 97145 - DNA, 22 bp, Homo sapiens
ggaggtaaagtaactcgcccag

SEQ ID NO: 97146 - DNA, 21 bp, Homo sapiens
cgtgactgggtccgtctggct

SEQ ID NO: 97147 - DNA, 22 bp, Homo sapiens
ccgggcgggggctctcgtcacc

SEQ ID NO: 97148 - DNA, 22 bp, Homo sapiens
tgtgcctagttctgtatttaca

SEQ ID NO: 97149 - DNA, 22 bp, Homo sapiens
tcatctaagagtcttacattta

SEQ ID NO: 97150 - DNA, 19 bp, Homo sapiens
tggctctgtcgaaggcaca

SEQ ID NO: 97151 - DNA, 22 bp, Homo sapiens
ttgtaacaggtactaaataact

SEQ ID NO: 97152 - DNA, 22 bp, Homo sapiens
cactgcactccatcctgggaaa

SEQ ID NO: 97153 - DNA, 22 bp, Homo sapiens
tccgggaggcagaggttgcagt

SEQ ID NO: 97154 - DNA, 22 bp, Homo sapiens
gggcggatcatttgaggtcagg

SEQ ID NO: 97155 - DNA, 22 bp, Homo sapiens
tttgtagcagcatgatttataa

SEQ ID NO: 97156 - DNA, 22 bp, Homo sapiens
gggcggatcacctgaggtcagg

SEQ ID NO: 97157 - DNA, 22 bp, Homo sapiens
tgtttcaaattacttgaggatt

SEQ ID NO: 97158 - DNA, 16 bp, Homo sapiens
ccacctgcagctctca

SEQ ID NO: 97159 - DNA, 22 bp, Homo sapiens
agcgccactgcactccagcctg

SEQ ID NO: 97160 - DNA, 20 bp, Homo sapiens
aaaatatgtataactcttct

SEQ ID NO: 97161 - DNA, 22 bp, Homo sapiens
tgcaataactactttaatgttg

SEQ ID NO: 97162 - DNA, 22 bp, Homo sapiens
cgccggcttgaggcaggcggca

SEQ ID NO: 97163 - DNA, 22 bp, Homo sapiens
ttatttaaaagtggtaagattc

SEQ ID NO: 97164 - DNA, 22 bp, Homo sapiens
ggaggtagcctcaaaagcagct

SEQ ID NO: 97165 - DNA, 22 bp, Homo sapiens
gttctgggagatcttgagcttc

SEQ ID NO: 97166 - DNA, 22 bp, Homo sapiens
gaaaaggcctggggcaaagtgt

SEQ ID NO: 97167 - DNA, 20 bp, Homo sapiens
ttgagcttttagtacagaca

SEQ ID NO: 97168 - DNA, 22 bp, Homo sapiens
taacaatacccattctaattac

SEQ ID NO: 97169 - DNA, 22 bp, Homo sapiens
ggctgagttgagaggattactt

SEQ ID NO: 97170 - DNA, 22 bp, Homo sapiens
tcctcggctgggccccaggctt

SEQ ID NO: 97171 - DNA, 22 bp, Homo sapiens
gtctccttgtggatctcaagga

SEQ ID NO: 97172 - DNA, 22 bp, Homo sapiens
cctcgcggcactcgggccggat

SEQ ID NO: 97173 - DNA, 22 bp, Homo sapiens
ctacaaaagtaattgtggtttt

SEQ ID NO: 97174 - DNA, 22 bp, Homo sapiens
catcatcaaaagtgacagagaa

SEQ ID NO: 97175 - DNA, 22 bp, Homo sapiens
cactgcacttcagcctgggtga

SEQ ID NO: 97176 - DNA, 22 bp, Homo sapiens
gccttgccgctcagcagtgggg

SEQ ID NO: 97177 - DNA, 22 bp, Homo sapiens
acccggagtcggaggttgcagt

SEQ ID NO: 97178 - DNA, 22 bp, Homo sapiens
ggctcatatcccggccatcatt

SEQ ID NO: 97179 - DNA, 22 bp, Homo sapiens
tgtgccatgaggctctgatatg

SEQ ID NO: 97180 - DNA, 22 bp, Homo sapiens
atgttctacagatggaaagggg

SEQ ID NO: 97181 - DNA, 22 bp, Homo sapiens
tcaaatgttccctgtactggcc

SEQ ID NO: 97182 - DNA, 22 bp, Homo sapiens
aaattacagccttgggtagctt

SEQ ID NO: 97183 - DNA, 22 bp, Homo sapiens
ccaggaggtggagattgcagtg

SEQ ID NO: 97184 - DNA, 22 bp, Homo sapiens
acagattagctggggccattga

SEQ ID NO: 97185 - DNA, 22 bp, Homo sapiens
agggctctgagtgggaaagagg

SEQ ID NO: 97186 - DNA, 22 bp, Homo sapiens
tctgctttcttactaaaaatga

SEQ ID NO: 97187 - DNA, 22 bp, Homo sapiens
atacaaaaattagccgggagta

SEQ ID NO: 97188 - DNA, 19 bp, Homo sapiens
cataatacagtggatctga

SEQ ID NO: 97189 - DNA, 22 bp, Homo sapiens
ctgcacatgtccctaagtgtca

SEQ ID NO: 97190 - DNA, 22 bp, Homo sapiens
gcctccggagttgcagtgtctt

SEQ ID NO: 97191 - DNA, 22 bp, Homo sapiens
tgagacgaagtcttgctctgtt

SEQ ID NO: 97192 - DNA, 22 bp, Homo sapiens
aaattagtcatgttgtattact

SEQ ID NO: 97193 - DNA, 22 bp, Homo sapiens
catgagatttgggaggggccag

SEQ ID NO: 97194 - DNA, 22 bp, Homo sapiens
tttaatcaggcaaagcataata

SEQ ID NO: 97195 - DNA, 22 bp, Homo sapiens
caggctggagtgcagtggtgcc

SEQ ID NO: 97196 - DNA, 22 bp, Homo sapiens
acacggcactttaggaaggggc

SEQ ID NO: 97197 - DNA, 22 bp, Homo sapiens
gtgatatcttacaattctcttt

SEQ ID NO: 97198 - DNA, 22 bp, Homo sapiens
aaattgcaaaagtacttttagg

SEQ ID NO: 97199 - DNA, 22 bp, Homo sapiens
aaccaccattctctcctcttcc

SEQ ID NO: 97200 - DNA, 22 bp, Homo sapiens
tacatagctcctagtgatgcat

SEQ ID NO: 97201 - DNA, 22 bp, Homo sapiens
tcttgcacttcatgaatatgtt

SEQ ID NO: 97202 - DNA, 22 bp, Homo sapiens
tgggtactcctattagttcagt

SEQ ID NO: 97203 - DNA, 22 bp, Homo sapiens
agagcggggatagttaatattc

SEQ ID NO: 97204 - DNA, 21 bp, Homo sapiens
tcttttctcagctttgtggtt

SEQ ID NO: 97205 - DNA, 22 bp, Homo sapiens
tgctcattggcgatctgaggga

SEQ ID NO: 97206 - DNA, 22 bp, Homo sapiens
tcgagctctggagccaaggatg

SEQ ID NO: 97207 - DNA, 22 bp, Homo sapiens
ttcctgggattattgtcaagca

SEQ ID NO: 97208 - DNA, 19 bp, Homo sapiens
gcagacaggtccagagagg

SEQ ID NO: 97209 - DNA, 22 bp, Homo sapiens
tgtcaatatgtaataactgaat

SEQ ID NO: 97210 - DNA, 22 bp, Homo sapiens
atatatttgagaatattcatga

SEQ ID NO: 97211 - DNA, 21 bp, Homo sapiens
agtagtttagcacagggtttg

SEQ ID NO: 97212 - DNA, 22 bp, Homo sapiens
tcgcaccattgcactccagcca

SEQ ID NO: 97213 - DNA, 22 bp, Homo sapiens
tagtatagattgaagcagatca

SEQ ID NO: 97214 - DNA, 22 bp, Homo sapiens
ggtgggaggactgtttgaggca

SEQ ID NO: 97215 - DNA, 22 bp, Homo sapiens
tggttaagtccagaaaggaagc

SEQ ID NO: 97216 - DNA, 22 bp, Homo sapiens
gagaggtggaggttgcagtgag

SEQ ID NO: 97217 - DNA, 22 bp, Homo sapiens
tctaatcctatggtggggaggg

SEQ ID NO: 97218 - DNA, 22 bp, Homo sapiens
actgcactccagcctgggtgac

SEQ ID NO: 97219 - DNA, 23 bp, Homo sapiens
aaacttgctatggctgaaatcat

SEQ ID NO: 97220 - DNA, 22 bp, Homo sapiens
gataccagacagggagggagaa

SEQ ID NO: 97221 - DNA, 22 bp, Homo sapiens
attgcacttcagcctgggtgac

SEQ ID NO: 97222 - DNA, 21 bp, Homo sapiens
ggccgccgccttgtgctctgc

SEQ ID NO: 97223 - DNA, 22 bp, Homo sapiens
agtcaaagatgaccgagttcct

SEQ ID NO: 97224 - DNA, 22 bp, Homo sapiens
ggagaggggaacttgttgcttg

SEQ ID NO: 97225 - DNA, 22 bp, Homo sapiens
aggggatggagctggaaggcag

SEQ ID NO: 97226 - DNA, 22 bp, Homo sapiens
gaatttcctctaaacccctgag

SEQ ID NO: 97227 - DNA, 22 bp, Homo sapiens
cgcggtggcggcctccagcgcc

SEQ ID NO: 97228 - DNA, 22 bp, Homo sapiens
tgaacatgctgttgatggcctg

SEQ ID NO: 97229 - DNA, 22 bp, Homo sapiens
gcaactgaacatgtgtgtggcc

SEQ ID NO: 97230 - DNA, 22 bp, Homo sapiens
ctccgcagcgggccaatccgga

SEQ ID NO: 97231 - DNA, 22 bp, Homo sapiens
ttgagggtctggatctgctgct

SEQ ID NO: 97232 - DNA, 20 bp, Homo sapiens
ctgtggaattttaccatgcg

SEQ ID NO: 97233 - DNA, 22 bp, Homo sapiens
gtctctatcatagctgaaccct

SEQ ID NO: 97234 - DNA, 22 bp, Homo sapiens
gaacttggcctgtctgtctggc

SEQ ID NO: 97235 - DNA, 22 bp, Homo sapiens
gggcggatcacctgaggtcagg

SEQ ID NO: 97236 - DNA, 22 bp, Homo sapiens
agagtactgcctcagttatgaa

SEQ ID NO: 97237 - DNA, 22 bp, Homo sapiens
gggcggatcatttgaggtcagg

SEQ ID NO: 97238 - DNA, 22 bp, Homo sapiens
tctgttgactcctagcagccat

SEQ ID NO: 97239 - DNA, 22 bp, Homo sapiens
cgcaccactgaattccagcctg

SEQ ID NO: 97240 - DNA, 22 bp, Homo sapiens
ggggcaggagcccttcttcagc

SEQ ID NO: 97241 - DNA, 22 bp, Homo sapiens
atgccacttcattccagcctcg

SEQ ID NO: 97242 - DNA, 22 bp, Homo sapiens
tcgcgggttgcacatggccatc

SEQ ID NO: 97243 - DNA, 19 bp, Homo sapiens
tctgaagaattagagagca

SEQ ID NO: 97244 - DNA, 17 bp, Homo sapiens
cccgttctcttcgctgg

SEQ ID NO: 97245 - DNA, 22 bp, Homo sapiens
ttaaatattatgttgtctgcaa

SEQ ID NO: 97246 - DNA, 22 bp, Homo sapiens
cactgcactccagcctgggaga

SEQ ID NO: 97247 - DNA, 22 bp, Homo sapiens
acattaaacttgcttggctgta

SEQ ID NO: 97248 - DNA, 22 bp, Homo sapiens
agttcgagatctgctgatgaga

SEQ ID NO: 97249 - DNA, 22 bp, Homo sapiens
ttcttcagcctaccttgacctc

SEQ ID NO: 97250 - DNA, 21 bp, Homo sapiens
ggtgacacgtggccccgctct

SEQ ID NO: 97251 - DNA, 22 bp, Homo sapiens
atgccactgcgctccagcctgg

SEQ ID NO: 97252 - DNA, 22 bp, Homo sapiens
cgtcacttcttagtctattttc

SEQ ID NO: 97253 - DNA, 22 bp, Homo sapiens
caatagtgtctgcttgtttcta

SEQ ID NO: 97254 - DNA, 22 bp, Homo sapiens
tgagatgaataactcctgctaa

SEQ ID NO: 97255 - DNA, 22 bp, Homo sapiens
cttccttctcactagcagcgcc

SEQ ID NO: 97256 - DNA, 22 bp, Homo sapiens
gtgcaaaagtaattgtggtttt

SEQ ID NO: 97257 - DNA, 22 bp, Homo sapiens
tcactgcaacctccacctcctg

SEQ ID NO: 97258 - DNA, 22 bp, Homo sapiens
ctcttagtaatgccatgaagca

SEQ ID NO: 97259 - DNA, 22 bp, Homo sapiens
gcaggtggatcaccacgtcagg

SEQ ID NO: 97260 - DNA, 22 bp, Homo sapiens
ggcctcgcggcttctggtggct

SEQ ID NO: 97261 - DNA, 22 bp, Homo sapiens
aacccgggaggcggaggttgtg

SEQ ID NO: 97262 - DNA, 22 bp, Homo sapiens
aggtggggaggagtgtctcttt

SEQ ID NO: 97263 - DNA, 22 bp, Homo sapiens
ttgatcaaatcagctactgagg

SEQ ID NO: 97264 - DNA, 22 bp, Homo sapiens
ctcttcctagtgtgcagcgtgg

SEQ ID NO: 97265 - DNA, 20 bp, Homo sapiens
tttctgtgagaaacactgtt

SEQ ID NO: 97266 - DNA, 22 bp, Homo sapiens
gggccatgagaggttcatcaac

SEQ ID NO: 97267 - DNA, 22 bp, Homo sapiens
tctggctctggagtccacctgc

SEQ ID NO: 97268 - DNA, 22 bp, Homo sapiens
cgtggggcgggtggacacttgc

SEQ ID NO: 97269 - DNA, 22 bp, Homo sapiens
cgcaggtgaaagaggctgggca

SEQ ID NO: 97270 - DNA, 22 bp, Homo sapiens
agtgaggggcagctgagtgggc

SEQ ID NO: 97271 - DNA, 22 bp, Homo sapiens
tgttattgtcgctgcactggga

SEQ ID NO: 97272 - DNA, 14 bp, Homo sapiens
gcaggcagatcacc

SEQ ID NO: 97273 - DNA, 22 bp, Homo sapiens
cctgcctatgagacgttttgcc

SEQ ID NO: 97274 - DNA, 18 bp, Homo sapiens
ggtgagggagctggaagc

SEQ ID NO: 97275 - DNA, 22 bp, Homo sapiens
aaaaagtattggccatggttga

SEQ ID NO: 97276 - DNA, 22 bp, Homo sapiens
ctgagatctttatacgaggcac

SEQ ID NO: 97277 - DNA, 22 bp, Homo sapiens
tggacaacatagtgagacctca

SEQ ID NO: 97278 - DNA, 22 bp, Homo sapiens
ttcatataccttgcgtttcaca

SEQ ID NO: 97279 - DNA, 22 bp, Homo sapiens
atttattcctttatggctggag

SEQ ID NO: 97280 - DNA, 22 bp, Homo sapiens
atttcctgtaggggcttgcgaa

SEQ ID NO: 97281 - DNA, 21 bp, Homo sapiens
ctggaggcaggtggtgccagg

SEQ ID NO: 97282 - DNA, 22 bp, Homo sapiens
tgtctcatctcttaaccccact

SEQ ID NO: 97283 - DNA, 19 bp, Homo sapiens
gggcaaagtgatcgtcctg

SEQ ID NO: 97284 - DNA, 22 bp, Homo sapiens
ggtggttcacgcctataatccc

SEQ ID NO: 97285 - DNA, 22 bp, Homo sapiens
gggacttaatgcagagagggac

SEQ ID NO: 97286 - DNA, 22 bp, Homo sapiens
tttccatgtgtactggccagaa

SEQ ID NO: 97287 - DNA, 22 bp, Homo sapiens
ggctagggatctagaccaggac

SEQ ID NO: 97288 - DNA, 22 bp, Homo sapiens
gggagctgagctggaagagaat

SEQ ID NO: 97289 - DNA, 22 bp, Homo sapiens
acatttatataactcactagga

SEQ ID NO: 97290 - DNA, 22 bp, Homo sapiens
agttattactctttaacatatt

SEQ ID NO: 97291 - DNA, 22 bp, Homo sapiens
attgtaaatagtgccacaataa

SEQ ID NO: 97292 - DNA, 22 bp, Homo sapiens
aatggaatacctaggtggccca

SEQ ID NO: 97293 - DNA, 22 bp, Homo sapiens
tgttgctgtatgaataggaagg

SEQ ID NO: 97294 - DNA, 22 bp, Homo sapiens
actgcacttcagcctgggtgac

SEQ ID NO: 97295 - DNA, 22 bp, Homo sapiens
acaagcatgggctttgacatca

SEQ ID NO: 97296 - DNA, 22 bp, Homo sapiens
gccaggcgggtctcaaactcct

SEQ ID NO: 97297 - DNA, 22 bp, Homo sapiens
caagcttgtttctcctgggggt

SEQ ID NO: 97298 - DNA, 22 bp, Homo sapiens
gggttgaggcggatgtcggcgg

SEQ ID NO: 97299 - DNA, 22 bp, Homo sapiens
ctgtaatcccagctactcggga

SEQ ID NO: 97300 - DNA, 22 bp, Homo sapiens
actgcactccagcctgggtaac

SEQ ID NO: 97301 - DNA, 22 bp, Homo sapiens
actgcactccaacctgggtgac

SEQ ID NO: 97302 - DNA, 22 bp, Homo sapiens
ttacctaaaatagctcaattta

SEQ ID NO: 97303 - DNA, 22 bp, Homo sapiens
ttctgggtttacatctgacttc

SEQ ID NO: 97304 - DNA, 21 bp, Homo sapiens
tgcaatccagcctgggcgaca

SEQ ID NO: 97305 - DNA, 22 bp, Homo sapiens
ggggtgtggacggctgtgccag

SEQ ID NO: 97306 - DNA, 22 bp, Homo sapiens
cactgcactccagcccgggcaa

SEQ ID NO: 97307 - DNA, 17 bp, Homo sapiens
tggctctgtcctcagct

SEQ ID NO: 97308 - DNA, 22 bp, Homo sapiens
gttactcttgagaggctgaggt

SEQ ID NO: 97309 - DNA, 21 bp, Homo sapiens
ccgccgctgatagctctgggc

SEQ ID NO: 97310 - DNA, 22 bp, Homo sapiens
ggcaggaggtgagtggcgggtg

SEQ ID NO: 97311 - DNA, 23 bp, Homo sapiens
aagtggttttgaacccggaccct

SEQ ID NO: 97312 - DNA, 18 bp, Homo sapiens
atggtctcatactgggag

SEQ ID NO: 97313 - DNA, 22 bp, Homo sapiens
ttcctagggcagagccgctggg

SEQ ID NO: 97314 - DNA, 22 bp, Homo sapiens
acgcctgtaatcccagcacttt

SEQ ID NO: 97315 - DNA, 22 bp, Homo sapiens
ttgtatagcccagagagtgaga

SEQ ID NO: 97316 - DNA, 22 bp, Homo sapiens
gcaggcagaggtggaggagaca

SEQ ID NO: 97317 - DNA, 22 bp, Homo sapiens
actttatttcctattgcatcca

SEQ ID NO: 97318 - DNA, 22 bp, Homo sapiens
acacttggagcaacacttatgg

SEQ ID NO: 97319 - DNA, 20 bp, Homo sapiens
ataaaataactgccacaaga

SEQ ID NO: 97320 - DNA, 22 bp, Homo sapiens
aagccggctgggccgaggctgc

SEQ ID NO: 97321 - DNA, 18 bp, Homo sapiens
tcttccaacactgacacc

SEQ ID NO: 97322 - DNA, 22 bp, Homo sapiens
tcccgtcttgctgttgtctgcg

SEQ ID NO: 97323 - DNA, 22 bp, Homo sapiens
gcagggcacaaggacgcacagg

SEQ ID NO: 97324 - DNA, 22 bp, Homo sapiens
cgcagggccgcgagcgggacca

SEQ ID NO: 97325 - DNA, 22 bp, Homo sapiens
tttggtattgcacactgtcttc

SEQ ID NO: 97326 - DNA, 22 bp, Homo sapiens
tgggattcaccatgggcttcag

SEQ ID NO: 97327 - DNA, 22 bp, Homo sapiens
gctgatagactgaatgttggga

SEQ ID NO: 97328 - DNA, 20 bp, Homo sapiens
tttgcgaggccaaggcgggc

SEQ ID NO: 97329 - DNA, 22 bp, Homo sapiens
tgtctattcccccacctccgtt

SEQ ID NO: 97330 - DNA, 22 bp, Homo sapiens
agcgccactgcactccagcctg

SEQ ID NO: 97331 - DNA, 22 bp, Homo sapiens
tctgcaggtaagcgttcttgga

SEQ ID NO: 97332 - DNA, 23 bp, Homo sapiens
aatgggtgcaactatccatgaca

SEQ ID NO: 97333 - DNA, 22 bp, Homo sapiens
aactatgttaataagtttcatt

SEQ ID NO: 97334 - DNA, 22 bp, Homo sapiens
cccatgaggtggaggttgcagt

SEQ ID NO: 97335 - DNA, 22 bp, Homo sapiens
tgatctcctgaccttgtaatcc

SEQ ID NO: 97336 - DNA, 22 bp, Homo sapiens
ggtgacctcacctggtcccacc

SEQ ID NO: 97337 - DNA, 22 bp, Homo sapiens
attgctaggaacaggttgcacc

SEQ ID NO: 97338 - DNA, 22 bp, Homo sapiens
atgccactgcactccagcctgg

SEQ ID NO: 97339 - DNA, 22 bp, Homo sapiens
atagttttaaaacctcaggaag

SEQ ID NO: 97340 - DNA, 23 bp, Homo sapiens
ttgcttgagcccaggaagtggag

SEQ ID NO: 97341 - DNA, 22 bp, Homo sapiens
ggctgagttgagaggattactt

SEQ ID NO: 97342 - DNA, 22 bp, Homo sapiens
cttgtcttgcacacggttgcca

SEQ ID NO: 97343 - DNA, 22 bp, Homo sapiens
tggcctcggcatccagcaagag

SEQ ID NO: 97344 - DNA, 22 bp, Homo sapiens
gcctggattccttgtttctcag

SEQ ID NO: 97345 - DNA, 22 bp, Homo sapiens
cactgcactccagcctgggtga

SEQ ID NO: 97346 - DNA, 22 bp, Homo sapiens
gtcactgtatccaggttccagc

SEQ ID NO: 97347 - DNA, 20 bp, Homo sapiens
gggtgtgtgcagggcctggt

SEQ ID NO: 97348 - DNA, 22 bp, Homo sapiens
cccagtttcaactttccagtgg

SEQ ID NO: 97349 - DNA, 22 bp, Homo sapiens
cgcgaggtggaggttgcagtga

SEQ ID NO: 97350 - DNA, 22 bp, Homo sapiens
actgcacttcagcctgggtgtc

SEQ ID NO: 97351 - DNA, 22 bp, Homo sapiens
aaatgtaagtctttgtttctta

SEQ ID NO: 97352 - DNA, 22 bp, Homo sapiens
gggagctggagctggaagactc

SEQ ID NO: 97353 - DNA, 22 bp, Homo sapiens
gaccctgtttctacaaataatt

SEQ ID NO: 97354 - DNA, 22 bp, Homo sapiens
tgcctgatgcaggagtatcaga

SEQ ID NO: 97355 - DNA, 22 bp, Homo sapiens
gccgtgcgtgcgcaggtgctgt

SEQ ID NO: 97356 - DNA, 23 bp, Homo sapiens
gacagagtgagaccttgtcttac

SEQ ID NO: 97357 - DNA, 22 bp, Homo sapiens
gggtattaaaatgaaggagaaa

SEQ ID NO: 97358 - DNA, 22 bp, Homo sapiens
atgtccttcctgagatccctgt

SEQ ID NO: 97359 - DNA, 22 bp, Homo sapiens
tcactgcaacctccacctcccg

SEQ ID NO: 97360 - DNA, 22 bp, Homo sapiens
gagcctcgtggcggccactgcg

SEQ ID NO: 97361 - DNA, 22 bp, Homo sapiens
agagcacggccaccatttacaa

SEQ ID NO: 97362 - DNA, 22 bp, Homo sapiens
tagcccctgcctttgaacctgg

SEQ ID NO: 97363 - DNA, 22 bp, Homo sapiens
ctgtcctggggaaagccagccc

SEQ ID NO: 97364 - DNA, 22 bp, Homo sapiens
tttattggatatttacaagata

SEQ ID NO: 97365 - DNA, 22 bp, Homo sapiens
cacggtggcccacaggtgcaag

SEQ ID NO: 97366 - DNA, 16 bp, Homo sapiens
gcaggcagatcacatg

SEQ ID NO: 97367 - DNA, 22 bp, Homo sapiens
acggtgaccaagcatcaccgag

SEQ ID NO: 97368 - DNA, 22 bp, Homo sapiens
cacctgtacagggccgggctgg

SEQ ID NO: 97369 - DNA, 22 bp, Homo sapiens
actgcactccagcctgggtgat

SEQ ID NO: 97370 - DNA, 22 bp, Homo sapiens
ctgtcctgccagtcctggactc

SEQ ID NO: 97371 - DNA, 22 bp, Homo sapiens
aaagcagaggttgcagtgagct

SEQ ID NO: 97372 - DNA, 22 bp, Homo sapiens
attgggatgccggctgataaga

SEQ ID NO: 97373 - DNA, 22 bp, Homo sapiens
agcactgatttaaactggattt

SEQ ID NO: 97374 - DNA, 22 bp, Homo sapiens
cagcatgaatgtgttcgtaggg

SEQ ID NO: 97375 - DNA, 22 bp, Homo sapiens
gctgggtgattcatttccataa

SEQ ID NO: 97376 - DNA, 22 bp, Homo sapiens
gtggtggatgtctgtaatctca

SEQ ID NO: 97377 - DNA, 22 bp, Homo sapiens
tgtcctcatcctccagtctgtc

SEQ ID NO: 97378 - DNA, 22 bp, Homo sapiens
ttccatacgactgaggtctcgg

SEQ ID NO: 97379 - DNA, 22 bp, Homo sapiens
gcatctaaataaacgtgggagt

SEQ ID NO: 97380 - DNA, 22 bp, Homo sapiens
tgagatgtaaggtatgcttact

SEQ ID NO: 97381 - DNA, 22 bp, Homo sapiens
agttggagtgaacatgagattg

SEQ ID NO: 97382 - DNA, 19 bp, Homo sapiens
catggtgaaaccccgtctc

SEQ ID NO: 97383 - DNA, 22 bp, Homo sapiens
catgtaaagaatttcacacaag

SEQ ID NO: 97384 - DNA, 22 bp, Homo sapiens
actgcactcctgcctgggtaac

SEQ ID NO: 97385 - DNA, 22 bp, Homo sapiens
tcacttcccagacggggtggca

SEQ ID NO: 97386 - DNA, 22 bp, Homo sapiens
gcttggaagtaggattgggaga

SEQ ID NO: 97387 - DNA, 22 bp, Homo sapiens
gtgtgtcccttggaacctcagc

SEQ ID NO: 97388 - DNA, 22 bp, Homo sapiens
ctggctgggagcgagctgctca

SEQ ID NO: 97389 - DNA, 22 bp, Homo sapiens
tctcgctctgtcgcccaggctg

SEQ ID NO: 97390 - DNA, 17 bp, Homo sapiens
tgtagcttctccttctc

SEQ ID NO: 97391 - DNA, 22 bp, Homo sapiens
tcctcagaatcacctggcagct

SEQ ID NO: 97392 - DNA, 22 bp, Homo sapiens
gttcagatttgactggtttctc

SEQ ID NO: 97393 - DNA, 22 bp, Homo sapiens
ttatgatttgccacagattggt

SEQ ID NO: 97394 - DNA, 22 bp, Homo sapiens
gtaatctcagctacttgggagg

SEQ ID NO: 97395 - DNA, 22 bp, Homo sapiens
aggctagaggcttctggcttca

SEQ ID NO: 97396 - DNA, 22 bp, Homo sapiens
caaatgtataaatgtactttct

SEQ ID NO: 97397 - DNA, 22 bp, Homo sapiens
ggggttaacagtattgctcatg

SEQ ID NO: 97398 - DNA, 21 bp, Homo sapiens
tgctgggtttgcccatcaggc

SEQ ID NO: 97399 - DNA, 22 bp, Homo sapiens
cttgtattaggaagaatgcttt

SEQ ID NO: 97400 - DNA, 18 bp, Homo sapiens
ggcgggtgttttattcac

SEQ ID NO: 97401 - DNA, 22 bp, Homo sapiens
ctgagggtcaacttgattgtat

SEQ ID NO: 97402 - DNA, 22 bp, Homo sapiens
gggatttcaccatgttggttgg

SEQ ID NO: 97403 - DNA, 22 bp, Homo sapiens
gttattgaggtggagtctcact

SEQ ID NO: 97404 - DNA, 19 bp, Homo sapiens
gatttaaacgtggctctat

SEQ ID NO: 97405 - DNA, 22 bp, Homo sapiens
tctaatccttgctacctgggtg

SEQ ID NO: 97406 - DNA, 22 bp, Homo sapiens
gtcccataagtagtgcaacttg

SEQ ID NO: 97407 - DNA, 22 bp, Homo sapiens
gcacctgcctgggactgaagat

SEQ ID NO: 97408 - DNA, 22 bp, Homo sapiens
gagggaaaggttaatacatgat

SEQ ID NO: 97409 - DNA, 22 bp, Homo sapiens
tgcaccctcatcagtcaaatgg

SEQ ID NO: 97410 - DNA, 22 bp, Homo sapiens
gtttacttgtgccttggcttaa

SEQ ID NO: 97411 - DNA, 22 bp, Homo sapiens
ctccttctgggcctggcagtgg

SEQ ID NO: 97412 - DNA, 22 bp, Homo sapiens
gagcagtgccaaagaatttgcg

SEQ ID NO: 97413 - DNA, 22 bp, Homo sapiens
aggtggaaatggctttcctagg

SEQ ID NO: 97414 - DNA, 22 bp, Homo sapiens
ctcgcatgccctgcctcatcca

SEQ ID NO: 97415 - DNA, 22 bp, Homo sapiens
gtgtgtccaaggcacggatgac

SEQ ID NO: 97416 - DNA, 22 bp, Homo sapiens
gcatgtgtctttatagcagcat

SEQ ID NO: 97417 - DNA, 22 bp, Homo sapiens
cactgcactccagcctgggtca

SEQ ID NO: 97418 - DNA, 22 bp, Homo sapiens
aacccgggaggcagaggttgtg

SEQ ID NO: 97419 - DNA, 22 bp, Homo sapiens
aggatttctgtgcctggaaaat

SEQ ID NO: 97420 - DNA, 22 bp, Homo sapiens
ttggtggacctcatcagaaccg

SEQ ID NO: 97421 - DNA, 22 bp, Homo sapiens
agggaagaggaccagagtctct

SEQ ID NO: 97422 - DNA, 22 bp, Homo sapiens
ctgccgtgtttttcatgttaaa

SEQ ID NO: 97423 - DNA, 23 bp, Homo sapiens
ccagtgattgcctggaaggaggt

SEQ ID NO: 97424 - DNA, 22 bp, Homo sapiens
ctggatgtccaggtagaagttt

SEQ ID NO: 97425 - DNA, 22 bp, Homo sapiens
agttgcagacgcagagatgttg

SEQ ID NO: 97426 - DNA, 22 bp, Homo sapiens
attgcactccagcctgggtgac

SEQ ID NO: 97427 - DNA, 20 bp, Homo sapiens
tttgagaccagtctgcccaa

SEQ ID NO: 97428 - DNA, 22 bp, Homo sapiens
cttagagatgggttttacttag

SEQ ID NO: 97429 - DNA, 22 bp, Homo sapiens
attgcactccggcctgggtgac

SEQ ID NO: 97430 - DNA, 22 bp, Homo sapiens
cactgcactccagcttgggtga

SEQ ID NO: 97431 - DNA, 22 bp, Homo sapiens
actgcacttcaccctgggtgac

SEQ ID NO: 97432 - DNA, 22 bp, Homo sapiens
ctagcctgggatttgaacttat

SEQ ID NO: 97433 - DNA, 22 bp, Homo sapiens
ccggctactcgggaggctgacg

SEQ ID NO: 97434 - DNA, 22 bp, Homo sapiens
gggaggttgaggctgcagtgag

SEQ ID NO: 97435 - DNA, 22 bp, Homo sapiens
tctagggtgtataaggaagcct

SEQ ID NO: 97436 - DNA, 22 bp, Homo sapiens
tttgaggttagctagcagatca

SEQ ID NO: 97437 - DNA, 22 bp, Homo sapiens
acgtgcaggatctggttggcga

SEQ ID NO: 97438 - DNA, 22 bp, Homo sapiens
actggacagaggaaatatggag

SEQ ID NO: 97439 - DNA, 21 bp, Homo sapiens
tgtaagtttcatctgaattgg

SEQ ID NO: 97440 - DNA, 22 bp, Homo sapiens
tatctattatgttctatgtgtc

SEQ ID NO: 97441 - DNA, 23 bp, Homo sapiens
ggttccaggaacacagcctgatg

SEQ ID NO: 97442 - DNA, 22 bp, Homo sapiens
gtggggtagatctttctcagga

SEQ ID NO: 97443 - DNA, 22 bp, Homo sapiens
gagatggagtctttttctgtca

SEQ ID NO: 97444 - DNA, 22 bp, Homo sapiens
ctgtcctgtgctttttactgtc

SEQ ID NO: 97445 - DNA, 22 bp, Homo sapiens
gacaggtgctaagggacctggc

SEQ ID NO: 97446 - DNA, 22 bp, Homo sapiens
gggtccctggaattacttgaca

SEQ ID NO: 97447 - DNA, 22 bp, Homo sapiens
caggtggtcaggcaaggacacg

SEQ ID NO: 97448 - DNA, 22 bp, Homo sapiens
gttggctatgagagctttagtg

SEQ ID NO: 97449 - DNA, 22 bp, Homo sapiens
acttcttcttcagctgggggat

SEQ ID NO: 97450 - DNA, 22 bp, Homo sapiens
atacagggacatccagtttttc

SEQ ID NO: 97451 - DNA, 22 bp, Homo sapiens
tgctagtgtgtgagatgttcaa

SEQ ID NO: 97452 - DNA, 22 bp, Homo sapiens
tctcctggagcccagatgctgg

SEQ ID NO: 97453 - DNA, 22 bp, Homo sapiens
ggagttgattttggatatatta

SEQ ID NO: 97454 - DNA, 21 bp, Homo sapiens
tctctttctggaagcttccct

SEQ ID NO: 97455 - DNA, 21 bp, Homo sapiens
tctgatggtagatgagatgtg

SEQ ID NO: 97456 - DNA, 22 bp, Homo sapiens
cctcgcggcactcgggccggat

SEQ ID NO: 97457 - DNA, 22 bp, Homo sapiens
tgacatgtatatcttacgctat

SEQ ID NO: 97458 - DNA, 20 bp, Homo sapiens
ttgagcttttagtacagaca

SEQ ID NO: 97459 - DNA, 22 bp, Homo sapiens
ggttccacctggcgaggggtat

SEQ ID NO: 97460 - DNA, 22 bp, Homo sapiens
tcctggcttgtcacatctacgt

SEQ ID NO: 97461 - DNA, 22 bp, Homo sapiens
caggcagggagctggaaaggat

SEQ ID NO: 97462 - DNA, 22 bp, Homo sapiens
gcaggtggatcacctgaggtca

SEQ ID NO: 97463 - DNA, 21 bp, Homo sapiens
tgttttccaccttgaggcaag

SEQ ID NO: 97464 - DNA, 22 bp, Homo sapiens
agggaattcactggaacgccct

SEQ ID NO: 97465 - DNA, 22 bp, Homo sapiens
tttccagagggtgctcagggcg

SEQ ID NO: 97466 - DNA, 22 bp, Homo sapiens
gggtggtggccagcagtgggca

SEQ ID NO: 97467 - DNA, 22 bp, Homo sapiens
ttgcactccagcccgagcaaca

SEQ ID NO: 97468 - DNA, 22 bp, Homo sapiens
tggtatgaccgtggtgcaagca

SEQ ID NO: 97469 - DNA, 22 bp, Homo sapiens
tgtgacctcatcttaactggaa

SEQ ID NO: 97470 - DNA, 22 bp, Homo sapiens
taggctaggctgaaggttttgg

SEQ ID NO: 97471 - DNA, 22 bp, Homo sapiens
gacagacacaattgatccatga

SEQ ID NO: 97472 - DNA, 22 bp, Homo sapiens
ccaggtgtgctctgcagtggat

SEQ ID NO: 97473 - DNA, 22 bp, Homo sapiens
acgcggtgcggcaagttcatgg

SEQ ID NO: 97474 - DNA, 22 bp, Homo sapiens
gcaggcagatcacctgtcagga

SEQ ID NO: 97475 - DNA, 22 bp, Homo sapiens
ttggcttttatgcagcttaggt

SEQ ID NO: 97476 - DNA, 18 bp, Homo sapiens
gaggatggaaggagatgc

SEQ ID NO: 97477 - DNA, 22 bp, Homo sapiens
ggagagggtaggggtcctgccc

SEQ ID NO: 97478 - DNA, 22 bp, Homo sapiens
agccggccatgtggtcttgtgc

SEQ ID NO: 97479 - DNA, 22 bp, Homo sapiens
gtctatatattgcttgaataat

SEQ ID NO: 97480 - DNA, 22 bp, Homo sapiens
catataaatacaacatgtgtta

SEQ ID NO: 97481 - DNA, 22 bp, Homo sapiens
gttgaggtgatgccagccctgc

SEQ ID NO: 97482 - DNA, 22 bp, Homo sapiens
gtggattacaagacagttgaga

SEQ ID NO: 97483 - DNA, 22 bp, Homo sapiens
agagggtgggcacgtgatggat

SEQ ID NO: 97484 - DNA, 22 bp, Homo sapiens
atgccactgcacttcagcttgg

SEQ ID NO: 97485 - DNA, 22 bp, Homo sapiens
tggtggggccagacttcagctc

SEQ ID NO: 97486 - DNA, 22 bp, Homo sapiens
ttctcttttcaccagttgctaa

SEQ ID NO: 97487 - DNA, 22 bp, Homo sapiens
ggacctgaacataaaacgaggc

SEQ ID NO: 97488 - DNA, 22 bp, Homo sapiens
gccagggttcgaatccgtatgg

SEQ ID NO: 97489 - DNA, 22 bp, Homo sapiens
aaagcagaactgagagagctgg

SEQ ID NO: 97490 - DNA, 22 bp, Homo sapiens
gaggtgtcatcaggcagctctg

SEQ ID NO: 97491 - DNA, 22 bp, Homo sapiens
cacagacagtgtccctttgttg

SEQ ID NO: 97492 - DNA, 22 bp, Homo sapiens
taatatctacttcatagagttt

SEQ ID NO: 97493 - DNA, 22 bp, Homo sapiens
tgcactactgtgatacacagcc

SEQ ID NO: 97494 - DNA, 22 bp, Homo sapiens
ggatgttgattgaatggccatt

SEQ ID NO: 97495 - DNA, 17 bp, Homo sapiens
gggcagggactcctggg

SEQ ID NO: 97496 - DNA, 22 bp, Homo sapiens
ttagtttataattcatttctgt

SEQ ID NO: 97497 - DNA, 22 bp, Homo sapiens
gcagtggcatgatgtgggctca

SEQ ID NO: 97498 - DNA, 22 bp, Homo sapiens
ttaggcctttgattggggtgct

SEQ ID NO: 97499 - DNA, 22 bp, Homo sapiens
accactgcccatggtgaaaact

SEQ ID NO: 97500 - DNA, 18 bp, Homo sapiens
tcctttctccctcatctt

SEQ ID NO: 97501 - DNA, 22 bp, Homo sapiens
ctgtaatcccagctacctggga

SEQ ID NO: 97502 - DNA, 19 bp, Homo sapiens
tccagatgatatggattac

SEQ ID NO: 97503 - DNA, 18 bp, Homo sapiens
tgagaggctattttttgc

SEQ ID NO: 97504 - DNA, 23 bp, Homo sapiens
ttggcaaagcctatgaagtcctc

SEQ ID NO: 97505 - DNA, 22 bp, Homo sapiens
tggcaatgttagcaaagcattt

SEQ ID NO: 97506 - DNA, 20 bp, Homo sapiens
ctgggtggcaagcaaggggg

SEQ ID NO: 97507 - DNA, 22 bp, Homo sapiens
tacaaaaaattgatactgacga

SEQ ID NO: 97508 - DNA, 22 bp, Homo sapiens
ttagggttacaccagcctcctg

SEQ ID NO: 97509 - DNA, 22 bp, Homo sapiens
ttggagatatcacaccttcaca

SEQ ID NO: 97510 - DNA, 22 bp, Homo sapiens
gcaggcaggcttccttgaactg

SEQ ID NO: 97511 - DNA, 22 bp, Homo sapiens
atgccactgcactccagcctag

SEQ ID NO: 97512 - DNA, 22 bp, Homo sapiens
gaaccattgttgaaaagaatag

SEQ ID NO: 97513 - DNA, 22 bp, Homo sapiens
ggaggcagaatagagtgtgggt

SEQ ID NO: 97514 - DNA, 22 bp, Homo sapiens
taatgtaaacacagagacagaa

SEQ ID NO: 97515 - DNA, 22 bp, Homo sapiens
ctggtagctcctgaatatccct

SEQ ID NO: 97516 - DNA, 15 bp, Homo sapiens
gcaggcaggtcacct

SEQ ID NO: 97517 - DNA, 22 bp, Homo sapiens
gaacttggaactggggctactg

SEQ ID NO: 97518 - DNA, 22 bp, Homo sapiens
tgcttgaacccaggaagtggag

SEQ ID NO: 97519 - DNA, 21 bp, Homo sapiens
cactccacttagaacagggtt

SEQ ID NO: 97520 - DNA, 22 bp, Homo sapiens
tgaatagagctgcagtggacat

SEQ ID NO: 97521 - DNA, 22 bp, Homo sapiens
ttctgtgaatcttttttcccac

SEQ ID NO: 97522 - DNA, 22 bp, Homo sapiens
actgcgctccagcctgggtgac

SEQ ID NO: 97523 - DNA, 22 bp, Homo sapiens
caggtgtcggtcaggcggtttt

SEQ ID NO: 97524 - DNA, 19 bp, Homo sapiens
gtgtccatggagcatggag

SEQ ID NO: 97525 - DNA, 22 bp, Homo sapiens
tgggactcactcttttggccag

SEQ ID NO: 97526 - DNA, 22 bp, Homo sapiens
gtggatggagctggaagccatt

SEQ ID NO: 97527 - DNA, 19 bp, Homo sapiens
tctcaattctccccactgc

SEQ ID NO: 97528 - DNA, 22 bp, Homo sapiens
ggcttggaccagtcacagtggt

SEQ ID NO: 97529 - DNA, 22 bp, Homo sapiens
gggcaggggtcagtggccccaa

SEQ ID NO: 97530 - DNA, 22 bp, Homo sapiens
tccatgaggaccaaattcgtag

SEQ ID NO: 97531 - DNA, 22 bp, Homo sapiens
agggaagaaaatccatcgctgc

SEQ ID NO: 97532 - DNA, 22 bp, Homo sapiens
gttcaagaccagcctggccaac

SEQ ID NO: 97533 - DNA, 23 bp, Homo sapiens
ccactagcacctgttcaacttct

SEQ ID NO: 97534 - DNA, 22 bp, Homo sapiens
tgggcaggggccctgcttccgt

SEQ ID NO: 97535 - DNA, 22 bp, Homo sapiens
tctgcggtccccttctcgccct

SEQ ID NO: 97536 - DNA, 23 bp, Homo sapiens
ttgtcctctggatcggtttggtt

SEQ ID NO: 97537 - DNA, 22 bp, Homo sapiens
agagagcagtggatcacctagc

SEQ ID NO: 97538 - DNA, 22 bp, Homo sapiens
gagcagtaggagaaccctgagc

SEQ ID NO: 97539 - DNA, 22 bp, Homo sapiens
actgcactccagcctcggggtc

SEQ ID NO: 97540 - DNA, 22 bp, Homo sapiens
tacctcaagttccaggaaagcg

SEQ ID NO: 97541 - DNA, 22 bp, Homo sapiens
aagctgcagcacagagaggtgg

SEQ ID NO: 97542 - DNA, 22 bp, Homo sapiens
catgtgtccacccttgaacaca

SEQ ID NO: 97543 - DNA, 20 bp, Homo sapiens
catgtgtcagttctcaccca

SEQ ID NO: 97544 - DNA, 22 bp, Homo sapiens
ggagctgaggacactacatttt

SEQ ID NO: 97545 - DNA, 22 bp, Homo sapiens
tgcactccaggctgggtgacag

SEQ ID NO: 97546 - DNA, 22 bp, Homo sapiens
ttatttaatgtgatctgaagag

SEQ ID NO: 97547 - DNA, 22 bp, Homo sapiens
gctgcagtgagccaagatcgtg

SEQ ID NO: 97548 - DNA, 22 bp, Homo sapiens
tggtattacttctagacacaag

SEQ ID NO: 97549 - DNA, 22 bp, Homo sapiens
tgggcagggagctggaaccaca

SEQ ID NO: 97550 - DNA, 22 bp, Homo sapiens
ggcttttgtttcagctctgcta

SEQ ID NO: 97551 - DNA, 22 bp, Homo sapiens
ttatttaaaagtggtaagattc

SEQ ID NO: 97552 - DNA, 22 bp, Homo sapiens
tcagtgatttctggggtgaggg

SEQ ID NO: 97553 - DNA, 22 bp, Homo sapiens
cactgcactccatcctgggaaa

SEQ ID NO: 97554 - DNA, 22 bp, Homo sapiens
ggggtgggcgtgcagggacacc

SEQ ID NO: 97555 - DNA, 21 bp, Homo sapiens
tgactgaggcttcttcacaca

SEQ ID NO: 97556 - DNA, 22 bp, Homo sapiens
gatgcgggcccgctccactgcc

SEQ ID NO: 97557 - DNA, 22 bp, Homo sapiens
tggctaacaaggtgaaaccccg

SEQ ID NO: 97558 - DNA, 22 bp, Homo sapiens
cggaggttgaggctgcagtgag

SEQ ID NO: 97559 - DNA, 22 bp, Homo sapiens
catgtgtcttgctgccctccat

SEQ ID NO: 97560 - DNA, 22 bp, Homo sapiens
aggtggagaagagatgggcagt

SEQ ID NO: 97561 - DNA, 22 bp, Homo sapiens
tctgtagtaggttgtagttctt

SEQ ID NO: 97562 - DNA, 22 bp, Homo sapiens
tggtatcgtgttggcactcagt

SEQ ID NO: 97563 - DNA, 22 bp, Homo sapiens
tcgcttgaacccaggaagtgga

SEQ ID NO: 97564 - DNA, 22 bp, Homo sapiens
gtagttctgcagtgtcacctga

SEQ ID NO: 97565 - DNA, 22 bp, Homo sapiens
ggcagggcaggaaagtcaggaa

SEQ ID NO: 97566 - DNA, 22 bp, Homo sapiens
ctgatagacaatcaccatggga

SEQ ID NO: 97567 - DNA, 22 bp, Homo sapiens
cttctcaaagttgtgaatcagg

SEQ ID NO: 97568 - DNA, 22 bp, Homo sapiens
cactgcacttcagcctgggtga

SEQ ID NO: 97569 - DNA, 22 bp, Homo sapiens
tagaggccgaatgctgagctgg

SEQ ID NO: 97570 - DNA, 22 bp, Homo sapiens
gtcatcttgctgttttagatct

SEQ ID NO: 97571 - DNA, 22 bp, Homo sapiens
tgagtggacacctgcttcttta

SEQ ID NO: 97572 - DNA, 22 bp, Homo sapiens
gcccagagtttgaagatacagt

SEQ ID NO: 97573 - DNA, 22 bp, Homo sapiens
tgctgttagtaaggaacatgac

SEQ ID NO: 97574 - DNA, 22 bp, Homo sapiens
tagctcaaaggttaagtgtgga

SEQ ID NO: 97575 - DNA, 22 bp, Homo sapiens
tgagcaggcgcagcaggaggtc

SEQ ID NO: 97576 - DNA, 22 bp, Homo sapiens
acatcttttactctggttcggg

SEQ ID NO: 97577 - DNA, 22 bp, Homo sapiens
aagctgttgttcatcctgaatt

SEQ ID NO: 97578 - DNA, 22 bp, Homo sapiens
gagaggtggaggttgcagtgag

SEQ ID NO: 97579 - DNA, 22 bp, Homo sapiens
tccacagtggttgaactagtaa

SEQ ID NO: 97580 - DNA, 22 bp, Homo sapiens
tagcccaggctggagtgcaggg

SEQ ID NO: 97581 - DNA, 22 bp, Homo sapiens
gaatatcccgctatgcaaagta

SEQ ID NO: 97582 - DNA, 22 bp, Homo sapiens
tgttaaatgctcagctcgggga

SEQ ID NO: 97583 - DNA, 22 bp, Homo sapiens
cagggcctcctaaggcatctaa

SEQ ID NO: 97584 - DNA, 22 bp, Homo sapiens
aggtggagaagagatgggcagt

SEQ ID NO: 97585 - DNA, 22 bp, Homo sapiens
tgcaggctcttggtgacgtggg

SEQ ID NO: 97586 - DNA, 22 bp, Homo sapiens
gaaggtggcgagcggattgctg

SEQ ID NO: 97587 - DNA, 22 bp, Homo sapiens
aaccaccattctctcctcttcc

SEQ ID NO: 97588 - DNA, 22 bp, Homo sapiens
acagttaataagtagtaagtca

SEQ ID NO: 97589 - DNA, 22 bp, Homo sapiens
ttggatccatctcaggcatagg

SEQ ID NO: 97590 - DNA, 22 bp, Homo sapiens
tccacagtggttgaactagttt

SEQ ID NO: 97591 - DNA, 22 bp, Homo sapiens
gtgaaatatttaacgtccaggt

SEQ ID NO: 97592 - DNA, 22 bp, Homo sapiens
tgcacgtgtgagcattcacatg

SEQ ID NO: 97593 - DNA, 22 bp, Homo sapiens
agctggagatgagtgacgtgcc

SEQ ID NO: 97594 - DNA, 22 bp, Homo sapiens
gccagagttgaggcagtttatt

SEQ ID NO: 97595 - DNA, 22 bp, Homo sapiens
aatggaatacctaggtggccca

SEQ ID NO: 97596 - DNA, 22 bp, Homo sapiens
aactctatttaccctactaaac

SEQ ID NO: 97597 - DNA, 22 bp, Homo sapiens
gattcactcatattttacgttt

SEQ ID NO: 97598 - DNA, 22 bp, Homo sapiens
gagcccaggagtttgatgctgc

SEQ ID NO: 97599 - DNA, 22 bp, Homo sapiens
tggtagtcggcctcggtggctc

SEQ ID NO: 97600 - DNA, 22 bp, Homo sapiens
tttcttcctgctttgtcccatg

SEQ ID NO: 97601 - DNA, 22 bp, Homo sapiens
gctgggctgcgtcggggaagcc

SEQ ID NO: 97602 - DNA, 22 bp, Homo sapiens
gaggtgggcggatcacaaggtc

SEQ ID NO: 97603 - DNA, 22 bp, Homo sapiens
acaggggcaagggctcacggcc

SEQ ID NO: 97604 - DNA, 19 bp, Homo sapiens
gttctttcatagtaagagc

SEQ ID NO: 97605 - DNA, 22 bp, Homo sapiens
actgttttctgtaaagggccag

SEQ ID NO: 97606 - DNA, 22 bp, Homo sapiens
agtggcctggagccccgcctgg

SEQ ID NO: 97607 - DNA, 22 bp, Homo sapiens
cacgttaacagctaacagatga

SEQ ID NO: 97608 - DNA, 22 bp, Homo sapiens
gaggtggatgttgcagtgagct

SEQ ID NO: 97609 - DNA, 22 bp, Homo sapiens
ggggtgggcgtgcagggacacc

SEQ ID NO: 97610 - DNA, 22 bp, Homo sapiens
cttctttcaagaatggattagg

SEQ ID NO: 97611 - DNA, 22 bp, Homo sapiens
gcccagagttcaaggctgcagt

SEQ ID NO: 97612 - DNA, 22 bp, Homo sapiens
ggaggtggaggttgcagtgagc

SEQ ID NO: 97613 - DNA, 22 bp, Homo sapiens
acagttaattgttgttgggtgt

SEQ ID NO: 97614 - DNA, 22 bp, Homo sapiens
gggttgaggcggatgtcggcgg

SEQ ID NO: 97615 - DNA, 22 bp, Homo sapiens
tgggaaggggagctggaaagga

SEQ ID NO: 97616 - DNA, 22 bp, Homo sapiens
aaggtgggcagatcacaaggtc

SEQ ID NO: 97617 - DNA, 22 bp, Homo sapiens
gaggtgggtgtatcacaggtca

SEQ ID NO: 97618 - DNA, 22 bp, Homo sapiens
agagtggagagaaacaactctg

SEQ ID NO: 97619 - DNA, 22 bp, Homo sapiens
tgggactcactcttttggccag

SEQ ID NO: 97620 - DNA, 20 bp, Homo sapiens
ccagagctgatggctgcccg

SEQ ID NO: 97621 - DNA, 22 bp, Homo sapiens
acttcttcttcagctgggggat

SEQ ID NO: 97622 - DNA, 22 bp, Homo sapiens
ggagaagaggagctggaagcct

SEQ ID NO: 97623 - DNA, 22 bp, Homo sapiens
tggaagggagctggaatttgga

SEQ ID NO: 97624 - DNA, 23 bp, Homo sapiens
ggatggacgtgatgccttagcca

SEQ ID NO: 97625 - DNA, 22 bp, Homo sapiens
agagtgcaaccgaaacaagcag

SEQ ID NO: 97626 - DNA, 22 bp, Homo sapiens
ctggtagtttgcaaaatggtgt

SEQ ID NO: 97627 - DNA, 22 bp, Homo sapiens
gattgagtctgaggatgctgca

SEQ ID NO: 97628 - DNA, 22 bp, Homo sapiens
tctaaattactttgggcagtat

SEQ ID NO: 97629 - DNA, 22 bp, Homo sapiens
tgtttcttacgtttttagaggc

SEQ ID NO: 97630 - DNA, 22 bp, Homo sapiens
cttcagctgcagttatgtttag

SEQ ID NO: 97631 - DNA, 22 bp, Homo sapiens
ccagagctgattcctgggactt

SEQ ID NO: 97632 - DNA, 22 bp, Homo sapiens
gtcccataagtagtgcaacttg

SEQ ID NO: 97633 - DNA, 22 bp, Homo sapiens
catctttgcccatccacttcca

SEQ ID NO: 97634 - DNA, 22 bp, Homo sapiens
atcttcccaggctggggagagg

SEQ ID NO: 97635 - DNA, 22 bp, Homo sapiens
agtactgtcagcagggtgttga

SEQ ID NO: 97636 - DNA, 22 bp, Homo sapiens
atatacacatctttttaaatat

SEQ ID NO: 97637 - DNA, 22 bp, Homo sapiens
atgtatatgcatgcattcaaag

SEQ ID NO: 97638 - DNA, 22 bp, Homo sapiens
tggagaattctatgttgagggg

SEQ ID NO: 97639 - DNA, 23 bp, Homo sapiens
cctgcctccccatcagttataca

SEQ ID NO: 97640 - DNA, 22 bp, Homo sapiens
ctggctgggagcgagctgctca

SEQ ID NO: 97641 - DNA, 22 bp, Homo sapiens
gggtccctggaattacttgaca

SEQ ID NO: 97642 - DNA, 22 bp, Homo sapiens
aagaggttgtctgtgatgagtt

SEQ ID NO: 97643 - DNA, 22 bp, Homo sapiens
ttttccttcatatcccttatgt

SEQ ID NO: 97644 - DNA, 23 bp, Homo sapiens
ctcctcgtaactctgtggtgggt

SEQ ID NO: 97645 - DNA, 22 bp, Homo sapiens
ctggcctaggaatggttttccg

SEQ ID NO: 97646 - DNA, 21 bp, Homo sapiens
cactccacttagaacagggtt

SEQ ID NO: 97647 - DNA, 22 bp, Homo sapiens
ctcgtgatccgcccacctcagc

SEQ ID NO: 97648 - DNA, 22 bp, Homo sapiens
agcctggtttaagcattttata

SEQ ID NO: 97649 - DNA, 22 bp, Homo sapiens
gccataggcagcgtggccagca

SEQ ID NO: 97650 - DNA, 22 bp, Homo sapiens
ctcactgcaagctcagcctccc

SEQ ID NO: 97651 - DNA, 22 bp, Homo sapiens
taggtgcagtggctcatgcctg

SEQ ID NO: 97652 - DNA, 22 bp, Homo sapiens
cagtggaggccttgggaccttt

SEQ ID NO: 97653 - DNA, 22 bp, Homo sapiens
ccctggctgcgtgatggatgaa

SEQ ID NO: 97654 - DNA, 22 bp, Homo sapiens
cttagatgaagtcacagaaccc

SEQ ID NO: 97655 - DNA, 22 bp, Homo sapiens
gggcggggtggctcatgcctgt

SEQ ID NO: 97656 - DNA, 22 bp, Homo sapiens
tggattcacaccattctcctgc

SEQ ID NO: 97657 - DNA, 22 bp, Homo sapiens
ttcagacatgcaggctgaggct

SEQ ID NO: 97658 - DNA, 22 bp, Homo sapiens
gcgagggcacgcggttgaaggc

SEQ ID NO: 97659 - DNA, 22 bp, Homo sapiens
gtatggcactatcctctctgat

SEQ ID NO: 97660 - DNA, 22 bp, Homo sapiens
catcttgtctttttgggcctga

SEQ ID NO: 97661 - DNA, 22 bp, Homo sapiens
ctgaggtgtgaaatggtggcaa

SEQ ID NO: 97662 - DNA, 22 bp, Homo sapiens
ggcctctcttgggacagctgtc

SEQ ID NO: 97663 - DNA, 22 bp, Homo sapiens
tgcttctgactaagctgcatga

SEQ ID NO: 97664 - DNA, 23 bp, Homo sapiens
gacagagtgagaccttgtcttac

SEQ ID NO: 97665 - DNA, 21 bp, Homo sapiens
tgaaggtgttcatgatgcggt

SEQ ID NO: 97666 - DNA, 19 bp, Homo sapiens
ggagccgccgcccttcatt

SEQ ID NO: 97667 - DNA, 22 bp, Homo sapiens
tcactgcactccagcactcagg

SEQ ID NO: 97668 - DNA, 22 bp, Homo sapiens
gctgcagctcgccttccggcct

SEQ ID NO: 97669 - DNA, 22 bp, Homo sapiens
ggagagggtaggggtcctgccc

SEQ ID NO: 97670 - DNA, 22 bp, Homo sapiens
atctggttttggctgtgtccct

SEQ ID NO: 97671 - DNA, 22 bp, Homo sapiens
ggccactgctctccagcctggg

SEQ ID NO: 97672 - DNA, 22 bp, Homo sapiens
cgcccaggctggagagcagtgg

SEQ ID NO: 97673 - DNA, 22 bp, Homo sapiens
ccacagaattctgtctccagga

SEQ ID NO: 97674 - DNA, 22 bp, Homo sapiens
tattactgtcaatatcacagaa

SEQ ID NO: 97675 - DNA, 22 bp, Homo sapiens
tacaaaaaattgatactgacga

SEQ ID NO: 97676 - DNA, 22 bp, Homo sapiens
ttccgagtctccaaggggttgt

SEQ ID NO: 97677 - DNA, 22 bp, Homo sapiens
gaaagacatagttgcaagatgg

SEQ ID NO: 97678 - DNA, 17 bp, Homo sapiens
gggcagggactcctggg

SEQ ID NO: 97679 - DNA, 22 bp, Homo sapiens
agacaaagaaaccgtagaagca

SEQ ID NO: 97680 - DNA, 22 bp, Homo sapiens
agggcactgcaagggttgaagg

SEQ ID NO: 97681 - DNA, 22 bp, Homo sapiens
ggtttattgttaataagtttga

SEQ ID NO: 97682 - DNA, 22 bp, Homo sapiens
ttttgagatggagtcttgctct

SEQ ID NO: 97683 - DNA, 22 bp, Homo sapiens
gggagaagaatgtgtcaattgt

SEQ ID NO: 97684 - DNA, 22 bp, Homo sapiens
gaggggctgccctggtgtcagg

SEQ ID NO: 97685 - DNA, 22 bp, Homo sapiens
tctgacattagattaattggaa

SEQ ID NO: 97686 - DNA, 22 bp, Homo sapiens
tcactgcaacctccacctcctg

SEQ ID NO: 97687 - DNA, 22 bp, Homo sapiens
gggaggttgaggctgcagtgag

SEQ ID NO: 97688 - DNA, 22 bp, Homo sapiens
agcatggccatctgggccgtcc

SEQ ID NO: 97689 - DNA, 22 bp, Homo sapiens
tttggaaattttcatccagaca

SEQ ID NO: 97690 - DNA, 22 bp, Homo sapiens
agaggggcccggttctccgtct

SEQ ID NO: 97691 - DNA, 22 bp, Homo sapiens
gaaggaagtcattagtgcagac

SEQ ID NO: 97692 - DNA, 22 bp, Homo sapiens
gattgggggtcaggctcaggtc

SEQ ID NO: 97693 - DNA, 22 bp, Homo sapiens
ctattattagataatctacttg

SEQ ID NO: 97694 - DNA, 22 bp, Homo sapiens
gaccaaggaagaggggagccag

SEQ ID NO: 97695 - DNA, 22 bp, Homo sapiens
gattcactcatattttacgttt

SEQ ID NO: 97696 - DNA, 22 bp, Homo sapiens
ggggccttggatctgtgccccg

SEQ ID NO: 97697 - DNA, 22 bp, Homo sapiens
cctgccctgctcactgtcggta

SEQ ID NO: 97698 - DNA, 22 bp, Homo sapiens
agggtggcactggtggctctat

SEQ ID NO: 97699 - DNA, 22 bp, Homo sapiens
agctcctgaaaatccagactgg

SEQ ID NO: 97700 - DNA, 22 bp, Homo sapiens
gccacctcggctttctctgctc

SEQ ID NO: 97701 - DNA, 22 bp, Homo sapiens
ggaagggcaaaagagatgaact

SEQ ID NO: 97702 - DNA, 22 bp, Homo sapiens
taagggttcagaatgcagtggt

SEQ ID NO: 97703 - DNA, 22 bp, Homo sapiens
cctggaggcggaggttgcagtg

SEQ ID NO: 97704 - DNA, 22 bp, Homo sapiens
gccaggacctcagatgcagggc

SEQ ID NO: 97705 - DNA, 22 bp, Homo sapiens
ttgggacagctgtggtagtgag

SEQ ID NO: 97706 - DNA, 22 bp, Homo sapiens
ctggagggtggagagaagtctc

SEQ ID NO: 97707 - DNA, 22 bp, Homo sapiens
ccaggaggcggaaggtacagtg

SEQ ID NO: 97708 - DNA, 21 bp, Homo sapiens
ggccgccgccttgtgctctgc

SEQ ID NO: 97709 - DNA, 19 bp, Homo sapiens
tggctctgtcgaaggcaca

SEQ ID NO: 97710 - DNA, 15 bp, Homo sapiens
tggcccacccgttga

SEQ ID NO: 97711 - DNA, 22 bp, Homo sapiens
tgggaagggtcaacagctggaa

SEQ ID NO: 97712 - DNA, 22 bp, Homo sapiens
gcagtggcatgatgtgggctca

SEQ ID NO: 97713 - DNA, 22 bp, Homo sapiens
cccagcaggaggaggttgcagt

SEQ ID NO: 97714 - DNA, 22 bp, Homo sapiens
gtctcccagcctacatctttct

SEQ ID NO: 97715 - DNA, 22 bp, Homo sapiens
aggtgcatctcgtagctcttct

SEQ ID NO: 97716 - DNA, 19 bp, Homo sapiens
ggggcctgtgatggtcaca

SEQ ID NO: 97717 - DNA, 22 bp, Homo sapiens
aagccctggcgggtggagggcc

SEQ ID NO: 97718 - DNA, 22 bp, Homo sapiens
actcatgtaagcggaatgtagt

SEQ ID NO: 97719 - DNA, 22 bp, Homo sapiens
gcccagagttcaaggctgcagt

SEQ ID NO: 97720 - DNA, 22 bp, Homo sapiens
aagacttgaccaggttgaaggc

SEQ ID NO: 97721 - DNA, 22 bp, Homo sapiens
gggcaacagagcgagggcctgt

SEQ ID NO: 97722 - DNA, 22 bp, Homo sapiens
gggactggagtagaggccggtg

SEQ ID NO: 97723 - DNA, 22 bp, Homo sapiens
tgcctccaacagcccatcctag

SEQ ID NO: 97724 - DNA, 22 bp, Homo sapiens
gagagaagggggatatgagcct

SEQ ID NO: 97725 - DNA, 22 bp, Homo sapiens
tcccaggccacacttggggaac

SEQ ID NO: 97726 - DNA, 22 bp, Homo sapiens
ccaggctggagtgcagtggcac

SEQ ID NO: 97727 - DNA, 22 bp, Homo sapiens
tgtcttcaggagtaaatatcat

SEQ ID NO: 97728 - DNA, 22 bp, Homo sapiens
cgggcgcactccgggcagctgt

SEQ ID NO: 97729 - DNA, 18 bp, Homo sapiens
cttgttcttctcttggcg

SEQ ID NO: 97730 - DNA, 22 bp, Homo sapiens
tgtgtgcatgcttggggcagca

SEQ ID NO: 97731 - DNA, 22 bp, Homo sapiens
gagctgtgtatgcatcattctg

SEQ ID NO: 97732 - DNA, 22 bp, Homo sapiens
gcccccgtagtagatgaggcgc

SEQ ID NO: 97733 - DNA, 22 bp, Homo sapiens
ctgctgagccgcacccaggagc

SEQ ID NO: 97734 - DNA, 22 bp, Homo sapiens
atgcacctgaactccatcagct

SEQ ID NO: 97735 - DNA, 18 bp, Homo sapiens
tggcgatggtcatttttc

SEQ ID NO: 97736 - DNA, 22 bp, Homo sapiens
ggcccaggctggagtgcagtgg

SEQ ID NO: 97737 - DNA, 22 bp, Homo sapiens
tggcatggagtggatggcccca

SEQ ID NO: 97738 - DNA, 22 bp, Homo sapiens
agtgtggagcatcgagggcaga

SEQ ID NO: 97739 - DNA, 22 bp, Homo sapiens
tagggggctttgctgcttgaca

SEQ ID NO: 97740 - DNA, 22 bp, Homo sapiens
gcctcctggggtgccatcatct

SEQ ID NO: 97741 - DNA, 22 bp, Homo sapiens
tctctatttgcctaggcttgtg

SEQ ID NO: 97742 - DNA, 22 bp, Homo sapiens
tcctgggacaagccgtggaagt

SEQ ID NO: 97743 - DNA, 22 bp, Homo sapiens
caggtgttggaagggcagtggg

SEQ ID NO: 97744 - DNA, 20 bp, Homo sapiens
ctgggtggcaagcaaggggg

SEQ ID NO: 97745 - DNA, 22 bp, Homo sapiens
tctggcttcgcagctcccagcc

SEQ ID NO: 97746 - DNA, 22 bp, Homo sapiens
cccagcaggtcggtgctgcctg

SEQ ID NO: 97747 - DNA, 22 bp, Homo sapiens
agatacattgttctaagcattg

SEQ ID NO: 97748 - DNA, 22 bp, Homo sapiens
tgttatcagagagaggtgctgt

SEQ ID NO: 97749 - DNA, 20 bp, Homo sapiens
gccgactgccttgtgagcct

SEQ ID NO: 97750 - DNA, 22 bp, Homo sapiens
aattcacatccgaccaggtcaa

SEQ ID NO: 97751 - DNA, 22 bp, Homo sapiens
agcataagttggtacagccact

SEQ ID NO: 97752 - DNA, 22 bp, Homo sapiens
agaaaatgtgaacttgtgaatt

SEQ ID NO: 97753 - DNA, 22 bp, Homo sapiens
catgctgtgtgttttagctcca

SEQ ID NO: 97754 - DNA, 22 bp, Homo sapiens
attttctatgttgtaattgtta

SEQ ID NO: 97755 - DNA, 22 bp, Homo sapiens
gaaatcatattctcagtccttc

SEQ ID NO: 97756 - DNA, 22 bp, Homo sapiens
gtgtaagtatctttgtatcttt

SEQ ID NO: 97757 - DNA, 22 bp, Homo sapiens
tcactgcaacctccacctcccg

SEQ ID NO: 97758 - DNA, 23 bp, Homo sapiens
attttttgtctttgtaactagat

SEQ ID NO: 97759 - DNA, 22 bp, Homo sapiens
tgggaggccgaggcaggtggat

SEQ ID NO: 97760 - DNA, 22 bp, Homo sapiens
gctgaaggcccggaggacaggg

SEQ ID NO: 97761 - DNA, 22 bp, Homo sapiens
tccaggtgacagagacaggata

SEQ ID NO: 97762 - DNA, 22 bp, Homo sapiens
ccctgctgtgtagcggaggaac

SEQ ID NO: 97763 - DNA, 22 bp, Homo sapiens
ccaggtagccaaggggtctggg

SEQ ID NO: 97764 - DNA, 22 bp, Homo sapiens
ccacccttgggttcggaggccg

SEQ ID NO: 97765 - DNA, 20 bp, Homo sapiens
tttgaatgtaaagcatgtca

SEQ ID NO: 97766 - DNA, 22 bp, Homo sapiens
cagggccagggacacgctgtca

SEQ ID NO: 97767 - DNA, 22 bp, Homo sapiens
gctcgcgccgcaccggtccacc

SEQ ID NO: 97768 - DNA, 22 bp, Homo sapiens
gggctgggattgcttgctgtga

SEQ ID NO: 97769 - DNA, 22 bp, Homo sapiens
ggctctgcttgaggccagcctg

SEQ ID NO: 97770 - DNA, 22 bp, Homo sapiens
tccgggcaactgaagggaggtt

SEQ ID NO: 97771 - DNA, 22 bp, Homo sapiens
gtacaaatgcaggtttgttaca

SEQ ID NO: 97772 - DNA, 22 bp, Homo sapiens
gcagctggaagtgacactctgt

SEQ ID NO: 97773 - DNA, 22 bp, Homo sapiens
gcctcctgtcccaggctgagga

SEQ ID NO: 97774 - DNA, 22 bp, Homo sapiens
catataaatacaacatgtgtta

SEQ ID NO: 97775 - DNA, 22 bp, Homo sapiens
taggcatgcaaataaatgtgca

SEQ ID NO: 97776 - DNA, 22 bp, Homo sapiens
cctgaggatgccagcatgggtg

SEQ ID NO: 97777 - DNA, 22 bp, Homo sapiens
agctcttacatttaggtctatg

SEQ ID NO: 97778 - DNA, 22 bp, Homo sapiens
tctgagaaatttctttgtgatg

SEQ ID NO: 97779 - DNA, 22 bp, Homo sapiens
attgttcaatgtaataattttg

SEQ ID NO: 97780 - DNA, 22 bp, Homo sapiens
cggctgggttcggctgcaggcc

SEQ ID NO: 97781 - DNA, 22 bp, Homo sapiens
tcagcctgctccaagtgctgcc

SEQ ID NO: 97782 - DNA, 22 bp, Homo sapiens
actgcactcctgcctgggtaac

SEQ ID NO: 97783 - DNA, 22 bp, Homo sapiens
ctggcaggtggaggttgcagtg

SEQ ID NO: 97784 - DNA, 22 bp, Homo sapiens
aggaggggttctcgggtgctga

SEQ ID NO: 97785 - DNA, 22 bp, Homo sapiens
tggaagggagctggaatttgga

SEQ ID NO: 97786 - DNA, 22 bp, Homo sapiens
ttgtgtgtactggttatgggca

SEQ ID NO: 97787 - DNA, 22 bp, Homo sapiens
aaatatcttaggagtatatgag

SEQ ID NO: 97788 - DNA, 22 bp, Homo sapiens
tgagcaggcgcagcaggaggtc

SEQ ID NO: 97789 - DNA, 22 bp, Homo sapiens
acccaggctggagtgcagtgat

SEQ ID NO: 97790 - DNA, 21 bp, Homo sapiens
gctgctcgagatccagtgctt

SEQ ID NO: 97791 - DNA, 22 bp, Homo sapiens
tctgaggctgaatggactccgt

SEQ ID NO: 97792 - DNA, 22 bp, Homo sapiens
caaagcccagaggcctcacttt

SEQ ID NO: 97793 - DNA, 22 bp, Homo sapiens
accctcaacaaattcactctat

SEQ ID NO: 97794 - DNA, 22 bp, Homo sapiens
cactgcactccatcctgggaaa

SEQ ID NO: 97795 - DNA, 22 bp, Homo sapiens
tatgacttttcccaattcagga

SEQ ID NO: 97796 - DNA, 22 bp, Homo sapiens
actttcttggtcccatgtttga

SEQ ID NO: 97797 - DNA, 22 bp, Homo sapiens
ttggaggcaatgggaaggaggc

SEQ ID NO: 97798 - DNA, 22 bp, Homo sapiens
ggcagcactgcagcttgttggg

SEQ ID NO: 97799 - DNA, 22 bp, Homo sapiens
cccagctcttcaagtcaccccc

SEQ ID NO: 97800 - DNA, 20 bp, Homo sapiens
cagcctgcatcatctgcagc

SEQ ID NO: 97801 - DNA, 22 bp, Homo sapiens
aaagtgctgagattacaagcgt

SEQ ID NO: 97802 - DNA, 22 bp, Homo sapiens
atgttattgatgcctgaggctt

SEQ ID NO: 97803 - DNA, 22 bp, Homo sapiens
agatcggctttgcagacctcat

SEQ ID NO: 97804 - DNA, 22 bp, Homo sapiens
gggtacagttcttccagtgtca

SEQ ID NO: 97805 - DNA, 22 bp, Homo sapiens
ccctctacagggaagcgctttc

SEQ ID NO: 97806 - DNA, 22 bp, Homo sapiens
ggagagcttggagtgcgatttt

SEQ ID NO: 97807 - DNA, 22 bp, Homo sapiens
aacagactccattacctggctt

SEQ ID NO: 97808 - DNA, 22 bp, Homo sapiens
caggctggagtgcagtggtgcc

SEQ ID NO: 97809 - DNA, 22 bp, Homo sapiens
gggacaatggaggcctctctcc

SEQ ID NO: 97810 - DNA, 22 bp, Homo sapiens
gaggggagcccccatcctccag

SEQ ID NO: 97811 - DNA, 18 bp, Homo sapiens
tccctcagaattatagaa

SEQ ID NO: 97812 - DNA, 22 bp, Homo sapiens
ttttaatactgctattgtagga

SEQ ID NO: 97813 - DNA, 22 bp, Homo sapiens
gatgcgggcccgctccactgcc

SEQ ID NO: 97814 - DNA, 22 bp, Homo sapiens
gtccaagagtcaagaagggggc

SEQ ID NO: 97815 - DNA, 22 bp, Homo sapiens
gttactcttgagaggctgaggt

SEQ ID NO: 97816 - DNA, 22 bp, Homo sapiens
tcctccactttgtctagcaaca

SEQ ID NO: 97817 - DNA, 22 bp, Homo sapiens
agaggctgcacttgctcatgat

SEQ ID NO: 97818 - DNA, 22 bp, Homo sapiens
gtgggctgcccttgaggtcagc

SEQ ID NO: 97819 - DNA, 22 bp, Homo sapiens
gcggcccgagcaggacgggtgg

SEQ ID NO: 97820 - DNA, 18 bp, Homo sapiens
cagctgccagctcatgga

SEQ ID NO: 97821 - DNA, 22 bp, Homo sapiens
cctcctgcacctccaggaactc

SEQ ID NO: 97822 - DNA, 22 bp, Homo sapiens
gcccaggctggagtgcagtggc

SEQ ID NO: 97823 - DNA, 22 bp, Homo sapiens
ctggcaagaaatatatatctta

SEQ ID NO: 97824 - DNA, 22 bp, Homo sapiens
tcgtgaggctctgcatcgcaca

SEQ ID NO: 97825 - DNA, 17 bp, Homo sapiens
tggctctgtcctcagct

SEQ ID NO: 97826 - DNA, 22 bp, Homo sapiens
acccagccatgttcagttctct

SEQ ID NO: 97827 - DNA, 22 bp, Homo sapiens
ggacagccgagtggccttctcc

SEQ ID NO: 97828 - DNA, 22 bp, Homo sapiens
gtggagggtgattgccggctgt

SEQ ID NO: 97829 - DNA, 22 bp, Homo sapiens
aggggtcagcccttttgtcagc

SEQ ID NO: 97830 - DNA, 22 bp, Homo sapiens
gagcccaggcagaggttgcagt

SEQ ID NO: 97831 - DNA, 22 bp, Homo sapiens
taatggttttttggagactgct

SEQ ID NO: 97832 - DNA, 22 bp, Homo sapiens
ctcctctttagccccagctgga

SEQ ID NO: 97833 - DNA, 22 bp, Homo sapiens
ggctgtggcagctggaagtggt

SEQ ID NO: 97834 - DNA, 22 bp, Homo sapiens
atatgcagtctcttgcccttct

SEQ ID NO: 97835 - DNA, 22 bp, Homo sapiens
aagacacaatgtagcccagcac

SEQ ID NO: 97836 - DNA, 22 bp, Homo sapiens
gacagctgcatcctcagacaca

SEQ ID NO: 97837 - DNA, 22 bp, Homo sapiens
gagagtgagatcctcctgggga

SEQ ID NO: 97838 - DNA, 17 bp, Homo sapiens
ccctcactcctgccggg

SEQ ID NO: 97839 - DNA, 22 bp, Homo sapiens
ggccttggcctagccctccagg

SEQ ID NO: 97840 - DNA, 22 bp, Homo sapiens
ttatgatttgccacagattggt

SEQ ID NO: 97841 - DNA, 22 bp, Homo sapiens
cttgtagaattgaaatggtctc

SEQ ID NO: 97842 - DNA, 22 bp, Homo sapiens
cttccctctgctccttggtcca

SEQ ID NO: 97843 - DNA, 22 bp, Homo sapiens
ctggagggctgcagcgaggctg

SEQ ID NO: 97844 - DNA, 22 bp, Homo sapiens
ctgggtggcagagcctgcagtg

SEQ ID NO: 97845 - DNA, 22 bp, Homo sapiens
agcccttagtacatttctcaag

SEQ ID NO: 97846 - DNA, 22 bp, Homo sapiens
tgaagactcagaagctaagata

SEQ ID NO: 97847 - DNA, 17 bp, Homo sapiens
ggctgcagtccaggagg

SEQ ID NO: 97848 - DNA, 22 bp, Homo sapiens
aactagaaaaagactttctgag

SEQ ID NO: 97849 - DNA, 22 bp, Homo sapiens
gtggctcacgtctgtcatctca

SEQ ID NO: 97850 - DNA, 16 bp, Homo sapiens
gaggagcccctctgcc

SEQ ID NO: 97851 - DNA, 22 bp, Homo sapiens
acctggaggcagaggttgcagt

SEQ ID NO: 97852 - DNA, 22 bp, Homo sapiens
tgcctgtgtcagcaggtggaag

SEQ ID NO: 97853 - DNA, 22 bp, Homo sapiens
atacaaaaattagccgggagta

SEQ ID NO: 97854 - DNA, 22 bp, Homo sapiens
agggatggagtgcggcccggac

SEQ ID NO: 97855 - DNA, 22 bp, Homo sapiens
attcatcagctaatggacattt

SEQ ID NO: 97856 - DNA, 22 bp, Homo sapiens
tatttcttttcgtgacttattg

SEQ ID NO: 97857 - DNA, 22 bp, Homo sapiens
ttctatttttgtggaactgtag

SEQ ID NO: 97858 - DNA, 22 bp, Homo sapiens
gcctccggagtcacagtgtctt

SEQ ID NO: 97859 - DNA, 22 bp, Homo sapiens
gggagctgagctggaagagaat

SEQ ID NO: 97860 - DNA, 22 bp, Homo sapiens
cctgcacagccggacccctgct

SEQ ID NO: 97861 - DNA, 22 bp, Homo sapiens
gttcccaccatgctgcacccat

SEQ ID NO: 97862 - DNA, 23 bp, Homo sapiens
gtgtggccccagggcctcctcgc

SEQ ID NO: 97863 - DNA, 22 bp, Homo sapiens
caccagcagcggtgtgagggtg

SEQ ID NO: 97864 - DNA, 22 bp, Homo sapiens
ggagaagcagcttcttgatgaa

SEQ ID NO: 97865 - DNA, 18 bp, Homo sapiens
gatcgggggcgccccaag

SEQ ID NO: 97866 - DNA, 22 bp, Homo sapiens
ctgctgagagccccagctgaga

SEQ ID NO: 97867 - DNA, 22 bp, Homo sapiens
aggggatgcctagtggagtctc

SEQ ID NO: 97868 - DNA, 22 bp, Homo sapiens
agccagtgcagctggaaattca

SEQ ID NO: 97869 - DNA, 22 bp, Homo sapiens
ctgcatccatgttgctgcaaag

SEQ ID NO: 97870 - DNA, 22 bp, Homo sapiens
tggatctcggcaatgcgggact

SEQ ID NO: 97871 - DNA, 22 bp, Homo sapiens
ccgcccacactaaatatgagcg

SEQ ID NO: 97872 - DNA, 22 bp, Homo sapiens
ctgctgaggtggagattgcagt

SEQ ID NO: 97873 - DNA, 22 bp, Homo sapiens
ccaggcagcctgctccattctg

SEQ ID NO: 97874 - DNA, 22 bp, Homo sapiens
ccaggctggagtatagtggcgc

SEQ ID NO: 97875 - DNA, 22 bp, Homo sapiens
tttctcttcactgtgtgcctca

SEQ ID NO: 97876 - DNA, 22 bp, Homo sapiens
ggaggaggggtgactgaatgct

SEQ ID NO: 97877 - DNA, 22 bp, Homo sapiens
aggagccagtggagttcctgcc

SEQ ID NO: 97878 - DNA, 22 bp, Homo sapiens
ggcagggcaggaaagtcaggaa

SEQ ID NO: 97879 - DNA, 22 bp, Homo sapiens
cttctcttcctttgtcaactga

SEQ ID NO: 97880 - DNA, 22 bp, Homo sapiens
agccctggtttgcagcatttgc

SEQ ID NO: 97881 - DNA, 22 bp, Homo sapiens
tccaagatctacagcagtttag

SEQ ID NO: 97882 - DNA, 22 bp, Homo sapiens
tggcacaggatctcagcggcca

SEQ ID NO: 97883 - DNA, 22 bp, Homo sapiens
agcatgcgcttgatcagctcca

SEQ ID NO: 97884 - DNA, 22 bp, Homo sapiens
tttaatcaggcaaagcataata

SEQ ID NO: 97885 - DNA, 22 bp, Homo sapiens
tgggagcagttgcatctccagt

SEQ ID NO: 97886 - DNA, 22 bp, Homo sapiens
cggtctcccgtgtgtgtgcgct

SEQ ID NO: 97887 - DNA, 22 bp, Homo sapiens
aagcactttatgtcaatgtcct

SEQ ID NO: 97888 - DNA, 21 bp, Homo sapiens
aggcttggatctagacaggcc

SEQ ID NO: 97889 - DNA, 22 bp, Homo sapiens
gacaagctcccggtggccctcc

SEQ ID NO: 97890 - DNA, 22 bp, Homo sapiens
ttggatccatctcaggcatagg

SEQ ID NO: 97891 - DNA, 18 bp, Homo sapiens
atggtctcatactgggag

SEQ ID NO: 97892 - DNA, 22 bp, Homo sapiens
cgtctggcttctccacggtaaa

SEQ ID NO: 97893 - DNA, 22 bp, Homo sapiens
tcacccaggctggagtgcagtg

SEQ ID NO: 97894 - DNA, 22 bp, Homo sapiens
tctcccaggcaggagtgcagtg

SEQ ID NO: 97895 - DNA, 22 bp, Homo sapiens
cacagctgtgagaagggagcct

SEQ ID NO: 97896 - DNA, 22 bp, Homo sapiens
gcaggcagaggtggaggagaca

SEQ ID NO: 97897 - DNA, 18 bp, Homo sapiens
tcctttctccctcatctt

SEQ ID NO: 97898 - DNA, 22 bp, Homo sapiens
ctggcaggttatagagctgccc

SEQ ID NO: 97899 - DNA, 22 bp, Homo sapiens
ggaggcggaagttgcagtgagc

SEQ ID NO: 97900 - DNA, 22 bp, Homo sapiens
cgggcagtgtggctccagagtc

SEQ ID NO: 97901 - DNA, 22 bp, Homo sapiens
tgggaagaggggtataaagaag

SEQ ID NO: 97902 - DNA, 22 bp, Homo sapiens
atgccactgcgctccagcctgg

SEQ ID NO: 97903 - DNA, 22 bp, Homo sapiens
actggacagaggaaatatggag

SEQ ID NO: 97904 - DNA, 22 bp, Homo sapiens
cctggaagttggaggttgcagt

SEQ ID NO: 97905 - DNA, 22 bp, Homo sapiens
ggggcaggagcccttcttcagc

SEQ ID NO: 97906 - DNA, 22 bp, Homo sapiens
ttgggctgaaccctgcagctga

SEQ ID NO: 97907 - DNA, 22 bp, Homo sapiens
ggaggcagaatagagtgtgggt

SEQ ID NO: 97908 - DNA, 19 bp, Homo sapiens
gactccaactttaagcatg

SEQ ID NO: 97909 - DNA, 22 bp, Homo sapiens
tctgaggaactggcaaagatgg

SEQ ID NO: 97910 - DNA, 22 bp, Homo sapiens
tttaaaaaactagtctgagtct

SEQ ID NO: 97911 - DNA, 22 bp, Homo sapiens
gggcggatcacctgaggtcagg

SEQ ID NO: 97912 - DNA, 22 bp, Homo sapiens
aggggatggagctggaaggcag

SEQ ID NO: 97913 - DNA, 22 bp, Homo sapiens
aaaggacacacaggaggtgtct

SEQ ID NO: 97914 - DNA, 22 bp, Homo sapiens
tgggcttaggtcggaggcggcc

SEQ ID NO: 97915 - DNA, 22 bp, Homo sapiens
tttgaggttagctagcagatca

SEQ ID NO: 97916 - DNA, 22 bp, Homo sapiens
cattccttaacgtggggagtct

SEQ ID NO: 97917 - DNA, 22 bp, Homo sapiens
gctcactgcaacctctgcctcc

SEQ ID NO: 97918 - DNA, 22 bp, Homo sapiens
gtgctggggagataggaagaga

SEQ ID NO: 97919 - DNA, 22 bp, Homo sapiens
accgggaagtcctgcactgggc

SEQ ID NO: 97920 - DNA, 22 bp, Homo sapiens
ttatgggagcaattggggaggt

SEQ ID NO: 97921 - DNA, 22 bp, Homo sapiens
ttcctgggattattgtcaagca

SEQ ID NO: 97922 - DNA, 22 bp, Homo sapiens
aacactatctgccttacaggga

SEQ ID NO: 97923 - DNA, 22 bp, Homo sapiens
agaaaacataggagacaggaaa

SEQ ID NO: 97924 - DNA, 22 bp, Homo sapiens
ctggcctaaaaatacagaacaa

SEQ ID NO: 97925 - DNA, 22 bp, Homo sapiens
aagcccttggcgcacaccgggc

SEQ ID NO: 97926 - DNA, 22 bp, Homo sapiens
agaatagaattctcatagaatt

SEQ ID NO: 97927 - DNA, 18 bp, Homo sapiens
ggtgagggagctggaagc

SEQ ID NO: 97928 - DNA, 22 bp, Homo sapiens
tcacaaatgtttgcatgtgtct

SEQ ID NO: 97929 - DNA, 22 bp, Homo sapiens
tagtggatgttcagagatttga

SEQ ID NO: 97930 - DNA, 22 bp, Homo sapiens
tttagcgtagctgacagctaat

SEQ ID NO: 97931 - DNA, 22 bp, Homo sapiens
atgtgggccgtgcgggtgtcct

SEQ ID NO: 97932 - DNA, 22 bp, Homo sapiens
ggtgccaggctgtagtcagggt

SEQ ID NO: 97933 - DNA, 22 bp, Homo sapiens
aaggagtctgggccattcagag

SEQ ID NO: 97934 - DNA, 22 bp, Homo sapiens
gatgtgtttccaggatttgttt

SEQ ID NO: 97935 - DNA, 22 bp, Homo sapiens
gctaatcaatgttaaggctgtg

SEQ ID NO: 97936 - DNA, 22 bp, Homo sapiens
aggggaggtgtccccaaatctc

SEQ ID NO: 97937 - DNA, 22 bp, Homo sapiens
caggcagggagctggaaaggat

SEQ ID NO: 97938 - DNA, 22 bp, Homo sapiens
cagccagtgtgaccgaggagga

SEQ ID NO: 97939 - DNA, 22 bp, Homo sapiens
ttgtaagtcacaccagggcagg

SEQ ID NO: 97940 - DNA, 22 bp, Homo sapiens
ggctgagttgagaggattactt

SEQ ID NO: 97941 - DNA, 22 bp, Homo sapiens
tcctgccgtcctccggggcctc

SEQ ID NO: 97942 - DNA, 22 bp, Homo sapiens
gtggatggagctggaagccatt

SEQ ID NO: 97943 - DNA, 22 bp, Homo sapiens
gtggagagagataagcctggtc

SEQ ID NO: 97944 - DNA, 22 bp, Homo sapiens
gctgctgggatcctgggtctca

SEQ ID NO: 97945 - DNA, 22 bp, Homo sapiens
tgtgttgtgacattcttggatg

SEQ ID NO: 97946 - DNA, 22 bp, Homo sapiens
tggcacagactgggccaaggaa

SEQ ID NO: 97947 - DNA, 22 bp, Homo sapiens
ggccagaagttggaaaagagcc

SEQ ID NO: 97948 - DNA, 21 bp, Homo sapiens
tctctttctggaagcttccct

SEQ ID NO: 97949 - DNA, 22 bp, Homo sapiens
agagtgcaaccgaaacaagcag

SEQ ID NO: 97950 - DNA, 22 bp, Homo sapiens
gctgcagtgagccaagatcgtg

SEQ ID NO: 97951 - DNA, 22 bp, Homo sapiens
atgttggagtcgtaaggcatgg

SEQ ID NO: 97952 - DNA, 22 bp, Homo sapiens
ggttgcaaactcctgggatcaa

SEQ ID NO: 97953 - DNA, 22 bp, Homo sapiens
actgcaacctccgcctgccagg

SEQ ID NO: 97954 - DNA, 22 bp, Homo sapiens
tgctccatgcgctcggccggcg

SEQ ID NO: 97955 - DNA, 22 bp, Homo sapiens
actgcgctccagcctgggtgac

SEQ ID NO: 97956 - DNA, 22 bp, Homo sapiens
tgggccacacacagaagaatca

SEQ ID NO: 97957 - DNA, 22 bp, Homo sapiens
gagcccaggagtttgatgctgc

SEQ ID NO: 97958 - DNA, 22 bp, Homo sapiens
aatgagatggaattcccgccta

SEQ ID NO: 97959 - DNA, 22 bp, Homo sapiens
gaggcagaggttgcagtgagct

SEQ ID NO: 97960 - DNA, 22 bp, Homo sapiens
aggcaggaggatcatggatgca

SEQ ID NO: 97961 - DNA, 22 bp, Homo sapiens
aaggtagggatgtattcagctt

SEQ ID NO: 97962 - DNA, 22 bp, Homo sapiens
agattctaccagagctagtttg

SEQ ID NO: 97963 - DNA, 22 bp, Homo sapiens
atttaagggatttggagaccaa

SEQ ID NO: 97964 - DNA, 22 bp, Homo sapiens
cctgcctatgagacgttttgcc

SEQ ID NO: 97965 - DNA, 22 bp, Homo sapiens
agagcagctcgctacctctcta

SEQ ID NO: 97966 - DNA, 22 bp, Homo sapiens
ctcagctcattgtggatccggt

SEQ ID NO: 97967 - DNA, 22 bp, Homo sapiens
cttgtgcttttatgaatgcaga

SEQ ID NO: 97968 - DNA, 22 bp, Homo sapiens
atgccactgcactccagcctag

SEQ ID NO: 97969 - DNA, 22 bp, Homo sapiens
tataactacttgaagagttcag

SEQ ID NO: 97970 - DNA, 22 bp, Homo sapiens
cactcagctgagccctcagccc

SEQ ID NO: 97971 - DNA, 22 bp, Homo sapiens
cagtggccaacttcctgcctct

SEQ ID NO: 97972 - DNA, 22 bp, Homo sapiens
cctgtggcgggggccagtgcct

SEQ ID NO: 97973 - DNA, 22 bp, Homo sapiens
ggtgccagatgaggcccgcgat

SEQ ID NO: 97974 - DNA, 22 bp, Homo sapiens
tggacaacatagtgagacctca

SEQ ID NO: 97975 - DNA, 22 bp, Homo sapiens
taaagggtaggttttactgtaa

SEQ ID NO: 97976 - DNA, 22 bp, Homo sapiens
aggagctgtcagagtgccagag

SEQ ID NO: 97977 - DNA, 22 bp, Homo sapiens
agaagccaccagctgaggaaga

SEQ ID NO: 97978 - DNA, 22 bp, Homo sapiens
ttagacatgatggtgcagagag

SEQ ID NO: 97979 - DNA, 22 bp, Homo sapiens
gcttagtcaattataaataggc

SEQ ID NO: 97980 - DNA, 22 bp, Homo sapiens
acggggctagagaaggtttctt

SEQ ID NO: 97981 - DNA, 22 bp, Homo sapiens
tgtcctcatcctccagtctgtc

SEQ ID NO: 97982 - DNA, 22 bp, Homo sapiens
tcagtggagagcttccaggatt

SEQ ID NO: 97983 - DNA, 22 bp, Homo sapiens
ggggtcggggcatagccactta

SEQ ID NO: 97984 - DNA, 22 bp, Homo sapiens
agtccggggtctggacacctgg

SEQ ID NO: 97985 - DNA, 22 bp, Homo sapiens
cccaggccccagggcttgtcag

SEQ ID NO: 97986 - DNA, 21 bp, Homo sapiens
ccgtgctcggctatggaccac

SEQ ID NO: 97987 - DNA, 22 bp, Homo sapiens
tgcctgcctaggaagctgtgaa

SEQ ID NO: 97988 - DNA, 22 bp, Homo sapiens
cgatggtatcggccagccccgg

SEQ ID NO: 97989 - DNA, 22 bp, Homo sapiens
ccgtggtcacctgagctccttg

SEQ ID NO: 97990 - DNA, 22 bp, Homo sapiens
aacccaggagttggaggctgtg

SEQ ID NO: 97991 - DNA, 20 bp, Homo sapiens
aaaatatgtataactcttct

SEQ ID NO: 97992 - DNA, 22 bp, Homo sapiens
ttccaactttgtcatatattat

SEQ ID NO: 97993 - DNA, 22 bp, Homo sapiens
gcactgcaggtgggtggagagg

SEQ ID NO: 97994 - DNA, 19 bp, Homo sapiens
ccacagcctgctgtcttcc

SEQ ID NO: 97995 - DNA, 22 bp, Homo sapiens
gggaggaggaatgttttgtgta

SEQ ID NO: 97996 - DNA, 22 bp, Homo sapiens
gagggggctagcgcagtgccca

SEQ ID NO: 97997 - DNA, 22 bp, Homo sapiens
agaacagaggccttatgtttca

SEQ ID NO: 97998 - DNA, 22 bp, Homo sapiens
tctggctccaggaccgggcaca

SEQ ID NO: 97999 - DNA, 22 bp, Homo sapiens
tcctgccttgcctgggacatca

SEQ ID NO: 98000 - DNA, 22 bp, Homo sapiens
atttagaactttgtttgccaat

SEQ ID NO: 98001 - DNA, 22 bp, Homo sapiens
gggcatggtggcaggcacctgt

SEQ ID NO: 98002 - DNA, 22 bp, Homo sapiens
tagatacctgctggacctcatt

SEQ ID NO: 98003 - DNA, 22 bp, Homo sapiens
tgggcagggagctggaaccaca

SEQ ID NO: 98004 - DNA, 22 bp, Homo sapiens
ctcactgcaagttccacctacc

SEQ ID NO: 98005 - DNA, 16 bp, Homo sapiens
tggggatggggaagag

SEQ ID NO: 98006 - DNA, 22 bp, Homo sapiens
gttactcttccccggggtctgg

SEQ ID NO: 98007 - DNA, 22 bp, Homo sapiens
acaggcttacaggctgcaagta

SEQ ID NO: 98008 - DNA, 22 bp, Homo sapiens
gggaagagggagctggaatgat

SEQ ID NO: 98009 - DNA, 22 bp, Homo sapiens
tagattcagatatttaggacaa

SEQ ID NO: 98010 - DNA, 22 bp, Homo sapiens
gaccttcttgctgtgtcctaac

SEQ ID NO: 98011 - DNA, 22 bp, Homo sapiens
cggctggtgtcgggcacagcaa

SEQ ID NO: 98012 - DNA, 22 bp, Homo sapiens
tatactctgagaaacgtgtcac

SEQ ID NO: 98013 - DNA, 22 bp, Homo sapiens
gagaaatgcatgcatgtcatca

SEQ ID NO: 98014 - DNA, 22 bp, Homo sapiens
tgaggcaggagttcaggctgcg

SEQ ID NO: 98015 - DNA, 18 bp, Homo sapiens
tctggaacaacttcatgt

SEQ ID NO: 98016 - DNA, 22 bp, Homo sapiens
tcttggccactaccacctggag

SEQ ID NO: 98017 - DNA, 22 bp, Homo sapiens
catctgctgttccttggactca

SEQ ID NO: 98018 - DNA, 22 bp, Homo sapiens
cttaatctcacctgcaaagtcc

SEQ ID NO: 98019 - DNA, 22 bp, Homo sapiens
ttttcagaattagcataccatt

SEQ ID NO: 98020 - DNA, 22 bp, Homo sapiens
gcagggtctgaggccacagagg

SEQ ID NO: 98021 - DNA, 22 bp, Homo sapiens
tatttcacatctatgaagtgag

SEQ ID NO: 98022 - DNA, 22 bp, Homo sapiens
ggtgggagagctctgtctccag

SEQ ID NO: 98023 - DNA, 23 bp, Homo sapiens
ctggggctttcaaatctgggcag

SEQ ID NO: 98024 - DNA, 23 bp, Homo sapiens
ccactagcacctgttcaacttct

SEQ ID NO: 98025 - DNA, 22 bp, Homo sapiens
cctttgatttcccccgtctcag

SEQ ID NO: 98026 - DNA, 22 bp, Homo sapiens
ccacactccccgcaggcgtagg

SEQ ID NO: 98027 - DNA, 22 bp, Homo sapiens
ggcggaggttgcagtaagccga

SEQ ID NO: 98028 - DNA, 22 bp, Homo sapiens
acagacaagtagttcagacaag

SEQ ID NO: 98029 - DNA, 22 bp, Homo sapiens
caaagttgcagttatgtgatta

SEQ ID NO: 98030 - DNA, 22 bp, Homo sapiens
ctggtctggctacccagcgaat

SEQ ID NO: 98031 - DNA, 22 bp, Homo sapiens
acccaggctggagtgcagtggg

SEQ ID NO: 98032 - DNA, 22 bp, Homo sapiens
gactggaaagcctgtcctcaga

SEQ ID NO: 98033 - DNA, 20 bp, Homo sapiens
acgtggccaccagtggctta

SEQ ID NO: 98034 - DNA, 22 bp, Homo sapiens
aggggctcctttgtgctgcgtc

SEQ ID NO: 98035 - DNA, 22 bp, Homo sapiens
ccaggagctggagggtgcagtg

SEQ ID NO: 98036 - DNA, 22 bp, Homo sapiens
ttttctcttccctctggacctg

SEQ ID NO: 98037 - DNA, 22 bp, Homo sapiens
ctgggaggcagaggttgcagtg

SEQ ID NO: 98038 - DNA, 23 bp, Homo sapiens
actctcaggttctttccagcagg

SEQ ID NO: 98039 - DNA, 22 bp, Homo sapiens
actattagcatatcatgaatgg

SEQ ID NO: 98040 - DNA, 21 bp, Homo sapiens
ccagagcctgagaggattatg

SEQ ID NO: 98041 - DNA, 22 bp, Homo sapiens
attgtgtcctcattgaccttca

SEQ ID NO: 98042 - DNA, 23 bp, Homo sapiens
cagagctggctcagagctgcctg

SEQ ID NO: 98043 - DNA, 22 bp, Homo sapiens
aagcagagaatctgggagcgag

SEQ ID NO: 98044 - DNA, 22 bp, Homo sapiens
ttatttaaaagtggtaagattc

SEQ ID NO: 98045 - DNA, 22 bp, Homo sapiens
tgcagcctggcttcgcgcctcc

SEQ ID NO: 98046 - DNA, 22 bp, Homo sapiens
cagcagcagtggctgcagaaca

SEQ ID NO: 98047 - DNA, 22 bp, Homo sapiens
acatgtttaagtttgttatatg

SEQ ID NO: 98048 - DNA, 22 bp, Homo sapiens
agagggatcaccctgtttctgg

SEQ ID NO: 98049 - DNA, 22 bp, Homo sapiens
catgtgaattccaaagctaggt

SEQ ID NO: 98050 - DNA, 22 bp, Homo sapiens
ggtggcagtagcactgggcctg

SEQ ID NO: 98051 - DNA, 22 bp, Homo sapiens
cctggctcctacgggtattttg

SEQ ID NO: 98052 - DNA, 22 bp, Homo sapiens
ttaataaagtatgaattggaaa

SEQ ID NO: 98053 - DNA, 22 bp, Homo sapiens
cttgatctacatagtgaaaccc

SEQ ID NO: 98054 - DNA, 22 bp, Homo sapiens
tggaaacacccacgcatgcata

SEQ ID NO: 98055 - DNA, 22 bp, Homo sapiens
cactgcactccagcctgggaga

SEQ ID NO: 98056 - DNA, 22 bp, Homo sapiens
cctcagacccctgctgagcttc

SEQ ID NO: 98057 - DNA, 21 bp, Homo sapiens
tgtaagtttcatctgaattgg

SEQ ID NO: 98058 - DNA, 22 bp, Homo sapiens
aggctcagatccttgtgtcctg

SEQ ID NO: 98059 - DNA, 22 bp, Homo sapiens
gcctgcagggcctgggcctacc

SEQ ID NO: 98060 - DNA, 22 bp, Homo sapiens
tcgtctgtgaaattgggataag

SEQ ID NO: 98061 - DNA, 22 bp, Homo sapiens
gagcctggagctggaacgaagc

SEQ ID NO: 98062 - DNA, 23 bp, Homo sapiens
gcgtccggcctctctcgctcccg

SEQ ID NO: 98063 - DNA, 22 bp, Homo sapiens
atatattttttgagacagagtc

SEQ ID NO: 98064 - DNA, 22 bp, Homo sapiens
cgttttcatgggtagaggttct

SEQ ID NO: 98065 - DNA, 23 bp, Homo sapiens
acagtcgtaggtatccttttcct

SEQ ID NO: 98066 - DNA, 22 bp, Homo sapiens
ctcactgcaagctccacctctt

SEQ ID NO: 98067 - DNA, 22 bp, Homo sapiens
ttctgattgctgatgaggccca

SEQ ID NO: 98068 - DNA, 22 bp, Homo sapiens
gcctgtgtggatgcgccggtgc

SEQ ID NO: 98069 - DNA, 22 bp, Homo sapiens
catccgcatgcaagtgctgtcc

SEQ ID NO: 98070 - DNA, 22 bp, Homo sapiens
gggcactcagctgtagagcagg

SEQ ID NO: 98071 - DNA, 22 bp, Homo sapiens
tttaagaagttatgttataaat

SEQ ID NO: 98072 - DNA, 22 bp, Homo sapiens
tacagctgctggtgctccatgc

SEQ ID NO: 98073 - DNA, 22 bp, Homo sapiens
catagacagatggtaagaagct

SEQ ID NO: 98074 - DNA, 22 bp, Homo sapiens
tcgagctctggagccaaggatg

SEQ ID NO: 98075 - DNA, 22 bp, Homo sapiens
cacccaggctggagtgcagtgg

SEQ ID NO: 98076 - DNA, 22 bp, Homo sapiens
tccacgctgtgtgaccttgggc

SEQ ID NO: 98077 - DNA, 22 bp, Homo sapiens
ggcagggagtggagactcccta

SEQ ID NO: 98078 - DNA, 22 bp, Homo sapiens
ccaggaggcagaagttgcagtg

SEQ ID NO: 98079 - DNA, 22 bp, Homo sapiens
acgtagcactgagagatgcagg

SEQ ID NO: 98080 - DNA, 22 bp, Homo sapiens
tccactgctacaacctcccaga

SEQ ID NO: 98081 - DNA, 22 bp, Homo sapiens
gtctgctcatgctaccgcgggc

SEQ ID NO: 98082 - DNA, 22 bp, Homo sapiens
tctggagataagcagcaatgaa

SEQ ID NO: 98083 - DNA, 18 bp, Homo sapiens
ccgggctttggtgacaca

SEQ ID NO: 98084 - DNA, 22 bp, Homo sapiens
caggctggagttcagtggtgtg

SEQ ID NO: 98085 - DNA, 22 bp, Homo sapiens
ggagaggggaacttgttgcttg

SEQ ID NO: 98086 - DNA, 22 bp, Homo sapiens
gcaggaggttgagccaggactg

SEQ ID NO: 98087 - DNA, 23 bp, Homo sapiens
cagggccctgctcaatttctcca

SEQ ID NO: 98088 - DNA, 22 bp, Homo sapiens
gaatgctaagcatgtgggagtt

SEQ ID NO: 98089 - DNA, 22 bp, Homo sapiens
ggaggcggaggttgcagtgagc

SEQ ID NO: 98090 - DNA, 22 bp, Homo sapiens
gcaggcaggcttccttgaactg

SEQ ID NO: 98091 - DNA, 17 bp, Homo sapiens
ttgaatgcattacttgg

SEQ ID NO: 98092 - DNA, 22 bp, Homo sapiens
ttcctggtctatttagaattgc

SEQ ID NO: 98093 - DNA, 22 bp, Homo sapiens
atgattgaccatctgctgggct

SEQ ID NO: 98094 - DNA, 22 bp, Homo sapiens
actctccttttgatcttcagaa

SEQ ID NO: 98095 - DNA, 22 bp, Homo sapiens
tctttctacatcatttgcttct

SEQ ID NO: 98096 - DNA, 22 bp, Homo sapiens
acatccgcaggttataaagccc

SEQ ID NO: 98097 - DNA, 22 bp, Homo sapiens
aaccaccattctctcctcttcc

SEQ ID NO: 98098 - DNA, 22 bp, Homo sapiens
tggacaggcaagcaagacatac

SEQ ID NO: 98099 - DNA, 22 bp, Homo sapiens
gggcaggggtcagtggccccaa

SEQ ID NO: 98100 - DNA, 22 bp, Homo sapiens
tgtctggtgggttgacaggcag

SEQ ID NO: 98101 - DNA, 22 bp, Homo sapiens
gcacggctaatttttgtatttt

SEQ ID NO: 98102 - DNA, 22 bp, Homo sapiens
aaggtttcgggagcgggtctgg

SEQ ID NO: 98103 - DNA, 22 bp, Homo sapiens
actaggggctcaggcccaggga

SEQ ID NO: 98104 - DNA, 22 bp, Homo sapiens
gggcagccgcgtgacctgccag

SEQ ID NO: 98105 - DNA, 22 bp, Homo sapiens
aaacttgagccaagggcttggg

SEQ ID NO: 98106 - DNA, 22 bp, Homo sapiens
cccacgtcgaacttgctccaga

SEQ ID NO: 98107 - DNA, 22 bp, Homo sapiens
actgcaacctccacctcctggg

SEQ ID NO: 98108 - DNA, 22 bp, Homo sapiens
agggaagaaaatccatcgctgc

SEQ ID NO: 98109 - DNA, 22 bp, Homo sapiens
gggttggatcctggtggctgcc

SEQ ID NO: 98110 - DNA, 22 bp, Homo sapiens
ctgctgggatagaagtatctca

SEQ ID NO: 98111 - DNA, 22 bp, Homo sapiens
gttattgaggtggagtctcact

SEQ ID NO: 98112 - DNA, 22 bp, Homo sapiens
cccgtgggagagacacgcaccc

SEQ ID NO: 98113 - DNA, 22 bp, Homo sapiens
agctcaagctacacacagagtc

SEQ ID NO: 98114 - DNA, 22 bp, Homo sapiens
caggaaggggctcactctggcc

SEQ ID NO: 98115 - DNA, 22 bp, Homo sapiens
acatcctcccgatctactggct

SEQ ID NO: 98116 - DNA, 22 bp, Homo sapiens
caaagggaaaagccatgtgggc

SEQ ID NO: 98117 - DNA, 17 bp, Homo sapiens
ttcttttctgagccttg

SEQ ID NO: 98118 - DNA, 22 bp, Homo sapiens
ggggtggatttcaggcggtgtc

SEQ ID NO: 98119 - DNA, 22 bp, Homo sapiens
ggagttgattttggatatatta

SEQ ID NO: 98120 - DNA, 22 bp, Homo sapiens
atacacgtgccatgttggtgtg

SEQ ID NO: 98121 - DNA, 20 bp, Homo sapiens
ttgttagaggaatgccatag

SEQ ID NO: 98122 - DNA, 22 bp, Homo sapiens
catgcacttacctgaaattcaa

SEQ ID NO: 98123 - DNA, 22 bp, Homo sapiens
cctggggccccgagccagaagc

SEQ ID NO: 98124 - DNA, 22 bp, Homo sapiens
gcaggctgtctaaagttagagt

SEQ ID NO: 98125 - DNA, 22 bp, Homo sapiens
atggaccagagcctcattctgt

SEQ ID NO: 98126 - DNA, 22 bp, Homo sapiens
gcctggattccttgtttctcag

SEQ ID NO: 98127 - DNA, 22 bp, Homo sapiens
cagccctcctaccctgccaggc

SEQ ID NO: 98128 - DNA, 22 bp, Homo sapiens
caggctggagtgcagtggggcg

SEQ ID NO: 98129 - DNA, 22 bp, Homo sapiens
atatatttgagaatattcatga

SEQ ID NO: 98130 - DNA, 22 bp, Homo sapiens
ggccttggttccaaagcaggca

SEQ ID NO: 98131 - DNA, 22 bp, Homo sapiens
aggctgaggcaagaggatcact

SEQ ID NO: 98132 - DNA, 22 bp, Homo sapiens
agtgaggggcagctgagtgggc

SEQ ID NO: 98133 - DNA, 22 bp, Homo sapiens
ccaggtgtgctctgcagtggat

SEQ ID NO: 98134 - DNA, 22 bp, Homo sapiens
atacaaaatatatactggagac

SEQ ID NO: 98135 - DNA, 22 bp, Homo sapiens
gcagaggacacaggagggcaag

SEQ ID NO: 98136 - DNA, 22 bp, Homo sapiens
aggaccatcctaaggtaggcaa

SEQ ID NO: 98137 - DNA, 22 bp, Homo sapiens
ctccaggctcgtccaagatcga

SEQ ID NO: 98138 - DNA, 19 bp, Homo sapiens
ctgctgccggagactcgtc

SEQ ID NO: 98139 - DNA, 22 bp, Homo sapiens
gttttgaatactactagaactt

SEQ ID NO: 98140 - DNA, 22 bp, Homo sapiens
aaaactgaaatacgatccaatg

SEQ ID NO: 98141 - DNA, 21 bp, Homo sapiens
gctctgtgttacaagttgggg

SEQ ID NO: 98142 - DNA, 22 bp, Homo sapiens
agaagcagaaactgggcttgtg

SEQ ID NO: 98143 - DNA, 22 bp, Homo sapiens
gcaagacctatctagttgctgt

SEQ ID NO: 98144 - DNA, 22 bp, Homo sapiens
aggtggagaagagatgggcagt

SEQ ID NO: 98145 - DNA, 22 bp, Homo sapiens
cagagcccctcgtctccaccac

SEQ ID NO: 98146 - DNA, 22 bp, Homo sapiens
acaggggcaagggctcacggcc

SEQ ID NO: 98147 - DNA, 22 bp, Homo sapiens
ggctagggatctagaccaggac

SEQ ID NO: 98148 - DNA, 22 bp, Homo sapiens
gtggcttggaccagtcacagtg

SEQ ID NO: 98149 - DNA, 22 bp, Homo sapiens
gcttccggagccaaaaggcccc

SEQ ID NO: 98150 - DNA, 22 bp, Homo sapiens
gctggggaggcagcagagaaca

SEQ ID NO: 98151 - DNA, 20 bp, Homo sapiens
ggcctcggacttcatcgtag

SEQ ID NO: 98152 - DNA, 22 bp, Homo sapiens
ggggatggaggcgtgtggtcct

SEQ ID NO: 98153 - DNA, 22 bp, Homo sapiens
tgaacatgctgttgatggcctg

SEQ ID NO: 98154 - DNA, 22 bp, Homo sapiens
agcctgggccctgcctcttctc

SEQ ID NO: 98155 - DNA, 22 bp, Homo sapiens
tgcgccatgtgctctcggccct

SEQ ID NO: 98156 - DNA, 22 bp, Homo sapiens
ggccaggcgatgacccctccac

SEQ ID NO: 98157 - DNA, 22 bp, Homo sapiens
agcttggccagcagccgcgacg

SEQ ID NO: 98158 - DNA, 22 bp, Homo sapiens
gagaacagaagcattcctaatt

SEQ ID NO: 98159 - DNA, 22 bp, Homo sapiens
cagccacttgtgatgctgggga

SEQ ID NO: 98160 - DNA, 22 bp, Homo sapiens
acccgggaggcaggagtcatag

SEQ ID NO: 98161 - DNA, 19 bp, Homo sapiens
tcctggggaggggcatggc

SEQ ID NO: 98162 - DNA, 22 bp, Homo sapiens
gtcttgatctcctgaccttgtg

SEQ ID NO: 98163 - DNA, 22 bp, Homo sapiens
cctgcagacacttgtccagcaa

SEQ ID NO: 98164 - DNA, 22 bp, Homo sapiens
aacccgagggccccaggctcgg

SEQ ID NO: 98165 - DNA, 22 bp, Homo sapiens
ccctgggattcaatttcactct

SEQ ID NO: 98166 - DNA, 22 bp, Homo sapiens
gggcagagactcagaaacagaa

SEQ ID NO: 98167 - DNA, 22 bp, Homo sapiens
gagaaatatggctcagttccac

SEQ ID NO: 98168 - DNA, 22 bp, Homo sapiens
tgagccaggagtttgaggctgt

SEQ ID NO: 98169 - DNA, 22 bp, Homo sapiens
ctggctctcaggctggtcccca

SEQ ID NO: 98170 - DNA, 22 bp, Homo sapiens
gaggccactgtccctgccttcc

SEQ ID NO: 98171 - DNA, 22 bp, Homo sapiens
gcagatggatgtggacggcgcc

SEQ ID NO: 98172 - DNA, 22 bp, Homo sapiens
gggatgcagactacagggctta

SEQ ID NO: 98173 - DNA, 22 bp, Homo sapiens
agctcaatgcaacctccgcctc

SEQ ID NO: 98174 - DNA, 22 bp, Homo sapiens
tctcctggtacccttcctagca

SEQ ID NO: 98175 - DNA, 22 bp, Homo sapiens
ttggaaacgtcaccttttcctt

SEQ ID NO: 98176 - DNA, 22 bp, Homo sapiens
ggagtagctgcattccgagcac

SEQ ID NO: 98177 - DNA, 22 bp, Homo sapiens
acctttcagtgccctttctgtc

SEQ ID NO: 98178 - DNA, 22 bp, Homo sapiens
cgcagggccgcgagcgggacca

SEQ ID NO: 98179 - DNA, 22 bp, Homo sapiens
gcgccccatctacagtactttt

SEQ ID NO: 98180 - DNA, 18 bp, Homo sapiens
gcctggcttcggagccgc

SEQ ID NO: 98181 - DNA, 22 bp, Homo sapiens
gtcctgtgagattcatgctcaa

SEQ ID NO: 98182 - DNA, 23 bp, Homo sapiens
ttaaacactagttcgagtagcat

SEQ ID NO: 98183 - DNA, 22 bp, Homo sapiens
tgctccagcaccaagagctcca

SEQ ID NO: 98184 - DNA, 20 bp, Homo sapiens
agagtgagactccatctcag

SEQ ID NO: 98185 - DNA, 22 bp, Homo sapiens
cgtcctctagagggaagcactt

SEQ ID NO: 98186 - DNA, 22 bp, Homo sapiens
gggggagagacgagcggctctg

SEQ ID NO: 98187 - DNA, 22 bp, Homo sapiens
gggccctgggattcagagcaag

SEQ ID NO: 98188 - DNA, 22 bp, Homo sapiens
ctgaggctggagtgcagtggtg

SEQ ID NO: 98189 - DNA, 22 bp, Homo sapiens
ccaggctggagtgcaatggcgt

SEQ ID NO: 98190 - DNA, 22 bp, Homo sapiens
ggagggcagagtcccctgctga

SEQ ID NO: 98191 - DNA, 18 bp, Homo sapiens
tcaagccattctcctgcc

SEQ ID NO: 98192 - DNA, 22 bp, Homo sapiens
ctacaaaagtaattgtggtttt

SEQ ID NO: 98193 - DNA, 22 bp, Homo sapiens
gccactgagcccggccattgtt

SEQ ID NO: 98194 - DNA, 22 bp, Homo sapiens
ccgggcctcgggacaccgggta

SEQ ID NO: 98195 - DNA, 23 bp, Homo sapiens
cagtctgcagcccacttgggcag

SEQ ID NO: 98196 - DNA, 22 bp, Homo sapiens
cggaggttgaggctgcagtgag

SEQ ID NO: 98197 - DNA, 22 bp, Homo sapiens
gggtaaatctcttttcatggct

SEQ ID NO: 98198 - DNA, 22 bp, Homo sapiens
ttcatatttctttaaggacttt

SEQ ID NO: 98199 - DNA, 22 bp, Homo sapiens
tcctgggaggcggaggttgcag

SEQ ID NO: 98200 - DNA, 22 bp, Homo sapiens
tcaccaggctggagtgcagtgg

SEQ ID NO: 98201 - DNA, 21 bp, Homo sapiens
tgaaggggtggcagtgtgctt

SEQ ID NO: 98202 - DNA, 22 bp, Homo sapiens
caggtgagaggcggtcctgcat

SEQ ID NO: 98203 - DNA, 22 bp, Homo sapiens
gtttctctgtctgttacattgg

SEQ ID NO: 98204 - DNA, 23 bp, Homo sapiens
caggagatggctgctgtgtcagc

SEQ ID NO: 98205 - DNA, 22 bp, Homo sapiens
aggtggaaatggctttcctagg

SEQ ID NO: 98206 - DNA, 22 bp, Homo sapiens
gagagtctaggaacctcatata

SEQ ID NO: 98207 - DNA, 22 bp, Homo sapiens
ctccaggccatggctgcggagg

SEQ ID NO: 98208 - DNA, 19 bp, Homo sapiens
gcctcatttccacctcccc

SEQ ID NO: 98209 - DNA, 22 bp, Homo sapiens
agcattccacactgaagtctgc

SEQ ID NO: 98210 - DNA, 22 bp, Homo sapiens
aaaaatcacttttataggcagc

SEQ ID NO: 98211 - DNA, 22 bp, Homo sapiens
cccaggaattggaggctgcagt

SEQ ID NO: 98212 - DNA, 22 bp, Homo sapiens
tgcagcactgttcacaatagcc

SEQ ID NO: 98213 - DNA, 22 bp, Homo sapiens
agatggtagactatggaacgta

SEQ ID NO: 98214 - DNA, 22 bp, Homo sapiens
ggacattgaagctggaaaggga

SEQ ID NO: 98215 - DNA, 22 bp, Homo sapiens
ttcttctcagggtcccacatgg

SEQ ID NO: 98216 - DNA, 22 bp, Homo sapiens
gggagctgaaggagccggcggg

SEQ ID NO: 98217 - DNA, 22 bp, Homo sapiens
gcccgcgccagcctctccatct

SEQ ID NO: 98218 - DNA, 22 bp, Homo sapiens
tgtaagtagtaatggaaggaca

SEQ ID NO: 98219 - DNA, 22 bp, Homo sapiens
tggttcctcaagcgctggcggc

SEQ ID NO: 98220 - DNA, 22 bp, Homo sapiens
ttgcaattgctatggagagcgt

SEQ ID NO: 98221 - DNA, 22 bp, Homo sapiens
gagccaggaggcagagactgca

SEQ ID NO: 98222 - DNA, 22 bp, Homo sapiens
tgttgcccaggttctctcctgc

SEQ ID NO: 98223 - DNA, 22 bp, Homo sapiens
cagttccctccgccagcacttc

SEQ ID NO: 98224 - DNA, 22 bp, Homo sapiens
gggcggggggagctggaatgaa

SEQ ID NO: 98225 - DNA, 22 bp, Homo sapiens
ccaggaggtggagattgcagtg

SEQ ID NO: 98226 - DNA, 22 bp, Homo sapiens
ttacctaaaatagctcaattta

SEQ ID NO: 98227 - DNA, 22 bp, Homo sapiens
gccagcagcttcttctcatcct

SEQ ID NO: 98228 - DNA, 22 bp, Homo sapiens
gggaggcagtgctggaggctgg

SEQ ID NO: 98229 - DNA, 22 bp, Homo sapiens
tctgccttttactagctggatg

SEQ ID NO: 98230 - DNA, 22 bp, Homo sapiens
tggagccagagcgcagcctggg

SEQ ID NO: 98231 - DNA, 22 bp, Homo sapiens
tgatgaccgccaacgtttaggt

SEQ ID NO: 98232 - DNA, 22 bp, Homo sapiens
gggcgccgtgggaaacagccgg

SEQ ID NO: 98233 - DNA, 22 bp, Homo sapiens
ccagagtcccttgcagctcagt

SEQ ID NO: 98234 - DNA, 20 bp, Homo sapiens
gggcagagccagccagtccc

SEQ ID NO: 98235 - DNA, 22 bp, Homo sapiens
tgaaatgttaaacaagtggctc

SEQ ID NO: 98236 - DNA, 22 bp, Homo sapiens
tggtatgaccgtggtgcaagca

SEQ ID NO: 98237 - DNA, 22 bp, Homo sapiens
gaagatacaaatttcttagatg

SEQ ID NO: 98238 - DNA, 22 bp, Homo sapiens
ttgcagatgaagaaactgaagc

SEQ ID NO: 98239 - DNA, 22 bp, Homo sapiens
ttggatgagagggtgtggtaca

SEQ ID NO: 98240 - DNA, 22 bp, Homo sapiens
tgcctctgaggaagattgtgtt

SEQ ID NO: 98241 - DNA, 22 bp, Homo sapiens
ggaggagcatgagagggtagtg

SEQ ID NO: 98242 - DNA, 22 bp, Homo sapiens
agcctagggttctgatgtcact

SEQ ID NO: 98243 - DNA, 21 bp, Homo sapiens
gggcctggctgcgcaggacgg

SEQ ID NO: 98244 - DNA, 22 bp, Homo sapiens
aagccgggcctgagaaatgaca

SEQ ID NO: 98245 - DNA, 22 bp, Homo sapiens
aactcactttgtggcttctgaa

SEQ ID NO: 98246 - DNA, 22 bp, Homo sapiens
aaggagaaatggtagatgtgca

SEQ ID NO: 98247 - DNA, 22 bp, Homo sapiens
ggggtctgggcttagctggaat

SEQ ID NO: 98248 - DNA, 20 bp, Homo sapiens
atcctctcctgattaattca

SEQ ID NO: 98249 - DNA, 22 bp, Homo sapiens
ggctcactgcaacctctgcctc

SEQ ID NO: 98250 - DNA, 22 bp, Homo sapiens
tcttcctgtcaatgagaattaa

SEQ ID NO: 98251 - DNA, 22 bp, Homo sapiens
cgccaggcttggtagctcatgc

SEQ ID NO: 98252 - DNA, 17 bp, Homo sapiens
ttaaggtggatcagcac

SEQ ID NO: 98253 - DNA, 22 bp, Homo sapiens
gagtggggggtccgtctcagtg

SEQ ID NO: 98254 - DNA, 22 bp, Homo sapiens
accactgcccatggtgaaaact

SEQ ID NO: 98255 - DNA, 21 bp, Homo sapiens
aaactgaccttgcctgagaca

SEQ ID NO: 98256 - DNA, 20 bp, Homo sapiens
cttctggctggtcaaggact

SEQ ID NO: 98257 - DNA, 22 bp, Homo sapiens
gggcagcagccactcatttagc

SEQ ID NO: 98258 - DNA, 22 bp, Homo sapiens
cagccccacacggtctagctct

SEQ ID NO: 98259 - DNA, 22 bp, Homo sapiens
ttccagttcactccatttctgg

SEQ ID NO: 98260 - DNA, 22 bp, Homo sapiens
gagctgggcctgcgagtgctgc

SEQ ID NO: 98261 - DNA, 22 bp, Homo sapiens
gcttggccagcagccgggatgc

SEQ ID NO: 98262 - DNA, 22 bp, Homo sapiens
cccagttgttgccggctctgga

SEQ ID NO: 98263 - DNA, 22 bp, Homo sapiens
cctgggaatcggtgcgttgagg

SEQ ID NO: 98264 - DNA, 22 bp, Homo sapiens
ctggcctcggcagcaggaacag

SEQ ID NO: 98265 - DNA, 22 bp, Homo sapiens
cggggccctggggctgaaggtc

SEQ ID NO: 98266 - DNA, 22 bp, Homo sapiens
gaaggaccctctggggtctcag

SEQ ID NO: 98267 - DNA, 22 bp, Homo sapiens
acccccaagaggggccttcagc

SEQ ID NO: 98268 - DNA, 22 bp, Homo sapiens
cgcaccactgaattccagcctg

SEQ ID NO: 98269 - DNA, 22 bp, Homo sapiens
aggccagcctcaggcagggacc

SEQ ID NO: 98270 - DNA, 22 bp, Homo sapiens
agacgctattttgaggggtcta

SEQ ID NO: 98271 - DNA, 22 bp, Homo sapiens
ggtgcagaggagccagctgggg

SEQ ID NO: 98272 - DNA, 22 bp, Homo sapiens
tgcgatggcgtagacaaatccc

SEQ ID NO: 98273 - DNA, 22 bp, Homo sapiens
actgggaagtcagagagaggct

SEQ ID NO: 98274 - DNA, 22 bp, Homo sapiens
gctggagaggatcccaaagcca

SEQ ID NO: 98275 - DNA, 22 bp, Homo sapiens
aagaagcaggtcacagacaggg

SEQ ID NO: 98276 - DNA, 22 bp, Homo sapiens
ccctggctgataccggaaaggc

SEQ ID NO: 98277 - DNA, 22 bp, Homo sapiens
agccccttgtgggcgcacagca

SEQ ID NO: 98278 - DNA, 22 bp, Homo sapiens
gggcagagagctggaactcctt

SEQ ID NO: 98279 - DNA, 22 bp, Homo sapiens
aatgtgaggccttggtagttat

SEQ ID NO: 98280 - DNA, 18 bp, Homo sapiens
tttctcagactctctttc

SEQ ID NO: 98281 - DNA, 22 bp, Homo sapiens
gtctccccagggccctcttcat

SEQ ID NO: 98282 - DNA, 22 bp, Homo sapiens
ttcacagcttaataaggctcag

SEQ ID NO: 98283 - DNA, 22 bp, Homo sapiens
tgatgggaggtgctgcaggacc

SEQ ID NO: 98284 - DNA, 22 bp, Homo sapiens
tgcaaaggtttgtgcttggaaa

SEQ ID NO: 98285 - DNA, 22 bp, Homo sapiens
aataaaatggtcagttttctca

SEQ ID NO: 98286 - DNA, 22 bp, Homo sapiens
aggcgcctgcgggatccttgcc

SEQ ID NO: 98287 - DNA, 22 bp, Homo sapiens
cctcgtccacaatccttgcaca

SEQ ID NO: 98288 - DNA, 22 bp, Homo sapiens
tcacaacgcctctgcaaatcct

SEQ ID NO: 98289 - DNA, 22 bp, Homo sapiens
tcaccaggctagagtgcagtgg

SEQ ID NO: 98290 - DNA, 20 bp, Homo sapiens
tcagccattccttacctttc

SEQ ID NO: 98291 - DNA, 22 bp, Homo sapiens
acccaggctggcgtgcagtggc

SEQ ID NO: 98292 - DNA, 22 bp, Homo sapiens
tcaccagatctctctgtaatgg

SEQ ID NO: 98293 - DNA, 19 bp, Homo sapiens
ggtatatgggcctcacttg

SEQ ID NO: 98294 - DNA, 22 bp, Homo sapiens
cctggagagctcgggccaggca

SEQ ID NO: 98295 - DNA, 22 bp, Homo sapiens
gaatgcagatggctggtgtatg

SEQ ID NO: 98296 - DNA, 22 bp, Homo sapiens
cctggggtcacttgcagccgca

SEQ ID NO: 98297 - DNA, 22 bp, Homo sapiens
gatgaaggggctggtgccctct

SEQ ID NO: 98298 - DNA, 22 bp, Homo sapiens
ggtcaggagcccttggccccct

SEQ ID NO: 98299 - DNA, 22 bp, Homo sapiens
tgtacacatggtgtacactccc

SEQ ID NO: 98300 - DNA, 22 bp, Homo sapiens
tggaatggaaacaaactgagga

SEQ ID NO: 98301 - DNA, 22 bp, Homo sapiens
tcccacacagcccgctcaccgg

SEQ ID NO: 98302 - DNA, 22 bp, Homo sapiens
tcccccaggctggagtgcagtg

SEQ ID NO: 98303 - DNA, 22 bp, Homo sapiens
gcttctgagttcttgcttaata

SEQ ID NO: 98304 - DNA, 22 bp, Homo sapiens
gtggatggccctgcacacaggt

SEQ ID NO: 98305 - DNA, 22 bp, Homo sapiens
ctgggaggcggaggttgcagtg

SEQ ID NO: 98306 - DNA, 22 bp, Homo sapiens
attataggcttgagccaccgtg

SEQ ID NO: 98307 - DNA, 22 bp, Homo sapiens
aatggctctgatgttgttgtga

SEQ ID NO: 98308 - DNA, 22 bp, Homo sapiens
tgccgtggggctgaggctggag

SEQ ID NO: 98309 - DNA, 22 bp, Homo sapiens
ggtccccccatggtgagcactg

SEQ ID NO: 98310 - DNA, 22 bp, Homo sapiens
cagtcactggaatagctgagga

SEQ ID NO: 98311 - DNA, 22 bp, Homo sapiens
cagggtgctgcaccatccctca

SEQ ID NO: 98312 - DNA, 22 bp, Homo sapiens
agacagggtgatcgcttgagcc

SEQ ID NO: 98313 - DNA, 22 bp, Homo sapiens
acagcagcaatagcagtgacat

SEQ ID NO: 98314 - DNA, 22 bp, Homo sapiens
ttttctaacatctagtaatttg

SEQ ID NO: 98315 - DNA, 19 bp, Homo sapiens
gagaaagcaggcacagcac

SEQ ID NO: 98316 - DNA, 22 bp, Homo sapiens
cgtgtggtcccggcaaggcaag

SEQ ID NO: 98317 - DNA, 18 bp, Homo sapiens
tgtagagccaggtttgcc

SEQ ID NO: 98318 - DNA, 19 bp, Homo sapiens
gccttcccaccacccgtcc

SEQ ID NO: 98319 - DNA, 22 bp, Homo sapiens
attgattttcagactatgcgag

SEQ ID NO: 98320 - DNA, 22 bp, Homo sapiens
tgagtgtggggaatgtcatgag

SEQ ID NO: 98321 - DNA, 21 bp, Homo sapiens
gggcagaggggcctcctgggt

SEQ ID NO: 98322 - DNA, 22 bp, Homo sapiens
actgttttctgtaaagggccag

SEQ ID NO: 98323 - DNA, 22 bp, Homo sapiens
gctcactgcaagctctgcctcc

SEQ ID NO: 98324 - DNA, 22 bp, Homo sapiens
cagagggttgatgtgaggctta

SEQ ID NO: 98325 - DNA, 16 bp, Homo sapiens
gcagaggaaaggggag

SEQ ID NO: 98326 - DNA, 22 bp, Homo sapiens
tgcgcctctaatctcgggcgtc

SEQ ID NO: 98327 - DNA, 22 bp, Homo sapiens
ccaggctggagtgcaatggcat

SEQ ID NO: 98328 - DNA, 22 bp, Homo sapiens
ggcatggacgtctctgaggcca

SEQ ID NO: 98329 - DNA, 22 bp, Homo sapiens
aaagaaggtagggctggtgact

SEQ ID NO: 98330 - DNA, 22 bp, Homo sapiens
tgtgactgaggctccaagctag

SEQ ID NO: 98331 - DNA, 22 bp, Homo sapiens
gttttagataaagctgtccttg

SEQ ID NO: 98332 - DNA, 22 bp, Homo sapiens
ctgcaagctacccctagcatca

SEQ ID NO: 98333 - DNA, 22 bp, Homo sapiens
gggttggcatcagggttctgtg

SEQ ID NO: 98334 - DNA, 22 bp, Homo sapiens
agaaggggcccaaggatgtcag

SEQ ID NO: 98335 - DNA, 22 bp, Homo sapiens
agtggccagcagcctagcctag

SEQ ID NO: 98336 - DNA, 22 bp, Homo sapiens
agcttgtgtttttctaagtatc

SEQ ID NO: 98337 - DNA, 18 bp, Homo sapiens
actctttctgcccacagg

SEQ ID NO: 98338 - DNA, 22 bp, Homo sapiens
gggagctggagctggaagactc

SEQ ID NO: 98339 - DNA, 22 bp, Homo sapiens
tgaggatgtctgtattttgcct

SEQ ID NO: 98340 - DNA, 22 bp, Homo sapiens
tgtgtgattgcaggagatgtgg

SEQ ID NO: 98341 - DNA, 20 bp, Homo sapiens
ataaaataactgccacaaga

SEQ ID NO: 98342 - DNA, 22 bp, Homo sapiens
tcggagctgtagatgaaaccct

SEQ ID NO: 98343 - DNA, 19 bp, Homo sapiens
taggaccctggtggccccc

SEQ ID NO: 98344 - DNA, 18 bp, Homo sapiens
gcagtgaagaaagagctt

SEQ ID NO: 98345 - DNA, 22 bp, Homo sapiens
tgtacttgaacttgactgtaga

SEQ ID NO: 98346 - DNA, 22 bp, Homo sapiens
aacagcgacgtcctccccaaca

SEQ ID NO: 98347 - DNA, 22 bp, Homo sapiens
tcagtgccatgggcagacaggc

SEQ ID NO: 98348 - DNA, 22 bp, Homo sapiens
gaaacactcaatttagtaattc

SEQ ID NO: 98349 - DNA, 22 bp, Homo sapiens
cccacaggtgtgagcttgctgg

SEQ ID NO: 98350 - DNA, 22 bp, Homo sapiens
gggttgaggcggatgtcggcgg

SEQ ID NO: 98351 - DNA, 22 bp, Homo sapiens
tgagatgtaaggtatgcttact

SEQ ID NO: 98352 - DNA, 20 bp, Homo sapiens
tatttctgggcaaccattta

SEQ ID NO: 98353 - DNA, 22 bp, Homo sapiens
actccacaccacgggggccgcc

SEQ ID NO: 98354 - DNA, 22 bp, Homo sapiens
gctgcagggagctggaaggctc

SEQ ID NO: 98355 - DNA, 22 bp, Homo sapiens
tggagacacaggaccagactgc

SEQ ID NO: 98356 - DNA, 22 bp, Homo sapiens
gggggaagaaagaacatggcat

SEQ ID NO: 98357 - DNA, 22 bp, Homo sapiens
cagcagcattgctctggattcc

SEQ ID NO: 98358 - DNA, 22 bp, Homo sapiens
gctgtggcctggcgcagagctg

SEQ ID NO: 98359 - DNA, 22 bp, Homo sapiens
cctgtgcttggccagagaggtt

SEQ ID NO: 98360 - DNA, 22 bp, Homo sapiens
ctcccagccttcgccagtctga

SEQ ID NO: 98361 - DNA, 22 bp, Homo sapiens
ttatttttaaaagttcacacag

SEQ ID NO: 98362 - DNA, 22 bp, Homo sapiens
gcaccaggtgcagccgggcccc

SEQ ID NO: 98363 - DNA, 22 bp, Homo sapiens
ggctgggcaggtctgcacaggg

SEQ ID NO: 98364 - DNA, 22 bp, Homo sapiens
tggccaccaccaatacttgcct

SEQ ID NO: 98365 - DNA, 22 bp, Homo sapiens
ttacactttaaatccagcttgt

SEQ ID NO: 98366 - DNA, 22 bp, Homo sapiens
tgaagaaacgcagagaggtagg

SEQ ID NO: 98367 - DNA, 22 bp, Homo sapiens
acccaggccattggcaagagtc

SEQ ID NO: 98368 - DNA, 22 bp, Homo sapiens
ttcttctttccaattacatggt

SEQ ID NO: 98369 - DNA, 22 bp, Homo sapiens
cctgggaggctgaggctgcagt

SEQ ID NO: 98370 - DNA, 22 bp, Homo sapiens
cccaggccctggcagagcttgt

SEQ ID NO: 98371 - DNA, 22 bp, Homo sapiens
tccctgcaggtgtgcaagctga

SEQ ID NO: 98372 - DNA, 22 bp, Homo sapiens
ggtcccaggttgacagggagac

SEQ ID NO: 98373 - DNA, 22 bp, Homo sapiens
cactgcactccagcactccagc

SEQ ID NO: 98374 - DNA, 22 bp, Homo sapiens
gcgtggcttagagtggggtacc

SEQ ID NO: 98375 - DNA, 22 bp, Homo sapiens
ttgtgggatctccctgttgctc

SEQ ID NO: 98376 - DNA, 22 bp, Homo sapiens
gggaggttctgttcgcacttga

SEQ ID NO: 98377 - DNA, 22 bp, Homo sapiens
ttggccatctaagcccagccac

SEQ ID NO: 98378 - DNA, 22 bp, Homo sapiens
gttggacagtttgggaagggag

SEQ ID NO: 98379 - DNA, 22 bp, Homo sapiens
atcttcccaggctggggagagg

SEQ ID NO: 98380 - DNA, 22 bp, Homo sapiens
tctcccctggtctcgcgcgctg

SEQ ID NO: 98381 - DNA, 22 bp, Homo sapiens
cctgcctactgagttttatatt

SEQ ID NO: 98382 - DNA, 22 bp, Homo sapiens
ttctccacccactcttttgttg

SEQ ID NO: 98383 - DNA, 22 bp, Homo sapiens
gaggtaggtgtaggaggcctgc

SEQ ID NO: 98384 - DNA, 22 bp, Homo sapiens
cagggcctcctaaggcatctaa

SEQ ID NO: 98385 - DNA, 22 bp, Homo sapiens
agcgccactgcactccagcctg

SEQ ID NO: 98386 - DNA, 22 bp, Homo sapiens
ttgtggttaaccgcacattttt

SEQ ID NO: 98387 - DNA, 22 bp, Homo sapiens
tggcctcggcatccagcaagag

SEQ ID NO: 98388 - DNA, 22 bp, Homo sapiens
caggaaggcgcggctgtgcctg

SEQ ID NO: 98389 - DNA, 22 bp, Homo sapiens
caattgacaatgacagtgtcaa

SEQ ID NO: 98390 - DNA, 22 bp, Homo sapiens
tcactcaggctggagtgcagtg

SEQ ID NO: 98391 - DNA, 22 bp, Homo sapiens
gctggaggatggactggaagaa

SEQ ID NO: 98392 - DNA, 22 bp, Homo sapiens
tttggaaatgaccccgtctaag

SEQ ID NO: 98393 - DNA, 22 bp, Homo sapiens
acagcccagctctttctctgca

SEQ ID NO: 98394 - DNA, 22 bp, Homo sapiens
ggcgctcagtgttgccccagag

SEQ ID NO: 98395 - DNA, 22 bp, Homo sapiens
ttttggttgttgggtaagagta

SEQ ID NO: 98396 - DNA, 22 bp, Homo sapiens
cgggagcctctgggtcacactg

SEQ ID NO: 98397 - DNA, 22 bp, Homo sapiens
acagagcaatgcgtgttctcta

SEQ ID NO: 98398 - DNA, 22 bp, Homo sapiens
cgctccttgagcgtgtcggcct

SEQ ID NO: 98399 - DNA, 22 bp, Homo sapiens
acaattctgatggtttcccagt

SEQ ID NO: 98400 - DNA, 22 bp, Homo sapiens
tcctgagataaatctcatgtga

SEQ ID NO: 98401 - DNA, 21 bp, Homo sapiens
tccctgagcccaaggggctcc

SEQ ID NO: 98402 - DNA, 22 bp, Homo sapiens
ggaactgaggaacgaactggga

SEQ ID NO: 98403 - DNA, 22 bp, Homo sapiens
gccattgcactccagcctaggc

SEQ ID NO: 98404 - DNA, 22 bp, Homo sapiens
atgagttgaagctacaagaggc

SEQ ID NO: 98405 - DNA, 22 bp, Homo sapiens
taacatttaaatttttcacata

SEQ ID NO: 98406 - DNA, 22 bp, Homo sapiens
gcaggagaacaaagcaagctgc

SEQ ID NO: 98407 - DNA, 22 bp, Homo sapiens
tcctcagcttttatttcacttg

SEQ ID NO: 98408 - DNA, 18 bp, Homo sapiens
agagtatacagacaacaa

SEQ ID NO: 98409 - DNA, 20 bp, Homo sapiens
gccactgggcaccagcaggg

SEQ ID NO: 98410 - DNA, 22 bp, Homo sapiens
tcttcctggatgggggttgatg

SEQ ID NO: 98411 - DNA, 22 bp, Homo sapiens
tctgcaggtaagcgttcttgga

SEQ ID NO: 98412 - DNA, 22 bp, Homo sapiens
gtctctatcatagctgaaccct

SEQ ID NO: 98413 - DNA, 22 bp, Homo sapiens
gggagtgggtttggcctaggcc

SEQ ID NO: 98414 - DNA, 22 bp, Homo sapiens
agaggcaggaggttgacttgag

SEQ ID NO: 98415 - DNA, 23 bp, Homo sapiens
tcaactgctctgggaaggtcccc

SEQ ID NO: 98416 - DNA, 22 bp, Homo sapiens
accgggctaatttttgtatctt

SEQ ID NO: 98417 - DNA, 22 bp, Homo sapiens
cctcccctcagacagagactgg

SEQ ID NO: 98418 - DNA, 22 bp, Homo sapiens
tcagggattgcaaaattcatcc

SEQ ID NO: 98419 - DNA, 22 bp, Homo sapiens
atagagtgatgtaaggtatgtg

SEQ ID NO: 98420 - DNA, 22 bp, Homo sapiens
atgaaatatcttgaagaaattc

SEQ ID NO: 98421 - DNA, 22 bp, Homo sapiens
tttgagaagcatggctgtattc

SEQ ID NO: 98422 - DNA, 22 bp, Homo sapiens
ttgtctaatgagctccacttca

SEQ ID NO: 98423 - DNA, 22 bp, Homo sapiens
gtgggccactgggaggcaaggg

SEQ ID NO: 98424 - DNA, 22 bp, Homo sapiens
ctctggcaattgctgctgactc

SEQ ID NO: 98425 - DNA, 22 bp, Homo sapiens
ccaggctgctgttggtgtccgc

SEQ ID NO: 98426 - DNA, 22 bp, Homo sapiens
gcccagcacctctctcagggtt

SEQ ID NO: 98427 - DNA, 22 bp, Homo sapiens
ttccacattccttacattcata

SEQ ID NO: 98428 - DNA, 22 bp, Homo sapiens
attaagtgactaaagtaatgct

SEQ ID NO: 98429 - DNA, 22 bp, Homo sapiens
cccgggttgtccgcgcgtccgg

SEQ ID NO: 98430 - DNA, 22 bp, Homo sapiens
ggttccccaggcggcccttgga

SEQ ID NO: 98431 - DNA, 22 bp, Homo sapiens
gtaatctcagctacttgggagg

SEQ ID NO: 98432 - DNA, 22 bp, Homo sapiens
gctgacccctacaggttgtgtt

SEQ ID NO: 98433 - DNA, 22 bp, Homo sapiens
ggctgcaggttggttggcagct

SEQ ID NO: 98434 - DNA, 22 bp, Homo sapiens
agagtggagagaaacaactctg

SEQ ID NO: 98435 - DNA, 22 bp, Homo sapiens
tctgttgcaatgtgcatggtga

SEQ ID NO: 98436 - DNA, 22 bp, Homo sapiens
agaggaagtaatcaggacctgc

SEQ ID NO: 98437 - DNA, 22 bp, Homo sapiens
gtgctgacaggagcctggcggt

SEQ ID NO: 98438 - DNA, 22 bp, Homo sapiens
atgccaggaacaaacagtggtg

SEQ ID NO: 98439 - DNA, 22 bp, Homo sapiens
ggcttggaccagtcacagtggt

SEQ ID NO: 98440 - DNA, 22 bp, Homo sapiens
gagggagggactagcattctct

SEQ ID NO: 98441 - DNA, 22 bp, Homo sapiens
gggaagtgatggagccaggatt

SEQ ID NO: 98442 - DNA, 22 bp, Homo sapiens
aaggggtgagcagaggcttcgc

SEQ ID NO: 98443 - DNA, 22 bp, Homo sapiens
gattgagtctgaggatgctgca

SEQ ID NO: 98444 - DNA, 22 bp, Homo sapiens
ctgggagtggtgacagctctcg

SEQ ID NO: 98445 - DNA, 22 bp, Homo sapiens
ggctgggctccgggagcatgcg

SEQ ID NO: 98446 - DNA, 21 bp, Homo sapiens
tggcggggacttgtggctgcc

SEQ ID NO: 98447 - DNA, 22 bp, Homo sapiens
tggggcagttaataaacattct

SEQ ID NO: 98448 - DNA, 22 bp, Homo sapiens
ccctgccttgtctgggctaggt

SEQ ID NO: 98449 - DNA, 22 bp, Homo sapiens
aagcatttcaggtagagatatt

SEQ ID NO: 98450 - DNA, 22 bp, Homo sapiens
gagccaggttggaggctgcagt

SEQ ID NO: 98451 - DNA, 22 bp, Homo sapiens
gtgtgggctgcagaggcacagc

SEQ ID NO: 98452 - DNA, 22 bp, Homo sapiens
tgggactcactcttttggccag

SEQ ID NO: 98453 - DNA, 20 bp, Homo sapiens
atcggcttgcctggaaacaa

SEQ ID NO: 98454 - DNA, 22 bp, Homo sapiens
cttcctctgtggccagagtgta

SEQ ID NO: 98455 - DNA, 22 bp, Homo sapiens
cattctgcgatcctcaagcaca

SEQ ID NO: 98456 - DNA, 22 bp, Homo sapiens
tgggaaggggagctggaaagga

SEQ ID NO: 98457 - DNA, 22 bp, Homo sapiens
tcgcaccattgcactccagcca

SEQ ID NO: 98458 - DNA, 22 bp, Homo sapiens
gaggcagaagttgcagtgagca

SEQ ID NO: 98459 - DNA, 22 bp, Homo sapiens
cttgatgagtcagaactgaagg

SEQ ID NO: 98460 - DNA, 22 bp, Homo sapiens
tgggaagctgcattttaacaag

SEQ ID NO: 98461 - DNA, 19 bp, Homo sapiens
gctggatggatcctggagt

SEQ ID NO: 98462 - DNA, 22 bp, Homo sapiens
tatccaattcaccattgatggg

SEQ ID NO: 98463 - DNA, 22 bp, Homo sapiens
aaagaaatagatggcatttaaa

SEQ ID NO: 98464 - DNA, 22 bp, Homo sapiens
ggttggacactaggtaggagcg

SEQ ID NO: 98465 - DNA, 22 bp, Homo sapiens
ccctcaggtgaaaggaaaaatt

SEQ ID NO: 98466 - DNA, 22 bp, Homo sapiens
ccttctcagccccagctcccgc

SEQ ID NO: 98467 - DNA, 22 bp, Homo sapiens
ggaggcggaggctgcagtgagc

SEQ ID NO: 98468 - DNA, 22 bp, Homo sapiens
gatagtcacctcccttaacttt

SEQ ID NO: 98469 - DNA, 22 bp, Homo sapiens
gcccagtggtaaaagcaggcct

SEQ ID NO: 98470 - DNA, 22 bp, Homo sapiens
cccccaaagtttgcacggataa

SEQ ID NO: 98471 - DNA, 22 bp, Homo sapiens
gcaggcagatcacctgtcagga

SEQ ID NO: 98472 - DNA, 22 bp, Homo sapiens
ttccatttggcacttcactgag

SEQ ID NO: 98473 - DNA, 22 bp, Homo sapiens
tctggtgtcagtattctttgaa

SEQ ID NO: 98474 - DNA, 22 bp, Homo sapiens
ctctgcctgtctcatcctgcaa

SEQ ID NO: 98475 - DNA, 22 bp, Homo sapiens
agatttatgtggtcacactcag

SEQ ID NO: 98476 - DNA, 22 bp, Homo sapiens
ctagttctagatccctgaggaa

SEQ ID NO: 98477 - DNA, 22 bp, Homo sapiens
ggcagacctctccagccccaca

SEQ ID NO: 98478 - DNA, 22 bp, Homo sapiens
ccagcccgaatccctggccagg

SEQ ID NO: 98479 - DNA, 22 bp, Homo sapiens
tcccttatctggtattttttag

SEQ ID NO: 98480 - DNA, 23 bp, Homo sapiens
ccagtgattgcctggaaggaggt

SEQ ID NO: 98481 - DNA, 22 bp, Homo sapiens
gagcccgagcgcgtacccggcg

SEQ ID NO: 98482 - DNA, 22 bp, Homo sapiens
cattcattacactcataaggtt

SEQ ID NO: 98483 - DNA, 22 bp, Homo sapiens
tagccgggtgttgtgtcatgca

SEQ ID NO: 98484 - DNA, 22 bp, Homo sapiens
gctggcagacttcctctggaac

SEQ ID NO: 98485 - DNA, 22 bp, Homo sapiens
ggcaggaggtgagtggcgggtg

SEQ ID NO: 98486 - DNA, 22 bp, Homo sapiens
gagccaggggtcagctccgagg

SEQ ID NO: 98487 - DNA, 22 bp, Homo sapiens
gggctgagacgatggggtcttc

SEQ ID NO: 98488 - DNA, 22 bp, Homo sapiens
taagaaatttagttatagaatg

SEQ ID NO: 98489 - DNA, 22 bp, Homo sapiens
ttccactctacacactgctggc

SEQ ID NO: 98490 - DNA, 22 bp, Homo sapiens
tacagctgcaagggtttctggg

SEQ ID NO: 98491 - DNA, 22 bp, Homo sapiens
attgctaggaacaggttgcacc

SEQ ID NO: 98492 - DNA, 22 bp, Homo sapiens
cccatgcaccctctaagaagga

SEQ ID NO: 98493 - DNA, 22 bp, Homo sapiens
attcacagggggagaagggtat

SEQ ID NO: 98494 - DNA, 22 bp, Homo sapiens
tgttgattagtgtttagactta

SEQ ID NO: 98495 - DNA, 22 bp, Homo sapiens
gaaaggagagggttaaggagct

SEQ ID NO: 98496 - DNA, 22 bp, Homo sapiens
aaaaaattatcatagttcctga

SEQ ID NO: 98497 - DNA, 22 bp, Homo sapiens
cctactctgagcgcctccgcat

SEQ ID NO: 98498 - DNA, 22 bp, Homo sapiens
cagccccatggtgtgctccagc

SEQ ID NO: 98499 - DNA, 22 bp, Homo sapiens
ggactgggaatcagggagatgc

SEQ ID NO: 98500 - DNA, 22 bp, Homo sapiens
cctcttctaggacgtccttgtg

SEQ ID NO: 98501 - DNA, 22 bp, Homo sapiens
gagagtctagtgcacctagttt

SEQ ID NO: 98502 - DNA, 22 bp, Homo sapiens
aatgttgcagagtgattgtcca

SEQ ID NO: 98503 - DNA, 22 bp, Homo sapiens
ctgggaggcggagcttgcagtg

SEQ ID NO: 98504 - DNA, 22 bp, Homo sapiens
atcaacatgtcataaagtgaaa

SEQ ID NO: 98505 - DNA, 22 bp, Homo sapiens
ttgtgaaacattcatggatttg

SEQ ID NO: 98506 - DNA, 22 bp, Homo sapiens
actcatgtcctaggagtaaagc

SEQ ID NO: 98507 - DNA, 22 bp, Homo sapiens
tgtcttcgctacaatgaaaagg

SEQ ID NO: 98508 - DNA, 22 bp, Homo sapiens
ccagaagcagagcctgaggcag

SEQ ID NO: 98509 - DNA, 22 bp, Homo sapiens
ggaggtggagctggaagttcca

SEQ ID NO: 98510 - DNA, 22 bp, Homo sapiens
aatggccagacagatggctgct

SEQ ID NO: 98511 - DNA, 22 bp, Homo sapiens
aatgtgagccaatgcccgtggg

SEQ ID NO: 98512 - DNA, 22 bp, Homo sapiens
aaagtgctgggattacaagcgt

SEQ ID NO: 98513 - DNA, 21 bp, Homo sapiens
gctcctggtgctgcgtggcgc

SEQ ID NO: 98514 - DNA, 22 bp, Homo sapiens
atacttctttagcatattgaac

SEQ ID NO: 98515 - DNA, 22 bp, Homo sapiens
atgtacataaaatgtataatga

SEQ ID NO: 98516 - DNA, 22 bp, Homo sapiens
agggccagcactcctggcagga

SEQ ID NO: 98517 - DNA, 22 bp, Homo sapiens
ccaggcaggcgatggtgcagtg

SEQ ID NO: 98518 - DNA, 22 bp, Homo sapiens
ggctgggcctctccctcagctg

SEQ ID NO: 98519 - DNA, 22 bp, Homo sapiens
tcaatcacgtgttccatgttct

SEQ ID NO: 98520 - DNA, 19 bp, Homo sapiens
acacagggatcagagggtt

SEQ ID NO: 98521 - DNA, 18 bp, Homo sapiens
ccatcaccctaactagtg

SEQ ID NO: 98522 - DNA, 22 bp, Homo sapiens
tggagggcatgctgtccatggg

SEQ ID NO: 98523 - DNA, 22 bp, Homo sapiens
atggggggatgaaggagtccaa

SEQ ID NO: 98524 - DNA, 22 bp, Homo sapiens
tctctggactcgagcttactca

SEQ ID NO: 98525 - DNA, 22 bp, Homo sapiens
tagcatgtcagtcgccacacgt

SEQ ID NO: 98526 - DNA, 22 bp, Homo sapiens
gtgttgatgacattttagaaac

SEQ ID NO: 98527 - DNA, 22 bp, Homo sapiens
ggagtgaagtggcgcgatctcg

SEQ ID NO: 98528 - DNA, 22 bp, Homo sapiens
ggctccaccctgcttccagaag

SEQ ID NO: 98529 - DNA, 22 bp, Homo sapiens
tagtatagattgaagcagatca

SEQ ID NO: 98530 - DNA, 21 bp, Homo sapiens
acacaggcagtgtcccgaggt

SEQ ID NO: 98531 - DNA, 22 bp, Homo sapiens
cggggacacactggcagctcct

SEQ ID NO: 98532 - DNA, 20 bp, Homo sapiens
aggccccaggtggacactag

SEQ ID NO: 98533 - DNA, 22 bp, Homo sapiens
tcctcctgtctaccagttcctg

SEQ ID NO: 98534 - DNA, 22 bp, Homo sapiens
agtccgtggccagactcaagag

SEQ ID NO: 98535 - DNA, 22 bp, Homo sapiens
gggacctcgcatgcacgaagcc

SEQ ID NO: 98536 - DNA, 22 bp, Homo sapiens
gcaccgccttggaccgcccgct

SEQ ID NO: 98537 - DNA, 22 bp, Homo sapiens
atgccacttcattccagcctcg

SEQ ID NO: 98538 - DNA, 19 bp, Homo sapiens
ccagagagctaggtacaga

SEQ ID NO: 98539 - DNA, 22 bp, Homo sapiens
tggagaagattggtcaccattc

SEQ ID NO: 98540 - DNA, 22 bp, Homo sapiens
tctgcaggaagctggcggctga

SEQ ID NO: 98541 - DNA, 22 bp, Homo sapiens
tgggcaggggccctgcttccgt

SEQ ID NO: 98542 - DNA, 22 bp, Homo sapiens
tgtggacgtcattaaagcagtg

SEQ ID NO: 98543 - DNA, 22 bp, Homo sapiens
gggcactcctctggtccagccc

SEQ ID NO: 98544 - DNA, 22 bp, Homo sapiens
tgaaatgattatatggtgtttg

SEQ ID NO: 98545 - DNA, 22 bp, Homo sapiens
atattacacacggtatcacggg

SEQ ID NO: 98546 - DNA, 19 bp, Homo sapiens
gcataaatacactattgtc

SEQ ID NO: 98547 - DNA, 22 bp, Homo sapiens
tttgaagactactgggagtgaa

SEQ ID NO: 98548 - DNA, 22 bp, Homo sapiens
ctcattccatgtgtattttgag

SEQ ID NO: 98549 - DNA, 22 bp, Homo sapiens
actgggcctacccagattggca

SEQ ID NO: 98550 - DNA, 22 bp, Homo sapiens
gctgatagactgaatgttggga

SEQ ID NO: 98551 - DNA, 22 bp, Homo sapiens
cccaggaagtggaggttgcagt

SEQ ID NO: 98552 - DNA, 22 bp, Homo sapiens
tggcactgagcagccgcggcag

SEQ ID NO: 98553 - DNA, 22 bp, Homo sapiens
ctgcagggagaggggacagcct

SEQ ID NO: 98554 - DNA, 22 bp, Homo sapiens
aggaaaacagaccaaggagctc

SEQ ID NO: 98555 - DNA, 22 bp, Homo sapiens
gcagaagcacaggtgacgggcc

SEQ ID NO: 98556 - DNA, 22 bp, Homo sapiens
tccataaattttatgaacatat

SEQ ID NO: 98557 - DNA, 22 bp, Homo sapiens
ttggatggaggttcaagcacta

SEQ ID NO: 98558 - DNA, 22 bp, Homo sapiens
attgtaacagacacatcagatt

SEQ ID NO: 98559 - DNA, 22 bp, Homo sapiens
gtgctccctccttcctcaagga

SEQ ID NO: 98560 - DNA, 20 bp, Homo sapiens
tgttgattggtgtcatctca

SEQ ID NO: 98561 - DNA, 21 bp, Homo sapiens
tggtacaccttgcctgtcaga

SEQ ID NO: 98562 - DNA, 22 bp, Homo sapiens
gaggctgaggttgcagtgagcc

SEQ ID NO: 98563 - DNA, 22 bp, Homo sapiens
tcacttcccagacggggtggca

SEQ ID NO: 98564 - DNA, 22 bp, Homo sapiens
gctgaggctcctcgggaggaca

SEQ ID NO: 98565 - DNA, 22 bp, Homo sapiens
agaggacagagtgctggattta

SEQ ID NO: 98566 - DNA, 22 bp, Homo sapiens
gctgatggaaggacaggcgccg

SEQ ID NO: 98567 - DNA, 22 bp, Homo sapiens
gaactttgcgcagttcccgggg

SEQ ID NO: 98568 - DNA, 22 bp, Homo sapiens
tctgacattttgagaatgacat

SEQ ID NO: 98569 - DNA, 22 bp, Homo sapiens
agtgcaggccccaggccaggcc

SEQ ID NO: 98570 - DNA, 22 bp, Homo sapiens
agccagggacgctgcaggctac

SEQ ID NO: 98571 - DNA, 22 bp, Homo sapiens
tttttccacataccctaggcca

SEQ ID NO: 98572 - DNA, 22 bp, Homo sapiens
cagtgcagccaaggacaggcac

SEQ ID NO: 98573 - DNA, 22 bp, Homo sapiens
cataatttctaccagggccata

SEQ ID NO: 98574 - DNA, 22 bp, Homo sapiens
ggacaagcctgtgagtgggttt

SEQ ID NO: 98575 - DNA, 18 bp, Homo sapiens
tgtccctgcaaataacat

SEQ ID NO: 98576 - DNA, 22 bp, Homo sapiens
ctggggaacgcagcgagcagcg

SEQ ID NO: 98577 - DNA, 23 bp, Homo sapiens
ttctgggctgtggaagcctcggg

SEQ ID NO: 98578 - DNA, 22 bp, Homo sapiens
tctgctcagccgatctgctccg

SEQ ID NO: 98579 - DNA, 22 bp, Homo sapiens
gggctgtaggagctggaatggg

SEQ ID NO: 98580 - DNA, 22 bp, Homo sapiens
gctgtgcagaggtgagaatcca

SEQ ID NO: 98581 - DNA, 22 bp, Homo sapiens
tccagcttataggtagatttaa

SEQ ID NO: 98582 - DNA, 22 bp, Homo sapiens
cctcgacctccccaggctcagg

SEQ ID NO: 98583 - DNA, 18 bp, Homo sapiens
tctgccccagccgcactg

SEQ ID NO: 98584 - DNA, 22 bp, Homo sapiens
tggaatcattgctgtgttgctt

SEQ ID NO: 98585 - DNA, 22 bp, Homo sapiens
gatggaggagatggcagggtgc

SEQ ID NO: 98586 - DNA, 19 bp, Homo sapiens
caggcctcttaccctctct

SEQ ID NO: 98587 - DNA, 22 bp, Homo sapiens
ccttttgctctcccatccagaa

SEQ ID NO: 98588 - DNA, 22 bp, Homo sapiens
ggccctggtcctaggggtggaa

SEQ ID NO: 98589 - DNA, 22 bp, Homo sapiens
ggaggggatttagtagatgcta

SEQ ID NO: 98590 - DNA, 23 bp, Homo sapiens
catctagcatccagtgagtagtg

SEQ ID NO: 98591 - DNA, 22 bp, Homo sapiens
agacattttcgttggagaggtt

SEQ ID NO: 98592 - DNA, 22 bp, Homo sapiens
ggagcagggaattacagcgcag

SEQ ID NO: 98593 - DNA, 22 bp, Homo sapiens
cctagagctctgctttatctaa

SEQ ID NO: 98594 - DNA, 22 bp, Homo sapiens
ttgtgctgactgcgcccagctc

SEQ ID NO: 98595 - DNA, 22 bp, Homo sapiens
gtggggtagatctttctcagga

SEQ ID NO: 98596 - DNA, 22 bp, Homo sapiens
taagtcccccacttgccacagg

SEQ ID NO: 98597 - DNA, 22 bp, Homo sapiens
ccaggaggcggaggttgcagcg

SEQ ID NO: 98598 - DNA, 22 bp, Homo sapiens
ccagatatcactgccgtgttgt

SEQ ID NO: 98599 - DNA, 22 bp, Homo sapiens
ttcctttctctggactgcagcc

SEQ ID NO: 98600 - DNA, 22 bp, Homo sapiens
gaggttggggctgcagtgagct

SEQ ID NO: 98601 - DNA, 22 bp, Homo sapiens
cactgcactccagcctggcgac

SEQ ID NO: 98602 - DNA, 22 bp, Homo sapiens
tcagagagcagaacttttttac

SEQ ID NO: 98603 - DNA, 22 bp, Homo sapiens
gaggggcacagtaaagggtccc

SEQ ID NO: 98604 - DNA, 22 bp, Homo sapiens
ggtccccgtggaggctggagcg

SEQ ID NO: 98605 - DNA, 22 bp, Homo sapiens
cctccagagggaagtactttct

SEQ ID NO: 98606 - DNA, 22 bp, Homo sapiens
tggcatttgagctggaaggatg

SEQ ID NO: 98607 - DNA, 22 bp, Homo sapiens
tgctggaggccagaagtctgag

SEQ ID NO: 98608 - DNA, 22 bp, Homo sapiens
atgttatgtctgggaaggggta

SEQ ID NO: 98609 - DNA, 22 bp, Homo sapiens
accaggcccgctgctatggtgg

SEQ ID NO: 98610 - DNA, 22 bp, Homo sapiens
gttcaagaccagcctggccaac

SEQ ID NO: 98611 - DNA, 22 bp, Homo sapiens
ggtcacgtgaccgcacctgcct

SEQ ID NO: 98612 - DNA, 22 bp, Homo sapiens
atgcctgtaatcccagcacttt

SEQ ID NO: 98613 - DNA, 22 bp, Homo sapiens
ccctggaggcggagcttgcagt

SEQ ID NO: 98614 - DNA, 22 bp, Homo sapiens
gttgaagtaaggcagccacagg

SEQ ID NO: 98615 - DNA, 22 bp, Homo sapiens
gtgacaggccactgcggctctg

SEQ ID NO: 98616 - DNA, 22 bp, Homo sapiens
tgcctagttctgtatttacagt

SEQ ID NO: 98617 - DNA, 22 bp, Homo sapiens
cacccaggctggattgcagtgg

SEQ ID NO: 98618 - DNA, 22 bp, Homo sapiens
taccagggaacagggatattaa

SEQ ID NO: 98619 - DNA, 22 bp, Homo sapiens
tttcttctatgtgtgatatttt

SEQ ID NO: 98620 - DNA, 22 bp, Homo sapiens
cagggggctcaaaggagagtgc

SEQ ID NO: 98621 - DNA, 22 bp, Homo sapiens
aggagaagccaagttgtgagca

SEQ ID NO: 98622 - DNA, 22 bp, Homo sapiens
tgtgggagaaggaagcaagctg

SEQ ID NO: 98623 - DNA, 22 bp, Homo sapiens
cacttgttggtggtgaaatcac

SEQ ID NO: 98624 - DNA, 22 bp, Homo sapiens
agccaccaccactgaaaggtta

SEQ ID NO: 98625 - DNA, 22 bp, Homo sapiens
ggggaccctcaggactgcgtct

SEQ ID NO: 98626 - DNA, 22 bp, Homo sapiens
accagcctggccaacatggtga

SEQ ID NO: 98627 - DNA, 22 bp, Homo sapiens
actgattgcattcatagggttt

SEQ ID NO: 98628 - DNA, 22 bp, Homo sapiens
aacagctttgtatacagtaact

SEQ ID NO: 98629 - DNA, 18 bp, Homo sapiens
atgagaggtgtcagaaga

SEQ ID NO: 98630 - DNA, 22 bp, Homo sapiens
tcaggggcttgaggtgcatgtc

SEQ ID NO: 98631 - DNA, 22 bp, Homo sapiens
gcctccggagttgcagtgtctt

SEQ ID NO: 98632 - DNA, 22 bp, Homo sapiens
gcccaggctggagtgcagtggt

SEQ ID NO: 98633 - DNA, 22 bp, Homo sapiens
ccccatgaagtagggtctctga

SEQ ID NO: 98634 - DNA, 22 bp, Homo sapiens
tgggagaaagaaccctgagtga

SEQ ID NO: 98635 - DNA, 22 bp, Homo sapiens
gaaggtggcgagcggattgctg

SEQ ID NO: 98636 - DNA, 22 bp, Homo sapiens
tgtagatattaattattccttt

SEQ ID NO: 98637 - DNA, 22 bp, Homo sapiens
cccaggctggagtgcagtggcg

SEQ ID NO: 98638 - DNA, 22 bp, Homo sapiens
gccagggttcgaatccgtatgg

SEQ ID NO: 98639 - DNA, 22 bp, Homo sapiens
acaggtgcatgctaccatgtct

SEQ ID NO: 98640 - DNA, 23 bp, Homo sapiens
aggttatgattatagagcgagga

SEQ ID NO: 98641 - DNA, 22 bp, Homo sapiens
gacccacctcaccaagcatgtg

SEQ ID NO: 98642 - DNA, 22 bp, Homo sapiens
tgccaggcgtggtggtgcgcac

SEQ ID NO: 98643 - DNA, 20 bp, Homo sapiens
ttgagcagcagtgctgtgtc

SEQ ID NO: 98644 - DNA, 22 bp, Homo sapiens
tgccatagcaatggtaagctga

SEQ ID NO: 98645 - DNA, 22 bp, Homo sapiens
ccctgttgggaagagagatggc

SEQ ID NO: 98646 - DNA, 22 bp, Homo sapiens
ccctgcctacagggttttcttt

SEQ ID NO: 98647 - DNA, 22 bp, Homo sapiens
tgaaatgtgttctagtgttttg

SEQ ID NO: 98648 - DNA, 22 bp, Homo sapiens
gatctggaatctgaaggctgag

SEQ ID NO: 98649 - DNA, 22 bp, Homo sapiens
gtccccgacgtttggcttgatg

SEQ ID NO: 98650 - DNA, 22 bp, Homo sapiens
accgtgtctgacactttgggcg

SEQ ID NO: 98651 - DNA, 22 bp, Homo sapiens
aaagcgcttccctttggagcgt

SEQ ID NO: 98652 - DNA, 22 bp, Homo sapiens
gagtgtgtcggtcagcgtggcg

SEQ ID NO: 98653 - DNA, 22 bp, Homo sapiens
aggggcgtgctcttccccgacg

SEQ ID NO: 98654 - DNA, 22 bp, Homo sapiens
caggcagaagaagtggaaggac

SEQ ID NO: 98655 - DNA, 22 bp, Homo sapiens
tagcccctgcctttgaacctgg

SEQ ID NO: 98656 - DNA, 22 bp, Homo sapiens
ccctggaggttgaggctgcagt

SEQ ID NO: 98657 - DNA, 22 bp, Homo sapiens
atttcctgcaaggagtgggttt

SEQ ID NO: 98658 - DNA, 22 bp, Homo sapiens
ggaactcctgctccaagcagct

SEQ ID NO: 98659 - DNA, 17 bp, Homo sapiens
cgggcatggagggcagg

SEQ ID NO: 98660 - DNA, 20 bp, Homo sapiens
gctctgtggtttgagtctcc

SEQ ID NO: 98661 - DNA, 22 bp, Homo sapiens
acaaacagagttgaaaaatagg

SEQ ID NO: 98662 - DNA, 22 bp, Homo sapiens
ggccttggagtcagccttgagc

SEQ ID NO: 98663 - DNA, 22 bp, Homo sapiens
ggcctcgcggcttctggtggct

SEQ ID NO: 98664 - DNA, 22 bp, Homo sapiens
gctcatgactgtaatcccagca

SEQ ID NO: 98665 - DNA, 22 bp, Homo sapiens
gacaggaggcagagctcaggtg

SEQ ID NO: 98666 - DNA, 22 bp, Homo sapiens
gcgggccaccttggagagcgct

SEQ ID NO: 98667 - DNA, 22 bp, Homo sapiens
actagaaagaagttttttgaga

SEQ ID NO: 98668 - DNA, 22 bp, Homo sapiens
actccacatttgaacacagttc

SEQ ID NO: 98669 - DNA, 22 bp, Homo sapiens
gtccaggcctgcctctgaggag

SEQ ID NO: 98670 - DNA, 22 bp, Homo sapiens
gagcatcgctgagatcccagac

SEQ ID NO: 98671 - DNA, 22 bp, Homo sapiens
ctcctgggaaaggctggacaca

SEQ ID NO: 98672 - DNA, 21 bp, Homo sapiens
cagaggcctatcacagactcc

SEQ ID NO: 98673 - DNA, 22 bp, Homo sapiens
acccaggctggagtgcagtggc

SEQ ID NO: 98674 - DNA, 22 bp, Homo sapiens
tcatcagggatattggcctgaa

SEQ ID NO: 98675 - DNA, 22 bp, Homo sapiens
cctggctctgccacttactgcc

SEQ ID NO: 98676 - DNA, 22 bp, Homo sapiens
gttgcctaggctggtcttgaac

SEQ ID NO: 98677 - DNA, 22 bp, Homo sapiens
ccagtgtgcattatcatgtgtc

SEQ ID NO: 98678 - DNA, 22 bp, Homo sapiens
actcagtacatctggagttggc

SEQ ID NO: 98679 - DNA, 22 bp, Homo sapiens
ttaaatattatgttgtctgcaa

SEQ ID NO: 98680 - DNA, 22 bp, Homo sapiens
aactatgttaataagtttcatt

SEQ ID NO: 98681 - DNA, 22 bp, Homo sapiens
tgtgtggattcatctcaaagag

SEQ ID NO: 98682 - DNA, 22 bp, Homo sapiens
tgttgatttgtgggctgcaaaa

SEQ ID NO: 98683 - DNA, 22 bp, Homo sapiens
tgagcacatttcacatgacagg

SEQ ID NO: 98684 - DNA, 22 bp, Homo sapiens
ctcctgagctctgaggaagctt

SEQ ID NO: 98685 - DNA, 22 bp, Homo sapiens
aaccccgctcaggctgggtgag

SEQ ID NO: 98686 - DNA, 22 bp, Homo sapiens
ttggacgctcctaagaccaagc

SEQ ID NO: 98687 - DNA, 22 bp, Homo sapiens
ccatgtggtgggaaggagaatg

SEQ ID NO: 98688 - DNA, 22 bp, Homo sapiens
atggggagctcaccacctgttt

SEQ ID NO: 98689 - DNA, 22 bp, Homo sapiens
tgtgttcagaatttgctgcttt

SEQ ID NO: 98690 - DNA, 22 bp, Homo sapiens
aaaagagcttggttgattttgc

SEQ ID NO: 98691 - DNA, 22 bp, Homo sapiens
gggccaccccactgcccacgct

SEQ ID NO: 98692 - DNA, 22 bp, Homo sapiens
tgagaaattacttcagtgatgg

SEQ ID NO: 98693 - DNA, 22 bp, Homo sapiens
cgcgctctccttctggcaccca

SEQ ID NO: 98694 - DNA, 22 bp, Homo sapiens
tctagttctagatccctgagga

SEQ ID NO: 98695 - DNA, 22 bp, Homo sapiens
ccctggctggctctgcccggac

SEQ ID NO: 98696 - DNA, 22 bp, Homo sapiens
ccaaagaaacccaagctcaggg

SEQ ID NO: 98697 - DNA, 22 bp, Homo sapiens
ctctctgggcccagttggcacc

SEQ ID NO: 98698 - DNA, 22 bp, Homo sapiens
aggctctgtcaggcggagcagc

SEQ ID NO: 98699 - DNA, 22 bp, Homo sapiens
ggtggctgcaatggctaacttc

SEQ ID NO: 98700 - DNA, 18 bp, Homo sapiens
gcctgagggtcaagtgtg

SEQ ID NO: 98701 - DNA, 22 bp, Homo sapiens
tggggagtgatgcctcggataa

SEQ ID NO: 98702 - DNA, 22 bp, Homo sapiens
gaggctgaggttgcagtgagct

SEQ ID NO: 98703 - DNA, 22 bp, Homo sapiens
gtggcatgaaagcatctgtgat

SEQ ID NO: 98704 - DNA, 22 bp, Homo sapiens
atagaatatgacttttagatcc

SEQ ID NO: 98705 - DNA, 21 bp, Homo sapiens
ctctgtttgcctgctgccatc

SEQ ID NO: 98706 - DNA, 22 bp, Homo sapiens
cagcctggtccccggctcaccc

SEQ ID NO: 98707 - DNA, 22 bp, Homo sapiens
ggaaggggtgggtgagcctcag

SEQ ID NO: 98708 - DNA, 21 bp, Homo sapiens
cccagaagttccatggggggc

SEQ ID NO: 98709 - DNA, 22 bp, Homo sapiens
tcaggcagtagaattgcttgaa

SEQ ID NO: 98710 - DNA, 22 bp, Homo sapiens
atgccactgcacttcagcttgg

SEQ ID NO: 98711 - DNA, 22 bp, Homo sapiens
atgccactgcactccagcctgg

SEQ ID NO: 98712 - DNA, 22 bp, Homo sapiens
gagggtggtggcttaaggtgct

SEQ ID NO: 98713 - DNA, 22 bp, Homo sapiens
ttgcccaggctggagtgcagtg

SEQ ID NO: 98714 - DNA, 22 bp, Homo sapiens
atccatttgacataatttcagc

SEQ ID NO: 98715 - DNA, 22 bp, Homo sapiens
gtctcccaaactctgatggtcc

SEQ ID NO: 98716 - DNA, 23 bp, Homo sapiens
gcctgggagttgcgatctgcccg

SEQ ID NO: 98717 - DNA, 22 bp, Homo sapiens
taaatgttgtaagtacatctaa

SEQ ID NO: 98718 - DNA, 22 bp, Homo sapiens
tccagtgcaatggctcattcat

SEQ ID NO: 98719 - DNA, 22 bp, Homo sapiens
acattacctggcatttgatctt

SEQ ID NO: 98720 - DNA, 22 bp, Homo sapiens
tgctgagcgcatccggcggccg

SEQ ID NO: 98721 - DNA, 22 bp, Homo sapiens
gtggcagaccttcccttctcct

SEQ ID NO: 98722 - DNA, 22 bp, Homo sapiens
ccggtcccaggtgccccggtga

SEQ ID NO: 98723 - DNA, 22 bp, Homo sapiens
tagaataatctgaggaaatgct

SEQ ID NO: 98724 - DNA, 22 bp, Homo sapiens
cccaggaggtcgaagctgcagt

SEQ ID NO: 98725 - DNA, 22 bp, Homo sapiens
aggagggagcttaagccaggca

SEQ ID NO: 98726 - DNA, 22 bp, Homo sapiens
tccacaaggcagctcctccagg

SEQ ID NO: 98727 - DNA, 22 bp, Homo sapiens
ttctcccatctcagtcttacat

SEQ ID NO: 98728 - DNA, 22 bp, Homo sapiens
ttaggctgttcttgtgttgtta

SEQ ID NO: 98729 - DNA, 22 bp, Homo sapiens
tcgaaataatttagaatataga

SEQ ID NO: 98730 - DNA, 22 bp, Homo sapiens
tcgttaccatagccttgtccct

SEQ ID NO: 98731 - DNA, 22 bp, Homo sapiens
cgtgattggcttctgcattgga

SEQ ID NO: 98732 - DNA, 22 bp, Homo sapiens
gagctcatccccatggtccgtc

SEQ ID NO: 98733 - DNA, 22 bp, Homo sapiens
tgactggattgtcattacgacg

SEQ ID NO: 98734 - DNA, 22 bp, Homo sapiens
ggaggtggaggttgcagtgagc

SEQ ID NO: 98735 - DNA, 22 bp, Homo sapiens
ggaggcggaggttgcagtgagt

SEQ ID NO: 98736 - DNA, 22 bp, Homo sapiens
tgctgagcccagaacggcctgg

SEQ ID NO: 98737 - DNA, 22 bp, Homo sapiens
gcaggtggatcaccacgtcagg

SEQ ID NO: 98738 - DNA, 22 bp, Homo sapiens
cccggcctctgcctggtggcct

SEQ ID NO: 98739 - DNA, 22 bp, Homo sapiens
cttcagctgcagttatgtttag

SEQ ID NO: 98740 - DNA, 18 bp, Homo sapiens
cagggctgtggggtcact

SEQ ID NO: 98741 - DNA, 22 bp, Homo sapiens
ggccgctctccggtgtggatct

SEQ ID NO: 98742 - DNA, 22 bp, Homo sapiens
tgcgcctgtaagtccagagtcc

SEQ ID NO: 98743 - DNA, 22 bp, Homo sapiens
caccaggctggagtgcagtggc

SEQ ID NO: 98744 - DNA, 22 bp, Homo sapiens
aggtattattagcatctctatt

SEQ ID NO: 98745 - DNA, 22 bp, Homo sapiens
gggtcgggcaggcgccctcgtc

SEQ ID NO: 98746 - DNA, 22 bp, Homo sapiens
cccaggcttttctcttgcccca

SEQ ID NO: 98747 - DNA, 22 bp, Homo sapiens
cctgggctctgtcagaattggg

SEQ ID NO: 98748 - DNA, 22 bp, Homo sapiens
ccaggaggttgaggctgcagtg

SEQ ID NO: 98749 - DNA, 22 bp, Homo sapiens
ttgcccaggctggagtgcagta

SEQ ID NO: 98750 - DNA, 22 bp, Homo sapiens
atcatgttttaattagcaaact

SEQ ID NO: 98751 - DNA, 22 bp, Homo sapiens
tgcccaggctggagtacagtgg

SEQ ID NO: 98752 - DNA, 22 bp, Homo sapiens
gagtctctgaccagggtgccaa

SEQ ID NO: 98753 - DNA, 18 bp, Homo sapiens
ctgccagtgtgctctccg

SEQ ID NO: 98754 - DNA, 22 bp, Homo sapiens
cactgcactccagcccgggcaa

SEQ ID NO: 98755 - DNA, 22 bp, Homo sapiens
gcccaggctggagttcagtggt

SEQ ID NO: 98756 - DNA, 22 bp, Homo sapiens
ctctgcctcagtgatttcttta

SEQ ID NO: 98757 - DNA, 22 bp, Homo sapiens
aatgactaaatctgaagatagg

SEQ ID NO: 98758 - DNA, 22 bp, Homo sapiens
tggcccgaagatccgagggtca

SEQ ID NO: 98759 - DNA, 22 bp, Homo sapiens
aggaaataagggacaagacaaa

SEQ ID NO: 98760 - DNA, 22 bp, Homo sapiens
ctctggaggtggaggttgcagt

SEQ ID NO: 98761 - DNA, 22 bp, Homo sapiens
gtgggggctggaaatcttgcca

SEQ ID NO: 98762 - DNA, 22 bp, Homo sapiens
atttacaggtagaattttaagt

SEQ ID NO: 98763 - DNA, 22 bp, Homo sapiens
tgattcatcagaataggagttt

SEQ ID NO: 98764 - DNA, 22 bp, Homo sapiens
tgacatttcctagtgctttgtg

SEQ ID NO: 98765 - DNA, 22 bp, Homo sapiens
agggctggagccacagctggga

SEQ ID NO: 98766 - DNA, 22 bp, Homo sapiens
tatcacagtaaatctgggtgca

SEQ ID NO: 98767 - DNA, 22 bp, Homo sapiens
tgctgggattacagtcatgagc

SEQ ID NO: 98768 - DNA, 22 bp, Homo sapiens
gctcccaggatgaggagccagg

SEQ ID NO: 98769 - DNA, 22 bp, Homo sapiens
ccccgaggctggagtgcagtgg

SEQ ID NO: 98770 - DNA, 22 bp, Homo sapiens
atggcagaatatctgcatcgca

SEQ ID NO: 98771 - DNA, 20 bp, Homo sapiens
tgtttgtgtggggccttggc

SEQ ID NO: 98772 - DNA, 22 bp, Homo sapiens
gggcggatcatttgaggtcagg

SEQ ID NO: 98773 - DNA, 22 bp, Homo sapiens
aagaaatgtgaatattgaatag

SEQ ID NO: 98774 - DNA, 22 bp, Homo sapiens
gcggggttccgtgccccagagt

SEQ ID NO: 98775 - DNA, 22 bp, Homo sapiens
ccacagtcctggcttctgtctg

SEQ ID NO: 98776 - DNA, 22 bp, Homo sapiens
cccaggaggcagaagttgcagt

SEQ ID NO: 98777 - DNA, 22 bp, Homo sapiens
gaagccttgaactgcaaacccc

SEQ ID NO: 98778 - DNA, 22 bp, Homo sapiens
ctgctaaacctctctgagagct

SEQ ID NO: 98779 - DNA, 22 bp, Homo sapiens
caaatgaatatttccatgggtt

SEQ ID NO: 98780 - DNA, 22 bp, Homo sapiens
agcacctgtcaagtccaggctg

SEQ ID NO: 98781 - DNA, 22 bp, Homo sapiens
tggtggggccagacttcagctc

SEQ ID NO: 98782 - DNA, 22 bp, Homo sapiens
ttgggctcaggagtttgagacc

SEQ ID NO: 98783 - DNA, 22 bp, Homo sapiens
gaagattgaaggctgggaatta

SEQ ID NO: 98784 - DNA, 22 bp, Homo sapiens
cgcaggtgaaagaggctgggca

SEQ ID NO: 98785 - DNA, 22 bp, Homo sapiens
taattgtaaagtagtagtacag

SEQ ID NO: 98786 - DNA, 22 bp, Homo sapiens
ttgtgctgtgagaatgctcatt

SEQ ID NO: 98787 - DNA, 17 bp, Homo sapiens
tgtatttatcatgtcag

SEQ ID NO: 98788 - DNA, 22 bp, Homo sapiens
tctcttgagctcagttctgatg

SEQ ID NO: 98789 - DNA, 22 bp, Homo sapiens
cctcgcggcactcgggccggat

SEQ ID NO: 98790 - DNA, 21 bp, Homo sapiens
ctcccagggtgactgttcaac

SEQ ID NO: 98791 - DNA, 22 bp, Homo sapiens
cacccaggcaaggattctgcaa

SEQ ID NO: 98792 - DNA, 22 bp, Homo sapiens
ttaagtgcaaaaatgaaagtat

SEQ ID NO: 98793 - DNA, 22 bp, Homo sapiens
tttgaagggcacgacaatagtt

SEQ ID NO: 98794 - DNA, 22 bp, Homo sapiens
tggaggctggagtgcagtggcg

SEQ ID NO: 98795 - DNA, 22 bp, Homo sapiens
tctctttgcctgctgccatcca

SEQ ID NO: 98796 - DNA, 19 bp, Homo sapiens
gcagacaggtccagagagg

SEQ ID NO: 98797 - DNA, 22 bp, Homo sapiens
tgtttcttacgtttttagaggc

SEQ ID NO: 98798 - DNA, 22 bp, Homo sapiens
cactgcaccctcaaactcctgg

SEQ ID NO: 98799 - DNA, 22 bp, Homo sapiens
ggaagaaaggtggacaacaggt

SEQ ID NO: 98800 - DNA, 21 bp, Homo sapiens
agaaggcaaaagcagacatct

SEQ ID NO: 98801 - DNA, 22 bp, Homo sapiens
cagtagatttggtaaactagga

SEQ ID NO: 98802 - DNA, 22 bp, Homo sapiens
ggcagagcttgcagtgagccga

SEQ ID NO: 98803 - DNA, 22 bp, Homo sapiens
aatggcactttataaatgttaa

SEQ ID NO: 98804 - DNA, 22 bp, Homo sapiens
ctagttgaagaggctgtcatca

SEQ ID NO: 98805 - DNA, 22 bp, Homo sapiens
gcgaggaggggtgctgggcccc

SEQ ID NO: 98806 - DNA, 22 bp, Homo sapiens
tagatagattctcctatagagt

SEQ ID NO: 98807 - DNA, 22 bp, Homo sapiens
ataaaatttgctactgttaaat

SEQ ID NO: 98808 - DNA, 22 bp, Homo sapiens
tgttatctgagcaacgtcgacg

SEQ ID NO: 98809 - DNA, 22 bp, Homo sapiens
tgcctccctggcaagtctctcc

SEQ ID NO: 98810 - DNA, 22 bp, Homo sapiens
gtaatagtctcaaactcctgga

SEQ ID NO: 98811 - DNA, 17 bp, Homo sapiens
ggcctgcacctcctgct

SEQ ID NO: 98812 - DNA, 22 bp, Homo sapiens
aaccaggtgactcatggtgagc

SEQ ID NO: 98813 - DNA, 22 bp, Homo sapiens
gggtggagagaaagaaacgtga

SEQ ID NO: 98814 - DNA, 22 bp, Homo sapiens
tctctctgcagcccgggacact

SEQ ID NO: 98815 - DNA, 22 bp, Homo sapiens
ctggagtagccggacgggtctg

SEQ ID NO: 98816 - DNA, 19 bp, Homo sapiens
tcctgcctggggccgcctg

SEQ ID NO: 98817 - DNA, 22 bp, Homo sapiens
cttatagtatgatgttgagaat

SEQ ID NO: 98818 - DNA, 22 bp, Homo sapiens
tcctccccaaagcccagcctgg

SEQ ID NO: 98819 - DNA, 22 bp, Homo sapiens
ctgccctggggggcctccttgc

SEQ ID NO: 98820 - DNA, 22 bp, Homo sapiens
gagctctgactgctgggtgaca

SEQ ID NO: 98821 - DNA, 22 bp, Homo sapiens
gaagccagtgtttgaagaattt

SEQ ID NO: 98822 - DNA, 22 bp, Homo sapiens
aagacccacaaggctgaatgtt

SEQ ID NO: 98823 - DNA, 22 bp, Homo sapiens
cgtgaggggggtaaggcgtccg

SEQ ID NO: 98824 - DNA, 22 bp, Homo sapiens
cacccaggctggaatgcagtgg

SEQ ID NO: 98825 - DNA, 22 bp, Homo sapiens
cacccaggctggagtgcagtga

SEQ ID NO: 98826 - DNA, 22 bp, Homo sapiens
tccacttccacgtgtgcagaat

SEQ ID NO: 98827 - DNA, 21 bp, Homo sapiens
tctgatggtagatgagatgtg

SEQ ID NO: 98828 - DNA, 22 bp, Homo sapiens
aggacagagggaccagagccca

SEQ ID NO: 98829 - DNA, 21 bp, Homo sapiens
ccaccaggtcttctgctcggg

SEQ ID NO: 98830 - DNA, 22 bp, Homo sapiens
aggagcagaccgtagtcctgca

SEQ ID NO: 98831 - DNA, 22 bp, Homo sapiens
aggaaaatggaccagagttgtt

SEQ ID NO: 98832 - DNA, 22 bp, Homo sapiens
gaatgtgtactgagtgcccctt

SEQ ID NO: 98833 - DNA, 22 bp, Homo sapiens
aaacatctactgtaggctggag

SEQ ID NO: 98834 - DNA, 22 bp, Homo sapiens
cctgctggctctgttgctcggc

SEQ ID NO: 98835 - DNA, 22 bp, Homo sapiens
ggatgtgtcactctcaggaggt

SEQ ID NO: 98836 - DNA, 22 bp, Homo sapiens
atttttctctttccactgagat

SEQ ID NO: 98837 - DNA, 22 bp, Homo sapiens
tgacttcctgcactcaggtgat

SEQ ID NO: 98838 - DNA, 22 bp, Homo sapiens
gagcacgttgaagcgcactgtc

SEQ ID NO: 98839 - DNA, 22 bp, Homo sapiens
gcctcctgagtagctgggattg

SEQ ID NO: 98840 - DNA, 22 bp, Homo sapiens
tgttatatctaaatagccacat

SEQ ID NO: 98841 - DNA, 22 bp, Homo sapiens
agtaaaactcacaaaaggatgg

SEQ ID NO: 98842 - DNA, 22 bp, Homo sapiens
gccagtggtcactgaggaagaa

SEQ ID NO: 98843 - DNA, 20 bp, Homo sapiens
ggcagagggcctgggagaag

SEQ ID NO: 98844 - DNA, 22 bp, Homo sapiens
ggggtgggcgtgcagggacacc

SEQ ID NO: 98845 - DNA, 22 bp, Homo sapiens
caagcgtggctgctctgatgga

SEQ ID NO: 98846 - DNA, 22 bp, Homo sapiens
gctctctgcagcctccttggag

SEQ ID NO: 98847 - DNA, 22 bp, Homo sapiens
tgccgctccaggtctcgcggtg

SEQ ID NO: 98848 - DNA, 22 bp, Homo sapiens
tgtctggatagagcctaggccc

SEQ ID NO: 98849 - DNA, 22 bp, Homo sapiens
aagaataagaggatttagaaca

SEQ ID NO: 98850 - DNA, 22 bp, Homo sapiens
tcccacaggtggagcttgcagt

SEQ ID NO: 98851 - DNA, 22 bp, Homo sapiens
ttgtcgggcttacgcagggcca

SEQ ID NO: 98852 - DNA, 22 bp, Homo sapiens
cgttggtctgtcccctggcacc

SEQ ID NO: 98853 - DNA, 22 bp, Homo sapiens
gccctgagaagaagtcggaggg

SEQ ID NO: 98854 - DNA, 22 bp, Homo sapiens
ggggtactggctggagccccac

SEQ ID NO: 98855 - DNA, 22 bp, Homo sapiens
acagcagagcctggtacttact

SEQ ID NO: 98856 - DNA, 22 bp, Homo sapiens
ggaggagacagtaaaaagcacg

SEQ ID NO: 98857 - DNA, 22 bp, Homo sapiens
ttcaccagcagctcactagtca

SEQ ID NO: 98858 - DNA, 22 bp, Homo sapiens
cccaggggttcaaggctgcagt

SEQ ID NO: 98859 - DNA, 22 bp, Homo sapiens
ttgcatttggttctgcctggta

SEQ ID NO: 98860 - DNA, 22 bp, Homo sapiens
atgattgaaaatgacattgcca

SEQ ID NO: 98861 - DNA, 22 bp, Homo sapiens
ggctagcaaggtagcagaatgc

SEQ ID NO: 98862 - DNA, 22 bp, Homo sapiens
taaaatttgtccctgagtgttg

SEQ ID NO: 98863 - DNA, 22 bp, Homo sapiens
tgtgaagatagctgttacatct

SEQ ID NO: 98864 - DNA, 22 bp, Homo sapiens
tctggctctggagtccacctgc

SEQ ID NO: 98865 - DNA, 22 bp, Homo sapiens
gcgcaccacctccaggtggccg

SEQ ID NO: 98866 - DNA, 22 bp, Homo sapiens
gaggtggctgcttgctgggaaa

SEQ ID NO: 98867 - DNA, 19 bp, Homo sapiens
atcctttcccacatacttt

SEQ ID NO: 98868 - DNA, 22 bp, Homo sapiens
gggagaggttacccgagcaact

SEQ ID NO: 98869 - DNA, 22 bp, Homo sapiens
caattctgaggcctgctttgtt

SEQ ID NO: 98870 - DNA, 22 bp, Homo sapiens
tgcgatgcaacagcttggcgga

SEQ ID NO: 98871 - DNA, 22 bp, Homo sapiens
gctgcgccggatcccacgttcc

SEQ ID NO: 98872 - DNA, 22 bp, Homo sapiens
acccaggagacggaggtgcagt

SEQ ID NO: 98873 - DNA, 22 bp, Homo sapiens
cacagctgaagtagccatgtgg

SEQ ID NO: 98874 - DNA, 22 bp, Homo sapiens
cttcatgctgatatcctcgatg

SEQ ID NO: 98875 - DNA, 22 bp, Homo sapiens
gccgggttcaagccattctcct

SEQ ID NO: 98876 - DNA, 20 bp, Homo sapiens
caaatccctgctctgtgctg

SEQ ID NO: 98877 - DNA, 22 bp, Homo sapiens
gggggactggaccgtcctgggt

SEQ ID NO: 98878 - DNA, 22 bp, Homo sapiens
agccaggatggtctcgatcggc

SEQ ID NO: 98879 - DNA, 22 bp, Homo sapiens
ggggttaacagtattgctcatg

SEQ ID NO: 98880 - DNA, 22 bp, Homo sapiens
tttaatcataagaaggaaaata

SEQ ID NO: 98881 - DNA, 22 bp, Homo sapiens
ccaggaggcggaggttgcagtg

SEQ ID NO: 98882 - DNA, 22 bp, Homo sapiens
acaggggacctaggaccctcgg

SEQ ID NO: 98883 - DNA, 22 bp, Homo sapiens
ctatggtctggaccgaggtcct

SEQ ID NO: 98884 - DNA, 22 bp, Homo sapiens
agcctgggcaacagagcaaaac

SEQ ID NO: 98885 - DNA, 22 bp, Homo sapiens
actgatcaagggtttaatttta

SEQ ID NO: 98886 - DNA, 22 bp, Homo sapiens
cctccccacagcccaggagact

SEQ ID NO: 98887 - DNA, 22 bp, Homo sapiens
caagtctgacctctgggtgaag

SEQ ID NO: 98888 - DNA, 22 bp, Homo sapiens
ctcctggaggatagtgactggg

SEQ ID NO: 98889 - DNA, 22 bp, Homo sapiens
aggctgagataggtggatcatt

SEQ ID NO: 98890 - DNA, 22 bp, Homo sapiens
cactgcactccagcctgggtca

SEQ ID NO: 98891 - DNA, 22 bp, Homo sapiens
cccaggaggcagagatagcagt

SEQ ID NO: 98892 - DNA, 22 bp, Homo sapiens
tcgcccaggctggaagtgcagt

SEQ ID NO: 98893 - DNA, 22 bp, Homo sapiens
ctgggcagctgtatcagggagt

SEQ ID NO: 98894 - DNA, 22 bp, Homo sapiens
agtgcactggcaccatctcagc

SEQ ID NO: 98895 - DNA, 23 bp, Homo sapiens
gtctctagagtgtggagcaaaga

SEQ ID NO: 98896 - DNA, 22 bp, Homo sapiens
cctctgtgtctccaagaggcct

SEQ ID NO: 98897 - DNA, 16 bp, Homo sapiens
aggtggagaagttcac

SEQ ID NO: 98898 - DNA, 22 bp, Homo sapiens
cacccaggttggagtgcagtgg

SEQ ID NO: 98899 - DNA, 22 bp, Homo sapiens
taattataacagttacatctta

SEQ ID NO: 98900 - DNA, 22 bp, Homo sapiens
aggagagctggtgtctggaatc

SEQ ID NO: 98901 - DNA, 22 bp, Homo sapiens
tctcgctctgtcgcccaggctg

SEQ ID NO: 98902 - DNA, 22 bp, Homo sapiens
tctgctggaaaaccagggaatt

SEQ ID NO: 98903 - DNA, 22 bp, Homo sapiens
tccaccatgtaacaagctctgt

SEQ ID NO: 98904 - DNA, 22 bp, Homo sapiens
tgaaggggttcagcatgggggt

SEQ ID NO: 98905 - DNA, 22 bp, Homo sapiens
ataatacatggttgatcttttc

SEQ ID NO: 98906 - DNA, 16 bp, Homo sapiens
ccacctgcagctctca

SEQ ID NO: 98907 - DNA, 22 bp, Homo sapiens
ctggcctggcgcagtggctcac

SEQ ID NO: 98908 - DNA, 22 bp, Homo sapiens
gtccacttctgcctttctggat

SEQ ID NO: 98909 - DNA, 23 bp, Homo sapiens
cccagaccttgtgctgcccttgg

SEQ ID NO: 98910 - DNA, 19 bp, Homo sapiens
catctggatgattctcctg

SEQ ID NO: 98911 - DNA, 22 bp, Homo sapiens
acgcccagactcccatactttg

SEQ ID NO: 98912 - DNA, 22 bp, Homo sapiens
caggcactgtgctgagctctgc

SEQ ID NO: 98913 - DNA, 22 bp, Homo sapiens
ccagttccagtgctcacatcca

SEQ ID NO: 98914 - DNA, 22 bp, Homo sapiens
ccaggaggtggaggttgcggtg

SEQ ID NO: 98915 - DNA, 22 bp, Homo sapiens
gctcccagtctgatggaggaga

SEQ ID NO: 98916 - DNA, 22 bp, Homo sapiens
cagggccagcgtctcgggctat

SEQ ID NO: 98917 - DNA, 22 bp, Homo sapiens
ctcaggacccggtccaggtggg

SEQ ID NO: 98918 - DNA, 23 bp, Homo sapiens
tgtcttcgactcctgcgtgcttc

SEQ ID NO: 98919 - DNA, 22 bp, Homo sapiens
ccactattactgtgtggcagtc

SEQ ID NO: 98920 - DNA, 22 bp, Homo sapiens
aaagcctcccaggttatgagta

SEQ ID NO: 98921 - DNA, 22 bp, Homo sapiens
gatggcctcatggctgcaggcc

SEQ ID NO: 98922 - DNA, 22 bp, Homo sapiens
accagcctggccaacatggcaa

SEQ ID NO: 98923 - DNA, 22 bp, Homo sapiens
ctctggagtgtctggccagggt

SEQ ID NO: 98924 - DNA, 22 bp, Homo sapiens
tgcctcagctgaggccgctcca

SEQ ID NO: 98925 - DNA, 22 bp, Homo sapiens
gaagcctcaacatctctgcgtc

SEQ ID NO: 98926 - DNA, 22 bp, Homo sapiens
gcagggcacaaggacgcacagg

SEQ ID NO: 98927 - DNA, 22 bp, Homo sapiens
gaggagggagctggaagctctt

SEQ ID NO: 98928 - DNA, 22 bp, Homo sapiens
gtgatatcttacaattctcttt

SEQ ID NO: 98929 - DNA, 22 bp, Homo sapiens
attgcaggctctgacaccaggc

SEQ ID NO: 98930 - DNA, 22 bp, Homo sapiens
gtagttctgcagtgtcacctga

SEQ ID NO: 98931 - DNA, 18 bp, Homo sapiens
gaattgtgctaaggtgat

SEQ ID NO: 98932 - DNA, 22 bp, Homo sapiens
taatggattaacgtccctgtcg

SEQ ID NO: 98933 - DNA, 23 bp, Homo sapiens
acagcaagaggaccagatgtgag

SEQ ID NO: 98934 - DNA, 22 bp, Homo sapiens
ctagggtcaggggcctgcgtcg

SEQ ID NO: 98935 - DNA, 22 bp, Homo sapiens
atcatcatgcccacttgagact

SEQ ID NO: 98936 - DNA, 22 bp, Homo sapiens
gcggggcccggacccagcctct

SEQ ID NO: 98937 - DNA, 22 bp, Homo sapiens
gcggggggaggaacatcttgca

SEQ ID NO: 98938 - DNA, 22 bp, Homo sapiens
cactgcactccagcctgggtga

SEQ ID NO: 98939 - DNA, 22 bp, Homo sapiens
cgggcagcggcgtggccatggt

SEQ ID NO: 98940 - DNA, 22 bp, Homo sapiens
acctggacacctgctgtcatct

SEQ ID NO: 98941 - DNA, 22 bp, Homo sapiens
tcaccttgtgatctccctgcct

SEQ ID NO: 98942 - DNA, 21 bp, Homo sapiens
gcagcagtgttctagaatact

SEQ ID NO: 98943 - DNA, 22 bp, Homo sapiens
gcctggagaaaggaaggtggga

SEQ ID NO: 98944 - DNA, 22 bp, Homo sapiens
gaggcacagagtaggtgcacac

SEQ ID NO: 98945 - DNA, 22 bp, Homo sapiens
catgaaattgtattggcctcaa

SEQ ID NO: 98946 - DNA, 22 bp, Homo sapiens
tcccctctttctggaaacacaa

SEQ ID NO: 98947 - DNA, 18 bp, Homo sapiens
tcactgggtgtatgtggc

SEQ ID NO: 98948 - DNA, 16 bp, Homo sapiens
gcgcctcctcggcctc

SEQ ID NO: 98949 - DNA, 16 bp, Homo sapiens
tgggtgggaggagcgg

SEQ ID NO: 98950 - DNA, 22 bp, Homo sapiens
attcacctttccccaaaatgag

SEQ ID NO: 98951 - DNA, 23 bp, Homo sapiens
acctgtctgcctcccaccatcaa

SEQ ID NO: 98952 - DNA, 22 bp, Homo sapiens
agtcaataaaagctttagattc

SEQ ID NO: 98953 - DNA, 22 bp, Homo sapiens
gaggtggatgttgcagtgagct

SEQ ID NO: 98954 - DNA, 22 bp, Homo sapiens
aaagtgctaggattacaagcgt

SEQ ID NO: 98955 - DNA, 22 bp, Homo sapiens
tagccgggtgtggtggaactcc

SEQ ID NO: 98956 - DNA, 22 bp, Homo sapiens
agtccaaagcagatgagggcca

SEQ ID NO: 98957 - DNA, 22 bp, Homo sapiens
aggacaaaggaccagatctgga

SEQ ID NO: 98958 - DNA, 22 bp, Homo sapiens
tctgttttgcataatgttcttt

SEQ ID NO: 98959 - DNA, 22 bp, Homo sapiens
ttctggaaggatgtttctatct

SEQ ID NO: 98960 - DNA, 22 bp, Homo sapiens
agggaagaggaccagagtctct

SEQ ID NO: 98961 - DNA, 22 bp, Homo sapiens
gtagtcccagctaccccggagg

SEQ ID NO: 98962 - DNA, 22 bp, Homo sapiens
gccatcatatcccctgtgacct

SEQ ID NO: 98963 - DNA, 22 bp, Homo sapiens
ctagggacctcagctcctggag

SEQ ID NO: 98964 - DNA, 22 bp, Homo sapiens
cctctgtgtgatgcgcaaagta

SEQ ID NO: 98965 - DNA, 22 bp, Homo sapiens
caggaagctgtgaaggagacgg

SEQ ID NO: 98966 - DNA, 21 bp, Homo sapiens
gaccccagaccagcagacaca

SEQ ID NO: 98967 - DNA, 22 bp, Homo sapiens
tggcatgcatctgttgtcctag

SEQ ID NO: 98968 - DNA, 22 bp, Homo sapiens
cagcagcagtgttctagaatct

SEQ ID NO: 98969 - DNA, 19 bp, Homo sapiens
ctctggagtcattgctccc

SEQ ID NO: 98970 - DNA, 22 bp, Homo sapiens
cacagagctggaaaggctgggc

SEQ ID NO: 98971 - DNA, 22 bp, Homo sapiens
aatgttacgatcaacaacacat

SEQ ID NO: 98972 - DNA, 22 bp, Homo sapiens
ctcggcaggtggaggttgtagt

SEQ ID NO: 98973 - DNA, 22 bp, Homo sapiens
agttgcagacgcagagatgttg

SEQ ID NO: 98974 - DNA, 22 bp, Homo sapiens
actgcactccagcctgggtaac

SEQ ID NO: 98975 - DNA, 22 bp, Homo sapiens
gccgggaccaaggccacggagc

SEQ ID NO: 98976 - DNA, 22 bp, Homo sapiens
tggctgagttacgaacagagca

SEQ ID NO: 98977 - DNA, 22 bp, Homo sapiens
acttcttcttcagctgggggat

SEQ ID NO: 98978 - DNA, 22 bp, Homo sapiens
gtcctggggattatagagtgtt

SEQ ID NO: 98979 - DNA, 22 bp, Homo sapiens
aggggagccagggctgcgagtt

SEQ ID NO: 98980 - DNA, 22 bp, Homo sapiens
ggggccgaccgcggttcaggcc

SEQ ID NO: 98981 - DNA, 22 bp, Homo sapiens
tgtggccattcttgaggtcgac

SEQ ID NO: 98982 - DNA, 22 bp, Homo sapiens
actgctggggctcattcatctc

SEQ ID NO: 98983 - DNA, 22 bp, Homo sapiens
gagccccaccctagacattctg

SEQ ID NO: 98984 - DNA, 22 bp, Homo sapiens
aagccctggacggcccttcccc

SEQ ID NO: 98985 - DNA, 22 bp, Homo sapiens
tttgaaatgtatcagtataggt

SEQ ID NO: 98986 - DNA, 22 bp, Homo sapiens
gggaaatctcgtcctctattta

SEQ ID NO: 98987 - DNA, 22 bp, Homo sapiens
cgcgaggtggaggttgcagtga

SEQ ID NO: 98988 - DNA, 23 bp, Homo sapiens
cttcacaggttcaggggattaag

SEQ ID NO: 98989 - DNA, 22 bp, Homo sapiens
tcttttgtgattctttagttac

SEQ ID NO: 98990 - DNA, 22 bp, Homo sapiens
ctacattaaattggcttactta

SEQ ID NO: 98991 - DNA, 22 bp, Homo sapiens
ggagcatgcgctctgtgaccga

SEQ ID NO: 98992 - DNA, 22 bp, Homo sapiens
cactgcacttcagcctgggtga

SEQ ID NO: 98993 - DNA, 22 bp, Homo sapiens
tcctgggatcaagtgatcctcc

SEQ ID NO: 98994 - DNA, 22 bp, Homo sapiens
agtgctgtcagttttatagata

SEQ ID NO: 98995 - DNA, 22 bp, Homo sapiens
caggctggagtacaattgtgtg

SEQ ID NO: 98996 - DNA, 22 bp, Homo sapiens
gcagactgtatcaatgtcagta

SEQ ID NO: 98997 - DNA, 22 bp, Homo sapiens
tcacagacccttgctgagctct

SEQ ID NO: 98998 - DNA, 22 bp, Homo sapiens
agtggagacaggacagtcgata

SEQ ID NO: 98999 - DNA, 22 bp, Homo sapiens
agagggtgggcacgtgatggat

SEQ ID NO: 99000 - DNA, 22 bp, Homo sapiens
tgagtggacacctgcttcttta

SEQ ID NO: 99001 - DNA, 19 bp, Homo sapiens
tctcaattctccccactgc

SEQ ID NO: 99002 - DNA, 22 bp, Homo sapiens
tagcgaggtgtttctaggactg

SEQ ID NO: 99003 - DNA, 22 bp, Homo sapiens
agaaatatgctgattagatgaa

SEQ ID NO: 99004 - DNA, 22 bp, Homo sapiens
acaaagtgaattgcatcgagtt

SEQ ID NO: 99005 - DNA, 22 bp, Homo sapiens
ataaaaactgacccatcctttg

SEQ ID NO: 99006 - DNA, 22 bp, Homo sapiens
gtgtttgttcgtgactccaaag

SEQ ID NO: 99007 - DNA, 22 bp, Homo sapiens
tgagtggacacctgcttcttta

SEQ ID NO: 99008 - DNA, 22 bp, Homo sapiens
gaggctgaggcggatggatcac

SEQ ID NO: 99009 - DNA, 22 bp, Homo sapiens
agagggtgggcacgtgatggat

SEQ ID NO: 99010 - DNA, 22 bp, Homo sapiens
gaggctgaggttgcagtgagct

SEQ ID NO: 99011 - DNA, 22 bp, Homo sapiens
caggctgatcagggctgggatg

SEQ ID NO: 99012 - DNA, 22 bp, Homo sapiens
aggtcaagggagctgagggcca

SEQ ID NO: 99013 - DNA, 22 bp, Homo sapiens
gaagaaggtggcccaggggtag

SEQ ID NO: 99014 - DNA, 22 bp, Homo sapiens
ccagaaaaatcctcccttgtcc

SEQ ID NO: 99015 - DNA, 22 bp, Homo sapiens
cttagagatgggttttacttag

SEQ ID NO: 99016 - DNA, 19 bp, Homo sapiens
ccagagagctaggtacaga

SEQ ID NO: 99017 - DNA, 21 bp, Homo sapiens
aagaggaagcattatggcata

SEQ ID NO: 99018 - DNA, 22 bp, Homo sapiens
gggaaagaccttcctggggtgt

SEQ ID NO: 99019 - DNA, 22 bp, Homo sapiens
aggtcaagagtaaatttgggta

SEQ ID NO: 99020 - DNA, 22 bp, Homo sapiens
caggctgaagtgcagtggtgtg

SEQ ID NO: 99021 - DNA, 22 bp, Homo sapiens
gtccaagagtcaagaagggggc

SEQ ID NO: 99022 - DNA, 22 bp, Homo sapiens
aggatttctgtgcctggaaaat

SEQ ID NO: 99023 - DNA, 22 bp, Homo sapiens
taagggttcagaatgcagtggt

SEQ ID NO: 99024 - DNA, 22 bp, Homo sapiens
acatatgcgatcataggatgca

SEQ ID NO: 99025 - DNA, 22 bp, Homo sapiens
aaagaaggtagggctggtgact

SEQ ID NO: 99026 - DNA, 22 bp, Homo sapiens
aaggctgaggcagtgaggcaga

SEQ ID NO: 99027 - DNA, 22 bp, Homo sapiens
gaaagacatagttgcaagatgg

SEQ ID NO: 99028 - DNA, 22 bp, Homo sapiens
aggacagagggaccagagccca

SEQ ID NO: 99029 - DNA, 22 bp, Homo sapiens
ggaaagtcttgtgtagatgtct

SEQ ID NO: 99030 - DNA, 22 bp, Homo sapiens
ctattattagataatctacttg

SEQ ID NO: 99031 - DNA, 22 bp, Homo sapiens
gggaagagggagctggaatgat

SEQ ID NO: 99032 - DNA, 22 bp, Homo sapiens
aaggctgagacagcacaggtcc

SEQ ID NO: 99033 - DNA, 22 bp, Homo sapiens
gaggctgaggcaggaggatcac

SEQ ID NO: 99034 - DNA, 22 bp, Homo sapiens
acccgggaggcaggagtcatag

SEQ ID NO: 99035 - DNA, 22 bp, Homo sapiens
agaggaagtaatcaggacctgc

SEQ ID NO: 99036 - DNA, 22 bp, Homo sapiens
tttcttctatgtgtgatatttt

SEQ ID NO: 99037 - DNA, 22 bp, Homo sapiens
cagggtttcaccatgttagcag

SEQ ID NO: 99038 - DNA, 22 bp, Homo sapiens
ctgcagggagaggggacagcct

SEQ ID NO: 99039 - DNA, 22 bp, Homo sapiens
tccacgtgagcttcgtgtgcag

SEQ ID NO: 99040 - DNA, 22 bp, Homo sapiens
gaggggcacagtaaagggtccc

SEQ ID NO: 99041 - DNA, 18 bp, Homo sapiens
tctggaacaacttcatgt

SEQ ID NO: 99042 - DNA, 16 bp, Homo sapiens
aggcgaaggttcattt

SEQ ID NO: 99043 - DNA, 22 bp, Homo sapiens
aggggagccagggctgcgagtt

SEQ ID NO: 99044 - DNA, 22 bp, Homo sapiens
ttatatgtttctgtttggaggc

SEQ ID NO: 99045 - DNA, 22 bp, Homo sapiens
ttcttctttccaattacatggt

SEQ ID NO: 99046 - DNA, 22 bp, Homo sapiens
tttaagaagttatgttataaat

SEQ ID NO: 99047 - DNA, 22 bp, Homo sapiens
atttactttgctgagatccatc

SEQ ID NO: 99048 - DNA, 22 bp, Homo sapiens
tggttaagtccagaaaggaagc

SEQ ID NO: 99049 - DNA, 22 bp, Homo sapiens
gaggctgaggttgcagtgagcc

SEQ ID NO: 99050 - DNA, 22 bp, Homo sapiens
ggaggggatttagtagatgcta

SEQ ID NO: 99051 - DNA, 22 bp, Homo sapiens
tagatgtgttgcctggagttgt

SEQ ID NO: 99052 - DNA, 22 bp, Homo sapiens
agatgtgtttctagttcctgca

SEQ ID NO: 99053 - DNA, 22 bp, Homo sapiens
catgtgtccacccttgaacaca

SEQ ID NO: 99054 - DNA, 22 bp, Homo sapiens
ggttgtagttggaggttgtata

SEQ ID NO: 99055 - DNA, 22 bp, Homo sapiens
gcagctgacatctggctgggcc

SEQ ID NO: 99056 - DNA, 22 bp, Homo sapiens
cgagagatgggttggcaggggc

SEQ ID NO: 99057 - DNA, 22 bp, Homo sapiens
gaagaaagatcaaatagtttcc

SEQ ID NO: 99058 - DNA, 22 bp, Homo sapiens
ccagatgtccctctcaggtttg

SEQ ID NO: 99059 - DNA, 21 bp, Homo sapiens
tctgatggtagatgagatgtg

SEQ ID NO: 99060 - DNA, 22 bp, Homo sapiens
ttggcataccttagtggtggag

SEQ ID NO: 99061 - DNA, 22 bp, Homo sapiens
ttgtgggggctgccctgtacgg

SEQ ID NO: 99062 - DNA, 22 bp, Homo sapiens
ctctgtggtggagtgggtcacc

SEQ ID NO: 99063 - DNA, 22 bp, Homo sapiens
agaaatatgctgattagatgaa

SEQ ID NO: 99064 - DNA, 22 bp, Homo sapiens
tgtggcacatacacaggagggc

SEQ ID NO: 99065 - DNA, 22 bp, Homo sapiens
agaaaatttaaagagacacaca

SEQ ID NO: 99066 - DNA, 22 bp, Homo sapiens
taattgtaaagtagtagtacag

SEQ ID NO: 99067 - DNA, 22 bp, Homo sapiens
gggagctgaaggagccggcggg

SEQ ID NO: 99068 - DNA, 20 bp, Homo sapiens
caaatccctgctctgtgctg

SEQ ID NO: 99069 - DNA, 22 bp, Homo sapiens
caggtgttggaagggcagtggg

SEQ ID NO: 99070 - DNA, 22 bp, Homo sapiens
tgaagaaacgcagagaggtagg

SEQ ID NO: 99071 - DNA, 22 bp, Homo sapiens
atcaacatgtcataaagtgaaa

SEQ ID NO: 99072 - DNA, 22 bp, Homo sapiens
ggccctggcagccacgaaagcc

SEQ ID NO: 99073 - DNA, 22 bp, Homo sapiens
gggagctgagctggaagagaat

SEQ ID NO: 99074 - DNA, 22 bp, Homo sapiens
tgaatgtgatgctaaacatatg

SEQ ID NO: 99075 - DNA, 22 bp, Homo sapiens
tagaagaaagtgaagctgggga

SEQ ID NO: 99076 - DNA, 22 bp, Homo sapiens
gggagctggagctggaagactc

SEQ ID NO: 99077 - DNA, 22 bp, Homo sapiens
agggctctgagtgggaaagagg

SEQ ID NO: 99078 - DNA, 22 bp, Homo sapiens
gtgtcaggccctgcattatgtg

SEQ ID NO: 99079 - DNA, 22 bp, Homo sapiens
ataaaagatcccttctgagctc

SEQ ID NO: 99080 - DNA, 22 bp, Homo sapiens
gggggctccaggcgagaatgtg

SEQ ID NO: 99081 - DNA, 22 bp, Homo sapiens
ctggtctggctacccagcgaat

SEQ ID NO: 99082 - DNA, 22 bp, Homo sapiens
aggtggggaggagtgtctcttt

SEQ ID NO: 99083 - DNA, 17 bp, Homo sapiens
caggtgttctgtttttc

SEQ ID NO: 99084 - DNA, 22 bp, Homo sapiens
tacaaaaaattgatactgacga

SEQ ID NO: 99085 - DNA, 22 bp, Homo sapiens
ggagaagaggagctggaagcct

SEQ ID NO: 99086 - DNA, 19 bp, Homo sapiens
tggctctgtcgaaggcaca

SEQ ID NO: 99087 - DNA, 20 bp, Homo sapiens
ttcatgggagcaaagaggcc

SEQ ID NO: 99088 - DNA, 22 bp, Homo sapiens
gggtacagttcttccagtgtca

SEQ ID NO: 99089 - DNA, 22 bp, Homo sapiens
tgtgtcagaaggcaatggggat

SEQ ID NO: 99090 - DNA, 22 bp, Homo sapiens
aattgcaaattcagacttaaga

SEQ ID NO: 99091 - DNA, 22 bp, Homo sapiens
tggggtacttgtatcaaagcac

SEQ ID NO: 99092 - DNA, 22 bp, Homo sapiens
ggaagaaaggtggacaacaggt

SEQ ID NO: 99093 - DNA, 22 bp, Homo sapiens
gaggctgaggcaggaggatcac

SEQ ID NO: 99094 - DNA, 22 bp, Homo sapiens
gattgtggaagtcagtggttct

SEQ ID NO: 99095 - DNA, 22 bp, Homo sapiens
caggaggattgcttgaggccag

SEQ ID NO: 99096 - DNA, 22 bp, Homo sapiens
taatgtataacaaatactcatc

SEQ ID NO: 99097 - DNA, 22 bp, Homo sapiens
aggggttggacataagacagaa

SEQ ID NO: 99098 - DNA, 22 bp, Homo sapiens
aagaaatgctgatgttggatgg

SEQ ID NO: 99099 - DNA, 22 bp, Homo sapiens
ctggcaagaaatatatatctta

SEQ ID NO: 99100 - DNA, 22 bp, Homo sapiens
cgcaactcagcaacttaactgc

SEQ ID NO: 99101 - DNA, 22 bp, Homo sapiens
ctgggatccacgggctcccaag

SEQ ID NO: 99102 - DNA, 23 bp, Homo sapiens
agcttttaggtggaaatggcact

SEQ ID NO: 99103 - DNA, 22 bp, Homo sapiens
caagcttgtttctcctgggggt

SEQ ID NO: 99104 - DNA, 22 bp, Homo sapiens
tttaatgtagcgtgaaatgatt

SEQ ID NO: 99105 - DNA, 22 bp, Homo sapiens
atgtgtcaggtacactcattag

SEQ ID NO: 99106 - DNA, 22 bp, Homo sapiens
ggccagaagttggaaaagagcc

SEQ ID NO: 99107 - DNA, 22 bp, Homo sapiens
taatgtaaacacagagacagaa

SEQ ID NO: 99108 - DNA, 22 bp, Homo sapiens
tctgtggcccaagtgatggctg

SEQ ID NO: 99109 - DNA, 22 bp, Homo sapiens
gccatcatatcccctgtgacct

SEQ ID NO: 99110 - DNA, 22 bp, Homo sapiens
gagctcattcattcattgcctg

SEQ ID NO: 99111 - DNA, 23 bp, Homo sapiens
ttctgggctgtggaagcctcggg

SEQ ID NO: 99112 - DNA, 22 bp, Homo sapiens
atggagttctgccagcgctgct

SEQ ID NO: 99113 - DNA, 22 bp, Homo sapiens
ggtgacctcacctggtcccacc

SEQ ID NO: 99114 - DNA, 22 bp, Homo sapiens
atccccctcttggatggcggca

SEQ ID NO: 99115 - DNA, 22 bp, Homo sapiens
ggctcacgcaattatcccggcc

SEQ ID NO: 99116 - DNA, 22 bp, Homo sapiens
tgggcagggagctggaaccaca

SEQ ID NO: 99117 - DNA, 22 bp, Homo sapiens
ggagtgactcacagctgggaca

SEQ ID NO: 99118 - DNA, 22 bp, Homo sapiens
agcaccaaagtcctgttagggt

SEQ ID NO: 99119 - DNA, 22 bp, Homo sapiens
tgaggcaggagttcaggctgcg

SEQ ID NO: 99120 - DNA, 22 bp, Homo sapiens
ggctcaatgcaacttctgcctc

SEQ ID NO: 99121 - DNA, 22 bp, Homo sapiens
tctcagggctcagagctcaggc

SEQ ID NO: 99122 - DNA, 22 bp, Homo sapiens
agttggagtgaacatgagattg

SEQ ID NO: 99123 - DNA, 22 bp, Homo sapiens
catgtgtcttgctgccctccat

SEQ ID NO: 99124 - DNA, 20 bp, Homo sapiens
catgtgtcagttctcaccca

SEQ ID NO: 99125 - DNA, 23 bp, Homo sapiens
gcagccatgttcccgtctcagct

SEQ ID NO: 99126 - DNA, 22 bp, Homo sapiens
gaggcagaggttgttgcagtga

SEQ ID NO: 99127 - DNA, 22 bp, Homo sapiens
gaagcctcaacatctctgcgtc

SEQ ID NO: 99128 - DNA, 22 bp, Homo sapiens
tggggagtgatgcctcggataa

SEQ ID NO: 99129 - DNA, 22 bp, Homo sapiens
ggaggcagaatagagtgtgggt

SEQ ID NO: 99130 - DNA, 22 bp, Homo sapiens
tgaggcaggacttgcataaagt

SEQ ID NO: 99131 - DNA, 22 bp, Homo sapiens
caaccccactacacgttggaga

SEQ ID NO: 99132 - DNA, 22 bp, Homo sapiens
cccattgtggttgttgaggata

SEQ ID NO: 99133 - DNA, 22 bp, Homo sapiens
gattgtggaagtcagtggttct

SEQ ID NO: 99134 - DNA, 22 bp, Homo sapiens
caggaagaccagggctgtggct

SEQ ID NO: 99135 - DNA, 22 bp, Homo sapiens
agaggcaggaggttgacttgag

SEQ ID NO: 99136 - DNA, 22 bp, Homo sapiens
tgtggactcgcatggctgaggc

SEQ ID NO: 99137 - DNA, 21 bp, Homo sapiens
tgcaatccagcctgggcgaca

SEQ ID NO: 99138 - DNA, 19 bp, Homo sapiens
tctcaattctccccactgc

SEQ ID NO: 99139 - DNA, 22 bp, Homo sapiens
actttaattaatgaactgtggc

SEQ ID NO: 99140 - DNA, 22 bp, Homo sapiens
atcacaaaggtctcagagcaca

SEQ ID NO: 99141 - DNA, 22 bp, Homo sapiens
gcaaacaaggacatacatcctg

SEQ ID NO: 99142 - DNA, 22 bp, Homo sapiens
catttacatttaaggttaatat

SEQ ID NO: 99143 - DNA, 22 bp, Homo sapiens
caagaatcaacattatttagtg

SEQ ID NO: 99144 - DNA, 22 bp, Homo sapiens
ttggtccactgtgaaattggga

SEQ ID NO: 99145 - DNA, 22 bp, Homo sapiens
tacaaaaaattgatactgacga

SEQ ID NO: 99146 - DNA, 22 bp, Homo sapiens
ctctaatcctttgtccctgggt

SEQ ID NO: 99147 - DNA, 22 bp, Homo sapiens
taatttcagtgcaagctcacgg

SEQ ID NO: 99148 - DNA, 22 bp, Homo sapiens
atttcatactaaggctcaaaaa

SEQ ID NO: 99149 - DNA, 22 bp, Homo sapiens
agaatttcctatgagagattcc

SEQ ID NO: 99150 - DNA, 22 bp, Homo sapiens
tagaactacaagcattaaaagt

SEQ ID NO: 99151 - DNA, 22 bp, Homo sapiens
tttcataatactgtacatgaaa

SEQ ID NO: 99152 - DNA, 23 bp, Homo sapiens
aatatcaaggtgatgttcccaga

SEQ ID NO: 99153 - DNA, 22 bp, Homo sapiens
aagaatgagctcaaagatctta

SEQ ID NO: 99154 - DNA, 22 bp, Homo sapiens
tgtatgttgggtcaaagtacat

SEQ ID NO: 99155 - DNA, 22 bp, Homo sapiens
atggatttgcttatacacatgt

SEQ ID NO: 99156 - DNA, 22 bp, Homo sapiens
gtatagaaacccagaaagatag

SEQ ID NO: 99157 - DNA, 22 bp, Homo sapiens
catcagaacgtgagctccttgt

SEQ ID NO: 99158 - DNA, 22 bp, Homo sapiens
gaatttcacaaggtgaggataa

SEQ ID NO: 99159 - DNA, 22 bp, Homo sapiens
cagtcaccttgaggactcagac

SEQ ID NO: 99160 - DNA, 22 bp, Homo sapiens
gcaaaaagtagtgctggttagg

SEQ ID NO: 99161 - DNA, 22 bp, Homo sapiens
tcaaaattaaaccaacgtccag

SEQ ID NO: 99162 - DNA, 22 bp, Homo sapiens
ttgaataatatgcttcgttctc

SEQ ID NO: 99163 - DNA, 22 bp, Homo sapiens
atgaaatatcttgaagaaattc

SEQ ID NO: 99164 - DNA, 22 bp, Homo sapiens
taagagaatgttgtggctaggt

SEQ ID NO: 99165 - DNA, 22 bp, Homo sapiens
aaattgcaaaagtacttttagg

SEQ ID NO: 99166 - DNA, 22 bp, Homo sapiens
ttagtactgatagggtcaatca

SEQ ID NO: 99167 - DNA, 22 bp, Homo sapiens
ttttcatttttgtagatgcaag

SEQ ID NO: 99168 - DNA, 22 bp, Homo sapiens
aataaaatggtcagttttctca

SEQ ID NO: 99169 - DNA, 22 bp, Homo sapiens
ttaattctgcctttcatgtaac

SEQ ID NO: 99170 - DNA, 22 bp, Homo sapiens
agatctgagggtccaagggagg

SEQ ID NO: 99171 - DNA, 22 bp, Homo sapiens
aatcagaaattgagggtctggt

SEQ ID NO: 99172 - DNA, 22 bp, Homo sapiens
ggcgcacaatgtgcaggtttgt

SEQ ID NO: 99173 - DNA, 22 bp, Homo sapiens
attgaaaataaggccagaaaca

SEQ ID NO: 99174 - DNA, 22 bp, Homo sapiens
atggcatttgaatctgtctttt

SEQ ID NO: 99175 - DNA, 22 bp, Homo sapiens
acaactttgacccttgttctta

SEQ ID NO: 99176 - DNA, 22 bp, Homo sapiens
tgtacaatgctgaggtttgggg

SEQ ID NO: 99177 - DNA, 22 bp, Homo sapiens
tgtcaccatgcgaggctaattt

SEQ ID NO: 99178 - DNA, 22 bp, Homo sapiens
gtgaataaaacacctgccaaga

SEQ ID NO: 99179 - DNA, 22 bp, Homo sapiens
ctggatcatgggaaagggatca

SEQ ID NO: 99180 - DNA, 22 bp, Homo sapiens
ataaaatttgctactgttaaat

SEQ ID NO: 99181 - DNA, 22 bp, Homo sapiens
taattataacagttacatctta

SEQ ID NO: 99182 - DNA, 22 bp, Homo sapiens
atggatcagaatcccgggaggg

SEQ ID NO: 99183 - DNA, 22 bp, Homo sapiens
aaaactgaaatacgatccaatg

SEQ ID NO: 99184 - DNA, 22 bp, Homo sapiens
gaataatcatgaaattcagtga

SEQ ID NO: 99185 - DNA, 22 bp, Homo sapiens
tgtccttatctccaaacaatca

SEQ ID NO: 99186 - DNA, 22 bp, Homo sapiens
ttaataaagtatgaattggaaa

SEQ ID NO: 99187 - DNA, 22 bp, Homo sapiens
tcaccgtcgggggtcgctgtct

SEQ ID NO: 99188 - DNA, 22 bp, Homo sapiens
aatattatcaaaagctttttca

SEQ ID NO: 99189 - DNA, 22 bp, Homo sapiens
atgaaaacggaccagagctatt

SEQ ID NO: 99190 - DNA, 22 bp, Homo sapiens
atacataattacttccgatgtt

SEQ ID NO: 99191 - DNA, 22 bp, Homo sapiens
tggttttagggaatcaatctat

SEQ ID NO: 99192 - DNA, 22 bp, Homo sapiens
tccaaagtgttgggattatagg

SEQ ID NO: 99193 - DNA, 22 bp, Homo sapiens
tgatttatgcattatactgttg

SEQ ID NO: 99194 - DNA, 22 bp, Homo sapiens
cccagctcttcaagtcaccccc

SEQ ID NO: 99195 - DNA, 22 bp, Homo sapiens
cacccaggttggagtgcagtgg

SEQ ID NO: 99196 - DNA, 22 bp, Homo sapiens
attataggcttgagccaccgtg

SEQ ID NO: 99197 - DNA, 22 bp, Homo sapiens
atgggtaaagcaggaagagagt

SEQ ID NO: 99198 - DNA, 22 bp, Homo sapiens
tggactaaagaggaagcaaata

SEQ ID NO: 99199 - DNA, 20 bp, Homo sapiens
agacaccccctgacagggaa

SEQ ID NO: 99200 - DNA, 22 bp, Homo sapiens
tccttaggaaaatgatgagggg

SEQ ID NO: 99201 - DNA, 22 bp, Homo sapiens
tgtcaagccccagctgtcacgc

SEQ ID NO: 99202 - DNA, 22 bp, Homo sapiens
ttctcttacattttctcagcct

SEQ ID NO: 99203 - DNA, 19 bp, Homo sapiens
atgtacccagtgtcaatcc

SEQ ID NO: 99204 - DNA, 22 bp, Homo sapiens
ccctgccttgtctgggctaggt

SEQ ID NO: 99205 - DNA, 22 bp, Homo sapiens
tctcaagcttgttggtatgttt

SEQ ID NO: 99206 - DNA, 22 bp, Homo sapiens
ggaggtagcctcaaaagcagct

SEQ ID NO: 99207 - DNA, 22 bp, Homo sapiens
cctgtctctgcagggccctgcc

SEQ ID NO: 99208 - DNA, 22 bp, Homo sapiens
gggcaggggtcagtggccccaa

SEQ ID NO: 99209 - DNA, 22 bp, Homo sapiens
ttggggtcccacaggctgcctg

SEQ ID NO: 99210 - DNA, 22 bp, Homo sapiens
tgttcttgagcctttagaccta

SEQ ID NO: 99211 - DNA, 22 bp, Homo sapiens
tcatctaagagtcttacattta

SEQ ID NO: 99212 - DNA, 22 bp, Homo sapiens
tcagtgcagggtgggagagaga

SEQ ID NO: 99213 - DNA, 22 bp, Homo sapiens
ggctcagatggtttgttctaga

SEQ ID NO: 99214 - DNA, 22 bp, Homo sapiens
agacactgttctcacatgcttg

SEQ ID NO: 99215 - DNA, 22 bp, Homo sapiens
aaaggctttaaaatgtacatat

SEQ ID NO: 99216 - DNA, 22 bp, Homo sapiens
acacatggtctacttcttctca

SEQ ID NO: 99217 - DNA, 22 bp, Homo sapiens
gccccgcgcctggctccaggtg

SEQ ID NO: 99218 - DNA, 23 bp, Homo sapiens
tgaggcaggcggatcacgaggtc

SEQ ID NO: 99219 - DNA, 22 bp, Homo sapiens
aagtcagacagctgagctgcct

SEQ ID NO: 99220 - DNA, 22 bp, Homo sapiens
gtgtaagtatctttgtatcttt

SEQ ID NO: 99221 - DNA, 22 bp, Homo sapiens
acagaagcctttggccatttga

SEQ ID NO: 99222 - DNA, 22 bp, Homo sapiens
agggctggagccacagctggga

SEQ ID NO: 99223 - DNA, 21 bp, Homo sapiens
ttctcctaggctgaggcggga

SEQ ID NO: 99224 - DNA, 22 bp, Homo sapiens
tgggaagaggggtataaagaag

SEQ ID NO: 99225 - DNA, 22 bp, Homo sapiens
tgccaggcgtggtggtgcgcac

SEQ ID NO: 99226 - DNA, 22 bp, Homo sapiens
tttttccacataccctaggcca

SEQ ID NO: 99227 - DNA, 22 bp, Homo sapiens
cagtaatagaggctttgagtct

SEQ ID NO: 99228 - DNA, 21 bp, Homo sapiens
aataagatggtatttggaggt

SEQ ID NO: 99229 - DNA, 22 bp, Homo sapiens
gtctttatttgagattgtcatt

SEQ ID NO: 99230 - DNA, 22 bp, Homo sapiens
gggagctggagctggaagactc

SEQ ID NO: 99231 - DNA, 22 bp, Homo sapiens
ttcagcagtgcagacacccagt

SEQ ID NO: 99232 - DNA, 22 bp, Homo sapiens
tatcagtccagggttttgtgac

SEQ ID NO: 99233 - DNA, 22 bp, Homo sapiens
ttatttttaaaagttcacacag

SEQ ID NO: 99234 - DNA, 16 bp, Homo sapiens
gcgcctcctcggcctc

SEQ ID NO: 99235 - DNA, 22 bp, Homo sapiens
aaggcaggatgggaaaagattt

SEQ ID NO: 99236 - DNA, 22 bp, Homo sapiens
gtataggtgagggacttgatca

SEQ ID NO: 99237 - DNA, 22 bp, Homo sapiens
tggagaagattggtcaccattc

SEQ ID NO: 99238 - DNA, 22 bp, Homo sapiens
tagcagcatttttgtagagtat

SEQ ID NO: 99239 - DNA, 22 bp, Homo sapiens
ctttggcaatgtcattttcaat

SEQ ID NO: 99240 - DNA, 22 bp, Homo sapiens
atttattcctttatggctggag

SEQ ID NO: 99241 - DNA, 22 bp, Homo sapiens
gggcagagagctggaactcctt

SEQ ID NO: 99242 - DNA, 22 bp, Homo sapiens
gactttgctgtgtcagcttcag

SEQ ID NO: 99243 - DNA, 22 bp, Homo sapiens
atgttggagtcgtaaggcatgg

SEQ ID NO: 99244 - DNA, 22 bp, Homo sapiens
tgtgggtggcatcgtcctggcc

SEQ ID NO: 99245 - DNA, 22 bp, Homo sapiens
gtcgtggagctcacagtgtgcc

SEQ ID NO: 99246 - DNA, 23 bp, Homo sapiens
ggagtgcaatggcgccatctcgg

SEQ ID NO: 99247 - DNA, 22 bp, Homo sapiens
ccaggctgctgttggtgtccgc

SEQ ID NO: 99248 - DNA, 22 bp, Homo sapiens
ggggttaacagtattgctcatg

SEQ ID NO: 99249 - DNA, 22 bp, Homo sapiens
aatgttgcagagtgattgtcca

SEQ ID NO: 99250 - DNA, 22 bp, Homo sapiens
ggtgttgcagttgaagactggt

SEQ ID NO: 99251 - DNA, 22 bp, Homo sapiens
tgctatgttgcccagggtggcc

SEQ ID NO: 99252 - DNA, 22 bp, Homo sapiens
gaggcagaagttgcagtgagca

SEQ ID NO: 99253 - DNA, 21 bp, Homo sapiens
ccaggccaggcctacggggat

SEQ ID NO: 99254 - DNA, 22 bp, Homo sapiens
agaaatatgctgattagatgaa

SEQ ID NO: 99255 - DNA, 22 bp, Homo sapiens
cgccaggcttggtagctcatgc

SEQ ID NO: 99256 - DNA, 22 bp, Homo sapiens
tcccccaggctggagtgcagtg

SEQ ID NO: 99257 - DNA, 22 bp, Homo sapiens
ataaaagatcccttctgagctc

SEQ ID NO: 99258 - DNA, 22 bp, Homo sapiens
tagtgtctcttcctgtttgaaa

SEQ ID NO: 99259 - DNA, 22 bp, Homo sapiens
caccaagaatcttcacttttta

SEQ ID NO: 99260 - DNA, 22 bp, Homo sapiens
aagcgccatggttcctgcgcag

SEQ ID NO: 99261 - DNA, 19 bp, Homo sapiens
tcctgcctggggccgcctg

SEQ ID NO: 99262 - DNA, 22 bp, Homo sapiens
tcttgaacttctgcacactcag

SEQ ID NO: 99263 - DNA, 22 bp, Homo sapiens
cagatcaaacaaaatgggttag

SEQ ID NO: 99264 - DNA, 22 bp, Homo sapiens
aggtattattagcatctctatt

SEQ ID NO: 99265 - DNA, 22 bp, Homo sapiens
agacagggtgatcgcttgagcc

SEQ ID NO: 99266 - DNA, 19 bp, Homo sapiens
catctggatgattctcctg

SEQ ID NO: 99267 - DNA, 22 bp, Homo sapiens
atacagggacatccagtttttc

SEQ ID NO: 99268 - DNA, 19 bp, Homo sapiens
acacagggatcagagggtt

SEQ ID NO: 99269 - DNA, 22 bp, Homo sapiens
tgcaaagttgaggaaggcatgg

SEQ ID NO: 99270 - DNA, 22 bp, Homo sapiens
atacttctttagcatattgaac

SEQ ID NO: 99271 - DNA, 22 bp, Homo sapiens
taagtcaaggtggcatttgaga

SEQ ID NO: 99272 - DNA, 22 bp, Homo sapiens
aaatgcacaaagattttgcact

SEQ ID NO: 99273 - DNA, 22 bp, Homo sapiens
ccaaagtgctaggattacaggc

SEQ ID NO: 99274 - DNA, 22 bp, Homo sapiens
tgggaggccgaggcaggtggat

SEQ ID NO: 99275 - DNA, 22 bp, Homo sapiens
gagaacagaagcattcctaatt

SEQ ID NO: 99276 - DNA, 22 bp, Homo sapiens
cactgcactccagcctgggtga

SEQ ID NO: 99277 - DNA, 22 bp, Homo sapiens
gacaggtgctaagggacctggc

SEQ ID NO: 99278 - DNA, 22 bp, Homo sapiens
agcactgatttaaactggattt

SEQ ID NO: 99279 - DNA, 22 bp, Homo sapiens
ctgccaggattctgtgaacccc

SEQ ID NO: 99280 - DNA, 22 bp, Homo sapiens
tgttgcccaggttctctcctgc

SEQ ID NO: 99281 - DNA, 22 bp, Homo sapiens
atgggttcaagtgattctcctg

SEQ ID NO: 99282 - DNA, 21 bp, Homo sapiens
tactgtagccttgcactgtag

SEQ ID NO: 99283 - DNA, 22 bp, Homo sapiens
atgtaaactactgactacacta

SEQ ID NO: 99284 - DNA, 22 bp, Homo sapiens
cacccaggctggagagcagtgg

SEQ ID NO: 99285 - DNA, 22 bp, Homo sapiens
atcttcccaggctggggagagg

SEQ ID NO: 99286 - DNA, 22 bp, Homo sapiens
gctgcagggagctggaaggctc

SEQ ID NO: 99287 - DNA, 22 bp, Homo sapiens
accctccccaagaggtcgtgcc

SEQ ID NO: 99288 - DNA, 22 bp, Homo sapiens
tattcatagtaaacaaaagtgg

SEQ ID NO: 99289 - DNA, 22 bp, Homo sapiens
ctccaggccatggctgcggagg

SEQ ID NO: 99290 - DNA, 22 bp, Homo sapiens
tctatgtctcgacccaagacaa

SEQ ID NO: 99291 - DNA, 22 bp, Homo sapiens
cctgcctatgagacgttttgcc

SEQ ID NO: 99292 - DNA, 22 bp, Homo sapiens
ccaaagtgctaggattacaggt

SEQ ID NO: 99293 - DNA, 22 bp, Homo sapiens
cttgtgcatttcattcctcagg

SEQ ID NO: 99294 - DNA, 22 bp, Homo sapiens
tgggcaggggccctgcttccgt

SEQ ID NO: 99295 - DNA, 22 bp, Homo sapiens
taacaatacccattctaattac

SEQ ID NO: 99296 - DNA, 22 bp, Homo sapiens
tcctcattcttggtgcatcaaa

SEQ ID NO: 99297 - DNA, 22 bp, Homo sapiens
cactgcactccagcttgggtga

SEQ ID NO: 99298 - DNA, 22 bp, Homo sapiens
agaggaggctctgggatcgtcc

SEQ ID NO: 99299 - DNA, 22 bp, Homo sapiens
ggaggtggaggttgcagtgagc

SEQ ID NO: 99300 - DNA, 22 bp, Homo sapiens
ccaggaggttgaggctgcagtg

SEQ ID NO: 99301 - DNA, 22 bp, Homo sapiens
cactctgcagctgaagggctgg

SEQ ID NO: 99302 - DNA, 22 bp, Homo sapiens
ggcctgggctccgggagttact

SEQ ID NO: 99303 - DNA, 20 bp, Homo sapiens
ataaaataactgccacaaga

SEQ ID NO: 99304 - DNA, 22 bp, Homo sapiens
aaaactacatttgacattttgt

SEQ ID NO: 99305 - DNA, 22 bp, Homo sapiens
aagggaatgttgtggttggttt

SEQ ID NO: 99306 - DNA, 22 bp, Homo sapiens
taatgcacatagaagtacttag

SEQ ID NO: 99307 - DNA, 22 bp, Homo sapiens
cttcttgctgggggcctcagtg

SEQ ID NO: 99308 - DNA, 22 bp, Homo sapiens
tcactcaggctggagtgcagtg

SEQ ID NO: 99309 - DNA, 22 bp, Homo sapiens
tcactgcgcttcagcctgggtg

SEQ ID NO: 99310 - DNA, 22 bp, Homo sapiens
agcccaggctggagtgcagtgg

SEQ ID NO: 99311 - DNA, 22 bp, Homo sapiens
gtccaagagtcaagaagggggc

SEQ ID NO: 99312 - DNA, 22 bp, Homo sapiens
gcaggctgtctaaagttagagt

SEQ ID NO: 99313 - DNA, 22 bp, Homo sapiens
agtaatcaatttttcggtggat

SEQ ID NO: 99314 - DNA, 22 bp, Homo sapiens
gaaagacatagttgcaagatgg

SEQ ID NO: 99315 - DNA, 22 bp, Homo sapiens
gggggaagaaagaacatggcat

SEQ ID NO: 99316 - DNA, 22 bp, Homo sapiens
ctgcactgacttccccggctgc

SEQ ID NO: 99317 - DNA, 22 bp, Homo sapiens
gacagacacaattgatccatga

SEQ ID NO: 99318 - DNA, 22 bp, Homo sapiens
tgacacccatctgtgccagtcc

SEQ ID NO: 99319 - DNA, 22 bp, Homo sapiens
tgaattccatcctgttgcaacc

SEQ ID NO: 99320 - DNA, 22 bp, Homo sapiens
gggcagagactcagaaacagaa

SEQ ID NO: 99321 - DNA, 22 bp, Homo sapiens
ccagctttatagcttcaaagga

SEQ ID NO: 99322 - DNA, 17 bp, Homo sapiens
ggctgcagtccaggagg

SEQ ID NO: 99323 - DNA, 22 bp, Homo sapiens
tgaggcaggagttcaggctgcg

SEQ ID NO: 99324 - DNA, 22 bp, Homo sapiens
gggcagatcacctgaggtcagg

SEQ ID NO: 99325 - DNA, 22 bp, Homo sapiens
gggcggatcatttgaggtcagg

SEQ ID NO: 99326 - DNA, 17 bp, Homo sapiens
gggcagggactcctggg

SEQ ID NO: 99327 - DNA, 22 bp, Homo sapiens
gatagtcacctcccttaacttt

SEQ ID NO: 99328 - DNA, 22 bp, Homo sapiens
ggctcacgcaattatcccggcc

SEQ ID NO: 99329 - DNA, 22 bp, Homo sapiens
tgtctggtgggttgacaggcag

SEQ ID NO: 99330 - DNA, 22 bp, Homo sapiens
ttgtgctctgtgttatttaagg

SEQ ID NO: 99331 - DNA, 22 bp, Homo sapiens
atgtatatgcatgcattcaaag

SEQ ID NO: 99332 - DNA, 22 bp, Homo sapiens
tctgcatattgttaatggaatg

SEQ ID NO: 99333 - DNA, 22 bp, Homo sapiens
ttgccaggctggagtgcagtgg

SEQ ID NO: 99334 - DNA, 23 bp, Homo sapiens
acagcaagaggaccagatgtgag

SEQ ID NO: 99335 - DNA, 22 bp, Homo sapiens
cctgggaggctgaggctgcagt

SEQ ID NO: 99336 - DNA, 22 bp, Homo sapiens
atcttgttaaaaagcagattct

SEQ ID NO: 99337 - DNA, 22 bp, Homo sapiens
acatttatataactcactagga

SEQ ID NO: 99338 - DNA, 22 bp, Homo sapiens
tcccgcatgccgccggtgaaca

SEQ ID NO: 99339 - DNA, 22 bp, Homo sapiens
gggagctgagctggaagagaat

SEQ ID NO: 99340 - DNA, 22 bp, Homo sapiens
attgtactctagcctctgggca

SEQ ID NO: 99341 - DNA, 22 bp, Homo sapiens
aatggaatacctaggtggccca

SEQ ID NO: 99342 - DNA, 22 bp, Homo sapiens
ctgtatctgtgttggatgagtt

SEQ ID NO: 99343 - DNA, 22 bp, Homo sapiens
agaaagagatgaatgctttaag

SEQ ID NO: 99344 - DNA, 22 bp, Homo sapiens
tgtcttcagcagtcatctgggg

SEQ ID NO: 99345 - DNA, 22 bp, Homo sapiens
agcattccacactgaagtctgc

SEQ ID NO: 99346 - DNA, 22 bp, Homo sapiens
ggtgagttctcagcttattgca

SEQ ID NO: 99347 - DNA, 22 bp, Homo sapiens
atttttctctttccactgagat

SEQ ID NO: 99348 - DNA, 22 bp, Homo sapiens
ctgaggaggctaatttgaggat

SEQ ID NO: 99349 - DNA, 20 bp, Homo sapiens
gctgaggggtctatggcata

SEQ ID NO: 99350 - DNA, 22 bp, Homo sapiens
tggtggggccagacttcagctc

SEQ ID NO: 99351 - DNA, 22 bp, Homo sapiens
attgtactccagcctgggtgac

SEQ ID NO: 99352 - DNA, 22 bp, Homo sapiens
gaggaggcttccgggaggcacg

SEQ ID NO: 99353 - DNA, 22 bp, Homo sapiens
tacagcctggcactaccctggg

SEQ ID NO: 99354 - DNA, 22 bp, Homo sapiens
catccaggctgaagtgcagtgg

SEQ ID NO: 99355 - DNA, 22 bp, Homo sapiens
tgacttgtctctttgggagaca

SEQ ID NO: 99356 - DNA, 22 bp, Homo sapiens
agtattctggaattctatgtga

SEQ ID NO: 99357 - DNA, 22 bp, Homo sapiens
tttctcctcatgactggttgtg

SEQ ID NO: 99358 - DNA, 22 bp, Homo sapiens
gtctatatattgcttgaataat

SEQ ID NO: 99359 - DNA, 22 bp, Homo sapiens
tcagaacatgtttgagtaagac

SEQ ID NO: 99360 - DNA, 22 bp, Homo sapiens
aagatacagacagagccaaaat

SEQ ID NO: 99361 - DNA, 22 bp, Homo sapiens
caaagggaaaagccatgtgggc

SEQ ID NO: 99362 - DNA, 22 bp, Homo sapiens
agcaagattgaggcttcctcag

SEQ ID NO: 99363 - DNA, 22 bp, Homo sapiens
ggcagacctctccagccccaca

SEQ ID NO: 99364 - DNA, 22 bp, Homo sapiens
gagatgggcgagaaggtggact

SEQ ID NO: 99365 - DNA, 22 bp, Homo sapiens
ttggaaacgtcaccttttcctt

SEQ ID NO: 99366 - DNA, 22 bp, Homo sapiens
gtgatatcttacaattctcttt

SEQ ID NO: 99367 - DNA, 22 bp, Homo sapiens
tgcttttagctagtaactagta

SEQ ID NO: 99368 - DNA, 19 bp, Homo sapiens
gggcttggggctgaagcct

SEQ ID NO: 99369 - DNA, 22 bp, Homo sapiens
cttggggcagcccaggctgagc

SEQ ID NO: 99370 - DNA, 22 bp, Homo sapiens
tcctcgatgggcaggaagatct

SEQ ID NO: 99371 - DNA, 22 bp, Homo sapiens
gggaggctctgctcagcccccg

SEQ ID NO: 99372 - DNA, 22 bp, Homo sapiens
agtgaaaacctaatcatgcagt

SEQ ID NO: 99373 - DNA, 22 bp, Homo sapiens
ttatttaaaagtggtaagattc

SEQ ID NO: 99374 - DNA, 22 bp, Homo sapiens
gtcagaggggcagctgccaggc

SEQ ID NO: 99375 - DNA, 18 bp, Homo sapiens
atggtctcatactgggag

SEQ ID NO: 99376 - DNA, 22 bp, Homo sapiens
ctagtgcaatgatgaatacaag

SEQ ID NO: 99377 - DNA, 22 bp, Homo sapiens
gtgggctgcccttgaggtcagc

SEQ ID NO: 99378 - DNA, 19 bp, Homo sapiens
gggaatgatggaagacttc

SEQ ID NO: 99379 - DNA, 22 bp, Homo sapiens
tgagccatgggactccaaggga

SEQ ID NO: 99380 - DNA, 22 bp, Homo sapiens
cagtggcaggatttcagctcag

SEQ ID NO: 99381 - DNA, 22 bp, Homo sapiens
tacccagtgccaccctctgagg

SEQ ID NO: 99382 - DNA, 22 bp, Homo sapiens
cacagggcttctcatggggtgc

SEQ ID NO: 99383 - DNA, 22 bp, Homo sapiens
tctagctctgcttatcatggct

SEQ ID NO: 99384 - DNA, 22 bp, Homo sapiens
agggctgcccagtgtgagagct

SEQ ID NO: 99385 - DNA, 19 bp, Homo sapiens
agcggttctcaaagtcagg

SEQ ID NO: 99386 - DNA, 22 bp, Homo sapiens
ctcgcatccaggataccctgag

SEQ ID NO: 99387 - DNA, 22 bp, Homo sapiens
ttttcaggctgatttgtgttag

SEQ ID NO: 99388 - DNA, 18 bp, Homo sapiens
tgtccctgcaaataacat

SEQ ID NO: 99389 - DNA, 22 bp, Homo sapiens
catcatactgtttacactcaaa

SEQ ID NO: 99390 - DNA, 22 bp, Homo sapiens
tccgggaggcagaggttgcagt

SEQ ID NO: 99391 - DNA, 22 bp, Homo sapiens
agtttgggtggaacagagtcgt

SEQ ID NO: 99392 - DNA, 22 bp, Homo sapiens
acaggcttacaggctgcaagta

SEQ ID NO: 99393 - DNA, 22 bp, Homo sapiens
ggaaggggtgggtgagcctcag

SEQ ID NO: 99394 - DNA, 22 bp, Homo sapiens
agggcactgcaagggttgaagg

SEQ ID NO: 99395 - DNA, 20 bp, Homo sapiens
ttgttgagctcttcaaagaa

SEQ ID NO: 99396 - DNA, 22 bp, Homo sapiens
gacaggaggcagagctcaggtg

SEQ ID NO: 99397 - DNA, 22 bp, Homo sapiens
cggtctcccgtgtgtgtgcgct

SEQ ID NO: 99398 - DNA, 22 bp, Homo sapiens
attgcacttcagcctgggtgac

SEQ ID NO: 99399 - DNA, 22 bp, Homo sapiens
aaggctgaggcagtgaggcaga

SEQ ID NO: 99400 - DNA, 22 bp, Homo sapiens
cttccctctgctccttggtcca

SEQ ID NO: 99401 - DNA, 23 bp, Homo sapiens
tgcaatggcatgatttcagctca

SEQ ID NO: 99402 - DNA, 22 bp, Homo sapiens
ataaaatttgctactgttaaat

SEQ ID NO: 99403 - DNA, 22 bp, Homo sapiens
tttctttatcatagcatctttg

SEQ ID NO: 99404 - DNA, 21 bp, Homo sapiens
ggtgacacgtggccccgctct

SEQ ID NO: 99405 - DNA, 22 bp, Homo sapiens
ggctctgtgtctccacccaaat

SEQ ID NO: 99406 - DNA, 22 bp, Homo sapiens
gcaaaagtacagccggatttct

SEQ ID NO: 99407 - DNA, 22 bp, Homo sapiens
ttctatttttgtggaactgtag

SEQ ID NO: 99408 - DNA, 22 bp, Homo sapiens
tcttcaggtagtgagtggggtg

SEQ ID NO: 99409 - DNA, 22 bp, Homo sapiens
tgctatgtcgaaagggccatta

SEQ ID NO: 99410 - DNA, 22 bp, Homo sapiens
aaatgcaacgggctttccttat

SEQ ID NO: 99411 - DNA, 22 bp, Homo sapiens
tacatttataaggcttctctgt

SEQ ID NO: 99412 - DNA, 22 bp, Homo sapiens
tcagcagtgagaattaatgttg

SEQ ID NO: 99413 - DNA, 22 bp, Homo sapiens
ttttcatttttgtagatgcaag

SEQ ID NO: 99414 - DNA, 22 bp, Homo sapiens
caggaattcatagcattgttct

SEQ ID NO: 99415 - DNA, 22 bp, Homo sapiens
catataaatacaacatgtgtta

SEQ ID NO: 99416 - DNA, 22 bp, Homo sapiens
tgatgcctaatatacttcaatt

SEQ ID NO: 99417 - DNA, 22 bp, Homo sapiens
agctgattccactttttcccca

SEQ ID NO: 99418 - DNA, 22 bp, Homo sapiens
ggggaaggaaagttattagcag

SEQ ID NO: 99419 - DNA, 22 bp, Homo sapiens
aagtggcagttcaggaagcaga

SEQ ID NO: 99420 - DNA, 22 bp, Homo sapiens
ctgtggctctcagaggctgctg

SEQ ID NO: 99421 - DNA, 22 bp, Homo sapiens
cactgcactccatcctgggaaa

SEQ ID NO: 99422 - DNA, 22 bp, Homo sapiens
acaattctgatggtttcccagt

SEQ ID NO: 99423 - DNA, 22 bp, Homo sapiens
caagggctcaaacggtggttgc

SEQ ID NO: 99424 - DNA, 22 bp, Homo sapiens
gcacagagagggaaggtaactt

SEQ ID NO: 99425 - DNA, 22 bp, Homo sapiens
actttcttggtcccatgtttga

SEQ ID NO: 99426 - DNA, 20 bp, Homo sapiens
ggcagagggcctgggagaag

SEQ ID NO: 99427 - DNA, 22 bp, Homo sapiens
ttacatgtttatgggggtacat

SEQ ID NO: 99428 - DNA, 22 bp, Homo sapiens
ggccagaagttggaaaagagcc

SEQ ID NO: 99429 - DNA, 22 bp, Homo sapiens
ccattgtaaattctgtggaagt

SEQ ID NO: 99430 - DNA, 22 bp, Homo sapiens
cacagctgaagtagccatgtgg

SEQ ID NO: 99431 - DNA, 22 bp, Homo sapiens
catctaagatactctctgtcac

SEQ ID NO: 99432 - DNA, 22 bp, Homo sapiens
cacccaggctggagtgcagtga

SEQ ID NO: 99433 - DNA, 22 bp, Homo sapiens
ctgctcagtaatagtcctatct

SEQ ID NO: 99434 - DNA, 22 bp, Homo sapiens
cgccgcctgctgcagcagctgt

SEQ ID NO: 99435 - DNA, 22 bp, Homo sapiens
caaatgtataaatgtactttct

SEQ ID NO: 99436 - DNA, 22 bp, Homo sapiens
cgtcatcacggcaagcatctcc

SEQ ID NO: 99437 - DNA, 22 bp, Homo sapiens
tatgcacaacatgcaggtttgt

SEQ ID NO: 99438 - DNA, 22 bp, Homo sapiens
ggcatagatttctttaggttta

SEQ ID NO: 99439 - DNA, 22 bp, Homo sapiens
agcgctgtgggcgtgcgaggag

SEQ ID NO: 99440 - DNA, 22 bp, Homo sapiens
ttctgtggttgaaaggagagat

SEQ ID NO: 99441 - DNA, 22 bp, Homo sapiens
ctgcaccgtgtctcgggctgcc

SEQ ID NO: 99442 - DNA, 22 bp, Homo sapiens
agcctgggccctgcctcttctc

SEQ ID NO: 99443 - DNA, 22 bp, Homo sapiens
aggcaggaggatcatggatgca

SEQ ID NO: 99444 - DNA, 22 bp, Homo sapiens
agtgctgtctccttcccccggg

SEQ ID NO: 99445 - DNA, 22 bp, Homo sapiens
gctgtggcctggcgcagagctg

SEQ ID NO: 99446 - DNA, 23 bp, Homo sapiens
agcagccagagatcctcggccct

SEQ ID NO: 99447 - DNA, 22 bp, Homo sapiens
ctgctttaaaactgatacatga

SEQ ID NO: 99448 - DNA, 22 bp, Homo sapiens
ctacattaaattggcttactta

SEQ ID NO: 99449 - DNA, 22 bp, Homo sapiens
cggggaagcggttctggcggta

SEQ ID NO: 99450 - DNA, 22 bp, Homo sapiens
agaagtatcaggaagattctca

SEQ ID NO: 99451 - DNA, 22 bp, Homo sapiens
ggaggtaaagtaactcgcccag

SEQ ID NO: 99452 - DNA, 22 bp, Homo sapiens
ggagagggtaggggtcctgccc

SEQ ID NO: 99453 - DNA, 22 bp, Homo sapiens
gggcgcatcacctgaggtcagg

SEQ ID NO: 99454 - DNA, 22 bp, Homo sapiens
gtcgtggtcagacaccagaaaa

SEQ ID NO: 99455 - DNA, 20 bp, Homo sapiens
ttgttagaggaatgccatag

SEQ ID NO: 99456 - DNA, 22 bp, Homo sapiens
accaggcccgctgctatggtgg

SEQ ID NO: 99457 - DNA, 22 bp, Homo sapiens
tgggaagggtcaacagctggaa

SEQ ID NO: 99458 - DNA, 22 bp, Homo sapiens
gtgggcggggcctctcaagctg

SEQ ID NO: 99459 - DNA, 22 bp, Homo sapiens
cggcatccccacttcctcctgc

SEQ ID NO: 99460 - DNA, 22 bp, Homo sapiens
caggctggagttcagtggtgtg

SEQ ID NO: 99461 - DNA, 22 bp, Homo sapiens
tgggaaagtctttatttctctt

SEQ ID NO: 99462 - DNA, 22 bp, Homo sapiens
aagaataagaggatttagaaca

SEQ ID NO: 99463 - DNA, 20 bp, Homo sapiens
taagcatagttgtcagggtc

SEQ ID NO: 99464 - DNA, 22 bp, Homo sapiens
atggaatgtttatacacagttg

SEQ ID NO: 99465 - DNA, 22 bp, Homo sapiens
gaaggaagtcattagtgcagac

SEQ ID NO: 99466 - DNA, 20 bp, Homo sapiens
gggcagtggcgctatctcag

SEQ ID NO: 99467 - DNA, 22 bp, Homo sapiens
cctggaggcggaggttgcagtg

SEQ ID NO: 99468 - DNA, 22 bp, Homo sapiens
tcactgtagcctcaactcttgg

SEQ ID NO: 99469 - DNA, 22 bp, Homo sapiens
acaggggcaagggctcacggcc

SEQ ID NO: 99470 - DNA, 22 bp, Homo sapiens
atgccaggaacaaacagtggtg

SEQ ID NO: 99471 - DNA, 22 bp, Homo sapiens
gctggaggatggactggaagaa

SEQ ID NO: 99472 - DNA, 19 bp, Homo sapiens
cccaggaagcggaggttgc

SEQ ID NO: 99473 - DNA, 22 bp, Homo sapiens
aagcatttcaggtagagatatt

SEQ ID NO: 99474 - DNA, 22 bp, Homo sapiens
cttagagatgggttttacttag

SEQ ID NO: 99475 - DNA, 22 bp, Homo sapiens
tgggcagggagctggaaccaca

SEQ ID NO: 99476 - DNA, 19 bp, Homo sapiens
ccctcttgcacaaagcaaa

SEQ ID NO: 99477 - DNA, 22 bp, Homo sapiens
aaatggaagctatttatgattc

SEQ ID NO: 99478 - DNA, 22 bp, Homo sapiens
ctcagcactgacccaggagatg

SEQ ID NO: 99479 - DNA, 22 bp, Homo sapiens
attttctatgttgtaattgtta

SEQ ID NO: 99480 - DNA, 18 bp, Homo sapiens
tgagaggctattttttgc

SEQ ID NO: 99481 - DNA, 22 bp, Homo sapiens
attcttcctcatcaatctgtag

SEQ ID NO: 99482 - DNA, 22 bp, Homo sapiens
tggggtacttgtatcaaagcac

SEQ ID NO: 99483 - DNA, 22 bp, Homo sapiens
ggcagggcaggaaagtcaggaa

SEQ ID NO: 99484 - DNA, 22 bp, Homo sapiens
aagaagcattctttcattggtt

SEQ ID NO: 99485 - DNA, 22 bp, Homo sapiens
caaagtgctgggattacaggtg

SEQ ID NO: 99486 - DNA, 22 bp, Homo sapiens
tggactaaagaaacattccgtg

SEQ ID NO: 99487 - DNA, 22 bp, Homo sapiens
agaaaacataggagacaggaaa

SEQ ID NO: 99488 - DNA, 22 bp, Homo sapiens
ccagcttgaagatgtgctggtt

SEQ ID NO: 99489 - DNA, 22 bp, Homo sapiens
aatatgcactctgatttagcag

SEQ ID NO: 99490 - DNA, 21 bp, Homo sapiens
tcagtggctcctggtgacgtc

SEQ ID NO: 99491 - DNA, 22 bp, Homo sapiens
aggctcagatccttgtgtcctg

SEQ ID NO: 99492 - DNA, 22 bp, Homo sapiens
attgtggtgtcagttataggca

SEQ ID NO: 99493 - DNA, 22 bp, Homo sapiens
ttccatttggcacttcactgag

SEQ ID NO: 99494 - DNA, 21 bp, Homo sapiens
tcacgtggtcacatgagcttt

SEQ ID NO: 99495 - DNA, 22 bp, Homo sapiens
ttgcactccagcccgagcaaca

SEQ ID NO: 99496 - DNA, 22 bp, Homo sapiens
cgttttcatgggtagaggttct

SEQ ID NO: 99497 - DNA, 21 bp, Homo sapiens
gggcagaggggcctcctgggt

SEQ ID NO: 99498 - DNA, 19 bp, Homo sapiens
gatttaaacgtggctctat

SEQ ID NO: 99499 - DNA, 22 bp, Homo sapiens
gaatatcccgctatgcaaagta

SEQ ID NO: 99500 - DNA, 22 bp, Homo sapiens
ctcattgcccagatccccacag

SEQ ID NO: 99501 - DNA, 22 bp, Homo sapiens
agtcaaggtggaccagaaaaat

SEQ ID NO: 99502 - DNA, 22 bp, Homo sapiens
agccagggacgctgcaggctac

SEQ ID NO: 99503 - DNA, 22 bp, Homo sapiens
aaagcagaggttgcagtgagct

SEQ ID NO: 99504 - DNA, 22 bp, Homo sapiens
gcctggagaaaggaaggtggga

SEQ ID NO: 99505 - DNA, 22 bp, Homo sapiens
tttgaacagtagcttaggtgtg

SEQ ID NO: 99506 - DNA, 22 bp, Homo sapiens
gtttcaggttggacaacatgcc

SEQ ID NO: 99507 - DNA, 22 bp, Homo sapiens
gtgagtaaaggttcattgaatt

SEQ ID NO: 99508 - DNA, 22 bp, Homo sapiens
gagagtctaggaacctcatata

SEQ ID NO: 99509 - DNA, 22 bp, Homo sapiens
aggagctgtcagagtgccagag

SEQ ID NO: 99510 - DNA, 22 bp, Homo sapiens
atgaaaacggaccagagctatt

SEQ ID NO: 99511 - DNA, 22 bp, Homo sapiens
caggaaggcgcggctgtgcctg

SEQ ID NO: 99512 - DNA, 22 bp, Homo sapiens
acacggcactttaggaaggggc

SEQ ID NO: 99513 - DNA, 22 bp, Homo sapiens
aggtggggaggagtgtctcttt

SEQ ID NO: 99514 - DNA, 22 bp, Homo sapiens
cagatgtacatgaagggcaatg

SEQ ID NO: 99515 - DNA, 22 bp, Homo sapiens
gggaggttgaggctgcagtgag

SEQ ID NO: 99516 - DNA, 22 bp, Homo sapiens
caccaggctggagtgcagtggc

SEQ ID NO: 99517 - DNA, 22 bp, Homo sapiens
ggctctgcgcctgcggggactt

SEQ ID NO: 99518 - DNA, 22 bp, Homo sapiens
cagggccagcgtctcgggctat

SEQ ID NO: 99519 - DNA, 22 bp, Homo sapiens
gcagctgacatctggctgggcc

SEQ ID NO: 99520 - DNA, 22 bp, Homo sapiens
ttagggttacaccagcctcctg

SEQ ID NO: 99521 - DNA, 22 bp, Homo sapiens
gaggtgggcggatcacaaggtc

SEQ ID NO: 99522 - DNA, 22 bp, Homo sapiens
ctctggagtgtctggccagggt

SEQ ID NO: 99523 - DNA, 22 bp, Homo sapiens
agcaacacgcagtagtatacga

SEQ ID NO: 99524 - DNA, 22 bp, Homo sapiens
cactgcactccagcccgggcaa

SEQ ID NO: 99525 - DNA, 22 bp, Homo sapiens
ccaaagtgctgagattacaggt

SEQ ID NO: 99526 - DNA, 22 bp, Homo sapiens
aggtgacaggacaggagctggt

SEQ ID NO: 99527 - DNA, 22 bp, Homo sapiens
actcatgtaagcggaatgtagt

SEQ ID NO: 99528 - DNA, 22 bp, Homo sapiens
cccggacagaggggcagagtgt

SEQ ID NO: 99529 - DNA, 22 bp, Homo sapiens
ggaggagcatgagagggtagtg

SEQ ID NO: 99530 - DNA, 22 bp, Homo sapiens
ttacttaaacagaaatgcagaa

SEQ ID NO: 99531 - DNA, 22 bp, Homo sapiens
atgagctagaaaaccatgtgga

SEQ ID NO: 99532 - DNA, 22 bp, Homo sapiens
ggctcaatgcaacttctgcctc

SEQ ID NO: 99533 - DNA, 22 bp, Homo sapiens
gcgttggggaccccgaagctgg

SEQ ID NO: 99534 - DNA, 20 bp, Homo sapiens
agaattcccaagcatgacca

SEQ ID NO: 99535 - DNA, 22 bp, Homo sapiens
attgcactccggcctgggtgac

SEQ ID NO: 99536 - DNA, 22 bp, Homo sapiens
gggatgcagactacagggctta

SEQ ID NO: 99537 - DNA, 22 bp, Homo sapiens
ttggccatctaagcccagccac

SEQ ID NO: 99538 - DNA, 22 bp, Homo sapiens
tgcgttgcgctcctgcagcagg

SEQ ID NO: 99539 - DNA, 22 bp, Homo sapiens
ctcttagtaatgccatgaagca

SEQ ID NO: 99540 - DNA, 23 bp, Homo sapiens
tcagaacagttcttggtgcatag

SEQ ID NO: 99541 - DNA, 22 bp, Homo sapiens
tgaggcaggagaatcacatgaa

SEQ ID NO: 99542 - DNA, 22 bp, Homo sapiens
gattcactcatattttacgttt

SEQ ID NO: 99543 - DNA, 22 bp, Homo sapiens
tatgttaacatgttaggaactg

SEQ ID NO: 99544 - DNA, 20 bp, Homo sapiens
cagtgcattgcttctgattt

SEQ ID NO: 99545 - DNA, 22 bp, Homo sapiens
ccagaagcagagcctgaggcag

SEQ ID NO: 99546 - DNA, 22 bp, Homo sapiens
taacatttaaatttttcacata

SEQ ID NO: 99547 - DNA, 21 bp, Homo sapiens
taaacataaccttgtatggct

SEQ ID NO: 99548 - DNA, 22 bp, Homo sapiens
tatgtcactcggctcggcccac

SEQ ID NO: 99549 - DNA, 22 bp, Homo sapiens
taactctgaatcctcacagcag

SEQ ID NO: 99550 - DNA, 21 bp, Homo sapiens
cagggccaatcctgacctcta

SEQ ID NO: 99551 - DNA, 21 bp, Homo sapiens
aaactgaccttgcctgagaca

SEQ ID NO: 99552 - DNA, 22 bp, Homo sapiens
aggtcaccatggcatgctccac

SEQ ID NO: 99553 - DNA, 22 bp, Homo sapiens
agttctttgcatagatttggct

SEQ ID NO: 99554 - DNA, 22 bp, Homo sapiens
tatgccactgctctccatccta

SEQ ID NO: 99555 - DNA, 21 bp, Homo sapiens
tctgatggtagatgagatgtg

SEQ ID NO: 99556 - DNA, 22 bp, Homo sapiens
aggaatgacatagaaaggggag

SEQ ID NO: 99557 - DNA, 22 bp, Homo sapiens
tccctagtcgcatctgtggaga

SEQ ID NO: 99558 - DNA, 22 bp, Homo sapiens
gagagaagggggatatgagcct

SEQ ID NO: 99559 - DNA, 22 bp, Homo sapiens
ttgcccagagtcacccagctca

SEQ ID NO: 99560 - DNA, 22 bp, Homo sapiens
ggcaggaggtgagtggcgggtg

SEQ ID NO: 99561 - DNA, 22 bp, Homo sapiens
caggctggagtgcaatgacgcc

SEQ ID NO: 99562 - DNA, 22 bp, Homo sapiens
gagctgggcctgcgagtgctgc

SEQ ID NO: 99563 - DNA, 22 bp, Homo sapiens
taccttctaggtgatggttaca

SEQ ID NO: 99564 - DNA, 22 bp, Homo sapiens
gctcccaggatgaggagccagg

SEQ ID NO: 99565 - DNA, 22 bp, Homo sapiens
cccattcatcctcgcttccttc

SEQ ID NO: 99566 - DNA, 22 bp, Homo sapiens
caaagtgctaggattacaggcc

SEQ ID NO: 99567 - DNA, 22 bp, Homo sapiens
gcttcttgcctgtgtagagaat

SEQ ID NO: 99568 - DNA, 22 bp, Homo sapiens
tggagttggccgcccggaccga

SEQ ID NO: 99569 - DNA, 22 bp, Homo sapiens
ctgctaaacctctctgagagct

SEQ ID NO: 99570 - DNA, 21 bp, Homo sapiens
cggaaaggactagggctcaga

SEQ ID NO: 99571 - DNA, 22 bp, Homo sapiens
gcagctcaaaggccacggacgg

SEQ ID NO: 99572 - DNA, 22 bp, Homo sapiens
ttcagacaggcagctgggctgg

SEQ ID NO: 99573 - DNA, 17 bp, Homo sapiens
gtaaggcttgcagatgc

SEQ ID NO: 99574 - DNA, 22 bp, Homo sapiens
tctggctccaggaccgggcaca

SEQ ID NO: 99575 - DNA, 22 bp, Homo sapiens
taaaatttgtccctgagtgttg

SEQ ID NO: 99576 - DNA, 22 bp, Homo sapiens
tccataaattttatgaacatat

SEQ ID NO: 99577 - DNA, 22 bp, Homo sapiens
aggtggcagatgggggtgctcg

SEQ ID NO: 99578 - DNA, 22 bp, Homo sapiens
ccaaagtgctgggattacaggc

SEQ ID NO: 99579 - DNA, 22 bp, Homo sapiens
agtgcagtggttaggagccagg

SEQ ID NO: 99580 - DNA, 22 bp, Homo sapiens
ggggtgggcgtgcagggacacc

SEQ ID NO: 99581 - DNA, 21 bp, Homo sapiens
cgcagagcgaacttgcggcgc

SEQ ID NO: 99582 - DNA, 22 bp, Homo sapiens
tgcagattcaaatgaaatgcaa

SEQ ID NO: 99583 - DNA, 22 bp, Homo sapiens
agtagtcctactgaaggaatga

SEQ ID NO: 99584 - DNA, 23 bp, Homo sapiens
cagtgtgacaaaacttattactt

SEQ ID NO: 99585 - DNA, 22 bp, Homo sapiens
ttttctaacatctagtaatttg

SEQ ID NO: 99586 - DNA, 22 bp, Homo sapiens
gagcctggagctggaacgaagc

SEQ ID NO: 99587 - DNA, 22 bp, Homo sapiens
aggaatgacaggcctcccgcag

SEQ ID NO: 99588 - DNA, 22 bp, Homo sapiens
actcatgtcctaggagtaaagc

SEQ ID NO: 99589 - DNA, 22 bp, Homo sapiens
tgtgagttcttagaaagtcagt

SEQ ID NO: 99590 - DNA, 22 bp, Homo sapiens
ttctttgcccatgtttcctaag

SEQ ID NO: 99591 - DNA, 22 bp, Homo sapiens
gagggaaaggttaatacatgat

SEQ ID NO: 99592 - DNA, 21 bp, Homo sapiens
aggcttggatctagacaggcc

SEQ ID NO: 99593 - DNA, 22 bp, Homo sapiens
tgctatgtgtgccagggactgt

SEQ ID NO: 99594 - DNA, 22 bp, Homo sapiens
agggcactctgcagggaccacc

SEQ ID NO: 99595 - DNA, 22 bp, Homo sapiens
ctccagattccgtttattcagg

SEQ ID NO: 99596 - DNA, 18 bp, Homo sapiens
gcagctagccaggggggc

SEQ ID NO: 99597 - DNA, 22 bp, Homo sapiens
tacaaaaaattgatactgacga

SEQ ID NO: 99598 - DNA, 22 bp, Homo sapiens
gaggtcctctcggaaccccttt

SEQ ID NO: 99599 - DNA, 22 bp, Homo sapiens
attggtagttttgtatttctct

SEQ ID NO: 99600 - DNA, 22 bp, Homo sapiens
tttgtggcaggagcggagaccg

SEQ ID NO: 99601 - DNA, 22 bp, Homo sapiens
ctctccattccctacagttttc

SEQ ID NO: 99602 - DNA, 22 bp, Homo sapiens
tcactgcaacctccacctcctg

SEQ ID NO: 99603 - DNA, 22 bp, Homo sapiens
cttcctctgtggccagagtgta

SEQ ID NO: 99604 - DNA, 22 bp, Homo sapiens
agtacccttttcactgtcacaa

SEQ ID NO: 99605 - DNA, 22 bp, Homo sapiens
agggtagtacagagagtgtcct

SEQ ID NO: 99606 - DNA, 20 bp, Homo sapiens
ttgagcttttagtacagaca

SEQ ID NO: 99607 - DNA, 22 bp, Homo sapiens
cagtgcagccaaggacaggcac

SEQ ID NO: 99608 - DNA, 22 bp, Homo sapiens
tgaggcaggaggattgcaggat

SEQ ID NO: 99609 - DNA, 22 bp, Homo sapiens
atggggctgttctctgccctgc

SEQ ID NO: 99610 - DNA, 22 bp, Homo sapiens
tcaggggcttgaggtgcatgtc

SEQ ID NO: 99611 - DNA, 22 bp, Homo sapiens
gggccatgagaggttcatcaac

SEQ ID NO: 99612 - DNA, 19 bp, Homo sapiens
caggcctcttaccctctct

SEQ ID NO: 99613 - DNA, 22 bp, Homo sapiens
aaaaatcacttttataggcagc

SEQ ID NO: 99614 - DNA, 22 bp, Homo sapiens
ttatttaatgtgatctgaagag

SEQ ID NO: 99615 - DNA, 22 bp, Homo sapiens
ggaggcccagaaggaagcccag

SEQ ID NO: 99616 - DNA, 22 bp, Homo sapiens
agatttatgtggtcacactcag

SEQ ID NO: 99617 - DNA, 22 bp, Homo sapiens
agaggtgagtcattacctagtg

SEQ ID NO: 99618 - DNA, 22 bp, Homo sapiens
cgagtgtccctaccatttccta

SEQ ID NO: 99619 - DNA, 22 bp, Homo sapiens
tcacccaggctggagtgcagtg

SEQ ID NO: 99620 - DNA, 16 bp, Homo sapiens
atgctgctattagagg

SEQ ID NO: 99621 - DNA, 22 bp, Homo sapiens
gcagaagcacaggtgacgggcc

SEQ ID NO: 99622 - DNA, 22 bp, Homo sapiens
gttgagtgggttaggatgctga

SEQ ID NO: 99623 - DNA, 22 bp, Homo sapiens
tttgttttcaatgtgtcattca

SEQ ID NO: 99624 - DNA, 22 bp, Homo sapiens
tgggaggccaaggcaggcggat

SEQ ID NO: 99625 - DNA, 22 bp, Homo sapiens
gctcccaccttaaccttcacat

SEQ ID NO: 99626 - DNA, 22 bp, Homo sapiens
caggaaggggctcactctggcc

SEQ ID NO: 99627 - DNA, 22 bp, Homo sapiens
ccaaagtgctggggttacaggc

SEQ ID NO: 99628 - DNA, 22 bp, Homo sapiens
tggggagtgatgcctcggataa

SEQ ID NO: 99629 - DNA, 22 bp, Homo sapiens
ggttttcacctccagaatgtgc

SEQ ID NO: 99630 - DNA, 22 bp, Homo sapiens
aaagtgctgggattacaagcgt

SEQ ID NO: 99631 - DNA, 22 bp, Homo sapiens
cgggaaggtggaggttgcagtg

SEQ ID NO: 99632 - DNA, 22 bp, Homo sapiens
tgggaaggggagctggaaagga

SEQ ID NO: 99633 - DNA, 22 bp, Homo sapiens
ggaggagacagtaaaaagcacg

SEQ ID NO: 99634 - DNA, 22 bp, Homo sapiens
tggagagttctgtagatatcta

SEQ ID NO: 99635 - DNA, 22 bp, Homo sapiens
ggagtgactcacagctgggaca

SEQ ID NO: 99636 - DNA, 22 bp, Homo sapiens
tcctcggctgggccccaggctt

SEQ ID NO: 99637 - DNA, 22 bp, Homo sapiens
acacttggagcaacacttatgg

SEQ ID NO: 99638 - DNA, 22 bp, Homo sapiens
caatttctaacattccatggat

SEQ ID NO: 99639 - DNA, 22 bp, Homo sapiens
ggctgcaggttggttggcagct

SEQ ID NO: 99640 - DNA, 22 bp, Homo sapiens
tggcactgaagctggaaagcct

SEQ ID NO: 99641 - DNA, 20 bp, Homo sapiens
ccccgtgtttagcatatcat

SEQ ID NO: 99642 - DNA, 22 bp, Homo sapiens
cagcagcagtggctgcagaaca

SEQ ID NO: 99643 - DNA, 22 bp, Homo sapiens
gcttctggtgaggcctcaggaa

SEQ ID NO: 99644 - DNA, 22 bp, Homo sapiens
tcccaggccacacttggggaac

SEQ ID NO: 99645 - DNA, 22 bp, Homo sapiens
gaccaagatacagcatcataga

SEQ ID NO: 99646 - DNA, 19 bp, Homo sapiens
agggaatccggctgaggga

SEQ ID NO: 99647 - DNA, 22 bp, Homo sapiens
gctcgtacaccagcgtggaggt

SEQ ID NO: 99648 - DNA, 23 bp, Homo sapiens
ccagtgattgcctggaaggaggt

SEQ ID NO: 99649 - DNA, 22 bp, Homo sapiens
cactgcactccagcctgggtca

SEQ ID NO: 99650 - DNA, 22 bp, Homo sapiens
cctgccagagcagcttgtcctc

SEQ ID NO: 99651 - DNA, 22 bp, Homo sapiens
attttctctttgtatatgctag

SEQ ID NO: 99652 - DNA, 22 bp, Homo sapiens
agaccaaagaaaacacatctgg

SEQ ID NO: 99653 - DNA, 22 bp, Homo sapiens
ctgggcagctgtatcagggagt

SEQ ID NO: 99654 - DNA, 22 bp, Homo sapiens
ctgaggcctctcccactccagc

SEQ ID NO: 99655 - DNA, 22 bp, Homo sapiens
ggagggcagagtcccctgctga

SEQ ID NO: 99656 - DNA, 22 bp, Homo sapiens
caggaggattgcttgaggccag

SEQ ID NO: 99657 - DNA, 22 bp, Homo sapiens
accattgccccctagtgtctgt

SEQ ID NO: 99658 - DNA, 22 bp, Homo sapiens
cattaaacaaccttgaatcaat

SEQ ID NO: 99659 - DNA, 22 bp, Homo sapiens
ccaaggccttgaaggcgcgggg

SEQ ID NO: 99660 - DNA, 22 bp, Homo sapiens
ataatacatggttgatcttttc

SEQ ID NO: 99661 - DNA, 22 bp, Homo sapiens
agctcctgaaaatccagactgg

SEQ ID NO: 99662 - DNA, 22 bp, Homo sapiens
cacccaggctggagtgcagtgg

SEQ ID NO: 99663 - DNA, 22 bp, Homo sapiens
gcccccgtagtagatgaggcgc

SEQ ID NO: 99664 - DNA, 16 bp, Homo sapiens
ccacctgcagctctca

SEQ ID NO: 99665 - DNA, 22 bp, Homo sapiens
tcacccaggctggagtgtagtg

SEQ ID NO: 99666 - DNA, 22 bp, Homo sapiens
gcttttcatgacaactcagcga

SEQ ID NO: 99667 - DNA, 22 bp, Homo sapiens
attgtactacaccatagtactg

SEQ ID NO: 99668 - DNA, 22 bp, Homo sapiens
tgggaaagctgcagaaattctc

SEQ ID NO: 99669 - DNA, 22 bp, Homo sapiens
ccaaagtgctgggattacaggt

SEQ ID NO: 99670 - DNA, 22 bp, Homo sapiens
ccacctgagataagagagctca

SEQ ID NO: 99671 - DNA, 22 bp, Homo sapiens
agggccagcactcctggcagga

SEQ ID NO: 99672 - DNA, 22 bp, Homo sapiens
cattgctttgtgcatatttaaa

SEQ ID NO: 99673 - DNA, 22 bp, Homo sapiens
tatgttgcaccaacctaataat

SEQ ID NO: 99674 - DNA, 22 bp, Homo sapiens
aaagtgctgcgacatttgagcg

SEQ ID NO: 99675 - DNA, 22 bp, Homo sapiens
gtgaaatatttaacgtccaggt

SEQ ID NO: 99676 - DNA, 22 bp, Homo sapiens
tctcctggtacccttcctagca

SEQ ID NO: 99677 - DNA, 23 bp, Homo sapiens
aggatatgacttgtctgccaacc

SEQ ID NO: 99678 - DNA, 22 bp, Homo sapiens
aatgccagtgtgttgattccag

SEQ ID NO: 99679 - DNA, 22 bp, Homo sapiens
agatgtgagaatcaagtgacca

SEQ ID NO: 99680 - DNA, 22 bp, Homo sapiens
gcccgcgccagcctctccatct

SEQ ID NO: 99681 - DNA, 22 bp, Homo sapiens
gttgtgaatagtgccgcaataa

SEQ ID NO: 99682 - DNA, 22 bp, Homo sapiens
tggggtacacgtggggcaggat

SEQ ID NO: 99683 - DNA, 22 bp, Homo sapiens
tcacccaggctggactgcagtg

SEQ ID NO: 99684 - DNA, 22 bp, Homo sapiens
aagagaattctggttttcctat

SEQ ID NO: 99685 - DNA, 21 bp, Homo sapiens
gctcctggtgctgcgtggcgc

SEQ ID NO: 99686 - DNA, 22 bp, Homo sapiens
aatattatcaaaagctttttca

SEQ ID NO: 99687 - DNA, 22 bp, Homo sapiens
ggtgccaggctgtagtcagggt

SEQ ID NO: 99688 - DNA, 22 bp, Homo sapiens
gctggccacagatccccaggga

SEQ ID NO: 99689 - DNA, 19 bp, Homo sapiens
tcctgcccaccagccaggg

SEQ ID NO: 99690 - DNA, 22 bp, Homo sapiens
actctccttttgatcttcagaa

SEQ ID NO: 99691 - DNA, 22 bp, Homo sapiens
ggccttggcctagccctccagg

SEQ ID NO: 99692 - DNA, 22 bp, Homo sapiens
tgtgtctttgttccaggtacga

SEQ ID NO: 99693 - DNA, 18 bp, Homo sapiens
ccctcttgcacaaagcaa

SEQ ID NO: 99694 - DNA, 22 bp, Homo sapiens
tgccatggcctagacctgtgat

SEQ ID NO: 99695 - DNA, 22 bp, Homo sapiens
ccagatgtccctctcaggtttg

SEQ ID NO: 99696 - DNA, 22 bp, Homo sapiens
acaagcgggccacagtgctggt

SEQ ID NO: 99697 - DNA, 22 bp, Homo sapiens
gttatataagacaaatcagagt

SEQ ID NO: 99698 - DNA, 22 bp, Homo sapiens
cttagatgaagtcacagaaccc

SEQ ID NO: 99699 - DNA, 22 bp, Homo sapiens
gcagtggcatgatgtgggctca

SEQ ID NO: 99700 - DNA, 22 bp, Homo sapiens
gggctgagacgatggggtcttc

SEQ ID NO: 99701 - DNA, 22 bp, Homo sapiens
tctaaattactttgggcagtat

SEQ ID NO: 99702 - DNA, 22 bp, Homo sapiens
gcaggtggatcaccacgtcagg

SEQ ID NO: 99703 - DNA, 22 bp, Homo sapiens
ctgggagtggtgacagctctcg

SEQ ID NO: 99704 - DNA, 22 bp, Homo sapiens
acagattcactgcactggccat

SEQ ID NO: 99705 - DNA, 22 bp, Homo sapiens
gcaggaggttgagccaggactg

SEQ ID NO: 99706 - DNA, 22 bp, Homo sapiens
ctgaacttattgagtgcttgct

SEQ ID NO: 99707 - DNA, 22 bp, Homo sapiens
gggagaagaatgtgtcaattgt

SEQ ID NO: 99708 - DNA, 22 bp, Homo sapiens
agaggctgcacttgctcatgat

SEQ ID NO: 99709 - DNA, 22 bp, Homo sapiens
gcatatgatcacgtgtgtcggt

SEQ ID NO: 99710 - DNA, 22 bp, Homo sapiens
aggaaggactccatggtccgtc

SEQ ID NO: 99711 - DNA, 22 bp, Homo sapiens
tggggcacagtctgaatgtttc

SEQ ID NO: 99712 - DNA, 20 bp, Homo sapiens
gggcagagccagccagtccc

SEQ ID NO: 99713 - DNA, 22 bp, Homo sapiens
gcccaggctggagtgcagtggt

SEQ ID NO: 99714 - DNA, 22 bp, Homo sapiens
cacgcacgctgggtggaggcgc

SEQ ID NO: 99715 - DNA, 22 bp, Homo sapiens
tgaaatgattatatggtgtttg

SEQ ID NO: 99716 - DNA, 22 bp, Homo sapiens
atgatccaaagccacaggggca

SEQ ID NO: 99717 - DNA, 22 bp, Homo sapiens
ggaggcagaatagagtgtgggt

SEQ ID NO: 99718 - DNA, 22 bp, Homo sapiens
agcgccactgcactccagcctg

SEQ ID NO: 99719 - DNA, 22 bp, Homo sapiens
agctagtatttcattgaggatt

SEQ ID NO: 99720 - DNA, 22 bp, Homo sapiens
cactctcagcataatgaatgtg

SEQ ID NO: 99721 - DNA, 22 bp, Homo sapiens
ttggaatgcacactgagcctgc

SEQ ID NO: 99722 - DNA, 22 bp, Homo sapiens
gggagtgggtttggcctaggcc

SEQ ID NO: 99723 - DNA, 18 bp, Homo sapiens
gctatctctaagatcttt

SEQ ID NO: 99724 - DNA, 20 bp, Homo sapiens
tttgagaccagtctgcccaa

SEQ ID NO: 99725 - DNA, 22 bp, Homo sapiens
tcactgcaacctccacctcccg

SEQ ID NO: 99726 - DNA, 22 bp, Homo sapiens
ttctgtgctcaaaactttccaa

SEQ ID NO: 99727 - DNA, 22 bp, Homo sapiens
gcccaggctggagtgcagtggc

SEQ ID NO: 99728 - DNA, 22 bp, Homo sapiens
ctgtccctgagcaactcctgtt

SEQ ID NO: 99729 - DNA, 20 bp, Homo sapiens
aaattactgccacacatttc

SEQ ID NO: 99730 - DNA, 22 bp, Homo sapiens
ccttgctcaagctagtgacggg

SEQ ID NO: 99731 - DNA, 22 bp, Homo sapiens
gcccagtagttcaaggttgcag

SEQ ID NO: 99732 - DNA, 22 bp, Homo sapiens
tggatatccttgttaactttct

SEQ ID NO: 99733 - DNA, 22 bp, Homo sapiens
tttaatcaggcaaagcataata

SEQ ID NO: 99734 - DNA, 22 bp, Homo sapiens
ttccacaatggttaagctcgtt

SEQ ID NO: 99735 - DNA, 22 bp, Homo sapiens
attgcactccagcctgggggac

SEQ ID NO: 99736 - DNA, 22 bp, Homo sapiens
actgtgaacggactgaagccca

SEQ ID NO: 99737 - DNA, 22 bp, Homo sapiens
aagaaggcggaccagaagggag

SEQ ID NO: 99738 - DNA, 22 bp, Homo sapiens
agatacattgttctaagcattg

SEQ ID NO: 99739 - DNA, 22 bp, Homo sapiens
ttaaattttagaaacagactct

SEQ ID NO: 99740 - DNA, 22 bp, Homo sapiens
tattgtccaataggatgttcct

SEQ ID NO: 99741 - DNA, 22 bp, Homo sapiens
tctaggcctggcttgggcccag

SEQ ID NO: 99742 - DNA, 22 bp, Homo sapiens
atgtcttctctgtaggtaaatt

SEQ ID NO: 99743 - DNA, 22 bp, Homo sapiens
tagtgccctcccctttgggata

SEQ ID NO: 99744 - DNA, 22 bp, Homo sapiens
gcccggcagtcacacacccagg

SEQ ID NO: 99745 - DNA, 22 bp, Homo sapiens
tgtgagttattttcaggagttt

SEQ ID NO: 99746 - DNA, 22 bp, Homo sapiens
aggctgtgtggataatattggg

SEQ ID NO: 99747 - DNA, 22 bp, Homo sapiens
ggaaaagtgttaaggtgttgat

SEQ ID NO: 99748 - DNA, 22 bp, Homo sapiens
tacgttttaaacacggagccag

SEQ ID NO: 99749 - DNA, 20 bp, Homo sapiens
agcggctggcggaggacacg

SEQ ID NO: 99750 - DNA, 22 bp, Homo sapiens
gcaggagaacaaagcaagctgc

SEQ ID NO: 99751 - DNA, 22 bp, Homo sapiens
agactcagccacacaagactac

SEQ ID NO: 99752 - DNA, 22 bp, Homo sapiens
ttattgaaggaactgaaataaa

SEQ ID NO: 99753 - DNA, 22 bp, Homo sapiens
gaggagggagctggaagctctt

SEQ ID NO: 99754 - DNA, 21 bp, Homo sapiens
tctgccagctgaagaggtgga

SEQ ID NO: 99755 - DNA, 22 bp, Homo sapiens
ccaggaggcggaaggtacagtg

SEQ ID NO: 99756 - DNA, 22 bp, Homo sapiens
tgatctaggttggcttcaactg

SEQ ID NO: 99757 - DNA, 22 bp, Homo sapiens
gacccggctccaggcccagcag

SEQ ID NO: 99758 - DNA, 22 bp, Homo sapiens
agcccaggttgaggctgcagtg

SEQ ID NO: 99759 - DNA, 22 bp, Homo sapiens
tcttgggcatgtgtttgatttc

SEQ ID NO: 99760 - DNA, 22 bp, Homo sapiens
tctttcttgtgggtgccctttt

SEQ ID NO: 99761 - DNA, 22 bp, Homo sapiens
gaagcttgaacagggccaggct

SEQ ID NO: 99762 - DNA, 22 bp, Homo sapiens
acactgaaagaagccagcttgt

SEQ ID NO: 99763 - DNA, 20 bp, Homo sapiens
acctcctggcgggcatcctc

SEQ ID NO: 99764 - DNA, 22 bp, Homo sapiens
ttcattttctttcacgctgctg

SEQ ID NO: 99765 - DNA, 22 bp, Homo sapiens
caagtctgacctctgggtgaag

SEQ ID NO: 99766 - DNA, 22 bp, Homo sapiens
gaccctctagatggaagcactg

SEQ ID NO: 99767 - DNA, 22 bp, Homo sapiens
attggccatttgcatgtattat

SEQ ID NO: 99768 - DNA, 19 bp, Homo sapiens
agggagtttatatttgcac

SEQ ID NO: 99769 - DNA, 22 bp, Homo sapiens
agtgggaattttctcccaggga

SEQ ID NO: 99770 - DNA, 22 bp, Homo sapiens
gcctcctgtcccaggctgagga

SEQ ID NO: 99771 - DNA, 22 bp, Homo sapiens
aatgtcaaaggctatacattca

SEQ ID NO: 99772 - DNA, 22 bp, Homo sapiens
agagtgtaccaaatatcctaca

SEQ ID NO: 99773 - DNA, 22 bp, Homo sapiens
tgaggaattgtgttgtagtgga

SEQ ID NO: 99774 - DNA, 22 bp, Homo sapiens
ttttaatactgctattgtagga

SEQ ID NO: 99775 - DNA, 21 bp, Homo sapiens
cactccacttagaacagggtt

SEQ ID NO: 99776 - DNA, 22 bp, Homo sapiens
tcagggctgcagaagaggcagg

SEQ ID NO: 99777 - DNA, 21 bp, Homo sapiens
gccatttcacacagacatttg

SEQ ID NO: 99778 - DNA, 22 bp, Homo sapiens
ttaaacatttatggaggcagca

SEQ ID NO: 99779 - DNA, 22 bp, Homo sapiens
ggagaagaggagctggaagcct

SEQ ID NO: 99780 - DNA, 22 bp, Homo sapiens
gttctgggagatcttgagcttc

SEQ ID NO: 99781 - DNA, 22 bp, Homo sapiens
aagtcgtggcaggcttgcacga

SEQ ID NO: 99782 - DNA, 22 bp, Homo sapiens
ggggaaagccagccctgcttcc

SEQ ID NO: 99783 - DNA, 22 bp, Homo sapiens
acagacaagtagttcagacaag

SEQ ID NO: 99784 - DNA, 23 bp, Homo sapiens
actcgtggaattctctgcgatcg

SEQ ID NO: 99785 - DNA, 22 bp, Homo sapiens
actctgtcttcatatttgcatt

SEQ ID NO: 99786 - DNA, 20 bp, Homo sapiens
gtctccactgggggttaacc

SEQ ID NO: 99787 - DNA, 22 bp, Homo sapiens
cctcgacctccccaggctcagg

SEQ ID NO: 99788 - DNA, 21 bp, Homo sapiens
cagaggcctatcacagactcc

SEQ ID NO: 99789 - DNA, 22 bp, Homo sapiens
gggagctgaaggagccggcggg

SEQ ID NO: 99790 - DNA, 22 bp, Homo sapiens
tctgacattagattaattggaa

SEQ ID NO: 99791 - DNA, 22 bp, Homo sapiens
attgaaaataaggccagaaaca

SEQ ID NO: 99792 - DNA, 22 bp, Homo sapiens
caaagtgctgggattacaggct

SEQ ID NO: 99793 - DNA, 22 bp, Homo sapiens
cacagtcctgccagagggcctt

SEQ ID NO: 99794 - DNA, 22 bp, Homo sapiens
aggaaaacagaccaaggagctc

SEQ ID NO: 99795 - DNA, 22 bp, Homo sapiens
aggggagccagggctgcgagtt

SEQ ID NO: 99796 - DNA, 22 bp, Homo sapiens
cccagggaggcccaggctctgc

SEQ ID NO: 99797 - DNA, 22 bp, Homo sapiens
aagaggtagcagtcacaaaaga

SEQ ID NO: 99798 - DNA, 22 bp, Homo sapiens
ctgggaggcggaggttgcagtg

SEQ ID NO: 99799 - DNA, 22 bp, Homo sapiens
ctcaggacccggtccaggtggg

SEQ ID NO: 99800 - DNA, 22 bp, Homo sapiens
gaagagctgacagtgtcatcct

SEQ ID NO: 99801 - DNA, 21 bp, Homo sapiens
gggcctggctgcgcaggacgg

SEQ ID NO: 99802 - DNA, 22 bp, Homo sapiens
agggagcaaaggtttcagggtt

SEQ ID NO: 99803 - DNA, 22 bp, Homo sapiens
gtttgagatgggttattgctct

SEQ ID NO: 99804 - DNA, 22 bp, Homo sapiens
actttaaaactgatcatcagag

SEQ ID NO: 99805 - DNA, 22 bp, Homo sapiens
ggtccccccatggtgagcactg

SEQ ID NO: 99806 - DNA, 22 bp, Homo sapiens
aaaggcttcggatcagaaggta

SEQ ID NO: 99807 - DNA, 22 bp, Homo sapiens
aaagcctcccaggttatgagta

SEQ ID NO: 99808 - DNA, 22 bp, Homo sapiens
gctcccaccgccgctatgggta

SEQ ID NO: 99809 - DNA, 22 bp, Homo sapiens
aggctatttccactcttctcat

SEQ ID NO: 99810 - DNA, 22 bp, Homo sapiens
tggcaccagggaacaagcattt

SEQ ID NO: 99811 - DNA, 22 bp, Homo sapiens
cttcaggggtgttagttttgtg

SEQ ID NO: 99812 - DNA, 22 bp, Homo sapiens
tctttctacatcatttgcttct

SEQ ID NO: 99813 - DNA, 22 bp, Homo sapiens
ctgagcctcctgcttctatttc

SEQ ID NO: 99814 - DNA, 22 bp, Homo sapiens
gcagggaggtttgctgacctgg

SEQ ID NO: 99815 - DNA, 22 bp, Homo sapiens
aaagtgctaggattacaagcgt

SEQ ID NO: 99816 - DNA, 22 bp, Homo sapiens
acagtccagcctagtatgtata

SEQ ID NO: 99817 - DNA, 22 bp, Homo sapiens
ggctctgtaagtgttgcaggta

SEQ ID NO: 99818 - DNA, 23 bp, Homo sapiens
acagtcgtaggtatccttttcct

SEQ ID NO: 99819 - DNA, 21 bp, Homo sapiens
tgactgaggcttcttcacaca

SEQ ID NO: 99820 - DNA, 22 bp, Homo sapiens
cgagcatgatgacggctgtggc

SEQ ID NO: 99821 - DNA, 22 bp, Homo sapiens
tacttttagcctatttgattct

SEQ ID NO: 99822 - DNA, 22 bp, Homo sapiens
gtgggggagatgcttaggtccg

SEQ ID NO: 99823 - DNA, 22 bp, Homo sapiens
tttcataatactgtacatgaaa

SEQ ID NO: 99824 - DNA, 22 bp, Homo sapiens
ccctcccagatgggcttgaggt

SEQ ID NO: 99825 - DNA, 22 bp, Homo sapiens
ccctcccaggagtggccagaga

SEQ ID NO: 99826 - DNA, 22 bp, Homo sapiens
gaaactctcgcatcctgggaac

SEQ ID NO: 99827 - DNA, 22 bp, Homo sapiens
gaggaggcagcctatcccttag

SEQ ID NO: 99828 - DNA, 22 bp, Homo sapiens
caccaaagtcgcttctgtcgtc

SEQ ID NO: 99829 - DNA, 22 bp, Homo sapiens
gttgcagatgtggaactcgtgc

SEQ ID NO: 99830 - DNA, 22 bp, Homo sapiens
gaggcagaggttgcagtgagct

SEQ ID NO: 99831 - DNA, 22 bp, Homo sapiens
tggcacgacaattggcaccaat

SEQ ID NO: 99832 - DNA, 18 bp, Homo sapiens
gctgtggaagtctttata

SEQ ID NO: 99833 - DNA, 22 bp, Homo sapiens
ggctgtggcagctggaagtggt

SEQ ID NO: 99834 - DNA, 22 bp, Homo sapiens
cactgcacttcagcctgggtga

SEQ ID NO: 99835 - DNA, 22 bp, Homo sapiens
taggaatggtgctcagcagaaa

SEQ ID NO: 99836 - DNA, 22 bp, Homo sapiens
gaggggcacagtaaagggtccc

SEQ ID NO: 99837 - DNA, 22 bp, Homo sapiens
agttttcattaccatgctgcaa

SEQ ID NO: 99838 - DNA, 22 bp, Homo sapiens
aaagtgctgagattacaagcgt

SEQ ID NO: 99839 - DNA, 22 bp, Homo sapiens
cactgaacaacaaatagtgaat

SEQ ID NO: 99840 - DNA, 22 bp, Homo sapiens
ctttcaggagaggattataaca

SEQ ID NO: 99841 - DNA, 22 bp, Homo sapiens
gggcggatcacctgaggtcagg

SEQ ID NO: 99842 - DNA, 23 bp, Homo sapiens
ctcctggtgctgctatcaggggt

SEQ ID NO: 99843 - DNA, 22 bp, Homo sapiens
tgaatatgtgactttgatttca

SEQ ID NO: 99844 - DNA, 22 bp, Homo sapiens
cggctggtgtcgggcacagcaa

SEQ ID NO: 99845 - DNA, 21 bp, Homo sapiens
gaacccagcagcagtgctctg

SEQ ID NO: 99846 - DNA, 22 bp, Homo sapiens
gcaccgccttggaccgcccgct

SEQ ID NO: 99847 - DNA, 22 bp, Homo sapiens
gatgtagacacttggaggctta

SEQ ID NO: 99848 - DNA, 22 bp, Homo sapiens
actatagatgctggcgaggctg

SEQ ID NO: 99849 - DNA, 22 bp, Homo sapiens
gcacatgcatgcatattcctgg

SEQ ID NO: 99850 - DNA, 22 bp, Homo sapiens
gaagggaactgggtctccttgt

SEQ ID NO: 99851 - DNA, 22 bp, Homo sapiens
cccaggaagtggaggttgcagt

SEQ ID NO: 99852 - DNA, 22 bp, Homo sapiens
tgaggcaggacttgcataaagt

SEQ ID NO: 99853 - DNA, 22 bp, Homo sapiens
gcagaggacacaggagggcaag

SEQ ID NO: 99854 - DNA, 19 bp, Homo sapiens
ttttggaaatgtgaacagc

SEQ ID NO: 99855 - DNA, 22 bp, Homo sapiens
agcttgtagaaggccacgagca

SEQ ID NO: 99856 - DNA, 22 bp, Homo sapiens
tgtttcaaattacttgaggatt

SEQ ID NO: 99857 - DNA, 22 bp, Homo sapiens
gagatgcagaaccctcaggagc

SEQ ID NO: 99858 - DNA, 22 bp, Homo sapiens
ataaaaactgacccatcctttg

SEQ ID NO: 99859 - DNA, 22 bp, Homo sapiens
ttaataaagtatgaattggaaa

SEQ ID NO: 99860 - DNA, 22 bp, Homo sapiens
ttgatcaaatcagctactgagg

SEQ ID NO: 99861 - DNA, 22 bp, Homo sapiens
gaacactgctgttgggttctga

SEQ ID NO: 99862 - DNA, 22 bp, Homo sapiens
ctgctttagacggctttcgctg

SEQ ID NO: 99863 - DNA, 22 bp, Homo sapiens
ttggaatgttttaatataaatt

SEQ ID NO: 99864 - DNA, 22 bp, Homo sapiens
gggctaaatgcagaaatgcaga

SEQ ID NO: 99865 - DNA, 22 bp, Homo sapiens
gagccaggttggaggctgcagt

SEQ ID NO: 99866 - DNA, 22 bp, Homo sapiens
agagttgctccattagaactta

SEQ ID NO: 99867 - DNA, 22 bp, Homo sapiens
aaacatggccattcagactgtg

SEQ ID NO: 99868 - DNA, 22 bp, Homo sapiens
gcaaatacatgttgagcaccta

SEQ ID NO: 99869 - DNA, 22 bp, Homo sapiens
gggctagcctcttccctgctcc

SEQ ID NO: 99870 - DNA, 22 bp, Homo sapiens
ctacaccggagcctggaaggta

SEQ ID NO: 99871 - DNA, 22 bp, Homo sapiens
cggggttcatccatgctgtggc

SEQ ID NO: 99872 - DNA, 22 bp, Homo sapiens
aggaatgacagatgtccgcacc

SEQ ID NO: 99873 - DNA, 22 bp, Homo sapiens
aggagggagcttaagccaggca

SEQ ID NO: 99874 - DNA, 22 bp, Homo sapiens
gggcactcagctgtagagcagg

SEQ ID NO: 99875 - DNA, 22 bp, Homo sapiens
gggaagagggagctggaatgat

SEQ ID NO: 99876 - DNA, 22 bp, Homo sapiens
gtgacacccgcatgccactgtg

SEQ ID NO: 99877 - DNA, 22 bp, Homo sapiens
cagcatgaatgtgttcgtaggg

SEQ ID NO: 99878 - DNA, 22 bp, Homo sapiens
ttccagtgggctgggagtaagg

SEQ ID NO: 99879 - DNA, 22 bp, Homo sapiens
cagggatggcgctggctgcccg

SEQ ID NO: 99880 - DNA, 22 bp, Homo sapiens
taaggctatcttttgagtgtgt

SEQ ID NO: 99881 - DNA, 22 bp, Homo sapiens
tcactgaaacctccacctctcg

SEQ ID NO: 99882 - DNA, 21 bp, Homo sapiens
tttcaagggaccctggggatc

SEQ ID NO: 99883 - DNA, 22 bp, Homo sapiens
ggagcagggaattacagcgcag

SEQ ID NO: 99884 - DNA, 22 bp, Homo sapiens
tcttgaattgtactcccataag

SEQ ID NO: 99885 - DNA, 22 bp, Homo sapiens
ctcggcaggtggaggttgtagt

SEQ ID NO: 99886 - DNA, 22 bp, Homo sapiens
attgataaattgcaatggggct

SEQ ID NO: 99887 - DNA, 22 bp, Homo sapiens
ctgggggcagcaagaagccatg

SEQ ID NO: 99888 - DNA, 22 bp, Homo sapiens
gagaggtggaggttgcagtgag

SEQ ID NO: 99889 - DNA, 22 bp, Homo sapiens
gcaggtccagtcaccagagaga

SEQ ID NO: 99890 - DNA, 22 bp, Homo sapiens
tcctgccttgcctgggacatca

SEQ ID NO: 99891 - DNA, 22 bp, Homo sapiens
tttgcttcacaagtatggttct

SEQ ID NO: 99892 - DNA, 22 bp, Homo sapiens
gtctttcttaaacaacagaaca

SEQ ID NO: 99893 - DNA, 18 bp, Homo sapiens
cttgttcttctcttggcg

SEQ ID NO: 99894 - DNA, 22 bp, Homo sapiens
ggcaaggggtcaggctgagaca

SEQ ID NO: 99895 - DNA, 22 bp, Homo sapiens
ccctgcctacagggttttcttt

SEQ ID NO: 99896 - DNA, 22 bp, Homo sapiens
atttggcagtataaattctggc

SEQ ID NO: 99897 - DNA, 22 bp, Homo sapiens
agaacctcaattatttttgcac

SEQ ID NO: 99898 - DNA, 22 bp, Homo sapiens
gggttgaggcggatgtcggcgg

SEQ ID NO: 99899 - DNA, 22 bp, Homo sapiens
aggaaaatggaccagagttgtt

SEQ ID NO: 99900 - DNA, 22 bp, Homo sapiens
actttatttcctattgcatcca

SEQ ID NO: 99901 - DNA, 22 bp, Homo sapiens
agttggcttcaaaggcagagag

SEQ ID NO: 99902 - DNA, 22 bp, Homo sapiens
ttcgactctgtgcctgaagagc

SEQ ID NO: 99903 - DNA, 22 bp, Homo sapiens
ttattagagtgctttgagaaag

SEQ ID NO: 99904 - DNA, 22 bp, Homo sapiens
tcgctgaggctgcacggctgcc

SEQ ID NO: 99905 - DNA, 22 bp, Homo sapiens
cggtcaggtgcagcgttggcac

SEQ ID NO: 99906 - DNA, 22 bp, Homo sapiens
gggaacagcttgggctctgcca

SEQ ID NO: 99907 - DNA, 22 bp, Homo sapiens
gaatgcttggaacctgaagttc

SEQ ID NO: 99908 - DNA, 19 bp, Homo sapiens
taggaccctggtggccccc

SEQ ID NO: 99909 - DNA, 22 bp, Homo sapiens
attcagagcactgggtagaatt

SEQ ID NO: 99910 - DNA, 22 bp, Homo sapiens
ttggggctcaggccgccgatgc

SEQ ID NO: 99911 - DNA, 22 bp, Homo sapiens
tgggagcagttgcatctccagt

SEQ ID NO: 99912 - DNA, 22 bp, Homo sapiens
gggctgtaggagctggaatggg

SEQ ID NO: 99913 - DNA, 22 bp, Homo sapiens
atcaggggagctgcgacctcag

SEQ ID NO: 99914 - DNA, 22 bp, Homo sapiens
gaagtgtagtcttgagccccca

SEQ ID NO: 99915 - DNA, 22 bp, Homo sapiens
tggccttggccgtgctggggtc

SEQ ID NO: 99916 - DNA, 22 bp, Homo sapiens
agcttgacagacagatggtagc

SEQ ID NO: 99917 - DNA, 22 bp, Homo sapiens
gctgcagtgagccaagatcgtg

SEQ ID NO: 99918 - DNA, 22 bp, Homo sapiens
aggtccaaggtagggcccagac

SEQ ID NO: 99919 - DNA, 22 bp, Homo sapiens
gaggcctcatgaggtgagcatt

SEQ ID NO: 99920 - DNA, 22 bp, Homo sapiens
tccattatacttctgattcaaa

SEQ ID NO: 99921 - DNA, 22 bp, Homo sapiens
tggcacaggatctcagcggcca

SEQ ID NO: 99922 - DNA, 22 bp, Homo sapiens
cagccccacacggtctagctct

SEQ ID NO: 99923 - DNA, 22 bp, Homo sapiens
tgaggcaggaggttgagaactg

SEQ ID NO: 99924 - DNA, 22 bp, Homo sapiens
ttgagggtctggatctgctgct

SEQ ID NO: 99925 - DNA, 22 bp, Homo sapiens
gcgtctcaaggcccccaggcca

SEQ ID NO: 99926 - DNA, 22 bp, Homo sapiens
caaagtgctaggattacaggcg

SEQ ID NO: 99927 - DNA, 22 bp, Homo sapiens
agccaggatggtctcgatcggc

SEQ ID NO: 99928 - DNA, 22 bp, Homo sapiens
ttacgcagctgctccaggaagc

SEQ ID NO: 99929 - DNA, 20 bp, Homo sapiens
ggggaagtcactgcagtcag

SEQ ID NO: 99930 - DNA, 22 bp, Homo sapiens
cataatttctaccagggccata

SEQ ID NO: 99931 - DNA, 22 bp, Homo sapiens
gcatcccctgcattctgttttc

SEQ ID NO: 99932 - DNA, 22 bp, Homo sapiens
attgcactccagcctgggtgac

SEQ ID NO: 99933 - DNA, 22 bp, Homo sapiens
tttgtcttatccaatctctcag

SEQ ID NO: 99934 - DNA, 22 bp, Homo sapiens
tttaaaaaactagtctgagtct

SEQ ID NO: 99935 - DNA, 22 bp, Homo sapiens
tttcttcctgctttgtcccatg

SEQ ID NO: 99936 - DNA, 22 bp, Homo sapiens
actgttgaagtgccagcttgat

SEQ ID NO: 99937 - DNA, 22 bp, Homo sapiens
acacccaggctggcgtgcagtg

SEQ ID NO: 99938 - DNA, 22 bp, Homo sapiens
ttgtggttaaccgcacattttt

SEQ ID NO: 99939 - DNA, 22 bp, Homo sapiens
tggagaattctatgttgagggg

SEQ ID NO: 99940 - DNA, 22 bp, Homo sapiens
aacggctagcaggggtgtcatg

SEQ ID NO: 99941 - DNA, 22 bp, Homo sapiens
ttccagctaactcacatccctt

SEQ ID NO: 99942 - DNA, 22 bp, Homo sapiens
tgggggctttatgtaatgcaca

SEQ ID NO: 99943 - DNA, 23 bp, Homo sapiens
ctggggctttcaaatctgggcag

SEQ ID NO: 99944 - DNA, 22 bp, Homo sapiens
tcgtgaggctctgcatcgcaca

SEQ ID NO: 99945 - DNA, 22 bp, Homo sapiens
gtagtctgaacagtaattttgt

SEQ ID NO: 99946 - DNA, 22 bp, Homo sapiens
gctcactgcctgggcaacaaga

SEQ ID NO: 99947 - DNA, 22 bp, Homo sapiens
gcgagaaactaagtgccctttg

SEQ ID NO: 99948 - DNA, 22 bp, Homo sapiens
gtggtgtttgagctgccaggga

SEQ ID NO: 99949 - DNA, 22 bp, Homo sapiens
ggtttgacagcttggggctgtc

SEQ ID NO: 99950 - DNA, 22 bp, Homo sapiens
gaatcccttgcattatcccttt

SEQ ID NO: 99951 - DNA, 22 bp, Homo sapiens
gccaggctgaggctctggaaga

SEQ ID NO: 99952 - DNA, 19 bp, Homo sapiens
tggctctgtcgaaggcaca

SEQ ID NO: 99953 - DNA, 22 bp, Homo sapiens
ccttcattcattaatttagccc

SEQ ID NO: 99954 - DNA, 22 bp, Homo sapiens
cagcttggaggaggatctaaga

SEQ ID NO: 99955 - DNA, 22 bp, Homo sapiens
tggggaaaatgcttgtagtcag

SEQ ID NO: 99956 - DNA, 22 bp, Homo sapiens
cttctttcaagaatggattagg

SEQ ID NO: 99957 - DNA, 22 bp, Homo sapiens
ggtgacctcacctggtcccacc

SEQ ID NO: 99958 - DNA, 22 bp, Homo sapiens
gtctatgcaacttttagtggga

SEQ ID NO: 99959 - DNA, 22 bp, Homo sapiens
gctcaagccttctgcccacctc

SEQ ID NO: 99960 - DNA, 22 bp, Homo sapiens
aaagaaatagatggcatttaaa

SEQ ID NO: 99961 - DNA, 22 bp, Homo sapiens
cttgatgagtcagaactgaagg

SEQ ID NO: 99962 - DNA, 22 bp, Homo sapiens
tgcgatgcaacagcttggcgga

SEQ ID NO: 99963 - DNA, 22 bp, Homo sapiens
tacccagtctggagtgcagtga

SEQ ID NO: 99964 - DNA, 22 bp, Homo sapiens
ctgggaggcagaggttgcagtg

SEQ ID NO: 99965 - DNA, 22 bp, Homo sapiens
ttttggccacatccttttgagt

SEQ ID NO: 99966 - DNA, 21 bp, Homo sapiens
cgggaaggaggttctgaccct

SEQ ID NO: 99967 - DNA, 22 bp, Homo sapiens
cacagacagtgtccctttgttg

SEQ ID NO: 99968 - DNA, 22 bp, Homo sapiens
tgagctgacacccaatcatact

SEQ ID NO: 99969 - DNA, 22 bp, Homo sapiens
gggagaggttacccgagcaact

SEQ ID NO: 99970 - DNA, 22 bp, Homo sapiens
ctggctctcaggctggtcccca

SEQ ID NO: 99971 - DNA, 22 bp, Homo sapiens
acagagcaatgcgtgttctcta

SEQ ID NO: 99972 - DNA, 18 bp, Homo sapiens
ggaaggtgattcagtttt

SEQ ID NO: 99973 - DNA, 22 bp, Homo sapiens
cctctgtgtctccaagaggcct

SEQ ID NO: 99974 - DNA, 22 bp, Homo sapiens
agggctctgagtgggaaagagg

SEQ ID NO: 99975 - DNA, 22 bp, Homo sapiens
aaagcagaactgagagagctgg

SEQ ID NO: 99976 - DNA, 22 bp, Homo sapiens
cactgcactccagcctgggaga

SEQ ID NO: 99977 - DNA, 22 bp, Homo sapiens
gtatccatgggggattggttcc

SEQ ID NO: 99978 - DNA, 22 bp, Homo sapiens
aaattctgatttaataagtgta

SEQ ID NO: 99979 - DNA, 22 bp, Homo sapiens
agggactatttacccatctcac

SEQ ID NO: 99980 - DNA, 22 bp, Homo sapiens
aaggtgggcagatcacaaggtc

SEQ ID NO: 99981 - DNA, 20 bp, Homo sapiens
ctcttccggaggggcgctcc

SEQ ID NO: 99982 - DNA, 22 bp, Homo sapiens
gacggagctggttgctgcggct

SEQ ID NO: 99983 - DNA, 22 bp, Homo sapiens
tccttaggcaatttgggagagt

SEQ ID NO: 99984 - DNA, 22 bp, Homo sapiens
tcacttcccagacggggtggca

SEQ ID NO: 99985 - DNA, 23 bp, Homo sapiens
gcctgggagttgcgatctgcccg

SEQ ID NO: 99986 - DNA, 22 bp, Homo sapiens
cttctgagatgttgttttacag

SEQ ID NO: 99987 - DNA, 22 bp, Homo sapiens
ttctttcagaacacaagtgatt

SEQ ID NO: 99988 - DNA, 22 bp, Homo sapiens
cataaaaggtagcagtttgaaa

SEQ ID NO: 99989 - DNA, 22 bp, Homo sapiens
caaagtgctggaattacaggtg

SEQ ID NO: 99990 - DNA, 22 bp, Homo sapiens
tcccagattcctgctcttatat

SEQ ID NO: 99991 - DNA, 22 bp, Homo sapiens
ggctcctgggggtgctcctgcc

SEQ ID NO: 99992 - DNA, 22 bp, Homo sapiens
aactcaaagatgcatgacgctt

SEQ ID NO: 99993 - DNA, 22 bp, Homo sapiens
tgatctggtcctactgtgggca

SEQ ID NO: 99994 - DNA, 22 bp, Homo sapiens
ttttcctttgattcccagatgt

SEQ ID NO: 99995 - DNA, 22 bp, Homo sapiens
tgccgtggggctgaggctggag

SEQ ID NO: 99996 - DNA, 22 bp, Homo sapiens
tcaccgaggctggagtgcagtg

SEQ ID NO: 99997 - DNA, 18 bp, Homo sapiens
cttttcccctttggactc

SEQ ID NO: 99998 - DNA, 17 bp, Homo sapiens
acctattgatctgtcac

SEQ ID NO: 99999 - DNA, 22 bp, Homo sapiens
tgaaatcttcactaagtctctt

SEQ ID NO: 100000 - DNA, 22 bp, Homo sapiens
tggtaaggttccagatctagaa

SEQ ID NO: 100001 - DNA, 22 bp, Homo sapiens
gcagtggggcaatcatagctca

SEQ ID NO: 100002 - DNA, 19 bp, Homo sapiens
aggaatggaattaattctg

SEQ ID NO: 100003 - DNA, 22 bp, Homo sapiens
tgaggcaggtggattacaaggt

SEQ ID NO: 100004 - DNA, 22 bp, Homo sapiens
tggaagggagctggaatttgga

SEQ ID NO: 100005 - DNA, 22 bp, Homo sapiens
cacatttttactgccaacttaa

SEQ ID NO: 100006 - DNA, 22 bp, Homo sapiens
tggcacagactgggccaaggaa

SEQ ID NO: 100007 - DNA, 22 bp, Homo sapiens
ggaaaatgggaacctgaagcca

SEQ ID NO: 100008 - DNA, 14 bp, Homo sapiens
gccataagggatgc

SEQ ID NO: 100009 - DNA, 22 bp, Homo sapiens
aggctctgtcaggcggagcagc

SEQ ID NO: 100010 - DNA, 22 bp, Homo sapiens
ggccaggcgatgacccctccac

SEQ ID NO: 100011 - DNA, 22 bp, Homo sapiens
ggctcctggcaatgtaacttta

SEQ ID NO: 100012 - DNA, 22 bp, Homo sapiens
tgatttcaagccagggggcgtt

SEQ ID NO: 100013 - DNA, 22 bp, Homo sapiens
cactgcaacctccacctcctgg

SEQ ID NO: 100014 - DNA, 22 bp, Homo sapiens
tcagccccacggggtcagccaa

SEQ ID NO: 100015 - DNA, 22 bp, Homo sapiens
aggggttggacataagacagaa

SEQ ID NO: 100016 - DNA, 22 bp, Homo sapiens
atttagacatgtatctgatagc

SEQ ID NO: 100017 - DNA, 22 bp, Homo sapiens
aagttactggcaagggctgcag

SEQ ID NO: 100018 - DNA, 22 bp, Homo sapiens
aataaaatggtcagttttctca

SEQ ID NO: 100019 - DNA, 22 bp, Homo sapiens
gggaggcagtgctggaggctgg

SEQ ID NO: 100020 - DNA, 22 bp, Homo sapiens
gagtgcaatggcatgatctggg

SEQ ID NO: 100021 - DNA, 22 bp, Homo sapiens
taggggcaggatcctttgagcc

SEQ ID NO: 100022 - DNA, 22 bp, Homo sapiens
caggctggagtgcagtggtgcc

SEQ ID NO: 100023 - DNA, 22 bp, Homo sapiens
tctcatggagtcaggagcagaa

SEQ ID NO: 100024 - DNA, 22 bp, Homo sapiens
aggcaggaggatcatggatgca

SEQ ID NO: 100025 - DNA, 22 bp, Homo sapiens
tcccacacagcccgctcaccgg

SEQ ID NO: 100026 - DNA, 22 bp, Homo sapiens
cagctgctgttcagttttgttt

SEQ ID NO: 100027 - DNA, 22 bp, Homo sapiens
tgaagtatggaatgtagaagtg

SEQ ID NO: 100028 - DNA, 22 bp, Homo sapiens
ctgtggtcatgagtccttccat

SEQ ID NO: 100029 - DNA, 22 bp, Homo sapiens
taatgtataacaaatactcatc

SEQ ID NO: 100030 - DNA, 22 bp, Homo sapiens
atacaaagtattgatcctgagt

SEQ ID NO: 100031 - DNA, 22 bp, Homo sapiens
gacaggaggcagagctcaggtg

SEQ ID NO: 100032 - DNA, 20 bp, Homo sapiens
tcccccactgtttctgctac

SEQ ID NO: 100033 - DNA, 22 bp, Homo sapiens
gctgggctgcgtcggggaagcc

SEQ ID NO: 100034 - DNA, 22 bp, Homo sapiens
tgttagtcagacacacctaaat

SEQ ID NO: 100035 - DNA, 22 bp, Homo sapiens
tacatagctcctagtgatgcat

SEQ ID NO: 100036 - DNA, 22 bp, Homo sapiens
aactctatttaccctactaaac

SEQ ID NO: 100037 - DNA, 22 bp, Homo sapiens
tctgaaaactccatgagctcgt

SEQ ID NO: 100038 - DNA, 22 bp, Homo sapiens
cttgtcagccaattgtggattt

SEQ ID NO: 100039 - DNA, 22 bp, Homo sapiens
aggctcagatccttgtgtcctg

SEQ ID NO: 100040 - DNA, 22 bp, Homo sapiens
atctagattaggtataagagct

SEQ ID NO: 100041 - DNA, 22 bp, Homo sapiens
ataaagtggaggtagtattcat

SEQ ID NO: 100042 - DNA, 22 bp, Homo sapiens
aagaataagaggatttagaaca

SEQ ID NO: 100043 - DNA, 22 bp, Homo sapiens
atggccgcctgtccttcccgcc

SEQ ID NO: 100044 - DNA, 22 bp, Homo sapiens
ggtgacgaatccatagcatcga

SEQ ID NO: 100045 - DNA, 22 bp, Homo sapiens
aatgttgtgcatgtattttgta

SEQ ID NO: 100046 - DNA, 22 bp, Homo sapiens
cccacgttgaaccgcttacaga

SEQ ID NO: 100047 - DNA, 22 bp, Homo sapiens
ggctgccttccctgagccccgg

SEQ ID NO: 100048 - DNA, 18 bp, Homo sapiens
tgtccctgcaaataacat

SEQ ID NO: 100049 - DNA, 22 bp, Homo sapiens
ttgctgccttggagaagctcct

SEQ ID NO: 100050 - DNA, 23 bp, Homo sapiens
cgcccagcctcagtgacctgggc

SEQ ID NO: 100051 - DNA, 22 bp, Homo sapiens
tcatggcttttattatgttgag

SEQ ID NO: 100052 - DNA, 22 bp, Homo sapiens
gaggtgtcatcaggcagctctg

SEQ ID NO: 100053 - DNA, 22 bp, Homo sapiens
caggaagaccagggctgtggct

SEQ ID NO: 100054 - DNA, 22 bp, Homo sapiens
gggaagagggagctggaatgat

SEQ ID NO: 100055 - DNA, 20 bp, Homo sapiens
tttgagaccagtctgcccaa

SEQ ID NO: 100056 - DNA, 22 bp, Homo sapiens
tgatggctgtagggtccggggc

SEQ ID NO: 100057 - DNA, 22 bp, Homo sapiens
agttgcagacgcagagatgttg

SEQ ID NO: 100058 - DNA, 22 bp, Homo sapiens
gtagtctgaacagtaattttgt

SEQ ID NO: 100059 - DNA, 22 bp, Homo sapiens
tccaagatctacagcagtttag

SEQ ID NO: 100060 - DNA, 22 bp, Homo sapiens
agaggaggctctgggatcgtcc

SEQ ID NO: 100061 - DNA, 22 bp, Homo sapiens
tagcacagggctcctcaaccca

SEQ ID NO: 100062 - DNA, 22 bp, Homo sapiens
gcccagccacagtcactttcat

SEQ ID NO: 100063 - DNA, 22 bp, Homo sapiens
gccaccccataggtgttaggtg

SEQ ID NO: 100064 - DNA, 22 bp, Homo sapiens
tctgtgaagctctgaacagcag

SEQ ID NO: 100065 - DNA, 22 bp, Homo sapiens
ggaggaggggtgactgaatgct

SEQ ID NO: 100066 - DNA, 22 bp, Homo sapiens
cggagtcttgctatgttgccca

SEQ ID NO: 100067 - DNA, 22 bp, Homo sapiens
tttattctgtgctacatgaaga

SEQ ID NO: 100068 - DNA, 22 bp, Homo sapiens
tgttttaagggtcaactgtcac

SEQ ID NO: 100069 - DNA, 22 bp, Homo sapiens
tacatttataaggcttctctgt

SEQ ID NO: 100070 - DNA, 22 bp, Homo sapiens
aggagaagccaagttgtgagca

SEQ ID NO: 100071 - DNA, 22 bp, Homo sapiens
gccctagcgccagctcagcacc

SEQ ID NO: 100072 - DNA, 17 bp, Homo sapiens
tggctctgtcctcagct

SEQ ID NO: 100073 - DNA, 22 bp, Homo sapiens
tgagatcattgacttgttcctg

SEQ ID NO: 100074 - DNA, 22 bp, Homo sapiens
ggtgggagagctctgtctccag

SEQ ID NO: 100075 - DNA, 22 bp, Homo sapiens
acccagccatgttcagttctct

SEQ ID NO: 100076 - DNA, 22 bp, Homo sapiens
tggaagggagctggaatttgga

SEQ ID NO: 100077 - DNA, 22 bp, Homo sapiens
tgtttctgtatgatcaatattg

SEQ ID NO: 100078 - DNA, 22 bp, Homo sapiens
gcaaacaaggacatacatcctg

SEQ ID NO: 100079 - DNA, 22 bp, Homo sapiens
tcctcctgtctaccagttcctg

SEQ ID NO: 100080 - DNA, 22 bp, Homo sapiens
ttctgcaggctgtacaagaagc

SEQ ID NO: 100081 - DNA, 22 bp, Homo sapiens
aggtttctttatgctgctagaa

SEQ ID NO: 100082 - DNA, 22 bp, Homo sapiens
gactttgtgccaaacgccagaa

SEQ ID NO: 100083 - DNA, 22 bp, Homo sapiens
tggtacacatgtccaaggtcag

SEQ ID NO: 100084 - DNA, 22 bp, Homo sapiens
agtcttagaactacagtgccta

SEQ ID NO: 100085 - DNA, 22 bp, Homo sapiens
agtccaggcattccagccattc

SEQ ID NO: 100086 - DNA, 22 bp, Homo sapiens
cagctacaaatacttttgtatg

SEQ ID NO: 100087 - DNA, 22 bp, Homo sapiens
ccagcttgctcctctgcaatgg

SEQ ID NO: 100088 - DNA, 22 bp, Homo sapiens
tgtctggtgggttgacaggcag

SEQ ID NO: 100089 - DNA, 22 bp, Homo sapiens
ttatcacttatgagctttttgc

SEQ ID NO: 100090 - DNA, 22 bp, Homo sapiens
tctggctccaggaccgggcaca

SEQ ID NO: 100091 - DNA, 22 bp, Homo sapiens
ttcagtttcaagtccctctggg

SEQ ID NO: 100092 - DNA, 22 bp, Homo sapiens
gtggctcacgcctgtaatccca

SEQ ID NO: 100093 - DNA, 21 bp, Homo sapiens
tggtacaccttgcctgtcaga

SEQ ID NO: 100094 - DNA, 22 bp, Homo sapiens
cattggccttttatcctagagg

SEQ ID NO: 100095 - DNA, 22 bp, Homo sapiens
aaagttctctatggtgtaaaaa

SEQ ID NO: 100096 - DNA, 22 bp, Homo sapiens
atgttgtgtttgactgttaccc

SEQ ID NO: 100097 - DNA, 22 bp, Homo sapiens
aactcaaagatgcatgacgctt

SEQ ID NO: 100098 - DNA, 22 bp, Homo sapiens
cctggctcctacgggtattttg

SEQ ID NO: 100099 - DNA, 23 bp, Homo sapiens
caccactttctccttctccttgg

SEQ ID NO: 100100 - DNA, 22 bp, Homo sapiens
tcacagctcactgtagcctcga

SEQ ID NO: 100101 - DNA, 22 bp, Homo sapiens
aggttatatgactgtcatgcct

SEQ ID NO: 100102 - DNA, 22 bp, Homo sapiens
tggctccgttgtacaggctgga

SEQ ID NO: 100103 - DNA, 23 bp, Homo sapiens
agcagccagagatcctcggccct

SEQ ID NO: 100104 - DNA, 20 bp, Homo sapiens
tatttctgggcaaccattta

SEQ ID NO: 100105 - DNA, 21 bp, Homo sapiens
aggcatgagccctgcatggac

SEQ ID NO: 100106 - DNA, 22 bp, Homo sapiens
gaagttctttatagcagtgtga

SEQ ID NO: 100107 - DNA, 22 bp, Homo sapiens
tacaaaaaattgatactgacga

SEQ ID NO: 100108 - DNA, 22 bp, Homo sapiens
aggcttttctccagaatgtact

SEQ ID NO: 100109 - DNA, 22 bp, Homo sapiens
ggcagcactgcagcttgttggg

SEQ ID NO: 100110 - DNA, 22 bp, Homo sapiens
aagaactgtttacaattttcac

SEQ ID NO: 100111 - DNA, 22 bp, Homo sapiens
agtgcaggccccaggccaggcc

SEQ ID NO: 100112 - DNA, 22 bp, Homo sapiens
tttcttaggctctaaaatgact

SEQ ID NO: 100113 - DNA, 22 bp, Homo sapiens
ataccaccatctatgaaaggta

SEQ ID NO: 100114 - DNA, 22 bp, Homo sapiens
ggtcagccttggatttggtagc

SEQ ID NO: 100115 - DNA, 22 bp, Homo sapiens
actctggccatcttggaccttg

SEQ ID NO: 100116 - DNA, 22 bp, Homo sapiens
gtggctcacacctgtaatccca

SEQ ID NO: 100117 - DNA, 22 bp, Homo sapiens
ctggcagagttgggtctcaaat

SEQ ID NO: 100118 - DNA, 23 bp, Homo sapiens
ggagtgcaatggcgccatctcgg

SEQ ID NO: 100119 - DNA, 22 bp, Homo sapiens
ttatttaaaagtggtaagattc

SEQ ID NO: 100120 - DNA, 22 bp, Homo sapiens
tttgtgaataggttggcttcca

SEQ ID NO: 100121 - DNA, 22 bp, Homo sapiens
aacatagaataaatgagttagg

SEQ ID NO: 100122 - DNA, 20 bp, Homo sapiens
caaatccctgctctgtgctg

SEQ ID NO: 100123 - DNA, 22 bp, Homo sapiens
ataaaatttgctactgttaaat

SEQ ID NO: 100124 - DNA, 22 bp, Homo sapiens
gtctgaatacgtacttgtgaag

SEQ ID NO: 100125 - DNA, 22 bp, Homo sapiens
ttgagcccaggaggcctgggtg

SEQ ID NO: 100126 - DNA, 22 bp, Homo sapiens
gccagggttcgaatccgtatgg

SEQ ID NO: 100127 - DNA, 22 bp, Homo sapiens
gaggaggcttccgggaggcacg

SEQ ID NO: 100128 - DNA, 22 bp, Homo sapiens
atacaaaatatatactggagac

SEQ ID NO: 100129 - DNA, 22 bp, Homo sapiens
atggctctgttttttatgctct

SEQ ID NO: 100130 - DNA, 22 bp, Homo sapiens
gaggcagaggttgcagtgagct

SEQ ID NO: 100131 - DNA, 22 bp, Homo sapiens
accaccttcctgcgtgtctctt

SEQ ID NO: 100132 - DNA, 22 bp, Homo sapiens
aggaaggcttctttggtcttct

SEQ ID NO: 100133 - DNA, 22 bp, Homo sapiens
aagatacagacagagccaaaat

SEQ ID NO: 100134 - DNA, 22 bp, Homo sapiens
gaggcagaagttgcagtgagca

SEQ ID NO: 100135 - DNA, 22 bp, Homo sapiens
cagcctggtccccggctcaccc

SEQ ID NO: 100136 - DNA, 22 bp, Homo sapiens
cctgggaggctgaggctgcagt

SEQ ID NO: 100137 - DNA, 22 bp, Homo sapiens
aggcaaggtgctacagacagtg

SEQ ID NO: 100138 - DNA, 22 bp, Homo sapiens
tcgggctcgctctcctagcgga

SEQ ID NO: 100139 - DNA, 22 bp, Homo sapiens
tcgcccagctcatctcccacaa

SEQ ID NO: 100140 - DNA, 22 bp, Homo sapiens
catcccctgatgctcttgagta

SEQ ID NO: 100141 - DNA, 22 bp, Homo sapiens
caggaaggggctcactctggcc

SEQ ID NO: 100142 - DNA, 22 bp, Homo sapiens
tctgctttcttactaaaaatga

SEQ ID NO: 100143 - DNA, 22 bp, Homo sapiens
gtggcccaggttggagtgcagt

SEQ ID NO: 100144 - DNA, 22 bp, Homo sapiens
gccagggttgccaatgggggca

SEQ ID NO: 100145 - DNA, 22 bp, Homo sapiens
acagcagcaatagcagtgacat

SEQ ID NO: 100146 - DNA, 22 bp, Homo sapiens
tggacaggcaagcaagacatac

SEQ ID NO: 100147 - DNA, 22 bp, Homo sapiens
ctggcccaggtggtcgttgagg

SEQ ID NO: 100148 - DNA, 22 bp, Homo sapiens
acagattagctggggccattga

SEQ ID NO: 100149 - DNA, 22 bp, Homo sapiens
tgtccaggctaaagtgcagtgg

SEQ ID NO: 100150 - DNA, 22 bp, Homo sapiens
ttgtctaatgagctccacttca

SEQ ID NO: 100151 - DNA, 22 bp, Homo sapiens
tgaacatgctgttgatggcctg

SEQ ID NO: 100152 - DNA, 22 bp, Homo sapiens
gtctctcaaaactagaagagaa

SEQ ID NO: 100153 - DNA, 22 bp, Homo sapiens
tttcataatactgtacatgaaa

SEQ ID NO: 100154 - DNA, 23 bp, Homo sapiens
actcgtggaattctctgcgatcg

SEQ ID NO: 100155 - DNA, 21 bp, Homo sapiens
tttcttaggctctaaaatgac

SEQ ID NO: 100156 - DNA, 22 bp, Homo sapiens
agggaagaggaccagagtctct

SEQ ID NO: 100157 - DNA, 22 bp, Homo sapiens
ctctcgccagcggggctgcgct

SEQ ID NO: 100158 - DNA, 21 bp, Homo sapiens
ggccccgcagacccagcacgt

SEQ ID NO: 100159 - DNA, 22 bp, Homo sapiens
atacaaaaattagccgggagta

SEQ ID NO: 100160 - DNA, 22 bp, Homo sapiens
gcccagcccagaaaggttcgga

SEQ ID NO: 100161 - DNA, 22 bp, Homo sapiens
agtccaggactgtttcagctga

SEQ ID NO: 100162 - DNA, 19 bp, Homo sapiens
acccagcccaggagtggca

SEQ ID NO: 100163 - DNA, 22 bp, Homo sapiens
ttggccatctaagcccagccac

SEQ ID NO: 100164 - DNA, 22 bp, Homo sapiens
cagaatcaagtccaattagcac

SEQ ID NO: 100165 - DNA, 22 bp, Homo sapiens
tcatctccatacggtctcgcag

SEQ ID NO: 100166 - DNA, 22 bp, Homo sapiens
tgtgttgtgacattcttggatg

SEQ ID NO: 100167 - DNA, 22 bp, Homo sapiens
ttattagagtgctttgagaaag

SEQ ID NO: 100168 - DNA, 20 bp, Homo sapiens
caggtccagcacgtgcacgg

SEQ ID NO: 100169 - DNA, 19 bp, Homo sapiens
tgttgtctaccatgaagtc

SEQ ID NO: 100170 - DNA, 22 bp, Homo sapiens
agagtactgcctcagttatgaa

SEQ ID NO: 100171 - DNA, 22 bp, Homo sapiens
ggcatgcacccggtgaccatga

SEQ ID NO: 100172 - DNA, 22 bp, Homo sapiens
ccagcagccaccttctcgaaat

SEQ ID NO: 100173 - DNA, 22 bp, Homo sapiens
atgttctacagatggaaagggg

SEQ ID NO: 100174 - DNA, 22 bp, Homo sapiens
ttcataaacaaattaaggcctg

SEQ ID NO: 100175 - DNA, 23 bp, Homo sapiens
attttttgtctttgtaactagat

SEQ ID NO: 100176 - DNA, 22 bp, Homo sapiens
tctgccgtgcgaggtcccacca

SEQ ID NO: 100177 - DNA, 22 bp, Homo sapiens
tagcttatcccacagtgcccag

SEQ ID NO: 100178 - DNA, 22 bp, Homo sapiens
cagccccacacggtctagctct

SEQ ID NO: 100179 - DNA, 18 bp, Homo sapiens
tggaggaaaaatctcatg

SEQ ID NO: 100180 - DNA, 22 bp, Homo sapiens
ttgggctgaaccctgcagctga

SEQ ID NO: 100181 - DNA, 22 bp, Homo sapiens
gagcctggagctggaacgaagc

SEQ ID NO: 100182 - DNA, 22 bp, Homo sapiens
aagccctggcgggtggagggcc

SEQ ID NO: 100183 - DNA, 22 bp, Homo sapiens
tttaaaaaactagtctgagtct

SEQ ID NO: 100184 - DNA, 19 bp, Homo sapiens
ggctgccttctgctcatct

SEQ ID NO: 100185 - DNA, 22 bp, Homo sapiens
tctccccagtatggattctctg

SEQ ID NO: 100186 - DNA, 22 bp, Homo sapiens
gtggcccaggctggagtgcagt

SEQ ID NO: 100187 - DNA, 20 bp, Homo sapiens
tcagccattccttacctttc

SEQ ID NO: 100188 - DNA, 22 bp, Homo sapiens
tgtccaggctggagtgcagtgg

SEQ ID NO: 100189 - DNA, 22 bp, Homo sapiens
tttaatcaggcaaagcataata

SEQ ID NO: 100190 - DNA, 22 bp, Homo sapiens
aggaagatgtgcaaagttggaa

SEQ ID NO: 100191 - DNA, 22 bp, Homo sapiens
ttgtcttttgtgggaaatatgg

SEQ ID NO: 100192 - DNA, 22 bp, Homo sapiens
cagcgtctcgttgtgggcctcg

SEQ ID NO: 100193 - DNA, 22 bp, Homo sapiens
gaattttattactagtcaactg

SEQ ID NO: 100194 - DNA, 22 bp, Homo sapiens
ctctttggatagaattacaaag

SEQ ID NO: 100195 - DNA, 22 bp, Homo sapiens
tccacgctgtgtgaccttgggc

SEQ ID NO: 100196 - DNA, 22 bp, Homo sapiens
tcaccggcagacgtggcctgat

SEQ ID NO: 100197 - DNA, 22 bp, Homo sapiens
gtggattacaagacagttgaga

SEQ ID NO: 100198 - DNA, 22 bp, Homo sapiens
ggaggtcccaggcctggcagca

SEQ ID NO: 100199 - DNA, 20 bp, Homo sapiens
attagctcaggtgaggtcat

SEQ ID NO: 100200 - DNA, 22 bp, Homo sapiens
atgcagaagactgaaaagctga

SEQ ID NO: 100201 - DNA, 22 bp, Homo sapiens
ggcgccagcactgcagcgcctc

SEQ ID NO: 100202 - DNA, 22 bp, Homo sapiens
agaaaacataggagacaggaaa

SEQ ID NO: 100203 - DNA, 19 bp, Homo sapiens
tctcaattctccccactgc

SEQ ID NO: 100204 - DNA, 22 bp, Homo sapiens
ttgggctgcagcaattattagt

SEQ ID NO: 100205 - DNA, 22 bp, Homo sapiens
ctacaaaagtaattgtggtttt

SEQ ID NO: 100206 - DNA, 22 bp, Homo sapiens
tccagctgttccatcagctctt

SEQ ID NO: 100207 - DNA, 22 bp, Homo sapiens
atgtttttggaaatgggaacat

SEQ ID NO: 100208 - DNA, 22 bp, Homo sapiens
tgggaaggggagctggaaagga

SEQ ID NO: 100209 - DNA, 22 bp, Homo sapiens
gaaggaagtcattagtgcagac

SEQ ID NO: 100210 - DNA, 22 bp, Homo sapiens
tgaagactcagaagctaagata

SEQ ID NO: 100211 - DNA, 22 bp, Homo sapiens
agtgctatcgagttctaatgct

SEQ ID NO: 100212 - DNA, 22 bp, Homo sapiens
gaatttcctctaaacccctgag

SEQ ID NO: 100213 - DNA, 22 bp, Homo sapiens
aaaaaattatcatagttcctga

SEQ ID NO: 100214 - DNA, 22 bp, Homo sapiens
agattcaggcatgtcttcattt

SEQ ID NO: 100215 - DNA, 22 bp, Homo sapiens
ggctttctgtctgcgtctgtgt

SEQ ID NO: 100216 - DNA, 22 bp, Homo sapiens
agtttccatcccacacttgctt

SEQ ID NO: 100217 - DNA, 22 bp, Homo sapiens
ttctgcagtgttaacaatgtca

SEQ ID NO: 100218 - DNA, 22 bp, Homo sapiens
tcagcctgctccaagtgctgcc

SEQ ID NO: 100219 - DNA, 22 bp, Homo sapiens
aacatacgagcagtttatagag

SEQ ID NO: 100220 - DNA, 22 bp, Homo sapiens
ccggagtgtctggcctgctggg

SEQ ID NO: 100221 - DNA, 22 bp, Homo sapiens
accccactcacacatggacctg

SEQ ID NO: 100222 - DNA, 22 bp, Homo sapiens
aggaaataggaccagacaaagc

SEQ ID NO: 100223 - DNA, 14 bp, Homo sapiens
aagatcaccttcct

SEQ ID NO: 100224 - DNA, 22 bp, Homo sapiens
tgggaagggtcaacagctggaa

SEQ ID NO: 100225 - DNA, 22 bp, Homo sapiens
aagtccaggtcctcattccatc

SEQ ID NO: 100226 - DNA, 22 bp, Homo sapiens
tgatgaccgccaacgtttaggt

SEQ ID NO: 100227 - DNA, 22 bp, Homo sapiens
ggccagcctggggctcccagac

SEQ ID NO: 100228 - DNA, 22 bp, Homo sapiens
ccagatatcactgccgtgttgt

SEQ ID NO: 100229 - DNA, 23 bp, Homo sapiens
gcctgccgcctggctgagaactg

SEQ ID NO: 100230 - DNA, 22 bp, Homo sapiens
aagatattcaaagatttattag

SEQ ID NO: 100231 - DNA, 22 bp, Homo sapiens
gcccaggaggagaggctgcagt

SEQ ID NO: 100232 - DNA, 22 bp, Homo sapiens
tatttcttttcgtgacttattg

SEQ ID NO: 100233 - DNA, 22 bp, Homo sapiens
tgatcaaaacattactccacca

SEQ ID NO: 100234 - DNA, 22 bp, Homo sapiens
gagggtggtggcttaaggtgct

SEQ ID NO: 100235 - DNA, 22 bp, Homo sapiens
cacagtcctgccagagggcctt

SEQ ID NO: 100236 - DNA, 23 bp, Homo sapiens
aatgggtgcaactatccatgaca

SEQ ID NO: 100237 - DNA, 22 bp, Homo sapiens
tccagcttataggtagatttaa

SEQ ID NO: 100238 - DNA, 23 bp, Homo sapiens
ttaacaggatctcgggcaagagg

SEQ ID NO: 100239 - DNA, 22 bp, Homo sapiens
gtccaggcctgcctctgaggag

SEQ ID NO: 100240 - DNA, 18 bp, Homo sapiens
cagcctctgattggttgc

SEQ ID NO: 100241 - DNA, 22 bp, Homo sapiens
ttccaatagtgtgaccttatag

SEQ ID NO: 100242 - DNA, 22 bp, Homo sapiens
gaggagggagctggaagctctt

SEQ ID NO: 100243 - DNA, 22 bp, Homo sapiens
tgcttctgactaagctgcatga

SEQ ID NO: 100244 - DNA, 22 bp, Homo sapiens
gtggcccatcacgtttcgcctt

SEQ ID NO: 100245 - DNA, 22 bp, Homo sapiens
agcctattccaggatgagctca

SEQ ID NO: 100246 - DNA, 22 bp, Homo sapiens
gggaggcagtgctggaggctgg

SEQ ID NO: 100247 - DNA, 22 bp, Homo sapiens
aggtctcttgctgtctctgggc

SEQ ID NO: 100248 - DNA, 22 bp, Homo sapiens
ctgctgagagccccagctgaga

SEQ ID NO: 100249 - DNA, 22 bp, Homo sapiens
atgaaatatcttgaagaaattc

SEQ ID NO: 100250 - DNA, 22 bp, Homo sapiens
aagtcacactagacaactgagg

SEQ ID NO: 100251 - DNA, 22 bp, Homo sapiens
tggcccagtatgtataatctta

SEQ ID NO: 100252 - DNA, 22 bp, Homo sapiens
aggacaaaggaccagatctgga

SEQ ID NO: 100253 - DNA, 22 bp, Homo sapiens
tcgtgaggctctgcatcgcaca

SEQ ID NO: 100254 - DNA, 22 bp, Homo sapiens
ttatttaatgtgatctgaagag

SEQ ID NO: 100255 - DNA, 20 bp, Homo sapiens
ataaaataactgccacaaga

SEQ ID NO: 100256 - DNA, 22 bp, Homo sapiens
tttgaagactactgggagtgaa

SEQ ID NO: 100257 - DNA, 22 bp, Homo sapiens
gcctggattccttgtttctcag

SEQ ID NO: 100258 - DNA, 22 bp, Homo sapiens
gcatacatgggtgcagggacat

SEQ ID NO: 100259 - DNA, 22 bp, Homo sapiens
ttgcccagagtcacccagctca

SEQ ID NO: 100260 - DNA, 22 bp, Homo sapiens
ttggaacatgccggggtccagg

SEQ ID NO: 100261 - DNA, 22 bp, Homo sapiens
ttgttgtcattgtagaggattt

SEQ ID NO: 100262 - DNA, 22 bp, Homo sapiens
gtgcagagaggaccttggggag

SEQ ID NO: 100263 - DNA, 22 bp, Homo sapiens
cccactgtttccctgaggctct

SEQ ID NO: 100264 - DNA, 22 bp, Homo sapiens
tttgaagactactgggagtgaa

SEQ ID NO: 100265 - DNA, 22 bp, Homo sapiens
aggggatggagctggaaggcag

SEQ ID NO: 100266 - DNA, 20 bp, Homo sapiens
tgttctgtcgtctttcttca

SEQ ID NO: 100267 - DNA, 22 bp, Homo sapiens
gacctcatgatccacctgcctt

SEQ ID NO: 100268 - DNA, 21 bp, Homo sapiens
gaacccagcagcagtgctctg

SEQ ID NO: 100269 - DNA, 22 bp, Homo sapiens
tctgccttttactagctggatg

SEQ ID NO: 100270 - DNA, 22 bp, Homo sapiens
atgccactgcacttcagcttgg

SEQ ID NO: 100271 - DNA, 20 bp, Homo sapiens
aatgctgcttctttttgcat

SEQ ID NO: 100272 - DNA, 22 bp, Homo sapiens
cctgcagacacttgtccagcaa

SEQ ID NO: 100273 - DNA, 22 bp, Homo sapiens
cccaggaggtggaggctgcagt

SEQ ID NO: 100274 - DNA, 22 bp, Homo sapiens
tgcagaaacaagccatcattca

SEQ ID NO: 100275 - DNA, 22 bp, Homo sapiens
tgagcaggcgcagcaggaggtc

SEQ ID NO: 100276 - DNA, 17 bp, Homo sapiens
acttcccacccctccag

SEQ ID NO: 100277 - DNA, 22 bp, Homo sapiens
tgaggcaggagaatcacatgaa

SEQ ID NO: 100278 - DNA, 22 bp, Homo sapiens
cccaggagttggaggctgcagt

SEQ ID NO: 100279 - DNA, 22 bp, Homo sapiens
agggtggcactggtggctctat

SEQ ID NO: 100280 - DNA, 22 bp, Homo sapiens
aagcacaatgaacatcttagat

SEQ ID NO: 100281 - DNA, 22 bp, Homo sapiens
gcctccggagttgcagtgtctt

SEQ ID NO: 100282 - DNA, 22 bp, Homo sapiens
gggctagcctcttccctgctcc

SEQ ID NO: 100283 - DNA, 22 bp, Homo sapiens
tccttagacaaagagtgggctt

SEQ ID NO: 100284 - DNA, 22 bp, Homo sapiens
gtggcaagatgactactcactg

SEQ ID NO: 100285 - DNA, 22 bp, Homo sapiens
agggccagcactcctggcagga

SEQ ID NO: 100286 - DNA, 22 bp, Homo sapiens
taaatcttctacatcatcataa

SEQ ID NO: 100287 - DNA, 22 bp, Homo sapiens
aatcacacaaaggcaacttttg

SEQ ID NO: 100288 - DNA, 22 bp, Homo sapiens
acctcctggcctcaagcaatcc

SEQ ID NO: 100289 - DNA, 22 bp, Homo sapiens
gaacttggaactggggctactg

SEQ ID NO: 100290 - DNA, 22 bp, Homo sapiens
aggtgcatctcgtagctcttct

SEQ ID NO: 100291 - DNA, 22 bp, Homo sapiens
acctggccagtggggccgcgct

SEQ ID NO: 100292 - DNA, 21 bp, Homo sapiens
cagggccaatcctgacctcta

SEQ ID NO: 100293 - DNA, 22 bp, Homo sapiens
ctgctcttcacactacacccgt

SEQ ID NO: 100294 - DNA, 22 bp, Homo sapiens
catgttggtgtgctgcacccgt

SEQ ID NO: 100295 - DNA, 22 bp, Homo sapiens
tctgcaggtaagcgttcttgga

SEQ ID NO: 100296 - DNA, 22 bp, Homo sapiens
atgcacctgaactccatcagct

SEQ ID NO: 100297 - DNA, 22 bp, Homo sapiens
tgtctcttttcaagctaccctt

SEQ ID NO: 100298 - DNA, 22 bp, Homo sapiens
tttggggatgtctgagttgttg

SEQ ID NO: 100299 - DNA, 22 bp, Homo sapiens
acccaggctggagtgcagtgat

SEQ ID NO: 100300 - DNA, 22 bp, Homo sapiens
tcactgcactccagcactcagg

SEQ ID NO: 100301 - DNA, 22 bp, Homo sapiens
gggcggggggagctggaatgaa

SEQ ID NO: 100302 - DNA, 22 bp, Homo sapiens
atcctcagacttcacgttccat

SEQ ID NO: 100303 - DNA, 22 bp, Homo sapiens
ggcgccgcactcggtgcagccg

SEQ ID NO: 100304 - DNA, 22 bp, Homo sapiens
ctgaggcaggatggcctggctg

SEQ ID NO: 100305 - DNA, 22 bp, Homo sapiens
ggggccgaccgcggttcaggcc

SEQ ID NO: 100306 - DNA, 22 bp, Homo sapiens
ttattgaaggaactgaaataaa

SEQ ID NO: 100307 - DNA, 22 bp, Homo sapiens
ggtgtccgcgctgtagaaggtc

SEQ ID NO: 100308 - DNA, 22 bp, Homo sapiens
acccagtctggagtgcagtgac

SEQ ID NO: 100309 - DNA, 22 bp, Homo sapiens
atgccactgcacttcagcctgg

SEQ ID NO: 100310 - DNA, 22 bp, Homo sapiens
tgtgacaagcattgtatattgg

SEQ ID NO: 100311 - DNA, 22 bp, Homo sapiens
gctctgagtcacactgccctgt

SEQ ID NO: 100312 - DNA, 22 bp, Homo sapiens
ctggtgtggactccgcgcggag

SEQ ID NO: 100313 - DNA, 22 bp, Homo sapiens
ctgtccctgagcaactcctgtt

SEQ ID NO: 100314 - DNA, 22 bp, Homo sapiens
tcactgcgcttcagcctgggtg

SEQ ID NO: 100315 - DNA, 22 bp, Homo sapiens
ggctcaatgcaacttctgcctc

SEQ ID NO: 100316 - DNA, 22 bp, Homo sapiens
tacgggcacgcaccacgatgcc

SEQ ID NO: 100317 - DNA, 22 bp, Homo sapiens
cacccaggctggagagcagtgg

SEQ ID NO: 100318 - DNA, 22 bp, Homo sapiens
acccaggctggagtgcagtggg

SEQ ID NO: 100319 - DNA, 22 bp, Homo sapiens
ggctagggatctagaccaggac

SEQ ID NO: 100320 - DNA, 19 bp, Homo sapiens
atgtacccagtgtcaatcc

SEQ ID NO: 100321 - DNA, 22 bp, Homo sapiens
cacccaggctggattgcagtgg

SEQ ID NO: 100322 - DNA, 22 bp, Homo sapiens
tcactcaggctggagtgcagtg

SEQ ID NO: 100323 - DNA, 22 bp, Homo sapiens
gtctgctttgtctttcatgata

SEQ ID NO: 100324 - DNA, 19 bp, Homo sapiens
ctctggagtcattgctccc

SEQ ID NO: 100325 - DNA, 22 bp, Homo sapiens
tgcactccaggctgggtgacag

SEQ ID NO: 100326 - DNA, 22 bp, Homo sapiens
ctgcaccctcaaactcctgggc

SEQ ID NO: 100327 - DNA, 22 bp, Homo sapiens
atatatttgagaatattcatga

SEQ ID NO: 100328 - DNA, 22 bp, Homo sapiens
ttgtgctgtgagaatgctcatt

SEQ ID NO: 100329 - DNA, 22 bp, Homo sapiens
ctgatcccaggcactgtcgcaa

SEQ ID NO: 100330 - DNA, 22 bp, Homo sapiens
gcctggccgggtcttggatttt

SEQ ID NO: 100331 - DNA, 22 bp, Homo sapiens
tagcagcaaagcaggatctgct

SEQ ID NO: 100332 - DNA, 22 bp, Homo sapiens
cagggggctcaaaggagagtgc

SEQ ID NO: 100333 - DNA, 22 bp, Homo sapiens
agtgaaaacctaatcatgcagt

SEQ ID NO: 100334 - DNA, 22 bp, Homo sapiens
gtcaggactctgacccgtcccg

SEQ ID NO: 100335 - DNA, 22 bp, Homo sapiens
tctagggtgtataaggaagcct

SEQ ID NO: 100336 - DNA, 22 bp, Homo sapiens
tgcgggtcccagggtcacaggc

SEQ ID NO: 100337 - DNA, 23 bp, Homo sapiens
gacagagtgagaccttgtcttac

SEQ ID NO: 100338 - DNA, 22 bp, Homo sapiens
gctcccaggatgaggagccagg

SEQ ID NO: 100339 - DNA, 16 bp, Homo sapiens
ccacctgcagctctca

SEQ ID NO: 100340 - DNA, 22 bp, Homo sapiens
ctcttcctagtgtgcagcgtgg

SEQ ID NO: 100341 - DNA, 22 bp, Homo sapiens
actgttgaagtgccagcttgat

SEQ ID NO: 100342 - DNA, 17 bp, Homo sapiens
ggctgcagtccaggagg

SEQ ID NO: 100343 - DNA, 22 bp, Homo sapiens
tcacccaggctggagtgtagtg

SEQ ID NO: 100344 - DNA, 22 bp, Homo sapiens
tgccacctgtacatgctatctg

SEQ ID NO: 100345 - DNA, 22 bp, Homo sapiens
aggctctgtcaggcggagcagc

SEQ ID NO: 100346 - DNA, 22 bp, Homo sapiens
tgggtgctctgcgaccgtaggg

SEQ ID NO: 100347 - DNA, 22 bp, Homo sapiens
agtttccatcccacacttgctt

SEQ ID NO: 100348 - DNA, 22 bp, Homo sapiens
gcctccggagtcacagtgtctt

SEQ ID NO: 100349 - DNA, 22 bp, Homo sapiens
tcagtgtgaattcaggagccta

SEQ ID NO: 100350 - DNA, 22 bp, Homo sapiens
ggtgttgcagttgaagactggt

SEQ ID NO: 100351 - DNA, 22 bp, Homo sapiens
accctccccaagaggtcgtgcc

SEQ ID NO: 100352 - DNA, 22 bp, Homo sapiens
cctagagctctgctttatctaa

SEQ ID NO: 100353 - DNA, 22 bp, Homo sapiens
cctggcactgctgaagtcctgg

SEQ ID NO: 100354 - DNA, 22 bp, Homo sapiens
tggtggctaccaggtcctgggg

SEQ ID NO: 100355 - DNA, 22 bp, Homo sapiens
tcaccggcagacgtggcctgat

SEQ ID NO: 100356 - DNA, 22 bp, Homo sapiens
ttttcatttttgtagatgcaag

SEQ ID NO: 100357 - DNA, 22 bp, Homo sapiens
tgctcattggcgatctgaggga

SEQ ID NO: 100358 - DNA, 22 bp, Homo sapiens
tgccgtggggctgaggctggag

SEQ ID NO: 100359 - DNA, 22 bp, Homo sapiens
tgagtgaccagaagtccccctc

SEQ ID NO: 100360 - DNA, 22 bp, Homo sapiens
gggaggcagtgctggaggctgg

SEQ ID NO: 100361 - DNA, 18 bp, Homo sapiens
tcttccaacactgacacc

SEQ ID NO: 100362 - DNA, 22 bp, Homo sapiens
gcctcctgagtagctgggattg

SEQ ID NO: 100363 - DNA, 22 bp, Homo sapiens
ctgggtggcagagcctgcagtg

SEQ ID NO: 100364 - DNA, 22 bp, Homo sapiens
ccagtgtgcattatcatgtgtc

SEQ ID NO: 100365 - DNA, 22 bp, Homo sapiens
tggtggggccagacttcagctc

SEQ ID NO: 100366 - DNA, 22 bp, Homo sapiens
ccaggctggagtgcagtggcac

SEQ ID NO: 100367 - DNA, 22 bp, Homo sapiens
agggaaattaatgtgagcaatg

SEQ ID NO: 100368 - DNA, 22 bp, Homo sapiens
catccgcatgcaagtgctgtcc

SEQ ID NO: 100369 - DNA, 22 bp, Homo sapiens
tggtctgctgaacagccgtatc

SEQ ID NO: 100370 - DNA, 22 bp, Homo sapiens
tgggtgtccagaccctgcacat

SEQ ID NO: 100371 - DNA, 22 bp, Homo sapiens
caccaggctggagtgcagtggc

SEQ ID NO: 100372 - DNA, 22 bp, Homo sapiens
gggttgaggcggatgtcggcgg

SEQ ID NO: 100373 - DNA, 22 bp, Homo sapiens
actgcactccagcccgagcaac

SEQ ID NO: 100374 - DNA, 22 bp, Homo sapiens
tttgaggttagctagcagatca

SEQ ID NO: 100375 - DNA, 20 bp, Homo sapiens
gggcaaggaaacagccccca

SEQ ID NO: 100376 - DNA, 23 bp, Homo sapiens
aatgggtgcaactatccatgaca

SEQ ID NO: 100377 - DNA, 22 bp, Homo sapiens
ttgtgctctgtgttatttaagg

SEQ ID NO: 100378 - DNA, 22 bp, Homo sapiens
aacagtgtttttcttcagcact

SEQ ID NO: 100379 - DNA, 22 bp, Homo sapiens
agaggaagtaatcaggacctgc

SEQ ID NO: 100380 - DNA, 22 bp, Homo sapiens
gccatcctgatgacaggccact

SEQ ID NO: 100381 - DNA, 22 bp, Homo sapiens
gcactggccgcacgcgtagggc

SEQ ID NO: 100382 - DNA, 22 bp, Homo sapiens
cccaggaggcgcaggttgcggt

SEQ ID NO: 100383 - DNA, 22 bp, Homo sapiens
ttgtctgcatgattctaggcag

SEQ ID NO: 100384 - DNA, 22 bp, Homo sapiens
gagaggtggaggttgcagtgag

SEQ ID NO: 100385 - DNA, 22 bp, Homo sapiens
acatggcgggagtttcagatac

SEQ ID NO: 100386 - DNA, 22 bp, Homo sapiens
ccaggctgctgttggtgtccgc

SEQ ID NO: 100387 - DNA, 22 bp, Homo sapiens
gctggccacagatccccaggga

SEQ ID NO: 100388 - DNA, 22 bp, Homo sapiens
gtggatggagctggaagccatt

SEQ ID NO: 100389 - DNA, 22 bp, Homo sapiens
cccaggaggttgaggctgcagt

SEQ ID NO: 100390 - DNA, 18 bp, Homo sapiens
ccctcttgcacaaagcaa

SEQ ID NO: 100391 - DNA, 22 bp, Homo sapiens
agttgggtttgtgtcagttgca

SEQ ID NO: 100392 - DNA, 22 bp, Homo sapiens
cccaggaggcggaggttgcagt

SEQ ID NO: 100393 - DNA, 22 bp, Homo sapiens
ttttggctctgtctgtatcttt

SEQ ID NO: 100394 - DNA, 21 bp, Homo sapiens
tgctgggtttgcccatcaggc

SEQ ID NO: 100395 - DNA, 22 bp, Homo sapiens
tctgctctgtggcttcagctaa

SEQ ID NO: 100396 - DNA, 18 bp, Homo sapiens
gaccccgggatctgtcga

SEQ ID NO: 100397 - DNA, 20 bp, Homo sapiens
ccaccctgtccggggcggag

SEQ ID NO: 100398 - DNA, 23 bp, Homo sapiens
ctgtggtgaggccctagaatctg

SEQ ID NO: 100399 - DNA, 22 bp, Homo sapiens
ttctccgctaagttctctgcag

SEQ ID NO: 100400 - DNA, 22 bp, Homo sapiens
ctgctcctgtccagcagggcca

SEQ ID NO: 100401 - DNA, 22 bp, Homo sapiens
aacactgctgctgggttctgtg

SEQ ID NO: 100402 - DNA, 22 bp, Homo sapiens
tatgaggtaggtattatactta

SEQ ID NO: 100403 - DNA, 22 bp, Homo sapiens
ctgggcacagcgttgggctctt

SEQ ID NO: 100404 - DNA, 22 bp, Homo sapiens
gggaagagggagctggaatgat

SEQ ID NO: 100405 - DNA, 23 bp, Homo sapiens
gggggccgtcctggggattatag

SEQ ID NO: 100406 - DNA, 22 bp, Homo sapiens
tgcctgatgcaggagtatcaga

SEQ ID NO: 100407 - DNA, 22 bp, Homo sapiens
gcagatcaacactctctttcaa

SEQ ID NO: 100408 - DNA, 22 bp, Homo sapiens
gctcccagtctgatggaggaga

SEQ ID NO: 100409 - DNA, 22 bp, Homo sapiens
cagcagcagtggctgcagaaca

SEQ ID NO: 100410 - DNA, 22 bp, Homo sapiens
tccaactttctcctccggcttg

SEQ ID NO: 100411 - DNA, 22 bp, Homo sapiens
gcttaattctggctcagtttcc

SEQ ID NO: 100412 - DNA, 22 bp, Homo sapiens
atgtggcaccgatctttagcca

SEQ ID NO: 100413 - DNA, 22 bp, Homo sapiens
ttagtattaggatcatatttga

SEQ ID NO: 100414 - DNA, 22 bp, Homo sapiens
atgccactgcgctccagcctgg

SEQ ID NO: 100415 - DNA, 22 bp, Homo sapiens
tctgagacaggaagtggagggt

SEQ ID NO: 100416 - DNA, 22 bp, Homo sapiens
tgtggtgccgagagtctggacg

SEQ ID NO: 100417 - DNA, 22 bp, Homo sapiens
tgtggttttggttcagaaacaa

SEQ ID NO: 100418 - DNA, 22 bp, Homo sapiens
gttaaggctgagcaggacactg

SEQ ID NO: 100419 - DNA, 22 bp, Homo sapiens
actcggggtggagagagcggtg

SEQ ID NO: 100420 - DNA, 22 bp, Homo sapiens
ccatcacagtccccatcgtgat

SEQ ID NO: 100421 - DNA, 22 bp, Homo sapiens
ttgcatcagaattacttggagg

SEQ ID NO: 100422 - DNA, 22 bp, Homo sapiens
ggctgtggcagctggaagtggt

SEQ ID NO: 100423 - DNA, 22 bp, Homo sapiens
agatgctgggatgcttggatgg

SEQ ID NO: 100424 - DNA, 23 bp, Homo sapiens
aaacttgctatggctgaaatcat

SEQ ID NO: 100425 - DNA, 22 bp, Homo sapiens
ggggatggaggcgtgtggtcct

SEQ ID NO: 100426 - DNA, 18 bp, Homo sapiens
ggtgagggagctggaagc

SEQ ID NO: 100427 - DNA, 22 bp, Homo sapiens
tggaagacaatttgaaaacatt

SEQ ID NO: 100428 - DNA, 22 bp, Homo sapiens
agggcagagctgtctaaatggc

SEQ ID NO: 100429 - DNA, 22 bp, Homo sapiens
acccaagttttccatgcctgtt

SEQ ID NO: 100430 - DNA, 22 bp, Homo sapiens
ccaggaggttgaggctgcagtg

SEQ ID NO: 100431 - DNA, 22 bp, Homo sapiens
gcaagtgaatgaggttgagatt

SEQ ID NO: 100432 - DNA, 22 bp, Homo sapiens
acatcccatgcgcatctggcaa

SEQ ID NO: 100433 - DNA, 22 bp, Homo sapiens
aatcagaaattgagggtctggt

SEQ ID NO: 100434 - DNA, 22 bp, Homo sapiens
ccctcaggtgaaaggaaaaatt

SEQ ID NO: 100435 - DNA, 22 bp, Homo sapiens
tccaccctgcttttgtctttga

SEQ ID NO: 100436 - DNA, 22 bp, Homo sapiens
ttaaatattatgttgtctgcaa

SEQ ID NO: 100437 - DNA, 22 bp, Homo sapiens
ccttcccatgcagcctgtctga

SEQ ID NO: 100438 - DNA, 18 bp, Homo sapiens
atactagagctctttgcc

SEQ ID NO: 100439 - DNA, 22 bp, Homo sapiens
gctcttgtcaaaaattagttga

SEQ ID NO: 100440 - DNA, 22 bp, Homo sapiens
tcacccaggctggagtgcagtg

SEQ ID NO: 100441 - DNA, 22 bp, Homo sapiens
tctcccaggcaggagtgcagtg

SEQ ID NO: 100442 - DNA, 22 bp, Homo sapiens
aggggaggtgtccccaaatctc

SEQ ID NO: 100443 - DNA, 22 bp, Homo sapiens
agtcacagggggcccctgcaac

SEQ ID NO: 100444 - DNA, 22 bp, Homo sapiens
tgtgacagcacggttcaactgc

SEQ ID NO: 100445 - DNA, 21 bp, Homo sapiens
ctgtggtacagctgggacgga

SEQ ID NO: 100446 - DNA, 22 bp, Homo sapiens
ggagggcagagtcccctgctga

SEQ ID NO: 100447 - DNA, 22 bp, Homo sapiens
ctgtgctgggtccttcttttga

SEQ ID NO: 100448 - DNA, 22 bp, Homo sapiens
ccaggggttggaggttgcagtg

SEQ ID NO: 100449 - DNA, 22 bp, Homo sapiens
acccaggctggcgtgcagtggc

SEQ ID NO: 100450 - DNA, 22 bp, Homo sapiens
catctgtaaagtaggaatattg

SEQ ID NO: 100451 - DNA, 22 bp, Homo sapiens
atgtgctgagtgtgtatataca

SEQ ID NO: 100452 - DNA, 22 bp, Homo sapiens
ttggaagacaatgctgattctc

SEQ ID NO: 100453 - DNA, 23 bp, Homo sapiens
cagagctggctcagagctgcctg

SEQ ID NO: 100454 - DNA, 22 bp, Homo sapiens
cactccagcctcagtgacagag

SEQ ID NO: 100455 - DNA, 22 bp, Homo sapiens
acatttatataactcactagga

SEQ ID NO: 100456 - DNA, 22 bp, Homo sapiens
tttcctcttctggcaggcaggg

SEQ ID NO: 100457 - DNA, 22 bp, Homo sapiens
ggtgggagagctctgtctccag

SEQ ID NO: 100458 - DNA, 22 bp, Homo sapiens
gcctgttctccagcatccaggt

SEQ ID NO: 100459 - DNA, 22 bp, Homo sapiens
tcaatgtgaattaagaatactt

SEQ ID NO: 100460 - DNA, 22 bp, Homo sapiens
aatttcggttcaaggcccagtt

SEQ ID NO: 100461 - DNA, 22 bp, Homo sapiens
tattgtgaataatgccgcaata

SEQ ID NO: 100462 - DNA, 22 bp, Homo sapiens
cccaggagttagaggttgtggt

SEQ ID NO: 100463 - DNA, 22 bp, Homo sapiens
ttctcatgaaactcgcttcctc

SEQ ID NO: 100464 - DNA, 22 bp, Homo sapiens
ggtccccgtggaggctggagcg

SEQ ID NO: 100465 - DNA, 22 bp, Homo sapiens
atgatactctaggtgatttaca

SEQ ID NO: 100466 - DNA, 22 bp, Homo sapiens
gggtattaaaatgaaggagaaa

SEQ ID NO: 100467 - DNA, 22 bp, Homo sapiens
ttactcgtgacaatgtccttga

SEQ ID NO: 100468 - DNA, 22 bp, Homo sapiens
ggcatcttgttgctcaaatcta

SEQ ID NO: 100469 - DNA, 22 bp, Homo sapiens
agcaagattgaggcttcctcag

SEQ ID NO: 100470 - DNA, 22 bp, Homo sapiens
ttatttaaaagtggtaagattc

SEQ ID NO: 100471 - DNA, 22 bp, Homo sapiens
ccctcccagatgggcttgaggt

SEQ ID NO: 100472 - DNA, 22 bp, Homo sapiens
cttctgagatgttgttttacag

SEQ ID NO: 100473 - DNA, 22 bp, Homo sapiens
cggaggttgaggctgcagtgag

SEQ ID NO: 100474 - DNA, 22 bp, Homo sapiens
cccaggaggcagaagttgcagt

SEQ ID NO: 100475 - DNA, 21 bp, Homo sapiens
cagagctgtccaaaccctgac

SEQ ID NO: 100476 - DNA, 22 bp, Homo sapiens
tcactgcagcctctgcctcccg

SEQ ID NO: 100477 - DNA, 22 bp, Homo sapiens
atgttggccaggctggtcttga

SEQ ID NO: 100478 - DNA, 22 bp, Homo sapiens
cagggcctcctaaggcatctaa

SEQ ID NO: 100479 - DNA, 22 bp, Homo sapiens
ctctccattccctacagttttc

SEQ ID NO: 100480 - DNA, 22 bp, Homo sapiens
gggtggtggccagcagtgggca

SEQ ID NO: 100481 - DNA, 22 bp, Homo sapiens
tttatgtagttacggactatca

SEQ ID NO: 100482 - DNA, 22 bp, Homo sapiens
gctgaaggcccggaggacaggg

SEQ ID NO: 100483 - DNA, 22 bp, Homo sapiens
ccaggctggagtgcaatggcgt

SEQ ID NO: 100484 - DNA, 22 bp, Homo sapiens
ctctctgggcccagttggcacc

SEQ ID NO: 100485 - DNA, 22 bp, Homo sapiens
acacccaggctggcgtgcagtg

SEQ ID NO: 100486 - DNA, 23 bp, Homo sapiens
ggttctgccgcttactgctgtgc

SEQ ID NO: 100487 - DNA, 22 bp, Homo sapiens
acaggggacctaggaccctcgg

SEQ ID NO: 100488 - DNA, 22 bp, Homo sapiens
tgtggctctcatgcactcccag

SEQ ID NO: 100489 - DNA, 19 bp, Homo sapiens
tttgatagggcataatata

SEQ ID NO: 100490 - DNA, 22 bp, Homo sapiens
gctgcagacttctcatctcatt

SEQ ID NO: 100491 - DNA, 22 bp, Homo sapiens
attcttcctcatcaatctgtag

SEQ ID NO: 100492 - DNA, 22 bp, Homo sapiens
cagctgttcattgttgccaccc

SEQ ID NO: 100493 - DNA, 22 bp, Homo sapiens
agtgctgggctatctactgcta

SEQ ID NO: 100494 - DNA, 22 bp, Homo sapiens
ttatttaatgtgatctgaagag

SEQ ID NO: 100495 - DNA, 22 bp, Homo sapiens
acctggccaatttttgtatttt

SEQ ID NO: 100496 - DNA, 22 bp, Homo sapiens
ctccaggctcgtccaagatcga

SEQ ID NO: 100497 - DNA, 22 bp, Homo sapiens
tgtgactaggcctgagctcttg

SEQ ID NO: 100498 - DNA, 22 bp, Homo sapiens
cagggccagggacacgctgtca

SEQ ID NO: 100499 - DNA, 22 bp, Homo sapiens
cccagagcatgtgctgcctttg

SEQ ID NO: 100500 - DNA, 22 bp, Homo sapiens
tgacaggcaggacagaggtgtg

SEQ ID NO: 100501 - DNA, 22 bp, Homo sapiens
aggtggggaggagtgtctcttt

SEQ ID NO: 100502 - DNA, 22 bp, Homo sapiens
gaacttggcctgtctgtctggc

SEQ ID NO: 100503 - DNA, 22 bp, Homo sapiens
gagcagtaggagaaccctgagc

SEQ ID NO: 100504 - DNA, 22 bp, Homo sapiens
aagagggctgcaatcttattgc

SEQ ID NO: 100505 - DNA, 22 bp, Homo sapiens
ttgaggcaggtccgggtccttc

SEQ ID NO: 100506 - DNA, 22 bp, Homo sapiens
cctcctgcacctccaggaactc

SEQ ID NO: 100507 - DNA, 22 bp, Homo sapiens
tgtttcctttctggtgagcata

SEQ ID NO: 100508 - DNA, 22 bp, Homo sapiens
aagattttcagtgcctaaaaca

SEQ ID NO: 100509 - DNA, 22 bp, Homo sapiens
tcagacaactctggaggctggc

SEQ ID NO: 100510 - DNA, 22 bp, Homo sapiens
gacagctccagctcctccaggc

SEQ ID NO: 100511 - DNA, 22 bp, Homo sapiens
tgggatgccggcaggaggcaat

SEQ ID NO: 100512 - DNA, 22 bp, Homo sapiens
aggacagagggaccagagccca

SEQ ID NO: 100513 - DNA, 22 bp, Homo sapiens
ccagaaaaatcctcccttgtcc

SEQ ID NO: 100514 - DNA, 22 bp, Homo sapiens
agcgggctcacccggttgttgt

SEQ ID NO: 100515 - DNA, 22 bp, Homo sapiens
gggaggttgaggctgcagtgag

SEQ ID NO: 100516 - DNA, 22 bp, Homo sapiens
cagagctgtccaaaccctgaca

SEQ ID NO: 100517 - DNA, 22 bp, Homo sapiens
attttctatgttgtaattgtta

SEQ ID NO: 100518 - DNA, 22 bp, Homo sapiens
gcccagcacctctctcagggtt

SEQ ID NO: 100519 - DNA, 22 bp, Homo sapiens
gagggaaaggttaatacatgat

SEQ ID NO: 100520 - DNA, 22 bp, Homo sapiens
atcctcagagaacgaacacaat

SEQ ID NO: 100521 - DNA, 21 bp, Homo sapiens
gctcctggtgctgcgtggcgc

SEQ ID NO: 100522 - DNA, 22 bp, Homo sapiens
gcctcctggggtgccatcatct

SEQ ID NO: 100523 - DNA, 22 bp, Homo sapiens
acctcctccaaggagccatagg

SEQ ID NO: 100524 - DNA, 22 bp, Homo sapiens
tgggaggccgaggcaggtggat

SEQ ID NO: 100525 - DNA, 22 bp, Homo sapiens
atcctagaatcagcccttgctg

SEQ ID NO: 100526 - DNA, 23 bp, Homo sapiens
ctcaccaagcgccgccgctgtgt

SEQ ID NO: 100527 - DNA, 22 bp, Homo sapiens
acagtatagggcttatattgta

SEQ ID NO: 100528 - DNA, 20 bp, Homo sapiens
ggggaagtcactgcagtcag

SEQ ID NO: 100529 - DNA, 19 bp, Homo sapiens
aggctaaagagtcttgcgt

SEQ ID NO: 100530 - DNA, 22 bp, Homo sapiens
gccgggtgcagcgggcccgcca

SEQ ID NO: 100531 - DNA, 22 bp, Homo sapiens
ctccaacgaggctggggtacaa

SEQ ID NO: 100532 - DNA, 22 bp, Homo sapiens
agcgccactgcactccagcctg

SEQ ID NO: 100533 - DNA, 23 bp, Homo sapiens
tgaggcaggcggatcacgaggtc

SEQ ID NO: 100534 - DNA, 22 bp, Homo sapiens
ctcggggatccatccacgtggc

SEQ ID NO: 100535 - DNA, 22 bp, Homo sapiens
agaaatatgctgattagatgaa

SEQ ID NO: 100536 - DNA, 22 bp, Homo sapiens
ggtgggaggactgtttgaggca

SEQ ID NO: 100537 - DNA, 22 bp, Homo sapiens
ttatgatttgccacagattggt

SEQ ID NO: 100538 - DNA, 22 bp, Homo sapiens
tacaaaaaattgatactgacga

SEQ ID NO: 100539 - DNA, 22 bp, Homo sapiens
atgttctacagatggaaagggg

SEQ ID NO: 100540 - DNA, 22 bp, Homo sapiens
cccaggaggtggagcttgcagt

SEQ ID NO: 100541 - DNA, 22 bp, Homo sapiens
cagcagagaaattacatatttg

SEQ ID NO: 100542 - DNA, 22 bp, Homo sapiens
acaagcgggccacagtgctggt

SEQ ID NO: 100543 - DNA, 22 bp, Homo sapiens
tttaatgtagcgtgaaatgatt

SEQ ID NO: 100544 - DNA, 19 bp, Homo sapiens
tctcaattctccccactgc

SEQ ID NO: 100545 - DNA, 22 bp, Homo sapiens
ctggggtaggaggcagctgtgc

SEQ ID NO: 100546 - DNA, 22 bp, Homo sapiens
ctgtcctggggaaagccagccc

SEQ ID NO: 100547 - DNA, 22 bp, Homo sapiens
atgccacttcattccagcctcg

SEQ ID NO: 100548 - DNA, 22 bp, Homo sapiens
agtgccctttacaacttcttga

SEQ ID NO: 100549 - DNA, 22 bp, Homo sapiens
ccaggctggagtatagtggcgc

SEQ ID NO: 100550 - DNA, 22 bp, Homo sapiens
ctcggcaggtggaggttgtagt

SEQ ID NO: 100551 - DNA, 22 bp, Homo sapiens
tcaccagatctctctgtaatgg

SEQ ID NO: 100552 - DNA, 22 bp, Homo sapiens
cacccaggctggaatgcagtgg

SEQ ID NO: 100553 - DNA, 22 bp, Homo sapiens
tcagtgcacccaattctctcca

SEQ ID NO: 100554 - DNA, 22 bp, Homo sapiens
tgtgtctttgttccaggtacga

SEQ ID NO: 100555 - DNA, 22 bp, Homo sapiens
ctgctgagccgcacccaggagc

SEQ ID NO: 100556 - DNA, 22 bp, Homo sapiens
gcacttcaccactgtcctggtt

SEQ ID NO: 100557 - DNA, 22 bp, Homo sapiens
aggtacatggggtgtgtgcacg

SEQ ID NO: 100558 - DNA, 22 bp, Homo sapiens
ctgaggcaggagagttgcttga

SEQ ID NO: 100559 - DNA, 22 bp, Homo sapiens
tggcaccagggaacaagcattt

SEQ ID NO: 100560 - DNA, 22 bp, Homo sapiens
gctgcagtgagccaagatcgtg

SEQ ID NO: 100561 - DNA, 22 bp, Homo sapiens
atgaaatatcttgaagaaattc

SEQ ID NO: 100562 - DNA, 22 bp, Homo sapiens
tccttgactgtgaggaactagc

SEQ ID NO: 100563 - DNA, 22 bp, Homo sapiens
ctgccctttgaaagaacgtctt

SEQ ID NO: 100564 - DNA, 22 bp, Homo sapiens
tcactgcaagctcctcctcctg

SEQ ID NO: 100565 - DNA, 22 bp, Homo sapiens
ggctgggcaggtctgcacaggg

SEQ ID NO: 100566 - DNA, 22 bp, Homo sapiens
ggtcccaggttgacagggagac

SEQ ID NO: 100567 - DNA, 22 bp, Homo sapiens
tgtctcatctcttaaccccact

SEQ ID NO: 100568 - DNA, 22 bp, Homo sapiens
aatgcaatgcagcacctccttg

SEQ ID NO: 100569 - DNA, 22 bp, Homo sapiens
aaaatatgtataactcttctgc

SEQ ID NO: 100570 - DNA, 22 bp, Homo sapiens
ggagagggtaggggtcctgccc

SEQ ID NO: 100571 - DNA, 22 bp, Homo sapiens
tgaggatgtctgtattttgcct

SEQ ID NO: 100572 - DNA, 22 bp, Homo sapiens
ctggagggctgcagcgaggctg

SEQ ID NO: 100573 - DNA, 22 bp, Homo sapiens
cccaggaggtcaaggctgcagt

SEQ ID NO: 100574 - DNA, 22 bp, Homo sapiens
aaggagtctgggccattcagag

SEQ ID NO: 100575 - DNA, 22 bp, Homo sapiens
aggggaccaaaatgtcctgcct

SEQ ID NO: 100576 - DNA, 22 bp, Homo sapiens
aggtcaagagtaaatttgggta

SEQ ID NO: 100577 - DNA, 22 bp, Homo sapiens
gccaccctggacgcactgttcg

SEQ ID NO: 100578 - DNA, 22 bp, Homo sapiens
aggggcacgagtagagctctag

SEQ ID NO: 100579 - DNA, 22 bp, Homo sapiens
cagcagcccacgcgtgctgtcc

SEQ ID NO: 100580 - DNA, 22 bp, Homo sapiens
tcctcagaatcacctggcagct

SEQ ID NO: 100581 - DNA, 22 bp, Homo sapiens
tttctggcagcgggacaggggt

SEQ ID NO: 100582 - DNA, 22 bp, Homo sapiens
acatttttcacatttgtagggt

SEQ ID NO: 100583 - DNA, 22 bp, Homo sapiens
atgtatatgcatgcattcaaag

SEQ ID NO: 100584 - DNA, 22 bp, Homo sapiens
cggggccctggggctgaaggtc

SEQ ID NO: 100585 - DNA, 22 bp, Homo sapiens
gtagggctcagtaaatactttg

SEQ ID NO: 100586 - DNA, 22 bp, Homo sapiens
tgggaagaggggtataaagaag

SEQ ID NO: 100587 - DNA, 22 bp, Homo sapiens
ccagagctgattcctgggactt

SEQ ID NO: 100588 - DNA, 22 bp, Homo sapiens
ccctcccaggagtggccagaga

SEQ ID NO: 100589 - DNA, 22 bp, Homo sapiens
gggcatgtcccgctgtgcaccg

SEQ ID NO: 100590 - DNA, 22 bp, Homo sapiens
tgtgactggttgtcccgctttc

SEQ ID NO: 100591 - DNA, 20 bp, Homo sapiens
ttcgctgggagtggccaggc

SEQ ID NO: 100592 - DNA, 22 bp, Homo sapiens
agctcaatgcaacctccgcctc

SEQ ID NO: 100593 - DNA, 22 bp, Homo sapiens
gccgggaccaaggccacggagc

SEQ ID NO: 100594 - DNA, 20 bp, Homo sapiens
gggactgtcccatcctcatc

SEQ ID NO: 100595 - DNA, 22 bp, Homo sapiens
tgacagtgcgggtacatcatag

SEQ ID NO: 100596 - DNA, 21 bp, Homo sapiens
tctcttcctccgcgccgccgc

SEQ ID NO: 100597 - DNA, 22 bp, Homo sapiens
tttggcatgggctatttgcttt

SEQ ID NO: 100598 - DNA, 22 bp, Homo sapiens
atgccactgcgctctagcctgg

SEQ ID NO: 100599 - DNA, 22 bp, Homo sapiens
gtgacaggccactgcggctctg

SEQ ID NO: 100600 - DNA, 18 bp, Homo sapiens
acttcccagatgagggga

SEQ ID NO: 100601 - DNA, 22 bp, Homo sapiens
ggagttgattttggatatatta

SEQ ID NO: 100602 - DNA, 22 bp, Homo sapiens
ggggtccctgcaccagcatgtc

SEQ ID NO: 100603 - DNA, 22 bp, Homo sapiens
ctgagggtcaacttgattgtat

SEQ ID NO: 100604 - DNA, 22 bp, Homo sapiens
gttgaggtgatgccagccctgc

SEQ ID NO: 100605 - DNA, 22 bp, Homo sapiens
ggagaggcttccagagtcgtgc

SEQ ID NO: 100606 - DNA, 22 bp, Homo sapiens
tggagacacaggaccagactgc

SEQ ID NO: 100607 - DNA, 22 bp, Homo sapiens
tgttgatttgtgggctgcaaaa

SEQ ID NO: 100608 - DNA, 22 bp, Homo sapiens
catggcggtcaggatgtaggtg

SEQ ID NO: 100609 - DNA, 22 bp, Homo sapiens
gcaccctgtcaaaatggaccaa

SEQ ID NO: 100610 - DNA, 22 bp, Homo sapiens
cctgggcctctcaaagtgctgg

SEQ ID NO: 100611 - DNA, 22 bp, Homo sapiens
ggggctgaacctggaggtggtc

SEQ ID NO: 100612 - DNA, 22 bp, Homo sapiens
gaatatcccgctatgcaaagta

SEQ ID NO: 100613 - DNA, 22 bp, Homo sapiens
cggcatgggcgtccccctcact

SEQ ID NO: 100614 - DNA, 22 bp, Homo sapiens
tgtgacagcaataactacttaa

SEQ ID NO: 100615 - DNA, 19 bp, Homo sapiens
tggctctgtcgaaggcaca

SEQ ID NO: 100616 - DNA, 22 bp, Homo sapiens
ggctgcaggttggttggcagct

SEQ ID NO: 100617 - DNA, 22 bp, Homo sapiens
tgaacatgctgttgatggcctg

SEQ ID NO: 100618 - DNA, 22 bp, Homo sapiens
tggcccagtatgtataatctta

SEQ ID NO: 100619 - DNA, 22 bp, Homo sapiens
cagcagcattgctctggattcc

SEQ ID NO: 100620 - DNA, 22 bp, Homo sapiens
gggccggagctgggtcccgcgc

SEQ ID NO: 100621 - DNA, 22 bp, Homo sapiens
gactttctgatgtaaacattta

SEQ ID NO: 100622 - DNA, 22 bp, Homo sapiens
tggaagactcaaggtggtgaat

SEQ ID NO: 100623 - DNA, 22 bp, Homo sapiens
ctgggctagaaggaccaggatg

SEQ ID NO: 100624 - DNA, 23 bp, Homo sapiens
aaactacaacgccaggcactgag

SEQ ID NO: 100625 - DNA, 22 bp, Homo sapiens
ctagggtgtgcagattttgcct

SEQ ID NO: 100626 - DNA, 22 bp, Homo sapiens
aatggctctgatgttgttgtga

SEQ ID NO: 100627 - DNA, 22 bp, Homo sapiens
agctcctgaaaatccagactgg

SEQ ID NO: 100628 - DNA, 22 bp, Homo sapiens
cagggccagcgtctcgggctat

SEQ ID NO: 100629 - DNA, 22 bp, Homo sapiens
ctccagtcttctcatgtatccc

SEQ ID NO: 100630 - DNA, 22 bp, Homo sapiens
acaaagccagattctggagcac

SEQ ID NO: 100631 - DNA, 22 bp, Homo sapiens
tttcagaacataatgtgagcat

SEQ ID NO: 100632 - DNA, 23 bp, Homo sapiens
ggagtgcaatggcgccatctcgg

SEQ ID NO: 100633 - DNA, 22 bp, Homo sapiens
gctgatagactgaatgttggga

SEQ ID NO: 100634 - DNA, 22 bp, Homo sapiens
gcagtggcatgatgtgggctca

SEQ ID NO: 100635 - DNA, 20 bp, Homo sapiens
ccagagctgatggctgcccg

SEQ ID NO: 100636 - DNA, 22 bp, Homo sapiens
gttgctcaggcaggagtacagt

SEQ ID NO: 100637 - DNA, 22 bp, Homo sapiens
agggatggagtgcggcccggac

SEQ ID NO: 100638 - DNA, 19 bp, Homo sapiens
ccctcttgcacaaagcaaa

SEQ ID NO: 100639 - DNA, 22 bp, Homo sapiens
atcacagggtgaggattagacc

SEQ ID NO: 100640 - DNA, 22 bp, Homo sapiens
aagtcgtggcaggcttgcacga

SEQ ID NO: 100641 - DNA, 22 bp, Homo sapiens
tctagctctgcttatcatggct

SEQ ID NO: 100642 - DNA, 22 bp, Homo sapiens
tcactgcaacctctgcctcccg

SEQ ID NO: 100643 - DNA, 22 bp, Homo sapiens
ccagatgtccctctcaggtttg

SEQ ID NO: 100644 - DNA, 22 bp, Homo sapiens
ttcacagtggtagtgcatttag

SEQ ID NO: 100645 - DNA, 22 bp, Homo sapiens
ggtggcagtagcactgggcctg

SEQ ID NO: 100646 - DNA, 22 bp, Homo sapiens
tctctcaggctggagtgcagtg

SEQ ID NO: 100647 - DNA, 22 bp, Homo sapiens
gcctggccaacgtggtgaaacc

SEQ ID NO: 100648 - DNA, 22 bp, Homo sapiens
agctctgaaagttatgtcgccg

SEQ ID NO: 100649 - DNA, 20 bp, Homo sapiens
tgtggtttttgccagttgaa

SEQ ID NO: 100650 - DNA, 22 bp, Homo sapiens
aggcactgtgcagtcccaagca

SEQ ID NO: 100651 - DNA, 22 bp, Homo sapiens
cccaggaggcagagcttgcagt

SEQ ID NO: 100652 - DNA, 22 bp, Homo sapiens
taacatttaaatttttcacata

SEQ ID NO: 100653 - DNA, 21 bp, Homo sapiens
ccagagcctgagaggattatg

SEQ ID NO: 100654 - DNA, 22 bp, Homo sapiens
gctcggtggccagcctgaggcc

SEQ ID NO: 100655 - DNA, 22 bp, Homo sapiens
ccaaagtgctggggttacaggc

SEQ ID NO: 100656 - DNA, 22 bp, Homo sapiens
acccaggagacggaggtgcagt

SEQ ID NO: 100657 - DNA, 20 bp, Homo sapiens
ctgggtggcaagcaaggggg

SEQ ID NO: 100658 - DNA, 22 bp, Homo sapiens
ctggatgtccaggtagaagttt

SEQ ID NO: 100659 - DNA, 22 bp, Homo sapiens
tggttaagtccagaaaggaagc

SEQ ID NO: 100660 - DNA, 22 bp, Homo sapiens
cccaggaggcagagatagcagt

SEQ ID NO: 100661 - DNA, 22 bp, Homo sapiens
atttagaactttgtttgccaat

SEQ ID NO: 100662 - DNA, 22 bp, Homo sapiens
gagcacagtaaagcagtgtcac

SEQ ID NO: 100663 - DNA, 22 bp, Homo sapiens
tgaatgtgatgctaaacatatg

SEQ ID NO: 100664 - DNA, 22 bp, Homo sapiens
caggcgggcaggtgcggcccct

SEQ ID NO: 100665 - DNA, 22 bp, Homo sapiens
ggcttagcaactcctgaggctc

SEQ ID NO: 100666 - DNA, 22 bp, Homo sapiens
tgcttctgactaagctgcatga

SEQ ID NO: 100667 - DNA, 22 bp, Homo sapiens
taaatgttgtaagtacatctaa

SEQ ID NO: 100668 - DNA, 22 bp, Homo sapiens
tcacccaggctggactgcagtg

SEQ ID NO: 100669 - DNA, 22 bp, Homo sapiens
tgggaggccaaggcaggcggat

SEQ ID NO: 100670 - DNA, 22 bp, Homo sapiens
cacagtggtccccgaagcccct

SEQ ID NO: 100671 - DNA, 18 bp, Homo sapiens
tgggaagaaattcttctc

SEQ ID NO: 100672 - DNA, 22 bp, Homo sapiens
ggggaccctcaggactgcgtct

SEQ ID NO: 100673 - DNA, 22 bp, Homo sapiens
tcacttagatggggatcatcac

SEQ ID NO: 100674 - DNA, 22 bp, Homo sapiens
cggagtcttgctatgttgccca

SEQ ID NO: 100675 - DNA, 22 bp, Homo sapiens
agaggctgcacttgctcatgat

SEQ ID NO: 100676 - DNA, 22 bp, Homo sapiens
aaaagcaattgcagttcttgcc

SEQ ID NO: 100677 - DNA, 21 bp, Homo sapiens
gttgtggttggggctgcagct

SEQ ID NO: 100678 - DNA, 22 bp, Homo sapiens
ttgaccactgaatggttctgaa

SEQ ID NO: 100679 - DNA, 22 bp, Homo sapiens
tattgtgaatagtgccgcaata

SEQ ID NO: 100680 - DNA, 23 bp, Homo sapiens
tcagaacagttcttggtgcatag

SEQ ID NO: 100681 - DNA, 22 bp, Homo sapiens
atgcagaagactgaaaagctga

SEQ ID NO: 100682 - DNA, 22 bp, Homo sapiens
atcttcccaggctggggagagg

SEQ ID NO: 100683 - DNA, 22 bp, Homo sapiens
cttgagtcatataaagacagag

SEQ ID NO: 100684 - DNA, 22 bp, Homo sapiens
cgctccttgagcgtgtcggcct

SEQ ID NO: 100685 - DNA, 22 bp, Homo sapiens
tgtctttgttattgtggacagg

SEQ ID NO: 100686 - DNA, 22 bp, Homo sapiens
attgcacatctgcactacagcc

SEQ ID NO: 100687 - DNA, 22 bp, Homo sapiens
gggagaggttacccgagcaact

SEQ ID NO: 100688 - DNA, 22 bp, Homo sapiens
ttctgggtttacatctgacttc

SEQ ID NO: 100689 - DNA, 22 bp, Homo sapiens
gctactgattgaccttggagag

SEQ ID NO: 100690 - DNA, 22 bp, Homo sapiens
ccatgtggtgggaaggagaatg

SEQ ID NO: 100691 - DNA, 22 bp, Homo sapiens
atatatgcgcaggcacccagct

SEQ ID NO: 100692 - DNA, 22 bp, Homo sapiens
ctctgagctgccttttgagctt

SEQ ID NO: 100693 - DNA, 22 bp, Homo sapiens
ggggtggatttcaggcggtgtc

SEQ ID NO: 100694 - DNA, 22 bp, Homo sapiens
gtgattttctcctcctagaagt

SEQ ID NO: 100695 - DNA, 22 bp, Homo sapiens
ggaggcagaatagagtgtgggt

SEQ ID NO: 100696 - DNA, 22 bp, Homo sapiens
aggtggaaatggctttcctagg

SEQ ID NO: 100697 - DNA, 22 bp, Homo sapiens
atgccactgcactccagcctag

SEQ ID NO: 100698 - DNA, 22 bp, Homo sapiens
tgaggcaggagttcaggctgcg

SEQ ID NO: 100699 - DNA, 22 bp, Homo sapiens
gctgggttttcttccgggccta

SEQ ID NO: 100700 - DNA, 22 bp, Homo sapiens
gggcttggcacatgggctcagc

SEQ ID NO: 100701 - DNA, 22 bp, Homo sapiens
cagcccaggactgcaggtgttt

SEQ ID NO: 100702 - DNA, 22 bp, Homo sapiens
tgactggattgtcattacgacg

SEQ ID NO: 100703 - DNA, 22 bp, Homo sapiens
tccagctctgctgtgcgccggt

SEQ ID NO: 100704 - DNA, 22 bp, Homo sapiens
tctccgatcacaggttttcaat

SEQ ID NO: 100705 - DNA, 23 bp, Homo sapiens
ggatggacgtgatgccttagcca

SEQ ID NO: 100706 - DNA, 22 bp, Homo sapiens
tctgagccagggtctcctccct

SEQ ID NO: 100707 - DNA, 22 bp, Homo sapiens
ctggccagatgttacgtccaat

SEQ ID NO: 100708 - DNA, 20 bp, Homo sapiens
caaatccctgctctgtgctg

SEQ ID NO: 100709 - DNA, 22 bp, Homo sapiens
gttgaggagcaagcatgtgtct

SEQ ID NO: 100710 - DNA, 22 bp, Homo sapiens
tgtaggagtccaatcaggagac

SEQ ID NO: 100711 - DNA, 22 bp, Homo sapiens
cttgcctttgtcttcaaaggct

SEQ ID NO: 100712 - DNA, 22 bp, Homo sapiens
tttcttcctgctttgtcccatg

SEQ ID NO: 100713 - DNA, 22 bp, Homo sapiens
gggcgccgtgggaaacagccgg

SEQ ID NO: 100714 - DNA, 22 bp, Homo sapiens
agctgattccactttttcccca

SEQ ID NO: 100715 - DNA, 22 bp, Homo sapiens
caggagtgtctccacacagcaa

SEQ ID NO: 100716 - DNA, 17 bp, Homo sapiens
tccttcagtgcctctgc

SEQ ID NO: 100717 - DNA, 22 bp, Homo sapiens
cctgtctctgcagggccctgcc

SEQ ID NO: 100718 - DNA, 22 bp, Homo sapiens
ttcgggaggcggagcttgcagt

SEQ ID NO: 100719 - DNA, 22 bp, Homo sapiens
atgaggcaggtggaggctgcca

SEQ ID NO: 100720 - DNA, 22 bp, Homo sapiens
ctgatccctccatagggcacag

SEQ ID NO: 100721 - DNA, 22 bp, Homo sapiens
cccacacacatttatgatagga

SEQ ID NO: 100722 - DNA, 22 bp, Homo sapiens
tgagatcattgacttgttcctg

SEQ ID NO: 100723 - DNA, 22 bp, Homo sapiens
tcctggtcttcaggttgcaaaa

SEQ ID NO: 100724 - DNA, 19 bp, Homo sapiens
gctgaaggaggtgcctgca

SEQ ID NO: 100725 - DNA, 22 bp, Homo sapiens
ttgagcccaggaggcctgggtg

SEQ ID NO: 100726 - DNA, 22 bp, Homo sapiens
ttttaatactgctattgtagga

SEQ ID NO: 100727 - DNA, 23 bp, Homo sapiens
aaaacagcttcctccagtggctc

SEQ ID NO: 100728 - DNA, 22 bp, Homo sapiens
agggaaatctcagctctaaaat

SEQ ID NO: 100729 - DNA, 22 bp, Homo sapiens
acccaggctggagtgcagtggc

SEQ ID NO: 100730 - DNA, 22 bp, Homo sapiens
caggtggcagtgcctgcattct

SEQ ID NO: 100731 - DNA, 22 bp, Homo sapiens
caacggctctggcttccaggcg

SEQ ID NO: 100732 - DNA, 22 bp, Homo sapiens
atgggatgatcacctgagctca

SEQ ID NO: 100733 - DNA, 22 bp, Homo sapiens
tccacaaggcagctcctccagg

SEQ ID NO: 100734 - DNA, 22 bp, Homo sapiens
ctgaggcaggcagatcacttga

SEQ ID NO: 100735 - DNA, 22 bp, Homo sapiens
tccacaggtccggcatgaacag

SEQ ID NO: 100736 - DNA, 22 bp, Homo sapiens
gcaggcagatcacctgtcagga

SEQ ID NO: 100737 - DNA, 22 bp, Homo sapiens
ggagaggggaacttgttgcttg

SEQ ID NO: 100738 - DNA, 22 bp, Homo sapiens
catataaatacaacatgtgtta

SEQ ID NO: 100739 - DNA, 22 bp, Homo sapiens
ccaggctggagtgcaatggcat

SEQ ID NO: 100740 - DNA, 22 bp, Homo sapiens
gtgccgcgacgcagtcggtgcc

SEQ ID NO: 100741 - DNA, 22 bp, Homo sapiens
ctacattaaattggcttactta

SEQ ID NO: 100742 - DNA, 22 bp, Homo sapiens
tcggggtctttgacacgctctg

SEQ ID NO: 100743 - DNA, 22 bp, Homo sapiens
gagaacagaagcattcctaatt

SEQ ID NO: 100744 - DNA, 22 bp, Homo sapiens
ttccagtcacaaaacatattaa

SEQ ID NO: 100745 - DNA, 22 bp, Homo sapiens
atgaggcaggagtgcagtggca

SEQ ID NO: 100746 - DNA, 22 bp, Homo sapiens
gtatcacttttgagagtgagaa

SEQ ID NO: 100747 - DNA, 22 bp, Homo sapiens
atgccactgcactccagcctgg

SEQ ID NO: 100748 - DNA, 22 bp, Homo sapiens
ggcagcactgcagcttgttggg

SEQ ID NO: 100749 - DNA, 19 bp, Homo sapiens
tcctggggaggggcatggc

SEQ ID NO: 100750 - DNA, 22 bp, Homo sapiens
gggactggagtagaggccggtg

SEQ ID NO: 100751 - DNA, 22 bp, Homo sapiens
gcaggctgtctaaagttagagt

SEQ ID NO: 100752 - DNA, 22 bp, Homo sapiens
cggccgcagcagtgtcggccca

SEQ ID NO: 100753 - DNA, 22 bp, Homo sapiens
ttgtgctgactgcgcccagctc

SEQ ID NO: 100754 - DNA, 22 bp, Homo sapiens
aggaattcaagaccagctgggc

SEQ ID NO: 100755 - DNA, 22 bp, Homo sapiens
tagcatgtcagtcgccacacgt

SEQ ID NO: 100756 - DNA, 22 bp, Homo sapiens
ccctggctgataccggaaaggc

SEQ ID NO: 100757 - DNA, 22 bp, Homo sapiens
ggggtctcactatgttacccag

SEQ ID NO: 100758 - DNA, 22 bp, Homo sapiens
ccagggtggcgtagatgctggg

SEQ ID NO: 100759 - DNA, 22 bp, Homo sapiens
accatgtcatttattggccaaa

SEQ ID NO: 100760 - DNA, 22 bp, Homo sapiens
gcggggggaggaacatcttgca

SEQ ID NO: 100761 - DNA, 22 bp, Homo sapiens
ctctggagtgtctggccagggt

SEQ ID NO: 100762 - DNA, 18 bp, Homo sapiens
catgggtgacaggtggat

SEQ ID NO: 100763 - DNA, 22 bp, Homo sapiens
gggaggcacgaggcgcgcagtg

SEQ ID NO: 100764 - DNA, 22 bp, Homo sapiens
tcctgagataaatctcatgtga

SEQ ID NO: 100765 - DNA, 22 bp, Homo sapiens
ttcctcaggctgctttcacata

SEQ ID NO: 100766 - DNA, 22 bp, Homo sapiens
cccagcagtagagctcatatgg

SEQ ID NO: 100767 - DNA, 22 bp, Homo sapiens
actttatttcctattgcatcca

SEQ ID NO: 100768 - DNA, 22 bp, Homo sapiens
actgcgctccagcctgggtgac

SEQ ID NO: 100769 - DNA, 22 bp, Homo sapiens
ccagtgtgcaatctctggctta

SEQ ID NO: 100770 - DNA, 22 bp, Homo sapiens
ctcctctttagccccagctgga

SEQ ID NO: 100771 - DNA, 22 bp, Homo sapiens
catcagaacgtgagctccttgt

SEQ ID NO: 100772 - DNA, 22 bp, Homo sapiens
ttcctttctctggactgcagcc

SEQ ID NO: 100773 - DNA, 22 bp, Homo sapiens
agattctaccagagctagtttg

SEQ ID NO: 100774 - DNA, 22 bp, Homo sapiens
gccatcatatcccctgtgacct

SEQ ID NO: 100775 - DNA, 22 bp, Homo sapiens
ctgggaggcggaggttgcagtg

SEQ ID NO: 100776 - DNA, 22 bp, Homo sapiens
taccagggaacagggatattaa

SEQ ID NO: 100777 - DNA, 22 bp, Homo sapiens
ctgggaggcagaggttgcagtg

SEQ ID NO: 100778 - DNA, 22 bp, Homo sapiens
tttagcgtagctgacagctaat

SEQ ID NO: 100779 - DNA, 22 bp, Homo sapiens
tcaccagatctctctgtaatgg

SEQ ID NO: 100780 - DNA, 22 bp, Homo sapiens
ggaggggatttagtagatgcta

SEQ ID NO: 100781 - DNA, 22 bp, Homo sapiens
gaagccttgaactgcaaacccc

SEQ ID NO: 100782 - DNA, 22 bp, Homo sapiens
actgattgcattcatagggttt

SEQ ID NO: 100783 - DNA, 18 bp, Homo sapiens
ccatcaccctaactagtg

SEQ ID NO: 100784 - DNA, 22 bp, Homo sapiens
tggagaattctatgttgagggg

SEQ ID NO: 100785 - DNA, 20 bp, Homo sapiens
atcggcttgcctggaaacaa

SEQ ID NO: 100786 - DNA, 22 bp, Homo sapiens
acctggacacctgctgtcatct

SEQ ID NO: 100787 - DNA, 22 bp, Homo sapiens
agggagatcgaccgtgttatat

SEQ ID NO: 100788 - DNA, 14 bp, Homo sapiens
gcaggcggatcact

SEQ ID NO: 100789 - DNA, 22 bp, Homo sapiens
cttccctctgctccttggtcca

SEQ ID NO: 100790 - DNA, 22 bp, Homo sapiens
tgctccagcaccaagagctcca

SEQ ID NO: 100791 - DNA, 22 bp, Homo sapiens
tgcagcaccgtcccactggcta

SEQ ID NO: 100792 - DNA, 22 bp, Homo sapiens
cagccctcctaccctgccaggc

SEQ ID NO: 100793 - DNA, 22 bp, Homo sapiens
gaggccactgtccctgccttcc

SEQ ID NO: 100794 - DNA, 22 bp, Homo sapiens
gaggccacggaagggagctgtg

SEQ ID NO: 100795 - DNA, 22 bp, Homo sapiens
gagaggtggaggttgcagtgag

SEQ ID NO: 100796 - DNA, 22 bp, Homo sapiens
gctcgtacaccagcgtggaggt

SEQ ID NO: 100797 - DNA, 22 bp, Homo sapiens
tgatattttatgagctttcata

SEQ ID NO: 100798 - DNA, 22 bp, Homo sapiens
tggctaacaaggtgaaaccccg

SEQ ID NO: 100799 - DNA, 22 bp, Homo sapiens
tttcaacagatctgtcttcagg

SEQ ID NO: 100800 - DNA, 22 bp, Homo sapiens
aagaggagaaaggctggctttg

SEQ ID NO: 100801 - DNA, 22 bp, Homo sapiens
cccaggaggcagaagttgcagt

SEQ ID NO: 100802 - DNA, 22 bp, Homo sapiens
cccattcatcctcgcttccttc

SEQ ID NO: 100803 - DNA, 22 bp, Homo sapiens
gcctcctggggtgccatcatct

SEQ ID NO: 100804 - DNA, 20 bp, Homo sapiens
ggggcccaagccctcttgcc

SEQ ID NO: 100805 - DNA, 22 bp, Homo sapiens
aaaatcctgctgactcgagatg

SEQ ID NO: 100806 - DNA, 22 bp, Homo sapiens
ctgagcatcatggcagaatctt

SEQ ID NO: 100807 - DNA, 20 bp, Homo sapiens
ttgttagaggaatgccatag

SEQ ID NO: 100808 - DNA, 22 bp, Homo sapiens
tagaggattttgcatttcatat

SEQ ID NO: 100809 - DNA, 22 bp, Homo sapiens
gtagagttgagtagtggtaaca

SEQ ID NO: 100810 - DNA, 22 bp, Homo sapiens
ttagccaggggagcagcttgtc

SEQ ID NO: 100811 - DNA, 23 bp, Homo sapiens
gtgcgccaggacaacctgacgga

SEQ ID NO: 100812 - DNA, 22 bp, Homo sapiens
ggctcactgcaaactgtgcctc

SEQ ID NO: 100813 - DNA, 22 bp, Homo sapiens
acattcagaatcttgtagcagt

SEQ ID NO: 100814 - DNA, 19 bp, Homo sapiens
tcctgcccaccagccaggg

SEQ ID NO: 100815 - DNA, 22 bp, Homo sapiens
ctgaacttattgagtgcttgct

SEQ ID NO: 100816 - DNA, 22 bp, Homo sapiens
tcattccctcattgttcactgg

SEQ ID NO: 100817 - DNA, 22 bp, Homo sapiens
ccactggttttattctctttca

SEQ ID NO: 100818 - DNA, 22 bp, Homo sapiens
tctaatccttgctacctgggtg

SEQ ID NO: 100819 - DNA, 22 bp, Homo sapiens
ttcatatttctttaaggacttt

SEQ ID NO: 100820 - DNA, 22 bp, Homo sapiens
gtagcagagggcccaggtaact

SEQ ID NO: 100821 - DNA, 22 bp, Homo sapiens
atccatttgacataatttcagc

SEQ ID NO: 100822 - DNA, 22 bp, Homo sapiens
cctgcgggctgtgctgaagcct

SEQ ID NO: 100823 - DNA, 22 bp, Homo sapiens
ggcgctcagtgttgccccagag

SEQ ID NO: 100824 - DNA, 17 bp, Homo sapiens
gagacccccactacacc

SEQ ID NO: 100825 - DNA, 22 bp, Homo sapiens
catcttgtctttttgggcctga

SEQ ID NO: 100826 - DNA, 22 bp, Homo sapiens
aagtgctgggattataggcatg

SEQ ID NO: 100827 - DNA, 22 bp, Homo sapiens
tgtgaatggacaattaaatcta

SEQ ID NO: 100828 - DNA, 22 bp, Homo sapiens
ggtgagaaagggattcctgttc

SEQ ID NO: 100829 - DNA, 22 bp, Homo sapiens
aaagcagggaaatctatttgca

SEQ ID NO: 100830 - DNA, 22 bp, Homo sapiens
gaatgtcttcaaaactagactg

SEQ ID NO: 100831 - DNA, 22 bp, Homo sapiens
catcatactgtttacactcaaa

SEQ ID NO: 100832 - DNA, 22 bp, Homo sapiens
cgctggaaattgccgttggctt

SEQ ID NO: 100833 - DNA, 22 bp, Homo sapiens
actgcacttcaccctgggtgac

SEQ ID NO: 100834 - DNA, 22 bp, Homo sapiens
tgggccgtggagcactctgaga

SEQ ID NO: 100835 - DNA, 22 bp, Homo sapiens
ggccactgacctacatctgggg

SEQ ID NO: 100836 - DNA, 22 bp, Homo sapiens
tctggctctggagtccacctgc

SEQ ID NO: 100837 - DNA, 22 bp, Homo sapiens
gaggctggacgtgcatttctac

SEQ ID NO: 100838 - DNA, 22 bp, Homo sapiens
tctcttggagagtccatcatca

SEQ ID NO: 100839 - DNA, 22 bp, Homo sapiens
ccttcattcattaatttagccc

SEQ ID NO: 100840 - DNA, 22 bp, Homo sapiens
aggaaataagggacaagacaaa

SEQ ID NO: 100841 - DNA, 22 bp, Homo sapiens
gggccccaagaacctcctcctg

SEQ ID NO: 100842 - DNA, 19 bp, Homo sapiens
gatgctcattcaggtggaa

SEQ ID NO: 100843 - DNA, 16 bp, Homo sapiens
aggctcagaggctgga

SEQ ID NO: 100844 - DNA, 22 bp, Homo sapiens
tgagaaacacaggcatgaatag

SEQ ID NO: 100845 - DNA, 22 bp, Homo sapiens
gaaatctttgccttagctgtgt

SEQ ID NO: 100846 - DNA, 22 bp, Homo sapiens
gagagtctagtgcacctagttt

SEQ ID NO: 100847 - DNA, 22 bp, Homo sapiens
cgcccaggctggagtgcagtga

SEQ ID NO: 100848 - DNA, 22 bp, Homo sapiens
ctgtccatattcaaggggtagg

SEQ ID NO: 100849 - DNA, 22 bp, Homo sapiens
ccagggtggcgtagatgctggg

SEQ ID NO: 100850 - DNA, 22 bp, Homo sapiens
tcctgggccctccggatcaggt

SEQ ID NO: 100851 - DNA, 21 bp, Homo sapiens
cgtgactgggtccgtctggct

SEQ ID NO: 100852 - DNA, 22 bp, Homo sapiens
cagcatgttcttgtctcactgg

SEQ ID NO: 100853 - DNA, 22 bp, Homo sapiens
ttttctcttccctctggacctg

SEQ ID NO: 100854 - DNA, 22 bp, Homo sapiens
ctctggagtgtctggccagggt

SEQ ID NO: 100855 - DNA, 22 bp, Homo sapiens
ccatgtacatgaacacggcggc

SEQ ID NO: 100856 - DNA, 22 bp, Homo sapiens
tggaggagaccgcattttattt

SEQ ID NO: 100857 - DNA, 22 bp, Homo sapiens
tccttgcagggtttgataaaga

SEQ ID NO: 100858 - DNA, 22 bp, Homo sapiens
gcgccccatctacagtactttt

SEQ ID NO: 100859 - DNA, 22 bp, Homo sapiens
gctcgcttagattttcctctga

SEQ ID NO: 100860 - DNA, 20 bp, Homo sapiens
gccaacgcgctggggctgcc

SEQ ID NO: 100861 - DNA, 22 bp, Homo sapiens
tcagcctgctccaagtgctgcc

SEQ ID NO: 100862 - DNA, 22 bp, Homo sapiens
tagtgccctcccctttgggata

SEQ ID NO: 100863 - DNA, 22 bp, Homo sapiens
accacccagccagcttctccct

SEQ ID NO: 100864 - DNA, 22 bp, Homo sapiens
gtccgtagtggctgatgctttg

SEQ ID NO: 100865 - DNA, 22 bp, Homo sapiens
aggctccctgaatcgcccgttc

SEQ ID NO: 100866 - DNA, 22 bp, Homo sapiens
ttaccaaatgaaatagagattt

SEQ ID NO: 100867 - DNA, 22 bp, Homo sapiens
atttctctgcagtgttcggaat

SEQ ID NO: 100868 - DNA, 22 bp, Homo sapiens
gcggggcccggacccagcctct

SEQ ID NO: 100869 - DNA, 22 bp, Homo sapiens
tgcttctgactaagctgcatga

SEQ ID NO: 100870 - DNA, 22 bp, Homo sapiens
tgtcacagtttgtactttatag

SEQ ID NO: 100871 - DNA, 22 bp, Homo sapiens
ccattgcactccatcctgggca

SEQ ID NO: 100872 - DNA, 22 bp, Homo sapiens
cctgggacttggtctggggttt

SEQ ID NO: 100873 - DNA, 22 bp, Homo sapiens
gggaggctctgctcagcccccg

SEQ ID NO: 100874 - DNA, 22 bp, Homo sapiens
ggaaaatgggaacctgaagcca

SEQ ID NO: 100875 - DNA, 22 bp, Homo sapiens
ggcatggacgtctctgaggcca

SEQ ID NO: 100876 - DNA, 22 bp, Homo sapiens
cctgacgaaaggcgtgctggag

SEQ ID NO: 100877 - DNA, 22 bp, Homo sapiens
ttgcccaggctggagtgcagtg

SEQ ID NO: 100878 - DNA, 22 bp, Homo sapiens
ccctgccttgtctgggctaggt

SEQ ID NO: 100879 - DNA, 22 bp, Homo sapiens
taaagttggacctgattttatt

SEQ ID NO: 100880 - DNA, 22 bp, Homo sapiens
catgagatctgcagggatgggc

SEQ ID NO: 100881 - DNA, 22 bp, Homo sapiens
cactgcactccagcctgggcaa

SEQ ID NO: 100882 - DNA, 22 bp, Homo sapiens
atcttctcatgtgtaatgaggt

SEQ ID NO: 100883 - DNA, 22 bp, Homo sapiens
atgccactgcacttcagcctgg

SEQ ID NO: 100884 - DNA, 22 bp, Homo sapiens
ctctcgccagcggggctgcgct

SEQ ID NO: 100885 - DNA, 22 bp, Homo sapiens
gaggtgtcatcaggcagctctg

SEQ ID NO: 100886 - DNA, 22 bp, Homo sapiens
tgtgaagatagctgttacatct

SEQ ID NO: 100887 - DNA, 22 bp, Homo sapiens
gacaggtgctaagggacctggc

SEQ ID NO: 100888 - DNA, 22 bp, Homo sapiens
ttagaggaaagactgggactaa

SEQ ID NO: 100889 - DNA, 22 bp, Homo sapiens
gaactttataactgtaaatgtc

SEQ ID NO: 100890 - DNA, 22 bp, Homo sapiens
cacggtggcccacaggtgcaag

SEQ ID NO: 100891 - DNA, 22 bp, Homo sapiens
ttgatcaaatcagctactgagg

SEQ ID NO: 100892 - DNA, 22 bp, Homo sapiens
tctttgctattgtgaatagtgc

SEQ ID NO: 100893 - DNA, 22 bp, Homo sapiens
acggtgcagcctgtcccttctc

SEQ ID NO: 100894 - DNA, 22 bp, Homo sapiens
gcaggctgtctaaagttagagt

SEQ ID NO: 100895 - DNA, 22 bp, Homo sapiens
gaggtaacactgttcagtgggc

SEQ ID NO: 100896 - DNA, 22 bp, Homo sapiens
tttgctattgtgaatagtgcca

SEQ ID NO: 100897 - DNA, 22 bp, Homo sapiens
acagagacacggaagctaaaga

SEQ ID NO: 100898 - DNA, 22 bp, Homo sapiens
aaactgctttccacagtggcta

SEQ ID NO: 100899 - DNA, 22 bp, Homo sapiens
acagttaataagtagtaagtca

SEQ ID NO: 100900 - DNA, 22 bp, Homo sapiens
agcatgcgcttgatcagctcca

SEQ ID NO: 100901 - DNA, 22 bp, Homo sapiens
cagccacttgtgatgctgggga

SEQ ID NO: 100902 - DNA, 22 bp, Homo sapiens
caaagttgcagttatgtgatta

SEQ ID NO: 100903 - DNA, 15 bp, Homo sapiens
gcaggcaggtcacct

SEQ ID NO: 100904 - DNA, 22 bp, Homo sapiens
atgcaactacccccaggatttt

SEQ ID NO: 100905 - DNA, 22 bp, Homo sapiens
gctgcgccggatcccacgttcc

SEQ ID NO: 100906 - DNA, 22 bp, Homo sapiens
cccaggaggcgcaggttgcggt

SEQ ID NO: 100907 - DNA, 22 bp, Homo sapiens
tgggcttaggtcggaggcggcc

SEQ ID NO: 100908 - DNA, 22 bp, Homo sapiens
gtctatatattgcttgaataat

SEQ ID NO: 100909 - DNA, 22 bp, Homo sapiens
gagatcggtaaagagcatgcac

SEQ ID NO: 100910 - DNA, 22 bp, Homo sapiens
ttcctgcgcccttctcgcccgc

SEQ ID NO: 100911 - DNA, 22 bp, Homo sapiens
ggagaggcttccagagtcgtgc

SEQ ID NO: 100912 - DNA, 23 bp, Homo sapiens
aaataggagtatctggatcatga

SEQ ID NO: 100913 - DNA, 22 bp, Homo sapiens
tctttcattctagtctgaggtt

SEQ ID NO: 100914 - DNA, 22 bp, Homo sapiens
gtgttgatgacattttagaaac

SEQ ID NO: 100915 - DNA, 22 bp, Homo sapiens
agcaccaaagtcctgttagggt

SEQ ID NO: 100916 - DNA, 22 bp, Homo sapiens
gctctgagtcacactgccctgt

SEQ ID NO: 100917 - DNA, 21 bp, Homo sapiens
agtagtttagcacagggtttg

SEQ ID NO: 100918 - DNA, 22 bp, Homo sapiens
atggagcaacagacctatcaca

SEQ ID NO: 100919 - DNA, 22 bp, Homo sapiens
ggtgtctatgattcagtttatg

SEQ ID NO: 100920 - DNA, 22 bp, Homo sapiens
atgcttgcccatgtttctgaag

SEQ ID NO: 100921 - DNA, 22 bp, Homo sapiens
tggcacgacaattggcaccaat

SEQ ID NO: 100922 - DNA, 22 bp, Homo sapiens
tagaaaagccccagctggaggg

SEQ ID NO: 100923 - DNA, 22 bp, Homo sapiens
gaggggagcccccatcctccag

SEQ ID NO: 100924 - DNA, 22 bp, Homo sapiens
acaaggcactttatgaagagga

SEQ ID NO: 100925 - DNA, 22 bp, Homo sapiens
ttcagcttgctgactgcggcag

SEQ ID NO: 100926 - DNA, 22 bp, Homo sapiens
tgaaatgtgttctagtgttttg

SEQ ID NO: 100927 - DNA, 22 bp, Homo sapiens
ctgggcacagcgttgggctctt

SEQ ID NO: 100928 - DNA, 22 bp, Homo sapiens
tatctattatgttctatgtgtc

SEQ ID NO: 100929 - DNA, 21 bp, Homo sapiens
aggagcattgttgtggtggag

SEQ ID NO: 100930 - DNA, 22 bp, Homo sapiens
aagaactgagtacgttaataaa

SEQ ID NO: 100931 - DNA, 22 bp, Homo sapiens
cctcccctcagacagagactgg

SEQ ID NO: 100932 - DNA, 22 bp, Homo sapiens
tccacgtgagcttcgtgtgcag

SEQ ID NO: 100933 - DNA, 22 bp, Homo sapiens
tagatttgtttccttctctcca

SEQ ID NO: 100934 - DNA, 22 bp, Homo sapiens
caggaggttgagggtgcagtga

SEQ ID NO: 100935 - DNA, 22 bp, Homo sapiens
agcaacacgcagtagtatacga

SEQ ID NO: 100936 - DNA, 22 bp, Homo sapiens
ggggcaggagcccttcttcagc

SEQ ID NO: 100937 - DNA, 22 bp, Homo sapiens
aaatgtaagtctttgtttctta

SEQ ID NO: 100938 - DNA, 22 bp, Homo sapiens
actgcactccagcctgggtgat

SEQ ID NO: 100939 - DNA, 22 bp, Homo sapiens
tggttttagggaatcaatctat

SEQ ID NO: 100940 - DNA, 22 bp, Homo sapiens
gctggtgtttcccgcggctcca

SEQ ID NO: 100941 - DNA, 22 bp, Homo sapiens
gagcaccgcctccacgatgccc

SEQ ID NO: 100942 - DNA, 22 bp, Homo sapiens
agattgtcattgacgatgagca

SEQ ID NO: 100943 - DNA, 22 bp, Homo sapiens
gatgcgggcccgctccactgcc

SEQ ID NO: 100944 - DNA, 22 bp, Homo sapiens
ttccatatctgttgcatatcat

SEQ ID NO: 100945 - DNA, 22 bp, Homo sapiens
caaatgtataaatgtactttct

SEQ ID NO: 100946 - DNA, 22 bp, Homo sapiens
aaatcgcttgaacccaggaagt

SEQ ID NO: 100947 - DNA, 22 bp, Homo sapiens
gaagagtggttatccctgctgt

SEQ ID NO: 100948 - DNA, 22 bp, Homo sapiens
tgggcgacagagcaagactccg

SEQ ID NO: 100949 - DNA, 22 bp, Homo sapiens
atgagttgaagctacaagaggc

SEQ ID NO: 100950 - DNA, 22 bp, Homo sapiens
tccaggattgtcagccagaagg

SEQ ID NO: 100951 - DNA, 22 bp, Homo sapiens
gggctgagacgatggggtcttc

SEQ ID NO: 100952 - DNA, 22 bp, Homo sapiens
ggctcctggcaatgtaacttta

SEQ ID NO: 100953 - DNA, 18 bp, Homo sapiens
gctttctatgcgacagta

SEQ ID NO: 100954 - DNA, 22 bp, Homo sapiens
ttctcttttcaccagttgctaa

SEQ ID NO: 100955 - DNA, 22 bp, Homo sapiens
ggttgcaaactcctgggatcaa

SEQ ID NO: 100956 - DNA, 17 bp, Homo sapiens
aggaggccctggcgttt

SEQ ID NO: 100957 - DNA, 22 bp, Homo sapiens
agggttcagtccagggcctggg

SEQ ID NO: 100958 - DNA, 22 bp, Homo sapiens
agtcaaggtggaccagaaaaat

SEQ ID NO: 100959 - DNA, 22 bp, Homo sapiens
cacctcaggcagcaaagtctca

SEQ ID NO: 100960 - DNA, 22 bp, Homo sapiens
agggctgcccagtgtgagagct

SEQ ID NO: 100961 - DNA, 22 bp, Homo sapiens
ggagctcctggcagtgacagag

SEQ ID NO: 100962 - DNA, 22 bp, Homo sapiens
cgtcatcacggcaagcatctcc

SEQ ID NO: 100963 - DNA, 22 bp, Homo sapiens
acatttttcacatttgtagggt

SEQ ID NO: 100964 - DNA, 22 bp, Homo sapiens
ccaggctggagtgcaatggcgt

SEQ ID NO: 100965 - DNA, 22 bp, Homo sapiens
aggggagagttaatgtgaatgt

SEQ ID NO: 100966 - DNA, 22 bp, Homo sapiens
tacccagtctggagtgcagtga

SEQ ID NO: 100967 - DNA, 22 bp, Homo sapiens
tggggaaaatgcttgtagtcag

SEQ ID NO: 100968 - DNA, 21 bp, Homo sapiens
tcgtgcagcagctgaggcttg

SEQ ID NO: 100969 - DNA, 22 bp, Homo sapiens
taagggaacagcttcaaactca

SEQ ID NO: 100970 - DNA, 18 bp, Homo sapiens
tcactgtgtgtcttgggt

SEQ ID NO: 100971 - DNA, 18 bp, Homo sapiens
gctgtggaagtctttata

SEQ ID NO: 100972 - DNA, 22 bp, Homo sapiens
tttttgggtccaggctgtatct

SEQ ID NO: 100973 - DNA, 22 bp, Homo sapiens
tgggagcagttgcatctccagt

SEQ ID NO: 100974 - DNA, 22 bp, Homo sapiens
gtgagaaatgacaaatgtgtcg

SEQ ID NO: 100975 - DNA, 22 bp, Homo sapiens
gtggagggtgattgccggctgt

SEQ ID NO: 100976 - DNA, 21 bp, Homo sapiens
ctcccagggtgactgttcaac

SEQ ID NO: 100977 - DNA, 22 bp, Homo sapiens
ttgaaattttaggccttgcaat

SEQ ID NO: 100978 - DNA, 22 bp, Homo sapiens
ttttccttcatatcccttatgt

SEQ ID NO: 100979 - DNA, 22 bp, Homo sapiens
aagaactgtttacaattttcac

SEQ ID NO: 100980 - DNA, 22 bp, Homo sapiens
ttccggacgcccgtcttccagc

SEQ ID NO: 100981 - DNA, 22 bp, Homo sapiens
ccaggaggcggaggttgcagcg

SEQ ID NO: 100982 - DNA, 22 bp, Homo sapiens
tcggggtctttgacacgctctg

SEQ ID NO: 100983 - DNA, 22 bp, Homo sapiens
gcacatccaatgattgttttga

SEQ ID NO: 100984 - DNA, 22 bp, Homo sapiens
cccaagaggtggaggttgcagt

SEQ ID NO: 100985 - DNA, 22 bp, Homo sapiens
gagaaagcttctttcccacagg

SEQ ID NO: 100986 - DNA, 22 bp, Homo sapiens
gtggaatttttacctatgaatg

SEQ ID NO: 100987 - DNA, 19 bp, Homo sapiens
tccaggggctccacctcct

SEQ ID NO: 100988 - DNA, 22 bp, Homo sapiens
gggctgcactagggcaaggtga

SEQ ID NO: 100989 - DNA, 22 bp, Homo sapiens
gtccaaaagagccagccgggcg

SEQ ID NO: 100990 - DNA, 22 bp, Homo sapiens
agacggaatttcatcatgttag

SEQ ID NO: 100991 - DNA, 22 bp, Homo sapiens
tgcagcttcactcctgaagcca

SEQ ID NO: 100992 - DNA, 22 bp, Homo sapiens
acagcccagctctttctctgca

SEQ ID NO: 100993 - DNA, 22 bp, Homo sapiens
ctcagctgcagcctggctggca

SEQ ID NO: 100994 - DNA, 22 bp, Homo sapiens
ccaggctggagtgcagtggcac

SEQ ID NO: 100995 - DNA, 22 bp, Homo sapiens
cctggaaagagaatgaatgagc

SEQ ID NO: 100996 - DNA, 22 bp, Homo sapiens
gtcgtggtcagacaccagaaaa

SEQ ID NO: 100997 - DNA, 22 bp, Homo sapiens
gagccagactgcctgaagctca

SEQ ID NO: 100998 - DNA, 22 bp, Homo sapiens
ttgatacccaagtgttatgggt

SEQ ID NO: 100999 - DNA, 20 bp, Homo sapiens
ttcgctgggagtggccaggc

SEQ ID NO: 101000 - DNA, 20 bp, Homo sapiens
tatgtgattttctcatcaat

SEQ ID NO: 101001 - DNA, 22 bp, Homo sapiens
aaacccagggttttgtcttccc

SEQ ID NO: 101002 - DNA, 22 bp, Homo sapiens
aagctgttgttcatcctgaatt

SEQ ID NO: 101003 - DNA, 22 bp, Homo sapiens
cacagggcttctcatggggtgc

SEQ ID NO: 101004 - DNA, 19 bp, Homo sapiens
gcagacaggtccagagagg

SEQ ID NO: 101005 - DNA, 22 bp, Homo sapiens
atggcagaatatctgcatcgca

SEQ ID NO: 101006 - DNA, 22 bp, Homo sapiens
tccattatacttctgattcaaa

SEQ ID NO: 101007 - DNA, 22 bp, Homo sapiens
ctagcctgggatttgaacttat

SEQ ID NO: 101008 - DNA, 22 bp, Homo sapiens
agagggcattaactctgtcttg

SEQ ID NO: 101009 - DNA, 22 bp, Homo sapiens
ttcacagcttaataaggctcag

SEQ ID NO: 101010 - DNA, 22 bp, Homo sapiens
gcaaagaatgcagatttgcctc

SEQ ID NO: 101011 - DNA, 22 bp, Homo sapiens
taggcactgtgtttgtaggagt

SEQ ID NO: 101012 - DNA, 22 bp, Homo sapiens
ggagctgttcaggactgcttca

SEQ ID NO: 101013 - DNA, 22 bp, Homo sapiens
acccccaagaggggccttcagc

SEQ ID NO: 101014 - DNA, 22 bp, Homo sapiens
cattgcactccagtctgggcca

SEQ ID NO: 101015 - DNA, 22 bp, Homo sapiens
aaggagaaatggtagatgtgca

SEQ ID NO: 101016 - DNA, 22 bp, Homo sapiens
ttgcagatatttccgatgctat

SEQ ID NO: 101017 - DNA, 23 bp, Homo sapiens
cagggccctgctcaatttctcca

SEQ ID NO: 101018 - DNA, 22 bp, Homo sapiens
ccagtgtatttttgggacctgc

SEQ ID NO: 101019 - DNA, 22 bp, Homo sapiens
gacccggctccaggcccagcag

SEQ ID NO: 101020 - DNA, 22 bp, Homo sapiens
tagcagcatttttgtagagtat

SEQ ID NO: 101021 - DNA, 23 bp, Homo sapiens
gttttacaggtgagaaaatggag

SEQ ID NO: 101022 - DNA, 18 bp, Homo sapiens
gacatagctcagagctca

SEQ ID NO: 101023 - DNA, 22 bp, Homo sapiens
acctttcagtgccctttctgtc

SEQ ID NO: 101024 - DNA, 22 bp, Homo sapiens
tattttgtgccatgcactgcct

SEQ ID NO: 101025 - DNA, 22 bp, Homo sapiens
ccggcgaccgctgtcggaggcg

SEQ ID NO: 101026 - DNA, 22 bp, Homo sapiens
ggtgccagatgaggcccgcgat

SEQ ID NO: 101027 - DNA, 22 bp, Homo sapiens
agcgccactgcactccagcctg

SEQ ID NO: 101028 - DNA, 22 bp, Homo sapiens
tgctgggctggggcctcagacc

SEQ ID NO: 101029 - DNA, 22 bp, Homo sapiens
tgacagtgcgggtacatcatag

SEQ ID NO: 101030 - DNA, 22 bp, Homo sapiens
catgtctgtgtacacatgcaca

SEQ ID NO: 101031 - DNA, 22 bp, Homo sapiens
gtggggtagatctttctcagga

SEQ ID NO: 101032 - DNA, 22 bp, Homo sapiens
attgctaggaacaggttgcacc

SEQ ID NO: 101033 - DNA, 22 bp, Homo sapiens
aggctctgtcaggcggagcagc

SEQ ID NO: 101034 - DNA, 22 bp, Homo sapiens
ttgctcagtggcagggctggta

SEQ ID NO: 101035 - DNA, 22 bp, Homo sapiens
ctcaggacccggtccaggtggg

SEQ ID NO: 101036 - DNA, 22 bp, Homo sapiens
tgtgcattaactccacaagcag

SEQ ID NO: 101037 - DNA, 22 bp, Homo sapiens
tccagggccatctccatgaggc

SEQ ID NO: 101038 - DNA, 22 bp, Homo sapiens
gacctccgtgtacacctcccag

SEQ ID NO: 101039 - DNA, 22 bp, Homo sapiens
cagtgcagccaaggacaggcac

SEQ ID NO: 101040 - DNA, 22 bp, Homo sapiens
tccagtttccaatcactgcacg

SEQ ID NO: 101041 - DNA, 22 bp, Homo sapiens
gacaattagatcattcctttga

SEQ ID NO: 101042 - DNA, 20 bp, Homo sapiens
tttgaatgtaaagcatgtca

SEQ ID NO: 101043 - DNA, 22 bp, Homo sapiens
gctggagaggatcccaaagcca

SEQ ID NO: 101044 - DNA, 22 bp, Homo sapiens
tcccagtttttctccactaagg

SEQ ID NO: 101045 - DNA, 22 bp, Homo sapiens
attgttgggtctcactcctaga

SEQ ID NO: 101046 - DNA, 22 bp, Homo sapiens
cactgttttacatgttatttaa

SEQ ID NO: 101047 - DNA, 22 bp, Homo sapiens
tgctgggggtagctctgcgtag

SEQ ID NO: 101048 - DNA, 22 bp, Homo sapiens
cggcatgggcgtccccctcact

SEQ ID NO: 101049 - DNA, 22 bp, Homo sapiens
gctcccaccttaaccttcacat

SEQ ID NO: 101050 - DNA, 22 bp, Homo sapiens
ggagcagggaattacagcgcag

SEQ ID NO: 101051 - DNA, 22 bp, Homo sapiens
ttagatttacaagcactgttta

SEQ ID NO: 101052 - DNA, 23 bp, Homo sapiens
agctataaaatctgtgacagcag

SEQ ID NO: 101053 - DNA, 22 bp, Homo sapiens
agcagcagtatccttccccggc

SEQ ID NO: 101054 - DNA, 22 bp, Homo sapiens
gggagctgagctggaagagaat

SEQ ID NO: 101055 - DNA, 22 bp, Homo sapiens
cacttcattgggaccagggctg

SEQ ID NO: 101056 - DNA, 22 bp, Homo sapiens
caggaaggcgcggctgtgcctg

SEQ ID NO: 101057 - DNA, 22 bp, Homo sapiens
gctgacccctacaggttgtgtt

SEQ ID NO: 101058 - DNA, 22 bp, Homo sapiens
taggtttaggagtgaaggtgaa

SEQ ID NO: 101059 - DNA, 22 bp, Homo sapiens
ctggatgtccaggtagaagttt

SEQ ID NO: 101060 - DNA, 22 bp, Homo sapiens
taaaatttgtccctgagtgttg

SEQ ID NO: 101061 - DNA, 22 bp, Homo sapiens
cataatttctaccagggccata

SEQ ID NO: 101062 - DNA, 22 bp, Homo sapiens
tgtctattcccccacctccgtt

SEQ ID NO: 101063 - DNA, 22 bp, Homo sapiens
tgaggcaggagttcaggctgcg

SEQ ID NO: 101064 - DNA, 22 bp, Homo sapiens
aatgaattgcagtactgacttg

SEQ ID NO: 101065 - DNA, 17 bp, Homo sapiens
ggctgcagtccaggagg

SEQ ID NO: 101066 - DNA, 22 bp, Homo sapiens
accattgccccctagtgtctgt

SEQ ID NO: 101067 - DNA, 22 bp, Homo sapiens
tctatgcttgagacagatgggg

SEQ ID NO: 101068 - DNA, 22 bp, Homo sapiens
atttttctctttccactgagat

SEQ ID NO: 101069 - DNA, 22 bp, Homo sapiens
tgctcgccccacatgccctcat

SEQ ID NO: 101070 - DNA, 22 bp, Homo sapiens
ccattgtaaattctgtggaagt

SEQ ID NO: 101071 - DNA, 22 bp, Homo sapiens
aatggaatacctaggtggccca

SEQ ID NO: 101072 - DNA, 22 bp, Homo sapiens
attgaggtcccagaaaggactg

SEQ ID NO: 101073 - DNA, 22 bp, Homo sapiens
atcggcaagccccacaccgtcc

SEQ ID NO: 101074 - DNA, 22 bp, Homo sapiens
aagcactttatgtcaatgtcct

SEQ ID NO: 101075 - DNA, 21 bp, Homo sapiens
tgactgaggcttcttcacaca

SEQ ID NO: 101076 - DNA, 22 bp, Homo sapiens
atcatcctagaaggaagctagg

SEQ ID NO: 101077 - DNA, 22 bp, Homo sapiens
taggctgggaagaaagattctc

SEQ ID NO: 101078 - DNA, 22 bp, Homo sapiens
ttatttaatgtgatctgaagag

SEQ ID NO: 101079 - DNA, 22 bp, Homo sapiens
ctggggaccagtgtctgtttgt

SEQ ID NO: 101080 - DNA, 22 bp, Homo sapiens
ccctctacagggaagcgctttc

SEQ ID NO: 101081 - DNA, 22 bp, Homo sapiens
aagctctttccactaaaccact

SEQ ID NO: 101082 - DNA, 22 bp, Homo sapiens
ttctaggcctggcttgggccca

SEQ ID NO: 101083 - DNA, 22 bp, Homo sapiens
ggtttgacagcttggggctgtc

SEQ ID NO: 101084 - DNA, 22 bp, Homo sapiens
catgagataatttttctccagt

SEQ ID NO: 101085 - DNA, 22 bp, Homo sapiens
acagcagagcctggtacttact

SEQ ID NO: 101086 - DNA, 22 bp, Homo sapiens
ctgtggctctttagttgagcac

SEQ ID NO: 101087 - DNA, 22 bp, Homo sapiens
attctaatggcagagactcctg

SEQ ID NO: 101088 - DNA, 22 bp, Homo sapiens
gggtaaatctcttttcatggct

SEQ ID NO: 101089 - DNA, 22 bp, Homo sapiens
agatgcagtggttaacaataca

SEQ ID NO: 101090 - DNA, 22 bp, Homo sapiens
tggttaagtccagaaaggaagc

SEQ ID NO: 101091 - DNA, 22 bp, Homo sapiens
ctgaggtgtgaaatggtggcaa

SEQ ID NO: 101092 - DNA, 22 bp, Homo sapiens
ttgctaccattgataccagcac

SEQ ID NO: 101093 - DNA, 22 bp, Homo sapiens
tatccgtgatgtttataaacca

SEQ ID NO: 101094 - DNA, 20 bp, Homo sapiens
ctgtggaattttaccatgcg

SEQ ID NO: 101095 - DNA, 21 bp, Homo sapiens
agtggctctcagcttgctaag

SEQ ID NO: 101096 - DNA, 22 bp, Homo sapiens
gggctctcccacaacgtgccag

SEQ ID NO: 101097 - DNA, 22 bp, Homo sapiens
gagcctggagctggaacgaagc

SEQ ID NO: 101098 - DNA, 22 bp, Homo sapiens
gccctagcgccagctcagcacc

SEQ ID NO: 101099 - DNA, 22 bp, Homo sapiens
ctacattaaattggcttactta

SEQ ID NO: 101100 - DNA, 22 bp, Homo sapiens
agcgtgaattagttggtacaca

SEQ ID NO: 101101 - DNA, 22 bp, Homo sapiens
tgttaaatgctcagctcgggga

SEQ ID NO: 101102 - DNA, 22 bp, Homo sapiens
acatcatttgtctgtagctgaa

SEQ ID NO: 101103 - DNA, 22 bp, Homo sapiens
atgagctcatccgagtcacact

SEQ ID NO: 101104 - DNA, 22 bp, Homo sapiens
tctgccttgtttgagctttgac

SEQ ID NO: 101105 - DNA, 22 bp, Homo sapiens
cagtgcacgggccagtcctgcc

SEQ ID NO: 101106 - DNA, 22 bp, Homo sapiens
gcaggcagaggtggaggagaca

SEQ ID NO: 101107 - DNA, 22 bp, Homo sapiens
agggctggagccacagctggga

SEQ ID NO: 101108 - DNA, 20 bp, Homo sapiens
ataaaataactgccacaaga

SEQ ID NO: 101109 - DNA, 22 bp, Homo sapiens
aattttctggtgtgtaatgaag

SEQ ID NO: 101110 - DNA, 22 bp, Homo sapiens
ttgcatagtgctgaggttcggg

SEQ ID NO: 101111 - DNA, 22 bp, Homo sapiens
ttcgggaggcggagcttgcagt

SEQ ID NO: 101112 - DNA, 22 bp, Homo sapiens
gaattttattactagtcaactg

SEQ ID NO: 101113 - DNA, 22 bp, Homo sapiens
acatgagatttgggtggtgata

SEQ ID NO: 101114 - DNA, 22 bp, Homo sapiens
caggccagggttgagaagagaa

SEQ ID NO: 101115 - DNA, 22 bp, Homo sapiens
tatactctgagaaacgtgtcac

SEQ ID NO: 101116 - DNA, 22 bp, Homo sapiens
ggccagaagttggaaaagagcc

SEQ ID NO: 101117 - DNA, 22 bp, Homo sapiens
gctcggtggccagcctgaggcc

SEQ ID NO: 101118 - DNA, 22 bp, Homo sapiens
tttgtcttatccaatctctcag

SEQ ID NO: 101119 - DNA, 22 bp, Homo sapiens
ctttgcttgacactgtgattgt

SEQ ID NO: 101120 - DNA, 18 bp, Homo sapiens
cttgttcttctcttggcg

SEQ ID NO: 101121 - DNA, 22 bp, Homo sapiens
aggcttcaggtttgctttgcag

SEQ ID NO: 101122 - DNA, 22 bp, Homo sapiens
ggagacagggttgaaccacgca

SEQ ID NO: 101123 - DNA, 22 bp, Homo sapiens
tactgtactgcagttctgcaaa

SEQ ID NO: 101124 - DNA, 22 bp, Homo sapiens
atgttcatatccccattctgat

SEQ ID NO: 101125 - DNA, 22 bp, Homo sapiens
atatatttgagaatattcatga

SEQ ID NO: 101126 - DNA, 22 bp, Homo sapiens
tgcagaaacaagccatcattca

SEQ ID NO: 101127 - DNA, 22 bp, Homo sapiens
ttgaccactgaatggttctgaa

SEQ ID NO: 101128 - DNA, 22 bp, Homo sapiens
gtgggggctggaaatcttgcca

SEQ ID NO: 101129 - DNA, 18 bp, Homo sapiens
cttttcccctttggactc

SEQ ID NO: 101130 - DNA, 22 bp, Homo sapiens
taggtagctttggcgtttcttg

SEQ ID NO: 101131 - DNA, 22 bp, Homo sapiens
aggaggggttctcgggtgctga

SEQ ID NO: 101132 - DNA, 22 bp, Homo sapiens
gggccctgggattcagagcaag

SEQ ID NO: 101133 - DNA, 22 bp, Homo sapiens
aaagaggcaatcaatgtagcaa

SEQ ID NO: 101134 - DNA, 22 bp, Homo sapiens
agaggcagtatacaatccgagc

SEQ ID NO: 101135 - DNA, 22 bp, Homo sapiens
agaccaaagaaaacacatctgg

SEQ ID NO: 101136 - DNA, 22 bp, Homo sapiens
tccctgaggatggttgtattta

SEQ ID NO: 101137 - DNA, 22 bp, Homo sapiens
aagatactttgcatgcatgaag

SEQ ID NO: 101138 - DNA, 22 bp, Homo sapiens
ataataacaatgccagatgcct

SEQ ID NO: 101139 - DNA, 22 bp, Homo sapiens
gagcctcgtggcggccactgcg

SEQ ID NO: 101140 - DNA, 22 bp, Homo sapiens
ttctttgcccatgtttcctaag

SEQ ID NO: 101141 - DNA, 22 bp, Homo sapiens
gtaaactattctttcaggagct

SEQ ID NO: 101142 - DNA, 19 bp, Homo sapiens
tttgatagggcataatata

SEQ ID NO: 101143 - DNA, 22 bp, Homo sapiens
cctggctgacagcttaattcca

SEQ ID NO: 101144 - DNA, 18 bp, Homo sapiens
cccggctaatttttggta

SEQ ID NO: 101145 - DNA, 23 bp, Homo sapiens
gtgccgacgctccagcaccatcc

SEQ ID NO: 101146 - DNA, 22 bp, Homo sapiens
gttaaggctgagcaggacactg

SEQ ID NO: 101147 - DNA, 22 bp, Homo sapiens
agcccaggctggagtgcagtgg

SEQ ID NO: 101148 - DNA, 22 bp, Homo sapiens
agtcttcctgcccagcaggagg

SEQ ID NO: 101149 - DNA, 22 bp, Homo sapiens
tgacagcctcactttgttaatt

SEQ ID NO: 101150 - DNA, 22 bp, Homo sapiens
tgggaggccaaggcaggcggat

SEQ ID NO: 101151 - DNA, 20 bp, Homo sapiens
caaatccctgctctgtgctg

SEQ ID NO: 101152 - DNA, 22 bp, Homo sapiens
cacccaggctggagtgcagtgg

SEQ ID NO: 101153 - DNA, 22 bp, Homo sapiens
tttacctttgtgggtctccctc

SEQ ID NO: 101154 - DNA, 22 bp, Homo sapiens
cccttggggtggaggttgcagt

SEQ ID NO: 101155 - DNA, 22 bp, Homo sapiens
taacaactgctgaggtatttga

SEQ ID NO: 101156 - DNA, 22 bp, Homo sapiens
caagagtgaaactctgtctcaa

SEQ ID NO: 101157 - DNA, 22 bp, Homo sapiens
ggcccaggctggagtgcagtgg

SEQ ID NO: 101158 - DNA, 22 bp, Homo sapiens
cctcgacctccccaggctcagg

SEQ ID NO: 101159 - DNA, 22 bp, Homo sapiens
agcctggcctgggcaggcacat

SEQ ID NO: 101160 - DNA, 17 bp, Homo sapiens
cgggcatggagggcagg

SEQ ID NO: 101161 - DNA, 22 bp, Homo sapiens
ggctgagttgagaggattactt

SEQ ID NO: 101162 - DNA, 22 bp, Homo sapiens
tccacatggctgggaggcctca

SEQ ID NO: 101163 - DNA, 22 bp, Homo sapiens
ctcctgggaaaggctggacaca

SEQ ID NO: 101164 - DNA, 22 bp, Homo sapiens
caggctggagtacaattgtgtg

SEQ ID NO: 101165 - DNA, 22 bp, Homo sapiens
gagggaaaggttaatacatgat

SEQ ID NO: 101166 - DNA, 22 bp, Homo sapiens
aaactcttggtcaacatgagga

SEQ ID NO: 101167 - DNA, 22 bp, Homo sapiens
cttgtagaattgaaatggtctc

SEQ ID NO: 101168 - DNA, 18 bp, Homo sapiens
aggcttacagcagcaggc

SEQ ID NO: 101169 - DNA, 22 bp, Homo sapiens
cttgcacgtcagatcttcctca

SEQ ID NO: 101170 - DNA, 22 bp, Homo sapiens
tgagaacggatactaagggctg

SEQ ID NO: 101171 - DNA, 22 bp, Homo sapiens
tttctgattgtcatgctgggtg

SEQ ID NO: 101172 - DNA, 22 bp, Homo sapiens
actgcaacctccgcctgccagg

SEQ ID NO: 101173 - DNA, 22 bp, Homo sapiens
tcacagagttaaaagtttcttt

SEQ ID NO: 101174 - DNA, 22 bp, Homo sapiens
gctggggaggcagcagagaaca

SEQ ID NO: 101175 - DNA, 22 bp, Homo sapiens
cctttgatttcccccgtctcag

SEQ ID NO: 101176 - DNA, 22 bp, Homo sapiens
attgtactacaccatagtactg

SEQ ID NO: 101177 - DNA, 22 bp, Homo sapiens
agaacactgatagctgagggga

SEQ ID NO: 101178 - DNA, 22 bp, Homo sapiens
aatgctgagtcctgtgagtctt

SEQ ID NO: 101179 - DNA, 22 bp, Homo sapiens
taagtcttcatagtctaatgtc

SEQ ID NO: 101180 - DNA, 22 bp, Homo sapiens
aggtccaaggtagggcccagac

SEQ ID NO: 101181 - DNA, 22 bp, Homo sapiens
ggagagtggattccagctgtat

SEQ ID NO: 101182 - DNA, 22 bp, Homo sapiens
agggcgacaatggagagcgttt

SEQ ID NO: 101183 - DNA, 22 bp, Homo sapiens
tgcagattcaaatgaaatgcaa

SEQ ID NO: 101184 - DNA, 22 bp, Homo sapiens
tggagttggccgcccggaccga

SEQ ID NO: 101185 - DNA, 22 bp, Homo sapiens
ctgaggcctctcccactccagc

SEQ ID NO: 101186 - DNA, 22 bp, Homo sapiens
gtccaagagtcaagaagggggc

SEQ ID NO: 101187 - DNA, 22 bp, Homo sapiens
tgtcatagtgtggtagcagtgg

SEQ ID NO: 101188 - DNA, 22 bp, Homo sapiens
ccctgctgtgtagcggaggaac

SEQ ID NO: 101189 - DNA, 22 bp, Homo sapiens
aggaatgacaggcctcccgcag

SEQ ID NO: 101190 - DNA, 22 bp, Homo sapiens
gtgaccatcatctcagctagtt

SEQ ID NO: 101191 - DNA, 22 bp, Homo sapiens
ctgggatccacgggctcccaag

SEQ ID NO: 101192 - DNA, 22 bp, Homo sapiens
tcctcagcttttatttcacttg

SEQ ID NO: 101193 - DNA, 22 bp, Homo sapiens
gcctccggagttgcagtgtctt

SEQ ID NO: 101194 - DNA, 22 bp, Homo sapiens
catggcactgagcaggtatgca

SEQ ID NO: 101195 - DNA, 22 bp, Homo sapiens
tgaggtgccacccaagagcctt

SEQ ID NO: 101196 - DNA, 22 bp, Homo sapiens
aggtcaccatggcatgctccac

SEQ ID NO: 101197 - DNA, 22 bp, Homo sapiens
tatgtgtttgacaccctgcaag

SEQ ID NO: 101198 - DNA, 19 bp, Homo sapiens
tcctgcctggggccgcctg

SEQ ID NO: 101199 - DNA, 22 bp, Homo sapiens
agtggcaggatctcggttcact

SEQ ID NO: 101200 - DNA, 22 bp, Homo sapiens
tcctgagccctactctagacga

SEQ ID NO: 101201 - DNA, 22 bp, Homo sapiens
tgtttcaaattacttgaggatt

SEQ ID NO: 101202 - DNA, 23 bp, Homo sapiens
tgttccagatacgccttttcctc

SEQ ID NO: 101203 - DNA, 22 bp, Homo sapiens
tctgagctgggtcttgacagct

SEQ ID NO: 101204 - DNA, 22 bp, Homo sapiens
gcagggcacaaggacgcacagg

SEQ ID NO: 101205 - DNA, 22 bp, Homo sapiens
cggagccagaggctggagaggc

SEQ ID NO: 101206 - DNA, 22 bp, Homo sapiens
tgcgaccctagccccctcactt

SEQ ID NO: 101207 - DNA, 22 bp, Homo sapiens
gtctccttgtggatctcaagga

SEQ ID NO: 101208 - DNA, 22 bp, Homo sapiens
gccacctcggctttctctgctc

SEQ ID NO: 101209 - DNA, 22 bp, Homo sapiens
gggggaagaaagaacatggcat

SEQ ID NO: 101210 - DNA, 22 bp, Homo sapiens
cagggaaagtcccaccccacac

SEQ ID NO: 101211 - DNA, 22 bp, Homo sapiens
gggcgccgtgggaaacagccgg

SEQ ID NO: 101212 - DNA, 22 bp, Homo sapiens
aggctgaggcaagaggatcact

SEQ ID NO: 101213 - DNA, 22 bp, Homo sapiens
ggcagggagtggagactcccta

SEQ ID NO: 101214 - DNA, 22 bp, Homo sapiens
atgatggctaggctggttttga

SEQ ID NO: 101215 - DNA, 22 bp, Homo sapiens
gctgtccagcccttgttcacct

SEQ ID NO: 101216 - DNA, 22 bp, Homo sapiens
cccagcgagtttgccggtgaac

SEQ ID NO: 101217 - DNA, 22 bp, Homo sapiens
tgggggctgggatgtcactttc

SEQ ID NO: 101218 - DNA, 22 bp, Homo sapiens
agagctccagggttttgtagtg

SEQ ID NO: 101219 - DNA, 22 bp, Homo sapiens
aggcactgtgcagtcccaagca

SEQ ID NO: 101220 - DNA, 22 bp, Homo sapiens
ggttcacagtaaggtttgtgct

SEQ ID NO: 101221 - DNA, 22 bp, Homo sapiens
gaggtaggtgtaggaggcctgc

SEQ ID NO: 101222 - DNA, 18 bp, Homo sapiens
actctgcggaggccccag

SEQ ID NO: 101223 - DNA, 22 bp, Homo sapiens
gagggggctagcgcagtgccca

SEQ ID NO: 101224 - DNA, 23 bp, Homo sapiens
caccccaccctgaggaggaggga

SEQ ID NO: 101225 - DNA, 22 bp, Homo sapiens
actctttgtctgttgccgctta

SEQ ID NO: 101226 - DNA, 22 bp, Homo sapiens
actaggggctcaggcccaggga

SEQ ID NO: 101227 - DNA, 22 bp, Homo sapiens
caggaagaccagggctgtggct

SEQ ID NO: 101228 - DNA, 19 bp, Homo sapiens
catctggatgattctcctg

SEQ ID NO: 101229 - DNA, 22 bp, Homo sapiens
ttaataaagtatgaattggaaa

SEQ ID NO: 101230 - DNA, 22 bp, Homo sapiens
tcactcaggctggagtgcagtg

SEQ ID NO: 101231 - DNA, 22 bp, Homo sapiens
ggcaaaaaccataattactttt

SEQ ID NO: 101232 - DNA, 22 bp, Homo sapiens
ggaatgaatttccagctgggtc

SEQ ID NO: 101233 - DNA, 22 bp, Homo sapiens
tgctggaggccagaagtctgag

SEQ ID NO: 101234 - DNA, 22 bp, Homo sapiens
cctgccctgctcactgtcggta

SEQ ID NO: 101235 - DNA, 19 bp, Homo sapiens
gagaaagcaggcacagcac

SEQ ID NO: 101236 - DNA, 22 bp, Homo sapiens
tccacaaggcagctcctccagg

SEQ ID NO: 101237 - DNA, 22 bp, Homo sapiens
catccaggctgaagtgcagtgg

SEQ ID NO: 101238 - DNA, 22 bp, Homo sapiens
gttgggttaaccaggatgtcaa

SEQ ID NO: 101239 - DNA, 22 bp, Homo sapiens
aaatgcctcattttctctcact

SEQ ID NO: 101240 - DNA, 22 bp, Homo sapiens
atcaaatacaaagggcataagg

SEQ ID NO: 101241 - DNA, 22 bp, Homo sapiens
agactgttgtgtgaagtagggt

SEQ ID NO: 101242 - DNA, 22 bp, Homo sapiens
ggcgccgcactcggtgcagccg

SEQ ID NO: 101243 - DNA, 22 bp, Homo sapiens
gttacagtcaggagatattttg

SEQ ID NO: 101244 - DNA, 20 bp, Homo sapiens
ggccggggagctctccaggg

SEQ ID NO: 101245 - DNA, 22 bp, Homo sapiens
agctggtgctcggggagctggc

SEQ ID NO: 101246 - DNA, 22 bp, Homo sapiens
tgaagactcagaagctaagata

SEQ ID NO: 101247 - DNA, 22 bp, Homo sapiens
ttgagatggagcctcagtcttg

SEQ ID NO: 101248 - DNA, 22 bp, Homo sapiens
ctatcacagagggttgttttga

SEQ ID NO: 101249 - DNA, 22 bp, Homo sapiens
acctctgtacctcctctgacag

SEQ ID NO: 101250 - DNA, 22 bp, Homo sapiens
ctgcagggagaggggacagcct

SEQ ID NO: 101251 - DNA, 22 bp, Homo sapiens
actttaaaactgatcatcagag

SEQ ID NO: 101252 - DNA, 20 bp, Homo sapiens
ggtcactgtggctgcaggat

SEQ ID NO: 101253 - DNA, 22 bp, Homo sapiens
attgtaaatagtgccacaataa

SEQ ID NO: 101254 - DNA, 22 bp, Homo sapiens
agttttcattaccatgctgcaa

SEQ ID NO: 101255 - DNA, 20 bp, Homo sapiens
aactcctagcctcaagtgat

SEQ ID NO: 101256 - DNA, 22 bp, Homo sapiens
tcttagaaattccccagtggct

SEQ ID NO: 101257 - DNA, 22 bp, Homo sapiens
ttcccactgtggcagagcctcg

SEQ ID NO: 101258 - DNA, 22 bp, Homo sapiens
gtgggtggacggtgcttttgtt

SEQ ID NO: 101259 - DNA, 22 bp, Homo sapiens
ggcagagcttgcagtgagccga

SEQ ID NO: 101260 - DNA, 22 bp, Homo sapiens
ctgtatctgtgttggatgagtt

SEQ ID NO: 101261 - DNA, 22 bp, Homo sapiens
tacagaggaggggattttaata

SEQ ID NO: 101262 - DNA, 22 bp, Homo sapiens
cccaggggttctgagcagcagc

SEQ ID NO: 101263 - DNA, 22 bp, Homo sapiens
tgtgtctcaagtcagagcatca

SEQ ID NO: 101264 - DNA, 22 bp, Homo sapiens
tgagctgacacccaatcatact

SEQ ID NO: 101265 - DNA, 22 bp, Homo sapiens
cttcctcctccatctcgaaggc

SEQ ID NO: 101266 - DNA, 22 bp, Homo sapiens
gccagggttgccaatgggggca

SEQ ID NO: 101267 - DNA, 22 bp, Homo sapiens
ttgccttgttattctctcagaa

SEQ ID NO: 101268 - DNA, 22 bp, Homo sapiens
cagcacatgctcatcagggaag

SEQ ID NO: 101269 - DNA, 22 bp, Homo sapiens
ggagtgctttgaagccttcatt

SEQ ID NO: 101270 - DNA, 22 bp, Homo sapiens
ctggctggagtgcaggtgagtg

SEQ ID NO: 101271 - DNA, 22 bp, Homo sapiens
gggccatgagaggttcatcaac

SEQ ID NO: 101272 - DNA, 22 bp, Homo sapiens
actgcactccagcctgggtgac

SEQ ID NO: 101273 - DNA, 22 bp, Homo sapiens
tgtaggagtccaatcaggagac

SEQ ID NO: 101274 - DNA, 22 bp, Homo sapiens
gacagacacaattgatccatga

SEQ ID NO: 101275 - DNA, 23 bp, Homo sapiens
gtcacagtgggtggtgcctacat

SEQ ID NO: 101276 - DNA, 22 bp, Homo sapiens
aagagaattctggttttcctat

SEQ ID NO: 101277 - DNA, 22 bp, Homo sapiens
gggaacagcttgggctctgcca

SEQ ID NO: 101278 - DNA, 22 bp, Homo sapiens
gcaggaggttgagccaggactg

SEQ ID NO: 101279 - DNA, 21 bp, Homo sapiens
ggtgctcgctgatgaggagtg

SEQ ID NO: 101280 - DNA, 22 bp, Homo sapiens
gcccagagttcaaggctgcagt

SEQ ID NO: 101281 - DNA, 22 bp, Homo sapiens
tctcttgagctcagttctgatg

SEQ ID NO: 101282 - DNA, 16 bp, Homo sapiens
gcgcctcctcggcctc

SEQ ID NO: 101283 - DNA, 22 bp, Homo sapiens
ggcagggcaggaaagtcaggaa

SEQ ID NO: 101284 - DNA, 22 bp, Homo sapiens
ttatttttaaaagttcacacag

SEQ ID NO: 101285 - DNA, 22 bp, Homo sapiens
cttcatcagctggcttactgtt

SEQ ID NO: 101286 - DNA, 22 bp, Homo sapiens
ctcagcttttcccggataggtg

SEQ ID NO: 101287 - DNA, 23 bp, Homo sapiens
ctatttctcatagttcaggtctt

SEQ ID NO: 101288 - DNA, 22 bp, Homo sapiens
aaaaaattatcatagttcctga

SEQ ID NO: 101289 - DNA, 22 bp, Homo sapiens
catataaatacaacatgtgtta

SEQ ID NO: 101290 - DNA, 22 bp, Homo sapiens
attgagaagaaaatctaatata

SEQ ID NO: 101291 - DNA, 18 bp, Homo sapiens
taggttacagccagccag

SEQ ID NO: 101292 - DNA, 23 bp, Homo sapiens
tgctggagaagcaaagttctgag

SEQ ID NO: 101293 - DNA, 22 bp, Homo sapiens
ttgcaaatcagaagtatagatt

SEQ ID NO: 101294 - DNA, 18 bp, Homo sapiens
tggttccttgaaggggca

SEQ ID NO: 101295 - DNA, 22 bp, Homo sapiens
ttattagagtgctttgagaaag

SEQ ID NO: 101296 - DNA, 22 bp, Homo sapiens
cagtagatttggtaaactagga

SEQ ID NO: 101297 - DNA, 22 bp, Homo sapiens
cagttccctccgccagcacttc

SEQ ID NO: 101298 - DNA, 22 bp, Homo sapiens
gggacaatggaggcctctctcc

SEQ ID NO: 101299 - DNA, 22 bp, Homo sapiens
gggctgggattgcttgctgtga

SEQ ID NO: 101300 - DNA, 22 bp, Homo sapiens
cattctctctacttgttttcaa

SEQ ID NO: 101301 - DNA, 22 bp, Homo sapiens
aactcagatgtttggctacctt

SEQ ID NO: 101302 - DNA, 22 bp, Homo sapiens
tgataggtcctcgggcactgga

SEQ ID NO: 101303 - DNA, 22 bp, Homo sapiens
gctgggacaacaggtgagcacc

SEQ ID NO: 101304 - DNA, 18 bp, Homo sapiens
tgagttcattagacttcc

SEQ ID NO: 101305 - DNA, 22 bp, Homo sapiens
tttttccacataccctaggcca

SEQ ID NO: 101306 - DNA, 22 bp, Homo sapiens
gtgccgcgacgcagtcggtgcc

SEQ ID NO: 101307 - DNA, 22 bp, Homo sapiens
tggcacttttcccagttttggt

SEQ ID NO: 101308 - DNA, 22 bp, Homo sapiens
cccaggaggtggagttcacagt

SEQ ID NO: 101309 - DNA, 22 bp, Homo sapiens
ttacaaagtttaaggtggcact

SEQ ID NO: 101310 - DNA, 22 bp, Homo sapiens
gcacttgtggatttgatataca

SEQ ID NO: 101311 - DNA, 22 bp, Homo sapiens
ctagtgcaatgatgaatacaag

SEQ ID NO: 101312 - DNA, 22 bp, Homo sapiens
gggtacttaatatttacggggt

SEQ ID NO: 101313 - DNA, 17 bp, Homo sapiens
tgcatgtcctttgttcc

SEQ ID NO: 101314 - DNA, 22 bp, Homo sapiens
gggtggtggccagcagtgggca

SEQ ID NO: 101315 - DNA, 22 bp, Homo sapiens
cctactctgagcgcctccgcat

SEQ ID NO: 101316 - DNA, 22 bp, Homo sapiens
ggatgtcgaggatggggtagca

SEQ ID NO: 101317 - DNA, 22 bp, Homo sapiens
agagtgtaccaaatatcctaca

SEQ ID NO: 101318 - DNA, 22 bp, Homo sapiens
gatgtagacacttggaggctta

SEQ ID NO: 101319 - DNA, 22 bp, Homo sapiens
cctgagagcattccacactgaa

SEQ ID NO: 101320 - DNA, 22 bp, Homo sapiens
cagctgctgttcagttttgttt

SEQ ID NO: 101321 - DNA, 22 bp, Homo sapiens
agctcttacatttaggtctatg

SEQ ID NO: 101322 - DNA, 22 bp, Homo sapiens
agtccaaagcagatgagggcca

SEQ ID NO: 101323 - DNA, 22 bp, Homo sapiens
gagagtctaggaacctcatata

SEQ ID NO: 101324 - DNA, 22 bp, Homo sapiens
aatgagatggaattcccgccta

SEQ ID NO: 101325 - DNA, 22 bp, Homo sapiens
ggggtcggggcatagccactta

SEQ ID NO: 101326 - DNA, 22 bp, Homo sapiens
ccgcaaggcagaggttgcagtg

SEQ ID NO: 101327 - DNA, 20 bp, Homo sapiens
ctttaactggaaggctgctt

SEQ ID NO: 101328 - DNA, 22 bp, Homo sapiens
tgctgtgaggttgagaaggaag

SEQ ID NO: 101329 - DNA, 20 bp, Homo sapiens
ttggatgtgcatggccgtgc

SEQ ID NO: 101330 - DNA, 21 bp, Homo sapiens
tctgccagctgaagaggtgga

SEQ ID NO: 101331 - DNA, 22 bp, Homo sapiens
agttgctgggaaagatttcagt

SEQ ID NO: 101332 - DNA, 22 bp, Homo sapiens
cactgcactccagcccgggcaa

SEQ ID NO: 101333 - DNA, 22 bp, Homo sapiens
ctcggggatccatccacgtggc

SEQ ID NO: 101334 - DNA, 22 bp, Homo sapiens
ctgagcagatgaccagccccag

SEQ ID NO: 101335 - DNA, 22 bp, Homo sapiens
tagcttatcccacagtgcccag

SEQ ID NO: 101336 - DNA, 22 bp, Homo sapiens
cggagcctgcttgttgcagctg

SEQ ID NO: 101337 - DNA, 22 bp, Homo sapiens
ttcttctttccaattacatggt

SEQ ID NO: 101338 - DNA, 22 bp, Homo sapiens
aaacttgagccaagggcttggg

SEQ ID NO: 101339 - DNA, 22 bp, Homo sapiens
acacagagccaaaccatatcac

SEQ ID NO: 101340 - DNA, 22 bp, Homo sapiens
aattacagtcggagcagcactg

SEQ ID NO: 101341 - DNA, 22 bp, Homo sapiens
aggctagaggcttctggcttca

SEQ ID NO: 101342 - DNA, 22 bp, Homo sapiens
cccaggaggcagagcttgcagt

SEQ ID NO: 101343 - DNA, 22 bp, Homo sapiens
tttgaggttagctagcagatca

SEQ ID NO: 101344 - DNA, 22 bp, Homo sapiens
gggacatctttctagtcagggt

SEQ ID NO: 101345 - DNA, 22 bp, Homo sapiens
ctatggtgatagaaatcagaat

SEQ ID NO: 101346 - DNA, 22 bp, Homo sapiens
cttcactttaagccaatcatga

SEQ ID NO: 101347 - DNA, 22 bp, Homo sapiens
tcactacaacctccgcctcctg

SEQ ID NO: 101348 - DNA, 22 bp, Homo sapiens
ccctgctgtcaggtgctgggag

SEQ ID NO: 101349 - DNA, 22 bp, Homo sapiens
gggcttcagttctgaccatctt

SEQ ID NO: 101350 - DNA, 22 bp, Homo sapiens
ctaaaatgtttggggcagaacc

SEQ ID NO: 101351 - DNA, 22 bp, Homo sapiens
tacatagctcctagtgatgcat

SEQ ID NO: 101352 - DNA, 19 bp, Homo sapiens
agggagtttatatttgcac

SEQ ID NO: 101353 - DNA, 22 bp, Homo sapiens
ccaggggggcgtagatgctggg

SEQ ID NO: 101354 - DNA, 22 bp, Homo sapiens
ttctacagtgactgcagccata

SEQ ID NO: 101355 - DNA, 18 bp, Homo sapiens
acctgattggcgcagccc

SEQ ID NO: 101356 - DNA, 17 bp, Homo sapiens
caggtgacctggtgatg

SEQ ID NO: 101357 - DNA, 23 bp, Homo sapiens
tgaatgtttattctcggtgcaga

SEQ ID NO: 101358 - DNA, 22 bp, Homo sapiens
ggacacgtggctgaaggcggcc

SEQ ID NO: 101359 - DNA, 22 bp, Homo sapiens
tccagaatcaatagcagttatc

SEQ ID NO: 101360 - DNA, 22 bp, Homo sapiens
tgctgctcagaacccctgggct

SEQ ID NO: 101361 - DNA, 22 bp, Homo sapiens
agctggaattacaggagcccat

SEQ ID NO: 101362 - DNA, 22 bp, Homo sapiens
agccctcgtttctgcatcctgt

SEQ ID NO: 101363 - DNA, 21 bp, Homo sapiens
cgggaaggaggttctgaccct

SEQ ID NO: 101364 - DNA, 22 bp, Homo sapiens
tggcacaggatctcagcggcca

SEQ ID NO: 101365 - DNA, 22 bp, Homo sapiens
ctggccagatgttacgtccaat

SEQ ID NO: 101366 - DNA, 22 bp, Homo sapiens
gcagcgaggtgatgaaatagct

SEQ ID NO: 101367 - DNA, 22 bp, Homo sapiens
ccagttccagtgctcacatcca

SEQ ID NO: 101368 - DNA, 22 bp, Homo sapiens
tgtatgaggcatacatcaggca

SEQ ID NO: 101369 - DNA, 22 bp, Homo sapiens
ctgggctcaagtgatccaccca

SEQ ID NO: 101370 - DNA, 22 bp, Homo sapiens
aggtaaacaggagaaaatgaga

SEQ ID NO: 101371 - DNA, 22 bp, Homo sapiens
tcacgtgagggacctgtgtctg

SEQ ID NO: 101372 - DNA, 22 bp, Homo sapiens
cacccaggttggagtgcagtgg

SEQ ID NO: 101373 - DNA, 22 bp, Homo sapiens
gcagctggaagtgacactctgt

SEQ ID NO: 101374 - DNA, 22 bp, Homo sapiens
aaaagcaattgcagttcttgcc

SEQ ID NO: 101375 - DNA, 22 bp, Homo sapiens
gggttgaggcggatgtcggcgg

SEQ ID NO: 101376 - DNA, 22 bp, Homo sapiens
cagcagcccacgcgtgctgtcc

SEQ ID NO: 101377 - DNA, 22 bp, Homo sapiens
gtcccataagtagtgcaacttg

SEQ ID NO: 101378 - DNA, 21 bp, Homo sapiens
atatcaatacagcaggacttc

SEQ ID NO: 101379 - DNA, 22 bp, Homo sapiens
gcagggtttagcacctgtagct

SEQ ID NO: 101380 - DNA, 22 bp, Homo sapiens
gaagggaactgggtctccttgt

SEQ ID NO: 101381 - DNA, 22 bp, Homo sapiens
cccaggcttttctcttgcccca

SEQ ID NO: 101382 - DNA, 14 bp, Homo sapiens
gcaggcagatcacc

SEQ ID NO: 101383 - DNA, 22 bp, Homo sapiens
acgcctgtaatcccagcacttt

SEQ ID NO: 101384 - DNA, 20 bp, Homo sapiens
gtctccactgggggttaacc

SEQ ID NO: 101385 - DNA, 22 bp, Homo sapiens
cccaggctggagtgtaatggtg

SEQ ID NO: 101386 - DNA, 22 bp, Homo sapiens
ctgtggctctcagaggctgctg

SEQ ID NO: 101387 - DNA, 22 bp, Homo sapiens
cacagctgaagtagccatgtgg

SEQ ID NO: 101388 - DNA, 22 bp, Homo sapiens
gagctctgactgctgggtgaca

SEQ ID NO: 101389 - DNA, 22 bp, Homo sapiens
aggacaaaggaccagatctgga

SEQ ID NO: 101390 - DNA, 22 bp, Homo sapiens
ctggcctggcgcagtggctcac

SEQ ID NO: 101391 - DNA, 22 bp, Homo sapiens
gcccaggctggagtgcagtggt

SEQ ID NO: 101392 - DNA, 22 bp, Homo sapiens
cctgcttaacattgccatgaca

SEQ ID NO: 101393 - DNA, 22 bp, Homo sapiens
gggtaggcaaagcaatgacgtt

SEQ ID NO: 101394 - DNA, 22 bp, Homo sapiens
ccttacactgcctggggccacg

SEQ ID NO: 101395 - DNA, 22 bp, Homo sapiens
tttattctgtgctacatgaaga

SEQ ID NO: 101396 - DNA, 22 bp, Homo sapiens
tcctgtgatattgtttgttata

SEQ ID NO: 101397 - DNA, 22 bp, Homo sapiens
gggctgtaggagctggaatggg

SEQ ID NO: 101398 - DNA, 22 bp, Homo sapiens
tacgcctgtaatcccagcactt

SEQ ID NO: 101399 - DNA, 22 bp, Homo sapiens
gcactggccgcacgcgtagggc

SEQ ID NO: 101400 - DNA, 22 bp, Homo sapiens
gtgatatcttacaattctcttt

SEQ ID NO: 101401 - DNA, 22 bp, Homo sapiens
tcaaatgttccctgtactggcc

SEQ ID NO: 101402 - DNA, 22 bp, Homo sapiens
tgagacaggcttccttcttggg

SEQ ID NO: 101403 - DNA, 22 bp, Homo sapiens
tttagattgtgacctcccccca

SEQ ID NO: 101404 - DNA, 19 bp, Homo sapiens
tctcaattctccccactgc

SEQ ID NO: 101405 - DNA, 22 bp, Homo sapiens
tcttgaattgtactcccataag

SEQ ID NO: 101406 - DNA, 22 bp, Homo sapiens
tggccttgagagatcaaaaggt

SEQ ID NO: 101407 - DNA, 22 bp, Homo sapiens
gtggcccaggctggagtgcagt

SEQ ID NO: 101408 - DNA, 22 bp, Homo sapiens
ggcagacctctccagccccaca

SEQ ID NO: 101409 - DNA, 22 bp, Homo sapiens
atagagtgatgtaaggtatgtg

SEQ ID NO: 101410 - DNA, 22 bp, Homo sapiens
tttgattgcaatagttttatga

SEQ ID NO: 101411 - DNA, 22 bp, Homo sapiens
aactatgttaataagtttcatt

SEQ ID NO: 101412 - DNA, 22 bp, Homo sapiens
gctggctgacagatttggggtg

SEQ ID NO: 101413 - DNA, 22 bp, Homo sapiens
tctctatttgcctaggcttgtg

SEQ ID NO: 101414 - DNA, 22 bp, Homo sapiens
ccgcccacactaaatatgagcg

SEQ ID NO: 101415 - DNA, 22 bp, Homo sapiens
tgagccagaggaggctgtgtgg

SEQ ID NO: 101416 - DNA, 22 bp, Homo sapiens
gatgtgtttccaggatttgttt

SEQ ID NO: 101417 - DNA, 22 bp, Homo sapiens
tgacagtaccactgaaagtctg

SEQ ID NO: 101418 - DNA, 22 bp, Homo sapiens
tctgttgactcctagcagccat

SEQ ID NO: 101419 - DNA, 22 bp, Homo sapiens
tgtgaagaattaatgtgaatca

SEQ ID NO: 101420 - DNA, 22 bp, Homo sapiens
atcattatcctcctatttgcct

SEQ ID NO: 101421 - DNA, 22 bp, Homo sapiens
cactgggcacttgggttgcttc

SEQ ID NO: 101422 - DNA, 22 bp, Homo sapiens
atttaagggatttggagaccaa

SEQ ID NO: 101423 - DNA, 22 bp, Homo sapiens
taaatgttgtaagtacatctaa

SEQ ID NO: 101424 - DNA, 22 bp, Homo sapiens
gctggccacagatccccaggga

SEQ ID NO: 101425 - DNA, 22 bp, Homo sapiens
gtccctgataagagccatcgat

SEQ ID NO: 101426 - DNA, 22 bp, Homo sapiens
aaagtaattgcagtttctgcca

SEQ ID NO: 101427 - DNA, 22 bp, Homo sapiens
ttccgagtctccaaggggttgt

SEQ ID NO: 101428 - DNA, 22 bp, Homo sapiens
ggatctgggctgcagtctaggc

SEQ ID NO: 101429 - DNA, 22 bp, Homo sapiens
gacttctgaattcctatcaggt

SEQ ID NO: 101430 - DNA, 22 bp, Homo sapiens
cctcggtttccacatctgtaca

SEQ ID NO: 101431 - DNA, 22 bp, Homo sapiens
agttcagaggcaggagaaggct

SEQ ID NO: 101432 - DNA, 22 bp, Homo sapiens
aaaagtcttggggaaggccagg

SEQ ID NO: 101433 - DNA, 22 bp, Homo sapiens
agggtgaatctcacaactctta

SEQ ID NO: 101434 - DNA, 22 bp, Homo sapiens
ttcccttaaattatggcatcta

SEQ ID NO: 101435 - DNA, 22 bp, Homo sapiens
cctgagtagctggaattaaagg

SEQ ID NO: 101436 - DNA, 22 bp, Homo sapiens
tttctataaaaagtgctaggat

SEQ ID NO: 101437 - DNA, 22 bp, Homo sapiens
ttatagcagcatgatttacaat

SEQ ID NO: 101438 - DNA, 22 bp, Homo sapiens
ggtgtcagactttgcatatcct

SEQ ID NO: 101439 - DNA, 22 bp, Homo sapiens
ttgtatagcccagagagtgaga

SEQ ID NO: 101440 - DNA, 22 bp, Homo sapiens
atggaatgtttatacacagttg

SEQ ID NO: 101441 - DNA, 19 bp, Homo sapiens
ccctcttgcacaaagcaaa

SEQ ID NO: 101442 - DNA, 22 bp, Homo sapiens
ggggaaggaaagttattagcag

SEQ ID NO: 101443 - DNA, 22 bp, Homo sapiens
gggaagtgagctggaatcaagg

SEQ ID NO: 101444 - DNA, 22 bp, Homo sapiens
taaaggtagtgtgacatattgt

SEQ ID NO: 101445 - DNA, 22 bp, Homo sapiens
gcttcaggctgaattcctccta

SEQ ID NO: 101446 - DNA, 22 bp, Homo sapiens
acatggcgggagtttcagatac

SEQ ID NO: 101447 - DNA, 22 bp, Homo sapiens
tttgtagcagcatgatttataa

SEQ ID NO: 101448 - DNA, 22 bp, Homo sapiens
actgagggtcaaccatttgctc

SEQ ID NO: 101449 - DNA, 23 bp, Homo sapiens
tgtgggcgcattgtaagggtagc

SEQ ID NO: 101450 - DNA, 22 bp, Homo sapiens
tggagccagcggcctgctgagg

SEQ ID NO: 101451 - DNA, 22 bp, Homo sapiens
ttttaatactgctattgtagga

SEQ ID NO: 101452 - DNA, 22 bp, Homo sapiens
tggtggggccagacttcagctc

SEQ ID NO: 101453 - DNA, 22 bp, Homo sapiens
ggtgactagataagccccatgg

SEQ ID NO: 101454 - DNA, 22 bp, Homo sapiens
agatcacagtggcaactccctt

SEQ ID NO: 101455 - DNA, 22 bp, Homo sapiens
aaattagtcatgttgtattact

SEQ ID NO: 101456 - DNA, 22 bp, Homo sapiens
agctggggctgtggttgtgatt

SEQ ID NO: 101457 - DNA, 22 bp, Homo sapiens
gaggcctgggcaagggggtctg

SEQ ID NO: 101458 - DNA, 22 bp, Homo sapiens
ccaggaggtggaggttgcggtg

SEQ ID NO: 101459 - DNA, 22 bp, Homo sapiens
cccaggccccagggcttgtcag

SEQ ID NO: 101460 - DNA, 22 bp, Homo sapiens
gaggttggggctgcagtgagct

SEQ ID NO: 101461 - DNA, 22 bp, Homo sapiens
gatggcctcatggctgcaggcc

SEQ ID NO: 101462 - DNA, 22 bp, Homo sapiens
ggcgggcagcgtcttgctggcc

SEQ ID NO: 101463 - DNA, 22 bp, Homo sapiens
ggaggcagaatagagtgtgggt

SEQ ID NO: 101464 - DNA, 22 bp, Homo sapiens
ccacccttgggttcggaggccg

SEQ ID NO: 101465 - DNA, 20 bp, Homo sapiens
ttcatgggagcaaagaggcc

SEQ ID NO: 101466 - DNA, 22 bp, Homo sapiens
aactcactttgtggcttctgaa

SEQ ID NO: 101467 - DNA, 22 bp, Homo sapiens
cccaggaggtggaggctgcagt

SEQ ID NO: 101468 - DNA, 22 bp, Homo sapiens
cccacaggtgtgagcttgctgg

SEQ ID NO: 101469 - DNA, 22 bp, Homo sapiens
tctagggtgtataaggaagcct

SEQ ID NO: 101470 - DNA, 22 bp, Homo sapiens
gctcccaggatgaggagccagg

SEQ ID NO: 101471 - DNA, 22 bp, Homo sapiens
atatccagcagcaggtgagtat

SEQ ID NO: 101472 - DNA, 22 bp, Homo sapiens
atgaggcaggtggaggctgcca

SEQ ID NO: 101473 - DNA, 22 bp, Homo sapiens
ttgaggcaggtccgggtccttc

SEQ ID NO: 101474 - DNA, 22 bp, Homo sapiens
cttggggaagccactgatccct

SEQ ID NO: 101475 - DNA, 22 bp, Homo sapiens
gagccgaggcgcacagctcggg

SEQ ID NO: 101476 - DNA, 22 bp, Homo sapiens
ccctggctgcgtgatggatgaa

SEQ ID NO: 101477 - DNA, 22 bp, Homo sapiens
tttaatcaggcaaagcataata

SEQ ID NO: 101478 - DNA, 22 bp, Homo sapiens
gtatacatgcaggtcacagggg

SEQ ID NO: 101479 - DNA, 20 bp, Homo sapiens
cctgtcatcccagcattttg

SEQ ID NO: 101480 - DNA, 22 bp, Homo sapiens
attgtgaatagtgccgcagtaa

SEQ ID NO: 101481 - DNA, 22 bp, Homo sapiens
ttaaattttagaaacagactct

SEQ ID NO: 101482 - DNA, 16 bp, Homo sapiens
gcagaggaaaggggag

SEQ ID NO: 101483 - DNA, 21 bp, Homo sapiens
ctggaggcaggtggtgccagg

SEQ ID NO: 101484 - DNA, 22 bp, Homo sapiens
atcatgttttaattagcaaact

SEQ ID NO: 101485 - DNA, 22 bp, Homo sapiens
gaaagtgctctctctatacaca

SEQ ID NO: 101486 - DNA, 22 bp, Homo sapiens
agagtactgcctcagttatgaa

SEQ ID NO: 101487 - DNA, 20 bp, Homo sapiens
tgttgattggtgtcatctca

SEQ ID NO: 101488 - DNA, 22 bp, Homo sapiens
caagcgtggctgctctgatgga

SEQ ID NO: 101489 - DNA, 22 bp, Homo sapiens
tatgtttggcctggcaatttca

SEQ ID NO: 101490 - DNA, 22 bp, Homo sapiens
atgaaatgctattttggctaga

SEQ ID NO: 101491 - DNA, 22 bp, Homo sapiens
gttctgagtcctcctttgaagg

SEQ ID NO: 101492 - DNA, 21 bp, Homo sapiens
ggagtttttctggaagggact

SEQ ID NO: 101493 - DNA, 22 bp, Homo sapiens
cttgacactgtcactcaggcca

SEQ ID NO: 101494 - DNA, 22 bp, Homo sapiens
ttgggctcaggagtttgagacc

SEQ ID NO: 101495 - DNA, 22 bp, Homo sapiens
cctacggaggacaggttagcca

SEQ ID NO: 101496 - DNA, 19 bp, Homo sapiens
agcggttctcaaagtcagg

SEQ ID NO: 101497 - DNA, 22 bp, Homo sapiens
gagccaggaggcagagactgca

SEQ ID NO: 101498 - DNA, 22 bp, Homo sapiens
acacttggagcaacacttatgg

SEQ ID NO: 101499 - DNA, 17 bp, Homo sapiens
cccgttctcttcgctgg

SEQ ID NO: 101500 - DNA, 22 bp, Homo sapiens
ctcctgagctctgaggaagctt

SEQ ID NO: 101501 - DNA, 22 bp, Homo sapiens
tatgaagtgatgttgaattttg

SEQ ID NO: 101502 - DNA, 22 bp, Homo sapiens
taattcttcaggccttttgtct

SEQ ID NO: 101503 - DNA, 22 bp, Homo sapiens
tgtggctcaggcggcttctcct

SEQ ID NO: 101504 - DNA, 22 bp, Homo sapiens
gtaaaaaggccaagcccttgtg

SEQ ID NO: 101505 - DNA, 22 bp, Homo sapiens
cagggccctgctcaatttctcc

SEQ ID NO: 101506 - DNA, 22 bp, Homo sapiens
tgtactgtatcattgcaacttt

SEQ ID NO: 101507 - DNA, 22 bp, Homo sapiens
cagcctgtcggctccttcattc

SEQ ID NO: 101508 - DNA, 22 bp, Homo sapiens
agtgcaggccccaggccaggcc

SEQ ID NO: 101509 - DNA, 22 bp, Homo sapiens
tcacttagatggggatcatcac

SEQ ID NO: 101510 - DNA, 22 bp, Homo sapiens
aggccagcagcatgacggcatc

SEQ ID NO: 101511 - DNA, 22 bp, Homo sapiens
tttgctttgtttaaaagtggta

SEQ ID NO: 101512 - DNA, 20 bp, Homo sapiens
tcagccttgaatgcttgaaa

SEQ ID NO: 101513 - DNA, 22 bp, Homo sapiens
actatagatgctggcgaggctg

SEQ ID NO: 101514 - DNA, 22 bp, Homo sapiens
caggaagctgtgaaggagacgg

SEQ ID NO: 101515 - DNA, 22 bp, Homo sapiens
tctgcatattgttaatggaatg

SEQ ID NO: 101516 - DNA, 22 bp, Homo sapiens
cacttcaacctctgagtcctgg

SEQ ID NO: 101517 - DNA, 22 bp, Homo sapiens
aatgactaaatctgaagatagg

SEQ ID NO: 101518 - DNA, 22 bp, Homo sapiens
tcttcatgtcatggtatattga

SEQ ID NO: 101519 - DNA, 21 bp, Homo sapiens
caatggcgagatcttggctca

SEQ ID NO: 101520 - DNA, 22 bp, Homo sapiens
agcacctccagagcttgaagct

SEQ ID NO: 101521 - DNA, 22 bp, Homo sapiens
tacaacaatttccacattagaa

SEQ ID NO: 101522 - DNA, 22 bp, Homo sapiens
tcattacaagatttccaatttg

SEQ ID NO: 101523 - DNA, 22 bp, Homo sapiens
cccaggaattggaggctgcagt

SEQ ID NO: 101524 - DNA, 23 bp, Homo sapiens
atgtttgcagtaacccatcctgg

SEQ ID NO: 101525 - DNA, 22 bp, Homo sapiens
ttgacctatgtttcttcatctg

SEQ ID NO: 101526 - DNA, 20 bp, Homo sapiens
tttctgtgagaaacactgtt

SEQ ID NO: 101527 - DNA, 22 bp, Homo sapiens
ctcagctcattgtggatccggt

SEQ ID NO: 101528 - DNA, 17 bp, Homo sapiens
tctgagaatgctggagg

SEQ ID NO: 101529 - DNA, 22 bp, Homo sapiens
catctgtctgcatgctctgggt

SEQ ID NO: 101530 - DNA, 22 bp, Homo sapiens
tctaaattactttgggcagtat

SEQ ID NO: 101531 - DNA, 22 bp, Homo sapiens
tgaggcaggtggattacaaggt

SEQ ID NO: 101532 - DNA, 22 bp, Homo sapiens
gatctcagacaggtggacaggg

SEQ ID NO: 101533 - DNA, 22 bp, Homo sapiens
gcccttctgctgttaggtagcc

SEQ ID NO: 101534 - DNA, 18 bp, Homo sapiens
ggtgagggagctggaagc

SEQ ID NO: 101535 - DNA, 22 bp, Homo sapiens
ccacgacgagtcatcagggcga

SEQ ID NO: 101536 - DNA, 22 bp, Homo sapiens
gactactcaaactttctctata

SEQ ID NO: 101537 - DNA, 21 bp, Homo sapiens
tggtttatgtgcttagggtct

SEQ ID NO: 101538 - DNA, 22 bp, Homo sapiens
caggctgctgacaggcttggag

SEQ ID NO: 101539 - DNA, 22 bp, Homo sapiens
ttggccttagcttcttcttaaa

SEQ ID NO: 101540 - DNA, 22 bp, Homo sapiens
agtcacagggggcccctgcaac

SEQ ID NO: 101541 - DNA, 22 bp, Homo sapiens
aatccaggtggcggaggttgtg

SEQ ID NO: 101542 - DNA, 19 bp, Homo sapiens
taggaccctggtggccccc

SEQ ID NO: 101543 - DNA, 22 bp, Homo sapiens
ctcctccacccgctggggccca

SEQ ID NO: 101544 - DNA, 22 bp, Homo sapiens
gacctggtccttgtactttgaa

SEQ ID NO: 101545 - DNA, 22 bp, Homo sapiens
tgatatgcatgtaagggagaca

SEQ ID NO: 101546 - DNA, 22 bp, Homo sapiens
gctgggttttcttccgggccta

SEQ ID NO: 101547 - DNA, 18 bp, Homo sapiens
tgagagcattcgaggcaa

SEQ ID NO: 101548 - DNA, 22 bp, Homo sapiens
attaagactgcccatgttttta

SEQ ID NO: 101549 - DNA, 22 bp, Homo sapiens
cctccaaccataggtccagggg

SEQ ID NO: 101550 - DNA, 22 bp, Homo sapiens
caggcgggcaggtgcggcccct

SEQ ID NO: 101551 - DNA, 22 bp, Homo sapiens
cattggccttttatcctagagg

SEQ ID NO: 101552 - DNA, 22 bp, Homo sapiens
ccccacaactcatgttgaaact

SEQ ID NO: 101553 - DNA, 22 bp, Homo sapiens
tcagccagccagctacaggctt

SEQ ID NO: 101554 - DNA, 22 bp, Homo sapiens
gatcgggtgggttctgccatca

SEQ ID NO: 101555 - DNA, 22 bp, Homo sapiens
ttccacaatggttaagctcgtt

SEQ ID NO: 101556 - DNA, 22 bp, Homo sapiens
agaagccaccagctgaggaaga

SEQ ID NO: 101557 - DNA, 22 bp, Homo sapiens
gaaggtggcgagcggattgctg

SEQ ID NO: 101558 - DNA, 22 bp, Homo sapiens
tcactgcaacctccacctcctg

SEQ ID NO: 101559 - DNA, 22 bp, Homo sapiens
ctggcccaggtggtcgttgagg

SEQ ID NO: 101560 - DNA, 22 bp, Homo sapiens
ccaattctgtagagttgattaa

SEQ ID NO: 101561 - DNA, 21 bp, Homo sapiens
cctcaaagatgatggggtttc

SEQ ID NO: 101562 - DNA, 22 bp, Homo sapiens
tgcatattatgtgtatctgtct

SEQ ID NO: 101563 - DNA, 20 bp, Homo sapiens
ctgccgaccacagccatgga

SEQ ID NO: 101564 - DNA, 22 bp, Homo sapiens
tgcacgtgtgagcattcacatg

SEQ ID NO: 101565 - DNA, 22 bp, Homo sapiens
caagaggattattaataaataa

SEQ ID NO: 101566 - DNA, 22 bp, Homo sapiens
gggttcagtccctcttgctact

SEQ ID NO: 101567 - DNA, 22 bp, Homo sapiens
actgcacttcagcctgggtgac

SEQ ID NO: 101568 - DNA, 20 bp, Homo sapiens
aaaatatgtataactcttct

SEQ ID NO: 101569 - DNA, 22 bp, Homo sapiens
tacaagatgacaggtgcatgat

SEQ ID NO: 101570 - DNA, 22 bp, Homo sapiens
catctttgcccatccacttcca

SEQ ID NO: 101571 - DNA, 21 bp, Homo sapiens
tggtaggtactggcttcaggc

SEQ ID NO: 101572 - DNA, 22 bp, Homo sapiens
ctgggcctggggctgttgagag

SEQ ID NO: 101573 - DNA, 22 bp, Homo sapiens
ttgcatttggttctgcctggta

SEQ ID NO: 101574 - DNA, 22 bp, Homo sapiens
gttgtgaatagtgccgcaataa

SEQ ID NO: 101575 - DNA, 22 bp, Homo sapiens
tgtctggatagagcctaggccc

SEQ ID NO: 101576 - DNA, 22 bp, Homo sapiens
tgtttacagctgatcaggcatc

SEQ ID NO: 101577 - DNA, 22 bp, Homo sapiens
cagagactggagtgcagtggcg

SEQ ID NO: 101578 - DNA, 22 bp, Homo sapiens
ctgcattaagttgcctgtaaga

SEQ ID NO: 101579 - DNA, 22 bp, Homo sapiens
ggcctggcagagcgcgcggctg

SEQ ID NO: 101580 - DNA, 22 bp, Homo sapiens
cagaccagaaggaagccgacaa

SEQ ID NO: 101581 - DNA, 23 bp, Homo sapiens
attttttgtctttgtaactagat

SEQ ID NO: 101582 - DNA, 22 bp, Homo sapiens
ttgcactataggaaaatgtgtc

SEQ ID NO: 101583 - DNA, 22 bp, Homo sapiens
tgcgcctggggccctggctgtc

SEQ ID NO: 101584 - DNA, 22 bp, Homo sapiens
cacccaggctggagagcagtgg

SEQ ID NO: 101585 - DNA, 22 bp, Homo sapiens
cagggagtgtacaccatgtgta

SEQ ID NO: 101586 - DNA, 22 bp, Homo sapiens
actttatttcctattgcatcca

SEQ ID NO: 101587 - DNA, 22 bp, Homo sapiens
aggaggcagtctgtcccttagc

SEQ ID NO: 101588 - DNA, 22 bp, Homo sapiens
agattcaggcatgtcttcattt

SEQ ID NO: 101589 - DNA, 22 bp, Homo sapiens
tcagtgactccttcttcctgct

SEQ ID NO: 101590 - DNA, 22 bp, Homo sapiens
gtatgtgctgagctttccccgc

SEQ ID NO: 101591 - DNA, 22 bp, Homo sapiens
ccctgtgggaactcctgagttg

SEQ ID NO: 101592 - DNA, 18 bp, Homo sapiens
cagctgccagctcatgga

SEQ ID NO: 101593 - DNA, 22 bp, Homo sapiens
gttaggtagaagtttactttga

SEQ ID NO: 101594 - DNA, 22 bp, Homo sapiens
gaggcccggcgcaggcggactt

SEQ ID NO: 101595 - DNA, 22 bp, Homo sapiens
tggcccagtatgtataatctta

SEQ ID NO: 101596 - DNA, 22 bp, Homo sapiens
gctgtagtgaatggccgcgttc

SEQ ID NO: 101597 - DNA, 22 bp, Homo sapiens
gctggaggatggactggaagaa

SEQ ID NO: 101598 - DNA, 22 bp, Homo sapiens
ttgtctctggaaggaaaaagca

SEQ ID NO: 101599 - DNA, 22 bp, Homo sapiens
atgtttttaaatagacttacag

SEQ ID NO: 101600 - DNA, 22 bp, Homo sapiens
gtcttaggcacccggatgtggt

SEQ ID NO: 101601 - DNA, 22 bp, Homo sapiens
atgcggagccccaagcttgaag

SEQ ID NO: 101602 - DNA, 21 bp, Homo sapiens
tggtacaccttgcctgtcaga

SEQ ID NO: 101603 - DNA, 22 bp, Homo sapiens
cttgctttcagtctcggcctca

SEQ ID NO: 101604 - DNA, 22 bp, Homo sapiens
tggtattacttctagacacaag

SEQ ID NO: 101605 - DNA, 22 bp, Homo sapiens
ttgcaattgctatggagagcgt

SEQ ID NO: 101606 - DNA, 22 bp, Homo sapiens
gaggcagaggttgttgcagtga

SEQ ID NO: 101607 - DNA, 22 bp, Homo sapiens
agtgggccggacagcccaggcc

SEQ ID NO: 101608 - DNA, 22 bp, Homo sapiens
tttgttttcaatgtgtcattca

SEQ ID NO: 101609 - DNA, 22 bp, Homo sapiens
tgagcctgtcattattcagaga

SEQ ID NO: 101610 - DNA, 22 bp, Homo sapiens
ggagagcagggaggctgctctg

SEQ ID NO: 101611 - DNA, 22 bp, Homo sapiens
tccaggtgggctgcacccaggc

SEQ ID NO: 101612 - DNA, 22 bp, Homo sapiens
cagctggttgaagaggagctgg

SEQ ID NO: 101613 - DNA, 22 bp, Homo sapiens
caatttgccctgttaaattttc

SEQ ID NO: 101614 - DNA, 22 bp, Homo sapiens
cctggcaggtggcgccctcggc

SEQ ID NO: 101615 - DNA, 22 bp, Homo sapiens
aacactctctgttggtaaggct

SEQ ID NO: 101616 - DNA, 22 bp, Homo sapiens
gcagggttttatagatctcttc

SEQ ID NO: 101617 - DNA, 22 bp, Homo sapiens
agttattactctttaacatatt

SEQ ID NO: 101618 - DNA, 22 bp, Homo sapiens
cagatgtacatgaagggcaatg

SEQ ID NO: 101619 - DNA, 22 bp, Homo sapiens
atgtacataaaatgtataatga

SEQ ID NO: 101620 - DNA, 22 bp, Homo sapiens
ttcccacattctttacattcat

SEQ ID NO: 101621 - DNA, 22 bp, Homo sapiens
taggctgggggtaggaattgag

SEQ ID NO: 101622 - DNA, 22 bp, Homo sapiens
acatcttttactctggttcggg

SEQ ID NO: 101623 - DNA, 22 bp, Homo sapiens
atggcatttgaatctgtctttt

SEQ ID NO: 101624 - DNA, 22 bp, Homo sapiens
cactgcactccagcttgggtga

SEQ ID NO: 101625 - DNA, 22 bp, Homo sapiens
aatgtattcttcaaccttgcta

SEQ ID NO: 101626 - DNA, 22 bp, Homo sapiens
aaagtgcttccttttagaggct

SEQ ID NO: 101627 - DNA, 22 bp, Homo sapiens
caaatactacgattcttgcagt

SEQ ID NO: 101628 - DNA, 22 bp, Homo sapiens
aaacatctactgtaggctggag

SEQ ID NO: 101629 - DNA, 22 bp, Homo sapiens
gaggtggatgttgcagtgagct

SEQ ID NO: 101630 - DNA, 23 bp, Homo sapiens
ctcaccaagcgccgccgctgtgt

SEQ ID NO: 101631 - DNA, 22 bp, Homo sapiens
ctgggaggcagaggttgcagtg

SEQ ID NO: 101632 - DNA, 22 bp, Homo sapiens
aaagatcacgtcccaggactcg

SEQ ID NO: 101633 - DNA, 22 bp, Homo sapiens
tgccctttatttctggggcaga

SEQ ID NO: 101634 - DNA, 22 bp, Homo sapiens
tttcttcctgctttgtcccatg

SEQ ID NO: 101635 - DNA, 23 bp, Homo sapiens
gacattggctgtctgatgcaggg

SEQ ID NO: 101636 - DNA, 22 bp, Homo sapiens
gcgagcctctggagtcctctgg

SEQ ID NO: 101637 - DNA, 22 bp, Homo sapiens
taggcatgcaaataaatgtgca

SEQ ID NO: 101638 - DNA, 22 bp, Homo sapiens
gtctgctttgtctttcatgata

SEQ ID NO: 101639 - DNA, 22 bp, Homo sapiens
aagacttgaccaggttgaaggc

SEQ ID NO: 101640 - DNA, 22 bp, Homo sapiens
gctccgtgggcattgctaggtg

SEQ ID NO: 101641 - DNA, 22 bp, Homo sapiens
ttttcctggagatggagttgtt

SEQ ID NO: 101642 - DNA, 23 bp, Homo sapiens
cagagctggctcagagctgcctg

SEQ ID NO: 101643 - DNA, 22 bp, Homo sapiens
aagtcgtggcaggcttgcacga

SEQ ID NO: 101644 - DNA, 22 bp, Homo sapiens
gccctgagaagaagtcggaggg

SEQ ID NO: 101645 - DNA, 22 bp, Homo sapiens
caggcaggtcagtgaagaagga

SEQ ID NO: 101646 - DNA, 22 bp, Homo sapiens
agaggctgcacttgctcatgat

SEQ ID NO: 101647 - DNA, 22 bp, Homo sapiens
gtagaccatttatctggggagt

SEQ ID NO: 101648 - DNA, 22 bp, Homo sapiens
cccagagcatgtgctgcctttg

SEQ ID NO: 101649 - DNA, 22 bp, Homo sapiens
actgttgaagtgccagcttgat

SEQ ID NO: 101650 - DNA, 22 bp, Homo sapiens
atggagttctgccagcgctgct

SEQ ID NO: 101651 - DNA, 22 bp, Homo sapiens
aggctctcaccctctgaccaga

SEQ ID NO: 101652 - DNA, 22 bp, Homo sapiens
agtggaccagaagactgaagct

SEQ ID NO: 101653 - DNA, 18 bp, Homo sapiens
gtcaggcatgaatctggg

SEQ ID NO: 101654 - DNA, 22 bp, Homo sapiens
ccaggagttggaggctgcagtg

SEQ ID NO: 101655 - DNA, 22 bp, Homo sapiens
ttggagatatcacaccttcaca

SEQ ID NO: 101656 - DNA, 22 bp, Homo sapiens
cagggcctcctaaggcatctaa

SEQ ID NO: 101657 - DNA, 22 bp, Homo sapiens
gcagaagcacaggtgacgggcc

SEQ ID NO: 101658 - DNA, 22 bp, Homo sapiens
gtctcgtcaatggcaggttccc

SEQ ID NO: 101659 - DNA, 22 bp, Homo sapiens
agcttgacagacagatggtagc

SEQ ID NO: 101660 - DNA, 22 bp, Homo sapiens
tgggagaaagaaccctgagtga

SEQ ID NO: 101661 - DNA, 22 bp, Homo sapiens
tgagacgaagtcttgctctgtt

SEQ ID NO: 101662 - DNA, 18 bp, Homo sapiens
cagggctgtggggtcact

SEQ ID NO: 101663 - DNA, 20 bp, Homo sapiens
agacaccccctgacagggaa

SEQ ID NO: 101664 - DNA, 22 bp, Homo sapiens
agtatgtcagagtgaaaatggt

SEQ ID NO: 101665 - DNA, 17 bp, Homo sapiens
cactagtagtctctggc

SEQ ID NO: 101666 - DNA, 22 bp, Homo sapiens
ctcttcatagcaaacatatggg

SEQ ID NO: 101667 - DNA, 22 bp, Homo sapiens
gtatcacttttgagagtgagaa

SEQ ID NO: 101668 - DNA, 22 bp, Homo sapiens
tacataggtacagcctttttta

SEQ ID NO: 101669 - DNA, 22 bp, Homo sapiens
ttcctggaaattatgctcacct

SEQ ID NO: 101670 - DNA, 22 bp, Homo sapiens
tgcactccaggctgggtgacag

SEQ ID NO: 101671 - DNA, 22 bp, Homo sapiens
gcagtatctatgtgatgggttg

SEQ ID NO: 101672 - DNA, 22 bp, Homo sapiens
cgtgattggcttctgcattgga

SEQ ID NO: 101673 - DNA, 22 bp, Homo sapiens
tctgcggtccccttctcgccct

SEQ ID NO: 101674 - DNA, 22 bp, Homo sapiens
tgtcaatatgtaataactgaat

SEQ ID NO: 101675 - DNA, 22 bp, Homo sapiens
ggctctgtaagtgttgcaggta

SEQ ID NO: 101676 - DNA, 22 bp, Homo sapiens
gcgcaccacctccaggtggccg

SEQ ID NO: 101677 - DNA, 22 bp, Homo sapiens
accactgcccatggtgaaaact

SEQ ID NO: 101678 - DNA, 22 bp, Homo sapiens
acgatgatgaaagagaacattc

SEQ ID NO: 101679 - DNA, 22 bp, Homo sapiens
ctggcaagaaatatatatctta

SEQ ID NO: 101680 - DNA, 22 bp, Homo sapiens
ggctccccaggtccaggagctg

SEQ ID NO: 101681 - DNA, 22 bp, Homo sapiens
cccagcaggtcggtgctgcctg

SEQ ID NO: 101682 - DNA, 22 bp, Homo sapiens
caggtgttggaagggcagtggg

SEQ ID NO: 101683 - DNA, 22 bp, Homo sapiens
taaatcttctacatcatcataa

SEQ ID NO: 101684 - DNA, 22 bp, Homo sapiens
ttctcaagaacatatgtagggt

SEQ ID NO: 101685 - DNA, 22 bp, Homo sapiens
tgaaggtgggaattcaccaggt

SEQ ID NO: 101686 - DNA, 22 bp, Homo sapiens
tagatacctgctggacctcatt

SEQ ID NO: 101687 - DNA, 22 bp, Homo sapiens
acatatgcgatcataggatgca

SEQ ID NO: 101688 - DNA, 22 bp, Homo sapiens
gccagccagaaacgtcacactg

SEQ ID NO: 101689 - DNA, 22 bp, Homo sapiens
ctccttctgggcctggcagtgg

SEQ ID NO: 101690 - DNA, 22 bp, Homo sapiens
tggctgtgtccctgtccagagt

SEQ ID NO: 101691 - DNA, 18 bp, Homo sapiens
tgagaggctattttttgc

SEQ ID NO: 101692 - DNA, 22 bp, Homo sapiens
atttcctgcaaggagtgggttt

SEQ ID NO: 101693 - DNA, 22 bp, Homo sapiens
ggaggcggaagttgcagtgagc

SEQ ID NO: 101694 - DNA, 22 bp, Homo sapiens
atatgggggggcgtgcagagga

SEQ ID NO: 101695 - DNA, 22 bp, Homo sapiens
tataaactcctcttgcattcct

SEQ ID NO: 101696 - DNA, 22 bp, Homo sapiens
ggttggacactaggtaggagcg

SEQ ID NO: 101697 - DNA, 22 bp, Homo sapiens
cttcatgctgatatcctcgatg

SEQ ID NO: 101698 - DNA, 22 bp, Homo sapiens
caggctggagtgcagtggcgcc

SEQ ID NO: 101699 - DNA, 22 bp, Homo sapiens
cctggcctttgaacgctagact

SEQ ID NO: 101700 - DNA, 19 bp, Homo sapiens
tgtgactggttgtctcgct

SEQ ID NO: 101701 - DNA, 22 bp, Homo sapiens
gtggcagagccaaggctggagc

SEQ ID NO: 101702 - DNA, 22 bp, Homo sapiens
gcccaggaggagaggctgcagt

SEQ ID NO: 101703 - DNA, 22 bp, Homo sapiens
gaggcggaggttgcagtgagcc

SEQ ID NO: 101704 - DNA, 22 bp, Homo sapiens
acactgcagatgaaagcataag

SEQ ID NO: 101705 - DNA, 22 bp, Homo sapiens
ggtgggccacggcataacgggc

SEQ ID NO: 101706 - DNA, 22 bp, Homo sapiens
tttcactcagctctcattgtct

SEQ ID NO: 101707 - DNA, 22 bp, Homo sapiens
cagccccacacggtctagctct

SEQ ID NO: 101708 - DNA, 22 bp, Homo sapiens
ggcatcgtcctgggcataggga

SEQ ID NO: 101709 - DNA, 22 bp, Homo sapiens
agcgcttgccgcactccaagca

SEQ ID NO: 101710 - DNA, 22 bp, Homo sapiens
gcctgtgtggatgcgccggtgc

SEQ ID NO: 101711 - DNA, 22 bp, Homo sapiens
gtttcactgcaaactgactttt

SEQ ID NO: 101712 - DNA, 22 bp, Homo sapiens
cttccccaggacctctgctaaa

SEQ ID NO: 101713 - DNA, 22 bp, Homo sapiens
aaggcaggatgggaaaagattt

SEQ ID NO: 101714 - DNA, 19 bp, Homo sapiens
tgctaccgtgggatgctta

SEQ ID NO: 101715 - DNA, 22 bp, Homo sapiens
actgggccaggtgtgggtgagt

SEQ ID NO: 101716 - DNA, 19 bp, Homo sapiens
ccagagagctaggtacaga

SEQ ID NO: 101717 - DNA, 22 bp, Homo sapiens
ccaccagctgcatatgcacgta

SEQ ID NO: 101718 - DNA, 22 bp, Homo sapiens
tactgatattttcaactagaag

SEQ ID NO: 101719 - DNA, 20 bp, Homo sapiens
tttgcgaggccaaggcgggc

SEQ ID NO: 101720 - DNA, 22 bp, Homo sapiens
tgggcaggggccctgcttccgt

SEQ ID NO: 101721 - DNA, 22 bp, Homo sapiens
gaagtttttgtagagacagggt

SEQ ID NO: 101722 - DNA, 22 bp, Homo sapiens
gaggggctgccctggtgtcagg

SEQ ID NO: 101723 - DNA, 22 bp, Homo sapiens
cacagagatggtctggcaggtg

SEQ ID NO: 101724 - DNA, 22 bp, Homo sapiens
gatctggaatctgaaggctgag

SEQ ID NO: 101725 - DNA, 17 bp, Homo sapiens
tgttccatttgaccacc

SEQ ID NO: 101726 - DNA, 22 bp, Homo sapiens
attgcactccggcctgggtgac

SEQ ID NO: 101727 - DNA, 22 bp, Homo sapiens
tctttggatggaaattggagtc

SEQ ID NO: 101728 - DNA, 22 bp, Homo sapiens
ctggtagtttgcaaaatggtgt

SEQ ID NO: 101729 - DNA, 22 bp, Homo sapiens
gccctccagcctgtggaaccgg

SEQ ID NO: 101730 - DNA, 22 bp, Homo sapiens
aggtgacaggacaggagctggt

SEQ ID NO: 101731 - DNA, 22 bp, Homo sapiens
gctcactgcaagctctgcctcc

SEQ ID NO: 101732 - DNA, 22 bp, Homo sapiens
gcttggcccattgatcagctgg

SEQ ID NO: 101733 - DNA, 22 bp, Homo sapiens
aaaaatcacttttataggcagc

SEQ ID NO: 101734 - DNA, 22 bp, Homo sapiens
catgctgggtaaaggtggtgaa

SEQ ID NO: 101735 - DNA, 22 bp, Homo sapiens
tttcacagaggaggaagctgag

SEQ ID NO: 101736 - DNA, 22 bp, Homo sapiens
tttctcctcatgactggttgtg

SEQ ID NO: 101737 - DNA, 22 bp, Homo sapiens
gctgctttgtctgtaaaatgga

SEQ ID NO: 101738 - DNA, 22 bp, Homo sapiens
ttgaataatatgcttcgttctc

SEQ ID NO: 101739 - DNA, 22 bp, Homo sapiens
atgcaggcagacactgtgggca

SEQ ID NO: 101740 - DNA, 22 bp, Homo sapiens
cccaggaggtggagcttgcagt

SEQ ID NO: 101741 - DNA, 22 bp, Homo sapiens
tagattatccctgatttgtcca

SEQ ID NO: 101742 - DNA, 22 bp, Homo sapiens
ggaggagacagtaaaaagcacg

SEQ ID NO: 101743 - DNA, 22 bp, Homo sapiens
gctgcagggagctggaaggctc

SEQ ID NO: 101744 - DNA, 22 bp, Homo sapiens
aacccgggaggtggaggttatg

SEQ ID NO: 101745 - DNA, 21 bp, Homo sapiens
gttcaaatcctgacactacac

SEQ ID NO: 101746 - DNA, 19 bp, Homo sapiens
gcataaatacactattgtc

SEQ ID NO: 101747 - DNA, 22 bp, Homo sapiens
ctgattgctaacctgttagaat

SEQ ID NO: 101748 - DNA, 22 bp, Homo sapiens
cccacgttgaaccgcttacaga

SEQ ID NO: 101749 - DNA, 17 bp, Homo sapiens
tgtatttatcatgtcag

SEQ ID NO: 101750 - DNA, 22 bp, Homo sapiens
tgccctggctcttcttgttcca

SEQ ID NO: 101751 - DNA, 20 bp, Homo sapiens
atggggtgagtgacgccctc

SEQ ID NO: 101752 - DNA, 17 bp, Homo sapiens
tactgaggggtctggag

SEQ ID NO: 101753 - DNA, 22 bp, Homo sapiens
cccccaaagtttgcacggataa

SEQ ID NO: 101754 - DNA, 22 bp, Homo sapiens
gtcctgacggctgattggcctg

SEQ ID NO: 101755 - DNA, 22 bp, Homo sapiens
cctacagttatattcttgattg

SEQ ID NO: 101756 - DNA, 22 bp, Homo sapiens
tgggatgctcagggcctggagc

SEQ ID NO: 101757 - DNA, 22 bp, Homo sapiens
gggacgacaggctctgtggtag

SEQ ID NO: 101758 - DNA, 22 bp, Homo sapiens
cttgtcagccaattgtggattt

SEQ ID NO: 101759 - DNA, 22 bp, Homo sapiens
taagtcatagattaatggccac

SEQ ID NO: 101760 - DNA, 22 bp, Homo sapiens
aggctgagataggtggatcatt

SEQ ID NO: 101761 - DNA, 22 bp, Homo sapiens
tgtgggtggcatcgtcctggcc

SEQ ID NO: 101762 - DNA, 22 bp, Homo sapiens
tattgtccaataggatgttcct

SEQ ID NO: 101763 - DNA, 22 bp, Homo sapiens
agccacacttgccaggggaagg

SEQ ID NO: 101764 - DNA, 22 bp, Homo sapiens
caatcaatgctgctagttcctt

SEQ ID NO: 101765 - DNA, 22 bp, Homo sapiens
cctgggggccaggaaggtgtga

SEQ ID NO: 101766 - DNA, 22 bp, Homo sapiens
ctggggtcagggatcagagagc

SEQ ID NO: 101767 - DNA, 22 bp, Homo sapiens
tccgccaggactgagggcccat

SEQ ID NO: 101768 - DNA, 22 bp, Homo sapiens
gggcctgtgtgttcaggagcct

SEQ ID NO: 101769 - DNA, 22 bp, Homo sapiens
ctgaaggatgtgtggtgggagt

SEQ ID NO: 101770 - DNA, 21 bp, Homo sapiens
ctacttaagtaggggattagg

SEQ ID NO: 101771 - DNA, 22 bp, Homo sapiens
cccacacacatttatgatagga

SEQ ID NO: 101772 - DNA, 22 bp, Homo sapiens
cccactgctgcgccgggcgccg

SEQ ID NO: 101773 - DNA, 22 bp, Homo sapiens
atgggttcaagtgattctcctg

SEQ ID NO: 101774 - DNA, 22 bp, Homo sapiens
atcctttcatctggtaatatat

SEQ ID NO: 101775 - DNA, 22 bp, Homo sapiens
aaagcagaactgagagagctgg

SEQ ID NO: 101776 - DNA, 22 bp, Homo sapiens
tgctgttagtaaggaacatgac

SEQ ID NO: 101777 - DNA, 22 bp, Homo sapiens
tggaatggaaacaaactgagga

SEQ ID NO: 101778 - DNA, 22 bp, Homo sapiens
gagtggggggtccgtctcagtg

SEQ ID NO: 101779 - DNA, 22 bp, Homo sapiens
atattgaaccctacagactgta

SEQ ID NO: 101780 - DNA, 22 bp, Homo sapiens
agagagcccgggccagggcaca

SEQ ID NO: 101781 - DNA, 22 bp, Homo sapiens
tggacaggcaagcaagacatac

SEQ ID NO: 101782 - DNA, 22 bp, Homo sapiens
gagcccaggcagaggttgcagt

SEQ ID NO: 101783 - DNA, 22 bp, Homo sapiens
tttcagaacataatgtgagcat

SEQ ID NO: 101784 - DNA, 22 bp, Homo sapiens
tgaacatgctgttgatggcctg

SEQ ID NO: 101785 - DNA, 22 bp, Homo sapiens
agaaggcatagaccggattatg

SEQ ID NO: 101786 - DNA, 22 bp, Homo sapiens
gcctggagaaaggaaggtggga

SEQ ID NO: 101787 - DNA, 22 bp, Homo sapiens
tccgggttttacactcacatca

SEQ ID NO: 101788 - DNA, 22 bp, Homo sapiens
atgttatcatgtttgttatacg

SEQ ID NO: 101789 - DNA, 20 bp, Homo sapiens
tgctggaaattgttctagga

SEQ ID NO: 101790 - DNA, 22 bp, Homo sapiens
ggggttaacagtattgctcatg

SEQ ID NO: 101791 - DNA, 22 bp, Homo sapiens
gcgtctcaaggcccccaggcca

SEQ ID NO: 101792 - DNA, 22 bp, Homo sapiens
agaaagtgcttccctttggact

SEQ ID NO: 101793 - DNA, 22 bp, Homo sapiens
agggcgctgaaatactaacatg

SEQ ID NO: 101794 - DNA, 22 bp, Homo sapiens
tcaccagacgcgtgggtctgag

SEQ ID NO: 101795 - DNA, 22 bp, Homo sapiens
aactgctgacaagtgaccagtg

SEQ ID NO: 101796 - DNA, 22 bp, Homo sapiens
ttattgaaggaactgaaataaa

SEQ ID NO: 101797 - DNA, 22 bp, Homo sapiens
cgtcagggttgagcaggtagat

SEQ ID NO: 101798 - DNA, 22 bp, Homo sapiens
gtgaggtggtacaatattaact

SEQ ID NO: 101799 - DNA, 22 bp, Homo sapiens
tagtaacccacacaacagtaga

SEQ ID NO: 101800 - DNA, 22 bp, Homo sapiens
ctgcttctccctgagatagtgt

SEQ ID NO: 101801 - DNA, 22 bp, Homo sapiens
tgtccttatctccaaacaatca

SEQ ID NO: 101802 - DNA, 22 bp, Homo sapiens
gagaaagctaaataagttgatt

SEQ ID NO: 101803 - DNA, 22 bp, Homo sapiens
agccagggtctctcgctctgtt

SEQ ID NO: 101804 - DNA, 22 bp, Homo sapiens
cccaggagttagaggttgtggt

SEQ ID NO: 101805 - DNA, 22 bp, Homo sapiens
gctcactgcaacctccgccttc

SEQ ID NO: 101806 - DNA, 22 bp, Homo sapiens
cctggggccccgagccagaagc

SEQ ID NO: 101807 - DNA, 22 bp, Homo sapiens
atacatgcgccatgttggtgtg

SEQ ID NO: 101808 - DNA, 22 bp, Homo sapiens
aacccgggaggcagaggttgtg

SEQ ID NO: 101809 - DNA, 22 bp, Homo sapiens
ggcttagcaactcctgaggctc

SEQ ID NO: 101810 - DNA, 22 bp, Homo sapiens
tcaccggcagacgtggcctgat

SEQ ID NO: 101811 - DNA, 22 bp, Homo sapiens
gaaagacatagttgcaagatgg

SEQ ID NO: 101812 - DNA, 22 bp, Homo sapiens
ctggctgggagcgagctgctca

SEQ ID NO: 101813 - DNA, 20 bp, Homo sapiens
ttgagcttttagtacagaca

SEQ ID NO: 101814 - DNA, 22 bp, Homo sapiens
aggccctattcaatggggccca

SEQ ID NO: 101815 - DNA, 22 bp, Homo sapiens
tacagtcacattctgaggtctt

SEQ ID NO: 101816 - DNA, 22 bp, Homo sapiens
aatttgtataaaatggtgtttt

SEQ ID NO: 101817 - DNA, 22 bp, Homo sapiens
acatcctcccgatctactggct

SEQ ID NO: 101818 - DNA, 22 bp, Homo sapiens
ctggcctaaaaatacagaacaa

SEQ ID NO: 101819 - DNA, 22 bp, Homo sapiens
tcaccttgtgatccgcccacct

SEQ ID NO: 101820 - DNA, 22 bp, Homo sapiens
ttgaggcctgctggaaggtgtt

SEQ ID NO: 101821 - DNA, 22 bp, Homo sapiens
cggggcgagcagacggcggcaa

SEQ ID NO: 101822 - DNA, 22 bp, Homo sapiens
tttttagtagaggtgggtttca

SEQ ID NO: 101823 - DNA, 22 bp, Homo sapiens
tggctacctgatttcttttcag

SEQ ID NO: 101824 - DNA, 22 bp, Homo sapiens
cccagggaggcccaggctctgc

SEQ ID NO: 101825 - DNA, 22 bp, Homo sapiens
tgactcctggtatggatgacag

SEQ ID NO: 101826 - DNA, 22 bp, Homo sapiens
cttgccttctctggggtggcag

SEQ ID NO: 101827 - DNA, 22 bp, Homo sapiens
tggcatctttgtcccagaagct

SEQ ID NO: 101828 - DNA, 22 bp, Homo sapiens
ttattaggaactcaggattttt

SEQ ID NO: 101829 - DNA, 22 bp, Homo sapiens
gcggggggaggaacatcttgca

SEQ ID NO: 101830 - DNA, 22 bp, Homo sapiens
ctgggaggcggaggttgcagtg

SEQ ID NO: 101831 - DNA, 22 bp, Homo sapiens
aaggctgtggttctatacagaa

SEQ ID NO: 101832 - DNA, 22 bp, Homo sapiens
tgcaatgatattgtcaaagcat

SEQ ID NO: 101833 - DNA, 22 bp, Homo sapiens
atgtggcaccgatctttagcca

SEQ ID NO: 101834 - DNA, 22 bp, Homo sapiens
atgtccttcctgagatccctgt

SEQ ID NO: 101835 - DNA, 22 bp, Homo sapiens
aatattatcaaaagctttttca

SEQ ID NO: 101836 - DNA, 22 bp, Homo sapiens
ggaggcggaggctgcagtgagc

SEQ ID NO: 101837 - DNA, 22 bp, Homo sapiens
tgggattcaccatgggcttcag

SEQ ID NO: 101838 - DNA, 22 bp, Homo sapiens
tgcctgtggaaaggctggtgct

SEQ ID NO: 101839 - DNA, 20 bp, Homo sapiens
tcacatcctctcccaacatg

SEQ ID NO: 101840 - DNA, 22 bp, Homo sapiens
gaagctgagctgaggcatgttg

SEQ ID NO: 101841 - DNA, 22 bp, Homo sapiens
gagacacaggcacagaagaggc

SEQ ID NO: 101842 - DNA, 22 bp, Homo sapiens
agaaaacataggagacaggaaa

SEQ ID NO: 101843 - DNA, 18 bp, Homo sapiens
ggctgtggacaagattag

SEQ ID NO: 101844 - DNA, 22 bp, Homo sapiens
ccaaagaaacccaagctcaggg

SEQ ID NO: 101845 - DNA, 22 bp, Homo sapiens
ttatttaaaagtggtaagattc

SEQ ID NO: 101846 - DNA, 22 bp, Homo sapiens
cccatgtgtgacagtccatttg

SEQ ID NO: 101847 - DNA, 22 bp, Homo sapiens
gcagtggcatgatgtgggctca

SEQ ID NO: 101848 - DNA, 22 bp, Homo sapiens
ggttccacctggcgaggggtat

SEQ ID NO: 101849 - DNA, 22 bp, Homo sapiens
tcgcccagctcatctcccacaa

SEQ ID NO: 101850 - DNA, 22 bp, Homo sapiens
tctagttctagatccctgagga

SEQ ID NO: 101851 - DNA, 22 bp, Homo sapiens
acaggcacctgccaccacatct

SEQ ID NO: 101852 - DNA, 22 bp, Homo sapiens
ggggagatgcttaggtccgggg

SEQ ID NO: 101853 - DNA, 22 bp, Homo sapiens
gttccgtttatatgctggatta

SEQ ID NO: 101854 - DNA, 22 bp, Homo sapiens
ggaaaggcctgggtgtcctggg

SEQ ID NO: 101855 - DNA, 22 bp, Homo sapiens
ggctgccttccctgagccccgg

SEQ ID NO: 101856 - DNA, 22 bp, Homo sapiens
ctctggactttttgtggattct

SEQ ID NO: 101857 - DNA, 22 bp, Homo sapiens
agccccttgtgggcgcacagca

SEQ ID NO: 101858 - DNA, 17 bp, Homo sapiens
ttaaggtggatcagcac

SEQ ID NO: 101859 - DNA, 22 bp, Homo sapiens
ttctgggcacacaggccctggt

SEQ ID NO: 101860 - DNA, 22 bp, Homo sapiens
agtgcattcctggggaagaagc

SEQ ID NO: 101861 - DNA, 22 bp, Homo sapiens
cactccagcctcagtgacagag

SEQ ID NO: 101862 - DNA, 22 bp, Homo sapiens
accctcaacaaattcactctat

SEQ ID NO: 101863 - DNA, 22 bp, Homo sapiens
cgcatgagacctgccggccatc

SEQ ID NO: 101864 - DNA, 21 bp, Homo sapiens
ctgtttgcaagcctatgtgtc

SEQ ID NO: 101865 - DNA, 22 bp, Homo sapiens
aaagtgcttcctttttgagggt

SEQ ID NO: 101866 - DNA, 22 bp, Homo sapiens
acaaagccagattctggagcac

SEQ ID NO: 101867 - DNA, 22 bp, Homo sapiens
gaagtgtagtcttgagccccca

SEQ ID NO: 101868 - DNA, 22 bp, Homo sapiens
aatgtgagccaatgcccgtggg

SEQ ID NO: 101869 - DNA, 22 bp, Homo sapiens
agacaaagaaaccgtagaagca

SEQ ID NO: 101870 - DNA, 22 bp, Homo sapiens
gtgcaaacatcatagagtgtac

SEQ ID NO: 101871 - DNA, 22 bp, Homo sapiens
gcctggattccttgtttctcag

SEQ ID NO: 101872 - DNA, 22 bp, Homo sapiens
tcttcccagaggaggtgccagc

SEQ ID NO: 101873 - DNA, 18 bp, Homo sapiens
gatatggaaggccatgcc

SEQ ID NO: 101874 - DNA, 22 bp, Homo sapiens
ctacccttaagtttctgtgggg

SEQ ID NO: 101875 - DNA, 22 bp, Homo sapiens
gggggggtcttcagacctcaga

SEQ ID NO: 101876 - DNA, 22 bp, Homo sapiens
gggtattaaaatgaaggagaaa

SEQ ID NO: 101877 - DNA, 22 bp, Homo sapiens
tttatgtagttacggactatca

SEQ ID NO: 101878 - DNA, 20 bp, Homo sapiens
ctgggtggcaagcaaggggg

SEQ ID NO: 101879 - DNA, 22 bp, Homo sapiens
taggtttactgaattagtggaa

SEQ ID NO: 101880 - DNA, 22 bp, Homo sapiens
gtagtcccagctaccccggagg

SEQ ID NO: 101881 - DNA, 19 bp, Homo sapiens
gttctttcatagtaagagc

SEQ ID NO: 101882 - DNA, 22 bp, Homo sapiens
tgcagcacttgccaaactaact

SEQ ID NO: 101883 - DNA, 22 bp, Homo sapiens
gctggaaatgattaaatggtga

SEQ ID NO: 101884 - DNA, 22 bp, Homo sapiens
ttttttgttgggtagaacggaa

SEQ ID NO: 101885 - DNA, 22 bp, Homo sapiens
ccaggcagcctgctccattctg

SEQ ID NO: 101886 - DNA, 22 bp, Homo sapiens
gttctgggagatcttgagcttc

SEQ ID NO: 101887 - DNA, 22 bp, Homo sapiens
aagcccttggcgcacaccgggc

SEQ ID NO: 101888 - DNA, 22 bp, Homo sapiens
tagtttcatctccaccctgccc

SEQ ID NO: 101889 - DNA, 22 bp, Homo sapiens
acgcccggtctccatagttttt

SEQ ID NO: 101890 - DNA, 22 bp, Homo sapiens
tatttcacatctatgaagtgag

SEQ ID NO: 101891 - DNA, 22 bp, Homo sapiens
gcccttacagggtggtcagcca

SEQ ID NO: 101892 - DNA, 20 bp, Homo sapiens
cagtgcattgcttctgattt

SEQ ID NO: 101893 - DNA, 20 bp, Homo sapiens
tgacgggaagctgaaggcac

SEQ ID NO: 101894 - DNA, 22 bp, Homo sapiens
gcatgcaatctatccttaggaa

SEQ ID NO: 101895 - DNA, 16 bp, Homo sapiens
gcaggcagatcacatg

SEQ ID NO: 101896 - DNA, 22 bp, Homo sapiens
gacatagctcagagctcagcac

SEQ ID NO: 101897 - DNA, 22 bp, Homo sapiens
tgagatgaataactcctgctaa

SEQ ID NO: 101898 - DNA, 22 bp, Homo sapiens
agaggaagtaatcaggacctgc

SEQ ID NO: 101899 - DNA, 22 bp, Homo sapiens
gatgctgctcgggtgcctggga

SEQ ID NO: 101900 - DNA, 22 bp, Homo sapiens
ttctcccatctcagtcttacat

SEQ ID NO: 101901 - DNA, 22 bp, Homo sapiens
agcgacaccgcctgcaggccat

SEQ ID NO: 101902 - DNA, 22 bp, Homo sapiens
cagtgcatgcacacacatggta

SEQ ID NO: 101903 - DNA, 22 bp, Homo sapiens
ttggaagttgatttaaaaagga

SEQ ID NO: 101904 - DNA, 22 bp, Homo sapiens
tcttggccactaccacctggag

SEQ ID NO: 101905 - DNA, 19 bp, Homo sapiens
tccacagtggttgaactag

SEQ ID NO: 101906 - DNA, 22 bp, Homo sapiens
agaggcaggaggttgacttgag

SEQ ID NO: 101907 - DNA, 22 bp, Homo sapiens
ttctgtggttgaaaggagagat

SEQ ID NO: 101908 - DNA, 22 bp, Homo sapiens
gtaatagtctcaaactcctgga

SEQ ID NO: 101909 - DNA, 21 bp, Homo sapiens
tttcaagggaccctggggatc

SEQ ID NO: 101910 - DNA, 22 bp, Homo sapiens
cggggttcatccatgctgtggc

SEQ ID NO: 101911 - DNA, 22 bp, Homo sapiens
atcagagtgggttttaaaagtg

SEQ ID NO: 101912 - DNA, 22 bp, Homo sapiens
aatctcatttacaacatgagga

SEQ ID NO: 101913 - DNA, 22 bp, Homo sapiens
atcttcccaggctggggagagg

SEQ ID NO: 101914 - DNA, 22 bp, Homo sapiens
acgtagcactgagagatgcagg

SEQ ID NO: 101915 - DNA, 22 bp, Homo sapiens
gggcatgtcccgctgtgcaccg

SEQ ID NO: 101916 - DNA, 22 bp, Homo sapiens
ggagagtgggagcaactgttgc

SEQ ID NO: 101917 - DNA, 22 bp, Homo sapiens
accatgtcatttattggccaaa

SEQ ID NO: 101918 - DNA, 22 bp, Homo sapiens
tggggtgagattcagatattca

SEQ ID NO: 101919 - DNA, 22 bp, Homo sapiens
tacagctgctggtgctccatgc

SEQ ID NO: 101920 - DNA, 22 bp, Homo sapiens
gtctttatttgagattgtcatt

SEQ ID NO: 101921 - DNA, 22 bp, Homo sapiens
ggagttccagaccagactggcc

SEQ ID NO: 101922 - DNA, 22 bp, Homo sapiens
ggagtgactcacagctgggaca

SEQ ID NO: 101923 - DNA, 22 bp, Homo sapiens
cagcagcagtggctgcagaaca

SEQ ID NO: 101924 - DNA, 22 bp, Homo sapiens
cctccctgccggctggactagt

SEQ ID NO: 101925 - DNA, 22 bp, Homo sapiens
ggcttggaaactagagtgtgca

SEQ ID NO: 101926 - DNA, 22 bp, Homo sapiens
atgaggcaggagtgcagtggca

SEQ ID NO: 101927 - DNA, 22 bp, Homo sapiens
tgtgtcattgccatgaaaaggc

SEQ ID NO: 101928 - DNA, 22 bp, Homo sapiens
gtgggggcaggcagtgctagga

SEQ ID NO: 101929 - DNA, 19 bp, Homo sapiens
atgtacccagtgtcaatcc

SEQ ID NO: 101930 - DNA, 22 bp, Homo sapiens
gagccccaccctagacattctg

SEQ ID NO: 101931 - DNA, 22 bp, Homo sapiens
cagctggtgtcaggcactgcag

SEQ ID NO: 101932 - DNA, 21 bp, Homo sapiens
gccagcggccgccctccagga

SEQ ID NO: 101933 - DNA, 22 bp, Homo sapiens
attgcactccagcctgggcgac

SEQ ID NO: 101934 - DNA, 22 bp, Homo sapiens
acatttatataactcactagga

SEQ ID NO: 101935 - DNA, 22 bp, Homo sapiens
ttcagacaggcagctgggctgg

SEQ ID NO: 101936 - DNA, 22 bp, Homo sapiens
gtctatgatattttgttatagc

SEQ ID NO: 101937 - DNA, 22 bp, Homo sapiens
aggtagaaggaccagaatttat

SEQ ID NO: 101938 - DNA, 22 bp, Homo sapiens
gctcaggtagatggggttgtcc

SEQ ID NO: 101939 - DNA, 22 bp, Homo sapiens
aaatatcttaggagtatatgag

SEQ ID NO: 101940 - DNA, 22 bp, Homo sapiens
gagagcaggaggcagcgggacg

SEQ ID NO: 101941 - DNA, 22 bp, Homo sapiens
attttctatgttgtaattgtta

SEQ ID NO: 101942 - DNA, 22 bp, Homo sapiens
ctgctttgcatagctgccagag

SEQ ID NO: 101943 - DNA, 22 bp, Homo sapiens
aagtttgtgtagtttagcatcc

SEQ ID NO: 101944 - DNA, 22 bp, Homo sapiens
agctagtatttcattgaggatt

SEQ ID NO: 101945 - DNA, 22 bp, Homo sapiens
aaaagaggaactcttatatact

SEQ ID NO: 101946 - DNA, 22 bp, Homo sapiens
ctttggaacacccagctctgtg

SEQ ID NO: 101947 - DNA, 22 bp, Homo sapiens
gggatgcagactacagggctta

SEQ ID NO: 101948 - DNA, 22 bp, Homo sapiens
aggatgagccgcgcaagctgac

SEQ ID NO: 101949 - DNA, 22 bp, Homo sapiens
atgatactctaggtgatttaca

SEQ ID NO: 101950 - DNA, 22 bp, Homo sapiens
cgagagatgggttggcaggggc

SEQ ID NO: 101951 - DNA, 22 bp, Homo sapiens
gcttttgcctacatcttggtct

SEQ ID NO: 101952 - DNA, 22 bp, Homo sapiens
gtgggccagcttttctcctggg

SEQ ID NO: 101953 - DNA, 22 bp, Homo sapiens
agcccagaggctgggcgtgcat

SEQ ID NO: 101954 - DNA, 22 bp, Homo sapiens
agcttgtgtttttctaagtatc

SEQ ID NO: 101955 - DNA, 22 bp, Homo sapiens
tgagagcaacacgcagtagtat

SEQ ID NO: 101956 - DNA, 22 bp, Homo sapiens
ctggtaggggtgactgttatcg

SEQ ID NO: 101957 - DNA, 22 bp, Homo sapiens
ggtcgagtcacttgttgccttt

SEQ ID NO: 101958 - DNA, 22 bp, Homo sapiens
attgtggactgatcagggctag

SEQ ID NO: 101959 - DNA, 18 bp, Homo sapiens
tgtagagccaggtttgcc

SEQ ID NO: 101960 - DNA, 22 bp, Homo sapiens
attggtggtgaggacatgccag

SEQ ID NO: 101961 - DNA, 22 bp, Homo sapiens
actcagtacatctggagttggc

SEQ ID NO: 101962 - DNA, 22 bp, Homo sapiens
ccaggaggcggaaggtacagtg

SEQ ID NO: 101963 - DNA, 22 bp, Homo sapiens
tttgatccgttgctggtgagga

SEQ ID NO: 101964 - DNA, 22 bp, Homo sapiens
aactcaaagatgcatgacgctt

SEQ ID NO: 101965 - DNA, 22 bp, Homo sapiens
ccaggggttggaggttgcagtg

SEQ ID NO: 101966 - DNA, 22 bp, Homo sapiens
aaaagttattgatgcaggacaa

SEQ ID NO: 101967 - DNA, 22 bp, Homo sapiens
ctcctgcttcacgggcaccgcc

SEQ ID NO: 101968 - DNA, 22 bp, Homo sapiens
ggtgggagccaacacccttctg

SEQ ID NO: 101969 - DNA, 22 bp, Homo sapiens
agctacagtcggaaggacagac

SEQ ID NO: 101970 - DNA, 22 bp, Homo sapiens
gggaaggccttgtcagcggatt

SEQ ID NO: 101971 - DNA, 22 bp, Homo sapiens
cagggtttcaccatgttagcag

SEQ ID NO: 101972 - DNA, 22 bp, Homo sapiens
aaggcaaaagaggtgtcatcac

SEQ ID NO: 101973 - DNA, 21 bp, Homo sapiens
ggccgccgccttgtgctctgc

SEQ ID NO: 101974 - DNA, 22 bp, Homo sapiens
tccaagatctacagcagtttag

SEQ ID NO: 101975 - DNA, 22 bp, Homo sapiens
tttgaaatatgtgtcttttgaa

SEQ ID NO: 101976 - DNA, 22 bp, Homo sapiens
aggtgcatctcgtagctcttct

SEQ ID NO: 101977 - DNA, 22 bp, Homo sapiens
gctgcacagacttgctcattta

SEQ ID NO: 101978 - DNA, 22 bp, Homo sapiens
ttgtacttgccatagaacaaca

SEQ ID NO: 101979 - DNA, 22 bp, Homo sapiens
tgcctgcctaggaagctgtgaa

SEQ ID NO: 101980 - DNA, 22 bp, Homo sapiens
cccacagtgatcgcattcgtac

SEQ ID NO: 101981 - DNA, 22 bp, Homo sapiens
gccaggttgctgacgacgatct

SEQ ID NO: 101982 - DNA, 23 bp, Homo sapiens
cctgcctccccatcagttataca

SEQ ID NO: 101983 - DNA, 22 bp, Homo sapiens
ttgtggttaaccgcacattttt

SEQ ID NO: 101984 - DNA, 22 bp, Homo sapiens
ctgcacatgtccctaagtgtca

SEQ ID NO: 101985 - DNA, 22 bp, Homo sapiens
tgggcagggagctggaaccaca

SEQ ID NO: 101986 - DNA, 22 bp, Homo sapiens
tcaggaggtccgcccgggaggg

SEQ ID NO: 101987 - DNA, 23 bp, Homo sapiens
ggggtcttggaacaggtggccct

SEQ ID NO: 101988 - DNA, 22 bp, Homo sapiens
cccagccaaaagcaagtttacc

SEQ ID NO: 101989 - DNA, 19 bp, Homo sapiens
catggtgaaaccccgtctc

SEQ ID NO: 101990 - DNA, 22 bp, Homo sapiens
agaacagaggccttatgtttca

SEQ ID NO: 101991 - DNA, 20 bp, Homo sapiens
aaacgagccatcattctggt

SEQ ID NO: 101992 - DNA, 22 bp, Homo sapiens
caagaatcaacattatttagtg

SEQ ID NO: 101993 - DNA, 22 bp, Homo sapiens
gaagcctcaacatctctgcgtc

SEQ ID NO: 101994 - DNA, 20 bp, Homo sapiens
gggcagagccagccagtccc

SEQ ID NO: 101995 - DNA, 20 bp, Homo sapiens
caagggtttgcattggcttt

SEQ ID NO: 101996 - DNA, 22 bp, Homo sapiens
tgaatgtgatgctaaacatatg

SEQ ID NO: 101997 - DNA, 22 bp, Homo sapiens
attgttcaatgtaataattttg

SEQ ID NO: 101998 - DNA, 22 bp, Homo sapiens
tccacagtggttgaactagtaa

SEQ ID NO: 101999 - DNA, 22 bp, Homo sapiens
gaatttcctctaaacccctgag

SEQ ID NO: 102000 - DNA, 22 bp, Homo sapiens
tgtcctcgtccgcctcgaactc

SEQ ID NO: 102001 - DNA, 22 bp, Homo sapiens
agctgcaccggctggaccactg

SEQ ID NO: 102002 - DNA, 22 bp, Homo sapiens
ggctcaatgcaacttctgcctc

SEQ ID NO: 102003 - DNA, 22 bp, Homo sapiens
cggccaggcacagtggcccacg

SEQ ID NO: 102004 - DNA, 22 bp, Homo sapiens
caggttggagatctgtctatgg

SEQ ID NO: 102005 - DNA, 18 bp, Homo sapiens
tggcgatggtcatttttc

SEQ ID NO: 102006 - DNA, 22 bp, Homo sapiens
tgctccatctagagctctgcag

SEQ ID NO: 102007 - DNA, 20 bp, Homo sapiens
gagattaactgagaatctag

SEQ ID NO: 102008 - DNA, 22 bp, Homo sapiens
ctgggagtggtgacagctctcg

SEQ ID NO: 102009 - DNA, 22 bp, Homo sapiens
gccctgtgcaggtgtgcagcag

SEQ ID NO: 102010 - DNA, 22 bp, Homo sapiens
cagcccaggactgcaggtgttt

SEQ ID NO: 102011 - DNA, 22 bp, Homo sapiens
tgttttaagctctagaagggga

SEQ ID NO: 102012 - DNA, 22 bp, Homo sapiens
tggggcagttaataaacattct

SEQ ID NO: 102013 - DNA, 22 bp, Homo sapiens
ggtgctggacacgtggcactcc

SEQ ID NO: 102014 - DNA, 18 bp, Homo sapiens
tctggaacaacttcatgt

SEQ ID NO: 102015 - DNA, 22 bp, Homo sapiens
tatgaagtctctgatgttgagt

SEQ ID NO: 102016 - DNA, 22 bp, Homo sapiens
ttgagatggagtctcactctgt

SEQ ID NO: 102017 - DNA, 22 bp, Homo sapiens
ttatcacttatgagctttttgc

SEQ ID NO: 102018 - DNA, 22 bp, Homo sapiens
tagggtagtaccatgctgccag

SEQ ID NO: 102019 - DNA, 22 bp, Homo sapiens
aaaaagtattggccatggttga

SEQ ID NO: 102020 - DNA, 22 bp, Homo sapiens
caaagcccagaggcctcacttt

SEQ ID NO: 102021 - DNA, 22 bp, Homo sapiens
gctgctctcagagctcatgctg

SEQ ID NO: 102022 - DNA, 22 bp, Homo sapiens
ttgtgaatagtgctgcaataaa

SEQ ID NO: 102023 - DNA, 22 bp, Homo sapiens
tacagtgcttggtatctagtaa

SEQ ID NO: 102024 - DNA, 22 bp, Homo sapiens
aagccaggttccatggaggagc

SEQ ID NO: 102025 - DNA, 21 bp, Homo sapiens
cggaaaggactagggctcaga

SEQ ID NO: 102026 - DNA, 22 bp, Homo sapiens
agctttggcatctgactagccg

SEQ ID NO: 102027 - DNA, 18 bp, Homo sapiens
ctgcactcccgcctgggc

SEQ ID NO: 102028 - DNA, 22 bp, Homo sapiens
tggaatgcagtgggagcttacc

SEQ ID NO: 102029 - DNA, 22 bp, Homo sapiens
taacatttaaatttttcacata

SEQ ID NO: 102030 - DNA, 22 bp, Homo sapiens
tgggcttggtttctaggtaggt

SEQ ID NO: 102031 - DNA, 22 bp, Homo sapiens
atacaatgacccgggtccaagg

SEQ ID NO: 102032 - DNA, 22 bp, Homo sapiens
ttagctcagaaaatttaaactt

SEQ ID NO: 102033 - DNA, 22 bp, Homo sapiens
tgcaccctcatcagtcaaatgg

SEQ ID NO: 102034 - DNA, 22 bp, Homo sapiens
aaattctgatttaataagtgta

SEQ ID NO: 102035 - DNA, 22 bp, Homo sapiens
ctgggtggcagagcctgcagtg

SEQ ID NO: 102036 - DNA, 22 bp, Homo sapiens
ctgctttggacaactattcttg

SEQ ID NO: 102037 - DNA, 21 bp, Homo sapiens
tcacgtggtcacatgagcttt

SEQ ID NO: 102038 - DNA, 22 bp, Homo sapiens
caactccctgtggggtactggg

SEQ ID NO: 102039 - DNA, 21 bp, Homo sapiens
aggcttggatctagacaggcc

SEQ ID NO: 102040 - DNA, 22 bp, Homo sapiens
aatgtgaggccttggtagttat

SEQ ID NO: 102041 - DNA, 22 bp, Homo sapiens
agtgagagtattaatgtgaact

SEQ ID NO: 102042 - DNA, 22 bp, Homo sapiens
tgagcctgggagatggaggctg

SEQ ID NO: 102043 - DNA, 22 bp, Homo sapiens
atggcctgcagtgctgccacag

SEQ ID NO: 102044 - DNA, 22 bp, Homo sapiens
cgatcaccgtggccactttgag

SEQ ID NO: 102045 - DNA, 22 bp, Homo sapiens
catgcggctctttccaaaccgg

SEQ ID NO: 102046 - DNA, 22 bp, Homo sapiens
tggaagaatatgggggtacaga

SEQ ID NO: 102047 - DNA, 22 bp, Homo sapiens
tggtgctgccaggctcctgcca

SEQ ID NO: 102048 - DNA, 22 bp, Homo sapiens
tgtgttcagaatttgctgcttt

SEQ ID NO: 102049 - DNA, 22 bp, Homo sapiens
tgaagctacagaccttcgcggt

SEQ ID NO: 102050 - DNA, 22 bp, Homo sapiens
tctgcaacattcctctccccac

SEQ ID NO: 102051 - DNA, 22 bp, Homo sapiens
atggggaagcaattggatttcc

SEQ ID NO: 102052 - DNA, 22 bp, Homo sapiens
aggtcacgtcctgtgatgtcat

SEQ ID NO: 102053 - DNA, 22 bp, Homo sapiens
aaaggtcaaaatcgtgacattg

SEQ ID NO: 102054 - DNA, 22 bp, Homo sapiens
gctcaagccttctgcccacctc

SEQ ID NO: 102055 - DNA, 22 bp, Homo sapiens
ggaaggcagaggtgtcgtgggg

SEQ ID NO: 102056 - DNA, 22 bp, Homo sapiens
taggtataggattctaggttgg

SEQ ID NO: 102057 - DNA, 22 bp, Homo sapiens
accctggacatcttgtcatagc

SEQ ID NO: 102058 - DNA, 22 bp, Homo sapiens
gctcactgcaacctctgcctcc

SEQ ID NO: 102059 - DNA, 22 bp, Homo sapiens
tgcccaggctggagtacagtgg

SEQ ID NO: 102060 - DNA, 22 bp, Homo sapiens
tgtttgagttctagcgcattta

SEQ ID NO: 102061 - DNA, 18 bp, Homo sapiens
ttcggcagatacgcttgg

SEQ ID NO: 102062 - DNA, 22 bp, Homo sapiens
agccctcttccagccagcacag

SEQ ID NO: 102063 - DNA, 22 bp, Homo sapiens
atacaaagtattgatcctgagt

SEQ ID NO: 102064 - DNA, 18 bp, Homo sapiens
acacttcctggtggtgtg

SEQ ID NO: 102065 - DNA, 22 bp, Homo sapiens
ggtttattgttaataagtttga

SEQ ID NO: 102066 - DNA, 20 bp, Homo sapiens
attagagctacatggctaca

SEQ ID NO: 102067 - DNA, 22 bp, Homo sapiens
tcccacaggtggagcttgcagt

SEQ ID NO: 102068 - DNA, 22 bp, Homo sapiens
tctgttttgcataatgttcttt

SEQ ID NO: 102069 - DNA, 22 bp, Homo sapiens
ggctgtggagctgcagagttgg

SEQ ID NO: 102070 - DNA, 22 bp, Homo sapiens
ctgggaggcagaggttgtagtg

SEQ ID NO: 102071 - DNA, 23 bp, Homo sapiens
gtgcatgtgtctttacagtagca

SEQ ID NO: 102072 - DNA, 22 bp, Homo sapiens
ttccgagggctcggcggccgcc

SEQ ID NO: 102073 - DNA, 22 bp, Homo sapiens
tttaagaagttatgttataaat

SEQ ID NO: 102074 - DNA, 22 bp, Homo sapiens
gccagtgcctcgccgcgctcct

SEQ ID NO: 102075 - DNA, 22 bp, Homo sapiens
tccagctgttccatcagctctt

SEQ ID NO: 102076 - DNA, 22 bp, Homo sapiens
aggggaccaaaatgtcctgcct

SEQ ID NO: 102077 - DNA, 22 bp, Homo sapiens
tgctccatgcgctcggccggcg

SEQ ID NO: 102078 - DNA, 23 bp, Homo sapiens
ccaagactgttaggagtggggag

SEQ ID NO: 102079 - DNA, 22 bp, Homo sapiens
cccaggaggcggaggttgcagt

SEQ ID NO: 102080 - DNA, 22 bp, Homo sapiens
tgtgagttcttagaaagtcagt

SEQ ID NO: 102081 - DNA, 22 bp, Homo sapiens
tgagccatgggactccaaggga

SEQ ID NO: 102082 - DNA, 22 bp, Homo sapiens
gattgggggtcaggctcaggtc

SEQ ID NO: 102083 - DNA, 22 bp, Homo sapiens
gcgttggggaccccgaagctgg

SEQ ID NO: 102084 - DNA, 22 bp, Homo sapiens
ggtgcagaggagccagctgggg

SEQ ID NO: 102085 - DNA, 22 bp, Homo sapiens
agattctaccagagctagtttg

SEQ ID NO: 102086 - DNA, 22 bp, Homo sapiens
cctgcctactgagttttatatt

SEQ ID NO: 102087 - DNA, 22 bp, Homo sapiens
ttggaatgttttaatataaatt

SEQ ID NO: 102088 - DNA, 22 bp, Homo sapiens
tcctccactttgtctagcaaca

SEQ ID NO: 102089 - DNA, 22 bp, Homo sapiens
tgcctactagtactattttgtg

SEQ ID NO: 102090 - DNA, 22 bp, Homo sapiens
agctgattccactttttcccca

SEQ ID NO: 102091 - DNA, 22 bp, Homo sapiens
gaagtattactctgaatgtatt

SEQ ID NO: 102092 - DNA, 22 bp, Homo sapiens
taattataacagttacatctta

SEQ ID NO: 102093 - DNA, 22 bp, Homo sapiens
ggctcacgcaattatcccggcc

SEQ ID NO: 102094 - DNA, 22 bp, Homo sapiens
ttggggtcccacaggctgcctg

SEQ ID NO: 102095 - DNA, 21 bp, Homo sapiens
gaccccagaccagcagacaca

SEQ ID NO: 102096 - DNA, 19 bp, Homo sapiens
acccagcccaggagtggca

SEQ ID NO: 102097 - DNA, 22 bp, Homo sapiens
gagcccaggagtttgatgctgc

SEQ ID NO: 102098 - DNA, 22 bp, Homo sapiens
tagatctgatacaattcatctg

SEQ ID NO: 102099 - DNA, 22 bp, Homo sapiens
gggacttcatagctaggcactt

SEQ ID NO: 102100 - DNA, 22 bp, Homo sapiens
ctcattgcagctgcattactgt

SEQ ID NO: 102101 - DNA, 22 bp, Homo sapiens
cagcagcagtgttctagaatct

SEQ ID NO: 102102 - DNA, 22 bp, Homo sapiens
aacatagaataaatgagttagg

SEQ ID NO: 102103 - DNA, 22 bp, Homo sapiens
tattgacagtgactattggtag

SEQ ID NO: 102104 - DNA, 22 bp, Homo sapiens
gtgggacaaggatgaagatatt

SEQ ID NO: 102105 - DNA, 22 bp, Homo sapiens
cactgcactccagcctgggtga

SEQ ID NO: 102106 - DNA, 17 bp, Homo sapiens
tccttcagtgcctctgc

SEQ ID NO: 102107 - DNA, 22 bp, Homo sapiens
tctgctggaaaaccagggaatt

SEQ ID NO: 102108 - DNA, 19 bp, Homo sapiens
agccagccagcaggtatgc

SEQ ID NO: 102109 - DNA, 18 bp, Homo sapiens
ccatcaccctaactagtg

SEQ ID NO: 102110 - DNA, 22 bp, Homo sapiens
ctaggtgatccactgctctctt

SEQ ID NO: 102111 - DNA, 22 bp, Homo sapiens
ccactgtgcccagcctcatggg

SEQ ID NO: 102112 - DNA, 22 bp, Homo sapiens
tcccagattcctgctcttatat

SEQ ID NO: 102113 - DNA, 22 bp, Homo sapiens
gcctccagcccacgcaggcctg

SEQ ID NO: 102114 - DNA, 22 bp, Homo sapiens
tcgaaataatttagaatataga

SEQ ID NO: 102115 - DNA, 22 bp, Homo sapiens
aagaaatgctgatgttggatgg

SEQ ID NO: 102116 - DNA, 22 bp, Homo sapiens
gtatgtctatagtttttaaata

SEQ ID NO: 102117 - DNA, 22 bp, Homo sapiens
aagccctggcgggtggagggcc

SEQ ID NO: 102118 - DNA, 22 bp, Homo sapiens
ttgtgctcctgtgagaatctag

SEQ ID NO: 102119 - DNA, 22 bp, Homo sapiens
cccaggatggggctgcagttat

SEQ ID NO: 102120 - DNA, 22 bp, Homo sapiens
acagaagcctttggccatttga

SEQ ID NO: 102121 - DNA, 22 bp, Homo sapiens
aagactgagtggcttaagaaaa

SEQ ID NO: 102122 - DNA, 22 bp, Homo sapiens
gcccagtggtaaaagcaggcct

SEQ ID NO: 102123 - DNA, 22 bp, Homo sapiens
gattgagtctgaggatgctgca

SEQ ID NO: 102124 - DNA, 23 bp, Homo sapiens
tgagctgggcctgcaggggtctc

SEQ ID NO: 102125 - DNA, 22 bp, Homo sapiens
atttagacatgtatctgatagc

SEQ ID NO: 102126 - DNA, 21 bp, Homo sapiens
acataggcgaatgttcgggag

SEQ ID NO: 102127 - DNA, 22 bp, Homo sapiens
cccgagtgtctactcactccca

SEQ ID NO: 102128 - DNA, 22 bp, Homo sapiens
ggagttgattttggatatatta

SEQ ID NO: 102129 - DNA, 22 bp, Homo sapiens
aaggctgagacagcacaggtcc

SEQ ID NO: 102130 - DNA, 22 bp, Homo sapiens
gtgtatgttctacttaatatta

SEQ ID NO: 102131 - DNA, 22 bp, Homo sapiens
gacccaggggcagggagaaagt

SEQ ID NO: 102132 - DNA, 22 bp, Homo sapiens
agcactgtgagcaccagcacgc

SEQ ID NO: 102133 - DNA, 23 bp, Homo sapiens
ccagtgattgcctggaaggaggt

SEQ ID NO: 102134 - DNA, 22 bp, Homo sapiens
agtgaaaacctaatcatgcagt

SEQ ID NO: 102135 - DNA, 22 bp, Homo sapiens
tgggaagaggagcactggaatg

SEQ ID NO: 102136 - DNA, 22 bp, Homo sapiens
ctgaggctggagtgcagtggtg

SEQ ID NO: 102137 - DNA, 22 bp, Homo sapiens
ttatgatttgccacagattggt

SEQ ID NO: 102138 - DNA, 22 bp, Homo sapiens
cccaggaggtcaaggctgcagt

SEQ ID NO: 102139 - DNA, 22 bp, Homo sapiens
ctcccagccttcgccagtctga

SEQ ID NO: 102140 - DNA, 22 bp, Homo sapiens
tgcctaggctggagtgtagtgg

SEQ ID NO: 102141 - DNA, 22 bp, Homo sapiens
gagtttcttcatggtgcagagg

SEQ ID NO: 102142 - DNA, 22 bp, Homo sapiens
actgcattccagcctgggcaac

SEQ ID NO: 102143 - DNA, 22 bp, Homo sapiens
tgatttcaagccagggggcgtt

SEQ ID NO: 102144 - DNA, 22 bp, Homo sapiens
tgggactcactcttttggccag

SEQ ID NO: 102145 - DNA, 22 bp, Homo sapiens
cccaggaggcagagatagcagt

SEQ ID NO: 102146 - DNA, 20 bp, Homo sapiens
aggccccaggtggacactag

SEQ ID NO: 102147 - DNA, 22 bp, Homo sapiens
aatgttgcagagtgattgtcca

SEQ ID NO: 102148 - DNA, 22 bp, Homo sapiens
tccacagtggttgaactagttt

SEQ ID NO: 102149 - DNA, 22 bp, Homo sapiens
cttgcctacttgtcaaccagca

SEQ ID NO: 102150 - DNA, 22 bp, Homo sapiens
gtccttccacatggccaacttc

SEQ ID NO: 102151 - DNA, 22 bp, Homo sapiens
catctgctgttccttggactca

SEQ ID NO: 102152 - DNA, 22 bp, Homo sapiens
aaagcttaccttttcagtcttt

SEQ ID NO: 102153 - DNA, 17 bp, Homo sapiens
aatctgtttacagtcag

SEQ ID NO: 102154 - DNA, 22 bp, Homo sapiens
aggctcccaagcactgacccca

SEQ ID NO: 102155 - DNA, 22 bp, Homo sapiens
tttccctgtgaatatttaaaga

SEQ ID NO: 102156 - DNA, 22 bp, Homo sapiens
tgtgcacaatgtgcaggtttgt

SEQ ID NO: 102157 - DNA, 22 bp, Homo sapiens
cactgggcgtgtcctgggtgag

SEQ ID NO: 102158 - DNA, 22 bp, Homo sapiens
gcagagccatgggaggtttttg

SEQ ID NO: 102159 - DNA, 22 bp, Homo sapiens
tccgggcaactgaagggaggtt

SEQ ID NO: 102160 - DNA, 22 bp, Homo sapiens
gagacctcttggtatcgctagg

SEQ ID NO: 102161 - DNA, 22 bp, Homo sapiens
aagggctctgtgcttgtcccat

SEQ ID NO: 102162 - DNA, 22 bp, Homo sapiens
tttctcatggaacatcgtttag

SEQ ID NO: 102163 - DNA, 22 bp, Homo sapiens
gcggctgccgagacaagccggt

SEQ ID NO: 102164 - DNA, 22 bp, Homo sapiens
tggtacacatgtccaaggtcag

SEQ ID NO: 102165 - DNA, 22 bp, Homo sapiens
gctgtatgtttatttgggaatt

SEQ ID NO: 102166 - DNA, 22 bp, Homo sapiens
agaaagtgcttccctttggtga

SEQ ID NO: 102167 - DNA, 22 bp, Homo sapiens
ggaggcggaggttgcagtgagt

SEQ ID NO: 102168 - DNA, 22 bp, Homo sapiens
ggaggtggaggttgcagtgagc

SEQ ID NO: 102169 - DNA, 22 bp, Homo sapiens
aaggatgattggtaatgacact

SEQ ID NO: 102170 - DNA, 22 bp, Homo sapiens
ctgaggcaggcagatcacttga

SEQ ID NO: 102171 - DNA, 22 bp, Homo sapiens
gggaaggaaagttattagcaga

SEQ ID NO: 102172 - DNA, 22 bp, Homo sapiens
gtggccaacctggccctgaact

SEQ ID NO: 102173 - DNA, 17 bp, Homo sapiens
aggtgggtggatcacct

SEQ ID NO: 102174 - DNA, 22 bp, Homo sapiens
tttaggttttttcacgtggcta

SEQ ID NO: 102175 - DNA, 23 bp, Homo sapiens
ttttgcaataagtcactggaata

SEQ ID NO: 102176 - DNA, 22 bp, Homo sapiens
cgtcctctagagggaagcactt

SEQ ID NO: 102177 - DNA, 22 bp, Homo sapiens
gcccatgaggtggaggctgcag

SEQ ID NO: 102178 - DNA, 22 bp, Homo sapiens
cagccagtgtgaccgaggagga

SEQ ID NO: 102179 - DNA, 22 bp, Homo sapiens
ttgtgaatggtgccgcaataaa

SEQ ID NO: 102180 - DNA, 22 bp, Homo sapiens
ttggccatctaagcccagccac

SEQ ID NO: 102181 - DNA, 22 bp, Homo sapiens
atttcctgtaggggcttgcgaa

SEQ ID NO: 102182 - DNA, 22 bp, Homo sapiens
gctcaagacccctctgtgactg

SEQ ID NO: 102183 - DNA, 18 bp, Homo sapiens
ccctgccagctcccagca

SEQ ID NO: 102184 - DNA, 22 bp, Homo sapiens
actttcttggtcccatgtttga

SEQ ID NO: 102185 - DNA, 22 bp, Homo sapiens
agagcacagggttttgtgccgg

SEQ ID NO: 102186 - DNA, 22 bp, Homo sapiens
gtggccaaatcatgtcaaaggc

SEQ ID NO: 102187 - DNA, 22 bp, Homo sapiens
acggggctagagaaggtttctt

SEQ ID NO: 102188 - DNA, 22 bp, Homo sapiens
cactgcactccatcctgggaaa

SEQ ID NO: 102189 - DNA, 23 bp, Homo sapiens
ggcctcagtgatgatgggttaaa

SEQ ID NO: 102190 - DNA, 22 bp, Homo sapiens
tggggagaaatgtctttgttcc

SEQ ID NO: 102191 - DNA, 22 bp, Homo sapiens
aggagggagcttaagccaggca

SEQ ID NO: 102192 - DNA, 22 bp, Homo sapiens
tgccgctccaggtctcgcggtg

SEQ ID NO: 102193 - DNA, 22 bp, Homo sapiens
ttattccccatcttcctctggt

SEQ ID NO: 102194 - DNA, 22 bp, Homo sapiens
tcccagaaacgcatatgttcat

SEQ ID NO: 102195 - DNA, 22 bp, Homo sapiens
ctcaggacggccgggggagcct

SEQ ID NO: 102196 - DNA, 22 bp, Homo sapiens
ttcattttctttcacgctgctg

SEQ ID NO: 102197 - DNA, 22 bp, Homo sapiens
agtgctgggctatctactgcta

SEQ ID NO: 102198 - DNA, 20 bp, Homo sapiens
cagagccagggttttgtttt

SEQ ID NO: 102199 - DNA, 22 bp, Homo sapiens
cctagatgggatggcggccggg

SEQ ID NO: 102200 - DNA, 22 bp, Homo sapiens
ggctttgggggtgtccaagaaa

SEQ ID NO: 102201 - DNA, 22 bp, Homo sapiens
tctgatctgtcagtcatgaagg

SEQ ID NO: 102202 - DNA, 22 bp, Homo sapiens
cttctcttcctttgtcaactga

SEQ ID NO: 102203 - DNA, 22 bp, Homo sapiens
agccaagagttctttagcggtg

SEQ ID NO: 102204 - DNA, 22 bp, Homo sapiens
ggcggctactcctcctggtgag

SEQ ID NO: 102205 - DNA, 22 bp, Homo sapiens
gtggtgtttgagctgccaggga

SEQ ID NO: 102206 - DNA, 22 bp, Homo sapiens
tcctgccgtcctccggggcctc

SEQ ID NO: 102207 - DNA, 22 bp, Homo sapiens
catggcggtcaggatgtaggtg

SEQ ID NO: 102208 - DNA, 22 bp, Homo sapiens
actgggcctgattgggtcggag

SEQ ID NO: 102209 - DNA, 22 bp, Homo sapiens
gatttttatataaagtgagaaa

SEQ ID NO: 102210 - DNA, 22 bp, Homo sapiens
cttttgtgattcctcagttact

SEQ ID NO: 102211 - DNA, 22 bp, Homo sapiens
acagtcttcagaagggattggg

SEQ ID NO: 102212 - DNA, 22 bp, Homo sapiens
agtgtggagcatcgagggcaga

SEQ ID NO: 102213 - DNA, 22 bp, Homo sapiens
aagcagatctgatagggccctg

SEQ ID NO: 102214 - DNA, 22 bp, Homo sapiens
gtgctggggagataggaagaga

SEQ ID NO: 102215 - DNA, 22 bp, Homo sapiens
ttttgacaatgctaatctcaat

SEQ ID NO: 102216 - DNA, 20 bp, Homo sapiens
tcactgtaacatttgggggg

SEQ ID NO: 102217 - DNA, 22 bp, Homo sapiens
agtggagacaggacagtcgata

SEQ ID NO: 102218 - DNA, 22 bp, Homo sapiens
catgatctggtcctactgtggg

SEQ ID NO: 102219 - DNA, 22 bp, Homo sapiens
cgggttcacgccattctcctgc

SEQ ID NO: 102220 - DNA, 22 bp, Homo sapiens
ggttgtagttggaggttgtata

SEQ ID NO: 102221 - DNA, 22 bp, Homo sapiens
cacttgttggtggtgaaatcac

SEQ ID NO: 102222 - DNA, 22 bp, Homo sapiens
acaggggcaagggctcacggcc

SEQ ID NO: 102223 - DNA, 22 bp, Homo sapiens
aagtcattggtagcttgatagg

SEQ ID NO: 102224 - DNA, 22 bp, Homo sapiens
gctgtctgtcttcacatctcgc

SEQ ID NO: 102225 - DNA, 22 bp, Homo sapiens
tcctagttctctgccagtcgct

SEQ ID NO: 102226 - DNA, 22 bp, Homo sapiens
ttttggctctgtctgtatcttt

SEQ ID NO: 102227 - DNA, 23 bp, Homo sapiens
agcagccagagatcctcggccct

SEQ ID NO: 102228 - DNA, 22 bp, Homo sapiens
acccagggctcaagcgtaggca

SEQ ID NO: 102229 - DNA, 22 bp, Homo sapiens
tgagcacatttcacatgacagg

SEQ ID NO: 102230 - DNA, 20 bp, Homo sapiens
aaactaaaggtgtttggttt

SEQ ID NO: 102231 - DNA, 22 bp, Homo sapiens
cgggtcccctcgggaggctgct

SEQ ID NO: 102232 - DNA, 22 bp, Homo sapiens
aggaaataggaccagacaaagc

SEQ ID NO: 102233 - DNA, 22 bp, Homo sapiens
gccggggctggggagagacatg

SEQ ID NO: 102234 - DNA, 22 bp, Homo sapiens
tcgggctcgctctcctagcgga

SEQ ID NO: 102235 - DNA, 22 bp, Homo sapiens
tctgaccctactcagcactttg

SEQ ID NO: 102236 - DNA, 22 bp, Homo sapiens
ccgccgtgcaggccgcgacgtg

SEQ ID NO: 102237 - DNA, 22 bp, Homo sapiens
aaaggacacacaggaggtgtct

SEQ ID NO: 102238 - DNA, 22 bp, Homo sapiens
agataaagtccaaactgtgtag

SEQ ID NO: 102239 - DNA, 22 bp, Homo sapiens
ggtgacctcacctggtcccacc

SEQ ID NO: 102240 - DNA, 22 bp, Homo sapiens
tagagctggccgggacagctgg

SEQ ID NO: 102241 - DNA, 22 bp, Homo sapiens
cacatttttactgccaacttaa

SEQ ID NO: 102242 - DNA, 22 bp, Homo sapiens
gcctcggggacacccgcaccac

SEQ ID NO: 102243 - DNA, 22 bp, Homo sapiens
ggctcttccgccaccagccaca

SEQ ID NO: 102244 - DNA, 22 bp, Homo sapiens
ctcgcgttccagctgcgggccg

SEQ ID NO: 102245 - DNA, 22 bp, Homo sapiens
actgcactccagcctgggtaac

SEQ ID NO: 102246 - DNA, 22 bp, Homo sapiens
actgcactccaacctgggtgac

SEQ ID NO: 102247 - DNA, 22 bp, Homo sapiens
acgtggcggccgccgtgagcgg

SEQ ID NO: 102248 - DNA, 22 bp, Homo sapiens
ttgtgaatagtgccgcaataaa

SEQ ID NO: 102249 - DNA, 22 bp, Homo sapiens
tcatctaagagtcttacattta

SEQ ID NO: 102250 - DNA, 22 bp, Homo sapiens
tcatggggccacagctgccagc

SEQ ID NO: 102251 - DNA, 22 bp, Homo sapiens
ggaggcccagaaggaagcccag

SEQ ID NO: 102252 - DNA, 22 bp, Homo sapiens
gggcggatcacctgaggtcagg

SEQ ID NO: 102253 - DNA, 22 bp, Homo sapiens
gagcaggaaggccagaagggtc

SEQ ID NO: 102254 - DNA, 22 bp, Homo sapiens
gaggcacagagtaggtgcacac

SEQ ID NO: 102255 - DNA, 22 bp, Homo sapiens
ggaagaaaggtggacaacaggt

SEQ ID NO: 102256 - DNA, 22 bp, Homo sapiens
ctcctggaggatagtgactggg

SEQ ID NO: 102257 - DNA, 22 bp, Homo sapiens
ctgcgtgcatgtctgcgtgcat

SEQ ID NO: 102258 - DNA, 22 bp, Homo sapiens
gaagcttgaacagggccaggct

SEQ ID NO: 102259 - DNA, 22 bp, Homo sapiens
acctcctccaaggagccatagg

SEQ ID NO: 102260 - DNA, 22 bp, Homo sapiens
gggtaggccgtgggtcaccagg

SEQ ID NO: 102261 - DNA, 22 bp, Homo sapiens
atgccactgcacttcagcttgg

SEQ ID NO: 102262 - DNA, 22 bp, Homo sapiens
cagggccagggacacgctgtca

SEQ ID NO: 102263 - DNA, 22 bp, Homo sapiens
tcaggcagtagaattgcttgaa

SEQ ID NO: 102264 - DNA, 22 bp, Homo sapiens
gagtcggaggcaggagacctgg

SEQ ID NO: 102265 - DNA, 22 bp, Homo sapiens
gatcatgcttaaagttggagtc

SEQ ID NO: 102266 - DNA, 22 bp, Homo sapiens
gtgtgcacagagctccagtgtt

SEQ ID NO: 102267 - DNA, 22 bp, Homo sapiens
tctgaatcgttcccatgcagga

SEQ ID NO: 102268 - DNA, 22 bp, Homo sapiens
gctccctggtagccatgctctc

SEQ ID NO: 102269 - DNA, 22 bp, Homo sapiens
tgcctctgaggaagattgtgtt

SEQ ID NO: 102270 - DNA, 22 bp, Homo sapiens
tgcccaggctggagtgcagtgg

SEQ ID NO: 102271 - DNA, 22 bp, Homo sapiens
accttgatggggctgttggagt

SEQ ID NO: 102272 - DNA, 22 bp, Homo sapiens
gggagcaagccggaggtactgt

SEQ ID NO: 102273 - DNA, 19 bp, Homo sapiens
ggagtttccaatgggtaaa

SEQ ID NO: 102274 - DNA, 22 bp, Homo sapiens
gatggtgcaggtgaagtgctgg

SEQ ID NO: 102275 - DNA, 22 bp, Homo sapiens
ttccagctaactcacatccctt

SEQ ID NO: 102276 - DNA, 22 bp, Homo sapiens
gtcttgggacccgcactgtggg

SEQ ID NO: 102277 - DNA, 22 bp, Homo sapiens
cagacgttggaggaaatatacc

SEQ ID NO: 102278 - DNA, 22 bp, Homo sapiens
cctgaggatgccagcatgggtg

SEQ ID NO: 102279 - DNA, 22 bp, Homo sapiens
tggggagtgatgcctcggataa

SEQ ID NO: 102280 - DNA, 19 bp, Homo sapiens
aggaatggaattaattctg

SEQ ID NO: 102281 - DNA, 22 bp, Homo sapiens
agagcactttcgagagccggag

SEQ ID NO: 102282 - DNA, 23 bp, Homo sapiens
gacagagtgagaccttgtcttac

SEQ ID NO: 102283 - DNA, 21 bp, Homo sapiens
agaaggcaaaagcagacatct

SEQ ID NO: 102284 - DNA, 22 bp, Homo sapiens
aggagcagaccgtagtcctgca

SEQ ID NO: 102285 - DNA, 22 bp, Homo sapiens
aacctgggcttgaacagtgcct

SEQ ID NO: 102286 - DNA, 22 bp, Homo sapiens
ggtgacgaatccatagcatcga

SEQ ID NO: 102287 - DNA, 22 bp, Homo sapiens
ccgggcctcgggacaccgggta

SEQ ID NO: 102288 - DNA, 22 bp, Homo sapiens
gtcccgcattgggcattcctgg

SEQ ID NO: 102289 - DNA, 22 bp, Homo sapiens
caatagtgtctgcttgtttcta

SEQ ID NO: 102290 - DNA, 22 bp, Homo sapiens
ctgaggaaggctgggggcatcc

SEQ ID NO: 102291 - DNA, 22 bp, Homo sapiens
cactgcactccagcctgggaga

SEQ ID NO: 102292 - DNA, 22 bp, Homo sapiens
gagatgggcgagaaggtggact

SEQ ID NO: 102293 - DNA, 22 bp, Homo sapiens
actcggggtggagagagcggtg

SEQ ID NO: 102294 - DNA, 19 bp, Homo sapiens
tctgaagaattagagagca

SEQ ID NO: 102295 - DNA, 22 bp, Homo sapiens
aacactgctgctgggttctgtg

SEQ ID NO: 102296 - DNA, 22 bp, Homo sapiens
gctctctgcagcctccttggag

SEQ ID NO: 102297 - DNA, 22 bp, Homo sapiens
tggccttggccgtgctggggtc

SEQ ID NO: 102298 - DNA, 22 bp, Homo sapiens
tgaatgtatggtcctgtgaatt

SEQ ID NO: 102299 - DNA, 22 bp, Homo sapiens
gcagactgtatcaatgtcagta

SEQ ID NO: 102300 - DNA, 22 bp, Homo sapiens
acccggagtcggaggttgcagt

SEQ ID NO: 102301 - DNA, 22 bp, Homo sapiens
cattctcagtatcagccagccc

SEQ ID NO: 102302 - DNA, 22 bp, Homo sapiens
gcgaggaggggtgctgggcccc

SEQ ID NO: 102303 - DNA, 20 bp, Homo sapiens
acgtggccaccagtggctta

SEQ ID NO: 102304 - DNA, 22 bp, Homo sapiens
ccagaggagttgaggctttggg

SEQ ID NO: 102305 - DNA, 22 bp, Homo sapiens
cccatgcaccctctaagaagga

SEQ ID NO: 102306 - DNA, 22 bp, Homo sapiens
ccggctactcgggaggctgacg

SEQ ID NO: 102307 - DNA, 22 bp, Homo sapiens
agggaagaggaccagagtctct

SEQ ID NO: 102308 - DNA, 22 bp, Homo sapiens
tttggtattgcacactgtcttc

SEQ ID NO: 102309 - DNA, 22 bp, Homo sapiens
atttagtagagaaattaagaaa

SEQ ID NO: 102310 - DNA, 22 bp, Homo sapiens
tagatgaccttgtgttaggcaa

SEQ ID NO: 102311 - DNA, 22 bp, Homo sapiens
tgaggcaggagaatcaccggaa

SEQ ID NO: 102312 - DNA, 22 bp, Homo sapiens
ctgggggcagcaagaagccatg

SEQ ID NO: 102313 - DNA, 22 bp, Homo sapiens
gtgttaaccagctaaactttgc

SEQ ID NO: 102314 - DNA, 22 bp, Homo sapiens
gggaaatctcgtcctctattta

SEQ ID NO: 102315 - DNA, 22 bp, Homo sapiens
tcactttaagcgggaggcagag

SEQ ID NO: 102316 - DNA, 22 bp, Homo sapiens
aggtgtctggacttgtgaagca

SEQ ID NO: 102317 - DNA, 22 bp, Homo sapiens
ttatttgtggcatatgagacga

SEQ ID NO: 102318 - DNA, 22 bp, Homo sapiens
cgtgatttctggctttctatat

SEQ ID NO: 102319 - DNA, 22 bp, Homo sapiens
gtgggtgtgggcttagcccaga

SEQ ID NO: 102320 - DNA, 22 bp, Homo sapiens
cgcaccactgaattccagcctg

SEQ ID NO: 102321 - DNA, 22 bp, Homo sapiens
gcagtggggcaatcatagctca

SEQ ID NO: 102322 - DNA, 22 bp, Homo sapiens
gggtccctggaattacttgaca

SEQ ID NO: 102323 - DNA, 22 bp, Homo sapiens
ttgtgagtagtgccgcaataaa

SEQ ID NO: 102324 - DNA, 22 bp, Homo sapiens
agttgcagacgcagagatgttg

SEQ ID NO: 102325 - DNA, 22 bp, Homo sapiens
gactggtaaggaaattcactaa

SEQ ID NO: 102326 - DNA, 22 bp, Homo sapiens
gctttggacaataactgctttt

SEQ ID NO: 102327 - DNA, 22 bp, Homo sapiens
ataatacatggttgatcttttc

SEQ ID NO: 102328 - DNA, 22 bp, Homo sapiens
gacaggaggcagagctcaggtg

SEQ ID NO: 102329 - DNA, 22 bp, Homo sapiens
ttcctggtctatttagaattgc

SEQ ID NO: 102330 - DNA, 22 bp, Homo sapiens
gcaggtggatcaccacgtcagg

SEQ ID NO: 102331 - DNA, 22 bp, Homo sapiens
gggcggatcatttgaggtcagg

SEQ ID NO: 102332 - DNA, 22 bp, Homo sapiens
cccaaaggttgaggctgcagtg

SEQ ID NO: 102333 - DNA, 22 bp, Homo sapiens
actgtacctcaaactctggaac

SEQ ID NO: 102334 - DNA, 22 bp, Homo sapiens
ccaggcaggcgatggtgcagtg

SEQ ID NO: 102335 - DNA, 22 bp, Homo sapiens
ctggtgtggactccgcgcggag

SEQ ID NO: 102336 - DNA, 22 bp, Homo sapiens
ggcaaggggtcaggctgagaca

SEQ ID NO: 102337 - DNA, 22 bp, Homo sapiens
acatcccatgcgcatctggcaa

SEQ ID NO: 102338 - DNA, 19 bp, Homo sapiens
gagtattttccaacttggt

SEQ ID NO: 102339 - DNA, 22 bp, Homo sapiens
agaaaatgtgaacttgtgaatt

SEQ ID NO: 102340 - DNA, 22 bp, Homo sapiens
aagtagttaggaacattctctc

SEQ ID NO: 102341 - DNA, 22 bp, Homo sapiens
ttccgaacccggatctgctgct

SEQ ID NO: 102342 - DNA, 22 bp, Homo sapiens
ctctttggatagaattacaaag

SEQ ID NO: 102343 - DNA, 22 bp, Homo sapiens
tgtggttttggttcagaaacaa

SEQ ID NO: 102344 - DNA, 22 bp, Homo sapiens
ctccatgtctgtaacacatgac

SEQ ID NO: 102345 - DNA, 21 bp, Homo sapiens
gggcagaggggcctcctgggt

SEQ ID NO: 102346 - DNA, 22 bp, Homo sapiens
agggagcaaaggtttcagggtt

SEQ ID NO: 102347 - DNA, 22 bp, Homo sapiens
gaccagtcattactcatgccct

SEQ ID NO: 102348 - DNA, 22 bp, Homo sapiens
atgtatatgcatgcattcaaag

SEQ ID NO: 102349 - DNA, 22 bp, Homo sapiens
gttatataagacaaatcagagt

SEQ ID NO: 102350 - DNA, 22 bp, Homo sapiens
gtggctcacgtctgtcatctca

SEQ ID NO: 102351 - DNA, 22 bp, Homo sapiens
attgataaattgcaatggggct

SEQ ID NO: 102352 - DNA, 22 bp, Homo sapiens
catttctgggagacatgctaga

SEQ ID NO: 102353 - DNA, 22 bp, Homo sapiens
aaggcggggggatcacgaggtc

SEQ ID NO: 102354 - DNA, 22 bp, Homo sapiens
tttatagtagcatgatttatag

SEQ ID NO: 102355 - DNA, 22 bp, Homo sapiens
aaaggcttcggatcagaaggta

SEQ ID NO: 102356 - DNA, 22 bp, Homo sapiens
acagttaattgttgttgggtgt

SEQ ID NO: 102357 - DNA, 22 bp, Homo sapiens
tcagaattgtggagaaagggga

SEQ ID NO: 102358 - DNA, 22 bp, Homo sapiens
tggagaattctatgttgagggg

SEQ ID NO: 102359 - DNA, 22 bp, Homo sapiens
caggagtgttgattgctcagga

SEQ ID NO: 102360 - DNA, 22 bp, Homo sapiens
taaagattgctcaaaactgtga

SEQ ID NO: 102361 - DNA, 21 bp, Homo sapiens
tgttttccaccttgaggcaag

SEQ ID NO: 102362 - DNA, 22 bp, Homo sapiens
tgctggtaccgcgcctccgcca

SEQ ID NO: 102363 - DNA, 22 bp, Homo sapiens
aaggccttgccgaaggatgcca

SEQ ID NO: 102364 - DNA, 22 bp, Homo sapiens
tggctcctcacgtcctcagagc

SEQ ID NO: 102365 - DNA, 22 bp, Homo sapiens
ggaccggtggcttcctcgggtc

SEQ ID NO: 102366 - DNA, 22 bp, Homo sapiens
atcatgacatacttttgagaag

SEQ ID NO: 102367 - DNA, 22 bp, Homo sapiens
gatctgtgtgattggatgcatt

SEQ ID NO: 102368 - DNA, 19 bp, Homo sapiens
ttctggtctggaatcaagg

SEQ ID NO: 102369 - DNA, 22 bp, Homo sapiens
tcgagctctggagccaaggatg

SEQ ID NO: 102370 - DNA, 22 bp, Homo sapiens
gtggggtctgtcctcttctggg

SEQ ID NO: 102371 - DNA, 22 bp, Homo sapiens
cacagcggcctccgatgctgat

SEQ ID NO: 102372 - DNA, 22 bp, Homo sapiens
agaatagaattctcatagaatt

SEQ ID NO: 102373 - DNA, 22 bp, Homo sapiens
ctggtttgtcttgggaggatgt

SEQ ID NO: 102374 - DNA, 22 bp, Homo sapiens
ttgccttcctgcccagcttctg

SEQ ID NO: 102375 - DNA, 22 bp, Homo sapiens
tctgagccagggtctcctccct

SEQ ID NO: 102376 - DNA, 20 bp, Homo sapiens
ggcagagggcctgggagaag

SEQ ID NO: 102377 - DNA, 20 bp, Homo sapiens
aaattactgccacacatttc

SEQ ID NO: 102378 - DNA, 22 bp, Homo sapiens
cacagcctcctctggctcacgg

SEQ ID NO: 102379 - DNA, 22 bp, Homo sapiens
agaggacagagtgctggattta

SEQ ID NO: 102380 - DNA, 22 bp, Homo sapiens
gggaggcagtgctggaggctgg

SEQ ID NO: 102381 - DNA, 22 bp, Homo sapiens
gcttccgcgatgtcctaggtgg

SEQ ID NO: 102382 - DNA, 22 bp, Homo sapiens
tccagggagagccgctgctcca

SEQ ID NO: 102383 - DNA, 22 bp, Homo sapiens
ccttctagcaaatcaacataaa

SEQ ID NO: 102384 - DNA, 22 bp, Homo sapiens
taatactgtatactgcaaattt

SEQ ID NO: 102385 - DNA, 22 bp, Homo sapiens
tcctcggctgggccccaggctt

SEQ ID NO: 102386 - DNA, 22 bp, Homo sapiens
gcaacaatggaggtttggaggg

SEQ ID NO: 102387 - DNA, 22 bp, Homo sapiens
tggcagtggcgggactcagggc

SEQ ID NO: 102388 - DNA, 22 bp, Homo sapiens
agaggccgggtgcctgctcaga

SEQ ID NO: 102389 - DNA, 22 bp, Homo sapiens
acattacctggcatttgatctt

SEQ ID NO: 102390 - DNA, 22 bp, Homo sapiens
agtcttcccagaggaggtgcca

SEQ ID NO: 102391 - DNA, 22 bp, Homo sapiens
aaggtttcgggagcgggtctgg

SEQ ID NO: 102392 - DNA, 22 bp, Homo sapiens
tagatagattctcctatagagt

SEQ ID NO: 102393 - DNA, 22 bp, Homo sapiens
gagtccaagctagagccactca

SEQ ID NO: 102394 - DNA, 22 bp, Homo sapiens
tctgaaaactccatgagctcgt

SEQ ID NO: 102395 - DNA, 20 bp, Homo sapiens
gctgaggggtctatggcata

SEQ ID NO: 102396 - DNA, 22 bp, Homo sapiens
gacggagctggttgctgcggct

SEQ ID NO: 102397 - DNA, 22 bp, Homo sapiens
aattgaaaatattgtagaccat

SEQ ID NO: 102398 - DNA, 22 bp, Homo sapiens
gtataggtgagggacttgatca

SEQ ID NO: 102399 - DNA, 22 bp, Homo sapiens
tgtagtagcattcacgaagtgt

SEQ ID NO: 102400 - DNA, 22 bp, Homo sapiens
gtggatggagctggaagccatt

SEQ ID NO: 102401 - DNA, 22 bp, Homo sapiens
ctgaaatgacggtttggggcaa

SEQ ID NO: 102402 - DNA, 22 bp, Homo sapiens
tgagcaggcgcagcaggaggtc

SEQ ID NO: 102403 - DNA, 22 bp, Homo sapiens
cagagctgtccaaaccctgaca

SEQ ID NO: 102404 - DNA, 22 bp, Homo sapiens
caagtagaacagagctaccttg

SEQ ID NO: 102405 - DNA, 18 bp, Homo sapiens
gcagtgaagaaagagctt

SEQ ID NO: 102406 - DNA, 22 bp, Homo sapiens
aacactatctgccttacaggga

SEQ ID NO: 102407 - DNA, 22 bp, Homo sapiens
ttgctttgtttaaaagtggtat

SEQ ID NO: 102408 - DNA, 22 bp, Homo sapiens
ggtgttgcagttgaagactggt

SEQ ID NO: 102409 - DNA, 22 bp, Homo sapiens
ggatgttctggggttctcttgt

SEQ ID NO: 102410 - DNA, 22 bp, Homo sapiens
ctgaggcaggatggcctggctg

SEQ ID NO: 102411 - DNA, 22 bp, Homo sapiens
gctgatagactgaatgttggga

SEQ ID NO: 102412 - DNA, 22 bp, Homo sapiens
tcttgggcaatttctctagagg

SEQ ID NO: 102413 - DNA, 22 bp, Homo sapiens
taattgtaaagtagtagtacag

SEQ ID NO: 102414 - DNA, 22 bp, Homo sapiens
gaccttgtgatccacccgcctt

SEQ ID NO: 102415 - DNA, 22 bp, Homo sapiens
tcaggaggcggaggttgcagtg

SEQ ID NO: 102416 - DNA, 22 bp, Homo sapiens
tgatatgggaaaagggctcgga

SEQ ID NO: 102417 - DNA, 22 bp, Homo sapiens
atggccgcctgtccttcccgcc

SEQ ID NO: 102418 - DNA, 19 bp, Homo sapiens
ggggcctgtgatggtcaca

SEQ ID NO: 102419 - DNA, 22 bp, Homo sapiens
gtggggacgggatggctcactg

SEQ ID NO: 102420 - DNA, 21 bp, Homo sapiens
ggccccgcagacccagcacgt

SEQ ID NO: 102421 - DNA, 22 bp, Homo sapiens
agaatccctggggagctgcagc

SEQ ID NO: 102422 - DNA, 22 bp, Homo sapiens
agggaacatttgcactgttggt

SEQ ID NO: 102423 - DNA, 22 bp, Homo sapiens
aaggagtctgggccattcagag

SEQ ID NO: 102424 - DNA, 22 bp, Homo sapiens
tgtacaatgctgaggtttgggg

SEQ ID NO: 102425 - DNA, 22 bp, Homo sapiens
ggtgacagtggttaaaatttgt

SEQ ID NO: 102426 - DNA, 22 bp, Homo sapiens
gaggctgaggttgcagtgagct

SEQ ID NO: 102427 - DNA, 22 bp, Homo sapiens
aggtgggcggattcatgaggtc

SEQ ID NO: 102428 - DNA, 22 bp, Homo sapiens
gctcttgtcaaaaattagttga

SEQ ID NO: 102429 - DNA, 21 bp, Homo sapiens
ggtgacacgtggccccgctct

SEQ ID NO: 102430 - DNA, 22 bp, Homo sapiens
caattgacaatgacagtgtcaa

SEQ ID NO: 102431 - DNA, 22 bp, Homo sapiens
ttttctgtttgcttcaagacat

SEQ ID NO: 102432 - DNA, 22 bp, Homo sapiens
cagctggcgactctcctcgatg

SEQ ID NO: 102433 - DNA, 23 bp, Homo sapiens
tgcaatggcatgatttcagctca

SEQ ID NO: 102434 - DNA, 22 bp, Homo sapiens
tgaagctttaggatgggttcat

SEQ ID NO: 102435 - DNA, 22 bp, Homo sapiens
ctgaggaggctaatttgaggat

SEQ ID NO: 102436 - DNA, 22 bp, Homo sapiens
ttccacggggctccccgctctt

SEQ ID NO: 102437 - DNA, 22 bp, Homo sapiens
aacgcccagccttgatcaaatg

SEQ ID NO: 102438 - DNA, 22 bp, Homo sapiens
cccaggaggttgaggctgcagt

SEQ ID NO: 102439 - DNA, 22 bp, Homo sapiens
tgaggcaggacttgcataaagt

SEQ ID NO: 102440 - DNA, 22 bp, Homo sapiens
cttttcattgtttgtacatgca

SEQ ID NO: 102441 - DNA, 22 bp, Homo sapiens
ctagggtcaggggcctgcgtcg

SEQ ID NO: 102442 - DNA, 22 bp, Homo sapiens
ctgtaatcccagctactcggga

SEQ ID NO: 102443 - DNA, 22 bp, Homo sapiens
gaccaagatacagcatcataga

SEQ ID NO: 102444 - DNA, 22 bp, Homo sapiens
gctgctaagcgtttctgttcca

SEQ ID NO: 102445 - DNA, 22 bp, Homo sapiens
caggaggattgcttgaggccag

SEQ ID NO: 102446 - DNA, 23 bp, Homo sapiens
cgcccagcctcagtgacctgggc

SEQ ID NO: 102447 - DNA, 23 bp, Homo sapiens
atgacactcctgtgcgcaccctg

SEQ ID NO: 102448 - DNA, 22 bp, Homo sapiens
ctgctcctgtccagcagggcca

SEQ ID NO: 102449 - DNA, 22 bp, Homo sapiens
ttccctccatttcattttataa

SEQ ID NO: 102450 - DNA, 22 bp, Homo sapiens
ttcctagggcagagccgctggg

SEQ ID NO: 102451 - DNA, 23 bp, Homo sapiens
ggagtgcaatggcgccatctcgg

SEQ ID NO: 102452 - DNA, 20 bp, Homo sapiens
tgtttgtgtggggccttggc

SEQ ID NO: 102453 - DNA, 22 bp, Homo sapiens
tctcacatgcaaacagtccaca

SEQ ID NO: 102454 - DNA, 22 bp, Homo sapiens
gcggcggcggtcattgagcatg

SEQ ID NO: 102455 - DNA, 22 bp, Homo sapiens
atgctatgtaactggcagatag

SEQ ID NO: 102456 - DNA, 22 bp, Homo sapiens
cattgctttgtgcatatttaaa

SEQ ID NO: 102457 - DNA, 22 bp, Homo sapiens
gttgcctaggctggtcttgaac

SEQ ID NO: 102458 - DNA, 22 bp, Homo sapiens
tgataaacttagaaagaatgtt

SEQ ID NO: 102459 - DNA, 20 bp, Homo sapiens
tcagccattccttacctttc

SEQ ID NO: 102460 - DNA, 22 bp, Homo sapiens
ggccgctctccggtgtggatct

SEQ ID NO: 102461 - DNA, 21 bp, Homo sapiens
tcctgtaagcttgggtggctc

SEQ ID NO: 102462 - DNA, 22 bp, Homo sapiens
actggggactctggccttttga

SEQ ID NO: 102463 - DNA, 22 bp, Homo sapiens
gaatcccttgcattatcccttt

SEQ ID NO: 102464 - DNA, 22 bp, Homo sapiens
aggtattattagcatctctatt

SEQ ID NO: 102465 - DNA, 19 bp, Homo sapiens
gctgttaaggaccctcgga

SEQ ID NO: 102466 - DNA, 22 bp, Homo sapiens
acccattgctagagagagtgtg

SEQ ID NO: 102467 - DNA, 22 bp, Homo sapiens
gaggtggctgcttgctgggaaa

SEQ ID NO: 102468 - DNA, 21 bp, Homo sapiens
caaaagagactgattcttgga

SEQ ID NO: 102469 - DNA, 22 bp, Homo sapiens
gtctctatcatagctgaaccct

SEQ ID NO: 102470 - DNA, 22 bp, Homo sapiens
tgtaagtagtaatggaaggaca

SEQ ID NO: 102471 - DNA, 22 bp, Homo sapiens
aacccgggaggcggaggttgtg

SEQ ID NO: 102472 - DNA, 22 bp, Homo sapiens
taatgtaaacacagagacagaa

SEQ ID NO: 102473 - DNA, 22 bp, Homo sapiens
gttattgaggtggagtctcact

SEQ ID NO: 102474 - DNA, 22 bp, Homo sapiens
agttcaacaccagcctgaccaa

SEQ ID NO: 102475 - DNA, 22 bp, Homo sapiens
agatgaatccacacatggcaaa

SEQ ID NO: 102476 - DNA, 22 bp, Homo sapiens
gggcggggtggctcatgcctgt

SEQ ID NO: 102477 - DNA, 22 bp, Homo sapiens
ctccagtgcttctagaaaatac

SEQ ID NO: 102478 - DNA, 22 bp, Homo sapiens
aggggatgcctagtggagtctc

SEQ ID NO: 102479 - DNA, 22 bp, Homo sapiens
gagggtggtggcttaaggtgct

SEQ ID NO: 102480 - DNA, 22 bp, Homo sapiens
tagcataacaggtaagagtgag

SEQ ID NO: 102481 - DNA, 22 bp, Homo sapiens
agagaggtctcaggagaaacca

SEQ ID NO: 102482 - DNA, 22 bp, Homo sapiens
actcttgattgatttagtcttt

SEQ ID NO: 102483 - DNA, 22 bp, Homo sapiens
gcttcggggtccaagcgcgtgt

SEQ ID NO: 102484 - DNA, 22 bp, Homo sapiens
cttgggaggcagaggttgcagt

SEQ ID NO: 102485 - DNA, 22 bp, Homo sapiens
ccttacctgattgctggcatcc

SEQ ID NO: 102486 - DNA, 22 bp, Homo sapiens
ccaaggccttgaaggcgcgggg

SEQ ID NO: 102487 - DNA, 22 bp, Homo sapiens
gctgggctgcgtcggggaagcc

SEQ ID NO: 102488 - DNA, 22 bp, Homo sapiens
tctcctggtacccttcctagca

SEQ ID NO: 102489 - DNA, 22 bp, Homo sapiens
atcacaaaggtctcagagcaca

SEQ ID NO: 102490 - DNA, 22 bp, Homo sapiens
gcttctgagttcttgcttaata

SEQ ID NO: 102491 - DNA, 22 bp, Homo sapiens
taagggttcagaatgcagtggt

SEQ ID NO: 102492 - DNA, 23 bp, Homo sapiens
agctctgctcgggcatgccctgc

SEQ ID NO: 102493 - DNA, 22 bp, Homo sapiens
acattaaacttgcttggctgta

SEQ ID NO: 102494 - DNA, 22 bp, Homo sapiens
ctcagtgaattggaggatggcc

SEQ ID NO: 102495 - DNA, 22 bp, Homo sapiens
cccagggagagcgcggaggcgg

SEQ ID NO: 102496 - DNA, 22 bp, Homo sapiens
aaactgtcctcccgaggtttcc

SEQ ID NO: 102497 - DNA, 22 bp, Homo sapiens
gcccccgtagtagatgaggcgc

SEQ ID NO: 102498 - DNA, 22 bp, Homo sapiens
aaagcctcccaggttatgagta

SEQ ID NO: 102499 - DNA, 22 bp, Homo sapiens
agacggctggcagtgagcggct

SEQ ID NO: 102500 - DNA, 22 bp, Homo sapiens
tgaagtcagggattccatgaag

SEQ ID NO: 102501 - DNA, 22 bp, Homo sapiens
tctcgctctgtcgcccaggctg

SEQ ID NO: 102502 - DNA, 18 bp, Homo sapiens
tcatgagaatagcagggg

SEQ ID NO: 102503 - DNA, 22 bp, Homo sapiens
caattgtcagtgctgtttaaat

SEQ ID NO: 102504 - DNA, 22 bp, Homo sapiens
gaccttgtgctccgaggcgggc

SEQ ID NO: 102505 - DNA, 22 bp, Homo sapiens
ttcaaatgatggcagtcctggc

SEQ ID NO: 102506 - DNA, 22 bp, Homo sapiens
gggggtttctgggctgagcaga

SEQ ID NO: 102507 - DNA, 22 bp, Homo sapiens
ttaagtaacttgtccaaatgag

SEQ ID NO: 102508 - DNA, 22 bp, Homo sapiens
ttctgattgctgatgaggccca

SEQ ID NO: 102509 - DNA, 17 bp, Homo sapiens
catcaaagaaatttcca

SEQ ID NO: 102510 - DNA, 22 bp, Homo sapiens
tttggcatgggctatttgcttt

SEQ ID NO: 102511 - DNA, 22 bp, Homo sapiens
ggctgggcctctccctcagctg

SEQ ID NO: 102512 - DNA, 23 bp, Homo sapiens
ctgtggatctagagggggcccta

SEQ ID NO: 102513 - DNA, 22 bp, Homo sapiens
ctgctcttgagggactgcggtc

SEQ ID NO: 102514 - DNA, 22 bp, Homo sapiens
cacagtggtccccgaagcccct

SEQ ID NO: 102515 - DNA, 21 bp, Homo sapiens
ttgctgttttcccaatgcagt

SEQ ID NO: 102516 - DNA, 22 bp, Homo sapiens
acaggggacctaggaccctcgg

SEQ ID NO: 102517 - DNA, 22 bp, Homo sapiens
gagagagctctgtgcctgggat

SEQ ID NO: 102518 - DNA, 21 bp, Homo sapiens
taaacataaccttgtatggct

SEQ ID NO: 102519 - DNA, 22 bp, Homo sapiens
tttctttatcatagcatctttg

SEQ ID NO: 102520 - DNA, 22 bp, Homo sapiens
caggagctcagatgacatctca

SEQ ID NO: 102521 - DNA, 22 bp, Homo sapiens
tactgcattatcaaggggaagg

SEQ ID NO: 102522 - DNA, 20 bp, Homo sapiens
atcaggtgttcagccactgc

SEQ ID NO: 102523 - DNA, 22 bp, Homo sapiens
cgtgggtcgggactccgcctcg

SEQ ID NO: 102524 - DNA, 22 bp, Homo sapiens
ccttcccacattccttacatgc

SEQ ID NO: 102525 - DNA, 22 bp, Homo sapiens
ttctcctttcattccctgtaga

SEQ ID NO: 102526 - DNA, 22 bp, Homo sapiens
ccctagtccacaggttcctgga

SEQ ID NO: 102527 - DNA, 22 bp, Homo sapiens
gtgagtaaaggttcattgaatt

SEQ ID NO: 102528 - DNA, 22 bp, Homo sapiens
agggaaattaatgtgagcaatg

SEQ ID NO: 102529 - DNA, 22 bp, Homo sapiens
cctgtggcgggggccagtgcct

SEQ ID NO: 102530 - DNA, 22 bp, Homo sapiens
ctgattctcctcaagactttcg

SEQ ID NO: 102531 - DNA, 22 bp, Homo sapiens
gataccagacagggagggagaa

SEQ ID NO: 102532 - DNA, 22 bp, Homo sapiens
atgcacctgaactccatcagct

SEQ ID NO: 102533 - DNA, 22 bp, Homo sapiens
gtctctcaaaactagaagagaa

SEQ ID NO: 102534 - DNA, 22 bp, Homo sapiens
ataatctttcttttccagatag

SEQ ID NO: 102535 - DNA, 22 bp, Homo sapiens
cgggagcctctgggtcacactg

SEQ ID NO: 102536 - DNA, 22 bp, Homo sapiens
actgggaagtcagagagaggct

SEQ ID NO: 102537 - DNA, 22 bp, Homo sapiens
ggtgacggggcccaggtttcct

SEQ ID NO: 102538 - DNA, 22 bp, Homo sapiens
actggggtttaggcctgggcaa

SEQ ID NO: 102539 - DNA, 22 bp, Homo sapiens
tgtaatattgtagtgacagtac

SEQ ID NO: 102540 - DNA, 22 bp, Homo sapiens
tctttctacatcatttgcttct

SEQ ID NO: 102541 - DNA, 22 bp, Homo sapiens
cactgcactccagcactccagc

SEQ ID NO: 102542 - DNA, 22 bp, Homo sapiens
tggttcctcaagcgctggcggc

SEQ ID NO: 102543 - DNA, 22 bp, Homo sapiens
ggcatctggatctgcttctccc

SEQ ID NO: 102544 - DNA, 22 bp, Homo sapiens
gcaccaggtgcagccgggcccc

SEQ ID NO: 102545 - DNA, 22 bp, Homo sapiens
cccaggaagtggaggttgcagt

SEQ ID NO: 102546 - DNA, 22 bp, Homo sapiens
ttgcccactggctgttggtcag

SEQ ID NO: 102547 - DNA, 22 bp, Homo sapiens
ttggagttctgggcacagctgc

SEQ ID NO: 102548 - DNA, 22 bp, Homo sapiens
agacactgttctcacatgcttg

SEQ ID NO: 102549 - DNA, 22 bp, Homo sapiens
gcccgcagagatctttaacaaa

SEQ ID NO: 102550 - DNA, 22 bp, Homo sapiens
aggcgagaggcttgggctagta

SEQ ID NO: 102551 - DNA, 22 bp, Homo sapiens
agtggccagcagcctagcctag

SEQ ID NO: 102552 - DNA, 22 bp, Homo sapiens
actcatgtcctaggagtaaagc

SEQ ID NO: 102553 - DNA, 22 bp, Homo sapiens
ctgctgagagccccagctgaga

SEQ ID NO: 102554 - DNA, 22 bp, Homo sapiens
tgcctagttctgtatttacagt

SEQ ID NO: 102555 - DNA, 22 bp, Homo sapiens
gcatgtgtctttatagcagcat

SEQ ID NO: 102556 - DNA, 22 bp, Homo sapiens
tgcgatgcaacagcttggcgga

SEQ ID NO: 102557 - DNA, 22 bp, Homo sapiens
cccaccagtacagatggtagat

SEQ ID NO: 102558 - DNA, 22 bp, Homo sapiens
aaattcttttgtgcggtgaagt

SEQ ID NO: 102559 - DNA, 22 bp, Homo sapiens
aaagggaagttgcacatgttcc

SEQ ID NO: 102560 - DNA, 22 bp, Homo sapiens
gagctgggcctgcgagtgctgc

SEQ ID NO: 102561 - DNA, 22 bp, Homo sapiens
gtagctctgtttaaagttcttt

SEQ ID NO: 102562 - DNA, 22 bp, Homo sapiens
gggcggggggagctggaatgaa

SEQ ID NO: 102563 - DNA, 22 bp, Homo sapiens
tccaccctgcttttgtctttga

SEQ ID NO: 102564 - DNA, 22 bp, Homo sapiens
acgtgcaggatctggttggcga

SEQ ID NO: 102565 - DNA, 22 bp, Homo sapiens
ctggggtaggaggcagctgtgc

SEQ ID NO: 102566 - DNA, 22 bp, Homo sapiens
tgagatgtaaggtatgcttact

SEQ ID NO: 102567 - DNA, 22 bp, Homo sapiens
gagcccaggaagtggaggctga

SEQ ID NO: 102568 - DNA, 22 bp, Homo sapiens
cctgctcaacgaatatggcgat

SEQ ID NO: 102569 - DNA, 22 bp, Homo sapiens
ggaagggcaaaagagatgaact

SEQ ID NO: 102570 - DNA, 22 bp, Homo sapiens
tgtgactggttgtcccgctttc

SEQ ID NO: 102571 - DNA, 22 bp, Homo sapiens
cctgtaatcccagctactcggg

SEQ ID NO: 102572 - DNA, 22 bp, Homo sapiens
aaaactacatttgacattttgt

SEQ ID NO: 102573 - DNA, 22 bp, Homo sapiens
gggttggatcctggtggctgcc

SEQ ID NO: 102574 - DNA, 22 bp, Homo sapiens
ctgggggtcttgaaagggagag

SEQ ID NO: 102575 - DNA, 22 bp, Homo sapiens
gggaggttctgttcgcacttga

SEQ ID NO: 102576 - DNA, 22 bp, Homo sapiens
acagcagcaatagcagtgacat

SEQ ID NO: 102577 - DNA, 22 bp, Homo sapiens
ggcaatatggtgaaaccccatc

SEQ ID NO: 102578 - DNA, 22 bp, Homo sapiens
ccagaagcagagcctgaggcag

SEQ ID NO: 102579 - DNA, 22 bp, Homo sapiens
tttctcggcagagatgatgggc

SEQ ID NO: 102580 - DNA, 22 bp, Homo sapiens
tctgaggctgaatggactccgt

SEQ ID NO: 102581 - DNA, 22 bp, Homo sapiens
tttgaagactactgggagtgaa

SEQ ID NO: 102582 - DNA, 22 bp, Homo sapiens
ttttatctgtgacatctggcag

SEQ ID NO: 102583 - DNA, 22 bp, Homo sapiens
cccaggctggagtgcagtggcg

SEQ ID NO: 102584 - DNA, 22 bp, Homo sapiens
ttgtgaatagtgccgctataaa

SEQ ID NO: 102585 - DNA, 17 bp, Homo sapiens
tggtagaatgacaggcc

SEQ ID NO: 102586 - DNA, 20 bp, Homo sapiens
tttgagaccagtctgcccaa

SEQ ID NO: 102587 - DNA, 22 bp, Homo sapiens
atgcagaagactgaaaagctga

SEQ ID NO: 102588 - DNA, 22 bp, Homo sapiens
ttcaatatgatattagctgtgg

SEQ ID NO: 102589 - DNA, 23 bp, Homo sapiens
gctcatcaggcttagagtcaagg

SEQ ID NO: 102590 - DNA, 22 bp, Homo sapiens
cccagcagtagagctcatatgg

SEQ ID NO: 102591 - DNA, 22 bp, Homo sapiens
atgggctgtccattgctggctg

SEQ ID NO: 102592 - DNA, 19 bp, Homo sapiens
tgaacgatgtctcagggca

SEQ ID NO: 102593 - DNA, 22 bp, Homo sapiens
ctatgaccccagcatgaataag

SEQ ID NO: 102594 - DNA, 22 bp, Homo sapiens
aacccgtgatcctgactcccct

SEQ ID NO: 102595 - DNA, 22 bp, Homo sapiens
catgctgtgtgttttagctcca

SEQ ID NO: 102596 - DNA, 22 bp, Homo sapiens
tagcaaaggatgactatgtacc

SEQ ID NO: 102597 - DNA, 22 bp, Homo sapiens
caggaggacatactggctcaca

SEQ ID NO: 102598 - DNA, 22 bp, Homo sapiens
cttcccaccaaagcccttgttg

SEQ ID NO: 102599 - DNA, 22 bp, Homo sapiens
ccctgcctacagggttttcttt

SEQ ID NO: 102600 - DNA, 22 bp, Homo sapiens
tcaccgaggctggagtgcagtg

SEQ ID NO: 102601 - DNA, 22 bp, Homo sapiens
tggtccgctcctattcgccgca

SEQ ID NO: 102602 - DNA, 19 bp, Homo sapiens
taccatccaagctggtttg

SEQ ID NO: 102603 - DNA, 22 bp, Homo sapiens
gagggccctggctggctccagc

SEQ ID NO: 102604 - DNA, 22 bp, Homo sapiens
ggggtctgggcttagctggaat

SEQ ID NO: 102605 - DNA, 22 bp, Homo sapiens
caattttcaattccttcagata

SEQ ID NO: 102606 - DNA, 22 bp, Homo sapiens
gccttgtttcattacacgtggt

SEQ ID NO: 102607 - DNA, 22 bp, Homo sapiens
tcagtgcagggtgggagagaga

SEQ ID NO: 102608 - DNA, 22 bp, Homo sapiens
agtactgtcagcagggtgttga

SEQ ID NO: 102609 - DNA, 22 bp, Homo sapiens
gtccctgagcctggcatttccc

SEQ ID NO: 102610 - DNA, 22 bp, Homo sapiens
ggaaggggtgggtgagcctcag

SEQ ID NO: 102611 - DNA, 22 bp, Homo sapiens
tgattttctccattgtaaattc

SEQ ID NO: 102612 - DNA, 22 bp, Homo sapiens
tgacagtgaacaggttaccact

SEQ ID NO: 102613 - DNA, 22 bp, Homo sapiens
atgtgggccgtgcgggtgtcct

SEQ ID NO: 102614 - DNA, 22 bp, Homo sapiens
ttcctttctctggactgcagcc

SEQ ID NO: 102615 - DNA, 22 bp, Homo sapiens
gtactagagatgtgtgcgggta

SEQ ID NO: 102616 - DNA, 23 bp, Homo sapiens
aggatgtaggatgtatggcagag

SEQ ID NO: 102617 - DNA, 22 bp, Homo sapiens
cactaggctggagtgcagtggc

SEQ ID NO: 102618 - DNA, 22 bp, Homo sapiens
tccataaattttatgaacatat

SEQ ID NO: 102619 - DNA, 22 bp, Homo sapiens
tccttcagcctcccagctcaaa

SEQ ID NO: 102620 - DNA, 19 bp, Homo sapiens
tggttgtgcacgggttggt

SEQ ID NO: 102621 - DNA, 22 bp, Homo sapiens
ggagaccagaaggaagcttcga

SEQ ID NO: 102622 - DNA, 22 bp, Homo sapiens
ctggcagatagtaagtgatcaa

SEQ ID NO: 102623 - DNA, 22 bp, Homo sapiens
cttagagatgggttttacttag

SEQ ID NO: 102624 - DNA, 22 bp, Homo sapiens
ttagtttataattcatttctgt

SEQ ID NO: 102625 - DNA, 22 bp, Homo sapiens
ctagttgaagaggctgtcatca

SEQ ID NO: 102626 - DNA, 22 bp, Homo sapiens
tcaggggcttgaggtgcatgtc

SEQ ID NO: 102627 - DNA, 22 bp, Homo sapiens
taggtttcagaggtgccgggaa

SEQ ID NO: 102628 - DNA, 22 bp, Homo sapiens
tggatatccttgttaactttct

SEQ ID NO: 102629 - DNA, 22 bp, Homo sapiens
ggcctctgccccgcggggctcg

SEQ ID NO: 102630 - DNA, 19 bp, Homo sapiens
aggtggctgaaactacaga

SEQ ID NO: 102631 - DNA, 22 bp, Homo sapiens
tgtcctcatcctccagtctgtc

SEQ ID NO: 102632 - DNA, 22 bp, Homo sapiens
tttggtaagtacccacctgggt

SEQ ID NO: 102633 - DNA, 22 bp, Homo sapiens
agtgagcaagttgataatggcc

SEQ ID NO: 102634 - DNA, 22 bp, Homo sapiens
gtgcgccagctcaaggggaggc

SEQ ID NO: 102635 - DNA, 22 bp, Homo sapiens
cgagagttagctaggagtcaca

SEQ ID NO: 102636 - DNA, 22 bp, Homo sapiens
tcacagagaaatgtggcacaaa

SEQ ID NO: 102637 - DNA, 22 bp, Homo sapiens
gggggagagacgagcggctctg

SEQ ID NO: 102638 - DNA, 22 bp, Homo sapiens
gtggcccaggttggagtgcagt

SEQ ID NO: 102639 - DNA, 22 bp, Homo sapiens
atgaccagccgagataaacaga

SEQ ID NO: 102640 - DNA, 22 bp, Homo sapiens
agatgtgagaatcaagtgacca

SEQ ID NO: 102641 - DNA, 22 bp, Homo sapiens
atgcattgtcaggcaatttcat

SEQ ID NO: 102642 - DNA, 22 bp, Homo sapiens
ggtttgttggggtccaggccca

SEQ ID NO: 102643 - DNA, 22 bp, Homo sapiens
gagagaagggggatatgagcct

SEQ ID NO: 102644 - DNA, 23 bp, Homo sapiens
tctgtgtctccacccaaatctca

SEQ ID NO: 102645 - DNA, 22 bp, Homo sapiens
aggattgtgcctccagtcagaa

SEQ ID NO: 102646 - DNA, 22 bp, Homo sapiens
tttggggatgtctgagttgttg

SEQ ID NO: 102647 - DNA, 22 bp, Homo sapiens
ggaactcctgctccaagcagct

SEQ ID NO: 102648 - DNA, 22 bp, Homo sapiens
agtgctgtctccttcccccggg

SEQ ID NO: 102649 - DNA, 22 bp, Homo sapiens
gacaattgcttttgccgaataa

SEQ ID NO: 102650 - DNA, 22 bp, Homo sapiens
gcccagccacagtcactttcat

SEQ ID NO: 102651 - DNA, 22 bp, Homo sapiens
tgccgcagtgcggggagggccc

SEQ ID NO: 102652 - DNA, 22 bp, Homo sapiens
ccacaggggcccacgagccgct

SEQ ID NO: 102653 - DNA, 22 bp, Homo sapiens
gctcccagtctgatggaggaga

SEQ ID NO: 102654 - DNA, 22 bp, Homo sapiens
taaaggtctgaacacagtgagg

SEQ ID NO: 102655 - DNA, 22 bp, Homo sapiens
ccgggagcaggcgccaccgcca

SEQ ID NO: 102656 - DNA, 22 bp, Homo sapiens
ggcaagagggcagatggagtgc

SEQ ID NO: 102657 - DNA, 22 bp, Homo sapiens
gatctcaaagcagtgtgggttg

SEQ ID NO: 102658 - DNA, 22 bp, Homo sapiens
atgccactgcgctctagcctgg

SEQ ID NO: 102659 - DNA, 22 bp, Homo sapiens
tcattgagttgcacttttacta

SEQ ID NO: 102660 - DNA, 22 bp, Homo sapiens
gggagcctgtggatgtctgact

SEQ ID NO: 102661 - DNA, 22 bp, Homo sapiens
tgatgcctaatatacttcaatt

SEQ ID NO: 102662 - DNA, 22 bp, Homo sapiens
gcagcctcaaactccccagctc

SEQ ID NO: 102663 - DNA, 22 bp, Homo sapiens
tccttgtaaaggagctctaaca

SEQ ID NO: 102664 - DNA, 22 bp, Homo sapiens
tttattggatatttacaagata

SEQ ID NO: 102665 - DNA, 22 bp, Homo sapiens
tgtccaggttagcttcaaacac

SEQ ID NO: 102666 - DNA, 22 bp, Homo sapiens
gctcatgactgtaatcccagca

SEQ ID NO: 102667 - DNA, 22 bp, Homo sapiens
tcgtgatctgtccacctcggcc

SEQ ID NO: 102668 - DNA, 19 bp, Homo sapiens
tgttgtctaccatgaagtc

SEQ ID NO: 102669 - DNA, 22 bp, Homo sapiens
actgcgctccagcctgggtgac

SEQ ID NO: 102670 - DNA, 22 bp, Homo sapiens
gccatgcttggtatgctgtgag

SEQ ID NO: 102671 - DNA, 22 bp, Homo sapiens
cctggctctgccacttactgcc

SEQ ID NO: 102672 - DNA, 22 bp, Homo sapiens
atgttggagtcgtaaggcatgg

SEQ ID NO: 102673 - DNA, 22 bp, Homo sapiens
gttcagatttgactggtttctc

SEQ ID NO: 102674 - DNA, 22 bp, Homo sapiens
cctgtctctgcagggccctgcc

SEQ ID NO: 102675 - DNA, 22 bp, Homo sapiens
aacagtgtttttcttcagcact

SEQ ID NO: 102676 - DNA, 22 bp, Homo sapiens
atttggcagtataaattctggc

SEQ ID NO: 102677 - DNA, 21 bp, Homo sapiens
gccatttcacacagacatttg

SEQ ID NO: 102678 - DNA, 22 bp, Homo sapiens
cgggcagtgtggctccagagtc

SEQ ID NO: 102679 - DNA, 22 bp, Homo sapiens
tgatttatgcattatactgttg

SEQ ID NO: 102680 - DNA, 22 bp, Homo sapiens
gacagtgaacaggttcccactg

SEQ ID NO: 102681 - DNA, 19 bp, Homo sapiens
tggctctgtcgaaggcaca

SEQ ID NO: 102682 - DNA, 22 bp, Homo sapiens
gcagggaggtttgctgacctgg

SEQ ID NO: 102683 - DNA, 22 bp, Homo sapiens
agccagggacgctgcaggctac

SEQ ID NO: 102684 - DNA, 22 bp, Homo sapiens
aacttgtgggctcaagcaattt

SEQ ID NO: 102685 - DNA, 23 bp, Homo sapiens
cagtgtgacaaaacttattactt

SEQ ID NO: 102686 - DNA, 22 bp, Homo sapiens
ctggctttgatcagagtgacct

SEQ ID NO: 102687 - DNA, 22 bp, Homo sapiens
cggggccctggggctgaaggtc

SEQ ID NO: 102688 - DNA, 22 bp, Homo sapiens
aagattttcagtgcctaaaaca

SEQ ID NO: 102689 - DNA, 22 bp, Homo sapiens
ctggggaacgcagcgagcagcg

SEQ ID NO: 102690 - DNA, 22 bp, Homo sapiens
ttcatgcttggtgtggggatta

SEQ ID NO: 102691 - DNA, 22 bp, Homo sapiens
ccgggctggagtgcaatggctc

SEQ ID NO: 102692 - DNA, 22 bp, Homo sapiens
tctgctttcttactaaaaatga

SEQ ID NO: 102693 - DNA, 22 bp, Homo sapiens
attggccatttgcatgtattat

SEQ ID NO: 102694 - DNA, 22 bp, Homo sapiens
tggaaatgtttcttgagctcag

SEQ ID NO: 102695 - DNA, 22 bp, Homo sapiens
aaagcactgcacatatatttgc

SEQ ID NO: 102696 - DNA, 22 bp, Homo sapiens
ttgccgccgtctgctcgccccg

SEQ ID NO: 102697 - DNA, 22 bp, Homo sapiens
agcaagatttttcaggttagta

SEQ ID NO: 102698 - DNA, 22 bp, Homo sapiens
tgggtactcctattagttcagt

SEQ ID NO: 102699 - DNA, 22 bp, Homo sapiens
ggaggtggagctggaagttcca

SEQ ID NO: 102700 - DNA, 22 bp, Homo sapiens
ggttcccggatctccgagtccc

SEQ ID NO: 102701 - DNA, 22 bp, Homo sapiens
gaggagggagctggaagctctt

SEQ ID NO: 102702 - DNA, 22 bp, Homo sapiens
ggagcatgcgctctgtgaccga

SEQ ID NO: 102703 - DNA, 22 bp, Homo sapiens
cctcatcgtttccagaatgtgg

SEQ ID NO: 102704 - DNA, 22 bp, Homo sapiens
aatggctctgatgttgttgtga

SEQ ID NO: 102705 - DNA, 22 bp, Homo sapiens
caccaggctggagtgcagtggc

SEQ ID NO: 102706 - DNA, 22 bp, Homo sapiens
ctgctaaacctctctgagagct

SEQ ID NO: 102707 - DNA, 22 bp, Homo sapiens
ttgttgtcattgtagaggattt

SEQ ID NO: 102708 - DNA, 22 bp, Homo sapiens
tgagccaggagtttgaggctgt

SEQ ID NO: 102709 - DNA, 18 bp, Homo sapiens
gaggatggaaggagatgc

SEQ ID NO: 102710 - DNA, 22 bp, Homo sapiens
catgtgaattccaaagctaggt

SEQ ID NO: 102711 - DNA, 22 bp, Homo sapiens
aggggaggtgtccccaaatctc

SEQ ID NO: 102712 - DNA, 16 bp, Homo sapiens
tggggatggggaagag

SEQ ID NO: 102713 - DNA, 22 bp, Homo sapiens
gggcatttcttgtcaatgtagg

SEQ ID NO: 102714 - DNA, 22 bp, Homo sapiens
agtgaggggcagctgagtgggc

SEQ ID NO: 102715 - DNA, 22 bp, Homo sapiens
gggcagatcacctgaggtcagg

SEQ ID NO: 102716 - DNA, 22 bp, Homo sapiens
acagtcaaatgtctatcttctt

SEQ ID NO: 102717 - DNA, 19 bp, Homo sapiens
gggaatgatggaagacttc

SEQ ID NO: 102718 - DNA, 22 bp, Homo sapiens
caaagcaggaagctcctgacag

SEQ ID NO: 102719 - DNA, 22 bp, Homo sapiens
aatgccttggagagcctagagg

SEQ ID NO: 102720 - DNA, 22 bp, Homo sapiens
tgtgacagcacggttcaactgc

SEQ ID NO: 102721 - DNA, 20 bp, Homo sapiens
tctgccacgtctggtgactg

SEQ ID NO: 102722 - DNA, 22 bp, Homo sapiens
agacggattacctgaggtcagg

SEQ ID NO: 102723 - DNA, 22 bp, Homo sapiens
agtaatcaatttttcggtggat

SEQ ID NO: 102724 - DNA, 22 bp, Homo sapiens
cgcccaggctggagtgcagtgg

SEQ ID NO: 102725 - DNA, 22 bp, Homo sapiens
tacaaaggaggtgcatagaaca

SEQ ID NO: 102726 - DNA, 19 bp, Homo sapiens
ttaccgtgaaatggttcag

SEQ ID NO: 102727 - DNA, 22 bp, Homo sapiens
tcgtctgtgaaattgggataag

SEQ ID NO: 102728 - DNA, 16 bp, Homo sapiens
aggtggagaagttcac

SEQ ID NO: 102729 - DNA, 22 bp, Homo sapiens
aggacttagaacattatgtact

SEQ ID NO: 102730 - DNA, 22 bp, Homo sapiens
gttcacagtttctaatcccagc

SEQ ID NO: 102731 - DNA, 22 bp, Homo sapiens
ttcctccagccatgattgtaaa

SEQ ID NO: 102732 - DNA, 17 bp, Homo sapiens
gtaaggcttgcagatgc

SEQ ID NO: 102733 - DNA, 22 bp, Homo sapiens
ggcgcccccttcaaacagagca

SEQ ID NO: 102734 - DNA, 22 bp, Homo sapiens
ctgccttttaaagccagtgtta

SEQ ID NO: 102735 - DNA, 22 bp, Homo sapiens
caggctgatcagggctgggatg

SEQ ID NO: 102736 - DNA, 22 bp, Homo sapiens
cttctcggggttcccgcgccct

SEQ ID NO: 102737 - DNA, 22 bp, Homo sapiens
aacttaggaaaataaggcatga

SEQ ID NO: 102738 - DNA, 22 bp, Homo sapiens
aggacgctctcgctgaacttct

SEQ ID NO: 102739 - DNA, 22 bp, Homo sapiens
gcccctgcctttgaacctggag

SEQ ID NO: 102740 - DNA, 22 bp, Homo sapiens
aggggtgaaagagggccctcaa

SEQ ID NO: 102741 - DNA, 22 bp, Homo sapiens
ttggaggcaatgggaaggaggc

SEQ ID NO: 102742 - DNA, 22 bp, Homo sapiens
tgagatggagccactgcactct

SEQ ID NO: 102743 - DNA, 22 bp, Homo sapiens
agttgggtttgtgtcagttgca

SEQ ID NO: 102744 - DNA, 22 bp, Homo sapiens
agacagggtgatcgcttgagcc

SEQ ID NO: 102745 - DNA, 22 bp, Homo sapiens
agggtggcactggtggctctat

SEQ ID NO: 102746 - DNA, 22 bp, Homo sapiens
tgtctttgttattgtggacagg

SEQ ID NO: 102747 - DNA, 22 bp, Homo sapiens
taattataacatgctttctggc

SEQ ID NO: 102748 - DNA, 22 bp, Homo sapiens
acgggccttctcttcaggcgag

SEQ ID NO: 102749 - DNA, 22 bp, Homo sapiens
atggccaggcacctctggctga

SEQ ID NO: 102750 - DNA, 22 bp, Homo sapiens
gactttgctgtgtcagcttcag

SEQ ID NO: 102751 - DNA, 21 bp, Homo sapiens
tgaaggtgttcatgatgcggt

SEQ ID NO: 102752 - DNA, 22 bp, Homo sapiens
gttgagtgttgtgcatgcacca

SEQ ID NO: 102753 - DNA, 22 bp, Homo sapiens
tattactgtcaatatcacagaa

SEQ ID NO: 102754 - DNA, 23 bp, Homo sapiens
ggagcctccggtgtgtgagaggc

SEQ ID NO: 102755 - DNA, 22 bp, Homo sapiens
gccgggtgcagcgggcccgcca

SEQ ID NO: 102756 - DNA, 22 bp, Homo sapiens
tggagccagagcgcagcctggg

SEQ ID NO: 102757 - DNA, 22 bp, Homo sapiens
gaggctgaggcggatggatcac

SEQ ID NO: 102758 - DNA, 22 bp, Homo sapiens
cttgtagacccctggactcacg

SEQ ID NO: 102759 - DNA, 22 bp, Homo sapiens
gctgccttgccctcttcccata

SEQ ID NO: 102760 - DNA, 22 bp, Homo sapiens
gcagggtctgaggccacagagg

SEQ ID NO: 102761 - DNA, 22 bp, Homo sapiens
actattagcatatcatgaatgg

SEQ ID NO: 102762 - DNA, 22 bp, Homo sapiens
aatcggttgaacccaggaagtg

SEQ ID NO: 102763 - DNA, 22 bp, Homo sapiens
tcctgggacaagccgtggaagt

SEQ ID NO: 102764 - DNA, 22 bp, Homo sapiens
aagtcagacagctgagctgcct

SEQ ID NO: 102765 - DNA, 22 bp, Homo sapiens
tattgggtaaagatccagtttt

SEQ ID NO: 102766 - DNA, 22 bp, Homo sapiens
acagagcaatgcgtgttctcta

SEQ ID NO: 102767 - DNA, 22 bp, Homo sapiens
tctgtagtaggttgtagttctt

SEQ ID NO: 102768 - DNA, 22 bp, Homo sapiens
tcacccaggctggagtgtagtg

SEQ ID NO: 102769 - DNA, 22 bp, Homo sapiens
cataaaaggtagcagtttgaaa

SEQ ID NO: 102770 - DNA, 22 bp, Homo sapiens
cttctgagatgttgttttacag

SEQ ID NO: 102771 - DNA, 22 bp, Homo sapiens
tctctctgcagcccgggacact

SEQ ID NO: 102772 - DNA, 22 bp, Homo sapiens
tgggagcagcctcagcttcggg

SEQ ID NO: 102773 - DNA, 22 bp, Homo sapiens
ttaggtattttgttatgtcagc

SEQ ID NO: 102774 - DNA, 22 bp, Homo sapiens
agaaaatttaaagagacacaca

SEQ ID NO: 102775 - DNA, 16 bp, Homo sapiens
ccacctgcagctctca

SEQ ID NO: 102776 - DNA, 22 bp, Homo sapiens
agagttgctccattagaactta

SEQ ID NO: 102777 - DNA, 22 bp, Homo sapiens
atgctattgaaaagaaataaga

SEQ ID NO: 102778 - DNA, 22 bp, Homo sapiens
agctcaccacaacctccgcctc

SEQ ID NO: 102779 - DNA, 22 bp, Homo sapiens
tgaaatgtgtaatgtggatgcc

SEQ ID NO: 102780 - DNA, 22 bp, Homo sapiens
atggtgtttataggcaaagatc

SEQ ID NO: 102781 - DNA, 22 bp, Homo sapiens
ttccacattccttacattcata

SEQ ID NO: 102782 - DNA, 22 bp, Homo sapiens
gaggcaggcagattgcttgagg

SEQ ID NO: 102783 - DNA, 22 bp, Homo sapiens
gaaagagaacctgggcctagat

SEQ ID NO: 102784 - DNA, 23 bp, Homo sapiens
tcatttggacaaggcacagcaga

SEQ ID NO: 102785 - DNA, 22 bp, Homo sapiens
tgtatattctgcctaaaagctt

SEQ ID NO: 102786 - DNA, 23 bp, Homo sapiens
tgcatgtgattcatagagtccag

SEQ ID NO: 102787 - DNA, 22 bp, Homo sapiens
ttgcatgttccaaagaattttg

SEQ ID NO: 102788 - DNA, 22 bp, Homo sapiens
aaagttctctatggtgtaaaaa

SEQ ID NO: 102789 - DNA, 22 bp, Homo sapiens
aaggatacttttagagcctgag

SEQ ID NO: 102790 - DNA, 22 bp, Homo sapiens
atggctagcaccgcgttgctgg

SEQ ID NO: 102791 - DNA, 22 bp, Homo sapiens
atgtttaaagggttgagaaata

SEQ ID NO: 102792 - DNA, 22 bp, Homo sapiens
tagccgggtgtggtggaactcc

SEQ ID NO: 102793 - DNA, 22 bp, Homo sapiens
gagccaggttggaggctgcagt

SEQ ID NO: 102794 - DNA, 21 bp, Homo sapiens
cagaggcctatcacagactcc

SEQ ID NO: 102795 - DNA, 22 bp, Homo sapiens
gccgggttcaagccattctcct

SEQ ID NO: 102796 - DNA, 22 bp, Homo sapiens
ggagtgactctcggggccacta

SEQ ID NO: 102797 - DNA, 22 bp, Homo sapiens
caggaattcatagcattgttct

SEQ ID NO: 102798 - DNA, 22 bp, Homo sapiens
accccagaggcggaggctgcag

SEQ ID NO: 102799 - DNA, 22 bp, Homo sapiens
gcccaggctggagttcagtggt

SEQ ID NO: 102800 - DNA, 22 bp, Homo sapiens
gactcgctcccttttgtcttat

SEQ ID NO: 102801 - DNA, 19 bp, Homo sapiens
gggcaaagtgatcgtcctg

SEQ ID NO: 102802 - DNA, 22 bp, Homo sapiens
aggaattcaagaccagctgggc

SEQ ID NO: 102803 - DNA, 22 bp, Homo sapiens
tagaatgtaaattccaagggca

SEQ ID NO: 102804 - DNA, 22 bp, Homo sapiens
gatttagtggcccttggtacac

SEQ ID NO: 102805 - DNA, 22 bp, Homo sapiens
ggacattgaagctggaaaggga

SEQ ID NO: 102806 - DNA, 22 bp, Homo sapiens
gggaggcacgaggcgcgcagtg

SEQ ID NO: 102807 - DNA, 19 bp, Homo sapiens
agataagagttgactgtgg

SEQ ID NO: 102808 - DNA, 22 bp, Homo sapiens
taatggttttttggagactgct

SEQ ID NO: 102809 - DNA, 22 bp, Homo sapiens
tataaagagtctcaaagaagtt

SEQ ID NO: 102810 - DNA, 22 bp, Homo sapiens
ttagggttacaccagcctcctg

SEQ ID NO: 102811 - DNA, 18 bp, Homo sapiens
tgtccctgcaaataacat

SEQ ID NO: 102812 - DNA, 22 bp, Homo sapiens
tctcagggctcagagctcaggc

SEQ ID NO: 102813 - DNA, 22 bp, Homo sapiens
atgagctagaaaaccatgtgga

SEQ ID NO: 102814 - DNA, 22 bp, Homo sapiens
gaaaaggcctggggcaaagtgt

SEQ ID NO: 102815 - DNA, 22 bp, Homo sapiens
ctgctttaaaactgatacatga

SEQ ID NO: 102816 - DNA, 22 bp, Homo sapiens
cttcctctgtggccagagtgta

SEQ ID NO: 102817 - DNA, 22 bp, Homo sapiens
ggggtctcactatgttacccag

SEQ ID NO: 102818 - DNA, 22 bp, Homo sapiens
ctgggaggtggaggttgcattg

SEQ ID NO: 102819 - DNA, 22 bp, Homo sapiens
aggcaacttttggggatgatgg

SEQ ID NO: 102820 - DNA, 22 bp, Homo sapiens
atgaattgaggaaaacagtcgt

SEQ ID NO: 102821 - DNA, 22 bp, Homo sapiens
atgagaaagttaatcatcatga

SEQ ID NO: 102822 - DNA, 22 bp, Homo sapiens
gtgcccagcagcagcgtccccg

SEQ ID NO: 102823 - DNA, 22 bp, Homo sapiens
gtgaagttggccagtttagttt

SEQ ID NO: 102824 - DNA, 22 bp, Homo sapiens
ctgggatgcggaggttgcggtg

SEQ ID NO: 102825 - DNA, 22 bp, Homo sapiens
ccctcaggtgaaaggaaaaatt

SEQ ID NO: 102826 - DNA, 22 bp, Homo sapiens
tggcttccccggagtgacatgt

SEQ ID NO: 102827 - DNA, 22 bp, Homo sapiens
gagatttccatattttgtaaca

SEQ ID NO: 102828 - DNA, 22 bp, Homo sapiens
cagtggctggttagggacagga

SEQ ID NO: 102829 - DNA, 22 bp, Homo sapiens
acctggccagtggggccgcgct

SEQ ID NO: 102830 - DNA, 22 bp, Homo sapiens
taatggattaacgtccctgtcg

SEQ ID NO: 102831 - DNA, 22 bp, Homo sapiens
ttacttaaacagaaatgcagaa

SEQ ID NO: 102832 - DNA, 22 bp, Homo sapiens
gaggcggaggttgcagtgagct

SEQ ID NO: 102833 - DNA, 22 bp, Homo sapiens
tagagcaatgctctactccttg

SEQ ID NO: 102834 - DNA, 22 bp, Homo sapiens
tctggcttcgcagctcccagcc

SEQ ID NO: 102835 - DNA, 22 bp, Homo sapiens
ttgcttcttagatattcctctc

SEQ ID NO: 102836 - DNA, 22 bp, Homo sapiens
atgccactgcactccagcctgg

SEQ ID NO: 102837 - DNA, 22 bp, Homo sapiens
tgttcttaggtatttgacagtc

SEQ ID NO: 102838 - DNA, 22 bp, Homo sapiens
ttcacagtggtagtgcatttag

SEQ ID NO: 102839 - DNA, 22 bp, Homo sapiens
aggggagccagggctgcgagtt

SEQ ID NO: 102840 - DNA, 22 bp, Homo sapiens
ccaggaggtggagattgcagtg

SEQ ID NO: 102841 - DNA, 22 bp, Homo sapiens
cgtgagcaaaatggacactccc

SEQ ID NO: 102842 - DNA, 22 bp, Homo sapiens
gaagccagtgtttgaagaattt

SEQ ID NO: 102843 - DNA, 22 bp, Homo sapiens
gaagagctgacagtgtcatcct

SEQ ID NO: 102844 - DNA, 22 bp, Homo sapiens
actcatgtaagcggaatgtagt

SEQ ID NO: 102845 - DNA, 22 bp, Homo sapiens
atgcgagtgatgcagagtggct

SEQ ID NO: 102846 - DNA, 22 bp, Homo sapiens
cagcagcattgctctggattcc

SEQ ID NO: 102847 - DNA, 20 bp, Homo sapiens
atgctttcttgtgtgctgct

SEQ ID NO: 102848 - DNA, 22 bp, Homo sapiens
aggcaggaggatcatggatgca

SEQ ID NO: 102849 - DNA, 22 bp, Homo sapiens
acaagcatgggctttgacatca

SEQ ID NO: 102850 - DNA, 22 bp, Homo sapiens
actgattgcattcatagggttt

SEQ ID NO: 102851 - DNA, 22 bp, Homo sapiens
tgttattctagtggatcacgtc

SEQ ID NO: 102852 - DNA, 22 bp, Homo sapiens
ctcaggagttggaggctacagt

SEQ ID NO: 102853 - DNA, 22 bp, Homo sapiens
ctcattccatgtgtattttgag

SEQ ID NO: 102854 - DNA, 22 bp, Homo sapiens
tgggttcacgccattctcctgc

SEQ ID NO: 102855 - DNA, 22 bp, Homo sapiens
gtcccctgtccagggccagcca

SEQ ID NO: 102856 - DNA, 22 bp, Homo sapiens
aggtggcagatgggggtgctcg

SEQ ID NO: 102857 - DNA, 22 bp, Homo sapiens
cagctgcccctccagggctggg

SEQ ID NO: 102858 - DNA, 22 bp, Homo sapiens
gccaatgacagtctcagttctg

SEQ ID NO: 102859 - DNA, 22 bp, Homo sapiens
tagattcagatatttaggacaa

SEQ ID NO: 102860 - DNA, 22 bp, Homo sapiens
ccctgggattcaatttcactct

SEQ ID NO: 102861 - DNA, 22 bp, Homo sapiens
atgctaaggcccaggagaaaat

SEQ ID NO: 102862 - DNA, 23 bp, Homo sapiens
tctacaaagctgtgtcaggaccc

SEQ ID NO: 102863 - DNA, 20 bp, Homo sapiens
ggggaagtcactgcagtcag

SEQ ID NO: 102864 - DNA, 22 bp, Homo sapiens
cattgcaacttcaaactcctgg

SEQ ID NO: 102865 - DNA, 22 bp, Homo sapiens
tactgtgtgcccagccgagctg

SEQ ID NO: 102866 - DNA, 22 bp, Homo sapiens
ggctcatatcccggccatcatt

SEQ ID NO: 102867 - DNA, 22 bp, Homo sapiens
ttacctaaaatagctcaattta

SEQ ID NO: 102868 - DNA, 22 bp, Homo sapiens
agtcaggggatctagacttgaa

SEQ ID NO: 102869 - DNA, 22 bp, Homo sapiens
cggccgcagcagtgtcggccca

SEQ ID NO: 102870 - DNA, 22 bp, Homo sapiens
tagggcaatatttcccagaaaa

SEQ ID NO: 102871 - DNA, 22 bp, Homo sapiens
ataaaagatcccttctgagctc

SEQ ID NO: 102872 - DNA, 22 bp, Homo sapiens
gaaaattattgaaaatggctct

SEQ ID NO: 102873 - DNA, 22 bp, Homo sapiens
gagctgagaagcagcgcttgat

SEQ ID NO: 102874 - DNA, 22 bp, Homo sapiens
ggtgggagagcttgctttgatg

SEQ ID NO: 102875 - DNA, 22 bp, Homo sapiens
gatctccatctgcagtgtctgg

SEQ ID NO: 102876 - DNA, 21 bp, Homo sapiens
cagggccaatcctgacctcta

SEQ ID NO: 102877 - DNA, 22 bp, Homo sapiens
ttctagtgtccttggacttgct

SEQ ID NO: 102878 - DNA, 22 bp, Homo sapiens
catccaggctggagtacagtgg

SEQ ID NO: 102879 - DNA, 22 bp, Homo sapiens
caccagagtgggtgagggtgat

SEQ ID NO: 102880 - DNA, 20 bp, Homo sapiens
attagctcaggtgaggtcat

SEQ ID NO: 102881 - DNA, 22 bp, Homo sapiens
tcaaatgaagacagttgacttg

SEQ ID NO: 102882 - DNA, 22 bp, Homo sapiens
gcctcctgagtagctgggattg

SEQ ID NO: 102883 - DNA, 22 bp, Homo sapiens
tgtagatattaattattccttt

SEQ ID NO: 102884 - DNA, 22 bp, Homo sapiens
cagggtgctgcaccatccctca

SEQ ID NO: 102885 - DNA, 22 bp, Homo sapiens
atttacaggtagaattttaagt

SEQ ID NO: 102886 - DNA, 22 bp, Homo sapiens
gctgcagtgagccaagatcgtg

SEQ ID NO: 102887 - DNA, 22 bp, Homo sapiens
ggtagactgtcaaacactagcc

SEQ ID NO: 102888 - DNA, 22 bp, Homo sapiens
cctgcgcgtctgggtctgtctc

SEQ ID NO: 102889 - DNA, 22 bp, Homo sapiens
aggagaagccaagttgtgagca

SEQ ID NO: 102890 - DNA, 22 bp, Homo sapiens
gacaatatagttgaatgagcaa

SEQ ID NO: 102891 - DNA, 22 bp, Homo sapiens
cggctggtgtcgggcacagcaa

SEQ ID NO: 102892 - DNA, 22 bp, Homo sapiens
tggcactgaagctggaaagcct

SEQ ID NO: 102893 - DNA, 22 bp, Homo sapiens
ggggtggatttcaggcggtgtc

SEQ ID NO: 102894 - DNA, 22 bp, Homo sapiens
aagttgttgttgaggtgggtaa

SEQ ID NO: 102895 - DNA, 22 bp, Homo sapiens
acccaggctggagtgcagtggg

SEQ ID NO: 102896 - DNA, 22 bp, Homo sapiens
agtgctatcgagttctaatgct

SEQ ID NO: 102897 - DNA, 22 bp, Homo sapiens
taagaaatttagttatagaatg

SEQ ID NO: 102898 - DNA, 22 bp, Homo sapiens
tctgccttctatcttttgtctg

SEQ ID NO: 102899 - DNA, 22 bp, Homo sapiens
ccagactgcttgcttcccagcc

SEQ ID NO: 102900 - DNA, 22 bp, Homo sapiens
gagaactttctgtgtttttatc

SEQ ID NO: 102901 - DNA, 22 bp, Homo sapiens
agaggccggccgagcccatggg

SEQ ID NO: 102902 - DNA, 22 bp, Homo sapiens
cggtcaggtgcagcgttggcac

SEQ ID NO: 102903 - DNA, 22 bp, Homo sapiens
aggtggaaatggctttcctagg

SEQ ID NO: 102904 - DNA, 22 bp, Homo sapiens
gctgtgtccaggtgggggtgac

SEQ ID NO: 102905 - DNA, 22 bp, Homo sapiens
aaagattaaatcaaattggtca

SEQ ID NO: 102906 - DNA, 22 bp, Homo sapiens
agcctggcggtcgtcggtcagg

SEQ ID NO: 102907 - DNA, 22 bp, Homo sapiens
gagaggaagccttctgtacttg

SEQ ID NO: 102908 - DNA, 22 bp, Homo sapiens
ttctatttttgtggaactgtag

SEQ ID NO: 102909 - DNA, 17 bp, Homo sapiens
acttcccacccctccag

SEQ ID NO: 102910 - DNA, 22 bp, Homo sapiens
gtggattacaagacagttgaga

SEQ ID NO: 102911 - DNA, 22 bp, Homo sapiens
cacccaggctggattgcagtgg

SEQ ID NO: 102912 - DNA, 22 bp, Homo sapiens
ccccatgaagtagggtctctga

SEQ ID NO: 102913 - DNA, 22 bp, Homo sapiens
ttttctaacatctagtaatttg

SEQ ID NO: 102914 - DNA, 22 bp, Homo sapiens
tgactggattgtcattacgacg

SEQ ID NO: 102915 - DNA, 22 bp, Homo sapiens
tgtgcctactgatagagccaag

SEQ ID NO: 102916 - DNA, 22 bp, Homo sapiens
ctggtctggctacccagcgaat

SEQ ID NO: 102917 - DNA, 22 bp, Homo sapiens
ggtggcagtagcactgggcctg

SEQ ID NO: 102918 - DNA, 22 bp, Homo sapiens
atgaaatatcttgaagaaattc

SEQ ID NO: 102919 - DNA, 22 bp, Homo sapiens
ctgaggagaggtggcctgtgtt

SEQ ID NO: 102920 - DNA, 22 bp, Homo sapiens
tgagtggacacctgcttcttta

SEQ ID NO: 102921 - DNA, 16 bp, Homo sapiens
tgggtgggaggagcgg

SEQ ID NO: 102922 - DNA, 19 bp, Homo sapiens
tgagggtgagctttggaga

SEQ ID NO: 102923 - DNA, 22 bp, Homo sapiens
ggcccacggcggcccgggcgtc

SEQ ID NO: 102924 - DNA, 22 bp, Homo sapiens
gtcttgatctcctgaccttgtg

SEQ ID NO: 102925 - DNA, 22 bp, Homo sapiens
tggatctcggcaatgcgggact

SEQ ID NO: 102926 - DNA, 21 bp, Homo sapiens
ccgtgctcggctatggaccac

SEQ ID NO: 102927 - DNA, 19 bp, Homo sapiens
ccttgtctggtgaaggact

SEQ ID NO: 102928 - DNA, 22 bp, Homo sapiens
ttattttaccttcctctgagct

SEQ ID NO: 102929 - DNA, 21 bp, Homo sapiens
gggcactgaaagggaatagca

SEQ ID NO: 102930 - DNA, 22 bp, Homo sapiens
agtggcctggagccccgcctgg

SEQ ID NO: 102931 - DNA, 22 bp, Homo sapiens
taacaaagtattgtttgtgtat

SEQ ID NO: 102932 - DNA, 21 bp, Homo sapiens
gggcctggctgcgcaggacgg

SEQ ID NO: 102933 - DNA, 22 bp, Homo sapiens
ggccctggtcctaggggtggaa

SEQ ID NO: 102934 - DNA, 22 bp, Homo sapiens
tttacagcagcatgatttataa

SEQ ID NO: 102935 - DNA, 22 bp, Homo sapiens
cccgggaggtggaggttgcagt

SEQ ID NO: 102936 - DNA, 22 bp, Homo sapiens
ggattgtgataattgttgcaaa

SEQ ID NO: 102937 - DNA, 22 bp, Homo sapiens
aggagccagtggagttcctgcc

SEQ ID NO: 102938 - DNA, 22 bp, Homo sapiens
gggcaggaacaaatcaaatgat

SEQ ID NO: 102939 - DNA, 22 bp, Homo sapiens
ggggaccctcaggactgcgtct

SEQ ID NO: 102940 - DNA, 22 bp, Homo sapiens
ccagcctggttcagaattggct

SEQ ID NO: 102941 - DNA, 22 bp, Homo sapiens
cgtgaggggggtaaggcgtccg

SEQ ID NO: 102942 - DNA, 22 bp, Homo sapiens
ctgaggcaggagagttgcttga

SEQ ID NO: 102943 - DNA, 22 bp, Homo sapiens
tgtagctctccagccagcaagg

SEQ ID NO: 102944 - DNA, 20 bp, Homo sapiens
gggcaaggaaacagccccca

SEQ ID NO: 102945 - DNA, 22 bp, Homo sapiens
ctgaccaacatggtgaaacctt

SEQ ID NO: 102946 - DNA, 19 bp, Homo sapiens
gatttaaacgtggctctat

SEQ ID NO: 102947 - DNA, 21 bp, Homo sapiens
cttccccaggctggtctgtat

SEQ ID NO: 102948 - DNA, 22 bp, Homo sapiens
cgccccggacgtctgaccaaac

SEQ ID NO: 102949 - DNA, 22 bp, Homo sapiens
acgcagtttgtggacatttttt

SEQ ID NO: 102950 - DNA, 22 bp, Homo sapiens
tgtgctggagatcagcttattt

SEQ ID NO: 102951 - DNA, 22 bp, Homo sapiens
attgcactccagcctgggggac

SEQ ID NO: 102952 - DNA, 22 bp, Homo sapiens
tccacaggtccggcatgaacag

SEQ ID NO: 102953 - DNA, 22 bp, Homo sapiens
gtacagtgggtgtagggaccag

SEQ ID NO: 102954 - DNA, 22 bp, Homo sapiens
actgggcctacccagattggca

SEQ ID NO: 102955 - DNA, 22 bp, Homo sapiens
atttcccagggcctgggatttg

SEQ ID NO: 102956 - DNA, 22 bp, Homo sapiens
cggaggttgaggctgcagtgag

SEQ ID NO: 102957 - DNA, 22 bp, Homo sapiens
ggtgagttctcagcttattgca

SEQ ID NO: 102958 - DNA, 22 bp, Homo sapiens
aaggtcatggcaaattactttt

SEQ ID NO: 102959 - DNA, 22 bp, Homo sapiens
agagggatcaccctgtttctgg

SEQ ID NO: 102960 - DNA, 22 bp, Homo sapiens
tcctgaagaaggcagatatttg

SEQ ID NO: 102961 - DNA, 22 bp, Homo sapiens
ggagaagcagcttcttgatgaa

SEQ ID NO: 102962 - DNA, 22 bp, Homo sapiens
gcccagcccagaaaggttcgga

SEQ ID NO: 102963 - DNA, 22 bp, Homo sapiens
tgtggggatcttctagcttttc

SEQ ID NO: 102964 - DNA, 19 bp, Homo sapiens
tctagttttgagagacttc

SEQ ID NO: 102965 - DNA, 22 bp, Homo sapiens
tgggaagggtcaacagctggaa

SEQ ID NO: 102966 - DNA, 22 bp, Homo sapiens
ttactttaagggtgtcttatta

SEQ ID NO: 102967 - DNA, 22 bp, Homo sapiens
gtgcatgtcggggtgcatgtca

SEQ ID NO: 102968 - DNA, 22 bp, Homo sapiens
cagcgtctcgttgtgggcctcg

SEQ ID NO: 102969 - DNA, 22 bp, Homo sapiens
tggcacagactgggccaaggaa

SEQ ID NO: 102970 - DNA, 22 bp, Homo sapiens
tccaggtgacagagacaggata

SEQ ID NO: 102971 - DNA, 22 bp, Homo sapiens
gtgcgcaccctcccggcatccc

SEQ ID NO: 102972 - DNA, 22 bp, Homo sapiens
ataaaaactgacccatcctttg

SEQ ID NO: 102973 - DNA, 22 bp, Homo sapiens
agaaatatgctgattagatgaa

SEQ ID NO: 102974 - DNA, 22 bp, Homo sapiens
agcccttagtacatttctcaag

SEQ ID NO: 102975 - DNA, 23 bp, Homo sapiens
tcggtgggcgtggaggccgaggc

SEQ ID NO: 102976 - DNA, 22 bp, Homo sapiens
tgtcttcaggagtaaatatcat

SEQ ID NO: 102977 - DNA, 23 bp, Homo sapiens
actcgtggaattctctgcgatcg

SEQ ID NO: 102978 - DNA, 22 bp, Homo sapiens
tctccattagtgggtggcagtg

SEQ ID NO: 102979 - DNA, 22 bp, Homo sapiens
tagcacagcttcttgatgtcac

SEQ ID NO: 102980 - DNA, 22 bp, Homo sapiens
cgggcgcactccgggcagctgt

SEQ ID NO: 102981 - DNA, 21 bp, Homo sapiens
tctctttctggaagcttccct

SEQ ID NO: 102982 - DNA, 21 bp, Homo sapiens
gtggttctagagaaacagaat

SEQ ID NO: 102983 - DNA, 22 bp, Homo sapiens
ctcggcaggtggaggttgtagt

SEQ ID NO: 102984 - DNA, 22 bp, Homo sapiens
gaaatcatattctcagtccttc

SEQ ID NO: 102985 - DNA, 22 bp, Homo sapiens
ggccctggcagccacgaaagcc

SEQ ID NO: 102986 - DNA, 22 bp, Homo sapiens
acccaggctggcgtgcagtggc

SEQ ID NO: 102987 - DNA, 22 bp, Homo sapiens
tgattcatcagaataggagttt

SEQ ID NO: 102988 - DNA, 22 bp, Homo sapiens
cgcggtggcggcctccagcgcc

SEQ ID NO: 102989 - DNA, 22 bp, Homo sapiens
gttgattccggggccatttcaa

SEQ ID NO: 102990 - DNA, 22 bp, Homo sapiens
gctgtgtatcagatgccacggg

SEQ ID NO: 102991 - DNA, 22 bp, Homo sapiens
ggagaggggaacttgttgcttg

SEQ ID NO: 102992 - DNA, 22 bp, Homo sapiens
cacccaggctggagtgcagtga

SEQ ID NO: 102993 - DNA, 22 bp, Homo sapiens
cacccaggctggaatgcagtgg

SEQ ID NO: 102994 - DNA, 21 bp, Homo sapiens
accactgcctccaaggttcag

SEQ ID NO: 102995 - DNA, 22 bp, Homo sapiens
gcggcaggagtaaaggaggaag

SEQ ID NO: 102996 - DNA, 22 bp, Homo sapiens
ggctgagtctgtgacccatgcg

SEQ ID NO: 102997 - DNA, 22 bp, Homo sapiens
tgttatcctcagctcacctcta

SEQ ID NO: 102998 - DNA, 22 bp, Homo sapiens
gcttctcaattctcaccctcca

SEQ ID NO: 102999 - DNA, 22 bp, Homo sapiens
ccttctcagccccagctcccgc

SEQ ID NO: 103000 - DNA, 22 bp, Homo sapiens
cgctgataaacgtcacgttccc

SEQ ID NO: 103001 - DNA, 22 bp, Homo sapiens
ttccatttggcacttcactgag

SEQ ID NO: 103002 - DNA, 19 bp, Homo sapiens
gcccacggccctgctctgc

SEQ ID NO: 103003 - DNA, 22 bp, Homo sapiens
gagggagggactagcattctct

SEQ ID NO: 103004 - DNA, 22 bp, Homo sapiens
acccagccatgttcagttctct

SEQ ID NO: 103005 - DNA, 22 bp, Homo sapiens
agatacattgttctaagcattg

SEQ ID NO: 103006 - DNA, 22 bp, Homo sapiens
aggagctgtcagagtgccagag

SEQ ID NO: 103007 - DNA, 22 bp, Homo sapiens
tcttacccggcaacgtgtgtcg

SEQ ID NO: 103008 - DNA, 22 bp, Homo sapiens
tggacacaaagatcaaatattg

SEQ ID NO: 103009 - DNA, 22 bp, Homo sapiens
aggtggagaagagatgggcagt

SEQ ID NO: 103010 - DNA, 22 bp, Homo sapiens
ggctagggatctagaccaggac

SEQ ID NO: 103011 - DNA, 22 bp, Homo sapiens
caggaaagggatgggctgccac

SEQ ID NO: 103012 - DNA, 22 bp, Homo sapiens
ggtgggagagctctgtctccag

SEQ ID NO: 103013 - DNA, 22 bp, Homo sapiens
tcctgccttgcctgggacatca

SEQ ID NO: 103014 - DNA, 22 bp, Homo sapiens
cttggtgccacagcagcttgcg

SEQ ID NO: 103015 - DNA, 22 bp, Homo sapiens
gaggcagaagttgcagtgagca

SEQ ID NO: 103016 - DNA, 22 bp, Homo sapiens
attgtcagtttaatatagtcaa

SEQ ID NO: 103017 - DNA, 22 bp, Homo sapiens
ttggcagattctgaacaaagcc

SEQ ID NO: 103018 - DNA, 22 bp, Homo sapiens
cgtgcgcctcagcctcgtgcgc

SEQ ID NO: 103019 - DNA, 22 bp, Homo sapiens
gccagatttacagatttgccct

SEQ ID NO: 103020 - DNA, 21 bp, Homo sapiens
aaactgaccttgcctgagaca

SEQ ID NO: 103021 - DNA, 22 bp, Homo sapiens
tgcgttgcgctcctgcagcagg

SEQ ID NO: 103022 - DNA, 22 bp, Homo sapiens
gggccaccccactgcccacgct

SEQ ID NO: 103023 - DNA, 22 bp, Homo sapiens
agatgtgtttctagttcctgca

SEQ ID NO: 103024 - DNA, 22 bp, Homo sapiens
ggagtagctgcattccgagcac

SEQ ID NO: 103025 - DNA, 22 bp, Homo sapiens
attgtgtcctcattgaccttca

SEQ ID NO: 103026 - DNA, 22 bp, Homo sapiens
tgtgagttattttcaggagttt

SEQ ID NO: 103027 - DNA, 22 bp, Homo sapiens
aactctatttaccctactaaac

SEQ ID NO: 103028 - DNA, 22 bp, Homo sapiens
ctgatccctccatagggcacag

SEQ ID NO: 103029 - DNA, 22 bp, Homo sapiens
gccccagcctcccgagtagctg

SEQ ID NO: 103030 - DNA, 22 bp, Homo sapiens
tcttttgtgattcttcagttac

SEQ ID NO: 103031 - DNA, 22 bp, Homo sapiens
ggtccccccatggtgagcactg

SEQ ID NO: 103032 - DNA, 22 bp, Homo sapiens
gctactgattgaccttggagag

SEQ ID NO: 103033 - DNA, 22 bp, Homo sapiens
agtggctttgttccgtatggca

SEQ ID NO: 103034 - DNA, 21 bp, Homo sapiens
ggcaagaaacacaatcaagta

SEQ ID NO: 103035 - DNA, 22 bp, Homo sapiens
caggtgcctcaggatgagacaa

SEQ ID NO: 103036 - DNA, 21 bp, Homo sapiens
tactgtagccttgcactgtag

SEQ ID NO: 103037 - DNA, 22 bp, Homo sapiens
tcctgggaggcggaggttgcag

SEQ ID NO: 103038 - DNA, 22 bp, Homo sapiens
ttggaacatgccggggtccagg

SEQ ID NO: 103039 - DNA, 22 bp, Homo sapiens
tcacccaggctggagtgcagtg

SEQ ID NO: 103040 - DNA, 22 bp, Homo sapiens
tctcccaggcaggagtgcagtg

SEQ ID NO: 103041 - DNA, 22 bp, Homo sapiens
cttgtgcatttcattcctcagg

SEQ ID NO: 103042 - DNA, 22 bp, Homo sapiens
tgccctctttctgtacagctcc

SEQ ID NO: 103043 - DNA, 22 bp, Homo sapiens
agcaagattgaggcttcctcag

SEQ ID NO: 103044 - DNA, 22 bp, Homo sapiens
atggggagctcaccacctgttt

SEQ ID NO: 103045 - DNA, 22 bp, Homo sapiens
ttggaatgcacactgagcctgc

SEQ ID NO: 103046 - DNA, 22 bp, Homo sapiens
aggtcaagagtaaatttgggta

SEQ ID NO: 103047 - DNA, 22 bp, Homo sapiens
atacaatgattggttctcaccc

SEQ ID NO: 103048 - DNA, 22 bp, Homo sapiens
gggagctggagctggaagactc

SEQ ID NO: 103049 - DNA, 19 bp, Homo sapiens
gctgaggtggaggaaggag

SEQ ID NO: 103050 - DNA, 22 bp, Homo sapiens
gctgtggcctggcgcagagctg

SEQ ID NO: 103051 - DNA, 22 bp, Homo sapiens
tggtatgaccgtggtgcaagca

SEQ ID NO: 103052 - DNA, 22 bp, Homo sapiens
aaggaggcctggcagatgaaga

SEQ ID NO: 103053 - DNA, 22 bp, Homo sapiens
ccaggctggagtgcaatggcat

SEQ ID NO: 103054 - DNA, 22 bp, Homo sapiens
caagtctgacctctgggtgaag

SEQ ID NO: 103055 - DNA, 22 bp, Homo sapiens
aagtgatgctacgactttgaca

SEQ ID NO: 103056 - DNA, 22 bp, Homo sapiens
gacagctccagctcctccaggc

SEQ ID NO: 103057 - DNA, 22 bp, Homo sapiens
tagccgggtgttgtgtcatgca

SEQ ID NO: 103058 - DNA, 22 bp, Homo sapiens
gtcttagatttcaccgataatg

SEQ ID NO: 103059 - DNA, 22 bp, Homo sapiens
tccttagacaaagagtgggctt

SEQ ID NO: 103060 - DNA, 22 bp, Homo sapiens
tctcgatctcctgaccttgtga

SEQ ID NO: 103061 - DNA, 22 bp, Homo sapiens
cttaatctcacctgcaaagtcc

SEQ ID NO: 103062 - DNA, 22 bp, Homo sapiens
tcataaattctggtgctgtgag

SEQ ID NO: 103063 - DNA, 22 bp, Homo sapiens
ttatatgtttctgtttggaggc

SEQ ID NO: 103064 - DNA, 22 bp, Homo sapiens
tttctgtgataggctgcgacgc

SEQ ID NO: 103065 - DNA, 22 bp, Homo sapiens
agggttgcaccatgttggtcag

SEQ ID NO: 103066 - DNA, 21 bp, Homo sapiens
cccagaagttccatggggggc

SEQ ID NO: 103067 - DNA, 22 bp, Homo sapiens
taaagggtaggttttactgtaa

SEQ ID NO: 103068 - DNA, 22 bp, Homo sapiens
agatgcttactatggttgtatg

SEQ ID NO: 103069 - DNA, 22 bp, Homo sapiens
gatataggttcatagtgttaca

SEQ ID NO: 103070 - DNA, 22 bp, Homo sapiens
agcatttatcttttgtttgagt

SEQ ID NO: 103071 - DNA, 22 bp, Homo sapiens
gattccacagcttcgaggtctt

SEQ ID NO: 103072 - DNA, 18 bp, Homo sapiens
tcttcatctcctgagctg

SEQ ID NO: 103073 - DNA, 22 bp, Homo sapiens
agggatggagtgcggcccggac

SEQ ID NO: 103074 - DNA, 21 bp, Homo sapiens
ctttagctctatgtcctgagg

SEQ ID NO: 103075 - DNA, 22 bp, Homo sapiens
aggctgtgtgctccttatgaga

SEQ ID NO: 103076 - DNA, 22 bp, Homo sapiens
gctctagtaggaatgtccctct

SEQ ID NO: 103077 - DNA, 22 bp, Homo sapiens
ttctaattaaatctacgctagg

SEQ ID NO: 103078 - DNA, 22 bp, Homo sapiens
tcctcagaatcacctggcagct

SEQ ID NO: 103079 - DNA, 22 bp, Homo sapiens
aaagcagaggttgcagtgagct

SEQ ID NO: 103080 - DNA, 22 bp, Homo sapiens
ttaagggccattatggatgggt

SEQ ID NO: 103081 - DNA, 23 bp, Homo sapiens
aggcgagctcttctccagcacgt

SEQ ID NO: 103082 - DNA, 22 bp, Homo sapiens
ctcgttgctgaagccaaagtca

SEQ ID NO: 103083 - DNA, 22 bp, Homo sapiens
tgctgctgaggctaaagtatag

SEQ ID NO: 103084 - DNA, 22 bp, Homo sapiens
tcctcagtcacggtagcacatt

SEQ ID NO: 103085 - DNA, 22 bp, Homo sapiens
ccaggagttggaagctgccatg

SEQ ID NO: 103086 - DNA, 22 bp, Homo sapiens
gaaaagagacagggtgggtgat

SEQ ID NO: 103087 - DNA, 22 bp, Homo sapiens
atatgcagtctcttgcccttct

SEQ ID NO: 103088 - DNA, 22 bp, Homo sapiens
tctgcaggaagctggcggctga

SEQ ID NO: 103089 - DNA, 17 bp, Homo sapiens
acctattgatctgtcac

SEQ ID NO: 103090 - DNA, 22 bp, Homo sapiens
tagtatagattgaagcagatca

SEQ ID NO: 103091 - DNA, 22 bp, Homo sapiens
tgagtagagaattcagctaagg

SEQ ID NO: 103092 - DNA, 22 bp, Homo sapiens
cggtctcccgtgtgtgtgcgct

SEQ ID NO: 103093 - DNA, 22 bp, Homo sapiens
cccgcagtcggaatttctcagt

SEQ ID NO: 103094 - DNA, 22 bp, Homo sapiens
cacagctgtgagaagggagcct

SEQ ID NO: 103095 - DNA, 22 bp, Homo sapiens
gtgacacccgcatgccactgtg

SEQ ID NO: 103096 - DNA, 22 bp, Homo sapiens
caatagtaaattacggaggaga

SEQ ID NO: 103097 - DNA, 22 bp, Homo sapiens
ttgagcaggatggctatgcaca

SEQ ID NO: 103098 - DNA, 22 bp, Homo sapiens
acaggtcctcaagtcagctggg

SEQ ID NO: 103099 - DNA, 22 bp, Homo sapiens
aacgcccgtggttgccaaggta

SEQ ID NO: 103100 - DNA, 22 bp, Homo sapiens
cctcagctcccatgagatctgc

SEQ ID NO: 103101 - DNA, 22 bp, Homo sapiens
tggtggaattgtaaaatagtgt

SEQ ID NO: 103102 - DNA, 22 bp, Homo sapiens
ccacagaattctgtctccagga

SEQ ID NO: 103103 - DNA, 22 bp, Homo sapiens
cccaggaggtcgaagctgcagt

SEQ ID NO: 103104 - DNA, 22 bp, Homo sapiens
cccagaaggtcgaggctgcagt

SEQ ID NO: 103105 - DNA, 22 bp, Homo sapiens
cttgtcttgcacacggttgcca

SEQ ID NO: 103106 - DNA, 22 bp, Homo sapiens
ccacgcatccctccacagagag

SEQ ID NO: 103107 - DNA, 22 bp, Homo sapiens
tgacacccatctgtgccagtcc

SEQ ID NO: 103108 - DNA, 22 bp, Homo sapiens
tgtctgggagactgatcacccg

SEQ ID NO: 103109 - DNA, 21 bp, Homo sapiens
cactccacttagaacagggtt

SEQ ID NO: 103110 - DNA, 21 bp, Homo sapiens
agctgcctccacttctgaggc

SEQ ID NO: 103111 - DNA, 22 bp, Homo sapiens
ggttgctgggggtggcagagct

SEQ ID NO: 103112 - DNA, 22 bp, Homo sapiens
tttccctttagcctgagaatcc

SEQ ID NO: 103113 - DNA, 22 bp, Homo sapiens
ctgggaggcggaggttgtagtg

SEQ ID NO: 103114 - DNA, 22 bp, Homo sapiens
ctcagccccagcccagatagca

SEQ ID NO: 103115 - DNA, 22 bp, Homo sapiens
ttaggcctttgattggggtgct

SEQ ID NO: 103116 - DNA, 22 bp, Homo sapiens
ggaggagcatgagagggtagtg

SEQ ID NO: 103117 - DNA, 22 bp, Homo sapiens
ttctgggtttacatctgacttc

SEQ ID NO: 103118 - DNA, 22 bp, Homo sapiens
aaaatcttgtgacttaggaagg

SEQ ID NO: 103119 - DNA, 22 bp, Homo sapiens
ggattgcaacaagctagtttag

SEQ ID NO: 103120 - DNA, 22 bp, Homo sapiens
gcagctattgtctcctgggccc

SEQ ID NO: 103121 - DNA, 20 bp, Homo sapiens
gggtgtgtgcagggcctggt

SEQ ID NO: 103122 - DNA, 22 bp, Homo sapiens
gagatggagtctttttctgtca

SEQ ID NO: 103123 - DNA, 22 bp, Homo sapiens
ttggatccatctcaggcatagg

SEQ ID NO: 103124 - DNA, 22 bp, Homo sapiens
cgtaggtggctcagcacctggg

SEQ ID NO: 103125 - DNA, 22 bp, Homo sapiens
gcccaggaggcagaggttgtgg

SEQ ID NO: 103126 - DNA, 22 bp, Homo sapiens
ccaagcagagcagcctctctgg

SEQ ID NO: 103127 - DNA, 22 bp, Homo sapiens
ctggagggctgcagcgaggctg

SEQ ID NO: 103128 - DNA, 21 bp, Homo sapiens
ccaccaggtcttctgctcggg

SEQ ID NO: 103129 - DNA, 22 bp, Homo sapiens
ccctcccaggagtggccagaga

SEQ ID NO: 103130 - DNA, 22 bp, Homo sapiens
actgccaatggtagtttgatgg

SEQ ID NO: 103131 - DNA, 22 bp, Homo sapiens
tgtggactcgcatggctgaggc

SEQ ID NO: 103132 - DNA, 22 bp, Homo sapiens
aggggaatgggtagactgttga

SEQ ID NO: 103133 - DNA, 22 bp, Homo sapiens
gatatcatgggaaggtgtactt

SEQ ID NO: 103134 - DNA, 22 bp, Homo sapiens
tgttatctgagcaacgtcgacg

SEQ ID NO: 103135 - DNA, 22 bp, Homo sapiens
ccagtgtgcattatcatgtgtc

SEQ ID NO: 103136 - DNA, 22 bp, Homo sapiens
ttgcacagaatgacaatatgta

SEQ ID NO: 103137 - DNA, 22 bp, Homo sapiens
cctctgtgtctccaagaggcct

SEQ ID NO: 103138 - DNA, 22 bp, Homo sapiens
tacgttttaaacacggagccag

SEQ ID NO: 103139 - DNA, 22 bp, Homo sapiens
agtggactcttcccagtgcttg

SEQ ID NO: 103140 - DNA, 22 bp, Homo sapiens
gaatatcccgctatgcaaagta

SEQ ID NO: 103141 - DNA, 22 bp, Homo sapiens
ccactgcacttcagcctgggtg

SEQ ID NO: 103142 - DNA, 22 bp, Homo sapiens
tccggtccgggtactcctctct

SEQ ID NO: 103143 - DNA, 22 bp, Homo sapiens
agaggggcccggttctccgtct

SEQ ID NO: 103144 - DNA, 22 bp, Homo sapiens
aagaaatgtgaatattgaatag

SEQ ID NO: 103145 - DNA, 22 bp, Homo sapiens
ctggctctcaggctggtcccca

SEQ ID NO: 103146 - DNA, 22 bp, Homo sapiens
tctgcaggtaagcgttcttgga

SEQ ID NO: 103147 - DNA, 22 bp, Homo sapiens
agagtgcaaccgaaacaagcag

SEQ ID NO: 103148 - DNA, 22 bp, Homo sapiens
tctgactcccatattccacttc

SEQ ID NO: 103149 - DNA, 22 bp, Homo sapiens
aggtatatattctggtccttat

SEQ ID NO: 103150 - DNA, 22 bp, Homo sapiens
ccactattactgtgtggcagtc

SEQ ID NO: 103151 - DNA, 22 bp, Homo sapiens
ggctgtggcagctggaagtggt

SEQ ID NO: 103152 - DNA, 22 bp, Homo sapiens
cagtctctaaatcaatctgaat

SEQ ID NO: 103153 - DNA, 22 bp, Homo sapiens
catttacatttaaggttaatat

SEQ ID NO: 103154 - DNA, 22 bp, Homo sapiens
agagctgggtggacttgtagtt

SEQ ID NO: 103155 - DNA, 22 bp, Homo sapiens
gagctcattcattcattgcctg

SEQ ID NO: 103156 - DNA, 22 bp, Homo sapiens
aatattatacagtcaacctctt

SEQ ID NO: 103157 - DNA, 22 bp, Homo sapiens
gctcactgcaagctccgcctcc

SEQ ID NO: 103158 - DNA, 22 bp, Homo sapiens
gtacacaaagtgagacttgata

SEQ ID NO: 103159 - DNA, 22 bp, Homo sapiens
gtgctccctccttcctcaagga

SEQ ID NO: 103160 - DNA, 22 bp, Homo sapiens
catgtaaagaatttcacacaag

SEQ ID NO: 103161 - DNA, 22 bp, Homo sapiens
ggctcactgcaacttccgcctc

SEQ ID NO: 103162 - DNA, 22 bp, Homo sapiens
aaccaggtgactcatggtgagc

SEQ ID NO: 103163 - DNA, 22 bp, Homo sapiens
gaaaggagagggttaaggagct

SEQ ID NO: 103164 - DNA, 22 bp, Homo sapiens
catggcagctcctccagtgtga

SEQ ID NO: 103165 - DNA, 22 bp, Homo sapiens
tgaggcaggaggattgcaggat

SEQ ID NO: 103166 - DNA, 22 bp, Homo sapiens
tcccacacagcccgctcaccgg

SEQ ID NO: 103167 - DNA, 22 bp, Homo sapiens
tgaacgcaggtccacatggctc

SEQ ID NO: 103168 - DNA, 21 bp, Homo sapiens
aggtgctggcgccccaggaga

SEQ ID NO: 103169 - DNA, 22 bp, Homo sapiens
tcctgggatcaagtgatcctcc

SEQ ID NO: 103170 - DNA, 22 bp, Homo sapiens
aaattgtaatgacttcacttga

SEQ ID NO: 103171 - DNA, 22 bp, Homo sapiens
tccgggaggcagaggttgcagt

SEQ ID NO: 103172 - DNA, 22 bp, Homo sapiens
ataaagctattcctctcttttt

SEQ ID NO: 103173 - DNA, 22 bp, Homo sapiens
acacccaggctggcgtgcagtg

SEQ ID NO: 103174 - DNA, 22 bp, Homo sapiens
gggcagagactcagaaacagaa

SEQ ID NO: 103175 - DNA, 22 bp, Homo sapiens
gcttggaagtaggattgggaga

SEQ ID NO: 103176 - DNA, 22 bp, Homo sapiens
gagcactgagctggaattggag

SEQ ID NO: 103177 - DNA, 22 bp, Homo sapiens
tccaggctttggggcaggagcg

SEQ ID NO: 103178 - DNA, 22 bp, Homo sapiens
gagaacagaagcattcctaatt

SEQ ID NO: 103179 - DNA, 22 bp, Homo sapiens
cactgcagcctcgctctcctga

SEQ ID NO: 103180 - DNA, 22 bp, Homo sapiens
tgggaacagaggacttgactgt

SEQ ID NO: 103181 - DNA, 22 bp, Homo sapiens
caggggcgggtaaaaggcctcc

SEQ ID NO: 103182 - DNA, 22 bp, Homo sapiens
ttctgcagtgttaacaatgtca

SEQ ID NO: 103183 - DNA, 22 bp, Homo sapiens
gcctcagtctcccgagtagctg

SEQ ID NO: 103184 - DNA, 22 bp, Homo sapiens
gggaggttgaggctgcagtgag

SEQ ID NO: 103185 - DNA, 20 bp, Homo sapiens
tggcctctgagatgccacgg

SEQ ID NO: 103186 - DNA, 22 bp, Homo sapiens
ctctctgggcccagttggcacc

SEQ ID NO: 103187 - DNA, 23 bp, Homo sapiens
gtgtgttcccggagtagctcccg

SEQ ID NO: 103188 - DNA, 22 bp, Homo sapiens
ggctttgacatgctgaattaaa

SEQ ID NO: 103189 - DNA, 22 bp, Homo sapiens
tggtagtgactcccccagggct

SEQ ID NO: 103190 - DNA, 22 bp, Homo sapiens
ccagcagccaccttctcgaaat

SEQ ID NO: 103191 - DNA, 22 bp, Homo sapiens
cactgcagcctctgcctctcag

SEQ ID NO: 103192 - DNA, 22 bp, Homo sapiens
taggccacagagaggagatttc

SEQ ID NO: 103193 - DNA, 22 bp, Homo sapiens
tatttcttttcgtgacttattg

SEQ ID NO: 103194 - DNA, 22 bp, Homo sapiens
aagcagagaatctgggagcgag

SEQ ID NO: 103195 - DNA, 22 bp, Homo sapiens
tttgaaatgtatcagtataggt

SEQ ID NO: 103196 - DNA, 22 bp, Homo sapiens
gccgtggggagagagggtgcgt

SEQ ID NO: 103197 - DNA, 22 bp, Homo sapiens
cgagcatgatgacggctgtggc

SEQ ID NO: 103198 - DNA, 22 bp, Homo sapiens
aggacttccatggatggattgg

SEQ ID NO: 103199 - DNA, 22 bp, Homo sapiens
agagagcagtggatcacctagc

SEQ ID NO: 103200 - DNA, 22 bp, Homo sapiens
ctccagattccgtttattcagg

SEQ ID NO: 103201 - DNA, 22 bp, Homo sapiens
atggtactggggtcccggagtt

SEQ ID NO: 103202 - DNA, 22 bp, Homo sapiens
cagtggcctctggctttgctgt

SEQ ID NO: 103203 - DNA, 22 bp, Homo sapiens
agctctgaaagttatgtcgccg

SEQ ID NO: 103204 - DNA, 22 bp, Homo sapiens
caggcactgtgctgagctctgc

SEQ ID NO: 103205 - DNA, 22 bp, Homo sapiens
actgccctccagcctgggtgac

SEQ ID NO: 103206 - DNA, 22 bp, Homo sapiens
tgagatcattgacttgttcctg

SEQ ID NO: 103207 - DNA, 22 bp, Homo sapiens
gctaggagtggtgggtcaagga

SEQ ID NO: 103208 - DNA, 22 bp, Homo sapiens
tcaaaccagccttgcatcccag

SEQ ID NO: 103209 - DNA, 22 bp, Homo sapiens
ccatgtggtgggaaggagaatg

SEQ ID NO: 103210 - DNA, 22 bp, Homo sapiens
tattattgacatttacttggtg

SEQ ID NO: 103211 - DNA, 22 bp, Homo sapiens
tgaaatgttaaacaagtggctc

SEQ ID NO: 103212 - DNA, 22 bp, Homo sapiens
tcagtgatttctggggtgaggg

SEQ ID NO: 103213 - DNA, 22 bp, Homo sapiens
gagtcgagcagaaagccgtcgg

SEQ ID NO: 103214 - DNA, 22 bp, Homo sapiens
tctcatttacttccacaggctg

SEQ ID NO: 103215 - DNA, 22 bp, Homo sapiens
tctttggtttctgtctctgtaa

SEQ ID NO: 103216 - DNA, 22 bp, Homo sapiens
gtggaggagaggcgccttgcgg

SEQ ID NO: 103217 - DNA, 22 bp, Homo sapiens
gtagggttggagagcacaacca

SEQ ID NO: 103218 - DNA, 22 bp, Homo sapiens
gttcagtcacgtgcccaagttc

SEQ ID NO: 103219 - DNA, 22 bp, Homo sapiens
cccaggaggcctgcctggccgg

SEQ ID NO: 103220 - DNA, 22 bp, Homo sapiens
ctgatcccaggcactgtcgcaa

SEQ ID NO: 103221 - DNA, 22 bp, Homo sapiens
tcttgccgcgcaggcgcagttc

SEQ ID NO: 103222 - DNA, 22 bp, Homo sapiens
gccatcatatcccctgtgacct

SEQ ID NO: 103223 - DNA, 22 bp, Homo sapiens
tccttaggcaatttgggagagt

SEQ ID NO: 103224 - DNA, 22 bp, Homo sapiens
gcagagtgctgtcgtacgcccc

SEQ ID NO: 103225 - DNA, 22 bp, Homo sapiens
gacagctgcatcctcagacaca

SEQ ID NO: 103226 - DNA, 22 bp, Homo sapiens
gaatttcacaaggtgaggataa

SEQ ID NO: 103227 - DNA, 22 bp, Homo sapiens
tgggaggccgaggcaggtggat

SEQ ID NO: 103228 - DNA, 22 bp, Homo sapiens
catgggtaagactcttttgccc

SEQ ID NO: 103229 - DNA, 22 bp, Homo sapiens
ttctctgcctcacaggtctaag

SEQ ID NO: 103230 - DNA, 22 bp, Homo sapiens
cccagtttcaactttccagtgg

SEQ ID NO: 103231 - DNA, 22 bp, Homo sapiens
tgacatttcctagtgctttgtg

SEQ ID NO: 103232 - DNA, 22 bp, Homo sapiens
agggccagcactcctggcagga

SEQ ID NO: 103233 - DNA, 22 bp, Homo sapiens
tgacagtattgatggcaggatt

SEQ ID NO: 103234 - DNA, 22 bp, Homo sapiens
tcttcacgccaagtgcccctca

SEQ ID NO: 103235 - DNA, 22 bp, Homo sapiens
tccccagcttgctacttctgct

SEQ ID NO: 103236 - DNA, 22 bp, Homo sapiens
actgcatttggtaaagtcaaga

SEQ ID NO: 103237 - DNA, 22 bp, Homo sapiens
aacccacaaaggatttcagctc

SEQ ID NO: 103238 - DNA, 22 bp, Homo sapiens
tggtctgctgaacagccgtatc

SEQ ID NO: 103239 - DNA, 22 bp, Homo sapiens
tgcgcggctcagtcatctccag

SEQ ID NO: 103240 - DNA, 22 bp, Homo sapiens
ggggtgggcgtgcagggacacc

SEQ ID NO: 103241 - DNA, 23 bp, Homo sapiens
tcctcgcaggagggagatgatgc

SEQ ID NO: 103242 - DNA, 22 bp, Homo sapiens
ccaggaggttgaggctgcagtg

SEQ ID NO: 103243 - DNA, 19 bp, Homo sapiens
ggcatggggtccggggacc

SEQ ID NO: 103244 - DNA, 22 bp, Homo sapiens
ttagtctctttgcattgccata

SEQ ID NO: 103245 - DNA, 22 bp, Homo sapiens
gctgctgggatcctgggtctca

SEQ ID NO: 103246 - DNA, 22 bp, Homo sapiens
aagactgtgtctatggctactc

SEQ ID NO: 103247 - DNA, 22 bp, Homo sapiens
aagcgccatggttcctgcgcag

SEQ ID NO: 103248 - DNA, 22 bp, Homo sapiens
acagattcactgcactggccat

SEQ ID NO: 103249 - DNA, 22 bp, Homo sapiens
atgccacttcattccagcctcg

SEQ ID NO: 103250 - DNA, 22 bp, Homo sapiens
aggggcacgagtagagctctag

SEQ ID NO: 103251 - DNA, 22 bp, Homo sapiens
ccactgcactccagccttggca

SEQ ID NO: 103252 - DNA, 22 bp, Homo sapiens
ctctgagctgccttttgagctt

SEQ ID NO: 103253 - DNA, 22 bp, Homo sapiens
atacctgtgtatccacaagcgt

SEQ ID NO: 103254 - DNA, 18 bp, Homo sapiens
actctttctgcccacagg

SEQ ID NO: 103255 - DNA, 22 bp, Homo sapiens
ctttaattgtagctcccataat

SEQ ID NO: 103256 - DNA, 22 bp, Homo sapiens
tgttattgtcgctgcactggga

SEQ ID NO: 103257 - DNA, 22 bp, Homo sapiens
ggaaatgacttggtgcttcgtt

SEQ ID NO: 103258 - DNA, 22 bp, Homo sapiens
tgggatgccggcaggaggcaat

SEQ ID NO: 103259 - DNA, 22 bp, Homo sapiens
ggctgggcaggtctgcacaggg

SEQ ID NO: 103260 - DNA, 21 bp, Homo sapiens
agcgtcaatatcgtcaacagg

SEQ ID NO: 103261 - DNA, 14 bp, Homo sapiens
aagatcaccttcct

SEQ ID NO: 103262 - DNA, 22 bp, Homo sapiens
ccaggctgctgttggtgtccgc

SEQ ID NO: 103263 - DNA, 23 bp, Homo sapiens
ggatggacgtgatgccttagcca

SEQ ID NO: 103264 - DNA, 22 bp, Homo sapiens
tatctgatacaacagaataaca

SEQ ID NO: 103265 - DNA, 22 bp, Homo sapiens
tacatttataaggcttctctgt

SEQ ID NO: 103266 - DNA, 22 bp, Homo sapiens
cttggggcagcccaggctgagc

SEQ ID NO: 103267 - DNA, 22 bp, Homo sapiens
ggctccctgcaacctccgcctc

SEQ ID NO: 103268 - DNA, 22 bp, Homo sapiens
cagcctggtccccggctcaccc

SEQ ID NO: 103269 - DNA, 22 bp, Homo sapiens
gcgagggcacgcggttgaaggc

SEQ ID NO: 103270 - DNA, 22 bp, Homo sapiens
aggtacatggggtgtgtgcacg

SEQ ID NO: 103271 - DNA, 22 bp, Homo sapiens
acatgtttaagtttgttatatg

SEQ ID NO: 103272 - DNA, 22 bp, Homo sapiens
gcccagagtttgaagatacagt

SEQ ID NO: 103273 - DNA, 22 bp, Homo sapiens
tacggtcagtccgtgccccaag

SEQ ID NO: 103274 - DNA, 22 bp, Homo sapiens
attataggcttgagccaccgtg

SEQ ID NO: 103275 - DNA, 22 bp, Homo sapiens
tagctgggactactggccctgc

SEQ ID NO: 103276 - DNA, 22 bp, Homo sapiens
cctgggtttggagcctgcagaa

SEQ ID NO: 103277 - DNA, 20 bp, Homo sapiens
tgcctataaagggccaggta

SEQ ID NO: 103278 - DNA, 22 bp, Homo sapiens
gtctttcttaaacaacagaaca

SEQ ID NO: 103279 - DNA, 22 bp, Homo sapiens
cagtggaggccttgggaccttt

SEQ ID NO: 103280 - DNA, 22 bp, Homo sapiens
gtggctgcagcggctgtggaga

SEQ ID NO: 103281 - DNA, 22 bp, Homo sapiens
catgttggtgtgctgcacccgt

SEQ ID NO: 103282 - DNA, 22 bp, Homo sapiens
aagccaatgctagcccacatgc

SEQ ID NO: 103283 - DNA, 22 bp, Homo sapiens
ttttaagttggattgctaagta

SEQ ID NO: 103284 - DNA, 22 bp, Homo sapiens
aacttggctaccagcgttaaat

SEQ ID NO: 103285 - DNA, 22 bp, Homo sapiens
tggctgagttacgaacagagca

SEQ ID NO: 103286 - DNA, 22 bp, Homo sapiens
tgacaggcaggacagaggtgtg

SEQ ID NO: 103287 - DNA, 22 bp, Homo sapiens
tgggcagttttctatgctgcaa

SEQ ID NO: 103288 - DNA, 22 bp, Homo sapiens
agcattccacactgaagtctgc

SEQ ID NO: 103289 - DNA, 22 bp, Homo sapiens
aaccaccattctctcctcttcc

SEQ ID NO: 103290 - DNA, 22 bp, Homo sapiens
attgaaaataaggccagaaaca

SEQ ID NO: 103291 - DNA, 19 bp, Homo sapiens
agtcctggcctgggggacc

SEQ ID NO: 103292 - DNA, 22 bp, Homo sapiens
acagacaagtagttcagacaag

SEQ ID NO: 103293 - DNA, 22 bp, Homo sapiens
agaggaggctctgggatcgtcc

SEQ ID NO: 103294 - DNA, 22 bp, Homo sapiens
cggggacacactggcagctcct

SEQ ID NO: 103295 - DNA, 22 bp, Homo sapiens
atcgcaagtttaaaaatctttg

SEQ ID NO: 103296 - DNA, 22 bp, Homo sapiens
ggtcgctgtgtaggttcagcta

SEQ ID NO: 103297 - DNA, 22 bp, Homo sapiens
catgaaattgtattggcctcaa

SEQ ID NO: 103298 - DNA, 22 bp, Homo sapiens
cagtggcaggatttcagctcag

SEQ ID NO: 103299 - DNA, 22 bp, Homo sapiens
tcagcctggcaggatggcctgg

SEQ ID NO: 103300 - DNA, 22 bp, Homo sapiens
atgccaggaacaaacagtggtg

SEQ ID NO: 103301 - DNA, 22 bp, Homo sapiens
tttctaatctgattctcctacc

SEQ ID NO: 103302 - DNA, 22 bp, Homo sapiens
atatttagataaaaatgggctt

SEQ ID NO: 103303 - DNA, 19 bp, Homo sapiens
ggctgccttctgctcatct

SEQ ID NO: 103304 - DNA, 22 bp, Homo sapiens
ttcgactctgtgcctgaagagc

SEQ ID NO: 103305 - DNA, 22 bp, Homo sapiens
gaagattgaaggctgggaatta

SEQ ID NO: 103306 - DNA, 21 bp, Homo sapiens
tctgatggtagatgagatgtg

SEQ ID NO: 103307 - DNA, 22 bp, Homo sapiens
ggccactgctctccagcctggg

SEQ ID NO: 103308 - DNA, 22 bp, Homo sapiens
gccgggaccaaggccacggagc

SEQ ID NO: 103309 - DNA, 22 bp, Homo sapiens
gctaggttggggaagttctcct

SEQ ID NO: 103310 - DNA, 22 bp, Homo sapiens
tggggccatctcacccactgtt

SEQ ID NO: 103311 - DNA, 22 bp, Homo sapiens
gtgaccaatattatgctaatta

SEQ ID NO: 103312 - DNA, 22 bp, Homo sapiens
gggttgtagagctggaagggga

SEQ ID NO: 103313 - DNA, 22 bp, Homo sapiens
gccagtggtcactgaggaagaa

SEQ ID NO: 103314 - DNA, 22 bp, Homo sapiens
tgtctggtgggttgacaggcag

SEQ ID NO: 103315 - DNA, 22 bp, Homo sapiens
aagatgattatgtagattggga

SEQ ID NO: 103316 - DNA, 22 bp, Homo sapiens
gtcaggactctgacccgtcccg

SEQ ID NO: 103317 - DNA, 22 bp, Homo sapiens
acagtatagggcttatattgta

SEQ ID NO: 103318 - DNA, 22 bp, Homo sapiens
agtggccctggagtgactcgta

SEQ ID NO: 103319 - DNA, 22 bp, Homo sapiens
tgcaataactactttaatgttg

SEQ ID NO: 103320 - DNA, 22 bp, Homo sapiens
gtgtaagtatctttgtatcttt

SEQ ID NO: 103321 - DNA, 22 bp, Homo sapiens
agtctgcaggaccgcgtcacat

SEQ ID NO: 103322 - DNA, 19 bp, Homo sapiens
aatgctgcttctttttgca

SEQ ID NO: 103323 - DNA, 22 bp, Homo sapiens
agcctctcagagtgctgggatt

SEQ ID NO: 103324 - DNA, 22 bp, Homo sapiens
cgtgccactgcactctagcctg

SEQ ID NO: 103325 - DNA, 22 bp, Homo sapiens
tgtctcatctcttaaccccact

SEQ ID NO: 103326 - DNA, 22 bp, Homo sapiens
gaggccaaggtgggcagatcac

SEQ ID NO: 103327 - DNA, 22 bp, Homo sapiens
gcactgcaggtgggtggagagg

SEQ ID NO: 103328 - DNA, 22 bp, Homo sapiens
tactgcactccagcctgggtga

SEQ ID NO: 103329 - DNA, 22 bp, Homo sapiens
aggtgggcgctgctcccgctgg

SEQ ID NO: 103330 - DNA, 22 bp, Homo sapiens
gccaccccataggtgttaggtg

SEQ ID NO: 103331 - DNA, 22 bp, Homo sapiens
tgtaccgccttgtggggttggg

SEQ ID NO: 103332 - DNA, 19 bp, Homo sapiens
ctccttgccatttcttttc

SEQ ID NO: 103333 - DNA, 22 bp, Homo sapiens
cacgggagacgtgatcttggac

SEQ ID NO: 103334 - DNA, 22 bp, Homo sapiens
gaggcagaggttgcagtgagct

SEQ ID NO: 103335 - DNA, 22 bp, Homo sapiens
tagactagaggatcagcaaggg

SEQ ID NO: 103336 - DNA, 22 bp, Homo sapiens
cctgggcctctcaaagtgctgg

SEQ ID NO: 103337 - DNA, 22 bp, Homo sapiens
caggctgctgcctagaatgaca

SEQ ID NO: 103338 - DNA, 22 bp, Homo sapiens
gaggccaactttggagaacagg

SEQ ID NO: 103339 - DNA, 22 bp, Homo sapiens
gggaagatagtgttgagggccc

SEQ ID NO: 103340 - DNA, 22 bp, Homo sapiens
attcactgtgggtcctttggat

SEQ ID NO: 103341 - DNA, 22 bp, Homo sapiens
cgggcaaggcgagactaggccc

SEQ ID NO: 103342 - DNA, 22 bp, Homo sapiens
ggaggctgaggcaggcggatca

SEQ ID NO: 103343 - DNA, 22 bp, Homo sapiens
gggctcttctggcatgctgctc

SEQ ID NO: 103344 - DNA, 22 bp, Homo sapiens
tggtacaatcacagctcactgt

SEQ ID NO: 103345 - DNA, 22 bp, Homo sapiens
tcctggcaaagatgttggtgtt

SEQ ID NO: 103346 - DNA, 22 bp, Homo sapiens
atcactgtgtatgtatatgcag

SEQ ID NO: 103347 - DNA, 22 bp, Homo sapiens
tttgagtagtgagactaggcag

SEQ ID NO: 103348 - DNA, 22 bp, Homo sapiens
ctcgggtaccatgctaggcact

SEQ ID NO: 103349 - DNA, 22 bp, Homo sapiens
gagccaagctcttctccatgag

SEQ ID NO: 103350 - DNA, 22 bp, Homo sapiens
cctgtgcttggccagagaggtt

SEQ ID NO: 103351 - DNA, 22 bp, Homo sapiens
ctggaaggcggaggttgtagtg

SEQ ID NO: 103352 - DNA, 22 bp, Homo sapiens
tgttgagtatatacctacaagt

SEQ ID NO: 103353 - DNA, 22 bp, Homo sapiens
tgagccaagttcacaccattgc

SEQ ID NO: 103354 - DNA, 22 bp, Homo sapiens
tgaggaaacttacaaggcagaa

SEQ ID NO: 103355 - DNA, 22 bp, Homo sapiens
tttctcttcactgtgtgcctca

SEQ ID NO: 103356 - DNA, 22 bp, Homo sapiens
gggagctgaaggagccggcggg

SEQ ID NO: 103357 - DNA, 22 bp, Homo sapiens
ggacaagcctgtgagtgggttt

SEQ ID NO: 103358 - DNA, 22 bp, Homo sapiens
aagcctgaacattactagttgt

SEQ ID NO: 103359 - DNA, 22 bp, Homo sapiens
gaaccattgttgaaaagaatag

SEQ ID NO: 103360 - DNA, 21 bp, Homo sapiens
gctcctggtgctgcgtggcgc

SEQ ID NO: 103361 - DNA, 22 bp, Homo sapiens
cccagttgttgccggctctgga

SEQ ID NO: 103362 - DNA, 22 bp, Homo sapiens
gtgagccgagtatagttcatag

SEQ ID NO: 103363 - DNA, 22 bp, Homo sapiens
ggcccagacccaagagtggtgg

SEQ ID NO: 103364 - DNA, 22 bp, Homo sapiens
ctcagggccaaggatgctgttg

SEQ ID NO: 103365 - DNA, 22 bp, Homo sapiens
tacctcaagttccaggaaagcg

SEQ ID NO: 103366 - DNA, 22 bp, Homo sapiens
gtgctttgttaagtctgaaatt

SEQ ID NO: 103367 - DNA, 22 bp, Homo sapiens
tggagggcatgctgtccatggg

SEQ ID NO: 103368 - DNA, 22 bp, Homo sapiens
atacaaaatatatactggagac

SEQ ID NO: 103369 - DNA, 22 bp, Homo sapiens
gagcagtgtttgtggacctgga

SEQ ID NO: 103370 - DNA, 22 bp, Homo sapiens
acggtgctgggtattggggttc

SEQ ID NO: 103371 - DNA, 22 bp, Homo sapiens
aggatttctgtgcctggaaaat

SEQ ID NO: 103372 - DNA, 22 bp, Homo sapiens
aggagctcagctaagttggaga

SEQ ID NO: 103373 - DNA, 22 bp, Homo sapiens
ctggagtagccggacgggtctg

SEQ ID NO: 103374 - DNA, 22 bp, Homo sapiens
atatattttttgagacagagtc

SEQ ID NO: 103375 - DNA, 22 bp, Homo sapiens
agagcagctcgctacctctcta

SEQ ID NO: 103376 - DNA, 22 bp, Homo sapiens
agtcccaacagcttacaaggaa

SEQ ID NO: 103377 - DNA, 22 bp, Homo sapiens
tccagcagtccatgtgagacac

SEQ ID NO: 103378 - DNA, 22 bp, Homo sapiens
aggacagagggaccagagccca

SEQ ID NO: 103379 - DNA, 22 bp, Homo sapiens
agtggagcttttcctatcagag

SEQ ID NO: 103380 - DNA, 22 bp, Homo sapiens
tgatatgtaactactccttata

SEQ ID NO: 103381 - DNA, 22 bp, Homo sapiens
cagccccatggtgtgctccagc

SEQ ID NO: 103382 - DNA, 22 bp, Homo sapiens
atattacacacggtatcacggg

SEQ ID NO: 103383 - DNA, 22 bp, Homo sapiens
tgttgattagtgtttagactta

SEQ ID NO: 103384 - DNA, 22 bp, Homo sapiens
gtagcccacctggggagggcga

SEQ ID NO: 103385 - DNA, 22 bp, Homo sapiens
gtggagagagataagcctggtc

SEQ ID NO: 103386 - DNA, 22 bp, Homo sapiens
tacccaaggccctttcaatttc

SEQ ID NO: 103387 - DNA, 22 bp, Homo sapiens
cagtgatatttatcctactcac

SEQ ID NO: 103388 - DNA, 22 bp, Homo sapiens
cattaaacaaccttgaatcaat

SEQ ID NO: 103389 - DNA, 22 bp, Homo sapiens
ggtaacttagctcatggctgtg

SEQ ID NO: 103390 - DNA, 22 bp, Homo sapiens
actggacagaggaaatatggag

SEQ ID NO: 103391 - DNA, 22 bp, Homo sapiens
tcccgcccttgtacttgccgag

SEQ ID NO: 103392 - DNA, 22 bp, Homo sapiens
acactggttggttgaatttact

SEQ ID NO: 103393 - DNA, 22 bp, Homo sapiens
ccagatgtccctctcaggtttg

SEQ ID NO: 103394 - DNA, 22 bp, Homo sapiens
cagtggcgtgatctctgctcac

SEQ ID NO: 103395 - DNA, 22 bp, Homo sapiens
tgtgcctgttcccactttgcct

SEQ ID NO: 103396 - DNA, 22 bp, Homo sapiens
aaggttcctctctccacccagc

SEQ ID NO: 103397 - DNA, 22 bp, Homo sapiens
ttttcatttttgtagatgcaag

SEQ ID NO: 103398 - DNA, 22 bp, Homo sapiens
agtccaggcattccagccattc

SEQ ID NO: 103399 - DNA, 22 bp, Homo sapiens
ggtcccaggttgacagggagac

SEQ ID NO: 103400 - DNA, 22 bp, Homo sapiens
tgggtgctctgcgaccgtaggg

SEQ ID NO: 103401 - DNA, 22 bp, Homo sapiens
gacctcatgatccacctgcctt

SEQ ID NO: 103402 - DNA, 22 bp, Homo sapiens
tagagtgtcataacagtgccca

SEQ ID NO: 103403 - DNA, 22 bp, Homo sapiens
gtggccccagggccctgtctgg

SEQ ID NO: 103404 - DNA, 22 bp, Homo sapiens
accgcagtgacgtgggacttcc

SEQ ID NO: 103405 - DNA, 22 bp, Homo sapiens
gagccaggggtcagctccgagg

SEQ ID NO: 103406 - DNA, 22 bp, Homo sapiens
ttcatagtgtttccttccagtg

SEQ ID NO: 103407 - DNA, 22 bp, Homo sapiens
caggcagggagctggaaaggat

SEQ ID NO: 103408 - DNA, 22 bp, Homo sapiens
tttcataatactgtacatgaaa

SEQ ID NO: 103409 - DNA, 22 bp, Homo sapiens
atagttttaaaacctcaggaag

SEQ ID NO: 103410 - DNA, 20 bp, Homo sapiens
gtgcaatggctcagtctcag

SEQ ID NO: 103411 - DNA, 22 bp, Homo sapiens
aggtcacccgtttgactatcca

SEQ ID NO: 103412 - DNA, 22 bp, Homo sapiens
agcccaggagtttgaggctgtg

SEQ ID NO: 103413 - DNA, 22 bp, Homo sapiens
agcctgcgatcccacctggcct

SEQ ID NO: 103414 - DNA, 22 bp, Homo sapiens
accatgttggccaagctggtct

SEQ ID NO: 103415 - DNA, 22 bp, Homo sapiens
gaacttggcctgtctgtctggc

SEQ ID NO: 103416 - DNA, 22 bp, Homo sapiens
tgaccctgagagctgaatggct

SEQ ID NO: 103417 - DNA, 22 bp, Homo sapiens
gccaccctggacgcactgttcg

SEQ ID NO: 103418 - DNA, 22 bp, Homo sapiens
gtgtctcttagcctgctaatgc

SEQ ID NO: 103419 - DNA, 22 bp, Homo sapiens
tgtacttgaacttgactgtaga

SEQ ID NO: 103420 - DNA, 20 bp, Homo sapiens
ttctccagtgcggtagccat

SEQ ID NO: 103421 - DNA, 22 bp, Homo sapiens
tcagggctgcagaagaggcagg

SEQ ID NO: 103422 - DNA, 22 bp, Homo sapiens
ctgctgggatagaagtatctca

SEQ ID NO: 103423 - DNA, 17 bp, Homo sapiens
gaggccaaggcaggcgg

SEQ ID NO: 103424 - DNA, 22 bp, Homo sapiens
agagtccctcttcccaggaggc

SEQ ID NO: 103425 - DNA, 22 bp, Homo sapiens
taggcgacagcttgatggtgcg

SEQ ID NO: 103426 - DNA, 22 bp, Homo sapiens
ctgcttgcaaagtgttggtgat

SEQ ID NO: 103427 - DNA, 22 bp, Homo sapiens
agatttatgtggtcacactcag

SEQ ID NO: 103428 - DNA, 22 bp, Homo sapiens
caggaaggggctcactctggcc

SEQ ID NO: 103429 - DNA, 22 bp, Homo sapiens
cccccagctctgctgggtcccg

SEQ ID NO: 103430 - DNA, 22 bp, Homo sapiens
agctgccccgaggcggcgggaa

SEQ ID NO: 103431 - DNA, 22 bp, Homo sapiens
gtagtcttatcagaatttttaa

SEQ ID NO: 103432 - DNA, 22 bp, Homo sapiens
ttgaaggtcaccccgtagccat

SEQ ID NO: 103433 - DNA, 22 bp, Homo sapiens
aagtaaatatctgtagtcttta

SEQ ID NO: 103434 - DNA, 22 bp, Homo sapiens
ccaattttattcttctgcaagt

SEQ ID NO: 103435 - DNA, 22 bp, Homo sapiens
tctcatctgccatttgcaggag

SEQ ID NO: 103436 - DNA, 22 bp, Homo sapiens
atctggttcttcttaggcatca

SEQ ID NO: 103437 - DNA, 22 bp, Homo sapiens
ctaggctggagtgcagtggcac

SEQ ID NO: 103438 - DNA, 22 bp, Homo sapiens
ttgtgctcctatgagaatctaa

SEQ ID NO: 103439 - DNA, 22 bp, Homo sapiens
atatacacatctttttaaatat

SEQ ID NO: 103440 - DNA, 22 bp, Homo sapiens
agaatttcctatgagagattcc

SEQ ID NO: 103441 - DNA, 22 bp, Homo sapiens
acccaggctggagtgcagtgat

SEQ ID NO: 103442 - DNA, 22 bp, Homo sapiens
aagaagcattctttcattggtt

SEQ ID NO: 103443 - DNA, 22 bp, Homo sapiens
cctttcctgtgtccttttaagg

SEQ ID NO: 103444 - DNA, 22 bp, Homo sapiens
tacttttagcctatttgattct

SEQ ID NO: 103445 - DNA, 22 bp, Homo sapiens
agagcgcactgtctgcaggcaa

SEQ ID NO: 103446 - DNA, 22 bp, Homo sapiens
tcaaattgtcatcttgataatg

SEQ ID NO: 103447 - DNA, 22 bp, Homo sapiens
ctttttcactgtgtcctcacac

SEQ ID NO: 103448 - DNA, 22 bp, Homo sapiens
agacgctattttgaggggtcta

SEQ ID NO: 103449 - DNA, 22 bp, Homo sapiens
actgcactcctgcctgggtaac

SEQ ID NO: 103450 - DNA, 22 bp, Homo sapiens
gctccccaaaagctccaggaaa

SEQ ID NO: 103451 - DNA, 22 bp, Homo sapiens
tacaccattcccaggtggattt

SEQ ID NO: 103452 - DNA, 22 bp, Homo sapiens
tagagctctccttcctctgtgg

SEQ ID NO: 103453 - DNA, 22 bp, Homo sapiens
tgttcttgagcctttagaccta

SEQ ID NO: 103454 - DNA, 23 bp, Homo sapiens
aaacttgctatggctgaaatcat

SEQ ID NO: 103455 - DNA, 22 bp, Homo sapiens
ggagagggtaggggtcctgccc

SEQ ID NO: 103456 - DNA, 22 bp, Homo sapiens
ttgatgtaggtttatctattgt

SEQ ID NO: 103457 - DNA, 22 bp, Homo sapiens
agaatgggggctacaggccaca

SEQ ID NO: 103458 - DNA, 22 bp, Homo sapiens
tttaatcataagaaggaaaata

SEQ ID NO: 103459 - DNA, 22 bp, Homo sapiens
tgtggctctcatgcactcccag

SEQ ID NO: 103460 - DNA, 22 bp, Homo sapiens
caggctggagttcagtggtgtg

SEQ ID NO: 103461 - DNA, 22 bp, Homo sapiens
gctaatcaatgttaaggctgtg

SEQ ID NO: 103462 - DNA, 22 bp, Homo sapiens
gggtacagttcttccagtgtca

SEQ ID NO: 103463 - DNA, 22 bp, Homo sapiens
tggcaccatcaaggctgagaac

SEQ ID NO: 103464 - DNA, 22 bp, Homo sapiens
cccgggaggcagaggttgcagt

SEQ ID NO: 103465 - DNA, 22 bp, Homo sapiens
gagagtgagatcctcctgggga

SEQ ID NO: 103466 - DNA, 22 bp, Homo sapiens
cctccccacagcccaggagact

SEQ ID NO: 103467 - DNA, 22 bp, Homo sapiens
gactttctgatgtaaacattta

SEQ ID NO: 103468 - DNA, 22 bp, Homo sapiens
tgtaatactccattgtatggat

SEQ ID NO: 103469 - DNA, 22 bp, Homo sapiens
tagcagcaaagcaggatctgct

SEQ ID NO: 103470 - DNA, 18 bp, Homo sapiens
cagcctctgattggttgc

SEQ ID NO: 103471 - DNA, 22 bp, Homo sapiens
accccaggaagtggaggtcatg

SEQ ID NO: 103472 - DNA, 22 bp, Homo sapiens
tttcccaggctggaatgcagtg

SEQ ID NO: 103473 - DNA, 22 bp, Homo sapiens
tccagcccaggctggagtgtag

SEQ ID NO: 103474 - DNA, 23 bp, Homo sapiens
tgaggcaggcggatcacgaggtc

SEQ ID NO: 103475 - DNA, 22 bp, Homo sapiens
aggaaaacagaccaaggagctc

SEQ ID NO: 103476 - DNA, 22 bp, Homo sapiens
gcataaactccaaaaggcaggg

SEQ ID NO: 103477 - DNA, 22 bp, Homo sapiens
aatgtcaaaggctatacattca

SEQ ID NO: 103478 - DNA, 21 bp, Homo sapiens
tgcaatccagcctgggcgaca

SEQ ID NO: 103479 - DNA, 22 bp, Homo sapiens
ctgagcctcctgcttctatttc

SEQ ID NO: 103480 - DNA, 22 bp, Homo sapiens
cccagcaggaggaggttgcagt

SEQ ID NO: 103481 - DNA, 22 bp, Homo sapiens
ggaggactcaggtctggccatg

SEQ ID NO: 103482 - DNA, 22 bp, Homo sapiens
tttgcattgcattaagtattct

SEQ ID NO: 103483 - DNA, 22 bp, Homo sapiens
gggcttggcacatgggctcagc

SEQ ID NO: 103484 - DNA, 22 bp, Homo sapiens
gtgggctgcccttgaggtcagc

SEQ ID NO: 103485 - DNA, 18 bp, Homo sapiens
atggtctcatactgggag

SEQ ID NO: 103486 - DNA, 21 bp, Homo sapiens
atctcgggcttctcgcccagc

SEQ ID NO: 103487 - DNA, 22 bp, Homo sapiens
aagagggctgcaatcttattgc

SEQ ID NO: 103488 - DNA, 22 bp, Homo sapiens
tagaactaagagttatcattta

SEQ ID NO: 103489 - DNA, 22 bp, Homo sapiens
attgcactccagcctgggtgac

SEQ ID NO: 103490 - DNA, 22 bp, Homo sapiens
agagaagagtcttgtcaaatta

SEQ ID NO: 103491 - DNA, 22 bp, Homo sapiens
atgctctctgtcctgctcagag

SEQ ID NO: 103492 - DNA, 22 bp, Homo sapiens
gtcagtgtcttaacagagatta

SEQ ID NO: 103493 - DNA, 22 bp, Homo sapiens
gtgggacaggtcaaatcttaaa

SEQ ID NO: 103494 - DNA, 22 bp, Homo sapiens
ttccaactttgtcatatattat

SEQ ID NO: 103495 - DNA, 22 bp, Homo sapiens
ggagctgaggacactacatttt

SEQ ID NO: 103496 - DNA, 22 bp, Homo sapiens
atgattgaaaatgacattgcca

SEQ ID NO: 103497 - DNA, 18 bp, Homo sapiens
taggagagaatttattta

SEQ ID NO: 103498 - DNA, 22 bp, Homo sapiens
cagggatggcgctggctgcccg

SEQ ID NO: 103499 - DNA, 23 bp, Homo sapiens
ggggcctgcaccggtctgcgcgg

SEQ ID NO: 103500 - DNA, 22 bp, Homo sapiens
acccggaggcgggggatgcagt

SEQ ID NO: 103501 - DNA, 22 bp, Homo sapiens
ggctggtgttgagtgcctgtag

SEQ ID NO: 103502 - DNA, 22 bp, Homo sapiens
aatgttacgatcaacaacacat

SEQ ID NO: 103503 - DNA, 22 bp, Homo sapiens
gtggcaagatgactactcactg

SEQ ID NO: 103504 - DNA, 22 bp, Homo sapiens
gcggcggagacagcaggaagcc

SEQ ID NO: 103505 - DNA, 22 bp, Homo sapiens
tttaatgtagcgtgaaatgatt

SEQ ID NO: 103506 - DNA, 22 bp, Homo sapiens
ttgagggtctggatctgctgct

SEQ ID NO: 103507 - DNA, 22 bp, Homo sapiens
gtatgtgaggttggtttccagg

SEQ ID NO: 103508 - DNA, 22 bp, Homo sapiens
ccagcagagcatggggaggaag

SEQ ID NO: 103509 - DNA, 22 bp, Homo sapiens
atagggcctaaaaagtattgct

SEQ ID NO: 103510 - DNA, 22 bp, Homo sapiens
agggagcattgtgacatatcac

SEQ ID NO: 103511 - DNA, 22 bp, Homo sapiens
ctgggaggcggagcttgcagtg

SEQ ID NO: 103512 - DNA, 22 bp, Homo sapiens
tgtagatatagaaaaagactga

SEQ ID NO: 103513 - DNA, 23 bp, Homo sapiens
aattatctatttcaaatttagca

SEQ ID NO: 103514 - DNA, 22 bp, Homo sapiens
gcccaggctggagtgcagtggc

SEQ ID NO: 103515 - DNA, 22 bp, Homo sapiens
ttcttctaaatgtgcttattaa

SEQ ID NO: 103516 - DNA, 22 bp, Homo sapiens
gaggctgaggcaggaggatcac

SEQ ID NO: 103517 - DNA, 22 bp, Homo sapiens
ggaaaagtgttaaggtgttgat

SEQ ID NO: 103518 - DNA, 22 bp, Homo sapiens
tgcctcaagccctccactgcac

SEQ ID NO: 103519 - DNA, 22 bp, Homo sapiens
ggctgggctccgggagcatgcg

SEQ ID NO: 103520 - DNA, 22 bp, Homo sapiens
tagcccctgcctttgaacctgg

SEQ ID NO: 103521 - DNA, 22 bp, Homo sapiens
gcaggcagatcacctgtcagga

SEQ ID NO: 103522 - DNA, 22 bp, Homo sapiens
aattcacatccgaccaggtcaa

SEQ ID NO: 103523 - DNA, 22 bp, Homo sapiens
agcaggagtttgatgcttttat

SEQ ID NO: 103524 - DNA, 22 bp, Homo sapiens
tggtggcgggcagggccgtcac

SEQ ID NO: 103525 - DNA, 22 bp, Homo sapiens
tctgccttttactagctggatg

SEQ ID NO: 103526 - DNA, 22 bp, Homo sapiens
aggcaaggtgctacagacagtg

SEQ ID NO: 103527 - DNA, 22 bp, Homo sapiens
tgggaagctgcattttaacaag

SEQ ID NO: 103528 - DNA, 22 bp, Homo sapiens
atctagattaggtataagagct

SEQ ID NO: 103529 - DNA, 22 bp, Homo sapiens
gccactgtggtcctcccatgat

SEQ ID NO: 103530 - DNA, 22 bp, Homo sapiens
actaaagctcacagagttgaac

SEQ ID NO: 103531 - DNA, 19 bp, Homo sapiens
acacagggatcagagggtt

SEQ ID NO: 103532 - DNA, 22 bp, Homo sapiens
aggctcgcatgccctgcaccac

SEQ ID NO: 103533 - DNA, 22 bp, Homo sapiens
tcgtgaggctctgcatcgcaca

SEQ ID NO: 103534 - DNA, 22 bp, Homo sapiens
agccctggtttgcagcatttgc

SEQ ID NO: 103535 - DNA, 22 bp, Homo sapiens
aagccggctgggccgaggctgc

SEQ ID NO: 103536 - DNA, 22 bp, Homo sapiens
gctggtagacctcactgcactc

SEQ ID NO: 103537 - DNA, 22 bp, Homo sapiens
gggatcgtcatggaaagtgcta

SEQ ID NO: 103538 - DNA, 19 bp, Homo sapiens
gggtcccaaaagatgtgct

SEQ ID NO: 103539 - DNA, 22 bp, Homo sapiens
gtccaggagctcagggcttatt

SEQ ID NO: 103540 - DNA, 22 bp, Homo sapiens
gggctagcctcttccctgctcc

SEQ ID NO: 103541 - DNA, 22 bp, Homo sapiens
cacgcacgctgggtggaggcgc

SEQ ID NO: 103542 - DNA, 22 bp, Homo sapiens
tagcacagagcttttaaacttc

SEQ ID NO: 103543 - DNA, 22 bp, Homo sapiens
ggaggaggggtgactgaatgct

SEQ ID NO: 103544 - DNA, 22 bp, Homo sapiens
ggcgccagcactgcagcgcctc

SEQ ID NO: 103545 - DNA, 22 bp, Homo sapiens
atttcatactaaggctcaaaaa

SEQ ID NO: 103546 - DNA, 22 bp, Homo sapiens
tgtggtgccgagagtctggacg

SEQ ID NO: 103547 - DNA, 18 bp, Homo sapiens
gcactgaggaaaacctct

SEQ ID NO: 103548 - DNA, 23 bp, Homo sapiens
aagttagtttcaataaagcaatt

SEQ ID NO: 103549 - DNA, 22 bp, Homo sapiens
gtagagcagggagcaggaagct

SEQ ID NO: 103550 - DNA, 22 bp, Homo sapiens
cttcctttgctgttcggaggtt

SEQ ID NO: 103551 - DNA, 22 bp, Homo sapiens
tagatgcttgttcagaaatagg

SEQ ID NO: 103552 - DNA, 22 bp, Homo sapiens
tccgaggccaaagctgtgaata

SEQ ID NO: 103553 - DNA, 22 bp, Homo sapiens
tcaggcaatctgacagctggag

SEQ ID NO: 103554 - DNA, 22 bp, Homo sapiens
tgccaccccggaccccgaagtg

SEQ ID NO: 103555 - DNA, 22 bp, Homo sapiens
ctccaggctcgtccaagatcga

SEQ ID NO: 103556 - DNA, 22 bp, Homo sapiens
ttctggtgggactcaggctttc

SEQ ID NO: 103557 - DNA, 22 bp, Homo sapiens
gggggctccaggcgagaatgtg

SEQ ID NO: 103558 - DNA, 22 bp, Homo sapiens
agaccaccaaaactttctccat

SEQ ID NO: 103559 - DNA, 22 bp, Homo sapiens
atagaatatgacttttagatcc

SEQ ID NO: 103560 - DNA, 22 bp, Homo sapiens
ggagatatttgtattctgtctc

SEQ ID NO: 103561 - DNA, 22 bp, Homo sapiens
gcaggcaggcttccttgaactg

SEQ ID NO: 103562 - DNA, 22 bp, Homo sapiens
ggtgggaggactgtttgaggca

SEQ ID NO: 103563 - DNA, 22 bp, Homo sapiens
tagcacagggctcctcaaccca

SEQ ID NO: 103564 - DNA, 22 bp, Homo sapiens
aagcatgaatcgactcggcaac

SEQ ID NO: 103565 - DNA, 22 bp, Homo sapiens
caaccccactacacgttggaga

SEQ ID NO: 103566 - DNA, 22 bp, Homo sapiens
ttgcttcagagggagacacttt

SEQ ID NO: 103567 - DNA, 22 bp, Homo sapiens
gatggaggagatggcagggtgc

SEQ ID NO: 103568 - DNA, 22 bp, Homo sapiens
cacagtcctgccagagggcctt

SEQ ID NO: 103569 - DNA, 22 bp, Homo sapiens
gtgcacatcgtgcaggtttgtt

SEQ ID NO: 103570 - DNA, 22 bp, Homo sapiens
tgggtggcagcttcagcatgtt

SEQ ID NO: 103571 - DNA, 22 bp, Homo sapiens
caggagtccatctggcctggtg

SEQ ID NO: 103572 - DNA, 22 bp, Homo sapiens
tcactgtatcatgttgcactta

SEQ ID NO: 103573 - DNA, 19 bp, Homo sapiens
gcctcatttccacctcccc

SEQ ID NO: 103574 - DNA, 22 bp, Homo sapiens
agcttgtagaaggccacgagca

SEQ ID NO: 103575 - DNA, 22 bp, Homo sapiens
tgacttgtctctttgggagaca

SEQ ID NO: 103576 - DNA, 22 bp, Homo sapiens
gggcctcaggttctggagaagg

SEQ ID NO: 103577 - DNA, 18 bp, Homo sapiens
ttgcttcttttctctagg

SEQ ID NO: 103578 - DNA, 22 bp, Homo sapiens
tgagtgaccagaagtccccctc

SEQ ID NO: 103579 - DNA, 22 bp, Homo sapiens
ataatggtagatgtccacgcag

SEQ ID NO: 103580 - DNA, 22 bp, Homo sapiens
tatgcagtgagcactatttata

SEQ ID NO: 103581 - DNA, 22 bp, Homo sapiens
cccgggaggcggaggttgcagt

SEQ ID NO: 103582 - DNA, 22 bp, Homo sapiens
tgggaaggggagctggaaagga

SEQ ID NO: 103583 - DNA, 22 bp, Homo sapiens
ttcaaagcagagggtcaataca

SEQ ID NO: 103584 - DNA, 22 bp, Homo sapiens
ggcgccccatgatgagggctag

SEQ ID NO: 103585 - DNA, 22 bp, Homo sapiens
gaagaaagatcaaatagtttcc

SEQ ID NO: 103586 - DNA, 22 bp, Homo sapiens
ttagcttttgagaatgatttct

SEQ ID NO: 103587 - DNA, 22 bp, Homo sapiens
gcagaggacacaggagggcaag

SEQ ID NO: 103588 - DNA, 22 bp, Homo sapiens
aaaatatgtataactcttctgc

SEQ ID NO: 103589 - DNA, 22 bp, Homo sapiens
aggtggggaggagtgtctcttt

SEQ ID NO: 103590 - DNA, 22 bp, Homo sapiens
catggcattgcataacggggct

SEQ ID NO: 103591 - DNA, 22 bp, Homo sapiens
tccccatgtctgcagggagggt

SEQ ID NO: 103592 - DNA, 22 bp, Homo sapiens
gcaagacatgtctaaggtttaa

SEQ ID NO: 103593 - DNA, 22 bp, Homo sapiens
ccaggctggagtatagtggcgc

SEQ ID NO: 103594 - DNA, 22 bp, Homo sapiens
ctggcctcggcagcaggaacag

SEQ ID NO: 103595 - DNA, 22 bp, Homo sapiens
cagtgacgtaaactgcatgtgc

SEQ ID NO: 103596 - DNA, 22 bp, Homo sapiens
ctaaatctcatcatgtacctcc

SEQ ID NO: 103597 - DNA, 22 bp, Homo sapiens
aaggggaagagaccgcagagtc

SEQ ID NO: 103598 - DNA, 22 bp, Homo sapiens
tttatagtagcatgatttataa

SEQ ID NO: 103599 - DNA, 22 bp, Homo sapiens
tcacaaatgtttgcatgtgtct

SEQ ID NO: 103600 - DNA, 22 bp, Homo sapiens
gcccagctgcaccctggtgggt

SEQ ID NO: 103601 - DNA, 22 bp, Homo sapiens
cctgtaatcccaactacttggg

SEQ ID NO: 103602 - DNA, 22 bp, Homo sapiens
gcccagtagttcaaggttgcag

SEQ ID NO: 103603 - DNA, 22 bp, Homo sapiens
tgttttaagggtcaactgtcac

SEQ ID NO: 103604 - DNA, 22 bp, Homo sapiens
aggggatggagctggaaggcag

SEQ ID NO: 103605 - DNA, 22 bp, Homo sapiens
aggagatggagctcagtgggca

SEQ ID NO: 103606 - DNA, 22 bp, Homo sapiens
gatgatcatctgtaaagttaga

SEQ ID NO: 103607 - DNA, 22 bp, Homo sapiens
caggagatgacagggaagaacc

SEQ ID NO: 103608 - DNA, 22 bp, Homo sapiens
gcatctaaataaacgtgggagt

SEQ ID NO: 103609 - DNA, 22 bp, Homo sapiens
atttagaactttgtttgccaat

SEQ ID NO: 103610 - DNA, 22 bp, Homo sapiens
ccaggtagccaaggggtctggg

SEQ ID NO: 103611 - DNA, 22 bp, Homo sapiens
agccacacagcttaatgacaga

SEQ ID NO: 103612 - DNA, 22 bp, Homo sapiens
cagggggctcaaaggagagtgc

SEQ ID NO: 103613 - DNA, 22 bp, Homo sapiens
attaagtgactaaagtaatgct

SEQ ID NO: 103614 - DNA, 22 bp, Homo sapiens
tctgcaacagtgccctgtaaat

SEQ ID NO: 103615 - DNA, 22 bp, Homo sapiens
agagcggggatagttaatattc

SEQ ID NO: 103616 - DNA, 22 bp, Homo sapiens
ggggccttttctgaatgtggaa

SEQ ID NO: 103617 - DNA, 22 bp, Homo sapiens
tcacagtgttaaacctttcttt

SEQ ID NO: 103618 - DNA, 22 bp, Homo sapiens
gcctgtgtctgggtggccagag

SEQ ID NO: 103619 - DNA, 22 bp, Homo sapiens
ttaagtgcaaaaatgaaagtat

SEQ ID NO: 103620 - DNA, 19 bp, Homo sapiens
tcctggggaggggcatggc

SEQ ID NO: 103621 - DNA, 20 bp, Homo sapiens
ttcaggaataagatagcagc

SEQ ID NO: 103622 - DNA, 22 bp, Homo sapiens
atcatccaagcgtagttcttct

SEQ ID NO: 103623 - DNA, 22 bp, Homo sapiens
caggagtgtctccacacagcaa

SEQ ID NO: 103624 - DNA, 22 bp, Homo sapiens
ttgtaacaggtactaaataact

SEQ ID NO: 103625 - DNA, 22 bp, Homo sapiens
tctgctctgtggcttcagctaa

SEQ ID NO: 103626 - DNA, 22 bp, Homo sapiens
tgtgtgagtaaggctgagagag

SEQ ID NO: 103627 - DNA, 22 bp, Homo sapiens
gtagggctcagtaaatactttg

SEQ ID NO: 103628 - DNA, 22 bp, Homo sapiens
tgagaaattacttcagtgatgg

SEQ ID NO: 103629 - DNA, 22 bp, Homo sapiens
tcaggctcaggttaggggccaa

SEQ ID NO: 103630 - DNA, 22 bp, Homo sapiens
ttgctcttgaaaattgatgctg

SEQ ID NO: 103631 - DNA, 22 bp, Homo sapiens
gtccccgacgtttggcttgatg

SEQ ID NO: 103632 - DNA, 22 bp, Homo sapiens
cccaggagttggaggctgcagt

SEQ ID NO: 103633 - DNA, 22 bp, Homo sapiens
tggttgcctctcagagattccg

SEQ ID NO: 103634 - DNA, 22 bp, Homo sapiens
tgtccaggctaaagtgcagtgg

SEQ ID NO: 103635 - DNA, 22 bp, Homo sapiens
tgtcttcgctacaatgaaaagg

SEQ ID NO: 103636 - DNA, 22 bp, Homo sapiens
catagagtgatgtaaggtatgt

SEQ ID NO: 103637 - DNA, 22 bp, Homo sapiens
gcgagaaactaagtgccctttg

SEQ ID NO: 103638 - DNA, 23 bp, Homo sapiens
cagagctggcttcatgggtgtgc

SEQ ID NO: 103639 - DNA, 22 bp, Homo sapiens
ccaggagctggagggtgcagtg

SEQ ID NO: 103640 - DNA, 22 bp, Homo sapiens
ctggcctaggaatggttttccg

SEQ ID NO: 103641 - DNA, 22 bp, Homo sapiens
agcctctctgttagtcactggg

SEQ ID NO: 103642 - DNA, 22 bp, Homo sapiens
tcaccagatctctctgtaatgg

SEQ ID NO: 103643 - DNA, 22 bp, Homo sapiens
ctggaaggcagaggttgcagtg

SEQ ID NO: 103644 - DNA, 22 bp, Homo sapiens
caggcagaagaagtggaaggac

SEQ ID NO: 103645 - DNA, 22 bp, Homo sapiens
ccagagctgcaggtaaaatgct

SEQ ID NO: 103646 - DNA, 22 bp, Homo sapiens
gtggcttgagcaggggcagagg

SEQ ID NO: 103647 - DNA, 22 bp, Homo sapiens
ctttggcaatgtcattttcaat

SEQ ID NO: 103648 - DNA, 22 bp, Homo sapiens
ccagagctgattcctgggactt

SEQ ID NO: 103649 - DNA, 22 bp, Homo sapiens
tcagggattgcaaaattcatcc

SEQ ID NO: 103650 - DNA, 22 bp, Homo sapiens
tgtgacagcaataactacttaa

SEQ ID NO: 103651 - DNA, 22 bp, Homo sapiens
gaggcaggaggattgcttgagc

SEQ ID NO: 103652 - DNA, 18 bp, Homo sapiens
tggtcactgtggatagtg

SEQ ID NO: 103653 - DNA, 23 bp, Homo sapiens
gggggccgtcctggggattatag

SEQ ID NO: 103654 - DNA, 22 bp, Homo sapiens
ctgagatctttatacgaggcac

SEQ ID NO: 103655 - DNA, 22 bp, Homo sapiens
ctctgcctcccaggttcaagcg

SEQ ID NO: 103656 - DNA, 19 bp, Homo sapiens
gccttcccaccacccgtcc

SEQ ID NO: 103657 - DNA, 22 bp, Homo sapiens
atcaacatgtcataaagtgaaa

SEQ ID NO: 103658 - DNA, 22 bp, Homo sapiens
aataaacaaaggacaaggaggt

SEQ ID NO: 103659 - DNA, 22 bp, Homo sapiens
tgcaatctcggcactttgggag

SEQ ID NO: 103660 - DNA, 22 bp, Homo sapiens
tgtttcttacgtttttagaggc

SEQ ID NO: 103661 - DNA, 22 bp, Homo sapiens
caggctggagtgcagtggcgct

SEQ ID NO: 103662 - DNA, 22 bp, Homo sapiens
tgcatggacgtgacttggccaa

SEQ ID NO: 103663 - DNA, 22 bp, Homo sapiens
cagcctttgggtcagaagattc

SEQ ID NO: 103664 - DNA, 22 bp, Homo sapiens
taggcaagtggaccagaggttt

SEQ ID NO: 103665 - DNA, 18 bp, Homo sapiens
gcagctagccaggggggc

SEQ ID NO: 103666 - DNA, 22 bp, Homo sapiens
tctccgatcacaggttttcaat

SEQ ID NO: 103667 - DNA, 22 bp, Homo sapiens
ggggcattgtgtctgggttcct

SEQ ID NO: 103668 - DNA, 22 bp, Homo sapiens
ggaagctctgcctagatttcag

SEQ ID NO: 103669 - DNA, 22 bp, Homo sapiens
ggtgtagctctgtgtcccactg

SEQ ID NO: 103670 - DNA, 22 bp, Homo sapiens
ctcttagtaatgccatgaagca

SEQ ID NO: 103671 - DNA, 22 bp, Homo sapiens
gcctgtcccgcaccggagcccg

SEQ ID NO: 103672 - DNA, 22 bp, Homo sapiens
tccaggattgcaggtgcacaac

SEQ ID NO: 103673 - DNA, 22 bp, Homo sapiens
gccctgggcaaggttctggcca

SEQ ID NO: 103674 - DNA, 22 bp, Homo sapiens
ggaactgaatgtctcggtataa

SEQ ID NO: 103675 - DNA, 22 bp, Homo sapiens
tctcaatttgattacattcata

SEQ ID NO: 103676 - DNA, 16 bp, Homo sapiens
atgctgctattagagg

SEQ ID NO: 103677 - DNA, 21 bp, Homo sapiens
acctgagctccacctcctgcc

SEQ ID NO: 103678 - DNA, 22 bp, Homo sapiens
ctgctccccagcctgcgccttt

SEQ ID NO: 103679 - DNA, 22 bp, Homo sapiens
tgaggcaggaggttgagaactg

SEQ ID NO: 103680 - DNA, 22 bp, Homo sapiens
agtccgtcctgtcaagcagctg

SEQ ID NO: 103681 - DNA, 22 bp, Homo sapiens
cttgcctttgtcttcaaaggct

SEQ ID NO: 103682 - DNA, 22 bp, Homo sapiens
acatccgcaggttataaagccc

SEQ ID NO: 103683 - DNA, 22 bp, Homo sapiens
ctttttcctcgtagagcctaat

SEQ ID NO: 103684 - DNA, 22 bp, Homo sapiens
tgcacgtgggctctctgctctt

SEQ ID NO: 103685 - DNA, 22 bp, Homo sapiens
agcttgtgctggaattacatgt

SEQ ID NO: 103686 - DNA, 22 bp, Homo sapiens
cttgtattaggaagaatgcttt

SEQ ID NO: 103687 - DNA, 18 bp, Homo sapiens
gatcgggggcgccccaag

SEQ ID NO: 103688 - DNA, 22 bp, Homo sapiens
tatgttgcaccaacctaataat

SEQ ID NO: 103689 - DNA, 22 bp, Homo sapiens
gagaaatatggctcagttccac

SEQ ID NO: 103690 - DNA, 23 bp, Homo sapiens
agagtgcagagatatgcttgtgt

SEQ ID NO: 103691 - DNA, 22 bp, Homo sapiens
gttgctcaggcaggagtacagt

SEQ ID NO: 103692 - DNA, 22 bp, Homo sapiens
gcagctgacatctggctgggcc

SEQ ID NO: 103693 - DNA, 22 bp, Homo sapiens
tctcatggagtcaggagcagaa

SEQ ID NO: 103694 - DNA, 22 bp, Homo sapiens
cgggaaggtggaggttgcagtg

SEQ ID NO: 103695 - DNA, 22 bp, Homo sapiens
atgccactgcactccagcctag

SEQ ID NO: 103696 - DNA, 21 bp, Homo sapiens
gctctgtgttacaagttgggg

SEQ ID NO: 103697 - DNA, 22 bp, Homo sapiens
tagtttaggatccaatctaaga

SEQ ID NO: 103698 - DNA, 22 bp, Homo sapiens
ccctcgtgcatccatcatttag

SEQ ID NO: 103699 - DNA, 22 bp, Homo sapiens
gcctccccaagcagcagggatt

SEQ ID NO: 103700 - DNA, 22 bp, Homo sapiens
atgtcttctctgtaggtaaatt

SEQ ID NO: 103701 - DNA, 22 bp, Homo sapiens
ggggctgaacctggaggtggtc

SEQ ID NO: 103702 - DNA, 21 bp, Homo sapiens
ctggccactgcacctcttcct

SEQ ID NO: 103703 - DNA, 22 bp, Homo sapiens
gcgagtgccgagagggcagggc

SEQ ID NO: 103704 - DNA, 22 bp, Homo sapiens
gttgaggtgatgccagccctgc

SEQ ID NO: 103705 - DNA, 22 bp, Homo sapiens
acaaacagagttgaaaaatagg

SEQ ID NO: 103706 - DNA, 22 bp, Homo sapiens
aggtaaagacagtgaaagaggg

SEQ ID NO: 103707 - DNA, 22 bp, Homo sapiens
aaacatggccattcagactgtg

SEQ ID NO: 103708 - DNA, 22 bp, Homo sapiens
tcccagaaccctgccaggtcct

SEQ ID NO: 103709 - DNA, 22 bp, Homo sapiens
tgtcctgtgattccagctcttc

SEQ ID NO: 103710 - DNA, 22 bp, Homo sapiens
tccctgcaggtgtgcaagctga

SEQ ID NO: 103711 - DNA, 19 bp, Homo sapiens
ccatggcaatgatctgatg

SEQ ID NO: 103712 - DNA, 22 bp, Homo sapiens
cgacgggctcggtccgcttcct

SEQ ID NO: 103713 - DNA, 22 bp, Homo sapiens
gcagagatctgagaaggctgcc

SEQ ID NO: 103714 - DNA, 22 bp, Homo sapiens
gcagagctcatgcctgcacctc

SEQ ID NO: 103715 - DNA, 22 bp, Homo sapiens
ttgggacagctgtggtagtgag

SEQ ID NO: 103716 - DNA, 22 bp, Homo sapiens
tctcgacagcctggcacagtgg

SEQ ID NO: 103717 - DNA, 22 bp, Homo sapiens
aagaagagaactggcatcctaa

SEQ ID NO: 103718 - DNA, 22 bp, Homo sapiens
tctctcaggctggagtgcagtg

SEQ ID NO: 103719 - DNA, 22 bp, Homo sapiens
ggcggcttattcactctgggga

SEQ ID NO: 103720 - DNA, 22 bp, Homo sapiens
gtgcacttgatctagacagatt

SEQ ID NO: 103721 - DNA, 22 bp, Homo sapiens
cactgcactccagcctgggtca

SEQ ID NO: 103722 - DNA, 22 bp, Homo sapiens
tttgaacagtagcttaggtgtg

SEQ ID NO: 103723 - DNA, 22 bp, Homo sapiens
cccaggaggcagatgttgcagt

SEQ ID NO: 103724 - DNA, 22 bp, Homo sapiens
taaatacttagttttgtgtcta

SEQ ID NO: 103725 - DNA, 22 bp, Homo sapiens
tcgctgaggctgcacggctgcc

SEQ ID NO: 103726 - DNA, 22 bp, Homo sapiens
tctagctctgcttatcatggct

SEQ ID NO: 103727 - DNA, 22 bp, Homo sapiens
actgcaaagggaagccctttct

SEQ ID NO: 103728 - DNA, 22 bp, Homo sapiens
agccggccatgtggtcttgtgc

SEQ ID NO: 103729 - DNA, 22 bp, Homo sapiens
tggaagactcaaggtggtgaat

SEQ ID NO: 103730 - DNA, 20 bp, Homo sapiens
aggaaaaatggaaactggag

SEQ ID NO: 103731 - DNA, 22 bp, Homo sapiens
tctggtgtcagtattctttgaa

SEQ ID NO: 103732 - DNA, 22 bp, Homo sapiens
aaaggctttaaaatgtacatat

SEQ ID NO: 103733 - DNA, 22 bp, Homo sapiens
ctgtccctgagcaactcctgtt

SEQ ID NO: 103734 - DNA, 22 bp, Homo sapiens
aggagggtgggaagcagtttta

SEQ ID NO: 103735 - DNA, 21 bp, Homo sapiens
tagcccttctccacctcgccc

SEQ ID NO: 103736 - DNA, 23 bp, Homo sapiens
ctcctcgtaactctgtggtgggt

SEQ ID NO: 103737 - DNA, 22 bp, Homo sapiens
tggtattctttctgtagatcat

SEQ ID NO: 103738 - DNA, 22 bp, Homo sapiens
gtagtctgaacagtaattttgt

SEQ ID NO: 103739 - DNA, 22 bp, Homo sapiens
ttctgtgaatcttttttcccac

SEQ ID NO: 103740 - DNA, 22 bp, Homo sapiens
tattgtgaatagtgccgcaata

SEQ ID NO: 103741 - DNA, 22 bp, Homo sapiens
aataaaatggtcagttttctca

SEQ ID NO: 103742 - DNA, 22 bp, Homo sapiens
tgaggcacaggcagtgcccccg

SEQ ID NO: 103743 - DNA, 19 bp, Homo sapiens
ggagccgccgcccttcatt

SEQ ID NO: 103744 - DNA, 22 bp, Homo sapiens
atggtggacgggagacaggact

SEQ ID NO: 103745 - DNA, 22 bp, Homo sapiens
tcttgggcatgtgtttgatttc

SEQ ID NO: 103746 - DNA, 22 bp, Homo sapiens
ttcataaacaaattaaggcctg

SEQ ID NO: 103747 - DNA, 22 bp, Homo sapiens
aggctggagtgcagtggtgtga

SEQ ID NO: 103748 - DNA, 22 bp, Homo sapiens
ttcagaagagacactgtgacag

SEQ ID NO: 103749 - DNA, 22 bp, Homo sapiens
aagcatttcaggtagagatatt

SEQ ID NO: 103750 - DNA, 21 bp, Homo sapiens
tcttttctcagctttgtggtt

SEQ ID NO: 103751 - DNA, 22 bp, Homo sapiens
aggggctcctttgtgctgcgtc

SEQ ID NO: 103752 - DNA, 22 bp, Homo sapiens
ggccctgggccctctagcttgt

SEQ ID NO: 103753 - DNA, 22 bp, Homo sapiens
gaactttgcgcagttcccgggg

SEQ ID NO: 103754 - DNA, 22 bp, Homo sapiens
aagagactgtaaaggcgtgagt

SEQ ID NO: 103755 - DNA, 19 bp, Homo sapiens
gttttgcaggcagagggga

SEQ ID NO: 103756 - DNA, 22 bp, Homo sapiens
acccaggagacggaggtgcagt

SEQ ID NO: 103757 - DNA, 19 bp, Homo sapiens
ccacagcctgctgtcttcc

SEQ ID NO: 103758 - DNA, 22 bp, Homo sapiens
ttggttttgaaatagcttattg

SEQ ID NO: 103759 - DNA, 22 bp, Homo sapiens
cttctttcaagaatggattagg

SEQ ID NO: 103760 - DNA, 22 bp, Homo sapiens
ctcattgcaacctccgcctccc

SEQ ID NO: 103761 - DNA, 22 bp, Homo sapiens
aaacttttttaggttcataggc

SEQ ID NO: 103762 - DNA, 21 bp, Homo sapiens
cagtggcacgatttcggctca

SEQ ID NO: 103763 - DNA, 22 bp, Homo sapiens
tgaccacattgatttctcatcc

SEQ ID NO: 103764 - DNA, 22 bp, Homo sapiens
accctggaggtggaggtgcagt

SEQ ID NO: 103765 - DNA, 22 bp, Homo sapiens
agaaggggcccaaggatgtcag

SEQ ID NO: 103766 - DNA, 21 bp, Homo sapiens
ttgttcctatctgcctcctgc

SEQ ID NO: 103767 - DNA, 22 bp, Homo sapiens
tctttcttgtgggtgccctttt

SEQ ID NO: 103768 - DNA, 22 bp, Homo sapiens
gggagagtagctggaaggttct

SEQ ID NO: 103769 - DNA, 22 bp, Homo sapiens
ttatagcagcatgatttataat

SEQ ID NO: 103770 - DNA, 23 bp, Homo sapiens
agagcaaggaaatgaggtgtgat

SEQ ID NO: 103771 - DNA, 22 bp, Homo sapiens
agaacgtggaatgtggctcctt

SEQ ID NO: 103772 - DNA, 22 bp, Homo sapiens
ggtgaggggctcctctgcccgg

SEQ ID NO: 103773 - DNA, 22 bp, Homo sapiens
atacttctttagcatattgaac

SEQ ID NO: 103774 - DNA, 22 bp, Homo sapiens
atctggttttggctgtgtccct

SEQ ID NO: 103775 - DNA, 22 bp, Homo sapiens
tttggaaattttcatccagaca

SEQ ID NO: 103776 - DNA, 22 bp, Homo sapiens
atattagtttggagactacaat

SEQ ID NO: 103777 - DNA, 22 bp, Homo sapiens
agcctgggcaacagagcaaaac

SEQ ID NO: 103778 - DNA, 22 bp, Homo sapiens
agccaggatggtctcgatcggc

SEQ ID NO: 103779 - DNA, 22 bp, Homo sapiens
cttgccttcagtccatcagtca

SEQ ID NO: 103780 - DNA, 22 bp, Homo sapiens
accacctcatcaagctggattg

SEQ ID NO: 103781 - DNA, 22 bp, Homo sapiens
attttctctttgtatatgctag

SEQ ID NO: 103782 - DNA, 22 bp, Homo sapiens
aggagagctggtgtctggaatc

SEQ ID NO: 103783 - DNA, 22 bp, Homo sapiens
gtcagaggggcagctgccaggc

SEQ ID NO: 103784 - DNA, 22 bp, Homo sapiens
acaattctgatggtttcccagt

SEQ ID NO: 103785 - DNA, 22 bp, Homo sapiens
gctttgcccctttagtgggtgc

SEQ ID NO: 103786 - DNA, 22 bp, Homo sapiens
cctcccggatcatgtcccgcac

SEQ ID NO: 103787 - DNA, 22 bp, Homo sapiens
tgctggaagggtcggcgtgggc

SEQ ID NO: 103788 - DNA, 22 bp, Homo sapiens
actgcattctttatcccacaac

SEQ ID NO: 103789 - DNA, 22 bp, Homo sapiens
aagtggcagttcaggaagcaga

SEQ ID NO: 103790 - DNA, 22 bp, Homo sapiens
tagcagtgtctaggtaggccat

SEQ ID NO: 103791 - DNA, 22 bp, Homo sapiens
attggtagttttgtatttctct

SEQ ID NO: 103792 - DNA, 22 bp, Homo sapiens
aggcaggaaaatcgcttgaacc

SEQ ID NO: 103793 - DNA, 22 bp, Homo sapiens
actgcatttgtctgtctcaatt

SEQ ID NO: 103794 - DNA, 22 bp, Homo sapiens
agctcaatgcaacctccgcctc

SEQ ID NO: 103795 - DNA, 22 bp, Homo sapiens
gggcaggggtcagtggccccaa

SEQ ID NO: 103796 - DNA, 22 bp, Homo sapiens
cctgggccctcaccgccggtgg

SEQ ID NO: 103797 - DNA, 22 bp, Homo sapiens
ctgcagtcatctgaagattttg

SEQ ID NO: 103798 - DNA, 22 bp, Homo sapiens
gaggtgggcggatcacaaggtc

SEQ ID NO: 103799 - DNA, 22 bp, Homo sapiens
tctgtgcctgcttccccaccca

SEQ ID NO: 103800 - DNA, 18 bp, Homo sapiens
agagtatacagacaacaa

SEQ ID NO: 103801 - DNA, 22 bp, Homo sapiens
attttttgttaactcaggatag

SEQ ID NO: 103802 - DNA, 22 bp, Homo sapiens
caggtgagaggcggtcctgcat

SEQ ID NO: 103803 - DNA, 22 bp, Homo sapiens
tgtgttaaggtgcatctagtgc

SEQ ID NO: 103804 - DNA, 21 bp, Homo sapiens
ttagaagctaatgcagctggt

SEQ ID NO: 103805 - DNA, 22 bp, Homo sapiens
cagctgttcattgttgccaccc

SEQ ID NO: 103806 - DNA, 22 bp, Homo sapiens
aatgtgttgaataaattgtgcc

SEQ ID NO: 103807 - DNA, 22 bp, Homo sapiens
tgggggagctcagtccagccca

SEQ ID NO: 103808 - DNA, 22 bp, Homo sapiens
ttacaattacttgatctcagct

SEQ ID NO: 103809 - DNA, 22 bp, Homo sapiens
ggggtccctgcaccagcatgtc

SEQ ID NO: 103810 - DNA, 22 bp, Homo sapiens
gaggcaaagcatgtggctcagg

SEQ ID NO: 103811 - DNA, 22 bp, Homo sapiens
tgttcctctgaacttcttccaa

SEQ ID NO: 103812 - DNA, 22 bp, Homo sapiens
tcccagctactctagaggctga

SEQ ID NO: 103813 - DNA, 22 bp, Homo sapiens
ctgaggggtcgtgggagcccag

SEQ ID NO: 103814 - DNA, 22 bp, Homo sapiens
ccatgaattcactccatgctag

SEQ ID NO: 103815 - DNA, 22 bp, Homo sapiens
tcttggattttaatggatcaaa

SEQ ID NO: 103816 - DNA, 23 bp, Homo sapiens
gcctgggagttgcgatctgcccg

SEQ ID NO: 103817 - DNA, 22 bp, Homo sapiens
tggtatttctgtgcccagctca

SEQ ID NO: 103818 - DNA, 22 bp, Homo sapiens
gtggcatctcagaggccaagaa

SEQ ID NO: 103819 - DNA, 22 bp, Homo sapiens
actgcaacacctcctgggttca

SEQ ID NO: 103820 - DNA, 22 bp, Homo sapiens
tcctgagataaatctcatgtga

SEQ ID NO: 103821 - DNA, 17 bp, Homo sapiens
cttcccaccatctcctg

SEQ ID NO: 103822 - DNA, 22 bp, Homo sapiens
ggcctctcttgggacagctgtc

SEQ ID NO: 103823 - DNA, 22 bp, Homo sapiens
cagaagactgcagggaagggac

SEQ ID NO: 103824 - DNA, 22 bp, Homo sapiens
cctgtaatctcagctactcggg

SEQ ID NO: 103825 - DNA, 21 bp, Homo sapiens
tttcttaggctctaaaatgac

SEQ ID NO: 103826 - DNA, 22 bp, Homo sapiens
gctcagacctgtaatcttagca

SEQ ID NO: 103827 - DNA, 22 bp, Homo sapiens
cactaggcgccgggtggctgtg

SEQ ID NO: 103828 - DNA, 22 bp, Homo sapiens
gagaaatgcatgcatgtcatca

SEQ ID NO: 103829 - DNA, 23 bp, Homo sapiens
aaaacagcttcctccagtggctc

SEQ ID NO: 103830 - DNA, 21 bp, Homo sapiens
tgtaagtttcatctgaattgg

SEQ ID NO: 103831 - DNA, 22 bp, Homo sapiens
gcaaacaaggacatacatcctg

SEQ ID NO: 103832 - DNA, 22 bp, Homo sapiens
acaatgaagctccactgagctt

SEQ ID NO: 103833 - DNA, 22 bp, Homo sapiens
atcagtgtgtcaaaagcacaaa

SEQ ID NO: 103834 - DNA, 22 bp, Homo sapiens
ggacttcttgggcctgcaggga

SEQ ID NO: 103835 - DNA, 22 bp, Homo sapiens
aggctatttccactcttctcat

SEQ ID NO: 103836 - DNA, 22 bp, Homo sapiens
cattccttaacgtggggagtct

SEQ ID NO: 103837 - DNA, 22 bp, Homo sapiens
ctcgggcaccctggttctggtg

SEQ ID NO: 103838 - DNA, 22 bp, Homo sapiens
tacaggcatgtagcatggtgat

SEQ ID NO: 103839 - DNA, 22 bp, Homo sapiens
agctggaagtgcatttctcact

SEQ ID NO: 103840 - DNA, 22 bp, Homo sapiens
tcttaagcagagaagaagttga

SEQ ID NO: 103841 - DNA, 22 bp, Homo sapiens
cggctgggttcggctgcaggcc

SEQ ID NO: 103842 - DNA, 22 bp, Homo sapiens
ggcctgcctcacagtcagcacc

SEQ ID NO: 103843 - DNA, 22 bp, Homo sapiens
tacgggcacgcaccacgatgcc

SEQ ID NO: 103844 - DNA, 22 bp, Homo sapiens
gtgtggaatggagtttttgccc

SEQ ID NO: 103845 - DNA, 22 bp, Homo sapiens
ggccgtgctccaaagtcatcgt

SEQ ID NO: 103846 - DNA, 22 bp, Homo sapiens
acatctagactcttgccctctt

SEQ ID NO: 103847 - DNA, 22 bp, Homo sapiens
gggctgactcctattggatgaa

SEQ ID NO: 103848 - DNA, 22 bp, Homo sapiens
tgcccagggtggagtgcagtgg

SEQ ID NO: 103849 - DNA, 22 bp, Homo sapiens
ctctcagtcctgcgcgcctctg

SEQ ID NO: 103850 - DNA, 22 bp, Homo sapiens
gagacgtggcctttgcctgagc

SEQ ID NO: 103851 - DNA, 23 bp, Homo sapiens
aggtaggttattgctgctacctg

SEQ ID NO: 103852 - DNA, 22 bp, Homo sapiens
tttgccctttctgagcctcatc

SEQ ID NO: 103853 - DNA, 22 bp, Homo sapiens
aggccaggaatccttgtcccag

SEQ ID NO: 103854 - DNA, 22 bp, Homo sapiens
ctgtcctgccagtcctggactc

SEQ ID NO: 103855 - DNA, 22 bp, Homo sapiens
gcctcctgtcccaggctgagga

SEQ ID NO: 103856 - DNA, 21 bp, Homo sapiens
tgaaggggtggcagtgtgctt

SEQ ID NO: 103857 - DNA, 22 bp, Homo sapiens
agatttggtgtctggttgatat

SEQ ID NO: 103858 - DNA, 22 bp, Homo sapiens
tgtgcatgtttgttttcagggt

SEQ ID NO: 103859 - DNA, 21 bp, Homo sapiens
tttgtggaattctcactcttc

SEQ ID NO: 103860 - DNA, 22 bp, Homo sapiens
gggtctcctaatggaggatgac

SEQ ID NO: 103861 - DNA, 22 bp, Homo sapiens
gaccttcttgctgtgtcctaac

SEQ ID NO: 103862 - DNA, 22 bp, Homo sapiens
gcaagtgaatgaggttgagatt

SEQ ID NO: 103863 - DNA, 22 bp, Homo sapiens
actgcaacctccacctcctggg

SEQ ID NO: 103864 - DNA, 22 bp, Homo sapiens
catgatggctcatgcttgtaat

SEQ ID NO: 103865 - DNA, 22 bp, Homo sapiens
agtgactggtgtgaagttaaat

SEQ ID NO: 103866 - DNA, 22 bp, Homo sapiens
aataaacaaatccttccttccc

SEQ ID NO: 103867 - DNA, 22 bp, Homo sapiens
gcaggtctatcaggctgcaggt

SEQ ID NO: 103868 - DNA, 22 bp, Homo sapiens
aggaaagcttggcaaactaaat

SEQ ID NO: 103869 - DNA, 22 bp, Homo sapiens
acagtccagcctagtatgtata

SEQ ID NO: 103870 - DNA, 22 bp, Homo sapiens
gtgaaatatttaacgtccaggt

SEQ ID NO: 103871 - DNA, 22 bp, Homo sapiens
tcccccaggctggagtgcagtg

SEQ ID NO: 103872 - DNA, 22 bp, Homo sapiens
gacttttgaataaggtaggata

SEQ ID NO: 103873 - DNA, 18 bp, Homo sapiens
tcttccaacactgacacc

SEQ ID NO: 103874 - DNA, 22 bp, Homo sapiens
aggcaagggggcgccaccttcc

SEQ ID NO: 103875 - DNA, 22 bp, Homo sapiens
gagctgaaggagaaagcagggg

SEQ ID NO: 103876 - DNA, 22 bp, Homo sapiens
tggattcacaccattctcctgc

SEQ ID NO: 103877 - DNA, 22 bp, Homo sapiens
tgatgggaggtgctgcaggacc

SEQ ID NO: 103878 - DNA, 22 bp, Homo sapiens
tggctaggctggtgtcaagctc

SEQ ID NO: 103879 - DNA, 22 bp, Homo sapiens
gaagccttgaactgcaaacccc

SEQ ID NO: 103880 - DNA, 22 bp, Homo sapiens
tctcaagcttgttggtatgttt

SEQ ID NO: 103881 - DNA, 22 bp, Homo sapiens
tgtccaggctggagtgcagtgg

SEQ ID NO: 103882 - DNA, 22 bp, Homo sapiens
tcccagagctctggaggttgga

SEQ ID NO: 103883 - DNA, 22 bp, Homo sapiens
tcgcccaggctggaagtgcagt

SEQ ID NO: 103884 - DNA, 22 bp, Homo sapiens
ggggatggaggcgtgtggtcct

SEQ ID NO: 103885 - DNA, 22 bp, Homo sapiens
atgaaaacggaccagagctatt

SEQ ID NO: 103886 - DNA, 22 bp, Homo sapiens
tgtgggagaaggaagcaagctg

SEQ ID NO: 103887 - DNA, 22 bp, Homo sapiens
tgaaatcttcactaagtctctt

SEQ ID NO: 103888 - DNA, 22 bp, Homo sapiens
gaatgctaagcatgtgggagtt

SEQ ID NO: 103889 - DNA, 22 bp, Homo sapiens
gaaacactcaatttagtaattc

SEQ ID NO: 103890 - DNA, 22 bp, Homo sapiens
gttttgaatactactagaactt

SEQ ID NO: 103891 - DNA, 22 bp, Homo sapiens
tatttaataaaactatggcatg

SEQ ID NO: 103892 - DNA, 22 bp, Homo sapiens
agcaccgttcaaacccaggtta

SEQ ID NO: 103893 - DNA, 22 bp, Homo sapiens
ctgcatccatgttgctgcaaag

SEQ ID NO: 103894 - DNA, 22 bp, Homo sapiens
cacgttaacagctaacagatga

SEQ ID NO: 103895 - DNA, 22 bp, Homo sapiens
tcttttgtgattctttagttac

SEQ ID NO: 103896 - DNA, 22 bp, Homo sapiens
atgatgtaaaataagttgtgag

SEQ ID NO: 103897 - DNA, 22 bp, Homo sapiens
gctgcagacttctcatctcatt

SEQ ID NO: 103898 - DNA, 22 bp, Homo sapiens
attgtggtgtcagttataggca

SEQ ID NO: 103899 - DNA, 17 bp, Homo sapiens
agtttttggacctgtgt

SEQ ID NO: 103900 - DNA, 19 bp, Homo sapiens
ctgtccttggctgcactgt

SEQ ID NO: 103901 - DNA, 22 bp, Homo sapiens
taaatgttttgtgggttgagtt

SEQ ID NO: 103902 - DNA, 22 bp, Homo sapiens
ggaggtgactggatcatgggca

SEQ ID NO: 103903 - DNA, 22 bp, Homo sapiens
agccaccaccactgaaaggtta

SEQ ID NO: 103904 - DNA, 22 bp, Homo sapiens
atggggctgttctctgccctgc

SEQ ID NO: 103905 - DNA, 22 bp, Homo sapiens
accctctagagggaagcacttt

SEQ ID NO: 103906 - DNA, 22 bp, Homo sapiens
ggccagcctggggctcccagac

SEQ ID NO: 103907 - DNA, 22 bp, Homo sapiens
acgcccagactcccatactttg

SEQ ID NO: 103908 - DNA, 22 bp, Homo sapiens
accaggcccgctgctatggtgg

SEQ ID NO: 103909 - DNA, 22 bp, Homo sapiens
tttaaaaaactagtctgagtct

SEQ ID NO: 103910 - DNA, 22 bp, Homo sapiens
tactttaatatatgtgaagttc

SEQ ID NO: 103911 - DNA, 22 bp, Homo sapiens
cggctcactgcagctccgcctc

SEQ ID NO: 103912 - DNA, 22 bp, Homo sapiens
atgtgctgagtgtgtatataca

SEQ ID NO: 103913 - DNA, 22 bp, Homo sapiens
gtcatcttgctgttttagatct

SEQ ID NO: 103914 - DNA, 22 bp, Homo sapiens
cctctgtgtgatgcgcaaagta

SEQ ID NO: 103915 - DNA, 22 bp, Homo sapiens
tctgttgcaatgtgcatggtga

SEQ ID NO: 103916 - DNA, 22 bp, Homo sapiens
acactgtgtgacttctgagact

SEQ ID NO: 103917 - DNA, 23 bp, Homo sapiens
ctggggctttcaaatctgggcag

SEQ ID NO: 103918 - DNA, 22 bp, Homo sapiens
ggggccgaccgcggttcaggcc

SEQ ID NO: 103919 - DNA, 22 bp, Homo sapiens
tgatcaaaacattactccacca

SEQ ID NO: 103920 - DNA, 22 bp, Homo sapiens
tgacttcctgcactcaggtgat

SEQ ID NO: 103921 - DNA, 22 bp, Homo sapiens
cgctccttgagcgtgtcggcct

SEQ ID NO: 103922 - DNA, 22 bp, Homo sapiens
aaagcgcttccctttggagcgt

SEQ ID NO: 103923 - DNA, 22 bp, Homo sapiens
agtcaaagatgaccgagttcct

SEQ ID NO: 103924 - DNA, 22 bp, Homo sapiens
gaacgggtgcagccatgggccc

SEQ ID NO: 103925 - DNA, 22 bp, Homo sapiens
tttcttctatgtgtgatatttt

SEQ ID NO: 103926 - DNA, 22 bp, Homo sapiens
ctccaacgaggctggggtacaa

SEQ ID NO: 103927 - DNA, 22 bp, Homo sapiens
tataccatgtgtgcacactccc

SEQ ID NO: 103928 - DNA, 22 bp, Homo sapiens
acaccatactcatgttggttcc

SEQ ID NO: 103929 - DNA, 22 bp, Homo sapiens
acatagttgatgagcgtgtacg

SEQ ID NO: 103930 - DNA, 22 bp, Homo sapiens
ccatcacagtccccatcgtgat

SEQ ID NO: 103931 - DNA, 22 bp, Homo sapiens
acccaggctggagtgcagtggc

SEQ ID NO: 103932 - DNA, 22 bp, Homo sapiens
tgtggcacatacacaggagggc

SEQ ID NO: 103933 - DNA, 22 bp, Homo sapiens
ccctcccagatgggcttgaggt

SEQ ID NO: 103934 - DNA, 22 bp, Homo sapiens
tcctccccaaagcccagcctgg

SEQ ID NO: 103935 - DNA, 22 bp, Homo sapiens
actgtgaacggactgaagccca

SEQ ID NO: 103936 - DNA, 22 bp, Homo sapiens
ctggagcaaaagtgactcctct

SEQ ID NO: 103937 - DNA, 22 bp, Homo sapiens
tggtggctcacgtctgtaatct

SEQ ID NO: 103938 - DNA, 22 bp, Homo sapiens
agcccggcttccccggttgcta

SEQ ID NO: 103939 - DNA, 22 bp, Homo sapiens
agggaagcagcagccgcctgtc

SEQ ID NO: 103940 - DNA, 22 bp, Homo sapiens
tgcaggctcttggtgacgtggg

SEQ ID NO: 103941 - DNA, 22 bp, Homo sapiens
caggtggcagtgcctgcattct

SEQ ID NO: 103942 - DNA, 22 bp, Homo sapiens
taaggctatcttttgagtgtgt

SEQ ID NO: 103943 - DNA, 22 bp, Homo sapiens
tagcccaggctggagtgcaggg

SEQ ID NO: 103944 - DNA, 22 bp, Homo sapiens
tgggtgtccagaccctgcacat

SEQ ID NO: 103945 - DNA, 22 bp, Homo sapiens
ggggtgtggacggctgtgccag

SEQ ID NO: 103946 - DNA, 22 bp, Homo sapiens
aggcaatcccctgaggatactt

SEQ ID NO: 103947 - DNA, 22 bp, Homo sapiens
tcagaacctcctagcagtgttc

SEQ ID NO: 103948 - DNA, 23 bp, Homo sapiens
tctctgcatgtcctgagcacatc

SEQ ID NO: 103949 - DNA, 22 bp, Homo sapiens
aactcctctctggtggttcgtc

SEQ ID NO: 103950 - DNA, 23 bp, Homo sapiens
aacgacagctacaggcatcccac

SEQ ID NO: 103951 - DNA, 22 bp, Homo sapiens
ttatagcagcatgatttatagt

SEQ ID NO: 103952 - DNA, 22 bp, Homo sapiens
cacctgtacagggccgggctgg

SEQ ID NO: 103953 - DNA, 22 bp, Homo sapiens
aacccgagggccccaggctcgg

SEQ ID NO: 103954 - DNA, 22 bp, Homo sapiens
tggtggctaccaggtcctgggg

SEQ ID NO: 103955 - DNA, 22 bp, Homo sapiens
aaagtgcttctctttggtgggt

SEQ ID NO: 103956 - DNA, 22 bp, Homo sapiens
tggtggctcacacctgtaatcc

SEQ ID NO: 103957 - DNA, 20 bp, Homo sapiens
tagcatgggtgagggtagag

SEQ ID NO: 103958 - DNA, 22 bp, Homo sapiens
gtccaggcctgcctctgaggag

SEQ ID NO: 103959 - DNA, 22 bp, Homo sapiens
agctggtgtgccagttccagtt

SEQ ID NO: 103960 - DNA, 22 bp, Homo sapiens
gatgaggcataaacacagtcac

SEQ ID NO: 103961 - DNA, 20 bp, Homo sapiens
tgcagcacgggccctttcca

SEQ ID NO: 103962 - DNA, 23 bp, Homo sapiens
acagtcgtaggtatccttttcct

SEQ ID NO: 103963 - DNA, 23 bp, Homo sapiens
ggctgggagctccgggtgcacgt

SEQ ID NO: 103964 - DNA, 22 bp, Homo sapiens
tggagagttctgtagatatcta

SEQ ID NO: 103965 - DNA, 22 bp, Homo sapiens
gtaggccatggtggttgtctct

SEQ ID NO: 103966 - DNA, 22 bp, Homo sapiens
ttacatgtggtgtgaagaagag

SEQ ID NO: 103967 - DNA, 22 bp, Homo sapiens
gacccttagaatgtgatcttat

SEQ ID NO: 103968 - DNA, 22 bp, Homo sapiens
tccctagtcgcatctgtggaga

SEQ ID NO: 103969 - DNA, 22 bp, Homo sapiens
tctaccctgcggtcttggggca

SEQ ID NO: 103970 - DNA, 22 bp, Homo sapiens
agcttgggcaacacagcaagac

SEQ ID NO: 103971 - DNA, 22 bp, Homo sapiens
tgaggcaggagaatcacatgaa

SEQ ID NO: 103972 - DNA, 22 bp, Homo sapiens
cagcagagaaattacatatttg

SEQ ID NO: 103973 - DNA, 21 bp, Homo sapiens
cgcagagcgaacttgcggcgc

SEQ ID NO: 103974 - DNA, 22 bp, Homo sapiens
ctgcgtggtaggactcagttct

SEQ ID NO: 103975 - DNA, 22 bp, Homo sapiens
tctgtgaagctctgaacagcag

SEQ ID NO: 103976 - DNA, 22 bp, Homo sapiens
cactgcaacctccacctcctgg

SEQ ID NO: 103977 - DNA, 22 bp, Homo sapiens
ttcagagaattggataattcgt

SEQ ID NO: 103978 - DNA, 22 bp, Homo sapiens
ggaggctgagaggtcgcagtgg

SEQ ID NO: 103979 - DNA, 22 bp, Homo sapiens
gaatttaagaggatgaatctgt

SEQ ID NO: 103980 - DNA, 22 bp, Homo sapiens
aggccagcctcaggcagggacc

SEQ ID NO: 103981 - DNA, 22 bp, Homo sapiens
ctcactgcaagctcagcctccc

SEQ ID NO: 103982 - DNA, 22 bp, Homo sapiens
cgcaggtgaaagaggctgggca

SEQ ID NO: 103983 - DNA, 22 bp, Homo sapiens
ctctccattccctacagttttc

SEQ ID NO: 103984 - DNA, 22 bp, Homo sapiens
tgaaggtggctgtttgtgcata

SEQ ID NO: 103985 - DNA, 22 bp, Homo sapiens
agcgctgtgggcgtgcgaggag

SEQ ID NO: 103986 - DNA, 20 bp, Homo sapiens
agcagagtgcccatcccgga

SEQ ID NO: 103987 - DNA, 22 bp, Homo sapiens
cttagctgcgggccctcctcgc

SEQ ID NO: 103988 - DNA, 22 bp, Homo sapiens
atccaccctgtggtggctttct

SEQ ID NO: 103989 - DNA, 22 bp, Homo sapiens
agccaagcactcaactcctgga

SEQ ID NO: 103990 - DNA, 21 bp, Homo sapiens
aggcatgagccctgcatggac

SEQ ID NO: 103991 - DNA, 17 bp, Homo sapiens
gattagagaactaagga

SEQ ID NO: 103992 - DNA, 22 bp, Homo sapiens
atttgtgggactataatgcagg

SEQ ID NO: 103993 - DNA, 20 bp, Homo sapiens
tcccccactgtttctgctac

SEQ ID NO: 103994 - DNA, 22 bp, Homo sapiens
tcaccgccttgcccggccgggc

SEQ ID NO: 103995 - DNA, 21 bp, Homo sapiens
tccctgagcccaaggggctcc

SEQ ID NO: 103996 - DNA, 22 bp, Homo sapiens
tctctttgcctgctgccatcca

SEQ ID NO: 103997 - DNA, 22 bp, Homo sapiens
gggagtgggtttggcctaggcc

SEQ ID NO: 103998 - DNA, 22 bp, Homo sapiens
gtacaaatgcaggtttgttaca

SEQ ID NO: 103999 - DNA, 22 bp, Homo sapiens
ggtgttcaaatgaacacatgca

SEQ ID NO: 104000 - DNA, 22 bp, Homo sapiens
gtcgtggagctcacagtgtgcc

SEQ ID NO: 104001 - DNA, 22 bp, Homo sapiens
tgggctgcaggggttgagagct

SEQ ID NO: 104002 - DNA, 22 bp, Homo sapiens
ggtcagccttggatttggtagc

SEQ ID NO: 104003 - DNA, 22 bp, Homo sapiens
aatcaactgagccctggttctc

SEQ ID NO: 104004 - DNA, 22 bp, Homo sapiens
tctgagaatggtggatgtggtg

SEQ ID NO: 104005 - DNA, 22 bp, Homo sapiens
tcggagctgtagatgaaaccct

SEQ ID NO: 104006 - DNA, 22 bp, Homo sapiens
ccaaagctggctttcatggttt

SEQ ID NO: 104007 - DNA, 22 bp, Homo sapiens
gcagcctgggcaacagagtgag

SEQ ID NO: 104008 - DNA, 22 bp, Homo sapiens
agttcgagatctgctgatgaga

SEQ ID NO: 104009 - DNA, 22 bp, Homo sapiens
tcccctctttctggaaacacaa

SEQ ID NO: 104010 - DNA, 22 bp, Homo sapiens
tcctttgcttctgtcattctcc

SEQ ID NO: 104011 - DNA, 22 bp, Homo sapiens
ttgcacatctaataatgctaga

SEQ ID NO: 104012 - DNA, 22 bp, Homo sapiens
ctccaggccatggctgcggagg

SEQ ID NO: 104013 - DNA, 22 bp, Homo sapiens
tcttgggggactttggcatgga

SEQ ID NO: 104014 - DNA, 22 bp, Homo sapiens
tatacactgttgttgggagtct

SEQ ID NO: 104015 - DNA, 22 bp, Homo sapiens
tgaactcctgacctcatgatcc

SEQ ID NO: 104016 - DNA, 18 bp, Homo sapiens
tttctcagactctctttc

SEQ ID NO: 104017 - DNA, 22 bp, Homo sapiens
ctgctctgctgatcagtgtctc

SEQ ID NO: 104018 - DNA, 22 bp, Homo sapiens
cacagacagtgtccctttgttg

SEQ ID NO: 104019 - DNA, 22 bp, Homo sapiens
agagcaattctcaaggaggtgt

SEQ ID NO: 104020 - DNA, 22 bp, Homo sapiens
gattcactcatattttacgttt

SEQ ID NO: 104021 - DNA, 22 bp, Homo sapiens
accctccccaagaggtcgtgcc

SEQ ID NO: 104022 - DNA, 22 bp, Homo sapiens
gtgattttctcctcctagaagt

SEQ ID NO: 104023 - DNA, 22 bp, Homo sapiens
cgcccaggctggagagcagtgg

SEQ ID NO: 104024 - DNA, 22 bp, Homo sapiens
gcaactgaacatgtgtgtggcc

SEQ ID NO: 104025 - DNA, 21 bp, Homo sapiens
cagagctgtccaaaccctgac

SEQ ID NO: 104026 - DNA, 22 bp, Homo sapiens
tggagaagattggtcaccattc

SEQ ID NO: 104027 - DNA, 22 bp, Homo sapiens
gaattcttttctttctgaaagt

SEQ ID NO: 104028 - DNA, 22 bp, Homo sapiens
gggaagagggagctggaatgat

SEQ ID NO: 104029 - DNA, 22 bp, Homo sapiens
ccttcccatgcagcctgtctga

SEQ ID NO: 104030 - DNA, 22 bp, Homo sapiens
ttaatgaaaggcagtttggaac

SEQ ID NO: 104031 - DNA, 22 bp, Homo sapiens
tggaaacacccacgcatgcata

SEQ ID NO: 104032 - DNA, 22 bp, Homo sapiens
tccagctgaggtggcctctgtg

SEQ ID NO: 104033 - DNA, 22 bp, Homo sapiens
ggcagcactgcagcttgttggg

SEQ ID NO: 104034 - DNA, 22 bp, Homo sapiens
gaccatcctggccaacgtggta

SEQ ID NO: 104035 - DNA, 23 bp, Homo sapiens
ccatcccttggaagctggtttta

SEQ ID NO: 104036 - DNA, 22 bp, Homo sapiens
acttgtgttaccaaggtttggt

SEQ ID NO: 104037 - DNA, 22 bp, Homo sapiens
agcctggtttaagcattttata

SEQ ID NO: 104038 - DNA, 22 bp, Homo sapiens
cattctgaccctatgatttaag

SEQ ID NO: 104039 - DNA, 22 bp, Homo sapiens
cggagtcttgctatgttgccca

SEQ ID NO: 104040 - DNA, 22 bp, Homo sapiens
gcccagcacctctctcagggtt

SEQ ID NO: 104041 - DNA, 22 bp, Homo sapiens
atataatttttggttagctcaa

SEQ ID NO: 104042 - DNA, 22 bp, Homo sapiens
atctgtcttttaatgttaatgc

SEQ ID NO: 104043 - DNA, 22 bp, Homo sapiens
gtgacaggccactgcggctctg

SEQ ID NO: 104044 - DNA, 22 bp, Homo sapiens
acccaaaagtcactcaggagca

SEQ ID NO: 104045 - DNA, 22 bp, Homo sapiens
cctcctgcacctccaggaactc

SEQ ID NO: 104046 - DNA, 22 bp, Homo sapiens
aagggggcggcagccagtggaa

SEQ ID NO: 104047 - DNA, 22 bp, Homo sapiens
caggctggagtgcagtggtgcc

SEQ ID NO: 104048 - DNA, 22 bp, Homo sapiens
ggctcctgggggtgctcctgcc

SEQ ID NO: 104049 - DNA, 22 bp, Homo sapiens
ccctggaggttgaggctgcagt

SEQ ID NO: 104050 - DNA, 22 bp, Homo sapiens
cttgtccgaggagacgcggaag

SEQ ID NO: 104051 - DNA, 22 bp, Homo sapiens
aatcacttagaacccaggaagt

SEQ ID NO: 104052 - DNA, 22 bp, Homo sapiens
atgttctacagatggaaagggg

SEQ ID NO: 104053 - DNA, 18 bp, Homo sapiens
ggctcaagtgatcctcct

SEQ ID NO: 104054 - DNA, 23 bp, Homo sapiens
tcgttgaatagcaatagcacaac

SEQ ID NO: 104055 - DNA, 22 bp, Homo sapiens
agctcctgaaaatccagactgg

SEQ ID NO: 104056 - DNA, 22 bp, Homo sapiens
ctgcaccctcaaactcctgggc

SEQ ID NO: 104057 - DNA, 22 bp, Homo sapiens
gagcactgatttatttttgtct

SEQ ID NO: 104058 - DNA, 22 bp, Homo sapiens
gctgcctacgcttgagccctgg

SEQ ID NO: 104059 - DNA, 22 bp, Homo sapiens
gcgtctgagttgcgggggctca

SEQ ID NO: 104060 - DNA, 22 bp, Homo sapiens
tcttgccacttcatcccctttc

SEQ ID NO: 104061 - DNA, 22 bp, Homo sapiens
agtggctgagtgactgtgactc

SEQ ID NO: 104062 - DNA, 18 bp, Homo sapiens
gaccccgggatctgtcga

SEQ ID NO: 104063 - DNA, 22 bp, Homo sapiens
actagaaagaagttttttgaga

SEQ ID NO: 104064 - DNA, 22 bp, Homo sapiens
agaccactaaaactttctctat

SEQ ID NO: 104065 - DNA, 22 bp, Homo sapiens
gggtggagagaaagaaacgtga

SEQ ID NO: 104066 - DNA, 22 bp, Homo sapiens
ctctgctgtgccgccagggcct

SEQ ID NO: 104067 - DNA, 22 bp, Homo sapiens
ttcttctcagggtcccacatgg

SEQ ID NO: 104068 - DNA, 19 bp, Homo sapiens
gggcttggggctgaagcct

SEQ ID NO: 104069 - DNA, 22 bp, Homo sapiens
aaagaaatagatggcatttaaa

SEQ ID NO: 104070 - DNA, 22 bp, Homo sapiens
ggaggcggaggttgcagtgagc

SEQ ID NO: 104071 - DNA, 22 bp, Homo sapiens
gcgtggcttagagtggggtacc

SEQ ID NO: 104072 - DNA, 22 bp, Homo sapiens
ttcttctccgaggagggctggt

SEQ ID NO: 104073 - DNA, 23 bp, Homo sapiens
aatgggtgcaactatccatgaca

SEQ ID NO: 104074 - DNA, 23 bp, Homo sapiens
aaactacaacgccaggcactgag

SEQ ID NO: 104075 - DNA, 22 bp, Homo sapiens
gtttctctgtctgttacattgg

SEQ ID NO: 104076 - DNA, 22 bp, Homo sapiens
ccgaggctggagtgcagtggcg

SEQ ID NO: 104077 - DNA, 22 bp, Homo sapiens
gcaagacctatctagttgctgt

SEQ ID NO: 104078 - DNA, 22 bp, Homo sapiens
tgctcattggcgatctgaggga

SEQ ID NO: 104079 - DNA, 21 bp, Homo sapiens
tggcggggacttgtggctgcc

SEQ ID NO: 104080 - DNA, 22 bp, Homo sapiens
agttatgtcctcagcaaatcaa

SEQ ID NO: 104081 - DNA, 22 bp, Homo sapiens
gaccctctagatggaagcactg

SEQ ID NO: 104082 - DNA, 22 bp, Homo sapiens
atacaaagtattaatcctggat

SEQ ID NO: 104083 - DNA, 22 bp, Homo sapiens
acacggcactttaggaaggggc

SEQ ID NO: 104084 - DNA, 22 bp, Homo sapiens
agcctattccaggatgagctca

SEQ ID NO: 104085 - DNA, 22 bp, Homo sapiens
tgaagaaacgcagagaggtagg

SEQ ID NO: 104086 - DNA, 22 bp, Homo sapiens
ttgcccagagtcacccagctca

SEQ ID NO: 104087 - DNA, 22 bp, Homo sapiens
ctttgctactgtgaatagtgcc

SEQ ID NO: 104088 - DNA, 22 bp, Homo sapiens
atccccactgctgctggtgtag

SEQ ID NO: 104089 - DNA, 22 bp, Homo sapiens
cccaggggttcaaggctgcagt

SEQ ID NO: 104090 - DNA, 22 bp, Homo sapiens
ttgggctgaaccctgcagctga

SEQ ID NO: 104091 - DNA, 22 bp, Homo sapiens
ctggagggtggagagaagtctc

SEQ ID NO: 104092 - DNA, 22 bp, Homo sapiens
tgaaggacagcagtggctccaa

SEQ ID NO: 104093 - DNA, 22 bp, Homo sapiens
cgccgcctgctgcagcagctgt

SEQ ID NO: 104094 - DNA, 22 bp, Homo sapiens
gctgcactttgactgctggggt

SEQ ID NO: 104095 - DNA, 22 bp, Homo sapiens
ctgagaacatcattcagatatt

SEQ ID NO: 104096 - DNA, 22 bp, Homo sapiens
cctgcctatgagacgttttgcc

SEQ ID NO: 104097 - DNA, 22 bp, Homo sapiens
aggactgggtgcagagggcatc

SEQ ID NO: 104098 - DNA, 20 bp, Homo sapiens
aatgctgcttctttttgcat

SEQ ID NO: 104099 - DNA, 22 bp, Homo sapiens
ggctccaccctgcttccagaag

SEQ ID NO: 104100 - DNA, 22 bp, Homo sapiens
tgcgcctctaatctcgggcgtc

SEQ ID NO: 104101 - DNA, 22 bp, Homo sapiens
ctggagagaatgtggaatgatt

SEQ ID NO: 104102 - DNA, 22 bp, Homo sapiens
gcacggctaatttttgtatttt

SEQ ID NO: 104103 - DNA, 22 bp, Homo sapiens
ttgcccaggctggagtgcagta

SEQ ID NO: 104104 - DNA, 22 bp, Homo sapiens
cttagatgaagtcacagaaccc

SEQ ID NO: 104105 - DNA, 22 bp, Homo sapiens
tattcatagtaaacaaaagtgg

SEQ ID NO: 104106 - DNA, 22 bp, Homo sapiens
taacaatacccattctaattac

SEQ ID NO: 104107 - DNA, 22 bp, Homo sapiens
ggaggtgggctaaggactctct

SEQ ID NO: 104108 - DNA, 23 bp, Homo sapiens
gcctgccgcctggctgagaactg

SEQ ID NO: 104109 - DNA, 22 bp, Homo sapiens
aatttaagaacatttcaggact

SEQ ID NO: 104110 - DNA, 22 bp, Homo sapiens
agttggcactgagctgtgattg

SEQ ID NO: 104111 - DNA, 22 bp, Homo sapiens
cctgggaggctgaggctgcagt

SEQ ID NO: 104112 - DNA, 22 bp, Homo sapiens
accctaataatcacagactagt

SEQ ID NO: 104113 - DNA, 22 bp, Homo sapiens
cctagagctctgctttatctaa

SEQ ID NO: 104114 - DNA, 22 bp, Homo sapiens
tgatttacagtagtgtctaaac

SEQ ID NO: 104115 - DNA, 22 bp, Homo sapiens
agagcacggccaccatttacaa

SEQ ID NO: 104116 - DNA, 22 bp, Homo sapiens
catgtgtgtctccaccagctgc

SEQ ID NO: 104117 - DNA, 22 bp, Homo sapiens
tcgcgcccccaagcgtcattgg

SEQ ID NO: 104118 - DNA, 22 bp, Homo sapiens
ctctggaccctcctgctgagag

SEQ ID NO: 104119 - DNA, 22 bp, Homo sapiens
tctgacattttgagaatgacat

SEQ ID NO: 104120 - DNA, 22 bp, Homo sapiens
tgtcagggatttccaactcccc

SEQ ID NO: 104121 - DNA, 22 bp, Homo sapiens
gcccaggagttcaagtctagtg

SEQ ID NO: 104122 - DNA, 22 bp, Homo sapiens
tctcctggagcccagatgctgg

SEQ ID NO: 104123 - DNA, 22 bp, Homo sapiens
cctcttctaggacgtccttgtg

SEQ ID NO: 104124 - DNA, 22 bp, Homo sapiens
ggtagtcggccttgccctgggc

SEQ ID NO: 104125 - DNA, 22 bp, Homo sapiens
tggtaaggttccagatctagaa

SEQ ID NO: 104126 - DNA, 17 bp, Homo sapiens
tggctctgtcctcagct

SEQ ID NO: 104127 - DNA, 22 bp, Homo sapiens
ctctgcaacttctagcagtgtc

SEQ ID NO: 104128 - DNA, 22 bp, Homo sapiens
ttgagcccaggaggcctgggtg

SEQ ID NO: 104129 - DNA, 22 bp, Homo sapiens
ggcatcttgttgctcaaatcta

SEQ ID NO: 104130 - DNA, 22 bp, Homo sapiens
cgccggcttgaggcaggcggca

SEQ ID NO: 104131 - DNA, 22 bp, Homo sapiens
actgcactccagcctcggggtc

SEQ ID NO: 104132 - DNA, 22 bp, Homo sapiens
aagaatgagctcaaagatctta

SEQ ID NO: 104133 - DNA, 22 bp, Homo sapiens
tagtggatgttcagagatttga

SEQ ID NO: 104134 - DNA, 22 bp, Homo sapiens
ttggaaacgtcaccttttcctt

SEQ ID NO: 104135 - DNA, 22 bp, Homo sapiens
atttattcctttatggctggag

SEQ ID NO: 104136 - DNA, 22 bp, Homo sapiens
cgtgatgaatggtgagacccgc

SEQ ID NO: 104137 - DNA, 22 bp, Homo sapiens
agtccccctctgagcccaggga

SEQ ID NO: 104138 - DNA, 22 bp, Homo sapiens
tggcatttgagctggaaggatg

SEQ ID NO: 104139 - DNA, 21 bp, Homo sapiens
aagaggaagcattatggcata

SEQ ID NO: 104140 - DNA, 22 bp, Homo sapiens
gtcacccgtttgactatccacc

SEQ ID NO: 104141 - DNA, 23 bp, Homo sapiens
gcagaggagcaagctggacacca

SEQ ID NO: 104142 - DNA, 22 bp, Homo sapiens
ttctcatgaaactcgcttcctc

SEQ ID NO: 104143 - DNA, 22 bp, Homo sapiens
tggtcttagctggaaggaggga

SEQ ID NO: 104144 - DNA, 22 bp, Homo sapiens
aaatggaagctatttatgattc

SEQ ID NO: 104145 - DNA, 22 bp, Homo sapiens
tcactgcgcttcagcctgggtg

SEQ ID NO: 104146 - DNA, 22 bp, Homo sapiens
ccagatatcactgccgtgttgt

SEQ ID NO: 104147 - DNA, 22 bp, Homo sapiens
gggcgcatcacctgaggtcagg

SEQ ID NO: 104148 - DNA, 22 bp, Homo sapiens
aaggaatttgaggctgcagtga

SEQ ID NO: 104149 - DNA, 22 bp, Homo sapiens
attgcacttcagcctgggtgac

SEQ ID NO: 104150 - DNA, 22 bp, Homo sapiens
taaggcaggaactggctgtttt

SEQ ID NO: 104151 - DNA, 22 bp, Homo sapiens
tttgtgaataggttggcttcca

SEQ ID NO: 104152 - DNA, 22 bp, Homo sapiens
agtgctgtcagttttatagata

SEQ ID NO: 104153 - DNA, 22 bp, Homo sapiens
ctcttcctagtgtgcagcgtgg

SEQ ID NO: 104154 - DNA, 22 bp, Homo sapiens
ttgtgctctgtgttatttaagg

SEQ ID NO: 104155 - DNA, 22 bp, Homo sapiens
gaagttctttatagcagtgtga

SEQ ID NO: 104156 - DNA, 22 bp, Homo sapiens
aagaaggcggaccagaagggag

SEQ ID NO: 104157 - DNA, 22 bp, Homo sapiens
gggaggaggaatgttttgtgta

SEQ ID NO: 104158 - DNA, 22 bp, Homo sapiens
cagagctggtgtgtcctggcat

SEQ ID NO: 104159 - DNA, 22 bp, Homo sapiens
acattaaaattgggtggggtaa

SEQ ID NO: 104160 - DNA, 22 bp, Homo sapiens
gtccacagctctgaggtctccc

SEQ ID NO: 104161 - DNA, 22 bp, Homo sapiens
agggcagagctgtctaaatggc

SEQ ID NO: 104162 - DNA, 22 bp, Homo sapiens
atattgttagtaatatttcgaa

SEQ ID NO: 104163 - DNA, 22 bp, Homo sapiens
aatgcaatgcagcacctccttg

SEQ ID NO: 104164 - DNA, 22 bp, Homo sapiens
gagactgtcacttgggacctgt

SEQ ID NO: 104165 - DNA, 22 bp, Homo sapiens
tacaaaaaattgatactgacga

SEQ ID NO: 104166 - DNA, 22 bp, Homo sapiens
ctgtctgcaggatagtaccctc

SEQ ID NO: 104167 - DNA, 22 bp, Homo sapiens
cacatgaaggctggggtcgtga

SEQ ID NO: 104168 - DNA, 22 bp, Homo sapiens
gagcagtaggagaaccctgagc

SEQ ID NO: 104169 - DNA, 22 bp, Homo sapiens
cctcagacccctgctgagcttc

SEQ ID NO: 104170 - DNA, 22 bp, Homo sapiens
cctgattcagtggtgcccagag

SEQ ID NO: 104171 - DNA, 22 bp, Homo sapiens
gctggcagacttcctctggaac

SEQ ID NO: 104172 - DNA, 22 bp, Homo sapiens
gagatgcagaaccctcaggagc

SEQ ID NO: 104173 - DNA, 22 bp, Homo sapiens
actccacaccacgggggccgcc

SEQ ID NO: 104174 - DNA, 22 bp, Homo sapiens
tgtgactaggcctgagctcttg

SEQ ID NO: 104175 - DNA, 22 bp, Homo sapiens
agtgtattctgcatgggagact

SEQ ID NO: 104176 - DNA, 22 bp, Homo sapiens
gccttgccgctcagcagtgggg

SEQ ID NO: 104177 - DNA, 22 bp, Homo sapiens
acacagggctgcgcctgacccc

SEQ ID NO: 104178 - DNA, 22 bp, Homo sapiens
ctgagccaaggggacagtgaca

SEQ ID NO: 104179 - DNA, 22 bp, Homo sapiens
ctgagggtcaacttgattgtat

SEQ ID NO: 104180 - DNA, 22 bp, Homo sapiens
ataaaatttgctactgttaaat

SEQ ID NO: 104181 - DNA, 22 bp, Homo sapiens
tggagtgcaatagtaataaggt

SEQ ID NO: 104182 - DNA, 22 bp, Homo sapiens
gtggctcacgcctgtaatccca

SEQ ID NO: 104183 - DNA, 22 bp, Homo sapiens
gcttaattctggctcagtttcc

SEQ ID NO: 104184 - DNA, 22 bp, Homo sapiens
gggaaacaacaaagtatctatg

SEQ ID NO: 104185 - DNA, 22 bp, Homo sapiens
ttcaggcccagcacagcgcgtg

SEQ ID NO: 104186 - DNA, 18 bp, Homo sapiens
acgtgctgtgccttttgc

SEQ ID NO: 104187 - DNA, 22 bp, Homo sapiens
aatttaagagcatagctccaac

SEQ ID NO: 104188 - DNA, 22 bp, Homo sapiens
tcaaaatgccgagtgcccaggt

SEQ ID NO: 104189 - DNA, 22 bp, Homo sapiens
cggggaagcggttctggcggta

SEQ ID NO: 104190 - DNA, 22 bp, Homo sapiens
aggaaggcttctttggtcttct

SEQ ID NO: 104191 - DNA, 22 bp, Homo sapiens
cagaggaacgtttggattgatt

SEQ ID NO: 104192 - DNA, 22 bp, Homo sapiens
ggtgtccgcgctgtagaaggtc

SEQ ID NO: 104193 - DNA, 22 bp, Homo sapiens
ctgggcagctgtatcagggagt

SEQ ID NO: 104194 - DNA, 22 bp, Homo sapiens
gtggcagaccttcccttctcct

SEQ ID NO: 104195 - DNA, 22 bp, Homo sapiens
ttcattcttttacatgtgaata

SEQ ID NO: 104196 - DNA, 22 bp, Homo sapiens
cttttgattgagcagtttcaaa

SEQ ID NO: 104197 - DNA, 22 bp, Homo sapiens
caagggaattgtgtgtgagagg

SEQ ID NO: 104198 - DNA, 22 bp, Homo sapiens
gccctgccctctcggcactcgc

SEQ ID NO: 104199 - DNA, 22 bp, Homo sapiens
tctaatcctatggtggggaggg

SEQ ID NO: 104200 - DNA, 22 bp, Homo sapiens
ttgtcttttgtgggaaatatgg

SEQ ID NO: 104201 - DNA, 22 bp, Homo sapiens
gggagaggttacccgagcaact

SEQ ID NO: 104202 - DNA, 21 bp, Homo sapiens
gcccacagtgaggaggatccc

SEQ ID NO: 104203 - DNA, 22 bp, Homo sapiens
aacatgatttcatgcatttaga

SEQ ID NO: 104204 - DNA, 22 bp, Homo sapiens
ggtccccgtggaggctggagcg

SEQ ID NO: 104205 - DNA, 22 bp, Homo sapiens
gaacccggggaggttgcagtga

SEQ ID NO: 104206 - DNA, 22 bp, Homo sapiens
caaatgaatatttccatgggtt

SEQ ID NO: 104207 - DNA, 22 bp, Homo sapiens
cccacgtcgaacttgctccaga

SEQ ID NO: 104208 - DNA, 22 bp, Homo sapiens
ctatggtctggaccgaggtcct

SEQ ID NO: 104209 - DNA, 22 bp, Homo sapiens
tcaacgcatgctccaagaaaga

SEQ ID NO: 104210 - DNA, 22 bp, Homo sapiens
aactaatacattaatacatgtg

SEQ ID NO: 104211 - DNA, 22 bp, Homo sapiens
ttgggtgctgtcatggggcacg

SEQ ID NO: 104212 - DNA, 22 bp, Homo sapiens
ttcaccctggaccagaaattgg

SEQ ID NO: 104213 - DNA, 22 bp, Homo sapiens
acccgccgcacgtccaggctga

SEQ ID NO: 104214 - DNA, 22 bp, Homo sapiens
ggagagcttggagtgcgatttt

SEQ ID NO: 104215 - DNA, 21 bp, Homo sapiens
tcactagtgccttctgtcatt

SEQ ID NO: 104216 - DNA, 22 bp, Homo sapiens
gttcaagaccagcctggccaac

SEQ ID NO: 104217 - DNA, 22 bp, Homo sapiens
tctacctggagtccgttgttaa

SEQ ID NO: 104218 - DNA, 22 bp, Homo sapiens
agctggaattacaggcacgcac

SEQ ID NO: 104219 - DNA, 22 bp, Homo sapiens
tctgagacaggaagtggagggt

SEQ ID NO: 104220 - DNA, 22 bp, Homo sapiens
tcttgaacttctgcacactcag

SEQ ID NO: 104221 - DNA, 22 bp, Homo sapiens
tgaccaggctggagtgcagtgg

SEQ ID NO: 104222 - DNA, 22 bp, Homo sapiens
tgaggcactccaggatgctgtt

SEQ ID NO: 104223 - DNA, 22 bp, Homo sapiens
ccagagtcccttgcagctcagt

SEQ ID NO: 104224 - DNA, 19 bp, Homo sapiens
agccccttggtactgtcct

SEQ ID NO: 104225 - DNA, 21 bp, Homo sapiens
ccgccgctgatagctctgggc

SEQ ID NO: 104226 - DNA, 22 bp, Homo sapiens
cagtttcttcctcccccagaga

SEQ ID NO: 104227 - DNA, 22 bp, Homo sapiens
tcggactcggcaaggctatgca

SEQ ID NO: 104228 - DNA, 22 bp, Homo sapiens
cgcagggccgcgagcgggacca

SEQ ID NO: 104229 - DNA, 22 bp, Homo sapiens
ctggcaggagcattcacagagg

SEQ ID NO: 104230 - DNA, 22 bp, Homo sapiens
tcacaactgggtgtcttcatca

SEQ ID NO: 104231 - DNA, 22 bp, Homo sapiens
gtggagaggaacccagctctgt

SEQ ID NO: 104232 - DNA, 22 bp, Homo sapiens
ccttgctcaagctagtgacggg

SEQ ID NO: 104233 - DNA, 22 bp, Homo sapiens
ttaaatattatgttgtctgcaa

SEQ ID NO: 104234 - DNA, 22 bp, Homo sapiens
acagagcaataacagggagagg

SEQ ID NO: 104235 - DNA, 22 bp, Homo sapiens
gaggtagacttcttggaagtag

SEQ ID NO: 104236 - DNA, 22 bp, Homo sapiens
tcactgtagcctcaactcttgg

SEQ ID NO: 104237 - DNA, 22 bp, Homo sapiens
aggctggagtgcagttgcatga

SEQ ID NO: 104238 - DNA, 22 bp, Homo sapiens
gtggcccatcacgtttcgcctt

SEQ ID NO: 104239 - DNA, 22 bp, Homo sapiens
ctgaagagaaagggagctcttc

SEQ ID NO: 104240 - DNA, 22 bp, Homo sapiens
agcccaggttgaggctgcagtg

SEQ ID NO: 104241 - DNA, 22 bp, Homo sapiens
tcacccaggctggactgcagtg

SEQ ID NO: 104242 - DNA, 22 bp, Homo sapiens
tcctcattcttggtgcatcaaa

SEQ ID NO: 104243 - DNA, 22 bp, Homo sapiens
atggtttattagctgcacaggc

SEQ ID NO: 104244 - DNA, 22 bp, Homo sapiens
ctccccagccctggtattctga

SEQ ID NO: 104245 - DNA, 22 bp, Homo sapiens
ctagttctagatccctgaggaa

SEQ ID NO: 104246 - DNA, 22 bp, Homo sapiens
tctgcgttgctcacgctgggag

SEQ ID NO: 104247 - DNA, 22 bp, Homo sapiens
cctcaaagctcaaatgaggctt

SEQ ID NO: 104248 - DNA, 22 bp, Homo sapiens
tgccgtggggctgaggctggag

SEQ ID NO: 104249 - DNA, 22 bp, Homo sapiens
ctccagttggccccagttggtt

SEQ ID NO: 104250 - DNA, 22 bp, Homo sapiens
ggtgccaggctgtagtcagggt

SEQ ID NO: 104251 - DNA, 22 bp, Homo sapiens
cgcgaggtggaggttgcagtga

SEQ ID NO: 104252 - DNA, 22 bp, Homo sapiens
ggaggacaggggctgcagcaca

SEQ ID NO: 104253 - DNA, 22 bp, Homo sapiens
tgactacaacctccacctcccg

SEQ ID NO: 104254 - DNA, 22 bp, Homo sapiens
ggcgtgggcgaggtgctctatc

SEQ ID NO: 104255 - DNA, 22 bp, Homo sapiens
cggcatccccacttcctcctgc

SEQ ID NO: 104256 - DNA, 22 bp, Homo sapiens
ttctgatgaggaggtctctaag

SEQ ID NO: 104257 - DNA, 22 bp, Homo sapiens
tgtgtgcatgcttggggcagca

SEQ ID NO: 104258 - DNA, 18 bp, Homo sapiens
tcctttctccctcatctt

SEQ ID NO: 104259 - DNA, 22 bp, Homo sapiens
ttatgggagcaattggggaggt

SEQ ID NO: 104260 - DNA, 21 bp, Homo sapiens
acatggactgtgaatggggac

SEQ ID NO: 104261 - DNA, 17 bp, Homo sapiens
gggcagggactcctggg

SEQ ID NO: 104262 - DNA, 22 bp, Homo sapiens
tcccaagtactaccaatctaat

SEQ ID NO: 104263 - DNA, 22 bp, Homo sapiens
ttttcctttgattcccagatgt

SEQ ID NO: 104264 - DNA, 22 bp, Homo sapiens
caggctggagtgcagtggggcg

SEQ ID NO: 104265 - DNA, 22 bp, Homo sapiens
ggagaagaggagctggaagcct

SEQ ID NO: 104266 - DNA, 22 bp, Homo sapiens
aggaatgacagatgtccgcacc

SEQ ID NO: 104267 - DNA, 22 bp, Homo sapiens
gatgcagtgcttaaatcatttg

SEQ ID NO: 104268 - DNA, 19 bp, Homo sapiens
aggcttcaggccacatgct

SEQ ID NO: 104269 - DNA, 22 bp, Homo sapiens
gcctccggagtcacagtgtctt

SEQ ID NO: 104270 - DNA, 22 bp, Homo sapiens
aggcctgaggaccagataaatg

SEQ ID NO: 104271 - DNA, 22 bp, Homo sapiens
atacaaaaattagccgggagta

SEQ ID NO: 104272 - DNA, 22 bp, Homo sapiens
tccagaaggccacccggggatg

SEQ ID NO: 104273 - DNA, 22 bp, Homo sapiens
cctgtatttaaaaatattctaa

SEQ ID NO: 104274 - DNA, 22 bp, Homo sapiens
caccaggaggacaggcccctac

SEQ ID NO: 104275 - DNA, 22 bp, Homo sapiens
catgcaggcgcaacttctacaa

SEQ ID NO: 104276 - DNA, 22 bp, Homo sapiens
gtcctggggattatagagtgtt

SEQ ID NO: 104277 - DNA, 22 bp, Homo sapiens
ggaggggatttagtagatgcta

SEQ ID NO: 104278 - DNA, 22 bp, Homo sapiens
gctggtgagcaaaggagaagga

SEQ ID NO: 104279 - DNA, 22 bp, Homo sapiens
gcttctggtgaggcctcaggaa

SEQ ID NO: 104280 - DNA, 22 bp, Homo sapiens
cactgcatggctgtgaggcagc

SEQ ID NO: 104281 - DNA, 22 bp, Homo sapiens
ctgtaatcccagctacctggga

SEQ ID NO: 104282 - DNA, 22 bp, Homo sapiens
ttccaaagaagttcacatttac

SEQ ID NO: 104283 - DNA, 22 bp, Homo sapiens
tcccgtcttgctgttgtctgcg

SEQ ID NO: 104284 - DNA, 22 bp, Homo sapiens
ggctctgtgtctccacccaaat

SEQ ID NO: 104285 - DNA, 22 bp, Homo sapiens
tatggctaattctttactgacc

SEQ ID NO: 104286 - DNA, 22 bp, Homo sapiens
gcaggcggaggttgcagtgagc

SEQ ID NO: 104287 - DNA, 20 bp, Homo sapiens
tgatatggtttggctgtgtt

SEQ ID NO: 104288 - DNA, 22 bp, Homo sapiens
cagagagaatcttggcagctga

SEQ ID NO: 104289 - DNA, 22 bp, Homo sapiens
aagaataagaggatttagaaca

SEQ ID NO: 104290 - DNA, 22 bp, Homo sapiens
tcgcaccattgcactccagcca

SEQ ID NO: 104291 - DNA, 22 bp, Homo sapiens
ggcctgggctccgggagttact

SEQ ID NO: 104292 - DNA, 22 bp, Homo sapiens
cactgcacttcagcctgggtga

SEQ ID NO: 104293 - DNA, 22 bp, Homo sapiens
cagcaggaggtgagtagcaggt

SEQ ID NO: 104294 - DNA, 22 bp, Homo sapiens
tgatctcctgaccttgtaatcc

SEQ ID NO: 104295 - DNA, 22 bp, Homo sapiens
tctgagaaatttctttgtgatg

SEQ ID NO: 104296 - DNA, 22 bp, Homo sapiens
tgtggaaggggccccatgacca

SEQ ID NO: 104297 - DNA, 22 bp, Homo sapiens
gagcacagtaaagcagtgtcac

SEQ ID NO: 104298 - DNA, 19 bp, Homo sapiens
tcttgggtcgagacataga

SEQ ID NO: 104299 - DNA, 22 bp, Homo sapiens
attctcaaaacataacttcact

SEQ ID NO: 104300 - DNA, 22 bp, Homo sapiens
tagctcaaaggttaagtgtgga

SEQ ID NO: 104301 - DNA, 22 bp, Homo sapiens
actgcacttcagcctgggtgtc

SEQ ID NO: 104302 - DNA, 22 bp, Homo sapiens
gagccaggtcgggccgcggcga

SEQ ID NO: 104303 - DNA, 22 bp, Homo sapiens
gtgctgacaggagcctggcggt

SEQ ID NO: 104304 - DNA, 22 bp, Homo sapiens
tgtcagtgtctatgaagaattt

SEQ ID NO: 104305 - DNA, 22 bp, Homo sapiens
cttcagctgcagttatgtttag

SEQ ID NO: 104306 - DNA, 22 bp, Homo sapiens
aagaggttgtctgtgatgagtt

SEQ ID NO: 104307 - DNA, 22 bp, Homo sapiens
cagctacaaatacttttgtatg

SEQ ID NO: 104308 - DNA, 22 bp, Homo sapiens
aggtctcttgctgtctctgggc

SEQ ID NO: 104309 - DNA, 22 bp, Homo sapiens
caagacttcaccgctctgtgct

SEQ ID NO: 104310 - DNA, 22 bp, Homo sapiens
tcactgcaacctccacctcccg

SEQ ID NO: 104311 - DNA, 17 bp, Homo sapiens
caggtgttctgtttttc

SEQ ID NO: 104312 - DNA, 18 bp, Homo sapiens
gcctggcttcggagccgc

SEQ ID NO: 104313 - DNA, 22 bp, Homo sapiens
attctacatgatagaagggaga

SEQ ID NO: 104314 - DNA, 22 bp, Homo sapiens
tcagcctccgaaagtgctggga

SEQ ID NO: 104315 - DNA, 22 bp, Homo sapiens
ggcaggaggtgagtggcgggtg

SEQ ID NO: 104316 - DNA, 22 bp, Homo sapiens
ttgagatggagcttcactcttg

SEQ ID NO: 104317 - DNA, 22 bp, Homo sapiens
ggactgggaatcagggagatgc

SEQ ID NO: 104318 - DNA, 22 bp, Homo sapiens
gtcactgtatccaggttccagc

SEQ ID NO: 104319 - DNA, 22 bp, Homo sapiens
ccaggaggcagaagttgcagtg

SEQ ID NO: 104320 - DNA, 22 bp, Homo sapiens
gactacaggtgtgtgccaccat

SEQ ID NO: 104321 - DNA, 22 bp, Homo sapiens
agagggtgggcacgtgatggat

SEQ ID NO: 104322 - DNA, 22 bp, Homo sapiens
aaggctcggcaatgtgcggctc

SEQ ID NO: 104323 - DNA, 22 bp, Homo sapiens
gggcagagagctggaactcctt

SEQ ID NO: 104324 - DNA, 22 bp, Homo sapiens
cccatggcttaggagggagtgt

SEQ ID NO: 104325 - DNA, 22 bp, Homo sapiens
tgttcattacccatcccaggtc

SEQ ID NO: 104326 - DNA, 22 bp, Homo sapiens
caggggcggtggctcacgcctg

SEQ ID NO: 104327 - DNA, 22 bp, Homo sapiens
gatattcctgaaggacagggtt

SEQ ID NO: 104328 - DNA, 22 bp, Homo sapiens
tcctcctgtctaccagttcctg

SEQ ID NO: 104329 - DNA, 22 bp, Homo sapiens
tagactggtgaattagggggaa

SEQ ID NO: 104330 - DNA, 22 bp, Homo sapiens
tctgacattagattaattggaa

SEQ ID NO: 104331 - DNA, 22 bp, Homo sapiens
tcctggcttgtcacatctacgt

SEQ ID NO: 104332 - DNA, 21 bp, Homo sapiens
gaacccagcagcagtgctctg

SEQ ID NO: 104333 - DNA, 19 bp, Homo sapiens
atctgccttagtgctgctg

SEQ ID NO: 104334 - DNA, 22 bp, Homo sapiens
tgggggtgtcctggtgcacaca

SEQ ID NO: 104335 - DNA, 22 bp, Homo sapiens
tttataatagatttggggcggc

SEQ ID NO: 104336 - DNA, 22 bp, Homo sapiens
gaggtgggtgtatcacaggtca

SEQ ID NO: 104337 - DNA, 22 bp, Homo sapiens
gccttattacctgcactttgaa

SEQ ID NO: 104338 - DNA, 23 bp, Homo sapiens
aggaaagcattcatttttaccat

SEQ ID NO: 104339 - DNA, 18 bp, Homo sapiens
tccctcagaattatagaa

SEQ ID NO: 104340 - DNA, 22 bp, Homo sapiens
gaacttggaactggggctactg

SEQ ID NO: 104341 - DNA, 22 bp, Homo sapiens
cacctgccaaatggggatgctg

SEQ ID NO: 104342 - DNA, 21 bp, Homo sapiens
attctttgatgtgcaataagt

SEQ ID NO: 104343 - DNA, 22 bp, Homo sapiens
gaggaggcttccgggaggcacg

SEQ ID NO: 104344 - DNA, 22 bp, Homo sapiens
ctggcaggtggaggttgcagtg

SEQ ID NO: 104345 - DNA, 22 bp, Homo sapiens
tggaggctggagtgcagtggcg

SEQ ID NO: 104346 - DNA, 22 bp, Homo sapiens
tccaccatgtaacaagctctgt

SEQ ID NO: 104347 - DNA, 22 bp, Homo sapiens
ctggaaggagcccgggcggatc

SEQ ID NO: 104348 - DNA, 22 bp, Homo sapiens
caagcaccatgtgctccatgtt

SEQ ID NO: 104349 - DNA, 22 bp, Homo sapiens
tatctatgtgctctgacctctc

SEQ ID NO: 104350 - DNA, 22 bp, Homo sapiens
tgctcatcaacatgatgatcat

SEQ ID NO: 104351 - DNA, 22 bp, Homo sapiens
tgttgcccaggttctctcctgc

SEQ ID NO: 104352 - DNA, 22 bp, Homo sapiens
ccactgtggaaagcagttcaga

SEQ ID NO: 104353 - DNA, 22 bp, Homo sapiens
gggcatggtggcaggcacctgt

SEQ ID NO: 104354 - DNA, 22 bp, Homo sapiens
acggcaggctcagagctggaat

SEQ ID NO: 104355 - DNA, 19 bp, Homo sapiens
gactccaactttaagcatg

SEQ ID NO: 104356 - DNA, 22 bp, Homo sapiens
agcctgggccctgcctcttctc

SEQ ID NO: 104357 - DNA, 22 bp, Homo sapiens
ctggcaggttatagagctgccc

SEQ ID NO: 104358 - DNA, 18 bp, Homo sapiens
ccctcttgcacaaagcaa

SEQ ID NO: 104359 - DNA, 19 bp, Homo sapiens
ttcacattggaagaagtag

SEQ ID NO: 104360 - DNA, 22 bp, Homo sapiens
agtcaataaaagctttagattc

SEQ ID NO: 104361 - DNA, 22 bp, Homo sapiens
agggggctccttggtgtgcaga

SEQ ID NO: 104362 - DNA, 22 bp, Homo sapiens
gcaggagaacaaagcaagctgc

SEQ ID NO: 104363 - DNA, 22 bp, Homo sapiens
tggcctcggcatccagcaagag

SEQ ID NO: 104364 - DNA, 22 bp, Homo sapiens
gggccggagctgggtcccgcgc

SEQ ID NO: 104365 - DNA, 22 bp, Homo sapiens
catgagatttgggaggggccag

SEQ ID NO: 104366 - DNA, 22 bp, Homo sapiens
gttgagtgggttaggatgctga

SEQ ID NO: 104367 - DNA, 22 bp, Homo sapiens
tcctggatggcctgcaggcggt

SEQ ID NO: 104368 - DNA, 22 bp, Homo sapiens
tgaaggggttcagcatgggggt

SEQ ID NO: 104369 - DNA, 22 bp, Homo sapiens
tcccgtaggttgctgtagtcgg

SEQ ID NO: 104370 - DNA, 22 bp, Homo sapiens
ctgaagcagggagtgatgaagt

SEQ ID NO: 104371 - DNA, 22 bp, Homo sapiens
cactcagctgagccctcagccc

SEQ ID NO: 104372 - DNA, 22 bp, Homo sapiens
tcacccctccattctctcatgt

SEQ ID NO: 104373 - DNA, 22 bp, Homo sapiens
ccttttgctctcccatccagaa

SEQ ID NO: 104374 - DNA, 22 bp, Homo sapiens
ggagactgatctgagtgataac

SEQ ID NO: 104375 - DNA, 22 bp, Homo sapiens
tggttgtggtcctccacatcgc

SEQ ID NO: 104376 - DNA, 23 bp, Homo sapiens
caccactttctccttctccttgg

SEQ ID NO: 104377 - DNA, 22 bp, Homo sapiens
gcagtgccgaaggtagtggttg

SEQ ID NO: 104378 - DNA, 22 bp, Homo sapiens
aaagtgcaaggattacaggcat

SEQ ID NO: 104379 - DNA, 22 bp, Homo sapiens
tattgtgaataatgccgcaata

SEQ ID NO: 104380 - DNA, 22 bp, Homo sapiens
gaggctgaggttgcagtgagcc

SEQ ID NO: 104381 - DNA, 22 bp, Homo sapiens
tacccagtgccaccctctgagg

SEQ ID NO: 104382 - DNA, 22 bp, Homo sapiens
atgccactgcgctccagcctgg

SEQ ID NO: 104383 - DNA, 22 bp, Homo sapiens
gtgtgacctcatcttaactgga

SEQ ID NO: 104384 - DNA, 22 bp, Homo sapiens
gtaatctcagctacttgggagg

SEQ ID NO: 104385 - DNA, 22 bp, Homo sapiens
ggggccttggatctgtgccccg

SEQ ID NO: 104386 - DNA, 22 bp, Homo sapiens
atcccaggcggcacaggttgca

SEQ ID NO: 104387 - DNA, 22 bp, Homo sapiens
tgatctggtcctactgtgggca

SEQ ID NO: 104388 - DNA, 22 bp, Homo sapiens
ttaggctgttcttgtgttgtta

SEQ ID NO: 104389 - DNA, 22 bp, Homo sapiens
atgatccaaagccacaggggca

SEQ ID NO: 104390 - DNA, 22 bp, Homo sapiens
ggaaatctcagatctcccagat

SEQ ID NO: 104391 - DNA, 21 bp, Homo sapiens
ctgtggtacagctgggacgga

SEQ ID NO: 104392 - DNA, 22 bp, Homo sapiens
actgttttctgtaaagggccag

SEQ ID NO: 104393 - DNA, 22 bp, Homo sapiens
gccaggctgaggctctggaaga

SEQ ID NO: 104394 - DNA, 22 bp, Homo sapiens
taccagggaacagggatattaa

SEQ ID NO: 104395 - DNA, 22 bp, Homo sapiens
aggtgaacccaggtgcttcacg

SEQ ID NO: 104396 - DNA, 22 bp, Homo sapiens
aagagagtcagtctgagcacca

SEQ ID NO: 104397 - DNA, 22 bp, Homo sapiens
gaaggaagtcattagtgcagac

SEQ ID NO: 104398 - DNA, 22 bp, Homo sapiens
aagtggactaatacaaggacta

SEQ ID NO: 104399 - DNA, 22 bp, Homo sapiens
aatactgcctgtgaggtaactc

SEQ ID NO: 104400 - DNA, 22 bp, Homo sapiens
ggcggaggttgcagtaagccga

SEQ ID NO: 104401 - DNA, 22 bp, Homo sapiens
gcgggccaccttggagagcgct

SEQ ID NO: 104402 - DNA, 18 bp, Homo sapiens
ggcgggtgttttattcac

SEQ ID NO: 104403 - DNA, 22 bp, Homo sapiens
agcgggctcacccggttgttgt

SEQ ID NO: 104404 - DNA, 22 bp, Homo sapiens
cgttaataggtgcaaggtaagg

SEQ ID NO: 104405 - DNA, 22 bp, Homo sapiens
tgaaatgattatatggtgtttg

SEQ ID NO: 104406 - DNA, 22 bp, Homo sapiens
acaggatcgccctgttgcccag

SEQ ID NO: 104407 - DNA, 22 bp, Homo sapiens
atgcccaatgtcacaatttttg

SEQ ID NO: 104408 - DNA, 22 bp, Homo sapiens
gtctgctcatgctaccgcgggc

SEQ ID NO: 104409 - DNA, 22 bp, Homo sapiens
aggcgcctgcgggatccttgcc

SEQ ID NO: 104410 - DNA, 17 bp, Homo sapiens
tgtagcttctccttctc

SEQ ID NO: 104411 - DNA, 22 bp, Homo sapiens
tttgagatggagtcttgctctg

SEQ ID NO: 104412 - DNA, 22 bp, Homo sapiens
cagcctgtagtctggtccaggt

SEQ ID NO: 104413 - DNA, 22 bp, Homo sapiens
atgacttgctgtgcttgggagc

SEQ ID NO: 104414 - DNA, 22 bp, Homo sapiens
attctaaatcagagagctctgt

SEQ ID NO: 104415 - DNA, 22 bp, Homo sapiens
gctgctgcttgaaggctcggag

SEQ ID NO: 104416 - DNA, 20 bp, Homo sapiens
tttcttgtcggctgttgctg

SEQ ID NO: 104417 - DNA, 22 bp, Homo sapiens
gcttggccagcagccgggatgc

SEQ ID NO: 104418 - DNA, 22 bp, Homo sapiens
gtgcagagaggaccttggggag

SEQ ID NO: 104419 - DNA, 22 bp, Homo sapiens
ggggtactggctggagccccac

SEQ ID NO: 104420 - DNA, 22 bp, Homo sapiens
tgccttgtccttcgtcagggct

SEQ ID NO: 104421 - DNA, 22 bp, Homo sapiens
caggtagaggctgccatcagct

SEQ ID NO: 104422 - DNA, 22 bp, Homo sapiens
tatggcattgttggtgatgata

SEQ ID NO: 104423 - DNA, 22 bp, Homo sapiens
tcaaaattaaaccaacgtccag

SEQ ID NO: 104424 - DNA, 22 bp, Homo sapiens
aggaaaatggaccagagttgtt

SEQ ID NO: 104425 - DNA, 22 bp, Homo sapiens
acccgggaggcaggagtcatag

SEQ ID NO: 104426 - DNA, 22 bp, Homo sapiens
tgggtgagcggctgcacacccg

SEQ ID NO: 104427 - DNA, 22 bp, Homo sapiens
ctattattagataatctacttg

SEQ ID NO: 104428 - DNA, 22 bp, Homo sapiens
cggccaagccggggccccgaag

SEQ ID NO: 104429 - DNA, 22 bp, Homo sapiens
tcagccccacggggtcagccaa

SEQ ID NO: 104430 - DNA, 22 bp, Homo sapiens
tggaatgtcagctacaagaggg

SEQ ID NO: 104431 - DNA, 22 bp, Homo sapiens
aaactgaggctcccgagggtgt

SEQ ID NO: 104432 - DNA, 22 bp, Homo sapiens
ggtgccctggaagctgctgcat

SEQ ID NO: 104433 - DNA, 18 bp, Homo sapiens
catgggtgacaggtggat

SEQ ID NO: 104434 - DNA, 22 bp, Homo sapiens
gaggagctgcccgtgtgtctgc

SEQ ID NO: 104435 - DNA, 22 bp, Homo sapiens
ggtgagcagctgtctgtatgga

SEQ ID NO: 104436 - DNA, 22 bp, Homo sapiens
taagcctgcatgaaccatgaga

SEQ ID NO: 104437 - DNA, 22 bp, Homo sapiens
tgctgagcgcatccggcggccg

SEQ ID NO: 104438 - DNA, 22 bp, Homo sapiens
ccaggaggcggaggttgcagtg

SEQ ID NO: 104439 - DNA, 22 bp, Homo sapiens
gtggctcacacctgtaatccca

SEQ ID NO: 104440 - DNA, 22 bp, Homo sapiens
ctgggctagaaggaccaggatg

SEQ ID NO: 104441 - DNA, 22 bp, Homo sapiens
gtagttctgcagtgtcacctga

SEQ ID NO: 104442 - DNA, 22 bp, Homo sapiens
ctctgcctgtctcatcctgcaa

SEQ ID NO: 104443 - DNA, 22 bp, Homo sapiens
aaagtaattgtggttcttgcca

SEQ ID NO: 104444 - DNA, 22 bp, Homo sapiens
tcacttcccagacggggtggca

SEQ ID NO: 104445 - DNA, 22 bp, Homo sapiens
aactcaggagtttaaggctgca

SEQ ID NO: 104446 - DNA, 22 bp, Homo sapiens
aggaatgacatagaaaggggag

SEQ ID NO: 104447 - DNA, 22 bp, Homo sapiens
tagctgcttgaccaggcagtgg

SEQ ID NO: 104448 - DNA, 22 bp, Homo sapiens
cgcggaggaggtcaggaggtga

SEQ ID NO: 104449 - DNA, 22 bp, Homo sapiens
tggccggggctgatggacagtg

SEQ ID NO: 104450 - DNA, 22 bp, Homo sapiens
agttggagtgaacatgagattg

SEQ ID NO: 104451 - DNA, 22 bp, Homo sapiens
caccgcggagtgatggagaaac

SEQ ID NO: 104452 - DNA, 22 bp, Homo sapiens
tgcgatggcgtagacaaatccc

SEQ ID NO: 104453 - DNA, 22 bp, Homo sapiens
gaggtgctgctgtacttcttgc

SEQ ID NO: 104454 - DNA, 22 bp, Homo sapiens
cccgtgtgtgcgaggctcccgc

SEQ ID NO: 104455 - DNA, 22 bp, Homo sapiens
aatggcactttataaatgttaa

SEQ ID NO: 104456 - DNA, 22 bp, Homo sapiens
caaggtgccatgctgggcgggg

SEQ ID NO: 104457 - DNA, 22 bp, Homo sapiens
aacggctgtggctggcggcagc

SEQ ID NO: 104458 - DNA, 22 bp, Homo sapiens
attcacatttagcctctgacat

SEQ ID NO: 104459 - DNA, 23 bp, Homo sapiens
cagtctgcagcccacttgggcag

SEQ ID NO: 104460 - DNA, 22 bp, Homo sapiens
gcccagatctcctgaccctcag

SEQ ID NO: 104461 - DNA, 23 bp, Homo sapiens
aatggtcttcctccacccctctg

SEQ ID NO: 104462 - DNA, 22 bp, Homo sapiens
ctgccctggggggcctccttgc

SEQ ID NO: 104463 - DNA, 22 bp, Homo sapiens
ggctgcaggttggttggcagct

SEQ ID NO: 104464 - DNA, 22 bp, Homo sapiens
gatgaatgatggcttgtttctg

SEQ ID NO: 104465 - DNA, 22 bp, Homo sapiens
ctgctcagtaatagtcctatct

SEQ ID NO: 104466 - DNA, 22 bp, Homo sapiens
accagcacttccagaggtcagg

SEQ ID NO: 104467 - DNA, 22 bp, Homo sapiens
gaggctgcagctatcagacatt

SEQ ID NO: 104468 - DNA, 22 bp, Homo sapiens
atgttgtgtttgactgttaccc

SEQ ID NO: 104469 - DNA, 22 bp, Homo sapiens
ctacaaaagtaattgtggtttt

SEQ ID NO: 104470 - DNA, 23 bp, Homo sapiens
acagcaagaggaccagatgtgag

SEQ ID NO: 104471 - DNA, 22 bp, Homo sapiens
tccacgctgtgtgaccttgggc

SEQ ID NO: 104472 - DNA, 22 bp, Homo sapiens
ctggcagagttgggtctcaaat

SEQ ID NO: 104473 - DNA, 22 bp, Homo sapiens
agtattctggaattctatgtga

SEQ ID NO: 104474 - DNA, 22 bp, Homo sapiens
tggtagtcggcctcggtggctc

SEQ ID NO: 104475 - DNA, 22 bp, Homo sapiens
aggcgaagggaccagacggtag

SEQ ID NO: 104476 - DNA, 22 bp, Homo sapiens
aagacactcattatcactggtt

SEQ ID NO: 104477 - DNA, 22 bp, Homo sapiens
gtcggccacgcaggtgcggtag

SEQ ID NO: 104478 - DNA, 22 bp, Homo sapiens
cactgctacctctgcctcccgg

SEQ ID NO: 104479 - DNA, 22 bp, Homo sapiens
gtgctcatagatgatgctcttt

SEQ ID NO: 104480 - DNA, 22 bp, Homo sapiens
ttgtctaatgagctccacttca

SEQ ID NO: 104481 - DNA, 22 bp, Homo sapiens
gcaaaagtacagccggatttct

SEQ ID NO: 104482 - DNA, 22 bp, Homo sapiens
gcaggtggatcacctgaggtca

SEQ ID NO: 104483 - DNA, 22 bp, Homo sapiens
ccctggctggctctgcccggac

SEQ ID NO: 104484 - DNA, 22 bp, Homo sapiens
tagcatgtcagtcgccacacgt

SEQ ID NO: 104485 - DNA, 22 bp, Homo sapiens
tgaagttgttaaggttgccatt

SEQ ID NO: 104486 - DNA, 22 bp, Homo sapiens
cttgaatgtcctgtggcaaagt

SEQ ID NO: 104487 - DNA, 22 bp, Homo sapiens
tggacaacatagtgagacctca

SEQ ID NO: 104488 - DNA, 22 bp, Homo sapiens
cgaggaggaaacgcggagaact

SEQ ID NO: 104489 - DNA, 22 bp, Homo sapiens
aagatattcaaagatttattag

SEQ ID NO: 104490 - DNA, 22 bp, Homo sapiens
agctacctgatccttcttctga

SEQ ID NO: 104491 - DNA, 22 bp, Homo sapiens
caggctggagtgcaatgacgcc

SEQ ID NO: 104492 - DNA, 22 bp, Homo sapiens
gagatatgttggcagctggtat

SEQ ID NO: 104493 - DNA, 22 bp, Homo sapiens
tttgtggcaggagcggagaccg

SEQ ID NO: 104494 - DNA, 22 bp, Homo sapiens
cagtcctgaatactggacggtg

SEQ ID NO: 104495 - DNA, 22 bp, Homo sapiens
aagtgtgtgagcctgtcaggct

SEQ ID NO: 104496 - DNA, 22 bp, Homo sapiens
gactggaaagcctgtcctcaga

SEQ ID NO: 104497 - DNA, 22 bp, Homo sapiens
actgtctgtagacatttttggt

SEQ ID NO: 104498 - DNA, 22 bp, Homo sapiens
actgggcagcagctcgagccgc

SEQ ID NO: 104499 - DNA, 23 bp, Homo sapiens
ttgcatagacatcctcatagatt

SEQ ID NO: 104500 - DNA, 22 bp, Homo sapiens
tggctgagttacgaacagagca

SEQ ID NO: 104501 - DNA, 22 bp, Homo sapiens
agcttttagctcctggttgcaa

SEQ ID NO: 104502 - DNA, 22 bp, Homo sapiens
tgtcatagtgtggtagcagtgg

SEQ ID NO: 104503 - DNA, 22 bp, Homo sapiens
ggctggacgatctccccttcct

SEQ ID NO: 104504 - DNA, 22 bp, Homo sapiens
atatatttgagaatattcatga

SEQ ID NO: 104505 - DNA, 22 bp, Homo sapiens
aggtaaagacagtgaaagaggg

SEQ ID NO: 104506 - DNA, 22 bp, Homo sapiens
tcggactcggcaaggctatgca

SEQ ID NO: 104507 - DNA, 22 bp, Homo sapiens
ttccaaagaagttcacatttac

SEQ ID NO: 104508 - DNA, 22 bp, Homo sapiens
tggagataggctgaggcagggc

SEQ ID NO: 104509 - DNA, 22 bp, Homo sapiens
tggttgcctctcagagattccg

SEQ ID NO: 104510 - DNA, 22 bp, Homo sapiens
cttgtgcatttcattcctcagg

SEQ ID NO: 104511 - DNA, 21 bp, Homo sapiens
ctggaggcaggtggtgccagg

SEQ ID NO: 104512 - DNA, 22 bp, Homo sapiens
cccaggctggagtgcagtggcg

SEQ ID NO: 104513 - DNA, 23 bp, Homo sapiens
ccagtgattgcctggaaggaggt

SEQ ID NO: 104514 - DNA, 22 bp, Homo sapiens
cgggttcacgccattctcctgc

SEQ ID NO: 104515 - DNA, 22 bp, Homo sapiens
tcactcaggctggagtgcagtg

SEQ ID NO: 104516 - DNA, 22 bp, Homo sapiens
tgctggtaccgcgcctccgcca

SEQ ID NO: 104517 - DNA, 22 bp, Homo sapiens
aatgcaatgcagcacctccttg

SEQ ID NO: 104518 - DNA, 20 bp, Homo sapiens
tatttctgggcaaccattta

SEQ ID NO: 104519 - DNA, 22 bp, Homo sapiens
gctgggctgcgtcggggaagcc

SEQ ID NO: 104520 - DNA, 22 bp, Homo sapiens
tttgtggcaggagcggagaccg

SEQ ID NO: 104521 - DNA, 22 bp, Homo sapiens
atgccactgcactccagcctag

SEQ ID NO: 104522 - DNA, 22 bp, Homo sapiens
gctcactgcaagctctgcctcc

SEQ ID NO: 104523 - DNA, 22 bp, Homo sapiens
aaaatggtctcagctggcacca

SEQ ID NO: 104524 - DNA, 22 bp, Homo sapiens
cccacgtcgaacttgctccaga

SEQ ID NO: 104525 - DNA, 22 bp, Homo sapiens
tccaggattgcaggtgcacaac

SEQ ID NO: 104526 - DNA, 22 bp, Homo sapiens
ttcccaggaagcctctccaagc

SEQ ID NO: 104527 - DNA, 19 bp, Homo sapiens
atctgccttagtgctgctg

SEQ ID NO: 104528 - DNA, 22 bp, Homo sapiens
ttgagggtctggatctgctgct

SEQ ID NO: 104529 - DNA, 22 bp, Homo sapiens
tggtagtcggcctcggtggctc

SEQ ID NO: 104530 - DNA, 22 bp, Homo sapiens
agatgtgtttctagttcctgca

SEQ ID NO: 104531 - DNA, 22 bp, Homo sapiens
cgtctggcttctccacggtaaa

SEQ ID NO: 104532 - DNA, 22 bp, Homo sapiens
gcccagtagttcaaggttgcag

SEQ ID NO: 104533 - DNA, 22 bp, Homo sapiens
gggtacttaatatttacggggt

SEQ ID NO: 104534 - DNA, 22 bp, Homo sapiens
ccctgccttgtctgggctaggt

SEQ ID NO: 104535 - DNA, 22 bp, Homo sapiens
tctcctggtacccttcctagca

SEQ ID NO: 104536 - DNA, 22 bp, Homo sapiens
atgtttaaagggttgagaaata

SEQ ID NO: 104537 - DNA, 22 bp, Homo sapiens
gctcactgcaacctctgcctcc

SEQ ID NO: 104538 - DNA, 21 bp, Homo sapiens
tctgatggtagatgagatgtg

SEQ ID NO: 104539 - DNA, 20 bp, Homo sapiens
gggcaaggaaacagccccca

SEQ ID NO: 104540 - DNA, 23 bp, Homo sapiens
caccactttctccttctccttgg

SEQ ID NO: 104541 - DNA, 21 bp, Homo sapiens
tctgccagctgaagaggtgga

SEQ ID NO: 104542 - DNA, 22 bp, Homo sapiens
tgagcttccctcctgcactaca

SEQ ID NO: 104543 - DNA, 22 bp, Homo sapiens
tgatctggtcctactgtgggca

SEQ ID NO: 104544 - DNA, 22 bp, Homo sapiens
aggtggagaagagatgggcagt

SEQ ID NO: 104545 - DNA, 22 bp, Homo sapiens
aagtcgtcgaagatggaggttg

SEQ ID NO: 104546 - DNA, 22 bp, Homo sapiens
ccttctcagccccagctcccgc

SEQ ID NO: 104547 - DNA, 22 bp, Homo sapiens
tcctcagtcacggtagcacatt

SEQ ID NO: 104548 - DNA, 22 bp, Homo sapiens
ctgggggcagcaagaagccatg

SEQ ID NO: 104549 - DNA, 22 bp, Homo sapiens
ttatcacttatgagctttttgc

SEQ ID NO: 104550 - DNA, 22 bp, Homo sapiens
ttattttaccttcctctgagct

SEQ ID NO: 104551 - DNA, 22 bp, Homo sapiens
agggtcctgggtgcagttgctt

SEQ ID NO: 104552 - DNA, 22 bp, Homo sapiens
tgggagaaagaaccctgagtga

SEQ ID NO: 104553 - DNA, 19 bp, Homo sapiens
ccagagagctaggtacaga

SEQ ID NO: 104554 - DNA, 22 bp, Homo sapiens
tgccgcagtgcggggagggccc

SEQ ID NO: 104555 - DNA, 22 bp, Homo sapiens
ggccaattccaggagccggcgg

SEQ ID NO: 104556 - DNA, 22 bp, Homo sapiens
tgtgaaagatactaggcagagg

SEQ ID NO: 104557 - DNA, 22 bp, Homo sapiens
tccaggctttggggcaggagcg

SEQ ID NO: 104558 - DNA, 22 bp, Homo sapiens
tgccgtggggctgaggctggag

SEQ ID NO: 104559 - DNA, 22 bp, Homo sapiens
agttgcagacgcagagatgttg

SEQ ID NO: 104560 - DNA, 22 bp, Homo sapiens
accctcaacaaattcactctat

SEQ ID NO: 104561 - DNA, 22 bp, Homo sapiens
ctctctgggcccagttggcacc

SEQ ID NO: 104562 - DNA, 22 bp, Homo sapiens
ctgccgtgtttttcatgttaaa

SEQ ID NO: 104563 - DNA, 19 bp, Homo sapiens
cataatacagtggatctga

SEQ ID NO: 104564 - DNA, 22 bp, Homo sapiens
gagcccaggagtttgatgctgc

SEQ ID NO: 104565 - DNA, 22 bp, Homo sapiens
gagagtctaggaacctcatata

SEQ ID NO: 104566 - DNA, 22 bp, Homo sapiens
gccactgagcccggccattgtt

SEQ ID NO: 104567 - DNA, 22 bp, Homo sapiens
tgttgcccaggttctctcctgc

SEQ ID NO: 104568 - DNA, 22 bp, Homo sapiens
aggaaagcttggcaaactaaat

SEQ ID NO: 104569 - DNA, 22 bp, Homo sapiens
aagaggtaaccatagcaaccac

SEQ ID NO: 104570 - DNA, 22 bp, Homo sapiens
gccatgcttggtatgctgtgag

SEQ ID NO: 104571 - DNA, 22 bp, Homo sapiens
attaggtcatggggaggcccta

SEQ ID NO: 104572 - DNA, 22 bp, Homo sapiens
atcactgtgtatgtatatgcag

SEQ ID NO: 104573 - DNA, 22 bp, Homo sapiens
gtgggggcaggcagtgctagga

SEQ ID NO: 104574 - DNA, 22 bp, Homo sapiens
tcttcattttacaggcagacct

SEQ ID NO: 104575 - DNA, 22 bp, Homo sapiens
tccccaagcaggcaatctcccg

SEQ ID NO: 104576 - DNA, 22 bp, Homo sapiens
ccagaggtgctctttggaagtg

SEQ ID NO: 104577 - DNA, 22 bp, Homo sapiens
aaaaatcacttttataggcagc

SEQ ID NO: 104578 - DNA, 22 bp, Homo sapiens
ggctgagctccaagtattccat

SEQ ID NO: 104579 - DNA, 22 bp, Homo sapiens
tgagagttctctcttcaggtgg

SEQ ID NO: 104580 - DNA, 22 bp, Homo sapiens
ttgagtgtactttagtcatctg

SEQ ID NO: 104581 - DNA, 22 bp, Homo sapiens
gtctttatttgagattgtcatt

SEQ ID NO: 104582 - DNA, 22 bp, Homo sapiens
tgctgtgaggttgagaaggaag

SEQ ID NO: 104583 - DNA, 22 bp, Homo sapiens
cactgcactccagcccgggcaa

SEQ ID NO: 104584 - DNA, 22 bp, Homo sapiens
gagagaagggggatatgagcct

SEQ ID NO: 104585 - DNA, 22 bp, Homo sapiens
catttctgggagacatgctaga

SEQ ID NO: 104586 - DNA, 22 bp, Homo sapiens
taaaggtagtgtgacatattgt

SEQ ID NO: 104587 - DNA, 22 bp, Homo sapiens
gaggtgggtgtatcacaggtca

SEQ ID NO: 104588 - DNA, 22 bp, Homo sapiens
gccagggttcgaatccgtatgg

SEQ ID NO: 104589 - DNA, 22 bp, Homo sapiens
gagtggggggtccgtctcagtg

SEQ ID NO: 104590 - DNA, 22 bp, Homo sapiens
atttcccagggcctgggatttg

SEQ ID NO: 104591 - DNA, 22 bp, Homo sapiens
atgcccaatgtcacaatttttg

SEQ ID NO: 104592 - DNA, 22 bp, Homo sapiens
tttaatcaggcaaagcataata

SEQ ID NO: 104593 - DNA, 17 bp, Homo sapiens
aatctgtttacagtcag

SEQ ID NO: 104594 - DNA, 22 bp, Homo sapiens
tttgctattgtgaatagtgcca

SEQ ID NO: 104595 - DNA, 22 bp, Homo sapiens
gtagtcccagctaccccggagg

SEQ ID NO: 104596 - DNA, 20 bp, Homo sapiens
aggaaaaatggaaactggag

SEQ ID NO: 104597 - DNA, 22 bp, Homo sapiens
caggctggagtgcagtggggcg

SEQ ID NO: 104598 - DNA, 22 bp, Homo sapiens
aaccaccattctctcctcttcc

SEQ ID NO: 104599 - DNA, 22 bp, Homo sapiens
agactttaacaatgggtatgaa

SEQ ID NO: 104600 - DNA, 22 bp, Homo sapiens
ccctctacagggaagcgctttc

SEQ ID NO: 104601 - DNA, 22 bp, Homo sapiens
agtgaaaacctaatcatgcagt

SEQ ID NO: 104602 - DNA, 19 bp, Homo sapiens
ctctgggcaagtcacttaa

SEQ ID NO: 104603 - DNA, 18 bp, Homo sapiens
tcctttctccctcatctt

SEQ ID NO: 104604 - DNA, 23 bp, Homo sapiens
agctataaaatctgtgacagcag

SEQ ID NO: 104605 - DNA, 22 bp, Homo sapiens
ggttccccaggcggcccttgga

SEQ ID NO: 104606 - DNA, 22 bp, Homo sapiens
gacctcatgatccacctgcctt

SEQ ID NO: 104607 - DNA, 22 bp, Homo sapiens
cactgcacttcagcctgggtga

SEQ ID NO: 104608 - DNA, 22 bp, Homo sapiens
cagtctctaaatcaatctgaat

SEQ ID NO: 104609 - DNA, 22 bp, Homo sapiens
tatttcttttcgtgacttattg

SEQ ID NO: 104610 - DNA, 22 bp, Homo sapiens
tgtgccatgaggctctgatatg

SEQ ID NO: 104611 - DNA, 22 bp, Homo sapiens
aaatgcaacgggctttccttat

SEQ ID NO: 104612 - DNA, 22 bp, Homo sapiens
ctcactgcaagctctgcctcca

SEQ ID NO: 104613 - DNA, 22 bp, Homo sapiens
gaggctgaggcaggaggatcac

SEQ ID NO: 104614 - DNA, 22 bp, Homo sapiens
gaggctgaggcggatggatcac

SEQ ID NO: 104615 - DNA, 22 bp, Homo sapiens
ggactgggaatcagggagatgc

SEQ ID NO: 104616 - DNA, 22 bp, Homo sapiens
aggtggggaggagtgtctcttt

SEQ ID NO: 104617 - DNA, 22 bp, Homo sapiens
catgtctgtgtacacatgcaca

SEQ ID NO: 104618 - DNA, 22 bp, Homo sapiens
gtgttgatgacattttagaaac

SEQ ID NO: 104619 - DNA, 22 bp, Homo sapiens
ggcggtctcagcaccctcttgg

SEQ ID NO: 104620 - DNA, 22 bp, Homo sapiens
tttaaaaaactagtctgagtct

SEQ ID NO: 104621 - DNA, 22 bp, Homo sapiens
ctgtccctgagcaactcctgtt

SEQ ID NO: 104622 - DNA, 22 bp, Homo sapiens
tcctggcttgtcacatctacgt

SEQ ID NO: 104623 - DNA, 22 bp, Homo sapiens
agggccagcactcctggcagga

SEQ ID NO: 104624 - DNA, 22 bp, Homo sapiens
atgccacttcattccagcctcg

SEQ ID NO: 104625 - DNA, 22 bp, Homo sapiens
ctctggagtgtctggccagggt

SEQ ID NO: 104626 - DNA, 22 bp, Homo sapiens
gtatcacttttgagagtgagaa

SEQ ID NO: 104627 - DNA, 22 bp, Homo sapiens
ccctttagcccctgcagagact

SEQ ID NO: 104628 - DNA, 22 bp, Homo sapiens
gtcagtaggaacctagggtcaa

SEQ ID NO: 104629 - DNA, 22 bp, Homo sapiens
atgtttttaaatagacttacag

SEQ ID NO: 104630 - DNA, 22 bp, Homo sapiens
tgactacaacctccacctcccg

SEQ ID NO: 104631 - DNA, 22 bp, Homo sapiens
caggaaggcgcggctgtgcctg

SEQ ID NO: 104632 - DNA, 22 bp, Homo sapiens
tttcttaggctctaaaatgact

SEQ ID NO: 104633 - DNA, 22 bp, Homo sapiens
aagcacaatgaacatcttagat

SEQ ID NO: 104634 - DNA, 22 bp, Homo sapiens
tgcaatgatattgtcaaagcat

SEQ ID NO: 104635 - DNA, 22 bp, Homo sapiens
tatgccactgctctccatccta

SEQ ID NO: 104636 - DNA, 22 bp, Homo sapiens
gcaggagaacaaagcaagctgc

SEQ ID NO: 104637 - DNA, 22 bp, Homo sapiens
gcctggattccttgtttctcag

SEQ ID NO: 104638 - DNA, 22 bp, Homo sapiens
agtacccttttcactgtcacaa

SEQ ID NO: 104639 - DNA, 22 bp, Homo sapiens
tttttgggtccaggctgtatct

SEQ ID NO: 104640 - DNA, 22 bp, Homo sapiens
gtgggggctggaaatcttgcca

SEQ ID NO: 104641 - DNA, 22 bp, Homo sapiens
tcaaatgctgtattgtagtaat

SEQ ID NO: 104642 - DNA, 21 bp, Homo sapiens
tcactagtgccttctgtcatt

SEQ ID NO: 104643 - DNA, 22 bp, Homo sapiens
atagggcctaaaaagtattgct

SEQ ID NO: 104644 - DNA, 22 bp, Homo sapiens
ctatgaccccagcatgaataag

SEQ ID NO: 104645 - DNA, 22 bp, Homo sapiens
gtcagaggggcagctgccaggc

SEQ ID NO: 104646 - DNA, 22 bp, Homo sapiens
tctcccaggcaggagtgcagtg

SEQ ID NO: 104647 - DNA, 22 bp, Homo sapiens
tgcatattatgtgtatctgtct

SEQ ID NO: 104648 - DNA, 22 bp, Homo sapiens
agtgaatgtccccgcgggtcag

SEQ ID NO: 104649 - DNA, 22 bp, Homo sapiens
gttcaagaccagcctggccaac

SEQ ID NO: 104650 - DNA, 22 bp, Homo sapiens
ttgggctcaggagtttgagacc

SEQ ID NO: 104651 - DNA, 22 bp, Homo sapiens
cactgcactccagcctgggtca

SEQ ID NO: 104652 - DNA, 22 bp, Homo sapiens
taggtttaggagtgaaggtgaa

SEQ ID NO: 104653 - DNA, 22 bp, Homo sapiens
gcaggctgtctaaagttagagt

SEQ ID NO: 104654 - DNA, 22 bp, Homo sapiens
cagcccgccctgaactttcggg

SEQ ID NO: 104655 - DNA, 22 bp, Homo sapiens
cgagagttagctaggagtcaca

SEQ ID NO: 104656 - DNA, 22 bp, Homo sapiens
ctcactgcaagctccgcctccc

SEQ ID NO: 104657 - DNA, 22 bp, Homo sapiens
tctgggtccgggactgtggatg

SEQ ID NO: 104658 - DNA, 19 bp, Homo sapiens
tcctggggaggggcatggc

SEQ ID NO: 104659 - DNA, 22 bp, Homo sapiens
caggctgaagtgcagtggtgtg

SEQ ID NO: 104660 - DNA, 22 bp, Homo sapiens
tcctgggccctccggatcaggt

SEQ ID NO: 104661 - DNA, 22 bp, Homo sapiens
gccctgggcaaggttctggcca

SEQ ID NO: 104662 - DNA, 22 bp, Homo sapiens
ttaataaagtatgaattggaaa

SEQ ID NO: 104663 - DNA, 22 bp, Homo sapiens
catataaatacaacatgtgtta

SEQ ID NO: 104664 - DNA, 22 bp, Homo sapiens
agaggaggctctgggatcgtcc

SEQ ID NO: 104665 - DNA, 22 bp, Homo sapiens
cccagctcttcaagtcaccccc

SEQ ID NO: 104666 - DNA, 22 bp, Homo sapiens
gcaaatgctaaagtgtagagac

SEQ ID NO: 104667 - DNA, 22 bp, Homo sapiens
cgtgccactgcactctagcctg

SEQ ID NO: 104668 - DNA, 22 bp, Homo sapiens
tcaaaattaaaccaacgtccag

SEQ ID NO: 104669 - DNA, 22 bp, Homo sapiens
tctgtagtaggttgtagttctt

SEQ ID NO: 104670 - DNA, 22 bp, Homo sapiens
aacagaatgcaggggatgctgc

SEQ ID NO: 104671 - DNA, 22 bp, Homo sapiens
cacttcattgggaccagggctg

SEQ ID NO: 104672 - DNA, 22 bp, Homo sapiens
gttgcctaggctggagtgcagt

SEQ ID NO: 104673 - DNA, 22 bp, Homo sapiens
gggcaggggtcagtggccccaa

SEQ ID NO: 104674 - DNA, 22 bp, Homo sapiens
aaaatcttgtgacttaggaagg

SEQ ID NO: 104675 - DNA, 22 bp, Homo sapiens
taggctgggaagaaagattctc

SEQ ID NO: 104676 - DNA, 18 bp, Homo sapiens
cagcctctgattggttgc

SEQ ID NO: 104677 - DNA, 22 bp, Homo sapiens
cctgggctctgtcagaattggg

SEQ ID NO: 104678 - DNA, 22 bp, Homo sapiens
agtggactcttcccagtgcttg

SEQ ID NO: 104679 - DNA, 22 bp, Homo sapiens
tgtctcttttcaagctaccctt

SEQ ID NO: 104680 - DNA, 22 bp, Homo sapiens
aaggagaaatggtagatgtgca

SEQ ID NO: 104681 - DNA, 22 bp, Homo sapiens
ggcatagatttctttaggttta

SEQ ID NO: 104682 - DNA, 22 bp, Homo sapiens
catttacatttaaggttaatat

SEQ ID NO: 104683 - DNA, 22 bp, Homo sapiens
gctgggttttcttccgggccta

SEQ ID NO: 104684 - DNA, 22 bp, Homo sapiens
taggctgggggtaggaattgag

SEQ ID NO: 104685 - DNA, 21 bp, Homo sapiens
tgcaatccagcctgggcgaca

SEQ ID NO: 104686 - DNA, 22 bp, Homo sapiens
catagagtgatgtaaggtatgt

SEQ ID NO: 104687 - DNA, 22 bp, Homo sapiens
ctggcaagaaatatatatctta

SEQ ID NO: 104688 - DNA, 22 bp, Homo sapiens
ctacaaaagtaattgtggtttt

SEQ ID NO: 104689 - DNA, 22 bp, Homo sapiens
ggcctcttatctggctcctgca

SEQ ID NO: 104690 - DNA, 22 bp, Homo sapiens
gggcagagactcagaaacagaa

SEQ ID NO: 104691 - DNA, 22 bp, Homo sapiens
ttcaggaagtgctgcctggtgt

SEQ ID NO: 104692 - DNA, 22 bp, Homo sapiens
ctctgctgtgccgccagggcct

SEQ ID NO: 104693 - DNA, 22 bp, Homo sapiens
aggttatcatcagttgagcact

SEQ ID NO: 104694 - DNA, 22 bp, Homo sapiens
caggctggagtgcaatgacgcc

SEQ ID NO: 104695 - DNA, 22 bp, Homo sapiens
tctgacattttgagaatgacat

SEQ ID NO: 104696 - DNA, 22 bp, Homo sapiens
acagaactgggaaatgcacata

SEQ ID NO: 104697 - DNA, 22 bp, Homo sapiens
ccacgacgagtcatcagggcga

SEQ ID NO: 104698 - DNA, 22 bp, Homo sapiens
atgattgaaaatgacattgcca

SEQ ID NO: 104699 - DNA, 22 bp, Homo sapiens
agtgaggggcagctgagtgggc

SEQ ID NO: 104700 - DNA, 22 bp, Homo sapiens
agtccgtcctgtcaagcagctg

SEQ ID NO: 104701 - DNA, 22 bp, Homo sapiens
gaggctggacgtgcatttctac

SEQ ID NO: 104702 - DNA, 22 bp, Homo sapiens
atacaaaaattagccgggagta

SEQ ID NO: 104703 - DNA, 22 bp, Homo sapiens
cagagctggtgtgtcctggcat

SEQ ID NO: 104704 - DNA, 22 bp, Homo sapiens
tccaaacgggagccaaatgagc

SEQ ID NO: 104705 - DNA, 22 bp, Homo sapiens
atacaaaatatatactggagac

SEQ ID NO: 104706 - DNA, 16 bp, Homo sapiens
gtagccgtggccgctg

SEQ ID NO: 104707 - DNA, 22 bp, Homo sapiens
caggctggagtacaattgtgtg

SEQ ID NO: 104708 - DNA, 22 bp, Homo sapiens
agcgtgaattagttggtacaca

SEQ ID NO: 104709 - DNA, 23 bp, Homo sapiens
tgttccagatacgccttttcctc

SEQ ID NO: 104710 - DNA, 22 bp, Homo sapiens
ctgggcaaattgtgccagctat

SEQ ID NO: 104711 - DNA, 22 bp, Homo sapiens
tctcgctctgtcgcccaggctg

SEQ ID NO: 104712 - DNA, 22 bp, Homo sapiens
tcctgggatcaagtgatcctcc

SEQ ID NO: 104713 - DNA, 22 bp, Homo sapiens
tcagtgcacccaattctctcca

SEQ ID NO: 104714 - DNA, 22 bp, Homo sapiens
actgggctcaagtgattgtcct

SEQ ID NO: 104715 - DNA, 22 bp, Homo sapiens
taggtttactgaattagtggaa

SEQ ID NO: 104716 - DNA, 22 bp, Homo sapiens
ccagcatccatgctccctcggg

SEQ ID NO: 104717 - DNA, 21 bp, Homo sapiens
ctagcccctactccaagttga

SEQ ID NO: 104718 - DNA, 22 bp, Homo sapiens
ccctgcctacagggttttcttt

SEQ ID NO: 104719 - DNA, 22 bp, Homo sapiens
tcagtgcagggtgggagagaga

SEQ ID NO: 104720 - DNA, 22 bp, Homo sapiens
taatgcacatagaagtacttag

SEQ ID NO: 104721 - DNA, 22 bp, Homo sapiens
cggctcactgcagctccgcctc

SEQ ID NO: 104722 - DNA, 22 bp, Homo sapiens
ctcactgcaagctctgcctccc

SEQ ID NO: 104723 - DNA, 22 bp, Homo sapiens
aaggctgaggcagtgaggcaga

SEQ ID NO: 104724 - DNA, 22 bp, Homo sapiens
ctggagtagccggacgggtctg

SEQ ID NO: 104725 - DNA, 20 bp, Homo sapiens
gtgtggccaggagctgcgct

SEQ ID NO: 104726 - DNA, 22 bp, Homo sapiens
actgcaacctccacctcctggg

SEQ ID NO: 104727 - DNA, 22 bp, Homo sapiens
tgaatgtgatgctaaacatatg

SEQ ID NO: 104728 - DNA, 22 bp, Homo sapiens
tagagatggggtcttgctatga

SEQ ID NO: 104729 - DNA, 22 bp, Homo sapiens
tacaaaaaattgatactgacga

SEQ ID NO: 104730 - DNA, 22 bp, Homo sapiens
tagatctgatacaattcatctg

SEQ ID NO: 104731 - DNA, 22 bp, Homo sapiens
cgtgcgcctcagcctcgtgcgc

SEQ ID NO: 104732 - DNA, 22 bp, Homo sapiens
caaccccactacacgttggaga

SEQ ID NO: 104733 - DNA, 22 bp, Homo sapiens
gggtccctggaattacttgaca

SEQ ID NO: 104734 - DNA, 22 bp, Homo sapiens
gcaggtctgttgattacagtca

SEQ ID NO: 104735 - DNA, 22 bp, Homo sapiens
gtcccgcattgggcattcctgg

SEQ ID NO: 104736 - DNA, 22 bp, Homo sapiens
caggctggagtgcagtggtgcc

SEQ ID NO: 104737 - DNA, 22 bp, Homo sapiens
tgagcaggcgcagcaggaggtc

SEQ ID NO: 104738 - DNA, 23 bp, Homo sapiens
cagagctggctcagagctgcctg

SEQ ID NO: 104739 - DNA, 22 bp, Homo sapiens
caggctgatcagggctgggatg

SEQ ID NO: 104740 - DNA, 22 bp, Homo sapiens
tgctcgccccacatgccctcat

SEQ ID NO: 104741 - DNA, 22 bp, Homo sapiens
ttttcatttttgtagatgcaag

SEQ ID NO: 104742 - DNA, 22 bp, Homo sapiens
acaggatcgccctgttgcccag

SEQ ID NO: 104743 - DNA, 22 bp, Homo sapiens
tgcctaggctggagtgtagtgg

SEQ ID NO: 104744 - DNA, 22 bp, Homo sapiens
cccattcatcctcgcttccttc

SEQ ID NO: 104745 - DNA, 22 bp, Homo sapiens
tttctttatcatagcatctttg

SEQ ID NO: 104746 - DNA, 23 bp, Homo sapiens
cagagctggcttcatgggtgtgc

SEQ ID NO: 104747 - DNA, 22 bp, Homo sapiens
tatccaattcaccattgatggg

SEQ ID NO: 104748 - DNA, 22 bp, Homo sapiens
cagtgggtcctgcgtctgccag

SEQ ID NO: 104749 - DNA, 22 bp, Homo sapiens
cactgcactccagcctgggtga

SEQ ID NO: 104750 - DNA, 22 bp, Homo sapiens
tgctcattggcgatctgaggga

SEQ ID NO: 104751 - DNA, 22 bp, Homo sapiens
gtgtatgttctacttaatatta

SEQ ID NO: 104752 - DNA, 22 bp, Homo sapiens
tccattatacttctgattcaaa

SEQ ID NO: 104753 - DNA, 22 bp, Homo sapiens
gtgctccctccttcctcaagga

SEQ ID NO: 104754 - DNA, 22 bp, Homo sapiens
tttgaggttagctagcagatca

SEQ ID NO: 104755 - DNA, 22 bp, Homo sapiens
ttgtgagtagtgccgcaataaa

SEQ ID NO: 104756 - DNA, 22 bp, Homo sapiens
ttctgggcacacaggccctggt

SEQ ID NO: 104757 - DNA, 22 bp, Homo sapiens
aggaattcaagaccagctgggc

SEQ ID NO: 104758 - DNA, 22 bp, Homo sapiens
ctgtatctgtgttggatgagtt

SEQ ID NO: 104759 - DNA, 22 bp, Homo sapiens
ctcactgcaacctccgcctcct

SEQ ID NO: 104760 - DNA, 22 bp, Homo sapiens
tcagccccacggggtcagccaa

SEQ ID NO: 104761 - DNA, 22 bp, Homo sapiens
gaggctgaggttgcagtgagcc

SEQ ID NO: 104762 - DNA, 22 bp, Homo sapiens
tctgttgcaatgtgcatggtga

SEQ ID NO: 104763 - DNA, 22 bp, Homo sapiens
ggatcctaaacttcggcatgcc

SEQ ID NO: 104764 - DNA, 22 bp, Homo sapiens
gtagaccatttatctggggagt

SEQ ID NO: 104765 - DNA, 22 bp, Homo sapiens
tcccctttgtcttcctgtgggt

SEQ ID NO: 104766 - DNA, 22 bp, Homo sapiens
tagcagtgtctaggtaggccat

SEQ ID NO: 104767 - DNA, 22 bp, Homo sapiens
cccaggatggggctgcagttat

SEQ ID NO: 104768 - DNA, 22 bp, Homo sapiens
cctacagttatattcttgattg

SEQ ID NO: 104769 - DNA, 22 bp, Homo sapiens
ctcctgggaaaggctggacaca

SEQ ID NO: 104770 - DNA, 22 bp, Homo sapiens
ctgagctcaagcgatcctccca

SEQ ID NO: 104771 - DNA, 22 bp, Homo sapiens
gtctttcttaaacaacagaaca

SEQ ID NO: 104772 - DNA, 22 bp, Homo sapiens
gtcactgtatccaggttccagc

SEQ ID NO: 104773 - DNA, 22 bp, Homo sapiens
tagtgccctcccctttgggata

SEQ ID NO: 104774 - DNA, 22 bp, Homo sapiens
tagggcaatatttcccagaaaa

SEQ ID NO: 104775 - DNA, 22 bp, Homo sapiens
tgctgagcgcatccggcggccg

SEQ ID NO: 104776 - DNA, 22 bp, Homo sapiens
atgaaatatcttgaagaaattc

SEQ ID NO: 104777 - DNA, 22 bp, Homo sapiens
agatggggtttcatcatgttgg

SEQ ID NO: 104778 - DNA, 22 bp, Homo sapiens
gggttcttatagtatcagagct

SEQ ID NO: 104779 - DNA, 22 bp, Homo sapiens
agcttgtagaaggccacgagca

SEQ ID NO: 104780 - DNA, 22 bp, Homo sapiens
accactgcccatggtgaaaact

SEQ ID NO: 104781 - DNA, 22 bp, Homo sapiens
ttcctgggattattgtcaagca

SEQ ID NO: 104782 - DNA, 22 bp, Homo sapiens
tctctcaggctggagtgcagtg

SEQ ID NO: 104783 - DNA, 22 bp, Homo sapiens
agaacagaggccttatgtttca

SEQ ID NO: 104784 - DNA, 22 bp, Homo sapiens
gtctcgtcaatggcaggttccc

SEQ ID NO: 104785 - DNA, 22 bp, Homo sapiens
accatgttggccaagctggtct

SEQ ID NO: 104786 - DNA, 17 bp, Homo sapiens
cttcccaccatctcctg

SEQ ID NO: 104787 - DNA, 21 bp, Homo sapiens
tagcccttctccacctcgccc

SEQ ID NO: 104788 - DNA, 22 bp, Homo sapiens
cctgtggcgggggccagtgcct

SEQ ID NO: 104789 - DNA, 22 bp, Homo sapiens
gaggctgaggttgcagtgagct

SEQ ID NO: 104790 - DNA, 22 bp, Homo sapiens
tggcccttgttcaaatatgtca

SEQ ID NO: 104791 - DNA, 22 bp, Homo sapiens
ttggatccatctcaggcatagg

SEQ ID NO: 104792 - DNA, 22 bp, Homo sapiens
ttgtggttaaccgcacattttt

SEQ ID NO: 104793 - DNA, 22 bp, Homo sapiens
acatttatataactcactagga

SEQ ID NO: 104794 - DNA, 22 bp, Homo sapiens
caggctggagtgcagtggcgct

SEQ ID NO: 104795 - DNA, 22 bp, Homo sapiens
agtggcctggagccccgcctgg

SEQ ID NO: 104796 - DNA, 22 bp, Homo sapiens
tagcccctgcctttgaacctgg

SEQ ID NO: 104797 - DNA, 22 bp, Homo sapiens
caggctggagttcagtggtgtg

SEQ ID NO: 104798 - DNA, 23 bp, Homo sapiens
ttctgggctgtggaagcctcggg

SEQ ID NO: 104799 - DNA, 22 bp, Homo sapiens
tcataaattctggtgctgtgag

SEQ ID NO: 104800 - DNA, 22 bp, Homo sapiens
tgcaataactactttaatgttg

SEQ ID NO: 104801 - DNA, 22 bp, Homo sapiens
tctcatggagtcaggagcagaa

SEQ ID NO: 104802 - DNA, 22 bp, Homo sapiens
tgaaatgtgtaatgtggatgcc

SEQ ID NO: 104803 - DNA, 22 bp, Homo sapiens
ctccagattccgtttattcagg

SEQ ID NO: 104804 - DNA, 23 bp, Homo sapiens
aggaaagcattcatttttaccat

SEQ ID NO: 104805 - DNA, 22 bp, Homo sapiens
cggatcctcagtcgtgcgggag

SEQ ID NO: 104806 - DNA, 22 bp, Homo sapiens
tttcagatggaggtttaggaca

SEQ ID NO: 104807 - DNA, 22 bp, Homo sapiens
aaattagtgcaccaggttgaag

SEQ ID NO: 104808 - DNA, 22 bp, Homo sapiens
atggggggatgaaggagtccaa

SEQ ID NO: 104809 - DNA, 22 bp, Homo sapiens
gagccccaccctagacattctg

SEQ ID NO: 104810 - DNA, 17 bp, Homo sapiens
gtaaggcttgcagatgc

SEQ ID NO: 104811 - DNA, 19 bp, Homo sapiens
gcctcatttccacctcccc

SEQ ID NO: 104812 - DNA, 22 bp, Homo sapiens
aataaaatggtcagttttctca

SEQ ID NO: 104813 - DNA, 22 bp, Homo sapiens
cggggccctggggctgaaggtc

SEQ ID NO: 104814 - DNA, 22 bp, Homo sapiens
aatgagatggaattcccgccta

SEQ ID NO: 104815 - DNA, 22 bp, Homo sapiens
atgccactgcactccagcctgg

SEQ ID NO: 104816 - DNA, 22 bp, Homo sapiens
gagagtctagtgcacctagttt

SEQ ID NO: 104817 - DNA, 22 bp, Homo sapiens
tcatctaagagtcttacattta

SEQ ID NO: 104818 - DNA, 18 bp, Homo sapiens
tgagaggctattttttgc

SEQ ID NO: 104819 - DNA, 22 bp, Homo sapiens
ctgagcctcctgcttctatttc

SEQ ID NO: 104820 - DNA, 18 bp, Homo sapiens
gagtcgtcggagagtctg

SEQ ID NO: 104821 - DNA, 22 bp, Homo sapiens
aaattgcaaaagtacttttagg

SEQ ID NO: 104822 - DNA, 22 bp, Homo sapiens
cgcaccactgaattccagcctg

SEQ ID NO: 104823 - DNA, 22 bp, Homo sapiens
gggcagagagctggaactcctt

SEQ ID NO: 104824 - DNA, 22 bp, Homo sapiens
atgccactgcgctccagcctgg

SEQ ID NO: 104825 - DNA, 22 bp, Homo sapiens
gtctctatcatagctgaaccct

SEQ ID NO: 104826 - DNA, 20 bp, Homo sapiens
acgtggccaccagtggctta

SEQ ID NO: 104827 - DNA, 22 bp, Homo sapiens
taatatctacttcatagagttt

SEQ ID NO: 104828 - DNA, 22 bp, Homo sapiens
ttttcctttgattcccagatgt

SEQ ID NO: 104829 - DNA, 22 bp, Homo sapiens
aagaggtagcagtcacaaaaga

SEQ ID NO: 104830 - DNA, 22 bp, Homo sapiens
ggaggcagaatagagtgtgggt

SEQ ID NO: 104831 - DNA, 22 bp, Homo sapiens
ccaggctgctgttggtgtccgc

SEQ ID NO: 104832 - DNA, 22 bp, Homo sapiens
aaagaaatagatggcatttaaa

SEQ ID NO: 104833 - DNA, 22 bp, Homo sapiens
gccatcatatcccctgtgacct

SEQ ID NO: 104834 - DNA, 22 bp, Homo sapiens
tcctccccaaagcccagcctgg

SEQ ID NO: 104835 - DNA, 22 bp, Homo sapiens
ataggtccaaggagaggtcttt

SEQ ID NO: 104836 - DNA, 19 bp, Homo sapiens
agggttacccgctgccacc

SEQ ID NO: 104837 - DNA, 22 bp, Homo sapiens
tatgtgtttgacaccctgcaag

SEQ ID NO: 104838 - DNA, 20 bp, Homo sapiens
ataaaataactgccacaaga

SEQ ID NO: 104839 - DNA, 20 bp, Homo sapiens
aaaatatgtataactcttct

SEQ ID NO: 104840 - DNA, 22 bp, Homo sapiens
attataggcttgagccaccgtg

SEQ ID NO: 104841 - DNA, 22 bp, Homo sapiens
tgtatattctgcctaaaagctt

SEQ ID NO: 104842 - DNA, 22 bp, Homo sapiens
aaggctgagacagcacaggtcc

SEQ ID NO: 104843 - DNA, 22 bp, Homo sapiens
tcttagaaattccccagtggct

SEQ ID NO: 104844 - DNA, 22 bp, Homo sapiens
tccaggattgtcagccagaagg

SEQ ID NO: 104845 - DNA, 19 bp, Homo sapiens
ttcacattggaagaagtag

SEQ ID NO: 104846 - DNA, 22 bp, Homo sapiens
ctcactgcaagctcagcctccc

SEQ ID NO: 104847 - DNA, 22 bp, Homo sapiens
aggctcgcatgccctgcaccac

SEQ ID NO: 104848 - DNA, 22 bp, Homo sapiens
aaggaggttatcccagtggact

SEQ ID NO: 104849 - DNA, 22 bp, Homo sapiens
gagctgaaggagaaagcagggg

SEQ ID NO: 104850 - DNA, 22 bp, Homo sapiens
ctggtctggctacccagcgaat

SEQ ID NO: 104851 - DNA, 22 bp, Homo sapiens
ccatcacagtccccatcgtgat

SEQ ID NO: 104852 - DNA, 22 bp, Homo sapiens
tgcaccctcatcagtcaaatgg

SEQ ID NO: 104853 - DNA, 22 bp, Homo sapiens
cactgctacctctgcctcccgg

SEQ ID NO: 104854 - DNA, 22 bp, Homo sapiens
ttaggcctttgattggggtgct

SEQ ID NO: 104855 - DNA, 21 bp, Homo sapiens
ttggccgtgcagatgaacagc

SEQ ID NO: 104856 - DNA, 22 bp, Homo sapiens
gtagtctgaacagtaattttgt

SEQ ID NO: 104857 - DNA, 22 bp, Homo sapiens
caggctggagtgcagtggcgcc

SEQ ID NO: 104858 - DNA, 22 bp, Homo sapiens
gctcccagtctgatggaggaga

SEQ ID NO: 104859 - DNA, 22 bp, Homo sapiens
cagagcttcctgctgggcttct

SEQ ID NO: 104860 - DNA, 22 bp, Homo sapiens
tagcataacaggtaagagtgag

SEQ ID NO: 104861 - DNA, 22 bp, Homo sapiens
cctcccctcagacagagactgg

SEQ ID NO: 104862 - DNA, 22 bp, Homo sapiens
cggctggtgtcgggcacagcaa

SEQ ID NO: 104863 - DNA, 22 bp, Homo sapiens
atgtttttggaaatgggaacat

SEQ ID NO: 104864 - DNA, 22 bp, Homo sapiens
gggctgggattgcttgctgtga

SEQ ID NO: 104865 - DNA, 22 bp, Homo sapiens
gactgtggggaagcagatgcca

SEQ ID NO: 104866 - DNA, 22 bp, Homo sapiens
actttatttcctattgcatcca

SEQ ID NO: 104867 - DNA, 22 bp, Homo sapiens
gtggattacaagacagttgaga

SEQ ID NO: 104868 - DNA, 22 bp, Homo sapiens
ctctgcctgtctcatcctgcaa

SEQ ID NO: 104869 - DNA, 22 bp, Homo sapiens
tctggcttcgcagctcccagcc

SEQ ID NO: 104870 - DNA, 22 bp, Homo sapiens
ttctgattgctgatgaggccca

SEQ ID NO: 104871 - DNA, 22 bp, Homo sapiens
gcaggtctatcaggctgcaggt

SEQ ID NO: 104872 - DNA, 22 bp, Homo sapiens
aggggatggagctggaaggcag

SEQ ID NO: 104873 - DNA, 22 bp, Homo sapiens
tcaaatgttccctgtactggcc

SEQ ID NO: 104874 - DNA, 22 bp, Homo sapiens
tataaagagtctcaaagaagtt

SEQ ID NO: 104875 - DNA, 23 bp, Homo sapiens
tctctgcatgtcctgagcacatc

SEQ ID NO: 104876 - DNA, 18 bp, Homo sapiens
atggtctcatactgggag

SEQ ID NO: 104877 - DNA, 22 bp, Homo sapiens
tcaggcagtagaattgcttgaa

SEQ ID NO: 104878 - DNA, 22 bp, Homo sapiens
ccaggctggagtgcagtggcac

SEQ ID NO: 104879 - DNA, 20 bp, Homo sapiens
ccagagctgatggctgcccg

SEQ ID NO: 104880 - DNA, 22 bp, Homo sapiens
ggcttagcaactcctgaggctc

SEQ ID NO: 104881 - DNA, 22 bp, Homo sapiens
ggttctctaactttgactggag

SEQ ID NO: 104882 - DNA, 20 bp, Homo sapiens
tcccccactgtttctgctac

SEQ ID NO: 104883 - DNA, 22 bp, Homo sapiens
tacaggcatgtagcatggtgat

SEQ ID NO: 104884 - DNA, 22 bp, Homo sapiens
cctttaggagtgaggaccgagc

SEQ ID NO: 104885 - DNA, 22 bp, Homo sapiens
gaatgtgtactgagtgcccctt

SEQ ID NO: 104886 - DNA, 22 bp, Homo sapiens
gggatctgggacaacaggtggt

SEQ ID NO: 104887 - DNA, 22 bp, Homo sapiens
actgccaatggtagtttgatgg

SEQ ID NO: 104888 - DNA, 22 bp, Homo sapiens
tcaccgccttgcccggccgggc

SEQ ID NO: 104889 - DNA, 22 bp, Homo sapiens
agaaatatgctgattagatgaa

SEQ ID NO: 104890 - DNA, 22 bp, Homo sapiens
actctggccatcttggaccttg

SEQ ID NO: 104891 - DNA, 22 bp, Homo sapiens
tccaggatggtgacggtggcca

SEQ ID NO: 104892 - DNA, 20 bp, Homo sapiens
ttcaggaataagatagcagc

SEQ ID NO: 104893 - DNA, 22 bp, Homo sapiens
ttttaatactgctattgtagga

SEQ ID NO: 104894 - DNA, 22 bp, Homo sapiens
tagaatgtaaattccaagggca

SEQ ID NO: 104895 - DNA, 22 bp, Homo sapiens
taagaaatttagttatagaatg

SEQ ID NO: 104896 - DNA, 22 bp, Homo sapiens
gccatgactctccataccaaag

SEQ ID NO: 104897 - DNA, 22 bp, Homo sapiens
tggctccacaggccagggtgtg

SEQ ID NO: 104898 - DNA, 18 bp, Homo sapiens
tgtccctgcaaataacat

SEQ ID NO: 104899 - DNA, 22 bp, Homo sapiens
tccgggcaactgaagggaggtt

SEQ ID NO: 104900 - DNA, 22 bp, Homo sapiens
ctcactgcaacctctgcctccc

SEQ ID NO: 104901 - DNA, 22 bp, Homo sapiens
gctgtagtgaatggccgcgttc

SEQ ID NO: 104902 - DNA, 21 bp, Homo sapiens
gggcctggctgcgcaggacgg

SEQ ID NO: 104903 - DNA, 22 bp, Homo sapiens
tttatgtagttacggactatca

SEQ ID NO: 104904 - DNA, 22 bp, Homo sapiens
aggctaggaacagcccggccct

SEQ ID NO: 104905 - DNA, 22 bp, Homo sapiens
ctgggctcaagtgatccaccca

SEQ ID NO: 104906 - DNA, 22 bp, Homo sapiens
tttttagtagaggtgggtttca

SEQ ID NO: 104907 - DNA, 22 bp, Homo sapiens
acccacgaagatgagcggcatg

SEQ ID NO: 104908 - DNA, 22 bp, Homo sapiens
gaaaattattgaaaatggctct

SEQ ID NO: 104909 - DNA, 22 bp, Homo sapiens
atattgaaccctacagactgta

SEQ ID NO: 104910 - DNA, 18 bp, Homo sapiens
actctttctgcccacagg

SEQ ID NO: 104911 - DNA, 22 bp, Homo sapiens
ggggtgggcgtgcagggacacc

SEQ ID NO: 104912 - DNA, 22 bp, Homo sapiens
tgactcagtacatctggagttg

SEQ ID NO: 104913 - DNA, 22 bp, Homo sapiens
tgggccgtggagcactctgaga

SEQ ID NO: 104914 - DNA, 22 bp, Homo sapiens
gctgccttgccctcttcccata

SEQ ID NO: 104915 - DNA, 22 bp, Homo sapiens
caccctcaagcagtggcacgtg

SEQ ID NO: 104916 - DNA, 22 bp, Homo sapiens
ccaggttggagttcagtggcgc

SEQ ID NO: 104917 - DNA, 22 bp, Homo sapiens
agatgctgctccacaggccagg

SEQ ID NO: 104918 - DNA, 22 bp, Homo sapiens
agaggctgcacttgctcatgat

SEQ ID NO: 104919 - DNA, 22 bp, Homo sapiens
agacggattacctgaggtcagg

SEQ ID NO: 104920 - DNA, 22 bp, Homo sapiens
cccaggcttttctcttgcccca

SEQ ID NO: 104921 - DNA, 21 bp, Homo sapiens
cactccacttagaacagggtt

SEQ ID NO: 104922 - DNA, 22 bp, Homo sapiens
ttgtatagcccagagagtgaga

SEQ ID NO: 104923 - DNA, 22 bp, Homo sapiens
ttgtaacaggtactaaataact

SEQ ID NO: 104924 - DNA, 22 bp, Homo sapiens
ggtagtcggccttgccctgggc

SEQ ID NO: 104925 - DNA, 22 bp, Homo sapiens
cgtgtacagtctatcttttttc

SEQ ID NO: 104926 - DNA, 17 bp, Homo sapiens
acttcccacccctccag

SEQ ID NO: 104927 - DNA, 22 bp, Homo sapiens
aaatcgcttgaacccaggaagt

SEQ ID NO: 104928 - DNA, 23 bp, Homo sapiens
ggagtgcaatggcgccatctcgg

SEQ ID NO: 104929 - DNA, 22 bp, Homo sapiens
tagcacagcttcttgatgtcac

SEQ ID NO: 104930 - DNA, 22 bp, Homo sapiens
actaaagctcacagagttgaac

SEQ ID NO: 104931 - DNA, 22 bp, Homo sapiens
ggagctgttcaggactgcttca

SEQ ID NO: 104932 - DNA, 16 bp, Homo sapiens
tgggtgggaggagcgg

SEQ ID NO: 104933 - DNA, 22 bp, Homo sapiens
gaatgcagatggctggtgtatg

SEQ ID NO: 104934 - DNA, 22 bp, Homo sapiens
aggtagaaggaccagaatttat

SEQ ID NO: 104935 - DNA, 22 bp, Homo sapiens
ctggcctggcgcagtggctcac

SEQ ID NO: 104936 - DNA, 21 bp, Homo sapiens
cgcagagcgaacttgcggcgc

SEQ ID NO: 104937 - DNA, 22 bp, Homo sapiens
tgtttacagctgatcaggcatc

SEQ ID NO: 104938 - DNA, 22 bp, Homo sapiens
tcttttgtgattcttcagttac

SEQ ID NO: 104939 - DNA, 22 bp, Homo sapiens
agagggcattaactctgtcttg

SEQ ID NO: 104940 - DNA, 22 bp, Homo sapiens
aaagaaatagatggcatttaaa

SEQ ID NO: 104941 - DNA, 17 bp, Homo sapiens
cagtcgaggaggacctg

SEQ ID NO: 104942 - DNA, 22 bp, Homo sapiens
atatatttgagaatattcatga

SEQ ID NO: 104943 - DNA, 22 bp, Homo sapiens
tgtgacctcatcttaactggaa

SEQ ID NO: 104944 - DNA, 19 bp, Homo sapiens
gactcacaccttccgctgt

SEQ ID NO: 104945 - DNA, 22 bp, Homo sapiens
attttttgttaactcaggatag

SEQ ID NO: 104946 - DNA, 22 bp, Homo sapiens
ggtgacctcacctggtcccacc

SEQ ID NO: 104947 - DNA, 22 bp, Homo sapiens
agaggccggccgagcccatggg

SEQ ID NO: 104948 - DNA, 22 bp, Homo sapiens
tcttgcacttcatgaatatgtt

SEQ ID NO: 104949 - DNA, 22 bp, Homo sapiens
ttaaattttagaaacagactct

SEQ ID NO: 104950 - DNA, 22 bp, Homo sapiens
tttaaaaaactagtctgagtct

SEQ ID NO: 104951 - DNA, 22 bp, Homo sapiens
gagaagtcatttgaccacctag

SEQ ID NO: 104952 - DNA, 22 bp, Homo sapiens
catttacatttaaggttaatat

SEQ ID NO: 104953 - DNA, 22 bp, Homo sapiens
aaaactacatttgacattttgt

SEQ ID NO: 104954 - DNA, 23 bp, Homo sapiens
attttttgtctttgtaactagat

SEQ ID NO: 104955 - DNA, 22 bp, Homo sapiens
ggtgtagctctgtgtcccactg

SEQ ID NO: 104956 - DNA, 22 bp, Homo sapiens
gcagcctcaaactccccagctc

SEQ ID NO: 104957 - DNA, 22 bp, Homo sapiens
atctggttcttcttaggcatca

SEQ ID NO: 104958 - DNA, 22 bp, Homo sapiens
ttatagcagcatgatttacaat

SEQ ID NO: 104959 - DNA, 22 bp, Homo sapiens
tcattacaagatttccaatttg

SEQ ID NO: 104960 - DNA, 22 bp, Homo sapiens
tcactcaggctggagtgcagtg

SEQ ID NO: 104961 - DNA, 22 bp, Homo sapiens
tttctggcagcgggacaggggt

SEQ ID NO: 104962 - DNA, 22 bp, Homo sapiens
ttgtaacaggtactaaataact

SEQ ID NO: 104963 - DNA, 22 bp, Homo sapiens
gagtcgagcagaaagccgtcgg

SEQ ID NO: 104964 - DNA, 22 bp, Homo sapiens
acatttttcacatttgtagggt

SEQ ID NO: 104965 - DNA, 22 bp, Homo sapiens
tctaaattactttgggcagtat

SEQ ID NO: 104966 - DNA, 22 bp, Homo sapiens
tgagatgaataactcctgctaa

SEQ ID NO: 104967 - DNA, 22 bp, Homo sapiens
attgtcagtttaatatagtcaa

SEQ ID NO: 104968 - DNA, 22 bp, Homo sapiens
agaggaggctctgggatcgtcc

SEQ ID NO: 104969 - DNA, 22 bp, Homo sapiens
ttaccaaatgaaatagagattt

SEQ ID NO: 104970 - DNA, 22 bp, Homo sapiens
atttagaactttgtttgccaat

SEQ ID NO: 104971 - DNA, 22 bp, Homo sapiens
tgacctattagatttccttgcc

SEQ ID NO: 104972 - DNA, 22 bp, Homo sapiens
aatgtcaaaggctatacattca

SEQ ID NO: 104973 - DNA, 22 bp, Homo sapiens
tcgaaataatttagaatataga

SEQ ID NO: 104974 - DNA, 22 bp, Homo sapiens
aagtccaggtcctcattccatc

SEQ ID NO: 104975 - DNA, 22 bp, Homo sapiens
caaatactacgattcttgcagt

SEQ ID NO: 104976 - DNA, 22 bp, Homo sapiens
ttgtctctggaaggaaaaagca

SEQ ID NO: 104977 - DNA, 22 bp, Homo sapiens
ttgttgtcattgtagaggattt

SEQ ID NO: 104978 - DNA, 22 bp, Homo sapiens
ttttgacaatgctaatctcaat

SEQ ID NO: 104979 - DNA, 22 bp, Homo sapiens
gaggcaggaggattgcttgagc

SEQ ID NO: 104980 - DNA, 22 bp, Homo sapiens
ttgcagatatttccgatgctat

SEQ ID NO: 104981 - DNA, 22 bp, Homo sapiens
caatttgccctgttaaattttc

SEQ ID NO: 104982 - DNA, 22 bp, Homo sapiens
aaaaagtattggccatggttga

SEQ ID NO: 104983 - DNA, 22 bp, Homo sapiens
aggtcaccatggcatgctccac

SEQ ID NO: 104984 - DNA, 22 bp, Homo sapiens
acagttaataagtagtaagtca

SEQ ID NO: 104985 - DNA, 22 bp, Homo sapiens
gaaaggagagggttaaggagct

SEQ ID NO: 104986 - DNA, 22 bp, Homo sapiens
gaggcaggcagattgcttgagg

SEQ ID NO: 104987 - DNA, 22 bp, Homo sapiens
tacatttataaggcttctctgt

SEQ ID NO: 104988 - DNA, 22 bp, Homo sapiens
cacatttttactgccaacttaa

SEQ ID NO: 104989 - DNA, 22 bp, Homo sapiens
ttatttttaaaagttcacacag

SEQ ID NO: 104990 - DNA, 22 bp, Homo sapiens
cattctgcgatcctcaagcaca

SEQ ID NO: 104991 - DNA, 22 bp, Homo sapiens
ttgacctatgtttcttcatctg

SEQ ID NO: 104992 - DNA, 22 bp, Homo sapiens
attttctatgttgtaattgtta

SEQ ID NO: 104993 - DNA, 22 bp, Homo sapiens
atataatttttggttagctcaa

SEQ ID NO: 104994 - DNA, 22 bp, Homo sapiens
atgaaatatcttgaagaaattc

SEQ ID NO: 104995 - DNA, 22 bp, Homo sapiens
ttaaatattatgttgtctgcaa

SEQ ID NO: 104996 - DNA, 22 bp, Homo sapiens
gagacgtggcctttgcctgagc

SEQ ID NO: 104997 - DNA, 22 bp, Homo sapiens
atccatttgacataatttcagc

SEQ ID NO: 104998 - DNA, 22 bp, Homo sapiens
ttaattctgcctttcatgtaac

SEQ ID NO: 104999 - DNA, 22 bp, Homo sapiens
gaaaggagagggttaaggagct

SEQ ID NO: 105000 - DNA, 22 bp, Homo sapiens
cattctctctacttgttttcaa

SEQ ID NO: 105001 - DNA, 22 bp, Homo sapiens
tctgtagtaggttgtagttctt

SEQ ID NO: 105002 - DNA, 22 bp, Homo sapiens
actgcactccaacctgggtgac

SEQ ID NO: 105003 - DNA, 22 bp, Homo sapiens
actgcactccagcctgggtaac

SEQ ID NO: 105004 - DNA, 22 bp, Homo sapiens
cagctacaaatacttttgtatg

SEQ ID NO: 105005 - DNA, 22 bp, Homo sapiens
ttggagaggcagtcttgctctg

SEQ ID NO: 105006 - DNA, 22 bp, Homo sapiens
ctccaggccatggctgcggagg

SEQ ID NO: 105007 - DNA, 22 bp, Homo sapiens
caggaaggcgcggctgtgcctg

SEQ ID NO: 105008 - DNA, 23 bp, Homo sapiens
gcctgggagttgcgatctgcccg

SEQ ID NO: 105009 - DNA, 22 bp, Homo sapiens
tgggaagctgcattttaacaag

SEQ ID NO: 105010 - DNA, 22 bp, Homo sapiens
tttggaaatgaccccgtctaag

SEQ ID NO: 105011 - DNA, 22 bp, Homo sapiens
tgcaatctcggcactttgggag

SEQ ID NO: 105012 - DNA, 22 bp, Homo sapiens
tgtatgttgggtcaaagtacat

SEQ ID NO: 105013 - DNA, 22 bp, Homo sapiens
attgtcgtcaatggacacatag

SEQ ID NO: 105014 - DNA, 22 bp, Homo sapiens
actttaaaactgatcatcagag

SEQ ID NO: 105015 - DNA, 23 bp, Homo sapiens
tcagaacagttcttggtgcatag

SEQ ID NO: 105016 - DNA, 22 bp, Homo sapiens
caggctggagttcagtggtgtg

SEQ ID NO: 105017 - DNA, 22 bp, Homo sapiens
ataagattgtcatagtatggac

SEQ ID NO: 105018 - DNA, 22 bp, Homo sapiens
tggcacagcctccatgtcgtcc

SEQ ID NO: 105019 - DNA, 22 bp, Homo sapiens
tttgctattgtgaatagtgcca

SEQ ID NO: 105020 - DNA, 22 bp, Homo sapiens
tacatagctcctagtgatgcat

SEQ ID NO: 105021 - DNA, 22 bp, Homo sapiens
cactgcactgcagcctggagac

SEQ ID NO: 105022 - DNA, 22 bp, Homo sapiens
cagtgcagccaaggacaggcac

SEQ ID NO: 105023 - DNA, 22 bp, Homo sapiens
atgaaaacggaccagagctatt

SEQ ID NO: 105024 - DNA, 22 bp, Homo sapiens
gggctgtaggagctggaatggg

SEQ ID NO: 105025 - DNA, 22 bp, Homo sapiens
gctggaggatggactggaagaa

SEQ ID NO: 105026 - DNA, 22 bp, Homo sapiens
gctaagggataggctgcctcct

SEQ ID NO: 105027 - DNA, 22 bp, Homo sapiens
cagagactggagtgcagtggcg

SEQ ID NO: 105028 - DNA, 21 bp, Homo sapiens
ggaatagcctccttgaactca

SEQ ID NO: 105029 - DNA, 23 bp, Homo sapiens
agctctgctcgggcatgccctgc

SEQ ID NO: 105030 - DNA, 22 bp, Homo sapiens
cgggttcacgccattctcctgc

SEQ ID NO: 105031 - DNA, 22 bp, Homo sapiens
agcgctgtgggcgtgcgaggag

SEQ ID NO: 105032 - DNA, 21 bp, Homo sapiens
tactgtagccttgcactgtag

SEQ ID NO: 105033 - DNA, 22 bp, Homo sapiens
acagagcaatgcgtgttctcta

SEQ ID NO: 105034 - DNA, 22 bp, Homo sapiens
ttgcactccagcccgagcaaca

SEQ ID NO: 105035 - DNA, 22 bp, Homo sapiens
ggcttagcaactcctgaggctc

SEQ ID NO: 105036 - DNA, 22 bp, Homo sapiens
tgaatatgtgactttgatttca

SEQ ID NO: 105037 - DNA, 22 bp, Homo sapiens
aattttctggtgtgtaatgaag

SEQ ID NO: 105038 - DNA, 22 bp, Homo sapiens
catctgtctgcatgctctgggt

SEQ ID NO: 105039 - DNA, 22 bp, Homo sapiens
ttccatttggcacttcactgag

SEQ ID NO: 105040 - DNA, 22 bp, Homo sapiens
ctggggtcagggatcagagagc

SEQ ID NO: 105041 - DNA, 22 bp, Homo sapiens
gagtttcttcatggtgcagagg

SEQ ID NO: 105042 - DNA, 22 bp, Homo sapiens
ttatttgtggcatatgagacga

SEQ ID NO: 105043 - DNA, 20 bp, Homo sapiens
ttcatgggagcaaagaggcc

SEQ ID NO: 105044 - DNA, 22 bp, Homo sapiens
gagcagtaggagaaccctgagc

SEQ ID NO: 105045 - DNA, 22 bp, Homo sapiens
ggtgtagctctgtgtcccactg

SEQ ID NO: 105046 - DNA, 22 bp, Homo sapiens
agcttgtgctggaattacatgt

SEQ ID NO: 105047 - DNA, 22 bp, Homo sapiens
atataatttttggttagctcaa

SEQ ID NO: 105048 - DNA, 22 bp, Homo sapiens
atcagagtagttgttgcccaga

SEQ ID NO: 105049 - DNA, 22 bp, Homo sapiens
ttttcctttgattcccagatgt

SEQ ID NO: 105050 - DNA, 22 bp, Homo sapiens
atccccctcttggatggcggca

SEQ ID NO: 105051 - DNA, 19 bp, Homo sapiens
cggtccatccgattttaca

SEQ ID NO: 105052 - DNA, 22 bp, Homo sapiens
aggaaataagggacaagacaaa

SEQ ID NO: 105053 - DNA, 22 bp, Homo sapiens
tcgctgaggctgcacggctgcc

SEQ ID NO: 105054 - DNA, 22 bp, Homo sapiens
agtgtttgagtttgcggcattg

SEQ ID NO: 105055 - DNA, 22 bp, Homo sapiens
aatgtgagccaatgcccgtggg

SEQ ID NO: 105056 - DNA, 22 bp, Homo sapiens
gcccttggcctctttggcccgg

SEQ ID NO: 105057 - DNA, 22 bp, Homo sapiens
agagagcccgggccagggcaca

SEQ ID NO: 105058 - DNA, 22 bp, Homo sapiens
tctggcttcgcagctcccagcc

SEQ ID NO: 105059 - DNA, 22 bp, Homo sapiens
tcaagggcaaatgctacctata

SEQ ID NO: 105060 - DNA, 21 bp, Homo sapiens
cgcagagcgaacttgcggcgc

SEQ ID NO: 105061 - DNA, 22 bp, Homo sapiens
agggcgctgaaatactaacatg

SEQ ID NO: 105062 - DNA, 22 bp, Homo sapiens
gagaaagcttctttcccacagg

SEQ ID NO: 105063 - DNA, 22 bp, Homo sapiens
aagatccttcatatgggttttg

SEQ ID NO: 105064 - DNA, 22 bp, Homo sapiens
tgcacgtgtgagcattcacatg

SEQ ID NO: 105065 - DNA, 22 bp, Homo sapiens
tgagtgtggggaatgtcatgag

SEQ ID NO: 105066 - DNA, 22 bp, Homo sapiens
gcagggaggtttgctgacctgg

SEQ ID NO: 105067 - DNA, 22 bp, Homo sapiens
acttcttcttcagctgggggat

SEQ ID NO: 105068 - DNA, 22 bp, Homo sapiens
gaagaaagatcaaatagtttcc

SEQ ID NO: 105069 - DNA, 22 bp, Homo sapiens
acaaagtgctgacattacaggc

SEQ ID NO: 105070 - DNA, 22 bp, Homo sapiens
tatttcttttcgtgacttattg

SEQ ID NO: 105071 - DNA, 22 bp, Homo sapiens
cctccccacagcccaggagact

SEQ ID NO: 105072 - DNA, 22 bp, Homo sapiens
cagcatgaatgtgttcgtaggg

SEQ ID NO: 105073 - DNA, 22 bp, Homo sapiens
gatggcacacagacatccccgc

SEQ ID NO: 105074 - DNA, 22 bp, Homo sapiens
ttcacagtggtagtgcatttag

SEQ ID NO: 105075 - DNA, 22 bp, Homo sapiens
actctgcctgcggtgggcggga

SEQ ID NO: 105076 - DNA, 22 bp, Homo sapiens
gggcatggtggcaggcacctgt

SEQ ID NO: 105077 - DNA, 22 bp, Homo sapiens
accctggacatcttgtcatagc

SEQ ID NO: 105078 - DNA, 22 bp, Homo sapiens
tgacacccatctgtgccagtcc

SEQ ID NO: 105079 - DNA, 22 bp, Homo sapiens
aggccctattcaatggggccca

SEQ ID NO: 105080 - DNA, 22 bp, Homo sapiens
aggccagcctcaggcagggacc

SEQ ID NO: 105081 - DNA, 22 bp, Homo sapiens
ttctgccatctgcagaagggga

SEQ ID NO: 105082 - DNA, 22 bp, Homo sapiens
aaggaggttatcccagtggact

SEQ ID NO: 105083 - DNA, 22 bp, Homo sapiens
cattgcactcctgcctgggcaa

SEQ ID NO: 105084 - DNA, 22 bp, Homo sapiens
gagagcaggaggcagcgggacg

SEQ ID NO: 105085 - DNA, 22 bp, Homo sapiens
aacactctctgttggtaaggct

SEQ ID NO: 105086 - DNA, 22 bp, Homo sapiens
ctcttcctagtgtgcagcgtgg

SEQ ID NO: 105087 - DNA, 19 bp, Homo sapiens
ccctcttgcacaaagcaaa

SEQ ID NO: 105088 - DNA, 22 bp, Homo sapiens
ccaggctggagtgcagtggcac

SEQ ID NO: 105089 - DNA, 22 bp, Homo sapiens
ggcatcgtcctgggcataggga

SEQ ID NO: 105090 - DNA, 19 bp, Homo sapiens
ctgtccttggctgcactgt

SEQ ID NO: 105091 - DNA, 22 bp, Homo sapiens
tcactgcaacctccacctcccg

SEQ ID NO: 105092 - DNA, 22 bp, Homo sapiens
agtggcctggagccccgcctgg

SEQ ID NO: 105093 - DNA, 22 bp, Homo sapiens
gcagtggcatgatgtgggctca

SEQ ID NO: 105094 - DNA, 22 bp, Homo sapiens
tgggaggccgaggcaggtggat

SEQ ID NO: 105095 - DNA, 22 bp, Homo sapiens
ggctcctgggggtgctcctgcc

SEQ ID NO: 105096 - DNA, 22 bp, Homo sapiens
atatgcagtctcttgcccttct

SEQ ID NO: 105097 - DNA, 22 bp, Homo sapiens
gatgctgagagattggagacta

SEQ ID NO: 105098 - DNA, 22 bp, Homo sapiens
gaccaaggaagaggggagccag

SEQ ID NO: 105099 - DNA, 22 bp, Homo sapiens
acacggcactttaggaaggggc

SEQ ID NO: 105100 - DNA, 22 bp, Homo sapiens
cagcccaggactgcaggtgttt

SEQ ID NO: 105101 - DNA, 22 bp, Homo sapiens
tacagggattgttttaatcacc

SEQ ID NO: 105102 - DNA, 23 bp, Homo sapiens
aatatcaaggtgatgttcccaga

SEQ ID NO: 105103 - DNA, 22 bp, Homo sapiens
gaggtgggtgtatcacaggtca

SEQ ID NO: 105104 - DNA, 22 bp, Homo sapiens
tcctgggatcaagtgatcctcc

SEQ ID NO: 105105 - DNA, 22 bp, Homo sapiens
atgattgaccatctgctgggct

SEQ ID NO: 105106 - DNA, 23 bp, Homo sapiens
atgtttgcagtaacccatcctgg

SEQ ID NO: 105107 - DNA, 22 bp, Homo sapiens
gacctcatgatccacctgcctt

SEQ ID NO: 105108 - DNA, 22 bp, Homo sapiens
atgcagtggcttcagtgtcagt

SEQ ID NO: 105109 - DNA, 22 bp, Homo sapiens
aaagtgctcggattacaggtat

SEQ ID NO: 105110 - DNA, 22 bp, Homo sapiens
gagctcattcattcattgcctg

SEQ ID NO: 105111 - DNA, 22 bp, Homo sapiens
cctttgatttcccccgtctcag

SEQ ID NO: 105112 - DNA, 22 bp, Homo sapiens
gactttgctgtgtcagcttcag

SEQ ID NO: 105113 - DNA, 22 bp, Homo sapiens
ctgggaggtggaggttgcattg

SEQ ID NO: 105114 - DNA, 22 bp, Homo sapiens
agccagggacgctgcaggctac

SEQ ID NO: 105115 - DNA, 22 bp, Homo sapiens
ggccgctctccggtgtggatct

SEQ ID NO: 105116 - DNA, 16 bp, Homo sapiens
aggctcagaggctgga

SEQ ID NO: 105117 - DNA, 22 bp, Homo sapiens
ctacaccggagcctggaaggta

SEQ ID NO: 105118 - DNA, 22 bp, Homo sapiens
gagcaggaaggccagaagggtc

SEQ ID NO: 105119 - DNA, 22 bp, Homo sapiens
actaggggctcaggcccaggga

SEQ ID NO: 105120 - DNA, 22 bp, Homo sapiens
gtggcatctcagaggccaagaa

SEQ ID NO: 105121 - DNA, 22 bp, Homo sapiens
tcctgccttgcctgggacatca

SEQ ID NO: 105122 - DNA, 22 bp, Homo sapiens
gcctcctgtcccaggctgagga

SEQ ID NO: 105123 - DNA, 22 bp, Homo sapiens
ctctggagtgtctggccagggt

SEQ ID NO: 105124 - DNA, 22 bp, Homo sapiens
gagcactgatttatttttgtct

SEQ ID NO: 105125 - DNA, 22 bp, Homo sapiens
tttctataaaaagtgctaggat

SEQ ID NO: 105126 - DNA, 22 bp, Homo sapiens
tcctccccaaagcccagcctgg

SEQ ID NO: 105127 - DNA, 22 bp, Homo sapiens
aaagcagaggttgcagtgagct

SEQ ID NO: 105128 - DNA, 22 bp, Homo sapiens
tgaccctgagagctgaatggct

SEQ ID NO: 105129 - DNA, 22 bp, Homo sapiens
aggaatgacagatgtccgcacc

SEQ ID NO: 105130 - DNA, 21 bp, Homo sapiens
gaacccagcagcagtgctctg

SEQ ID NO: 105131 - DNA, 22 bp, Homo sapiens
tcacagagttaaaagtttcttt

SEQ ID NO: 105132 - DNA, 22 bp, Homo sapiens
tgacttgtctctttgggagaca

SEQ ID NO: 105133 - DNA, 22 bp, Homo sapiens
ctgctcttgagggactgcggtc

SEQ ID NO: 105134 - DNA, 22 bp, Homo sapiens
agaggaggctctgggatcgtcc

SEQ ID NO: 105135 - DNA, 22 bp, Homo sapiens
tctgccttgtttgagctttgac

SEQ ID NO: 105136 - DNA, 22 bp, Homo sapiens
gctcccagtctgatggaggaga

SEQ ID NO: 105137 - DNA, 22 bp, Homo sapiens
gtacactccccctgtgaagttg

SEQ ID NO: 105138 - DNA, 22 bp, Homo sapiens
gatcatgcttaaagttggagtc

SEQ ID NO: 105139 - DNA, 22 bp, Homo sapiens
actgcactcctgcctgggtaac

SEQ ID NO: 105140 - DNA, 22 bp, Homo sapiens
aagaactgagtacgttaataaa

SEQ ID NO: 105141 - DNA, 22 bp, Homo sapiens
attgtactacaccatagtactg

SEQ ID NO: 105142 - DNA, 22 bp, Homo sapiens
agtccaaagcagatgagggcca

SEQ ID NO: 105143 - DNA, 20 bp, Homo sapiens
agacaccccctgacagggaa

SEQ ID NO: 105144 - DNA, 22 bp, Homo sapiens
gccccagcctcccgagtagctg

SEQ ID NO: 105145 - DNA, 22 bp, Homo sapiens
atagcagggatgtcagcaagta

SEQ ID NO: 105146 - DNA, 22 bp, Homo sapiens
ctgcactgacttccccggctgc

SEQ ID NO: 105147 - DNA, 22 bp, Homo sapiens
gggacaatggaggcctctctcc

SEQ ID NO: 105148 - DNA, 22 bp, Homo sapiens
ggagcagggaattacagcgcag

SEQ ID NO: 105149 - DNA, 22 bp, Homo sapiens
tgagcccagagatctgagctat

SEQ ID NO: 105150 - DNA, 22 bp, Homo sapiens
cctttaggagtgaggaccgagc

SEQ ID NO: 105151 - DNA, 22 bp, Homo sapiens
gggtaattggggccttgcagtg

SEQ ID NO: 105152 - DNA, 22 bp, Homo sapiens
gtcttagatttcaccgataatg

SEQ ID NO: 105153 - DNA, 22 bp, Homo sapiens
cagtggatcctctgactccctc

SEQ ID NO: 105154 - DNA, 22 bp, Homo sapiens
agagtgcaaccgaaacaagcag

SEQ ID NO: 105155 - DNA, 22 bp, Homo sapiens
gcctggagaaaggaaggtggga

SEQ ID NO: 105156 - DNA, 22 bp, Homo sapiens
tactgtgtgcccagccgagctg

SEQ ID NO: 105157 - DNA, 22 bp, Homo sapiens
tttggaaattttcatccagaca

SEQ ID NO: 105158 - DNA, 22 bp, Homo sapiens
gttcacagtttctaatcccagc

SEQ ID NO: 105159 - DNA, 22 bp, Homo sapiens
cagggcctcctaaggcatctaa

SEQ ID NO: 105160 - DNA, 23 bp, Homo sapiens
tctgtgtctccacccaaatctca

SEQ ID NO: 105161 - DNA, 22 bp, Homo sapiens
taaagctctgggtttctagatc

SEQ ID NO: 105162 - DNA, 22 bp, Homo sapiens
aggaaggactccatggtccgtc

SEQ ID NO: 105163 - DNA, 22 bp, Homo sapiens
atgggctgtccattgctggctg

SEQ ID NO: 105164 - DNA, 22 bp, Homo sapiens
aaaactgaaatacgatccaatg

SEQ ID NO: 105165 - DNA, 22 bp, Homo sapiens
atgagttgaagctacaagaggc

SEQ ID NO: 105166 - DNA, 22 bp, Homo sapiens
ttggaatgttttaatataaatt

SEQ ID NO: 105167 - DNA, 22 bp, Homo sapiens
gctgaaggcccggaggacaggg

SEQ ID NO: 105168 - DNA, 22 bp, Homo sapiens
ctgcggctctgcgggcagctgg

SEQ ID NO: 105169 - DNA, 22 bp, Homo sapiens
agttggagtgaacatgagattg

SEQ ID NO: 105170 - DNA, 22 bp, Homo sapiens
catttacatttaaggttaatat

SEQ ID NO: 105171 - DNA, 22 bp, Homo sapiens
tttcttcctgctttgtcccatg

SEQ ID NO: 105172 - DNA, 22 bp, Homo sapiens
tggaagctcaaggcagggtgag

SEQ ID NO: 105173 - DNA, 22 bp, Homo sapiens
accctggaggtggaggtgcagt

SEQ ID NO: 105174 - DNA, 22 bp, Homo sapiens
atccccctgtatctggaagaat

SEQ ID NO: 105175 - DNA, 22 bp, Homo sapiens
tggaggttgggatgcttgtgat

SEQ ID NO: 105176 - DNA, 22 bp, Homo sapiens
atcctagaatcagcccttgctg

SEQ ID NO: 105177 - DNA, 22 bp, Homo sapiens
gctcttgtcaaaaattagttga

SEQ ID NO: 105178 - DNA, 22 bp, Homo sapiens
tgtctggtgggttgacaggcag

SEQ ID NO: 105179 - DNA, 22 bp, Homo sapiens
ccaggcaggcgatggtgcagtg

SEQ ID NO: 105180 - DNA, 22 bp, Homo sapiens
ttgtgaatagtgccacaataaa

SEQ ID NO: 105181 - DNA, 22 bp, Homo sapiens
tgcagaaacaagccatcattca

SEQ ID NO: 105182 - DNA, 22 bp, Homo sapiens
tggtgcaaaactaattgcggtt

SEQ ID NO: 105183 - DNA, 22 bp, Homo sapiens
cactgcactccagcctgggcga

SEQ ID NO: 105184 - DNA, 22 bp, Homo sapiens
aaagtgctgaaattacaggggt

SEQ ID NO: 105185 - DNA, 22 bp, Homo sapiens
aaagtgctgggattacaggcct

SEQ ID NO: 105186 - DNA, 22 bp, Homo sapiens
attgagaagaaaatctaatata

SEQ ID NO: 105187 - DNA, 22 bp, Homo sapiens
gcggcaggagtaaaggaggaag

SEQ ID NO: 105188 - DNA, 22 bp, Homo sapiens
gtcccgcattgggcattcctgg

SEQ ID NO: 105189 - DNA, 22 bp, Homo sapiens
ggccactgctctccagcctggg

SEQ ID NO: 105190 - DNA, 22 bp, Homo sapiens
aactcaaagatgcatgacgctt

SEQ ID NO: 105191 - DNA, 18 bp, Homo sapiens
gcactgaggaaaacctct

SEQ ID NO: 105192 - DNA, 22 bp, Homo sapiens
cttggggcagcccaggctgagc

SEQ ID NO: 105193 - DNA, 22 bp, Homo sapiens
gcacatgaggctgtctttgtct

SEQ ID NO: 105194 - DNA, 20 bp, Homo sapiens
ttctccagtgcggtagccat

SEQ ID NO: 105195 - DNA, 22 bp, Homo sapiens
aagcacaatgaacatcttagat

SEQ ID NO: 105196 - DNA, 22 bp, Homo sapiens
gttgattccggggccatttcaa

SEQ ID NO: 105197 - DNA, 22 bp, Homo sapiens
atgttcctattgcagaggatga

SEQ ID NO: 105198 - DNA, 22 bp, Homo sapiens
atagagtgatgtaaggtatgtg

SEQ ID NO: 105199 - DNA, 19 bp, Homo sapiens
aggtggctgaaactacaga

SEQ ID NO: 105200 - DNA, 22 bp, Homo sapiens
tctgagccagggtctcctccct

SEQ ID NO: 105201 - DNA, 22 bp, Homo sapiens
ggccaggcgatgacccctccac

SEQ ID NO: 105202 - DNA, 22 bp, Homo sapiens
ctccaggctcgtccaagatcga

SEQ ID NO: 105203 - DNA, 22 bp, Homo sapiens
tgtcttcaggagtaaatatcat

SEQ ID NO: 105204 - DNA, 22 bp, Homo sapiens
tgaactcctgacctcatgatcc

SEQ ID NO: 105205 - DNA, 22 bp, Homo sapiens
tctgctcagccgatctgctccg

SEQ ID NO: 105206 - DNA, 22 bp, Homo sapiens
agtgaaaacctaatcatgcagt

SEQ ID NO: 105207 - DNA, 22 bp, Homo sapiens
tttggctcagctcacagatccc

SEQ ID NO: 105208 - DNA, 22 bp, Homo sapiens
agggaagaggaccagagtctct

SEQ ID NO: 105209 - DNA, 22 bp, Homo sapiens
tgagcacatttcacatgacagg

SEQ ID NO: 105210 - DNA, 22 bp, Homo sapiens
aagagaattctggttttcctat

SEQ ID NO: 105211 - DNA, 22 bp, Homo sapiens
tagatgtgttgcctggagttgt

SEQ ID NO: 105212 - DNA, 22 bp, Homo sapiens
aaaaatcacttttataggcagc

SEQ ID NO: 105213 - DNA, 19 bp, Homo sapiens
ggcatggggtccggggacc

SEQ ID NO: 105214 - DNA, 22 bp, Homo sapiens
atttattcctttatggctggag

SEQ ID NO: 105215 - DNA, 22 bp, Homo sapiens
cagggatggcgctggctgcccg

SEQ ID NO: 105216 - DNA, 22 bp, Homo sapiens
gatcctggagctccatcactat

SEQ ID NO: 105217 - DNA, 22 bp, Homo sapiens
ctcctccacccgctggggccca

SEQ ID NO: 105218 - DNA, 22 bp, Homo sapiens
tgaggcaggagttcaggctgcg

SEQ ID NO: 105219 - DNA, 22 bp, Homo sapiens
tttcaacagatctgtcttcagg

SEQ ID NO: 105220 - DNA, 22 bp, Homo sapiens
agcctattccaggatgagctca

SEQ ID NO: 105221 - DNA, 23 bp, Homo sapiens
ccaagactgttaggagtggggag

SEQ ID NO: 105222 - DNA, 22 bp, Homo sapiens
atcttcccaggctggggagagg

SEQ ID NO: 105223 - DNA, 22 bp, Homo sapiens
aatatgcactctgatttagcag

SEQ ID NO: 105224 - DNA, 22 bp, Homo sapiens
atgcccctggcctggggaacat

SEQ ID NO: 105225 - DNA, 22 bp, Homo sapiens
tggcactgaagctggaaagcct

SEQ ID NO: 105226 - DNA, 22 bp, Homo sapiens
ctcaggatattgggctggagca

SEQ ID NO: 105227 - DNA, 22 bp, Homo sapiens
atgagaaagttaatcatcatga

SEQ ID NO: 105228 - DNA, 22 bp, Homo sapiens
aactcaggagtttaaggctgca

SEQ ID NO: 105229 - DNA, 22 bp, Homo sapiens
cccaggaggtcgaagctgcagt

SEQ ID NO: 105230 - DNA, 17 bp, Homo sapiens
gagacccccactacacc

SEQ ID NO: 105231 - DNA, 22 bp, Homo sapiens
tcctggcaaagatgttggtgtt

SEQ ID NO: 105232 - DNA, 22 bp, Homo sapiens
caaagtgctgggattataggca

SEQ ID NO: 105233 - DNA, 22 bp, Homo sapiens
gtgtggtcgaagttctcccgga

SEQ ID NO: 105234 - DNA, 22 bp, Homo sapiens
ttcagcccaggagttggaggct

SEQ ID NO: 105235 - DNA, 22 bp, Homo sapiens
agctggagatgagtgacgtgcc

SEQ ID NO: 105236 - DNA, 22 bp, Homo sapiens
agcttgtagaaggccacgagca

SEQ ID NO: 105237 - DNA, 22 bp, Homo sapiens
tggcgcgacgtgccccctgctt

SEQ ID NO: 105238 - DNA, 22 bp, Homo sapiens
tctcctggagcccagatgctgg

SEQ ID NO: 105239 - DNA, 22 bp, Homo sapiens
aagacttgaccaggttgaaggc

SEQ ID NO: 105240 - DNA, 20 bp, Homo sapiens
acgtggccaccagtggctta

SEQ ID NO: 105241 - DNA, 22 bp, Homo sapiens
agcttgtgtttttctaagtatc

SEQ ID NO: 105242 - DNA, 22 bp, Homo sapiens
acagtctgtcccccaggtgcta

SEQ ID NO: 105243 - DNA, 22 bp, Homo sapiens
gcctggattccttgtttctcag

SEQ ID NO: 105244 - DNA, 22 bp, Homo sapiens
gcttggccagcagccgggatgc

SEQ ID NO: 105245 - DNA, 19 bp, Homo sapiens
acccagcccaggagtggca

SEQ ID NO: 105246 - DNA, 22 bp, Homo sapiens
ggagtgactcacagctgggaca

SEQ ID NO: 105247 - DNA, 22 bp, Homo sapiens
gagagtctagtgcacctagttt

SEQ ID NO: 105248 - DNA, 22 bp, Homo sapiens
gctgtctgtcttcacatctcgc

SEQ ID NO: 105249 - DNA, 22 bp, Homo sapiens
acagcagcaatagcagtgacat

SEQ ID NO: 105250 - DNA, 22 bp, Homo sapiens
atacaccaccttggatctttca

SEQ ID NO: 105251 - DNA, 22 bp, Homo sapiens
tgggcaggggccctgcttccgt

SEQ ID NO: 105252 - DNA, 22 bp, Homo sapiens
acccggagtcggaggttgcagt

SEQ ID NO: 105253 - DNA, 22 bp, Homo sapiens
gccctcctggcaggcagtgatg

SEQ ID NO: 105254 - DNA, 22 bp, Homo sapiens
agccagggtctctcgctctgtt

SEQ ID NO: 105255 - DNA, 22 bp, Homo sapiens
gcactgcaggtgggtggagagg

SEQ ID NO: 105256 - DNA, 22 bp, Homo sapiens
ttccatttggagctcgcagcct

SEQ ID NO: 105257 - DNA, 22 bp, Homo sapiens
actggacagaggaaatatggag

SEQ ID NO: 105258 - DNA, 19 bp, Homo sapiens
caggcctcttaccctctct

SEQ ID NO: 105259 - DNA, 22 bp, Homo sapiens
tgtgtggattcatctcaaagag

SEQ ID NO: 105260 - DNA, 22 bp, Homo sapiens
taggcccctagtgccacgtggc

SEQ ID NO: 105261 - DNA, 22 bp, Homo sapiens
agctggaattacaggagcccat

SEQ ID NO: 105262 - DNA, 22 bp, Homo sapiens
gcccgcgccagcctctccatct

SEQ ID NO: 105263 - DNA, 22 bp, Homo sapiens
aagccaggttccatggaggagc

SEQ ID NO: 105264 - DNA, 22 bp, Homo sapiens
aacccgggaggcagaggttgtg

SEQ ID NO: 105265 - DNA, 22 bp, Homo sapiens
ctgctaaacctctctgagagct

SEQ ID NO: 105266 - DNA, 22 bp, Homo sapiens
tgaggcaggaggttgagaactg

SEQ ID NO: 105267 - DNA, 21 bp, Homo sapiens
agatcctggggtctggggagg

SEQ ID NO: 105268 - DNA, 22 bp, Homo sapiens
aataaacaaaggacaaggaggt

SEQ ID NO: 105269 - DNA, 22 bp, Homo sapiens
gtcccataagtagtgcaacttg

SEQ ID NO: 105270 - DNA, 22 bp, Homo sapiens
aggtgacaggacaggagctggt

SEQ ID NO: 105271 - DNA, 22 bp, Homo sapiens
tctgcaggaagctggcggctga

SEQ ID NO: 105272 - DNA, 22 bp, Homo sapiens
tacccagtctggagtgcagtga

SEQ ID NO: 105273 - DNA, 22 bp, Homo sapiens
gagacacaggcacagaagaggc

SEQ ID NO: 105274 - DNA, 22 bp, Homo sapiens
atgcctgtaatcccagcacttt

SEQ ID NO: 105275 - DNA, 22 bp, Homo sapiens
agatgtgtttctagttcctgca

SEQ ID NO: 105276 - DNA, 20 bp, Homo sapiens
ctgccgaccacagccatgga

SEQ ID NO: 105277 - DNA, 22 bp, Homo sapiens
ggaaggcagaggtgtcgtgggg

SEQ ID NO: 105278 - DNA, 22 bp, Homo sapiens
tccagcagtccatgtgagacac

SEQ ID NO: 105279 - DNA, 22 bp, Homo sapiens
gggcagagagctggaactcctt

SEQ ID NO: 105280 - DNA, 22 bp, Homo sapiens
aatatttccaaggcctgtcagg

SEQ ID NO: 105281 - DNA, 22 bp, Homo sapiens
ttcccaggaagcctctccaagc

SEQ ID NO: 105282 - DNA, 22 bp, Homo sapiens
gcagctcaaaggccacggacgg

SEQ ID NO: 105283 - DNA, 22 bp, Homo sapiens
ggaggaggggtgactgaatgct

SEQ ID NO: 105284 - DNA, 23 bp, Homo sapiens
gacagagtgagaccttgtcttac

SEQ ID NO: 105285 - DNA, 22 bp, Homo sapiens
gagctcatccccatggtccgtc

SEQ ID NO: 105286 - DNA, 22 bp, Homo sapiens
cctagatgggatggcggccggg

SEQ ID NO: 105287 - DNA, 22 bp, Homo sapiens
tggggacttgccttgttgctca

SEQ ID NO: 105288 - DNA, 22 bp, Homo sapiens
aataaaatggtcagttttctca

SEQ ID NO: 105289 - DNA, 22 bp, Homo sapiens
tagcataacaggtaagagtgag

SEQ ID NO: 105290 - DNA, 22 bp, Homo sapiens
catgagataatttttctccagt

SEQ ID NO: 105291 - DNA, 22 bp, Homo sapiens
aatggtttctgaagttaggcag

SEQ ID NO: 105292 - DNA, 22 bp, Homo sapiens
gcaggctgtctaaagttagagt

SEQ ID NO: 105293 - DNA, 22 bp, Homo sapiens
cccaggaggttgaggctgcagt

SEQ ID NO: 105294 - DNA, 22 bp, Homo sapiens
ccggtcccaggtgccccggtga

SEQ ID NO: 105295 - DNA, 22 bp, Homo sapiens
ccttgctcaagctagtgacggg

SEQ ID NO: 105296 - DNA, 20 bp, Homo sapiens
acctcctggcgggcatcctc

SEQ ID NO: 105297 - DNA, 22 bp, Homo sapiens
tgagatgtaaggtatgcttact

SEQ ID NO: 105298 - DNA, 22 bp, Homo sapiens
cctaacatatgtaaaggtcttt

SEQ ID NO: 105299 - DNA, 22 bp, Homo sapiens
aaagtaattgcagtttctgcca

SEQ ID NO: 105300 - DNA, 22 bp, Homo sapiens
ttcctttctctggactgcagcc

SEQ ID NO: 105301 - DNA, 22 bp, Homo sapiens
acctgcaggcacaggtgtgcgc

SEQ ID NO: 105302 - DNA, 20 bp, Homo sapiens
cagagccagggttttgtttt

SEQ ID NO: 105303 - DNA, 22 bp, Homo sapiens
gtcttgatctcctgaccttgtg

SEQ ID NO: 105304 - DNA, 22 bp, Homo sapiens
gcctccagcccacgcaggcctg

SEQ ID NO: 105305 - DNA, 22 bp, Homo sapiens
tagtttcatctccaccctgccc

SEQ ID NO: 105306 - DNA, 22 bp, Homo sapiens
caactccctgtggggtactggg

SEQ ID NO: 105307 - DNA, 22 bp, Homo sapiens
gacagacacaattgatccatga

SEQ ID NO: 105308 - DNA, 22 bp, Homo sapiens
atgacaagagtgttcagggaga

SEQ ID NO: 105309 - DNA, 22 bp, Homo sapiens
gaggagggagctggaagctctt

SEQ ID NO: 105310 - DNA, 22 bp, Homo sapiens
ttgagggtctggatctgctgct

SEQ ID NO: 105311 - DNA, 17 bp, Homo sapiens
cgggcatggagggcagg

SEQ ID NO: 105312 - DNA, 22 bp, Homo sapiens
atttcccagggcctgggatttg

SEQ ID NO: 105313 - DNA, 22 bp, Homo sapiens
gggccctgggattcagagcaag

SEQ ID NO: 105314 - DNA, 22 bp, Homo sapiens
tcaggctcaggttaggggccaa

SEQ ID NO: 105315 - DNA, 23 bp, Homo sapiens
ccccactaccgtgatgtgcgagg

SEQ ID NO: 105316 - DNA, 18 bp, Homo sapiens
tttctcagactctctttc

SEQ ID NO: 105317 - DNA, 22 bp, Homo sapiens
caaatgaatatttccatgggtt

SEQ ID NO: 105318 - DNA, 22 bp, Homo sapiens
tgctcgaggtccccaccggctc

SEQ ID NO: 105319 - DNA, 22 bp, Homo sapiens
gccaggttgctgacgacgatct

SEQ ID NO: 105320 - DNA, 22 bp, Homo sapiens
tgcaatttttccatgacctaga

SEQ ID NO: 105321 - DNA, 22 bp, Homo sapiens
ttggcttttatgcagcttaggt

SEQ ID NO: 105322 - DNA, 22 bp, Homo sapiens
tagctcaaaggttaagtgtgga

SEQ ID NO: 105323 - DNA, 22 bp, Homo sapiens
ccgccaggatattgtggctttt

SEQ ID NO: 105324 - DNA, 22 bp, Homo sapiens
aaagtgctgggattacaggtgt

SEQ ID NO: 105325 - DNA, 22 bp, Homo sapiens
tcacccaggctggagtgtagtg

SEQ ID NO: 105326 - DNA, 22 bp, Homo sapiens
tgagtagagaattcagctaagg

SEQ ID NO: 105327 - DNA, 22 bp, Homo sapiens
tacccagtgccaccctctgagg

SEQ ID NO: 105328 - DNA, 22 bp, Homo sapiens
ctgaacttattgagtgcttgct

SEQ ID NO: 105329 - DNA, 22 bp, Homo sapiens
gctcaagacccctctgtgactg

SEQ ID NO: 105330 - DNA, 22 bp, Homo sapiens
cacatacccggctattgctgct

SEQ ID NO: 105331 - DNA, 22 bp, Homo sapiens
aggaattgtgttgtagtggaga

SEQ ID NO: 105332 - DNA, 22 bp, Homo sapiens
cacagagatggtctggcaggtg

SEQ ID NO: 105333 - DNA, 22 bp, Homo sapiens
ttttctgtttgcttcaagacat

SEQ ID NO: 105334 - DNA, 22 bp, Homo sapiens
aggaaataggaccagacaaagc

SEQ ID NO: 105335 - DNA, 22 bp, Homo sapiens
tgatgtggccccacttagctgt

SEQ ID NO: 105336 - DNA, 22 bp, Homo sapiens
agcctggtttaagcattttata

SEQ ID NO: 105337 - DNA, 22 bp, Homo sapiens
caaggtgccatgctgggcgggg

SEQ ID NO: 105338 - DNA, 20 bp, Homo sapiens
gagattaactgagaatctag

SEQ ID NO: 105339 - DNA, 20 bp, Homo sapiens
caggtccagcacgtgcacgg

SEQ ID NO: 105340 - DNA, 22 bp, Homo sapiens
agggcaaagccagtgactccca

SEQ ID NO: 105341 - DNA, 22 bp, Homo sapiens
cccattcatcctcgcttccttc

SEQ ID NO: 105342 - DNA, 22 bp, Homo sapiens
cactgcaccctcaaactcctgg

SEQ ID NO: 105343 - DNA, 22 bp, Homo sapiens
gctgtcttgctcactcttgcag

SEQ ID NO: 105344 - DNA, 22 bp, Homo sapiens
atgccactgcgctccagcctgg

SEQ ID NO: 105345 - DNA, 22 bp, Homo sapiens
tcttggtctgtggcaggtgccg

SEQ ID NO: 105346 - DNA, 22 bp, Homo sapiens
gaaggtggcgagcggattgctg

SEQ ID NO: 105347 - DNA, 22 bp, Homo sapiens
gagggagggactagcattctct

SEQ ID NO: 105348 - DNA, 22 bp, Homo sapiens
gcccagagttcaaggctgcagt

SEQ ID NO: 105349 - DNA, 22 bp, Homo sapiens
caattgtcagtgctgtttaaat

SEQ ID NO: 105350 - DNA, 22 bp, Homo sapiens
gtggctgcagcggctgtggaga

SEQ ID NO: 105351 - DNA, 22 bp, Homo sapiens
gcaggtggatcaccacgtcagg

SEQ ID NO: 105352 - DNA, 22 bp, Homo sapiens
atatatttgagaatattcatga

SEQ ID NO: 105353 - DNA, 22 bp, Homo sapiens
agatgtgagaatcaagtgacca

SEQ ID NO: 105354 - DNA, 22 bp, Homo sapiens
tgatcaaaacattactccacca

SEQ ID NO: 105355 - DNA, 22 bp, Homo sapiens
tgtcttcagcagtcatctgggg

SEQ ID NO: 105356 - DNA, 22 bp, Homo sapiens
tagaggccgaatgctgagctgg

SEQ ID NO: 105357 - DNA, 22 bp, Homo sapiens
gcccaggctggagttcagtggt

SEQ ID NO: 105358 - DNA, 22 bp, Homo sapiens
gctggcagacttcctctggaac

SEQ ID NO: 105359 - DNA, 22 bp, Homo sapiens
gagccaggttggaggctgcagt

SEQ ID NO: 105360 - DNA, 22 bp, Homo sapiens
tgcaatgatattgtcaaagcat

SEQ ID NO: 105361 - DNA, 22 bp, Homo sapiens
ggcttcagtggccagagatgat

SEQ ID NO: 105362 - DNA, 19 bp, Homo sapiens
catggtgaaaccccgtctc

SEQ ID NO: 105363 - DNA, 22 bp, Homo sapiens
gcagagctgggatatgaaccca

SEQ ID NO: 105364 - DNA, 22 bp, Homo sapiens
agcgtgaattagttggtacaca

SEQ ID NO: 105365 - DNA, 22 bp, Homo sapiens
cagcagcagtggctgcagaaca

SEQ ID NO: 105366 - DNA, 22 bp, Homo sapiens
ttctcttacattttctcagcct

SEQ ID NO: 105367 - DNA, 22 bp, Homo sapiens
agaaatatgctgattagatgaa

SEQ ID NO: 105368 - DNA, 22 bp, Homo sapiens
catataaatacaacatgtgtta

SEQ ID NO: 105369 - DNA, 21 bp, Homo sapiens
gggcagaggggcctcctgggt

SEQ ID NO: 105370 - DNA, 23 bp, Homo sapiens
ggggcctgcaccggtctgcgcgg

SEQ ID NO: 105371 - DNA, 22 bp, Homo sapiens
caggaattcatagcattgttct

SEQ ID NO: 105372 - DNA, 22 bp, Homo sapiens
ttttttgttgggtagaacggaa

SEQ ID NO: 105373 - DNA, 22 bp, Homo sapiens
tgcctgcctaggaagctgtgaa

SEQ ID NO: 105374 - DNA, 22 bp, Homo sapiens
ttgtaacaggtactaaataact

SEQ ID NO: 105375 - DNA, 22 bp, Homo sapiens
ggacaagcctgtgagtgggttt

SEQ ID NO: 105376 - DNA, 22 bp, Homo sapiens
atgccaggaacaaacagtggtg

SEQ ID NO: 105377 - DNA, 22 bp, Homo sapiens
tagctgggactactggccctgc

SEQ ID NO: 105378 - DNA, 21 bp, Homo sapiens
gttcttgcaggatttccttcc

SEQ ID NO: 105379 - DNA, 22 bp, Homo sapiens
cccagttgttgccggctctgga

SEQ ID NO: 105380 - DNA, 22 bp, Homo sapiens
tcgcttgaacccaggaagtgga

SEQ ID NO: 105381 - DNA, 22 bp, Homo sapiens
aaagtgctggtattacaggtgt

SEQ ID NO: 105382 - DNA, 22 bp, Homo sapiens
actcccagaacatgctcttctt

SEQ ID NO: 105383 - DNA, 22 bp, Homo sapiens
tcttttgtgattctttagttac

SEQ ID NO: 105384 - DNA, 22 bp, Homo sapiens
agccctcgtttctgcatcctgt

SEQ ID NO: 105385 - DNA, 23 bp, Homo sapiens
tgggaatactgaaacaaccttat

SEQ ID NO: 105386 - DNA, 22 bp, Homo sapiens
gcagggtctgaggccacagagg

SEQ ID NO: 105387 - DNA, 22 bp, Homo sapiens
cccagcaaggccagctcagggc

SEQ ID NO: 105388 - DNA, 22 bp, Homo sapiens
tctggcttccctctgttctggg

SEQ ID NO: 105389 - DNA, 22 bp, Homo sapiens
gaggaggcagcctatcccttag

SEQ ID NO: 105390 - DNA, 22 bp, Homo sapiens
atcccaggcggcacaggttgca

SEQ ID NO: 105391 - DNA, 22 bp, Homo sapiens
tcgtctgtgaaattgggataag

SEQ ID NO: 105392 - DNA, 22 bp, Homo sapiens
gccagcagcttcttctcatcct

SEQ ID NO: 105393 - DNA, 22 bp, Homo sapiens
ggtgaggggctcctctgcccgg

SEQ ID NO: 105394 - DNA, 22 bp, Homo sapiens
tcatcagggatattggcctgaa

SEQ ID NO: 105395 - DNA, 22 bp, Homo sapiens
actatagatgctggcgaggctg

SEQ ID NO: 105396 - DNA, 22 bp, Homo sapiens
caaagtgctgggattacaggct

SEQ ID NO: 105397 - DNA, 22 bp, Homo sapiens
aactaatacattaatacatgtg

SEQ ID NO: 105398 - DNA, 22 bp, Homo sapiens
ctggctctcaggctggtcccca

SEQ ID NO: 105399 - DNA, 22 bp, Homo sapiens
atgccactgcactccagcctgg

SEQ ID NO: 105400 - DNA, 22 bp, Homo sapiens
aggctcagatccttgtgtcctg

SEQ ID NO: 105401 - DNA, 22 bp, Homo sapiens
gggctagcctcttccctgctcc

SEQ ID NO: 105402 - DNA, 22 bp, Homo sapiens
gctgtggcctggcgcagagctg

SEQ ID NO: 105403 - DNA, 22 bp, Homo sapiens
tggggagtgatgcctcggataa

SEQ ID NO: 105404 - DNA, 22 bp, Homo sapiens
tggcacagactgggccaaggaa

SEQ ID NO: 105405 - DNA, 22 bp, Homo sapiens
tctttggtttctgtctctgtaa

SEQ ID NO: 105406 - DNA, 22 bp, Homo sapiens
attaagtatgcaatggtgcagt

SEQ ID NO: 105407 - DNA, 22 bp, Homo sapiens
ctcaggagttggaggctacagt

SEQ ID NO: 105408 - DNA, 22 bp, Homo sapiens
cctcccctcagacagagactgg

SEQ ID NO: 105409 - DNA, 22 bp, Homo sapiens
gggaacagcttgggctctgcca

SEQ ID NO: 105410 - DNA, 22 bp, Homo sapiens
acccagggctcaagcgtaggca

SEQ ID NO: 105411 - DNA, 22 bp, Homo sapiens
ccgaggctggagtgcagtggcg

SEQ ID NO: 105412 - DNA, 22 bp, Homo sapiens
gagcccaggcagaggttgcagt

SEQ ID NO: 105413 - DNA, 22 bp, Homo sapiens
caggaggattgcttgaggccag

SEQ ID NO: 105414 - DNA, 22 bp, Homo sapiens
gtggcttggaccagtcacagtg

SEQ ID NO: 105415 - DNA, 22 bp, Homo sapiens
ctctcgccagcggggctgcgct

SEQ ID NO: 105416 - DNA, 22 bp, Homo sapiens
agtgggccggacagcccaggcc

SEQ ID NO: 105417 - DNA, 22 bp, Homo sapiens
agtccaggcattccagccattc

SEQ ID NO: 105418 - DNA, 17 bp, Homo sapiens
catccgtgagctcggca

SEQ ID NO: 105419 - DNA, 22 bp, Homo sapiens
gccatgcttggtatgctgtgag

SEQ ID NO: 105420 - DNA, 22 bp, Homo sapiens
ctcagctgcagcctggctggca

SEQ ID NO: 105421 - DNA, 22 bp, Homo sapiens
tccttagacaaagagtgggctt

SEQ ID NO: 105422 - DNA, 23 bp, Homo sapiens
tttctgatgagggatgtggtatg

SEQ ID NO: 105423 - DNA, 22 bp, Homo sapiens
cactgcactccatcctgggaaa

SEQ ID NO: 105424 - DNA, 22 bp, Homo sapiens
aagaatgagctcaaagatctta

SEQ ID NO: 105425 - DNA, 22 bp, Homo sapiens
gggcctcaggttctggagaagg

SEQ ID NO: 105426 - DNA, 22 bp, Homo sapiens
tctggagataagcagcaatgaa

SEQ ID NO: 105427 - DNA, 22 bp, Homo sapiens
gctcagaggcacgacctcttgg

SEQ ID NO: 105428 - DNA, 22 bp, Homo sapiens
cccaggaggcagagcttgcagt

SEQ ID NO: 105429 - DNA, 22 bp, Homo sapiens
actgcgctccagcctgggtgac

SEQ ID NO: 105430 - DNA, 22 bp, Homo sapiens
gcccaggctggagtgcagtggt

SEQ ID NO: 105431 - DNA, 21 bp, Homo sapiens
agtgcaatggctcgatctcgg

SEQ ID NO: 105432 - DNA, 22 bp, Homo sapiens
aggggtgaaagagggccctcaa

SEQ ID NO: 105433 - DNA, 22 bp, Homo sapiens
caagcaccatgtgctccatgtt

SEQ ID NO: 105434 - DNA, 22 bp, Homo sapiens
accccaggaagtggaggtcatg

SEQ ID NO: 105435 - DNA, 22 bp, Homo sapiens
cggaggttgaggctgcagtgag

SEQ ID NO: 105436 - DNA, 22 bp, Homo sapiens
aggagtcccactgtcaatgcta

SEQ ID NO: 105437 - DNA, 22 bp, Homo sapiens
ttgcccactggctgttggtcag

SEQ ID NO: 105438 - DNA, 22 bp, Homo sapiens
tgtccaggctaaagtgcagtgg

SEQ ID NO: 105439 - DNA, 22 bp, Homo sapiens
gggaggttgaggctgcagtgag

SEQ ID NO: 105440 - DNA, 23 bp, Homo sapiens
actcgtggaattctctgcgatcg

SEQ ID NO: 105441 - DNA, 22 bp, Homo sapiens
cagtggccaacttcctgcctct

SEQ ID NO: 105442 - DNA, 22 bp, Homo sapiens
acaactccttcttgggtcctgg

SEQ ID NO: 105443 - DNA, 22 bp, Homo sapiens
caggaggagggcagccgcctcc

SEQ ID NO: 105444 - DNA, 22 bp, Homo sapiens
cagagatgtgatccagctgtct

SEQ ID NO: 105445 - DNA, 22 bp, Homo sapiens
ggagagcagggaggctgctctg

SEQ ID NO: 105446 - DNA, 22 bp, Homo sapiens
aagcgcaggactggctcacggc

SEQ ID NO: 105447 - DNA, 23 bp, Homo sapiens
agagcaaggaaatgaggtgtgat

SEQ ID NO: 105448 - DNA, 22 bp, Homo sapiens
gaactttataactgtaaatgtc

SEQ ID NO: 105449 - DNA, 22 bp, Homo sapiens
tctttcttgtgggtgccctttt

SEQ ID NO: 105450 - DNA, 22 bp, Homo sapiens
aaagtgcttccttttagaggct

SEQ ID NO: 105451 - DNA, 22 bp, Homo sapiens
ttcccttaaattatggcatcta

SEQ ID NO: 105452 - DNA, 22 bp, Homo sapiens
tggactaaagaggaagcaaata

SEQ ID NO: 105453 - DNA, 22 bp, Homo sapiens
ggccgtgctccaaagtcatcgt

SEQ ID NO: 105454 - DNA, 22 bp, Homo sapiens
gccctgtgcaggtgtgcagcag

SEQ ID NO: 105455 - DNA, 22 bp, Homo sapiens
aaggaggcctggcagatgaaga

SEQ ID NO: 105456 - DNA, 22 bp, Homo sapiens
atgctattgaaaagaaataaga

SEQ ID NO: 105457 - DNA, 22 bp, Homo sapiens
gggaagagggagctggaatgat

SEQ ID NO: 105458 - DNA, 15 bp, Homo sapiens
gcaggcaggtcacct

SEQ ID NO: 105459 - DNA, 22 bp, Homo sapiens
tagaagaaagtgaagctgggga

SEQ ID NO: 105460 - DNA, 22 bp, Homo sapiens
cccagctcttcaagtcaccccc

SEQ ID NO: 105461 - DNA, 22 bp, Homo sapiens
ctattattagataatctacttg

SEQ ID NO: 105462 - DNA, 22 bp, Homo sapiens
gcgggttgaagggcgcatcgaa

SEQ ID NO: 105463 - DNA, 22 bp, Homo sapiens
ccacactccccgcaggcgtagg

SEQ ID NO: 105464 - DNA, 22 bp, Homo sapiens
aacagctttgtatacagtaact

SEQ ID NO: 105465 - DNA, 22 bp, Homo sapiens
cttagatgaagtcacagaaccc

SEQ ID NO: 105466 - DNA, 22 bp, Homo sapiens
ctgtggttggagtgcagtgaga

SEQ ID NO: 105467 - DNA, 22 bp, Homo sapiens
tgcctgtggaaaggctggtgct

SEQ ID NO: 105468 - DNA, 22 bp, Homo sapiens
cccagcagtagagctcatatgg

SEQ ID NO: 105469 - DNA, 22 bp, Homo sapiens
tcaaaccagccttgcatcccag

SEQ ID NO: 105470 - DNA, 22 bp, Homo sapiens
gcctgtgtggatgcgccggtgc

SEQ ID NO: 105471 - DNA, 22 bp, Homo sapiens
gagcccaggaagtggaggctga

SEQ ID NO: 105472 - DNA, 22 bp, Homo sapiens
aaatgcacaaagattttgcact

SEQ ID NO: 105473 - DNA, 22 bp, Homo sapiens
atcttggggaatcctctgtgta

SEQ ID NO: 105474 - DNA, 22 bp, Homo sapiens
tcttgaattgtactcccataag

SEQ ID NO: 105475 - DNA, 22 bp, Homo sapiens
acgcctgtaatcccagcacttt

SEQ ID NO: 105476 - DNA, 22 bp, Homo sapiens
tttacttcatttccagtgagga

SEQ ID NO: 105477 - DNA, 22 bp, Homo sapiens
cctggaaagagaatgaatgagc

SEQ ID NO: 105478 - DNA, 22 bp, Homo sapiens
attaagtgactaaagtaatgct

SEQ ID NO: 105479 - DNA, 22 bp, Homo sapiens
actctttgtctgttgccgctta

SEQ ID NO: 105480 - DNA, 22 bp, Homo sapiens
gggagctgagctggaagagaat

SEQ ID NO: 105481 - DNA, 22 bp, Homo sapiens
aggtcacgtcctgtgatgtcat

SEQ ID NO: 105482 - DNA, 22 bp, Homo sapiens
ttgcgcgcggctaggtctcggt

SEQ ID NO: 105483 - DNA, 22 bp, Homo sapiens
ttttcatttttgtagatgcaag

SEQ ID NO: 105484 - DNA, 22 bp, Homo sapiens
atggtcacaccactgtactcca

SEQ ID NO: 105485 - DNA, 22 bp, Homo sapiens
tcctcagcttttatttcacttg

SEQ ID NO: 105486 - DNA, 22 bp, Homo sapiens
actgcacttcagcctgggtgtc

SEQ ID NO: 105487 - DNA, 22 bp, Homo sapiens
ggaggctgagaggtcgcagtgg

SEQ ID NO: 105488 - DNA, 22 bp, Homo sapiens
gagtcgagcagaaagccgtcgg

SEQ ID NO: 105489 - DNA, 22 bp, Homo sapiens
acccgggaggcaggagtcatag

SEQ ID NO: 105490 - DNA, 22 bp, Homo sapiens
ggggccttttctgaatgtggaa

SEQ ID NO: 105491 - DNA, 22 bp, Homo sapiens
agtgctgtctccttcccccggg

SEQ ID NO: 105492 - DNA, 22 bp, Homo sapiens
atgaattgaggaaaacagtcgt

SEQ ID NO: 105493 - DNA, 22 bp, Homo sapiens
tctgcatattgttaatggaatg

SEQ ID NO: 105494 - DNA, 22 bp, Homo sapiens
aacatagccagaatgtctcctg

SEQ ID NO: 105495 - DNA, 22 bp, Homo sapiens
gctgctctcagagctcatgctg

SEQ ID NO: 105496 - DNA, 22 bp, Homo sapiens
ggcctgggctccgggagttact

SEQ ID NO: 105497 - DNA, 22 bp, Homo sapiens
gagaacagaagcattcctaatt

SEQ ID NO: 105498 - DNA, 22 bp, Homo sapiens
gagggggctagcgcagtgccca

SEQ ID NO: 105499 - DNA, 22 bp, Homo sapiens
atacaaaatatatactggagac

SEQ ID NO: 105500 - DNA, 22 bp, Homo sapiens
tgcacgtgggctctctgctctt

SEQ ID NO: 105501 - DNA, 18 bp, Homo sapiens
acacttcctggtggtgtg

SEQ ID NO: 105502 - DNA, 21 bp, Homo sapiens
acacaagcactcgtacatacg

SEQ ID NO: 105503 - DNA, 23 bp, Homo sapiens
agagtgcagagatatgcttgtgt

SEQ ID NO: 105504 - DNA, 22 bp, Homo sapiens
tccagggagagccgctgctcca

SEQ ID NO: 105505 - DNA, 22 bp, Homo sapiens
agagtggctctgctgggcacag

SEQ ID NO: 105506 - DNA, 22 bp, Homo sapiens
gccggggctggggagagacatg

SEQ ID NO: 105507 - DNA, 22 bp, Homo sapiens
gcaggcattagcccccatggct

SEQ ID NO: 105508 - DNA, 22 bp, Homo sapiens
ttaataaagtatgaattggaaa

SEQ ID NO: 105509 - DNA, 22 bp, Homo sapiens
caatcaatgctgctagttcctt

SEQ ID NO: 105510 - DNA, 22 bp, Homo sapiens
actgcactccagcctgggtgat

SEQ ID NO: 105511 - DNA, 22 bp, Homo sapiens
caggagtgtctccacacagcaa

SEQ ID NO: 105512 - DNA, 22 bp, Homo sapiens
tacaagatgacaggtgcatgat

SEQ ID NO: 105513 - DNA, 21 bp, Homo sapiens
ttgttcctatctgcctcctgc

SEQ ID NO: 105514 - DNA, 22 bp, Homo sapiens
cttagagatgggttttacttag

SEQ ID NO: 105515 - DNA, 22 bp, Homo sapiens
tcactcaggctggagtgcagtg

SEQ ID NO: 105516 - DNA, 22 bp, Homo sapiens
tcccagagctctggaggttgga

SEQ ID NO: 105517 - DNA, 22 bp, Homo sapiens
agcttactgccccatggaagga

SEQ ID NO: 105518 - DNA, 22 bp, Homo sapiens
aaagggaagttgcacatgttcc

SEQ ID NO: 105519 - DNA, 22 bp, Homo sapiens
tcacagctcactgtagcctcga

SEQ ID NO: 105520 - DNA, 22 bp, Homo sapiens
cttcctcctccatctcgaaggc

SEQ ID NO: 105521 - DNA, 22 bp, Homo sapiens
gtctccccagggccctcttcat

SEQ ID NO: 105522 - DNA, 23 bp, Homo sapiens
tgttccagatacgccttttcctc

SEQ ID NO: 105523 - DNA, 22 bp, Homo sapiens
aaggcaggatgggaaaagattt

SEQ ID NO: 105524 - DNA, 18 bp, Homo sapiens
ccctgccagctcccagca

SEQ ID NO: 105525 - DNA, 22 bp, Homo sapiens
tgccatagcaatggtaagctga

SEQ ID NO: 105526 - DNA, 22 bp, Homo sapiens
agatttatgtggtcacactcag

SEQ ID NO: 105527 - DNA, 22 bp, Homo sapiens
taggcatgcaaataaatgtgca

SEQ ID NO: 105528 - DNA, 17 bp, Homo sapiens
ggcctgcacctcctgct

SEQ ID NO: 105529 - DNA, 22 bp, Homo sapiens
gtagaggggtgattctgtgaga

SEQ ID NO: 105530 - DNA, 22 bp, Homo sapiens
gaggctgaggttgcagtgagcc

SEQ ID NO: 105531 - DNA, 22 bp, Homo sapiens
agagggatcaccctgtttctgg

SEQ ID NO: 105532 - DNA, 22 bp, Homo sapiens
atttcctgtaggggcttgcgaa

SEQ ID NO: 105533 - DNA, 22 bp, Homo sapiens
gaggaggcttccgggaggcacg

SEQ ID NO: 105534 - DNA, 23 bp, Homo sapiens
tgggttcattcttgaagtcagtg

SEQ ID NO: 105535 - DNA, 22 bp, Homo sapiens
acacagagccaaaccatatcac

SEQ ID NO: 105536 - DNA, 22 bp, Homo sapiens
tcctgggaggcggaggttgcag

SEQ ID NO: 105537 - DNA, 22 bp, Homo sapiens
ggctcactgcaacttccgcctc

SEQ ID NO: 105538 - DNA, 22 bp, Homo sapiens
tgaagtcagggattccatgaag

SEQ ID NO: 105539 - DNA, 22 bp, Homo sapiens
aaatgtaagtctttgtttctta

SEQ ID NO: 105540 - DNA, 22 bp, Homo sapiens
aagaaatgtgaatattgaatag

SEQ ID NO: 105541 - DNA, 22 bp, Homo sapiens
tgtcctgtaggaggcagaacaa

SEQ ID NO: 105542 - DNA, 22 bp, Homo sapiens
gcagcgaggtgatgaaatagct

SEQ ID NO: 105543 - DNA, 20 bp, Homo sapiens
ggtcactgtggctgcaggat

SEQ ID NO: 105544 - DNA, 22 bp, Homo sapiens
ccagaagtcaagtaagatgaag

SEQ ID NO: 105545 - DNA, 22 bp, Homo sapiens
gtaatagtctcaaactcctgga

SEQ ID NO: 105546 - DNA, 22 bp, Homo sapiens
tgtggactcgcatggctgaggc

SEQ ID NO: 105547 - DNA, 22 bp, Homo sapiens
tggaggtaggacgaagaactct

SEQ ID NO: 105548 - DNA, 22 bp, Homo sapiens
gcaactgaacatgtgtgtggcc

SEQ ID NO: 105549 - DNA, 22 bp, Homo sapiens
gccaatgacagtctcagttctg

SEQ ID NO: 105550 - DNA, 22 bp, Homo sapiens
tgaccgttttggcacccatgct

SEQ ID NO: 105551 - DNA, 22 bp, Homo sapiens
tgcctagttctgtatttacagt

SEQ ID NO: 105552 - DNA, 22 bp, Homo sapiens
actgcactccagcctgggtgac

SEQ ID NO: 105553 - DNA, 22 bp, Homo sapiens
ttatatgtttctgtttggaggc

SEQ ID NO: 105554 - DNA, 23 bp, Homo sapiens
ggatggacgtgatgccttagcca

SEQ ID NO: 105555 - DNA, 22 bp, Homo sapiens
cccaggaggcagatgttgcagt

SEQ ID NO: 105556 - DNA, 21 bp, Homo sapiens
gggcctggctgcgcaggacgg

SEQ ID NO: 105557 - DNA, 22 bp, Homo sapiens
acagatgttgcttgtcattctc

SEQ ID NO: 105558 - DNA, 22 bp, Homo sapiens
tcttgggcatgtgtttgatttc

SEQ ID NO: 105559 - DNA, 22 bp, Homo sapiens
ccaggctggagtatagtggcgc

SEQ ID NO: 105560 - DNA, 22 bp, Homo sapiens
ccaggctagagtgcaatggcat

SEQ ID NO: 105561 - DNA, 22 bp, Homo sapiens
atttcctgcaaggagtgggttt

SEQ ID NO: 105562 - DNA, 21 bp, Homo sapiens
caaaagagactgattcttgga

SEQ ID NO: 105563 - DNA, 19 bp, Homo sapiens
aaggctgtttctccctcag

SEQ ID NO: 105564 - DNA, 22 bp, Homo sapiens
gaaaattattgaaaatggctct

SEQ ID NO: 105565 - DNA, 22 bp, Homo sapiens
catgaaattgtattggcctcaa

SEQ ID NO: 105566 - DNA, 22 bp, Homo sapiens
atcaaatacaaagggcataagg

SEQ ID NO: 105567 - DNA, 22 bp, Homo sapiens
tctgccttttactagctggatg

SEQ ID NO: 105568 - DNA, 22 bp, Homo sapiens
cagtggctggttagggacagga

SEQ ID NO: 105569 - DNA, 22 bp, Homo sapiens
ttgaaaagttttgaaacactct

SEQ ID NO: 105570 - DNA, 22 bp, Homo sapiens
caaagtgctaggattacaggcc

SEQ ID NO: 105571 - DNA, 22 bp, Homo sapiens
ggctgggctccgggagcatgcg

SEQ ID NO: 105572 - DNA, 22 bp, Homo sapiens
ctggtttgtcttgggaggatgt

SEQ ID NO: 105573 - DNA, 22 bp, Homo sapiens
gaccatcctggccaacgtggta

SEQ ID NO: 105574 - DNA, 22 bp, Homo sapiens
acaggcacctgccaccacatct

SEQ ID NO: 105575 - DNA, 22 bp, Homo sapiens
ttggaggcaatgggaaggaggc

SEQ ID NO: 105576 - DNA, 22 bp, Homo sapiens
attgataaattgcaatggggct

SEQ ID NO: 105577 - DNA, 18 bp, Homo sapiens
gaggatggaaggagatgc

SEQ ID NO: 105578 - DNA, 22 bp, Homo sapiens
gcctcctggggtgccatcatct

SEQ ID NO: 105579 - DNA, 22 bp, Homo sapiens
ctcctggaggatagtgactggg

SEQ ID NO: 105580 - DNA, 22 bp, Homo sapiens
taccagggaacagggatattaa

SEQ ID NO: 105581 - DNA, 22 bp, Homo sapiens
atgaggcaggtggaggctgcca

SEQ ID NO: 105582 - DNA, 22 bp, Homo sapiens
tatcactacacctggctaatta

SEQ ID NO: 105583 - DNA, 22 bp, Homo sapiens
gcagcctgggcaacagagtgag

SEQ ID NO: 105584 - DNA, 22 bp, Homo sapiens
aaagaaatagatggcatttaaa

SEQ ID NO: 105585 - DNA, 22 bp, Homo sapiens
tattaagtggtgagtactgcca

SEQ ID NO: 105586 - DNA, 22 bp, Homo sapiens
ctcctctttagccccagctgga

SEQ ID NO: 105587 - DNA, 22 bp, Homo sapiens
aacccaggaggcagatgttgtg

SEQ ID NO: 105588 - DNA, 22 bp, Homo sapiens
tgggattcaccatgggcttcag

SEQ ID NO: 105589 - DNA, 22 bp, Homo sapiens
tggacaggcaagcaagacatac

SEQ ID NO: 105590 - DNA, 22 bp, Homo sapiens
ctgtggcgccgctgagagcaga

SEQ ID NO: 105591 - DNA, 22 bp, Homo sapiens
ccttttgctctcccatccagaa

SEQ ID NO: 105592 - DNA, 22 bp, Homo sapiens
tggggcagttaataaacattct

SEQ ID NO: 105593 - DNA, 20 bp, Homo sapiens
aaaatatgtataactcttct

SEQ ID NO: 105594 - DNA, 22 bp, Homo sapiens
gggcggatcatttgaggtcagg

SEQ ID NO: 105595 - DNA, 22 bp, Homo sapiens
cggagtcttgctatgttgccca

SEQ ID NO: 105596 - DNA, 23 bp, Homo sapiens
ggagtgcaatggcgccatctcgg

SEQ ID NO: 105597 - DNA, 21 bp, Homo sapiens
ctgtttgcaagcctatgtgtc

SEQ ID NO: 105598 - DNA, 22 bp, Homo sapiens
ccccatgaagtagggtctctga

SEQ ID NO: 105599 - DNA, 22 bp, Homo sapiens
ggctcacgcaattatcccggcc

SEQ ID NO: 105600 - DNA, 22 bp, Homo sapiens
ctcccctagcccgttgggaggt

SEQ ID NO: 105601 - DNA, 22 bp, Homo sapiens
gtgctccctccttcctcaagga

SEQ ID NO: 105602 - DNA, 22 bp, Homo sapiens
tggtctgctgaacagccgtatc

SEQ ID NO: 105603 - DNA, 22 bp, Homo sapiens
ccaggaggcggaggttgcagcg

SEQ ID NO: 105604 - DNA, 22 bp, Homo sapiens
caatagtaaattacggaggaga

SEQ ID NO: 105605 - DNA, 22 bp, Homo sapiens
tctgcgttgctcacgctgggag

SEQ ID NO: 105606 - DNA, 22 bp, Homo sapiens
tgattcatcagaataggagttt

SEQ ID NO: 105607 - DNA, 22 bp, Homo sapiens
ggagagggtaggggtcctgccc

SEQ ID NO: 105608 - DNA, 22 bp, Homo sapiens
agggtggcactggtggctctat

SEQ ID NO: 105609 - DNA, 19 bp, Homo sapiens
ttctctgctacattctcag

SEQ ID NO: 105610 - DNA, 22 bp, Homo sapiens
ctgtcctgccagtcctggactc

SEQ ID NO: 105611 - DNA, 22 bp, Homo sapiens
taaatacttagttttgtgtcta

SEQ ID NO: 105612 - DNA, 22 bp, Homo sapiens
agtccccctctgagcccaggga

SEQ ID NO: 105613 - DNA, 19 bp, Homo sapiens
tcctggggaggggcatggc

SEQ ID NO: 105614 - DNA, 22 bp, Homo sapiens
ttgtgttaaggtgcatctagtg

SEQ ID NO: 105615 - DNA, 22 bp, Homo sapiens
tttcttctatgtgtgatatttt

SEQ ID NO: 105616 - DNA, 22 bp, Homo sapiens
acagtccagcctagtatgtata

SEQ ID NO: 105617 - DNA, 22 bp, Homo sapiens
gccctgggcaaggttctggcca

SEQ ID NO: 105618 - DNA, 22 bp, Homo sapiens
atctggttttggctgtgtccct

SEQ ID NO: 105619 - DNA, 22 bp, Homo sapiens
gaggtagacttcttggaagtag

SEQ ID NO: 105620 - DNA, 22 bp, Homo sapiens
cccaggatggggctgcagttat

SEQ ID NO: 105621 - DNA, 22 bp, Homo sapiens
tgcccagggtggagtgcagtgg

SEQ ID NO: 105622 - DNA, 22 bp, Homo sapiens
cccaggagttggaggctgcagt

SEQ ID NO: 105623 - DNA, 22 bp, Homo sapiens
cttgagtcatataaagacagag

SEQ ID NO: 105624 - DNA, 22 bp, Homo sapiens
atctgggagcggaggttgcagt

SEQ ID NO: 105625 - DNA, 22 bp, Homo sapiens
tatgccactgctctccatccta

SEQ ID NO: 105626 - DNA, 21 bp, Homo sapiens
aggcatgagccctgcatggac

SEQ ID NO: 105627 - DNA, 22 bp, Homo sapiens
caagattaccaaggaccagcgg

SEQ ID NO: 105628 - DNA, 22 bp, Homo sapiens
aggccagcctgcccaaagctgc

SEQ ID NO: 105629 - DNA, 22 bp, Homo sapiens
ccagatgtccctctcaggtttg

SEQ ID NO: 105630 - DNA, 20 bp, Homo sapiens
aagacaccagtggcagcccc

SEQ ID NO: 105631 - DNA, 17 bp, Homo sapiens
tgcatgtcctttgttcc

SEQ ID NO: 105632 - DNA, 22 bp, Homo sapiens
ggggccttggatctgtgccccg

SEQ ID NO: 105633 - DNA, 22 bp, Homo sapiens
tggttaacttctgagcaggctg

SEQ ID NO: 105634 - DNA, 22 bp, Homo sapiens
ggcctctcttgggacagctgtc

SEQ ID NO: 105635 - DNA, 22 bp, Homo sapiens
attgggatgccggctgataaga

SEQ ID NO: 105636 - DNA, 22 bp, Homo sapiens
tttgtcctaacagtggtaaagg

SEQ ID NO: 105637 - DNA, 22 bp, Homo sapiens
ggcctgcctcacagtcagcacc

SEQ ID NO: 105638 - DNA, 22 bp, Homo sapiens
aggctgaggcaagaggatcact

SEQ ID NO: 105639 - DNA, 22 bp, Homo sapiens
tgccatggcctagacctgtgat

SEQ ID NO: 105640 - DNA, 22 bp, Homo sapiens
tagatttgtttccttctctcca

SEQ ID NO: 105641 - DNA, 18 bp, Homo sapiens
tctgccccagccgcactg

SEQ ID NO: 105642 - DNA, 22 bp, Homo sapiens
tactgatattttcaactagaag

SEQ ID NO: 105643 - DNA, 22 bp, Homo sapiens
ctgcatccatgttgctgcaaag

SEQ ID NO: 105644 - DNA, 19 bp, Homo sapiens
ggctgccttctgctcatct

SEQ ID NO: 105645 - DNA, 22 bp, Homo sapiens
cacagggcttctcatggggtgc

SEQ ID NO: 105646 - DNA, 22 bp, Homo sapiens
agcaggagtttgatgcttttat

SEQ ID NO: 105647 - DNA, 22 bp, Homo sapiens
taatgtataacaaatactcatc

SEQ ID NO: 105648 - DNA, 22 bp, Homo sapiens
ataaaaactgacccatcctttg

SEQ ID NO: 105649 - DNA, 22 bp, Homo sapiens
aatgttgcagagtgattgtcca

SEQ ID NO: 105650 - DNA, 22 bp, Homo sapiens
aatttaagaacatttcaggact

SEQ ID NO: 105651 - DNA, 22 bp, Homo sapiens
gcagagtgctgtcgtacgcccc

SEQ ID NO: 105652 - DNA, 22 bp, Homo sapiens
ataaagtggaggtagtattcat

SEQ ID NO: 105653 - DNA, 22 bp, Homo sapiens
tatgttgcaccaacctaataat

SEQ ID NO: 105654 - DNA, 22 bp, Homo sapiens
ctctgtagaaagagcccaggtg

SEQ ID NO: 105655 - DNA, 22 bp, Homo sapiens
tcatggggccacagctgccagc

SEQ ID NO: 105656 - DNA, 22 bp, Homo sapiens
caaagtgctgggattacaggtg

SEQ ID NO: 105657 - DNA, 22 bp, Homo sapiens
agctcagggccaggcgcgtttc

SEQ ID NO: 105658 - DNA, 22 bp, Homo sapiens
agctggggctgtggttgtgatt

SEQ ID NO: 105659 - DNA, 22 bp, Homo sapiens
caaagtgctaggattataggtg

SEQ ID NO: 105660 - DNA, 22 bp, Homo sapiens
ccagaggtgctctttggaagtg

SEQ ID NO: 105661 - DNA, 22 bp, Homo sapiens
ggagtgcaatggcacgatctca

SEQ ID NO: 105662 - DNA, 22 bp, Homo sapiens
cactgcactccagcttgggtga

SEQ ID NO: 105663 - DNA, 22 bp, Homo sapiens
ggaactcctgctccaagcagct

SEQ ID NO: 105664 - DNA, 22 bp, Homo sapiens
gtgcccagcagcagcgtccccg

SEQ ID NO: 105665 - DNA, 22 bp, Homo sapiens
gccttgccgctcagcagtgggg

SEQ ID NO: 105666 - DNA, 22 bp, Homo sapiens
ggctggtgttgagtgcctgtag

SEQ ID NO: 105667 - DNA, 22 bp, Homo sapiens
atgacttgctgtgcttgggagc

SEQ ID NO: 105668 - DNA, 22 bp, Homo sapiens
ggatgttctggggttctcttgt

SEQ ID NO: 105669 - DNA, 22 bp, Homo sapiens
cctcatcgtttccagaatgtgg

SEQ ID NO: 105670 - DNA, 22 bp, Homo sapiens
gaggggtccaggaggcacttac

SEQ ID NO: 105671 - DNA, 19 bp, Homo sapiens
gttttgcaggcagagggga

SEQ ID NO: 105672 - DNA, 22 bp, Homo sapiens
tgctgtgaggttgagaaggaag

SEQ ID NO: 105673 - DNA, 22 bp, Homo sapiens
cactgcacttcagcctgggtga

SEQ ID NO: 105674 - DNA, 22 bp, Homo sapiens
aattgaaaatattgtagaccat

SEQ ID NO: 105675 - DNA, 22 bp, Homo sapiens
cccaggaggtggagttcacagt

SEQ ID NO: 105676 - DNA, 22 bp, Homo sapiens
caagaggattattaataaataa

SEQ ID NO: 105677 - DNA, 22 bp, Homo sapiens
aagagagtcagtctgagcacca

SEQ ID NO: 105678 - DNA, 22 bp, Homo sapiens
ctcgggcaccctggttctggtg

SEQ ID NO: 105679 - DNA, 22 bp, Homo sapiens
gggcaggaacaaatcaaatgat

SEQ ID NO: 105680 - DNA, 22 bp, Homo sapiens
ccacgggcagatgtggttggtt

SEQ ID NO: 105681 - DNA, 22 bp, Homo sapiens
tgtatagttgagtcaagtttca

SEQ ID NO: 105682 - DNA, 16 bp, Homo sapiens
tgggtgggaggagcgg

SEQ ID NO: 105683 - DNA, 22 bp, Homo sapiens
agaaaacataggagacaggaaa

SEQ ID NO: 105684 - DNA, 22 bp, Homo sapiens
tttaatcaggcaaagcataata

SEQ ID NO: 105685 - DNA, 22 bp, Homo sapiens
aaggccttgccgaaggatgcca

SEQ ID NO: 105686 - DNA, 22 bp, Homo sapiens
caaagtgctggaattacaggtg

SEQ ID NO: 105687 - DNA, 22 bp, Homo sapiens
ttatgggagcaattggggaggt

SEQ ID NO: 105688 - DNA, 22 bp, Homo sapiens
tcctcagtcacggtagcacatt

SEQ ID NO: 105689 - DNA, 22 bp, Homo sapiens
gcctccccaagcagcagggatt

SEQ ID NO: 105690 - DNA, 22 bp, Homo sapiens
ccatgaattcactccatgctag

SEQ ID NO: 105691 - DNA, 22 bp, Homo sapiens
tccacaaggcagctcctccagg

SEQ ID NO: 105692 - DNA, 22 bp, Homo sapiens
ctgcattaagttgcctgtaaga

SEQ ID NO: 105693 - DNA, 22 bp, Homo sapiens
ccaagctacttaggagtctgag

SEQ ID NO: 105694 - DNA, 22 bp, Homo sapiens
tggcctctcctggctgagtttc

SEQ ID NO: 105695 - DNA, 22 bp, Homo sapiens
gtctttatttgagattgtcatt

SEQ ID NO: 105696 - DNA, 22 bp, Homo sapiens
tcagtctttccctccctcagtt

SEQ ID NO: 105697 - DNA, 19 bp, Homo sapiens
tccaggggctccacctcct

SEQ ID NO: 105698 - DNA, 22 bp, Homo sapiens
ttccacggggctccccgctctt

SEQ ID NO: 105699 - DNA, 22 bp, Homo sapiens
aatctcatttacaacatgagga

SEQ ID NO: 105700 - DNA, 22 bp, Homo sapiens
tgtgactgaggctccaagctag

SEQ ID NO: 105701 - DNA, 22 bp, Homo sapiens
aggagatggagctcagtgggca

SEQ ID NO: 105702 - DNA, 22 bp, Homo sapiens
tacagtcacattctgaggtctt

SEQ ID NO: 105703 - DNA, 22 bp, Homo sapiens
gaaagacatagttgcaagatgg

SEQ ID NO: 105704 - DNA, 22 bp, Homo sapiens
cctcaaagctcaaatgaggctt

SEQ ID NO: 105705 - DNA, 22 bp, Homo sapiens
cacagagctggaaaggctgggc

SEQ ID NO: 105706 - DNA, 22 bp, Homo sapiens
atgtatatgcatgcattcaaag

SEQ ID NO: 105707 - DNA, 22 bp, Homo sapiens
ccaggctgctgttggtgtccgc

SEQ ID NO: 105708 - DNA, 22 bp, Homo sapiens
cattggctcctgtgggacatga

SEQ ID NO: 105709 - DNA, 22 bp, Homo sapiens
ttgcttcttagatattcctctc

SEQ ID NO: 105710 - DNA, 22 bp, Homo sapiens
agaagcagaaactgggcttgtg

SEQ ID NO: 105711 - DNA, 22 bp, Homo sapiens
tatgtttggcctggcaatttca

SEQ ID NO: 105712 - DNA, 22 bp, Homo sapiens
cacagcctcctctggctcacgg

SEQ ID NO: 105713 - DNA, 22 bp, Homo sapiens
tcccgtcttgctgttgtctgcg

SEQ ID NO: 105714 - DNA, 22 bp, Homo sapiens
atgtttgccatcatgagattgt

SEQ ID NO: 105715 - DNA, 22 bp, Homo sapiens
actaaagctcacagagttgaac

SEQ ID NO: 105716 - DNA, 22 bp, Homo sapiens
gctgtgtatcagatgccacggg

SEQ ID NO: 105717 - DNA, 22 bp, Homo sapiens
tgcccaggctggagtacagtgg

SEQ ID NO: 105718 - DNA, 22 bp, Homo sapiens
agcttgacagacagatggtagc

SEQ ID NO: 105719 - DNA, 22 bp, Homo sapiens
ggtgacagtggttaaaatttgt

SEQ ID NO: 105720 - DNA, 22 bp, Homo sapiens
gatgaggcataaacacagtcac

SEQ ID NO: 105721 - DNA, 22 bp, Homo sapiens
aagaggttgtctgtgatgagtt

SEQ ID NO: 105722 - DNA, 22 bp, Homo sapiens
tggggaaaatgcttgtagtcag

SEQ ID NO: 105723 - DNA, 22 bp, Homo sapiens
ggctcactgcaaactgtgcctc

SEQ ID NO: 105724 - DNA, 22 bp, Homo sapiens
ctgctgaggtggagattgcagt

SEQ ID NO: 105725 - DNA, 21 bp, Homo sapiens
cactccacttagaacagggtt

SEQ ID NO: 105726 - DNA, 22 bp, Homo sapiens
tacgcctgtaatcccagcactt

SEQ ID NO: 105727 - DNA, 18 bp, Homo sapiens
ttgcttcttttctctagg

SEQ ID NO: 105728 - DNA, 22 bp, Homo sapiens
aagaggagaaaggctggctttg

SEQ ID NO: 105729 - DNA, 22 bp, Homo sapiens
cactgcacttcagcctgggcaa

SEQ ID NO: 105730 - DNA, 22 bp, Homo sapiens
tccagcccaggctggagtgtag

SEQ ID NO: 105731 - DNA, 22 bp, Homo sapiens
ttccgagggctcggcggccgcc

SEQ ID NO: 105732 - DNA, 22 bp, Homo sapiens
cactgcactccagcctgggcca

SEQ ID NO: 105733 - DNA, 22 bp, Homo sapiens
cactgcaacctccacctcctgg

SEQ ID NO: 105734 - DNA, 21 bp, Homo sapiens
tctgccagctgaagaggtgga

SEQ ID NO: 105735 - DNA, 19 bp, Homo sapiens
ggggcctgtgatggtcaca

SEQ ID NO: 105736 - DNA, 22 bp, Homo sapiens
cttgtcagccaattgtggattt

SEQ ID NO: 105737 - DNA, 22 bp, Homo sapiens
gtgtggctgaaatcaaggcagg

SEQ ID NO: 105738 - DNA, 22 bp, Homo sapiens
cagggggctcaaaggagagtgc

SEQ ID NO: 105739 - DNA, 18 bp, Homo sapiens
ccgggctttggtgacaca

SEQ ID NO: 105740 - DNA, 22 bp, Homo sapiens
atttgtgggactataatgcagg

SEQ ID NO: 105741 - DNA, 22 bp, Homo sapiens
gattgagtctgaggatgctgca

SEQ ID NO: 105742 - DNA, 22 bp, Homo sapiens
cagggccagggacacgctgtca

SEQ ID NO: 105743 - DNA, 22 bp, Homo sapiens
gtcttttgctagccagagagct

SEQ ID NO: 105744 - DNA, 23 bp, Homo sapiens
tgaggcaggcggatcacgaggtc

SEQ ID NO: 105745 - DNA, 22 bp, Homo sapiens
tcagggctgcagaagaggcagg

SEQ ID NO: 105746 - DNA, 19 bp, Homo sapiens
gcataaatacactattgtc

SEQ ID NO: 105747 - DNA, 22 bp, Homo sapiens
cgtgccctgcgcaagtgctgct

SEQ ID NO: 105748 - DNA, 22 bp, Homo sapiens
aaagtgctaggattacaagcgt

SEQ ID NO: 105749 - DNA, 22 bp, Homo sapiens
gatgcacggtcatgtcttttca

SEQ ID NO: 105750 - DNA, 22 bp, Homo sapiens
tttctcttcactgtgtgcctca

SEQ ID NO: 105751 - DNA, 22 bp, Homo sapiens
tttcacagaggaggaagctgag

SEQ ID NO: 105752 - DNA, 22 bp, Homo sapiens
gaggctgaggttgcagtgagct

SEQ ID NO: 105753 - DNA, 22 bp, Homo sapiens
taaaatttgtccctgagtgttg

SEQ ID NO: 105754 - DNA, 22 bp, Homo sapiens
ccaggaggttgaggctgcagtg

SEQ ID NO: 105755 - DNA, 22 bp, Homo sapiens
cactgcactccagcccgggcaa

SEQ ID NO: 105756 - DNA, 22 bp, Homo sapiens
agcccaggtccagttcactgca

SEQ ID NO: 105757 - DNA, 22 bp, Homo sapiens
caccagcagcggtgtgagggtg

SEQ ID NO: 105758 - DNA, 22 bp, Homo sapiens
agctgattccactttttcccca

SEQ ID NO: 105759 - DNA, 22 bp, Homo sapiens
acagacaagtagttcagacaag

SEQ ID NO: 105760 - DNA, 22 bp, Homo sapiens
tgccgcaagtactgctgcctgt

SEQ ID NO: 105761 - DNA, 21 bp, Homo sapiens
ccaccaggtcttctgctcggg

SEQ ID NO: 105762 - DNA, 22 bp, Homo sapiens
caggcacggtggctcatgcctg

SEQ ID NO: 105763 - DNA, 22 bp, Homo sapiens
cctgtctctgcagggccctgcc

SEQ ID NO: 105764 - DNA, 22 bp, Homo sapiens
gggctgagacgatggggtcttc

SEQ ID NO: 105765 - DNA, 22 bp, Homo sapiens
ccagggtggcgtagatgctggg

SEQ ID NO: 105766 - DNA, 22 bp, Homo sapiens
cctacagttatattcttgattg

SEQ ID NO: 105767 - DNA, 22 bp, Homo sapiens
gtgagagattgattgtagcggc

SEQ ID NO: 105768 - DNA, 22 bp, Homo sapiens
ggaggctgaggcaggcggatca

SEQ ID NO: 105769 - DNA, 22 bp, Homo sapiens
tatccgtgatgtttataaacca

SEQ ID NO: 105770 - DNA, 22 bp, Homo sapiens
tagagtgtcataacagtgccca

SEQ ID NO: 105771 - DNA, 22 bp, Homo sapiens
agctcctgaaaatccagactgg

SEQ ID NO: 105772 - DNA, 22 bp, Homo sapiens
gtggctcacgtctgtcatctca

SEQ ID NO: 105773 - DNA, 22 bp, Homo sapiens
agagtccctcttcccaggaggc

SEQ ID NO: 105774 - DNA, 22 bp, Homo sapiens
tgctccagcaccaagagctcca

SEQ ID NO: 105775 - DNA, 22 bp, Homo sapiens
gagaggtggaggttgcagtgag

SEQ ID NO: 105776 - DNA, 22 bp, Homo sapiens
gggaagatagtgttgagggccc

SEQ ID NO: 105777 - DNA, 22 bp, Homo sapiens
tgtgttgtgacattcttggatg

SEQ ID NO: 105778 - DNA, 19 bp, Homo sapiens
ccagagagctaggtacaga

SEQ ID NO: 105779 - DNA, 22 bp, Homo sapiens
gggccctgcgactcgcggcgga

SEQ ID NO: 105780 - DNA, 22 bp, Homo sapiens
acccaggctggcgtgcagtggc

SEQ ID NO: 105781 - DNA, 22 bp, Homo sapiens
catccgcatgcaagtgctgtcc

SEQ ID NO: 105782 - DNA, 22 bp, Homo sapiens
tttctgagaaattaaacacttt

SEQ ID NO: 105783 - DNA, 22 bp, Homo sapiens
gcgagcctctggagtcctctgg

SEQ ID NO: 105784 - DNA, 22 bp, Homo sapiens
aacttaggaaaataaggcatga

SEQ ID NO: 105785 - DNA, 22 bp, Homo sapiens
gagcctcatggtcatcttgagt

SEQ ID NO: 105786 - DNA, 22 bp, Homo sapiens
gtgaagttggccagtttagttt

SEQ ID NO: 105787 - DNA, 22 bp, Homo sapiens
tgtctcttttcaagctaccctt

SEQ ID NO: 105788 - DNA, 22 bp, Homo sapiens
tctgcaacagtgccctgtaaat

SEQ ID NO: 105789 - DNA, 22 bp, Homo sapiens
ggaggacaggggctgcagcaca

SEQ ID NO: 105790 - DNA, 22 bp, Homo sapiens
ctcctgagctctgaggaagctt

SEQ ID NO: 105791 - DNA, 18 bp, Homo sapiens
tcactgtgtgtcttgggt

SEQ ID NO: 105792 - DNA, 22 bp, Homo sapiens
gcaggcagatcacctgtcagga

SEQ ID NO: 105793 - DNA, 22 bp, Homo sapiens
cagcagagaaattacatatttg

SEQ ID NO: 105794 - DNA, 22 bp, Homo sapiens
caaagggaaaagccatgtgggc

SEQ ID NO: 105795 - DNA, 22 bp, Homo sapiens
tagtgccctcccctttgggata

SEQ ID NO: 105796 - DNA, 22 bp, Homo sapiens
agccaggatggtctcgatcggc

SEQ ID NO: 105797 - DNA, 22 bp, Homo sapiens
ttaaattttagaaacagactct

SEQ ID NO: 105798 - DNA, 22 bp, Homo sapiens
ctcggcaggtggaggttgtagt

SEQ ID NO: 105799 - DNA, 22 bp, Homo sapiens
cctggctctgccacttactgcc

SEQ ID NO: 105800 - DNA, 22 bp, Homo sapiens
agaaagagatgaatgctttaag

SEQ ID NO: 105801 - DNA, 22 bp, Homo sapiens
tccagatgctgcacattcctga

SEQ ID NO: 105802 - DNA, 22 bp, Homo sapiens
cagatgtacatgaagggcaatg

SEQ ID NO: 105803 - DNA, 22 bp, Homo sapiens
cccacaggtgtgagcttgctgg

SEQ ID NO: 105804 - DNA, 22 bp, Homo sapiens
tagcaaaggatgactatgtacc

SEQ ID NO: 105805 - DNA, 22 bp, Homo sapiens
ggtcctgtgagatgtatgcatt

SEQ ID NO: 105806 - DNA, 22 bp, Homo sapiens
aggagcagaccgtagtcctgca

SEQ ID NO: 105807 - DNA, 22 bp, Homo sapiens
agaagccaccagctgaggaaga

SEQ ID NO: 105808 - DNA, 22 bp, Homo sapiens
taaagattgctcaaaactgtga

SEQ ID NO: 105809 - DNA, 22 bp, Homo sapiens
ctaggaccactgtaacaaagta

SEQ ID NO: 105810 - DNA, 22 bp, Homo sapiens
tgcatattatgtgtatctgtct

SEQ ID NO: 105811 - DNA, 22 bp, Homo sapiens
gcccaggctggagtgcagtggc

SEQ ID NO: 105812 - DNA, 18 bp, Homo sapiens
cccaggttggcctacaga

SEQ ID NO: 105813 - DNA, 22 bp, Homo sapiens
gctgggctgcgtcggggaagcc

SEQ ID NO: 105814 - DNA, 22 bp, Homo sapiens
acatatgcgatcataggatgca

SEQ ID NO: 105815 - DNA, 22 bp, Homo sapiens
tatgaggtaggtattatactta

SEQ ID NO: 105816 - DNA, 22 bp, Homo sapiens
aatattatcaaaagctttttca

SEQ ID NO: 105817 - DNA, 22 bp, Homo sapiens
ggtgacggggcccaggtttcct

SEQ ID NO: 105818 - DNA, 22 bp, Homo sapiens
agatggggtttcatcatgttgg

SEQ ID NO: 105819 - DNA, 22 bp, Homo sapiens
gtcctgtgagattcatgctcaa

SEQ ID NO: 105820 - DNA, 22 bp, Homo sapiens
tccattatacttctgattcaaa

SEQ ID NO: 105821 - DNA, 22 bp, Homo sapiens
ccggagtgtctggcctgctggg

SEQ ID NO: 105822 - DNA, 22 bp, Homo sapiens
cattgcactccagcctgggcca

SEQ ID NO: 105823 - DNA, 22 bp, Homo sapiens
gaggctgcagctatcagacatt

SEQ ID NO: 105824 - DNA, 22 bp, Homo sapiens
gagagtctaggaacctcatata

SEQ ID NO: 105825 - DNA, 22 bp, Homo sapiens
caccaaagtcgcttctgtcgtc

SEQ ID NO: 105826 - DNA, 22 bp, Homo sapiens
atttggcagtataaattctggc

SEQ ID NO: 105827 - DNA, 22 bp, Homo sapiens
aagatacagacagagccaaaat

SEQ ID NO: 105828 - DNA, 22 bp, Homo sapiens
acatgtttaagtttgttatatg

SEQ ID NO: 105829 - DNA, 22 bp, Homo sapiens
atgcacctgaactccatcagct

SEQ ID NO: 105830 - DNA, 18 bp, Homo sapiens
actctttctgcccacagg

SEQ ID NO: 105831 - DNA, 22 bp, Homo sapiens
tcaggcagtagaattgcttgaa

SEQ ID NO: 105832 - DNA, 22 bp, Homo sapiens
attgcactccggcctgggtgac

SEQ ID NO: 105833 - DNA, 22 bp, Homo sapiens
cacccaggctggagtgcagtga

SEQ ID NO: 105834 - DNA, 22 bp, Homo sapiens
gtggatggagctggaagccatt

SEQ ID NO: 105835 - DNA, 22 bp, Homo sapiens
aagtggcagttcaggaagcaga

SEQ ID NO: 105836 - DNA, 22 bp, Homo sapiens
aaggctccagtgaatgctggca

SEQ ID NO: 105837 - DNA, 22 bp, Homo sapiens
tgacaggaaacatgcagtgatt

SEQ ID NO: 105838 - DNA, 22 bp, Homo sapiens
catgagatttgggaggggccag

SEQ ID NO: 105839 - DNA, 22 bp, Homo sapiens
gggcaggggtcagtggccccaa

SEQ ID NO: 105840 - DNA, 22 bp, Homo sapiens
ggatgcacgaaggcgcctcgga

SEQ ID NO: 105841 - DNA, 22 bp, Homo sapiens
cgagtgtccctaccatttccta

SEQ ID NO: 105842 - DNA, 22 bp, Homo sapiens
accgcagtgacgtgggacttcc

SEQ ID NO: 105843 - DNA, 22 bp, Homo sapiens
gggggggtcttcagacctcaga

SEQ ID NO: 105844 - DNA, 22 bp, Homo sapiens
gaagtgtagtcttgagccccca

SEQ ID NO: 105845 - DNA, 22 bp, Homo sapiens
tgctcttcacagtttcagcatc

SEQ ID NO: 105846 - DNA, 22 bp, Homo sapiens
taactgattcctttttgaaaat

SEQ ID NO: 105847 - DNA, 22 bp, Homo sapiens
gaggtgggcggatcacaaggtc

SEQ ID NO: 105848 - DNA, 20 bp, Homo sapiens
ttggatgtgcatggccgtgc

SEQ ID NO: 105849 - DNA, 22 bp, Homo sapiens
ctcccagccttcgccagtctga

SEQ ID NO: 105850 - DNA, 22 bp, Homo sapiens
gggagctggagctggaagactc

SEQ ID NO: 105851 - DNA, 22 bp, Homo sapiens
gtttctctgtctgttacattgg

SEQ ID NO: 105852 - DNA, 22 bp, Homo sapiens
ttgcccaggctggagtgcagta

SEQ ID NO: 105853 - DNA, 22 bp, Homo sapiens
tgtttcttacgtttttagaggc

SEQ ID NO: 105854 - DNA, 22 bp, Homo sapiens
gtcgtggagctcacagtgtgcc

SEQ ID NO: 105855 - DNA, 22 bp, Homo sapiens
tcttttgtgattcttcagttac

SEQ ID NO: 105856 - DNA, 22 bp, Homo sapiens
tgttcagaacaaaggtaaatga

SEQ ID NO: 105857 - DNA, 22 bp, Homo sapiens
gcccagcccagaaaggttcgga

SEQ ID NO: 105858 - DNA, 22 bp, Homo sapiens
ccagggatgcagaggttgcagt

SEQ ID NO: 105859 - DNA, 22 bp, Homo sapiens
aggttatcatcagttgagcact

SEQ ID NO: 105860 - DNA, 22 bp, Homo sapiens
agaggccggccgagcccatggg

SEQ ID NO: 105861 - DNA, 22 bp, Homo sapiens
tttctttatcatagcatctttg

SEQ ID NO: 105862 - DNA, 22 bp, Homo sapiens
cggggacacactggcagctcct

SEQ ID NO: 105863 - DNA, 22 bp, Homo sapiens
gggcggggggagctggaatgaa

SEQ ID NO: 105864 - DNA, 22 bp, Homo sapiens
tgtgcctgttcccactttgcct

SEQ ID NO: 105865 - DNA, 22 bp, Homo sapiens
tagcccaggctggagtgcaggg

SEQ ID NO: 105866 - DNA, 22 bp, Homo sapiens
gaaagtgctctctctatacaca

SEQ ID NO: 105867 - DNA, 22 bp, Homo sapiens
gtctctatcatagctgaaccct

SEQ ID NO: 105868 - DNA, 22 bp, Homo sapiens
ttactttaagggtgtcttatta

SEQ ID NO: 105869 - DNA, 22 bp, Homo sapiens
tgctgagcgcatccggcggccg

SEQ ID NO: 105870 - DNA, 18 bp, Homo sapiens
cttttcccctttggactc

SEQ ID NO: 105871 - DNA, 22 bp, Homo sapiens
acctctgtacctcctctgacag

SEQ ID NO: 105872 - DNA, 22 bp, Homo sapiens
cttatttgcccatgtttcttta

SEQ ID NO: 105873 - DNA, 20 bp, Homo sapiens
gccactgggcaccagcaggg

SEQ ID NO: 105874 - DNA, 22 bp, Homo sapiens
tggctaacaaggtgaaaccccg

SEQ ID NO: 105875 - DNA, 22 bp, Homo sapiens
cacagctgaagtagccatgtgg

SEQ ID NO: 105876 - DNA, 22 bp, Homo sapiens
atgccactgcacttcagcctgg

SEQ ID NO: 105877 - DNA, 22 bp, Homo sapiens
gtgggctgcccttgaggtcagc

SEQ ID NO: 105878 - DNA, 22 bp, Homo sapiens
tgggctgcaggggttgagagct

SEQ ID NO: 105879 - DNA, 22 bp, Homo sapiens
gtgtcaataaatagcggtgtgg

SEQ ID NO: 105880 - DNA, 21 bp, Homo sapiens
tgcaatgagattgcgcagggc

SEQ ID NO: 105881 - DNA, 22 bp, Homo sapiens
taacaatacccattctaattac

SEQ ID NO: 105882 - DNA, 22 bp, Homo sapiens
tggctgtgtccctgtccagagt

SEQ ID NO: 105883 - DNA, 22 bp, Homo sapiens
atacagggacatccagtttttc

SEQ ID NO: 105884 - DNA, 22 bp, Homo sapiens
tggggtacttgtatcaaagcac

SEQ ID NO: 105885 - DNA, 22 bp, Homo sapiens
ggcaaggggtcaggctgagaca

SEQ ID NO: 105886 - DNA, 22 bp, Homo sapiens
gctctctgcagcctccttggag

SEQ ID NO: 105887 - DNA, 22 bp, Homo sapiens
cagtggcgtgatctctgctcac

SEQ ID NO: 105888 - DNA, 22 bp, Homo sapiens
tgcccaggctggagtgcagtgg

SEQ ID NO: 105889 - DNA, 22 bp, Homo sapiens
aaagattaaatcaaattggtca

SEQ ID NO: 105890 - DNA, 22 bp, Homo sapiens
agagtggagagaaacaactctg

SEQ ID NO: 105891 - DNA, 20 bp, Homo sapiens
gctgaggggtctatggcata

SEQ ID NO: 105892 - DNA, 22 bp, Homo sapiens
attaagactgcccatgttttta

SEQ ID NO: 105893 - DNA, 22 bp, Homo sapiens
tgcctcagctgaggccgctcca

SEQ ID NO: 105894 - DNA, 22 bp, Homo sapiens
ggtgacctcacctggtcccacc

SEQ ID NO: 105895 - DNA, 22 bp, Homo sapiens
ccctgccttgtctgggctaggt

SEQ ID NO: 105896 - DNA, 22 bp, Homo sapiens
aagatattcaaagatttattag

SEQ ID NO: 105897 - DNA, 22 bp, Homo sapiens
attgcactccagcctgggggac

SEQ ID NO: 105898 - DNA, 22 bp, Homo sapiens
caggccctgtgctgggtgatgt

SEQ ID NO: 105899 - DNA, 22 bp, Homo sapiens
atgctatgtaactggcagatag

SEQ ID NO: 105900 - DNA, 22 bp, Homo sapiens
tcacagctctgtcaattttata

SEQ ID NO: 105901 - DNA, 17 bp, Homo sapiens
gggcagggactcctggg

SEQ ID NO: 105902 - DNA, 22 bp, Homo sapiens
ggaggcagaatagagtgtgggt

SEQ ID NO: 105903 - DNA, 23 bp, Homo sapiens
ctcaccaagcgccgccgctgtgt

SEQ ID NO: 105904 - DNA, 22 bp, Homo sapiens
ggcaggaacacagatggtgccg

SEQ ID NO: 105905 - DNA, 22 bp, Homo sapiens
gaaagagaacctgggcctagat

SEQ ID NO: 105906 - DNA, 22 bp, Homo sapiens
aagactgagtggcttaagaaaa

SEQ ID NO: 105907 - DNA, 22 bp, Homo sapiens
aatggaatacctaggtggccca

SEQ ID NO: 105908 - DNA, 22 bp, Homo sapiens
gtggcagagccaaggctggagc

SEQ ID NO: 105909 - DNA, 22 bp, Homo sapiens
ggtgccctggaagctgctgcat

SEQ ID NO: 105910 - DNA, 22 bp, Homo sapiens
aggctctgtcaggcggagcagc

SEQ ID NO: 105911 - DNA, 22 bp, Homo sapiens
agtgcaatggtgccatcatagc

SEQ ID NO: 105912 - DNA, 22 bp, Homo sapiens
gcgttggggaccccgaagctgg

SEQ ID NO: 105913 - DNA, 22 bp, Homo sapiens
tggaaagaaagtaaaggcgtat

SEQ ID NO: 105914 - DNA, 22 bp, Homo sapiens
cccagtttcaactttccagtgg

SEQ ID NO: 105915 - DNA, 22 bp, Homo sapiens
attgaaaataaggccagaaaca

SEQ ID NO: 105916 - DNA, 22 bp, Homo sapiens
tgtgcctactgatagagccaag

SEQ ID NO: 105917 - DNA, 22 bp, Homo sapiens
aggctgtgtgctccttatgaga

SEQ ID NO: 105918 - DNA, 22 bp, Homo sapiens
gctggggaggcagcagagaaca

SEQ ID NO: 105919 - DNA, 22 bp, Homo sapiens
tacagaggaggggattttaata

SEQ ID NO: 105920 - DNA, 22 bp, Homo sapiens
aggaagttagtaaattatgtgc

SEQ ID NO: 105921 - DNA, 22 bp, Homo sapiens
acatttttcacatttgtagggt

SEQ ID NO: 105922 - DNA, 22 bp, Homo sapiens
atcgcaagtttaaaaatctttg

SEQ ID NO: 105923 - DNA, 22 bp, Homo sapiens
caggaggacatactggctcaca

SEQ ID NO: 105924 - DNA, 22 bp, Homo sapiens
ctaggtgatccactgctctctt

SEQ ID NO: 105925 - DNA, 22 bp, Homo sapiens
ggggccgaccgcggttcaggcc

SEQ ID NO: 105926 - DNA, 22 bp, Homo sapiens
cccaggctggagtgcagtggcg

SEQ ID NO: 105927 - DNA, 19 bp, Homo sapiens
agggttacccgctgccacc

SEQ ID NO: 105928 - DNA, 22 bp, Homo sapiens
cctgggaggctgaggctgcagt

SEQ ID NO: 105929 - DNA, 22 bp, Homo sapiens
gactttggttcagggctcagag

SEQ ID NO: 105930 - DNA, 22 bp, Homo sapiens
ctgctcttcacactacacccgt

SEQ ID NO: 105931 - DNA, 22 bp, Homo sapiens
gagtggggggtccgtctcagtg

SEQ ID NO: 105932 - DNA, 22 bp, Homo sapiens
cacatgaaggctggggtcgtga

SEQ ID NO: 105933 - DNA, 22 bp, Homo sapiens
gcaggaggttgagccaggactg

SEQ ID NO: 105934 - DNA, 22 bp, Homo sapiens
ttggaacatgccggggtccagg

SEQ ID NO: 105935 - DNA, 22 bp, Homo sapiens
acagagacacggaagctaaaga

SEQ ID NO: 105936 - DNA, 22 bp, Homo sapiens
tctcagggctcagagctcaggc

SEQ ID NO: 105937 - DNA, 22 bp, Homo sapiens
ttcctagggcagagccgctggg

SEQ ID NO: 105938 - DNA, 22 bp, Homo sapiens
gagtgcaatggcatgatctggg

SEQ ID NO: 105939 - DNA, 22 bp, Homo sapiens
cactgggcacttgggttgcttc

SEQ ID NO: 105940 - DNA, 22 bp, Homo sapiens
aatgccttggagagcctagagg

SEQ ID NO: 105941 - DNA, 22 bp, Homo sapiens
cccaggaattggaggctgcagt

SEQ ID NO: 105942 - DNA, 22 bp, Homo sapiens
cctgagtagctggaattaaagg

SEQ ID NO: 105943 - DNA, 22 bp, Homo sapiens
tgagcaggcgcagcaggaggtc

SEQ ID NO: 105944 - DNA, 22 bp, Homo sapiens
ttctttgaatagatgttcccag

SEQ ID NO: 105945 - DNA, 22 bp, Homo sapiens
aagactgtgtctatggctactc

SEQ ID NO: 105946 - DNA, 22 bp, Homo sapiens
agggcactgcaagggttgaagg

SEQ ID NO: 105947 - DNA, 22 bp, Homo sapiens
cggcatgggcgtccccctcact

SEQ ID NO: 105948 - DNA, 22 bp, Homo sapiens
cgtgattggcttctgcattgga

SEQ ID NO: 105949 - DNA, 22 bp, Homo sapiens
aggcactgtgcagtcccaagca

SEQ ID NO: 105950 - DNA, 22 bp, Homo sapiens
atggaatgtttatacacagttg

SEQ ID NO: 105951 - DNA, 22 bp, Homo sapiens
ctcggagggcaacagaagtgct

SEQ ID NO: 105952 - DNA, 22 bp, Homo sapiens
tgtgaagatagctgttacatct

SEQ ID NO: 105953 - DNA, 22 bp, Homo sapiens
cctgtggcgggggccagtgcct

SEQ ID NO: 105954 - DNA, 22 bp, Homo sapiens
ggtgggagagcttgctttgatg

SEQ ID NO: 105955 - DNA, 22 bp, Homo sapiens
accaggggatggttggcactgt

SEQ ID NO: 105956 - DNA, 22 bp, Homo sapiens
ggccctgggccctctagcttgt

SEQ ID NO: 105957 - DNA, 22 bp, Homo sapiens
gctgaggctcctcgggaggaca

SEQ ID NO: 105958 - DNA, 19 bp, Homo sapiens
gagaaagcaggcacagcac

SEQ ID NO: 105959 - DNA, 22 bp, Homo sapiens
gctccgccacgcccactcctac

SEQ ID NO: 105960 - DNA, 22 bp, Homo sapiens
tgtgacctcatcttaactggaa

SEQ ID NO: 105961 - DNA, 22 bp, Homo sapiens
tctgccttctatcttttgtctg

SEQ ID NO: 105962 - DNA, 17 bp, Homo sapiens
tactgaggggtctggag

SEQ ID NO: 105963 - DNA, 22 bp, Homo sapiens
tctaatccttgctacctgggtg

SEQ ID NO: 105964 - DNA, 22 bp, Homo sapiens
ccaggctggagtgcaatggcat

SEQ ID NO: 105965 - DNA, 22 bp, Homo sapiens
atacaaaaattagccgggagta

SEQ ID NO: 105966 - DNA, 22 bp, Homo sapiens
tgggaagaggggtataaagaag

SEQ ID NO: 105967 - DNA, 22 bp, Homo sapiens
tgggcttggtttctaggtaggt

SEQ ID NO: 105968 - DNA, 22 bp, Homo sapiens
ctggcaggagcattcacagagg

SEQ ID NO: 105969 - DNA, 23 bp, Homo sapiens
ttctgggctgtggaagcctcggg

SEQ ID NO: 105970 - DNA, 22 bp, Homo sapiens
tttgtagcagcatgatttataa

SEQ ID NO: 105971 - DNA, 22 bp, Homo sapiens
cagctggttgaagaggagctgg

SEQ ID NO: 105972 - DNA, 22 bp, Homo sapiens
ggaaggggtgggtgagcctcag

SEQ ID NO: 105973 - DNA, 22 bp, Homo sapiens
aggggatggagctggaaggcag

SEQ ID NO: 105974 - DNA, 22 bp, Homo sapiens
aggaggcagtctgtcccttagc

SEQ ID NO: 105975 - DNA, 22 bp, Homo sapiens
actttaattaatgaactgtggc

SEQ ID NO: 105976 - DNA, 22 bp, Homo sapiens
agggtgaatctcacaactctta

SEQ ID NO: 105977 - DNA, 22 bp, Homo sapiens
cagtgatatttatcctactcac

SEQ ID NO: 105978 - DNA, 19 bp, Homo sapiens
tcctgcccaccagccaggg

SEQ ID NO: 105979 - DNA, 22 bp, Homo sapiens
tgccgctccaggtctcgcggtg

SEQ ID NO: 105980 - DNA, 22 bp, Homo sapiens
tgcctgtgtcagcaggtggaag

SEQ ID NO: 105981 - DNA, 22 bp, Homo sapiens
tggctagcactctacctttctc

SEQ ID NO: 105982 - DNA, 21 bp, Homo sapiens
gcccacagtgaggaggatccc

SEQ ID NO: 105983 - DNA, 22 bp, Homo sapiens
tccgccaggactgagggcccat

SEQ ID NO: 105984 - DNA, 23 bp, Homo sapiens
cccagaccttgtgctgcccttgg

SEQ ID NO: 105985 - DNA, 22 bp, Homo sapiens
gcccatgcactttctgtgatgg

SEQ ID NO: 105986 - DNA, 22 bp, Homo sapiens
agcctgggcaacagagcaaaac

SEQ ID NO: 105987 - DNA, 22 bp, Homo sapiens
tgcctgatgcaggagtatcaga

SEQ ID NO: 105988 - DNA, 22 bp, Homo sapiens
ggccttggttccaaagcaggca

SEQ ID NO: 105989 - DNA, 22 bp, Homo sapiens
aatgtcaaaggctatacattca

SEQ ID NO: 105990 - DNA, 22 bp, Homo sapiens
ggtgccaggctgtagtcagggt

SEQ ID NO: 105991 - DNA, 22 bp, Homo sapiens
ctacaaaagtaattgtggtttt

SEQ ID NO: 105992 - DNA, 22 bp, Homo sapiens
gccaggctgaggctctggaaga

SEQ ID NO: 105993 - DNA, 22 bp, Homo sapiens
ttctcccatctcagtcttacat

SEQ ID NO: 105994 - DNA, 22 bp, Homo sapiens
tgtacttgaacttgactgtaga

SEQ ID NO: 105995 - DNA, 22 bp, Homo sapiens
ggcaatgagcttgacctcctgg

SEQ ID NO: 105996 - DNA, 22 bp, Homo sapiens
ctgtggctctcagaggctgctg

SEQ ID NO: 105997 - DNA, 22 bp, Homo sapiens
acctcctccaaggagccatagg

SEQ ID NO: 105998 - DNA, 22 bp, Homo sapiens
ggcagacctctccagccccaca

SEQ ID NO: 105999 - DNA, 22 bp, Homo sapiens
ttcatatttctttaaggacttt

SEQ ID NO: 106000 - DNA, 22 bp, Homo sapiens
gagatgggcgagaaggtggact

SEQ ID NO: 106001 - DNA, 20 bp, Homo sapiens
cagcagtggatgagagtttt

SEQ ID NO: 106002 - DNA, 22 bp, Homo sapiens
agggcactctgcagggaccacc

SEQ ID NO: 106003 - DNA, 22 bp, Homo sapiens
acggtgctgggtattggggttc

SEQ ID NO: 106004 - DNA, 22 bp, Homo sapiens
tgtatattctgcctaaaagctt

SEQ ID NO: 106005 - DNA, 22 bp, Homo sapiens
tgtttacagctgatcaggcatc

SEQ ID NO: 106006 - DNA, 22 bp, Homo sapiens
tgctgctgaggctaaagtatag

SEQ ID NO: 106007 - DNA, 22 bp, Homo sapiens
ctctgcaacttctagcagtgtc

SEQ ID NO: 106008 - DNA, 21 bp, Homo sapiens
cgggaaggaggttctgaccct

SEQ ID NO: 106009 - DNA, 22 bp, Homo sapiens
tcctccactttgtctagcaaca

SEQ ID NO: 106010 - DNA, 22 bp, Homo sapiens
ttatgatttgccacagattggt

SEQ ID NO: 106011 - DNA, 22 bp, Homo sapiens
atgcttccagattggtaggggt

SEQ ID NO: 106012 - DNA, 22 bp, Homo sapiens
gctgtccagcccttgttcacct

SEQ ID NO: 106013 - DNA, 22 bp, Homo sapiens
aggtcacccgtttgactatcca

SEQ ID NO: 106014 - DNA, 22 bp, Homo sapiens
gcccaggaggcagaggttgtgg

SEQ ID NO: 106015 - DNA, 22 bp, Homo sapiens
tgcgggttggtggcatatgcag

SEQ ID NO: 106016 - DNA, 22 bp, Homo sapiens
tcagtttttctatactttgtag

SEQ ID NO: 106017 - DNA, 22 bp, Homo sapiens
caagtctgacctctgggtgaag

SEQ ID NO: 106018 - DNA, 22 bp, Homo sapiens
gaccggttctgccgtggactgg

SEQ ID NO: 106019 - DNA, 22 bp, Homo sapiens
agtgaccgaggcacttggcaac

SEQ ID NO: 106020 - DNA, 22 bp, Homo sapiens
ttctccacccactcttttgttg

SEQ ID NO: 106021 - DNA, 22 bp, Homo sapiens
agagcagctcgctacctctcta

SEQ ID NO: 106022 - DNA, 22 bp, Homo sapiens
agatgcagtggttaacaataca

SEQ ID NO: 106023 - DNA, 22 bp, Homo sapiens
gaccttgtgatccccctgcctt

SEQ ID NO: 106024 - DNA, 22 bp, Homo sapiens
aaacatctactgtaggctggag

SEQ ID NO: 106025 - DNA, 22 bp, Homo sapiens
cccacacacatttatgatagga

SEQ ID NO: 106026 - DNA, 22 bp, Homo sapiens
atcatgacatacttttgagaag

SEQ ID NO: 106027 - DNA, 22 bp, Homo sapiens
aaagtgctgggattacaagcgt

SEQ ID NO: 106028 - DNA, 22 bp, Homo sapiens
caggggcggtggctcacgcctg

SEQ ID NO: 106029 - DNA, 22 bp, Homo sapiens
tggggtgagattcagatattca

SEQ ID NO: 106030 - DNA, 22 bp, Homo sapiens
ctggccagatgttacgtccaat

SEQ ID NO: 106031 - DNA, 22 bp, Homo sapiens
tctctttgcctgctgccatcca

SEQ ID NO: 106032 - DNA, 22 bp, Homo sapiens
agggagcaaaggtttcagggtt

SEQ ID NO: 106033 - DNA, 22 bp, Homo sapiens
caatagtgtctgcttgtttcta

SEQ ID NO: 106034 - DNA, 22 bp, Homo sapiens
cactgcactccagcctgggtca

SEQ ID NO: 106035 - DNA, 22 bp, Homo sapiens
tggatctcggcaatgcgggact

SEQ ID NO: 106036 - DNA, 22 bp, Homo sapiens
tagatctgatacaattcatctg

SEQ ID NO: 106037 - DNA, 22 bp, Homo sapiens
agtgggaattttctcccaggga

SEQ ID NO: 106038 - DNA, 22 bp, Homo sapiens
tgacagagtgacactcttgtct

SEQ ID NO: 106039 - DNA, 22 bp, Homo sapiens
tgtcctcatcctccagtctgtc

SEQ ID NO: 106040 - DNA, 22 bp, Homo sapiens
ataaagctattcctctcttttt

SEQ ID NO: 106041 - DNA, 22 bp, Homo sapiens
tggtatgtaaattgtaactcaa

SEQ ID NO: 106042 - DNA, 22 bp, Homo sapiens
ggtgggagagctctgtctccag

SEQ ID NO: 106043 - DNA, 22 bp, Homo sapiens
attgtaaatagtgccacaataa

SEQ ID NO: 106044 - DNA, 22 bp, Homo sapiens
agctggtgctcggggagctggc

SEQ ID NO: 106045 - DNA, 23 bp, Homo sapiens
ctcaaccctagtaagggagtagg

SEQ ID NO: 106046 - DNA, 22 bp, Homo sapiens
gcccagccacagtcactttcat

SEQ ID NO: 106047 - DNA, 22 bp, Homo sapiens
aagtgatgctacgactttgaca

SEQ ID NO: 106048 - DNA, 22 bp, Homo sapiens
ccacagaattctgtctccagga

SEQ ID NO: 106049 - DNA, 22 bp, Homo sapiens
tgaatgtgatgctaaacatatg

SEQ ID NO: 106050 - DNA, 22 bp, Homo sapiens
gcaggcagaggtggaggagaca

SEQ ID NO: 106051 - DNA, 22 bp, Homo sapiens
caggctggagtgcagtggcgct

SEQ ID NO: 106052 - DNA, 22 bp, Homo sapiens
gctccctggtagccatgctctc

SEQ ID NO: 106053 - DNA, 17 bp, Homo sapiens
aggtgggtggatcacct

SEQ ID NO: 106054 - DNA, 23 bp, Homo sapiens
tgcaatggcatgatttcagctca

SEQ ID NO: 106055 - DNA, 22 bp, Homo sapiens
tcttcccccgtgctccagtgca

SEQ ID NO: 106056 - DNA, 22 bp, Homo sapiens
gccttgtttcattacacgtggt

SEQ ID NO: 106057 - DNA, 22 bp, Homo sapiens
tctagttctagatccctgagga

SEQ ID NO: 106058 - DNA, 22 bp, Homo sapiens
tgccctggctcttcttgttcca

SEQ ID NO: 106059 - DNA, 22 bp, Homo sapiens
ttgtccgtggtgagttcgcatt

SEQ ID NO: 106060 - DNA, 22 bp, Homo sapiens
gggcgcatcacctgaggtcagg

SEQ ID NO: 106061 - DNA, 22 bp, Homo sapiens
gcctcagtctcccgagtagctg

SEQ ID NO: 106062 - DNA, 22 bp, Homo sapiens
ttgagcccaggaggcctgggtg

SEQ ID NO: 106063 - DNA, 22 bp, Homo sapiens
acatcctcccgatctactggct

SEQ ID NO: 106064 - DNA, 22 bp, Homo sapiens
gaggtaggtgtaggaggcctgc

SEQ ID NO: 106065 - DNA, 22 bp, Homo sapiens
tgctgggggtagctctgcgtag

SEQ ID NO: 106066 - DNA, 22 bp, Homo sapiens
gggagtgggtttggcctaggcc

SEQ ID NO: 106067 - DNA, 22 bp, Homo sapiens
tttaagaagttatgttataaat

SEQ ID NO: 106068 - DNA, 22 bp, Homo sapiens
tccttgccctaaatgtctgtgt

SEQ ID NO: 106069 - DNA, 22 bp, Homo sapiens
gagcctcgtggcggccactgcg

SEQ ID NO: 106070 - DNA, 22 bp, Homo sapiens
tgggaaggggagctggaaagga

SEQ ID NO: 106071 - DNA, 22 bp, Homo sapiens
agctgctgagccaggctgatgt

SEQ ID NO: 106072 - DNA, 22 bp, Homo sapiens
ttggaatgcacactgagcctgc

SEQ ID NO: 106073 - DNA, 22 bp, Homo sapiens
actgcacttcagcctgggtgac

SEQ ID NO: 106074 - DNA, 22 bp, Homo sapiens
actctgctctgtatttcactgt

SEQ ID NO: 106075 - DNA, 22 bp, Homo sapiens
aaagtgctgggattacaagtgt

SEQ ID NO: 106076 - DNA, 22 bp, Homo sapiens
tgaaatcttcactaagtctctt

SEQ ID NO: 106077 - DNA, 21 bp, Homo sapiens
attctttgatgtgcaataagt

SEQ ID NO: 106078 - DNA, 22 bp, Homo sapiens
caggagatgacagggaagaacc

SEQ ID NO: 106079 - DNA, 22 bp, Homo sapiens
atgagctagaaaaccatgtgga

SEQ ID NO: 106080 - DNA, 22 bp, Homo sapiens
cacctcaggcagcaaagtctca

SEQ ID NO: 106081 - DNA, 21 bp, Homo sapiens
acatggactgtgaatggggac

SEQ ID NO: 106082 - DNA, 23 bp, Homo sapiens
aaaacagcttcctccagtggctc

SEQ ID NO: 106083 - DNA, 22 bp, Homo sapiens
tgagatcattgacttgttcctg

SEQ ID NO: 106084 - DNA, 22 bp, Homo sapiens
cacccaggctggagtgcagtgg

SEQ ID NO: 106085 - DNA, 22 bp, Homo sapiens
gatgatcatctgtaaagttaga

SEQ ID NO: 106086 - DNA, 22 bp, Homo sapiens
ataatacatggttgatcttttc

SEQ ID NO: 106087 - DNA, 22 bp, Homo sapiens
tgggaagggtcaacagctggaa

SEQ ID NO: 106088 - DNA, 23 bp, Homo sapiens
gcagaggagcaagctggacacca

SEQ ID NO: 106089 - DNA, 22 bp, Homo sapiens
acccaggctggagtgcagtggg

SEQ ID NO: 106090 - DNA, 22 bp, Homo sapiens
agcaccaaagtcctgttagggt

SEQ ID NO: 106091 - DNA, 22 bp, Homo sapiens
gagacgtggcctttgcctgagc

SEQ ID NO: 106092 - DNA, 22 bp, Homo sapiens
cgcggtggcggcctccagcgcc

SEQ ID NO: 106093 - DNA, 22 bp, Homo sapiens
cagagcccctcgtctccaccac

SEQ ID NO: 106094 - DNA, 22 bp, Homo sapiens
ccctctgcatacaggcgaggag

SEQ ID NO: 106095 - DNA, 22 bp, Homo sapiens
ttgcctaggctggagtgcagtg

SEQ ID NO: 106096 - DNA, 22 bp, Homo sapiens
tggtagtcggcctcggtggctc

SEQ ID NO: 106097 - DNA, 22 bp, Homo sapiens
cagagagaatcttggcagctga

SEQ ID NO: 106098 - DNA, 22 bp, Homo sapiens
aggtaaatgtcagagcctttaa

SEQ ID NO: 106099 - DNA, 22 bp, Homo sapiens
agacccaggattggggctgccg

SEQ ID NO: 106100 - DNA, 20 bp, Homo sapiens
gccaacgcgctggggctgcc

SEQ ID NO: 106101 - DNA, 22 bp, Homo sapiens
gtcctggggattatagagtgtt

SEQ ID NO: 106102 - DNA, 22 bp, Homo sapiens
tgagcattacctgaggccactg

SEQ ID NO: 106103 - DNA, 22 bp, Homo sapiens
agctcactgcaacctccgcctc

SEQ ID NO: 106104 - DNA, 22 bp, Homo sapiens
tagcccctgcctttgaacctgg

SEQ ID NO: 106105 - DNA, 22 bp, Homo sapiens
gcctcctgagtagctgggattg

SEQ ID NO: 106106 - DNA, 22 bp, Homo sapiens
tatccaattcaccattgatggg

SEQ ID NO: 106107 - DNA, 22 bp, Homo sapiens
ctcagcactttggaaggctgat

SEQ ID NO: 106108 - DNA, 22 bp, Homo sapiens
aaagtgctgggattataggcat

SEQ ID NO: 106109 - DNA, 17 bp, Homo sapiens
tccttcagtgcctctgc

SEQ ID NO: 106110 - DNA, 22 bp, Homo sapiens
gcacggctaatttttgtatttt

SEQ ID NO: 106111 - DNA, 22 bp, Homo sapiens
ctatacagcagcttactagtta

SEQ ID NO: 106112 - DNA, 22 bp, Homo sapiens
caggggcgggtaaaaggcctcc

SEQ ID NO: 106113 - DNA, 22 bp, Homo sapiens
gtgggttcgtggtctcgctggc

SEQ ID NO: 106114 - DNA, 20 bp, Homo sapiens
ttgagcttttagtacagaca

SEQ ID NO: 106115 - DNA, 22 bp, Homo sapiens
ggccctggcagccacgaaagcc

SEQ ID NO: 106116 - DNA, 22 bp, Homo sapiens
aagtccaggtcctcattccatc

SEQ ID NO: 106117 - DNA, 22 bp, Homo sapiens
atgaaatatcttgaagaaattc

SEQ ID NO: 106118 - DNA, 22 bp, Homo sapiens
cttgcctttgtcttcaaaggct

SEQ ID NO: 106119 - DNA, 22 bp, Homo sapiens
atgtttaaagggttgagaaata

SEQ ID NO: 106120 - DNA, 22 bp, Homo sapiens
gagccaggggtcagctccgagg

SEQ ID NO: 106121 - DNA, 22 bp, Homo sapiens
caggaggttgagggtgcagtga

SEQ ID NO: 106122 - DNA, 19 bp, Homo sapiens
gcctcatttccacctcccc

SEQ ID NO: 106123 - DNA, 22 bp, Homo sapiens
gaatgctaagcatgtgggagtt

SEQ ID NO: 106124 - DNA, 22 bp, Homo sapiens
ctcacctccaggagctgctggc

SEQ ID NO: 106125 - DNA, 22 bp, Homo sapiens
tacaggcatgtagcatggtgat

SEQ ID NO: 106126 - DNA, 22 bp, Homo sapiens
tggccttggccgtgctggggtc

SEQ ID NO: 106127 - DNA, 22 bp, Homo sapiens
ttggagagtgatattcagatgc

SEQ ID NO: 106128 - DNA, 22 bp, Homo sapiens
tgtccccacctaaatcttatct

SEQ ID NO: 106129 - DNA, 22 bp, Homo sapiens
ggagtagctgcattccgagcac

SEQ ID NO: 106130 - DNA, 22 bp, Homo sapiens
gggcttggcacatgggctcagc

SEQ ID NO: 106131 - DNA, 22 bp, Homo sapiens
tactgtactgcagttctgcaaa

SEQ ID NO: 106132 - DNA, 22 bp, Homo sapiens
acccatccagtgtccctgctag

SEQ ID NO: 106133 - DNA, 22 bp, Homo sapiens
gaggcctcatgaggtgagcatt

SEQ ID NO: 106134 - DNA, 22 bp, Homo sapiens
aactattatgaaagacagtgtg

SEQ ID NO: 106135 - DNA, 22 bp, Homo sapiens
atatttgcattttaaacaggca

SEQ ID NO: 106136 - DNA, 22 bp, Homo sapiens
agtccagaaagtgaacagtgtt

SEQ ID NO: 106137 - DNA, 22 bp, Homo sapiens
taggtttcagaggtgccgggaa

SEQ ID NO: 106138 - DNA, 22 bp, Homo sapiens
ttcgggcccaggccgaggacct

SEQ ID NO: 106139 - DNA, 22 bp, Homo sapiens
ttcttctccgaggagggctggt

SEQ ID NO: 106140 - DNA, 22 bp, Homo sapiens
tctctcaggctggagtgcagtg

SEQ ID NO: 106141 - DNA, 22 bp, Homo sapiens
ttccagctaactcacatccctt

SEQ ID NO: 106142 - DNA, 22 bp, Homo sapiens
ggctgccttccctgagccccgg

SEQ ID NO: 106143 - DNA, 22 bp, Homo sapiens
gggctgggattgcttgctgtga

SEQ ID NO: 106144 - DNA, 22 bp, Homo sapiens
gggccatgagaggttcatcaac

SEQ ID NO: 106145 - DNA, 17 bp, Homo sapiens
ccctcactcctgccggg

SEQ ID NO: 106146 - DNA, 22 bp, Homo sapiens
gaagccttgaactgcaaacccc

SEQ ID NO: 106147 - DNA, 22 bp, Homo sapiens
gcgctgaggctggaggcgcacg

SEQ ID NO: 106148 - DNA, 22 bp, Homo sapiens
aacggctgtggctggcggcagc

SEQ ID NO: 106149 - DNA, 22 bp, Homo sapiens
tgactacaacctccacctcccg

SEQ ID NO: 106150 - DNA, 22 bp, Homo sapiens
caccatgcccggctaattttgg

SEQ ID NO: 106151 - DNA, 22 bp, Homo sapiens
tcttgcacttcatgaatatgtt

SEQ ID NO: 106152 - DNA, 22 bp, Homo sapiens
cccacagtgatcgcattcgtac

SEQ ID NO: 106153 - DNA, 22 bp, Homo sapiens
gcaggtctatcaggctgcaggt

SEQ ID NO: 106154 - DNA, 22 bp, Homo sapiens
cataaaaggtagcagtttgaaa

SEQ ID NO: 106155 - DNA, 22 bp, Homo sapiens
ccagaagcagagcctgaggcag

SEQ ID NO: 106156 - DNA, 22 bp, Homo sapiens
tgcaataactactttaatgttg

SEQ ID NO: 106157 - DNA, 22 bp, Homo sapiens
agtttgggtggaacagagtcgt

SEQ ID NO: 106158 - DNA, 22 bp, Homo sapiens
ggctgggcctctccctcagctg

SEQ ID NO: 106159 - DNA, 22 bp, Homo sapiens
ccaggagttggaagctgccatg

SEQ ID NO: 106160 - DNA, 22 bp, Homo sapiens
agaggaagtaatcaggacctgc

SEQ ID NO: 106161 - DNA, 22 bp, Homo sapiens
tcccccaggctggagtgcagtg

SEQ ID NO: 106162 - DNA, 22 bp, Homo sapiens
ctgcgtgcatgtctgcgtgcat

SEQ ID NO: 106163 - DNA, 22 bp, Homo sapiens
ttaagggccattatggatgggt

SEQ ID NO: 106164 - DNA, 22 bp, Homo sapiens
catggcggtcaggatgtaggtg

SEQ ID NO: 106165 - DNA, 22 bp, Homo sapiens
ttatttaaaagtggtaagattc

SEQ ID NO: 106166 - DNA, 22 bp, Homo sapiens
caagcgtggctgctctgatgga

SEQ ID NO: 106167 - DNA, 22 bp, Homo sapiens
gtggcgtgatctcggctcactg

SEQ ID NO: 106168 - DNA, 22 bp, Homo sapiens
cctgtcacctaggtactgagca

SEQ ID NO: 106169 - DNA, 22 bp, Homo sapiens
gcccagtggtaaaagcaggcct

SEQ ID NO: 106170 - DNA, 22 bp, Homo sapiens
tggaagactcaaggtggtgaat

SEQ ID NO: 106171 - DNA, 22 bp, Homo sapiens
aaagtgctgaaattacaggtgt

SEQ ID NO: 106172 - DNA, 22 bp, Homo sapiens
aaggtgggcagatcacaaggtc

SEQ ID NO: 106173 - DNA, 22 bp, Homo sapiens
cagggccagcgtctcgggctat

SEQ ID NO: 106174 - DNA, 22 bp, Homo sapiens
tttggactgcatgatgatctgg

SEQ ID NO: 106175 - DNA, 22 bp, Homo sapiens
aaatcccatcggagaggaggat

SEQ ID NO: 106176 - DNA, 22 bp, Homo sapiens
aaagtgctgagattacaagcgt

SEQ ID NO: 106177 - DNA, 22 bp, Homo sapiens
aaagtgctgggattacaggcgt

SEQ ID NO: 106178 - DNA, 22 bp, Homo sapiens
ttaatgaaaggcagtttggaac

SEQ ID NO: 106179 - DNA, 22 bp, Homo sapiens
tgggaaagctgcagaaattctc

SEQ ID NO: 106180 - DNA, 22 bp, Homo sapiens
tataaagagtctcaaagaagtt

SEQ ID NO: 106181 - DNA, 22 bp, Homo sapiens
ctctgcctgtctcatcctgcaa

SEQ ID NO: 106182 - DNA, 22 bp, Homo sapiens
aggctgagataggtggatcatt

SEQ ID NO: 106183 - DNA, 22 bp, Homo sapiens
ttcagcagtgcagacacccagt

SEQ ID NO: 106184 - DNA, 22 bp, Homo sapiens
agactcagccacacaagactac

SEQ ID NO: 106185 - DNA, 22 bp, Homo sapiens
tcatctaagagtcttacattta

SEQ ID NO: 106186 - DNA, 22 bp, Homo sapiens
ctgggaggcggaggttgcagtg

SEQ ID NO: 106187 - DNA, 22 bp, Homo sapiens
cacttcattgggaccagggctg

SEQ ID NO: 106188 - DNA, 22 bp, Homo sapiens
cggctgggttcggctgcaggcc

SEQ ID NO: 106189 - DNA, 22 bp, Homo sapiens
gccatcatatcccctgtgacct

SEQ ID NO: 106190 - DNA, 22 bp, Homo sapiens
ctctgtggtggagtgggtcacc

SEQ ID NO: 106191 - DNA, 21 bp, Homo sapiens
acataggcgaatgttcgggag

SEQ ID NO: 106192 - DNA, 22 bp, Homo sapiens
ttgggctgaaccctgcagctga

SEQ ID NO: 106193 - DNA, 23 bp, Homo sapiens
ggcctcagtgatgatgggttaaa

SEQ ID NO: 106194 - DNA, 22 bp, Homo sapiens
actgcaacctccgcctgccagg

SEQ ID NO: 106195 - DNA, 22 bp, Homo sapiens
gcatcccctgcattctgttttc

SEQ ID NO: 106196 - DNA, 22 bp, Homo sapiens
ggtcccaggttgacagggagac

SEQ ID NO: 106197 - DNA, 22 bp, Homo sapiens
actgcacttcaccctgggtgac

SEQ ID NO: 106198 - DNA, 22 bp, Homo sapiens
tgggtgctctgcgaccgtaggg

SEQ ID NO: 106199 - DNA, 22 bp, Homo sapiens
cgccaggcttggtagctcatgc

SEQ ID NO: 106200 - DNA, 22 bp, Homo sapiens
ctgaggagaggtggcctgtgtt

SEQ ID NO: 106201 - DNA, 22 bp, Homo sapiens
agggggctccttggtgtgcaga

SEQ ID NO: 106202 - DNA, 22 bp, Homo sapiens
cggggcctcgtcactctttgcg

SEQ ID NO: 106203 - DNA, 22 bp, Homo sapiens
gggcctgctgcaggttcaggat

SEQ ID NO: 106204 - DNA, 19 bp, Homo sapiens
gggcttggggctgaagcct

SEQ ID NO: 106205 - DNA, 22 bp, Homo sapiens
cactccagcctcagtgacagag

SEQ ID NO: 106206 - DNA, 22 bp, Homo sapiens
gagagaagggggatatgagcct

SEQ ID NO: 106207 - DNA, 23 bp, Homo sapiens
gtgccgacgctccagcaccatcc

SEQ ID NO: 106208 - DNA, 22 bp, Homo sapiens
acccagccatgttcagttctct

SEQ ID NO: 106209 - DNA, 22 bp, Homo sapiens
accaggcccgctgctatggtgg

SEQ ID NO: 106210 - DNA, 22 bp, Homo sapiens
actgttgaagtgccagcttgat

SEQ ID NO: 106211 - DNA, 23 bp, Homo sapiens
aacgacagctacaggcatcccac

SEQ ID NO: 106212 - DNA, 22 bp, Homo sapiens
ctgtatctgtgttggatgagtt

SEQ ID NO: 106213 - DNA, 21 bp, Homo sapiens
tccctgagcccaaggggctcc

SEQ ID NO: 106214 - DNA, 22 bp, Homo sapiens
cttccccaggacctctgctaaa

SEQ ID NO: 106215 - DNA, 22 bp, Homo sapiens
aggccaggaatccttgtcccag

SEQ ID NO: 106216 - DNA, 22 bp, Homo sapiens
cgtctggcttctccacggtaaa

SEQ ID NO: 106217 - DNA, 22 bp, Homo sapiens
tcgcaccattgcactccagcca

SEQ ID NO: 106218 - DNA, 18 bp, Homo sapiens
ggtgagggagctggaagc

SEQ ID NO: 106219 - DNA, 22 bp, Homo sapiens
gccctcctgagctagcacgtgt

SEQ ID NO: 106220 - DNA, 22 bp, Homo sapiens
ccctgatagcccctatcatcag

SEQ ID NO: 106221 - DNA, 22 bp, Homo sapiens
ggatattaatctgtgtcatttc

SEQ ID NO: 106222 - DNA, 22 bp, Homo sapiens
ttggggccgggataaggttgtt

SEQ ID NO: 106223 - DNA, 22 bp, Homo sapiens
ctgccaggattctgtgaacccc

SEQ ID NO: 106224 - DNA, 22 bp, Homo sapiens
atattgttagtaatatttcgaa

SEQ ID NO: 106225 - DNA, 22 bp, Homo sapiens
tacctcaagttccaggaaagcg

SEQ ID NO: 106226 - DNA, 22 bp, Homo sapiens
accagaagctggagcacaagga

SEQ ID NO: 106227 - DNA, 22 bp, Homo sapiens
caggtggcagtgcctgcattct

SEQ ID NO: 106228 - DNA, 22 bp, Homo sapiens
ccactgccctgcaaaagctgga

SEQ ID NO: 106229 - DNA, 22 bp, Homo sapiens
cactgcactccagcctgggcaa

SEQ ID NO: 106230 - DNA, 22 bp, Homo sapiens
cgggaaggtggaggttgcagtg

SEQ ID NO: 106231 - DNA, 22 bp, Homo sapiens
ctcgggtaccatgctaggcact

SEQ ID NO: 106232 - DNA, 22 bp, Homo sapiens
catccaggctgaagtgcagtgg

SEQ ID NO: 106233 - DNA, 22 bp, Homo sapiens
cgggcagtgtggctccagagtc

SEQ ID NO: 106234 - DNA, 22 bp, Homo sapiens
aataaacaaatccttccttccc

SEQ ID NO: 106235 - DNA, 22 bp, Homo sapiens
cctcctgcacctccaggaactc

SEQ ID NO: 106236 - DNA, 22 bp, Homo sapiens
ttggaagacaatgctgattctc

SEQ ID NO: 106237 - DNA, 22 bp, Homo sapiens
ccaggagctggagggtgcagtg

SEQ ID NO: 106238 - DNA, 22 bp, Homo sapiens
atgagtatatgatatggtttgg

SEQ ID NO: 106239 - DNA, 22 bp, Homo sapiens
agctgccgatgcccagctgcat

SEQ ID NO: 106240 - DNA, 22 bp, Homo sapiens
aggaaggcttctttggtcttct

SEQ ID NO: 106241 - DNA, 22 bp, Homo sapiens
agttgggtttgtgtcagttgca

SEQ ID NO: 106242 - DNA, 22 bp, Homo sapiens
gctgctgggatcctgggtctca

SEQ ID NO: 106243 - DNA, 22 bp, Homo sapiens
taattagtgtccagcttctgct

SEQ ID NO: 106244 - DNA, 22 bp, Homo sapiens
tttgaggttagctagcagatca

SEQ ID NO: 106245 - DNA, 22 bp, Homo sapiens
ctgggctagaaggaccaggatg

SEQ ID NO: 106246 - DNA, 20 bp, Homo sapiens
agagtgagactccatctcag

SEQ ID NO: 106247 - DNA, 22 bp, Homo sapiens
gcttcaggctgaattcctccta

SEQ ID NO: 106248 - DNA, 18 bp, Homo sapiens
tcttccaacactgacacc

SEQ ID NO: 106249 - DNA, 22 bp, Homo sapiens
ttcagagaattggataattcgt

SEQ ID NO: 106250 - DNA, 21 bp, Homo sapiens
cctcaagtgcctcctgctgct

SEQ ID NO: 106251 - DNA, 19 bp, Homo sapiens
tttgatagggcataatata

SEQ ID NO: 106252 - DNA, 22 bp, Homo sapiens
ggagaagaggagctggaagcct

SEQ ID NO: 106253 - DNA, 22 bp, Homo sapiens
gtgacacccgcatgccactgtg

SEQ ID NO: 106254 - DNA, 22 bp, Homo sapiens
tcacccaggctggagtgcagtg

SEQ ID NO: 106255 - DNA, 22 bp, Homo sapiens
tctcccaggcaggagtgcagtg

SEQ ID NO: 106256 - DNA, 22 bp, Homo sapiens
agctggtgtgccagttccagtt

SEQ ID NO: 106257 - DNA, 22 bp, Homo sapiens
gcctgtgtctgggtggccagag

SEQ ID NO: 106258 - DNA, 22 bp, Homo sapiens
agtcccaacagcttacaaggaa

SEQ ID NO: 106259 - DNA, 22 bp, Homo sapiens
cctggcaggtggcgccctcggc

SEQ ID NO: 106260 - DNA, 22 bp, Homo sapiens
ctccagattccgtttattcagg

SEQ ID NO: 106261 - DNA, 22 bp, Homo sapiens
ggcaagagggcagatggagtgc

SEQ ID NO: 106262 - DNA, 22 bp, Homo sapiens
gagagtgagatcctcctgggga

SEQ ID NO: 106263 - DNA, 20 bp, Homo sapiens
gggcagagccagccagtccc

SEQ ID NO: 106264 - DNA, 22 bp, Homo sapiens
gcccagagtttgaagatacagt

SEQ ID NO: 106265 - DNA, 22 bp, Homo sapiens
cccaggccccagggcttgtcag

SEQ ID NO: 106266 - DNA, 22 bp, Homo sapiens
tctgcaggtaagcgttcttgga

SEQ ID NO: 106267 - DNA, 22 bp, Homo sapiens
ggttcacagtaaggtttgtgct

SEQ ID NO: 106268 - DNA, 22 bp, Homo sapiens
atagaatatgacttttagatcc

SEQ ID NO: 106269 - DNA, 22 bp, Homo sapiens
gaatttcctctaaacccctgag

SEQ ID NO: 106270 - DNA, 22 bp, Homo sapiens
gtgcgcaccctcccggcatccc

SEQ ID NO: 106271 - DNA, 22 bp, Homo sapiens
gcagagccatgggaggtttttg

SEQ ID NO: 106272 - DNA, 22 bp, Homo sapiens
ctcattgcaacctccgcctccc

SEQ ID NO: 106273 - DNA, 21 bp, Homo sapiens
atgcattcctcccctttcctc

SEQ ID NO: 106274 - DNA, 22 bp, Homo sapiens
atatgtggcattatttctgagg

SEQ ID NO: 106275 - DNA, 22 bp, Homo sapiens
agccggccatgtggtcttgtgc

SEQ ID NO: 106276 - DNA, 22 bp, Homo sapiens
ttgttgtcattgtagaggattt

SEQ ID NO: 106277 - DNA, 22 bp, Homo sapiens
gagcccaggagtttgatgctgc

SEQ ID NO: 106278 - DNA, 22 bp, Homo sapiens
ctgtaatcccagctacctggga

SEQ ID NO: 106279 - DNA, 22 bp, Homo sapiens
aaggtatatctgatccatgagg

SEQ ID NO: 106280 - DNA, 22 bp, Homo sapiens
ggagagtggattccagctgtat

SEQ ID NO: 106281 - DNA, 22 bp, Homo sapiens
tcccagcgcggggggaggatcc

SEQ ID NO: 106282 - DNA, 22 bp, Homo sapiens
ggcgctcagtgttgccccagag

SEQ ID NO: 106283 - DNA, 22 bp, Homo sapiens
ggggtgggcgtgcagggacacc

SEQ ID NO: 106284 - DNA, 22 bp, Homo sapiens
tcctttgcttctgtcattctcc

SEQ ID NO: 106285 - DNA, 22 bp, Homo sapiens
agtactgtcagcagggtgttga

SEQ ID NO: 106286 - DNA, 22 bp, Homo sapiens
tctaatcctatggtggggaggg

SEQ ID NO: 106287 - DNA, 22 bp, Homo sapiens
gaggcaggcagattgcttgagg

SEQ ID NO: 106288 - DNA, 22 bp, Homo sapiens
tcccagtttttctccactaagg

SEQ ID NO: 106289 - DNA, 22 bp, Homo sapiens
tatctatgtgctctgacctctc

SEQ ID NO: 106290 - DNA, 22 bp, Homo sapiens
gaagcctcaacatctctgcgtc

SEQ ID NO: 106291 - DNA, 23 bp, Homo sapiens
agctataaaatctgtgacagcag

SEQ ID NO: 106292 - DNA, 20 bp, Homo sapiens
ccagagctgatggctgcccg

SEQ ID NO: 106293 - DNA, 22 bp, Homo sapiens
gtcatcttgctgttttagatct

SEQ ID NO: 106294 - DNA, 22 bp, Homo sapiens
acaggggcaagggctcacggcc

SEQ ID NO: 106295 - DNA, 20 bp, Homo sapiens
tgttgattggtgtcatctca

SEQ ID NO: 106296 - DNA, 22 bp, Homo sapiens
tcctgggacaagccgtggaagt

SEQ ID NO: 106297 - DNA, 22 bp, Homo sapiens
cacttgttggtggtgaaatcac

SEQ ID NO: 106298 - DNA, 22 bp, Homo sapiens
ctgagctcacgccattctcctt

SEQ ID NO: 106299 - DNA, 22 bp, Homo sapiens
tttagattgtgacctcccccca

SEQ ID NO: 106300 - DNA, 22 bp, Homo sapiens
caagggaattgtgtgtgagagg

SEQ ID NO: 106301 - DNA, 22 bp, Homo sapiens
gcccaggagttcaagtctagtg

SEQ ID NO: 106302 - DNA, 22 bp, Homo sapiens
gaccttcttgctgtgtcctaac

SEQ ID NO: 106303 - DNA, 18 bp, Homo sapiens
gctctgcaggtgctcggt

SEQ ID NO: 106304 - DNA, 22 bp, Homo sapiens
tctcttgagctcagttctgatg

SEQ ID NO: 106305 - DNA, 22 bp, Homo sapiens
cagtgggtcctgcgtctgccag

SEQ ID NO: 106306 - DNA, 23 bp, Homo sapiens
gcaagagacagagcatcctgttc

SEQ ID NO: 106307 - DNA, 22 bp, Homo sapiens
atgtgggccgtgcgggtgtcct

SEQ ID NO: 106308 - DNA, 22 bp, Homo sapiens
ccttcccatgcagcctgtctga

SEQ ID NO: 106309 - DNA, 22 bp, Homo sapiens
tataactacttgaagagttcag

SEQ ID NO: 106310 - DNA, 22 bp, Homo sapiens
taactctgaatcctcacagcag

SEQ ID NO: 106311 - DNA, 22 bp, Homo sapiens
ccctggaggttgaggctgcagt

SEQ ID NO: 106312 - DNA, 22 bp, Homo sapiens
caccatgcctggctaatttttt

SEQ ID NO: 106313 - DNA, 22 bp, Homo sapiens
gcaggtggatcacctgaggtca

SEQ ID NO: 106314 - DNA, 22 bp, Homo sapiens
ggaggagacagtaaaaagcacg

SEQ ID NO: 106315 - DNA, 22 bp, Homo sapiens
gcgagggcacgcggttgaaggc

SEQ ID NO: 106316 - DNA, 22 bp, Homo sapiens
gtctttcttaaacaacagaaca

SEQ ID NO: 106317 - DNA, 22 bp, Homo sapiens
atgtgctgagtgtgtatataca

SEQ ID NO: 106318 - DNA, 22 bp, Homo sapiens
ttctcaaagtgtgctccctgga

SEQ ID NO: 106319 - DNA, 22 bp, Homo sapiens
ccctagtccacaggttcctgga

SEQ ID NO: 106320 - DNA, 22 bp, Homo sapiens
ggctctgcgcctgcggggactt

SEQ ID NO: 106321 - DNA, 22 bp, Homo sapiens
tcctccagttccttggtttcag

SEQ ID NO: 106322 - DNA, 22 bp, Homo sapiens
aactcctctctggtggttcgtc

SEQ ID NO: 106323 - DNA, 22 bp, Homo sapiens
ctgagctcaagcgatcctccca

SEQ ID NO: 106324 - DNA, 22 bp, Homo sapiens
cttcagctgcagttatgtttag

SEQ ID NO: 106325 - DNA, 22 bp, Homo sapiens
ctgtggctcaggcctgtaagcc

SEQ ID NO: 106326 - DNA, 22 bp, Homo sapiens
cattcctggcccgggcgccgtc

SEQ ID NO: 106327 - DNA, 22 bp, Homo sapiens
ggggcaggagcccttcttcagc

SEQ ID NO: 106328 - DNA, 22 bp, Homo sapiens
tctgtgttgagaaggatcatga

SEQ ID NO: 106329 - DNA, 22 bp, Homo sapiens
gatctggaatctgaaggctgag

SEQ ID NO: 106330 - DNA, 22 bp, Homo sapiens
cttgcacgtcagatcttcctca

SEQ ID NO: 106331 - DNA, 22 bp, Homo sapiens
ccacgcatccctccacagagag

SEQ ID NO: 106332 - DNA, 22 bp, Homo sapiens
cagctgcccctccagggctggg

SEQ ID NO: 106333 - DNA, 22 bp, Homo sapiens
gtgaggtggtacaatattaact

SEQ ID NO: 106334 - DNA, 23 bp, Homo sapiens
tgagctgggcctgcaggggtctc

SEQ ID NO: 106335 - DNA, 22 bp, Homo sapiens
ccaggctggagtgcaatggcgt

SEQ ID NO: 106336 - DNA, 22 bp, Homo sapiens
cttccctctgctccttggtcca

SEQ ID NO: 106337 - DNA, 22 bp, Homo sapiens
ctggaaggcagaggttgcagtg

SEQ ID NO: 106338 - DNA, 22 bp, Homo sapiens
agcaccgttcaaacccaggtta

SEQ ID NO: 106339 - DNA, 22 bp, Homo sapiens
tgaggaaacttacaaggcagaa

SEQ ID NO: 106340 - DNA, 22 bp, Homo sapiens
agtgcaatggctgcctgcatgg

SEQ ID NO: 106341 - DNA, 22 bp, Homo sapiens
agaggtgagtcattacctagtg

SEQ ID NO: 106342 - DNA, 22 bp, Homo sapiens
cccaggggttcaaggctgcagt

SEQ ID NO: 106343 - DNA, 22 bp, Homo sapiens
tttgtttgccacacaaaacagt

SEQ ID NO: 106344 - DNA, 22 bp, Homo sapiens
gagatcggtaaagagcatgcac

SEQ ID NO: 106345 - DNA, 22 bp, Homo sapiens
tttctcctcatgactggttgtg

SEQ ID NO: 106346 - DNA, 22 bp, Homo sapiens
cctcagctcccatgagatctgc

SEQ ID NO: 106347 - DNA, 18 bp, Homo sapiens
gaaagatgaacttttttc

SEQ ID NO: 106348 - DNA, 22 bp, Homo sapiens
atgtggcaccgatctttagcca

SEQ ID NO: 106349 - DNA, 22 bp, Homo sapiens
tcagaacatgtttgagtaagac

SEQ ID NO: 106350 - DNA, 22 bp, Homo sapiens
cagccccatggtgtgctccagc

SEQ ID NO: 106351 - DNA, 22 bp, Homo sapiens
cactgcacttcagcctgggcga

SEQ ID NO: 106352 - DNA, 22 bp, Homo sapiens
gctgcagggagctggaaggctc

SEQ ID NO: 106353 - DNA, 22 bp, Homo sapiens
gtccagttgtatgtccagtgtc

SEQ ID NO: 106354 - DNA, 22 bp, Homo sapiens
ggctgtggcagctggaagtggt

SEQ ID NO: 106355 - DNA, 22 bp, Homo sapiens
atgccactgcactccagcctag

SEQ ID NO: 106356 - DNA, 22 bp, Homo sapiens
agtgttagattcttactcagtt

SEQ ID NO: 106357 - DNA, 22 bp, Homo sapiens
gtgcacatcgtgcaggtttgtt

SEQ ID NO: 106358 - DNA, 22 bp, Homo sapiens
agaggctgcacttgctcatgat

SEQ ID NO: 106359 - DNA, 22 bp, Homo sapiens
tgatttatgcattatactgttg

SEQ ID NO: 106360 - DNA, 22 bp, Homo sapiens
aaggctgaggcagtgaggcaga

SEQ ID NO: 106361 - DNA, 22 bp, Homo sapiens
agaaactctggaagaactttta

SEQ ID NO: 106362 - DNA, 23 bp, Homo sapiens
gctcatcaggcttagagtcaagg

SEQ ID NO: 106363 - DNA, 22 bp, Homo sapiens
ccaggggttggaggttgcagtg

SEQ ID NO: 106364 - DNA, 22 bp, Homo sapiens
gcctccagggatgattccttcc

SEQ ID NO: 106365 - DNA, 22 bp, Homo sapiens
tgccaggcgtggtggtgcgcac

SEQ ID NO: 106366 - DNA, 22 bp, Homo sapiens
gagccaggaggcagagactgca

SEQ ID NO: 106367 - DNA, 22 bp, Homo sapiens
ttttaatactgctattgtagga

SEQ ID NO: 106368 - DNA, 22 bp, Homo sapiens
agagggaagatggtccaatctt

SEQ ID NO: 106369 - DNA, 22 bp, Homo sapiens
tctgcgcgctgctggtaccgaa

SEQ ID NO: 106370 - DNA, 21 bp, Homo sapiens
ctcccagggtgactgttcaac

SEQ ID NO: 106371 - DNA, 22 bp, Homo sapiens
atctaagagaaaggaagttcag

SEQ ID NO: 106372 - DNA, 22 bp, Homo sapiens
cttctcaaagttgtgaatcagg

SEQ ID NO: 106373 - DNA, 22 bp, Homo sapiens
aggcgcctgcgggatccttgcc

SEQ ID NO: 106374 - DNA, 22 bp, Homo sapiens
gtgaccatcatctcagctagtt

SEQ ID NO: 106375 - DNA, 22 bp, Homo sapiens
agagtactgcctcagttatgaa

SEQ ID NO: 106376 - DNA, 19 bp, Homo sapiens
gggtcccaaaagatgtgct

SEQ ID NO: 106377 - DNA, 22 bp, Homo sapiens
tgatttacagtagtgtctaaac

SEQ ID NO: 106378 - DNA, 22 bp, Homo sapiens
ctgggcgtggcagcggagctgg

SEQ ID NO: 106379 - DNA, 22 bp, Homo sapiens
aagctctttccactaaaccact

SEQ ID NO: 106380 - DNA, 22 bp, Homo sapiens
gctctgccagcccaaggcgcag

SEQ ID NO: 106381 - DNA, 22 bp, Homo sapiens
gtgagccgagtatagttcatag

SEQ ID NO: 106382 - DNA, 22 bp, Homo sapiens
tcacagtgttaaacctttcttt

SEQ ID NO: 106383 - DNA, 22 bp, Homo sapiens
gtatgtgaggttggtttccagg

SEQ ID NO: 106384 - DNA, 22 bp, Homo sapiens
agtgctatcgagttctaatgct

SEQ ID NO: 106385 - DNA, 22 bp, Homo sapiens
cccaggaggtcaaggctgcagt

SEQ ID NO: 106386 - DNA, 22 bp, Homo sapiens
tccctcaatgtgggtcaagacc

SEQ ID NO: 106387 - DNA, 22 bp, Homo sapiens
cctcttctaggacgtccttgtg

SEQ ID NO: 106388 - DNA, 22 bp, Homo sapiens
ttgcccagagtcacccagctca

SEQ ID NO: 106389 - DNA, 22 bp, Homo sapiens
agcccaggctggagtgcagtgg

SEQ ID NO: 106390 - DNA, 22 bp, Homo sapiens
cttgaaagtcagcagagtggat

SEQ ID NO: 106391 - DNA, 22 bp, Homo sapiens
agcccaggttgaggctgcagtg

SEQ ID NO: 106392 - DNA, 20 bp, Homo sapiens
aggccccaggtggacactag

SEQ ID NO: 106393 - DNA, 22 bp, Homo sapiens
aagcccttggcgcacaccgggc

SEQ ID NO: 106394 - DNA, 22 bp, Homo sapiens
ctgtcaggtttcccggctcacg

SEQ ID NO: 106395 - DNA, 22 bp, Homo sapiens
gaatgcaaactggggcaccgtt

SEQ ID NO: 106396 - DNA, 22 bp, Homo sapiens
agccaagcactcaactcctgga

SEQ ID NO: 106397 - DNA, 22 bp, Homo sapiens
tcagggattgcaaaattcatcc

SEQ ID NO: 106398 - DNA, 22 bp, Homo sapiens
taggtataggattctaggttgg

SEQ ID NO: 106399 - DNA, 22 bp, Homo sapiens
ctgggcagctgtatcagggagt

SEQ ID NO: 106400 - DNA, 22 bp, Homo sapiens
agcccggcttccccggttgcta

SEQ ID NO: 106401 - DNA, 22 bp, Homo sapiens
tagcgaggtgtttctaggactg

SEQ ID NO: 106402 - DNA, 22 bp, Homo sapiens
atgcagaagactgaaaagctga

SEQ ID NO: 106403 - DNA, 22 bp, Homo sapiens
gagaaatatggctcagttccac

SEQ ID NO: 106404 - DNA, 22 bp, Homo sapiens
gtggggcctgtggcttccgtgg

SEQ ID NO: 106405 - DNA, 22 bp, Homo sapiens
cccctcgcctgcagagcacagc

SEQ ID NO: 106406 - DNA, 22 bp, Homo sapiens
aggcaggaggatcatggatgca

SEQ ID NO: 106407 - DNA, 22 bp, Homo sapiens
atccatttgacataatttcagc

SEQ ID NO: 106408 - DNA, 22 bp, Homo sapiens
tggagtgcaatagtaataaggt

SEQ ID NO: 106409 - DNA, 22 bp, Homo sapiens
ttgtgaatagtgctgcaataaa

SEQ ID NO: 106410 - DNA, 22 bp, Homo sapiens
ttacatgtggtgtgaagaagag

SEQ ID NO: 106411 - DNA, 22 bp, Homo sapiens
gcagccagagggggtgtgatca

SEQ ID NO: 106412 - DNA, 22 bp, Homo sapiens
acgtggcggccgccgtgagcgg

SEQ ID NO: 106413 - DNA, 22 bp, Homo sapiens
agttattactctttaacatatt

SEQ ID NO: 106414 - DNA, 20 bp, Homo sapiens
gggcaaggaaacagccccca

SEQ ID NO: 106415 - DNA, 22 bp, Homo sapiens
cttttcattgtttgtacatgca

SEQ ID NO: 106416 - DNA, 22 bp, Homo sapiens
atggtttattagctgcacaggc

SEQ ID NO: 106417 - DNA, 22 bp, Homo sapiens
gactggaaagcctgtcctcaga

SEQ ID NO: 106418 - DNA, 22 bp, Homo sapiens
actgcaacctccacctcctggg

SEQ ID NO: 106419 - DNA, 20 bp, Homo sapiens
gtgcaatggcaccatctcag

SEQ ID NO: 106420 - DNA, 22 bp, Homo sapiens
gcccagctgcaccctggtgggt

SEQ ID NO: 106421 - DNA, 22 bp, Homo sapiens
gaggccactgtccctgccttcc

SEQ ID NO: 106422 - DNA, 21 bp, Homo sapiens
ccaggccaggcctacggggat

SEQ ID NO: 106423 - DNA, 22 bp, Homo sapiens
aaatgcaacgggctttccttat

SEQ ID NO: 106424 - DNA, 22 bp, Homo sapiens
gctggccacagatccccaggga

SEQ ID NO: 106425 - DNA, 22 bp, Homo sapiens
actgtgaacggactgaagccca

SEQ ID NO: 106426 - DNA, 22 bp, Homo sapiens
tcacccaggctggactgcagtg

SEQ ID NO: 106427 - DNA, 22 bp, Homo sapiens
atgttgtgtttgactgttaccc

SEQ ID NO: 106428 - DNA, 22 bp, Homo sapiens
tgctgctccccagcacacagca

SEQ ID NO: 106429 - DNA, 22 bp, Homo sapiens
gtgcttccatctagagggtcac

SEQ ID NO: 106430 - DNA, 22 bp, Homo sapiens
cgcaccactgaattccagcctg

SEQ ID NO: 106431 - DNA, 22 bp, Homo sapiens
aggagggagcttaagccaggca

SEQ ID NO: 106432 - DNA, 22 bp, Homo sapiens
cccccagctctgctgggtcccg

SEQ ID NO: 106433 - DNA, 22 bp, Homo sapiens
ttgcccaggctggagtgcagtg

SEQ ID NO: 106434 - DNA, 22 bp, Homo sapiens
gtccaaaagagccagccgggcg

SEQ ID NO: 106435 - DNA, 22 bp, Homo sapiens
tcttgggcaatttctctagagg

SEQ ID NO: 106436 - DNA, 22 bp, Homo sapiens
tggtatgaccgtggtgcaagca

SEQ ID NO: 106437 - DNA, 22 bp, Homo sapiens
tccctagtcgcatctgtggaga

SEQ ID NO: 106438 - DNA, 21 bp, Homo sapiens
tggtaggtactggcttcaggc

SEQ ID NO: 106439 - DNA, 22 bp, Homo sapiens
gagacctcttggtatcgctagg

SEQ ID NO: 106440 - DNA, 22 bp, Homo sapiens
gttccaggtggtcacagagctc

SEQ ID NO: 106441 - DNA, 22 bp, Homo sapiens
ttcctgggattattgtcaagca

SEQ ID NO: 106442 - DNA, 22 bp, Homo sapiens
agcttagtggttgtatgagtta

SEQ ID NO: 106443 - DNA, 22 bp, Homo sapiens
tggcacaggatctcagcggcca

SEQ ID NO: 106444 - DNA, 20 bp, Homo sapiens
ttgttagaggaatgccatag

SEQ ID NO: 106445 - DNA, 22 bp, Homo sapiens
ctcagcagtatactctgaagat

SEQ ID NO: 106446 - DNA, 22 bp, Homo sapiens
ggcccaggctggagtgcagtgg

SEQ ID NO: 106447 - DNA, 22 bp, Homo sapiens
gctcaagccttctgcccacctc

SEQ ID NO: 106448 - DNA, 22 bp, Homo sapiens
tgaggcaggagaatcaccggaa

SEQ ID NO: 106449 - DNA, 22 bp, Homo sapiens
cctgccagagcagcttgtcctc

SEQ ID NO: 106450 - DNA, 22 bp, Homo sapiens
ggatgtttgctagcattcctgg

SEQ ID NO: 106451 - DNA, 22 bp, Homo sapiens
atctagattaggtataagagct

SEQ ID NO: 106452 - DNA, 22 bp, Homo sapiens
tgaacatgctgttgatggcctg

SEQ ID NO: 106453 - DNA, 22 bp, Homo sapiens
ggagacagggttgaaccacgca

SEQ ID NO: 106454 - DNA, 22 bp, Homo sapiens
ctcagcactgacccaggagatg

SEQ ID NO: 106455 - DNA, 22 bp, Homo sapiens
tgtgaagaattaatgtgaatca

SEQ ID NO: 106456 - DNA, 22 bp, Homo sapiens
aaacttttttaggttcataggc

SEQ ID NO: 106457 - DNA, 22 bp, Homo sapiens
cccaggaggtggaggctgcagt

SEQ ID NO: 106458 - DNA, 22 bp, Homo sapiens
agttgcagacgcagagatgttg

SEQ ID NO: 106459 - DNA, 22 bp, Homo sapiens
aaatatcttaggagtatatgag

SEQ ID NO: 106460 - DNA, 21 bp, Homo sapiens
tttcttaggctctaaaatgac

SEQ ID NO: 106461 - DNA, 22 bp, Homo sapiens
agcttgggcaacacagcaagac

SEQ ID NO: 106462 - DNA, 20 bp, Homo sapiens
tttgagaccagtctgcccaa

SEQ ID NO: 106463 - DNA, 22 bp, Homo sapiens
agcgaggtgagtcctccagctc

SEQ ID NO: 106464 - DNA, 22 bp, Homo sapiens
tcccagctactctagaggctga

SEQ ID NO: 106465 - DNA, 22 bp, Homo sapiens
agtcttcctgcccagcaggagg

SEQ ID NO: 106466 - DNA, 22 bp, Homo sapiens
gcagggttttatagatctcttc

SEQ ID NO: 106467 - DNA, 22 bp, Homo sapiens
tgtccagatcaatgcccacatg

SEQ ID NO: 106468 - DNA, 22 bp, Homo sapiens
actgcaacacctcctgggttca

SEQ ID NO: 106469 - DNA, 22 bp, Homo sapiens
tttaaaaaactagtctgagtct

SEQ ID NO: 106470 - DNA, 22 bp, Homo sapiens
tgccgtggggctgaggctggag

SEQ ID NO: 106471 - DNA, 22 bp, Homo sapiens
ggcagggcaggaaagtcaggaa

SEQ ID NO: 106472 - DNA, 23 bp, Homo sapiens
cagagctggcttcatgggtgtgc

SEQ ID NO: 106473 - DNA, 22 bp, Homo sapiens
caggagtgttgattgctcagga

SEQ ID NO: 106474 - DNA, 22 bp, Homo sapiens
ttccgctgtttagttgaagttt

SEQ ID NO: 106475 - DNA, 16 bp, Homo sapiens
gcaggcagatcacatg

SEQ ID NO: 106476 - DNA, 22 bp, Homo sapiens
tgttcttgagcctttagaccta

SEQ ID NO: 106477 - DNA, 22 bp, Homo sapiens
ccttacctgattgctggcatcc

SEQ ID NO: 106478 - DNA, 22 bp, Homo sapiens
gtggggtctgtcctcttctggg

SEQ ID NO: 106479 - DNA, 22 bp, Homo sapiens
gtcctgacggctgattggcctg

SEQ ID NO: 106480 - DNA, 22 bp, Homo sapiens
cagcaggaggtgagtagcaggt

SEQ ID NO: 106481 - DNA, 22 bp, Homo sapiens
tgggcaaggctggagcctgcag

SEQ ID NO: 106482 - DNA, 22 bp, Homo sapiens
gggagaggttacccgagcaact

SEQ ID NO: 106483 - DNA, 22 bp, Homo sapiens
cactgcactccagcctgggaga

SEQ ID NO: 106484 - DNA, 22 bp, Homo sapiens
aattgcaaattcagacttaaga

SEQ ID NO: 106485 - DNA, 19 bp, Homo sapiens
tggctattccttggacaca

SEQ ID NO: 106486 - DNA, 22 bp, Homo sapiens
cattgcacaccagcctgggcaa

SEQ ID NO: 106487 - DNA, 22 bp, Homo sapiens
tcaaatgaagacagttgacttg

SEQ ID NO: 106488 - DNA, 22 bp, Homo sapiens
tgaggcaggtggattacaaggt

SEQ ID NO: 106489 - DNA, 22 bp, Homo sapiens
ctggcagatagtaagtgatcaa

SEQ ID NO: 106490 - DNA, 23 bp, Homo sapiens
aaactacaacgccaggcactgag

SEQ ID NO: 106491 - DNA, 22 bp, Homo sapiens
attacctatttcattttctgtc

SEQ ID NO: 106492 - DNA, 22 bp, Homo sapiens
cactgcactccagcctgggtga

SEQ ID NO: 106493 - DNA, 22 bp, Homo sapiens
cttctggcgttggaggtctgag

SEQ ID NO: 106494 - DNA, 22 bp, Homo sapiens
tctgttgactcctagcagccat

SEQ ID NO: 106495 - DNA, 22 bp, Homo sapiens
cagcagcccacgcgtgctgtcc

SEQ ID NO: 106496 - DNA, 22 bp, Homo sapiens
agctgccccgaggcggcgggaa

SEQ ID NO: 106497 - DNA, 22 bp, Homo sapiens
ctggaaggcggaggttgtagtg

SEQ ID NO: 106498 - DNA, 22 bp, Homo sapiens
ccttggcaggcacgtcctgcgg

SEQ ID NO: 106499 - DNA, 22 bp, Homo sapiens
gtagatgagctcacatgacctt

SEQ ID NO: 106500 - DNA, 22 bp, Homo sapiens
atggctgcctgggcgctggccg

SEQ ID NO: 106501 - DNA, 22 bp, Homo sapiens
aattagttcacgtcctgtgctt

SEQ ID NO: 106502 - DNA, 22 bp, Homo sapiens
gggtaaatctcttttcatggct

SEQ ID NO: 106503 - DNA, 22 bp, Homo sapiens
ccaggttggagttcagtggcgc

SEQ ID NO: 106504 - DNA, 22 bp, Homo sapiens
tctgtgctaggcagcctggccc

SEQ ID NO: 106505 - DNA, 22 bp, Homo sapiens
tcactgcaacctccacctcctg

SEQ ID NO: 106506 - DNA, 22 bp, Homo sapiens
aaagtgctgggattccaggcgt

SEQ ID NO: 106507 - DNA, 22 bp, Homo sapiens
ctgtatttcttggacagttgct

SEQ ID NO: 106508 - DNA, 18 bp, Homo sapiens
aggtttggtggaaacata

SEQ ID NO: 106509 - DNA, 22 bp, Homo sapiens
agtgcaggccccaggccaggcc

SEQ ID NO: 106510 - DNA, 22 bp, Homo sapiens
ccagcagagcatggggaggaag

SEQ ID NO: 106511 - DNA, 22 bp, Homo sapiens
aggcaggaaaatcgcttgaacc

SEQ ID NO: 106512 - DNA, 21 bp, Homo sapiens
aggcttggatctagacaggcc

SEQ ID NO: 106513 - DNA, 22 bp, Homo sapiens
acccaggccattggcaagagtc

SEQ ID NO: 106514 - DNA, 22 bp, Homo sapiens
tttcataatactgtacatgaaa

SEQ ID NO: 106515 - DNA, 19 bp, Homo sapiens
ttttggaaatgtgaacagc

SEQ ID NO: 106516 - DNA, 22 bp, Homo sapiens
ggctgggcaggtctgcacaggg

SEQ ID NO: 106517 - DNA, 22 bp, Homo sapiens
taatgcacatagaagtacttag

SEQ ID NO: 106518 - DNA, 19 bp, Homo sapiens
agggaatccggctgaggga

SEQ ID NO: 106519 - DNA, 22 bp, Homo sapiens
gcagaagcacaggtgacgggcc

SEQ ID NO: 106520 - DNA, 22 bp, Homo sapiens
tcaaattgtcatcttgataatg

SEQ ID NO: 106521 - DNA, 22 bp, Homo sapiens
atgccacttcattccagcctcg

SEQ ID NO: 106522 - DNA, 22 bp, Homo sapiens
aggatttctgtgcctggaaaat

SEQ ID NO: 106523 - DNA, 22 bp, Homo sapiens
gaagatgttatggagagctcag

SEQ ID NO: 106524 - DNA, 22 bp, Homo sapiens
atggcagaatatctgcatcgca

SEQ ID NO: 106525 - DNA, 22 bp, Homo sapiens
cggggccctggggctgaaggtc

SEQ ID NO: 106526 - DNA, 22 bp, Homo sapiens
ggggaaggaaagttattagcag

SEQ ID NO: 106527 - DNA, 22 bp, Homo sapiens
catgtgaattccaaagctaggt

SEQ ID NO: 106528 - DNA, 22 bp, Homo sapiens
gcacttgtggatttgatataca

SEQ ID NO: 106529 - DNA, 22 bp, Homo sapiens
tgaggcaggacttgcataaagt

SEQ ID NO: 106530 - DNA, 22 bp, Homo sapiens
ccaattttattcttctgcaagt

SEQ ID NO: 106531 - DNA, 22 bp, Homo sapiens
ccaagggcgcctccgttccccc

SEQ ID NO: 106532 - DNA, 22 bp, Homo sapiens
aatactgcctgtgaggtaactc

SEQ ID NO: 106533 - DNA, 22 bp, Homo sapiens
attgcactccagcctgggtgac

SEQ ID NO: 106534 - DNA, 22 bp, Homo sapiens
gcaagtgaatgaggttgagatt

SEQ ID NO: 106535 - DNA, 22 bp, Homo sapiens
gttctgagtcctcctttgaagg

SEQ ID NO: 106536 - DNA, 22 bp, Homo sapiens
gtcactgtatccaggttccagc

SEQ ID NO: 106537 - DNA, 22 bp, Homo sapiens
tgcactactgtgatacacagcc

SEQ ID NO: 106538 - DNA, 22 bp, Homo sapiens
aaagaaggtagggctggtgact

SEQ ID NO: 106539 - DNA, 22 bp, Homo sapiens
aagggcctgccagctcttcatg

SEQ ID NO: 106540 - DNA, 22 bp, Homo sapiens
actcatgtaagcggaatgtagt

SEQ ID NO: 106541 - DNA, 22 bp, Homo sapiens
tcaagcaaagtttagctggtta

SEQ ID NO: 106542 - DNA, 18 bp, Homo sapiens
tgtccctgcaaataacat

SEQ ID NO: 106543 - DNA, 22 bp, Homo sapiens
actccacaccacgggggccgcc

SEQ ID NO: 106544 - DNA, 22 bp, Homo sapiens
atgattgaaaatgacattgcca

SEQ ID NO: 106545 - DNA, 22 bp, Homo sapiens
cactgcccaccaagtggctggt

SEQ ID NO: 106546 - DNA, 22 bp, Homo sapiens
ctggagggctgcagcgaggctg

SEQ ID NO: 106547 - DNA, 22 bp, Homo sapiens
atgaggcaggagtgcagtggca

SEQ ID NO: 106548 - DNA, 19 bp, Homo sapiens
ctgggatgtctcctcccag

SEQ ID NO: 106549 - DNA, 22 bp, Homo sapiens
agaaaatgtgaacttgtgaatt

SEQ ID NO: 106550 - DNA, 18 bp, Homo sapiens
tctggaacaacttcatgt

SEQ ID NO: 106551 - DNA, 22 bp, Homo sapiens
gggcactcagctgtagagcagg

SEQ ID NO: 106552 - DNA, 22 bp, Homo sapiens
cagcctggtccccggctcaccc

SEQ ID NO: 106553 - DNA, 23 bp, Homo sapiens
ggaagctcacgtagtcctgcact

SEQ ID NO: 106554 - DNA, 22 bp, Homo sapiens
acaaacagagttgaaaaatagg

SEQ ID NO: 106555 - DNA, 22 bp, Homo sapiens
ccaggaggcggaaggtacagtg

SEQ ID NO: 106556 - DNA, 22 bp, Homo sapiens
gtgggtgtgggcttagcccaga

SEQ ID NO: 106557 - DNA, 22 bp, Homo sapiens
ccttacactgcctggggccacg

SEQ ID NO: 106558 - DNA, 22 bp, Homo sapiens
caggcaggtcagtgaagaagga

SEQ ID NO: 106559 - DNA, 23 bp, Homo sapiens
tcgttgaatagcaatagcacaac

SEQ ID NO: 106560 - DNA, 22 bp, Homo sapiens
agtggtcttagcttgctgggct

SEQ ID NO: 106561 - DNA, 22 bp, Homo sapiens
aggtcaccatggcatgctccac

SEQ ID NO: 106562 - DNA, 22 bp, Homo sapiens
tctcagctcatggcagccttga

SEQ ID NO: 106563 - DNA, 22 bp, Homo sapiens
accttcaggtgagcacacagat

SEQ ID NO: 106564 - DNA, 22 bp, Homo sapiens
ccaggagttggaggctgcagtg

SEQ ID NO: 106565 - DNA, 22 bp, Homo sapiens
caaagcaggaagctcctgacag

SEQ ID NO: 106566 - DNA, 22 bp, Homo sapiens
gaggtggatgttgcagtgagct

SEQ ID NO: 106567 - DNA, 21 bp, Homo sapiens
ggagtttttctggaagggact

SEQ ID NO: 106568 - DNA, 20 bp, Homo sapiens
gtgcaatggctcagtctcag

SEQ ID NO: 106569 - DNA, 18 bp, Homo sapiens
cttgttcttctcttggcg

SEQ ID NO: 106570 - DNA, 19 bp, Homo sapiens
gatttaaacgtggctctat

SEQ ID NO: 106571 - DNA, 22 bp, Homo sapiens
ataggtccaaggagaggtcttt

SEQ ID NO: 106572 - DNA, 22 bp, Homo sapiens
ggctagggatctagaccaggac

SEQ ID NO: 106573 - DNA, 22 bp, Homo sapiens
aaagtgcaaggattacaggcat

SEQ ID NO: 106574 - DNA, 22 bp, Homo sapiens
aggctccctgaatcgcccgttc

SEQ ID NO: 106575 - DNA, 22 bp, Homo sapiens
atgccactgcacttcagcttgg

SEQ ID NO: 106576 - DNA, 20 bp, Homo sapiens
tctcgcactcggagcagccg

SEQ ID NO: 106577 - DNA, 22 bp, Homo sapiens
cagtggcaggatttcagctcag

SEQ ID NO: 106578 - DNA, 22 bp, Homo sapiens
aactatgttaataagtttcatt

SEQ ID NO: 106579 - DNA, 20 bp, Homo sapiens
ataaaataactgccacaaga

SEQ ID NO: 106580 - DNA, 22 bp, Homo sapiens
tcagccagccagctacaggctt

SEQ ID NO: 106581 - DNA, 22 bp, Homo sapiens
tgaggcaggagaatcacatgaa

SEQ ID NO: 106582 - DNA, 22 bp, Homo sapiens
attttttgttaactcaggatag

SEQ ID NO: 106583 - DNA, 22 bp, Homo sapiens
gggcagagactcagaaacagaa

SEQ ID NO: 106584 - DNA, 22 bp, Homo sapiens
ggctgcaggttggttggcagct

SEQ ID NO: 106585 - DNA, 21 bp, Homo sapiens
ggtgacacgtggccccgctct

SEQ ID NO: 106586 - DNA, 22 bp, Homo sapiens
cacagacagtgtccctttgttg

SEQ ID NO: 106587 - DNA, 22 bp, Homo sapiens
gaatcccttgcattatcccttt

SEQ ID NO: 106588 - DNA, 22 bp, Homo sapiens
agaatccctgcttgtcttcaaa

SEQ ID NO: 106589 - DNA, 22 bp, Homo sapiens
ctgagcagatgaccagccccag

SEQ ID NO: 106590 - DNA, 22 bp, Homo sapiens
tggctacctgatttcttttcag

SEQ ID NO: 106591 - DNA, 18 bp, Homo sapiens
ggaaggtgattcagtttt

SEQ ID NO: 106592 - DNA, 22 bp, Homo sapiens
cccagcaggaggaggttgcagt

SEQ ID NO: 106593 - DNA, 22 bp, Homo sapiens
acacccaggctggcgtgcagtg

SEQ ID NO: 106594 - DNA, 22 bp, Homo sapiens
caggcactgtgctgagctctgc

SEQ ID NO: 106595 - DNA, 22 bp, Homo sapiens
agtgcaatggcgtgatcttggc

SEQ ID NO: 106596 - DNA, 22 bp, Homo sapiens
agtgtggagcatcgagggcaga

SEQ ID NO: 106597 - DNA, 22 bp, Homo sapiens
actttcttggtcccatgtttga

SEQ ID NO: 106598 - DNA, 22 bp, Homo sapiens
ggctttagtgtaggtttctgtt

SEQ ID NO: 106599 - DNA, 22 bp, Homo sapiens
tatctcctgtcagggtggtggt

SEQ ID NO: 106600 - DNA, 22 bp, Homo sapiens
agcccaggagtttgaggctgtg

SEQ ID NO: 106601 - DNA, 22 bp, Homo sapiens
gcaggcaggcttccttgaactg

SEQ ID NO: 106602 - DNA, 22 bp, Homo sapiens
ttccccttgggctgtggaggag

SEQ ID NO: 106603 - DNA, 22 bp, Homo sapiens
ggctcttccgccaccagccaca

SEQ ID NO: 106604 - DNA, 22 bp, Homo sapiens
cctgggctctgtcagaattggg

SEQ ID NO: 106605 - DNA, 22 bp, Homo sapiens
ttctagtgtccttggacttgct

SEQ ID NO: 106606 - DNA, 23 bp, Homo sapiens
aggttatgattatagagcgagga

SEQ ID NO: 106607 - DNA, 22 bp, Homo sapiens
acttttaaatgagtttcagttg

SEQ ID NO: 106608 - DNA, 22 bp, Homo sapiens
gctcccaggatgaggagccagg

SEQ ID NO: 106609 - DNA, 22 bp, Homo sapiens
tacaaaaaattgatactgacga

SEQ ID NO: 106610 - DNA, 22 bp, Homo sapiens
gtcacctcgctgtcttcctgag

SEQ ID NO: 106611 - DNA, 22 bp, Homo sapiens
tgcactccaggctgggtgacag

SEQ ID NO: 106612 - DNA, 22 bp, Homo sapiens
ggaggtggaggttgcagtgagc

SEQ ID NO: 106613 - DNA, 22 bp, Homo sapiens
aagaagagaactggcatcctaa

SEQ ID NO: 106614 - DNA, 19 bp, Homo sapiens
atcccaaggagctgggact

SEQ ID NO: 106615 - DNA, 22 bp, Homo sapiens
aatgcaatgcagcacctccttg

SEQ ID NO: 106616 - DNA, 22 bp, Homo sapiens
ttccagagagttattcccctgg

SEQ ID NO: 106617 - DNA, 22 bp, Homo sapiens
agagctccagggttttgtagtg

SEQ ID NO: 106618 - DNA, 22 bp, Homo sapiens
gtggggacgggatggctcactg

SEQ ID NO: 106619 - DNA, 22 bp, Homo sapiens
attgcacatctgcactacagcc

SEQ ID NO: 106620 - DNA, 18 bp, Homo sapiens
cagggctgtggggtcact

SEQ ID NO: 106621 - DNA, 22 bp, Homo sapiens
caaagtgctaggattacaggcg

SEQ ID NO: 106622 - DNA, 22 bp, Homo sapiens
tgcagcttcactcctgaagcca

SEQ ID NO: 106623 - DNA, 22 bp, Homo sapiens
cccaggggttctgagcagcagc

SEQ ID NO: 106624 - DNA, 22 bp, Homo sapiens
gcagctattgtctcctgggccc

SEQ ID NO: 106625 - DNA, 22 bp, Homo sapiens
tataaactcctcttgcattcct

SEQ ID NO: 106626 - DNA, 22 bp, Homo sapiens
tctgaggctgaatggactccgt

SEQ ID NO: 106627 - DNA, 22 bp, Homo sapiens
actgagggtcaaccatttgctc

SEQ ID NO: 106628 - DNA, 22 bp, Homo sapiens
gcaggagaacaaagcaagctgc

SEQ ID NO: 106629 - DNA, 22 bp, Homo sapiens
ttctctgcctcacaggtctaag

SEQ ID NO: 106630 - DNA, 22 bp, Homo sapiens
tcctcctgtctaccagttcctg

SEQ ID NO: 106631 - DNA, 22 bp, Homo sapiens
tccagggccatctccatgaggc

SEQ ID NO: 106632 - DNA, 22 bp, Homo sapiens
ggcaggaggtgagtggcgggtg

SEQ ID NO: 106633 - DNA, 22 bp, Homo sapiens
gtctgtctgccaggttaggctg

SEQ ID NO: 106634 - DNA, 22 bp, Homo sapiens
ctgggcgcgtcccctgaggcgg

SEQ ID NO: 106635 - DNA, 19 bp, Homo sapiens
catctggatgattctcctg

SEQ ID NO: 106636 - DNA, 22 bp, Homo sapiens
ccaggaggcagaagttgcagtg

SEQ ID NO: 106637 - DNA, 21 bp, Homo sapiens
tctcttcctccgcgccgccgc

SEQ ID NO: 106638 - DNA, 22 bp, Homo sapiens
gggagaagaatgtgtcaattgt

SEQ ID NO: 106639 - DNA, 21 bp, Homo sapiens
ctagcccctactccaagttga

SEQ ID NO: 106640 - DNA, 22 bp, Homo sapiens
tggaatgcagtgggagcttacc

SEQ ID NO: 106641 - DNA, 22 bp, Homo sapiens
gagcactgagctggaattggag

SEQ ID NO: 106642 - DNA, 22 bp, Homo sapiens
ggccctggtcctaggggtggaa

SEQ ID NO: 106643 - DNA, 22 bp, Homo sapiens
tccacaggtccggcatgaacag

SEQ ID NO: 106644 - DNA, 22 bp, Homo sapiens
tcactgcactccagcctggtga

SEQ ID NO: 106645 - DNA, 22 bp, Homo sapiens
ctgctcctgtccagcagggcca

SEQ ID NO: 106646 - DNA, 22 bp, Homo sapiens
gatgctgagaggtggagggaac

SEQ ID NO: 106647 - DNA, 22 bp, Homo sapiens
aggtggaaatggctttcctagg

SEQ ID NO: 106648 - DNA, 21 bp, Homo sapiens
gctgctcgagatccagtgctt

SEQ ID NO: 106649 - DNA, 22 bp, Homo sapiens
cccagcgagtttgccggtgaac

SEQ ID NO: 106650 - DNA, 22 bp, Homo sapiens
aagcccggttgggaacgtggtg

SEQ ID NO: 106651 - DNA, 22 bp, Homo sapiens
gctctgagtcacactgccctgt

SEQ ID NO: 106652 - DNA, 22 bp, Homo sapiens
caggagtccatctggcctggtg

SEQ ID NO: 106653 - DNA, 22 bp, Homo sapiens
aggaatgacaggcctcccgcag

SEQ ID NO: 106654 - DNA, 22 bp, Homo sapiens
agtgaagctggagaaaggcagt

SEQ ID NO: 106655 - DNA, 22 bp, Homo sapiens
ttacaaagtttaaggtggcact

SEQ ID NO: 106656 - DNA, 22 bp, Homo sapiens
ttgtggttaaccgcacattttt

SEQ ID NO: 106657 - DNA, 22 bp, Homo sapiens
tggaatggaaacaaactgagga

SEQ ID NO: 106658 - DNA, 21 bp, Homo sapiens
tctgatggtagatgagatgtg

SEQ ID NO: 106659 - DNA, 22 bp, Homo sapiens
gtagtcccagctaccccggagg

SEQ ID NO: 106660 - DNA, 22 bp, Homo sapiens
ctgtccctgagcaactcctgtt

SEQ ID NO: 106661 - DNA, 22 bp, Homo sapiens
cttctttcaagaatggattagg

SEQ ID NO: 106662 - DNA, 22 bp, Homo sapiens
caggagttttaaatctagcatg

SEQ ID NO: 106663 - DNA, 22 bp, Homo sapiens
tgttgattagtgtttagactta

SEQ ID NO: 106664 - DNA, 22 bp, Homo sapiens
ccagagtcccttgcagctcagt

SEQ ID NO: 106665 - DNA, 22 bp, Homo sapiens
gagatggagtctttttctgtca

SEQ ID NO: 106666 - DNA, 22 bp, Homo sapiens
ggcagggagtggagactcccta

SEQ ID NO: 106667 - DNA, 22 bp, Homo sapiens
ccgtggtcacctgagctccttg

SEQ ID NO: 106668 - DNA, 22 bp, Homo sapiens
caggctggagtgcagtggcgcc

SEQ ID NO: 106669 - DNA, 22 bp, Homo sapiens
ccagagctgattcctgggactt

SEQ ID NO: 106670 - DNA, 22 bp, Homo sapiens
gcttacaggtgaggcagcaaga

SEQ ID NO: 106671 - DNA, 22 bp, Homo sapiens
gcttccacctactaaatgccac

SEQ ID NO: 106672 - DNA, 22 bp, Homo sapiens
caggaagaccagggctgtggct

SEQ ID NO: 106673 - DNA, 22 bp, Homo sapiens
cacagctgtgagaagggagcct

SEQ ID NO: 106674 - DNA, 21 bp, Homo sapiens
ctacttaagtaggggattagg

SEQ ID NO: 106675 - DNA, 23 bp, Homo sapiens
gggggccgtcctggggattatag

SEQ ID NO: 106676 - DNA, 22 bp, Homo sapiens
cactgcactccagcactccagc

SEQ ID NO: 106677 - DNA, 22 bp, Homo sapiens
gtgaccaatattatgctaatta

SEQ ID NO: 106678 - DNA, 22 bp, Homo sapiens
gcgagtgccgagagggcagggc

SEQ ID NO: 106679 - DNA, 22 bp, Homo sapiens
ttctgcagtgttaacaatgtca

SEQ ID NO: 106680 - DNA, 22 bp, Homo sapiens
tgatcagcatcttcccagctcg

SEQ ID NO: 106681 - DNA, 22 bp, Homo sapiens
tttttgggtccaggctgtatct

SEQ ID NO: 106682 - DNA, 22 bp, Homo sapiens
ttcattcttttacatgtgaata

SEQ ID NO: 106683 - DNA, 22 bp, Homo sapiens
ttcataaacaaattaaggcctg

SEQ ID NO: 106684 - DNA, 22 bp, Homo sapiens
acatttatataactcactagga

SEQ ID NO: 106685 - DNA, 22 bp, Homo sapiens
tcctaggttttcaaaagaccac

SEQ ID NO: 106686 - DNA, 22 bp, Homo sapiens
agctcaccacaacctccgcctc

SEQ ID NO: 106687 - DNA, 19 bp, Homo sapiens
gccttcccaccacccgtcc

SEQ ID NO: 106688 - DNA, 22 bp, Homo sapiens
tgtcctgtgattccagctcttc

SEQ ID NO: 106689 - DNA, 22 bp, Homo sapiens
ttgaataatatgcttcgttctc

SEQ ID NO: 106690 - DNA, 22 bp, Homo sapiens
ttgaggcctgctggaaggtgtt

SEQ ID NO: 106691 - DNA, 22 bp, Homo sapiens
acggggctagagaaggtttctt

SEQ ID NO: 106692 - DNA, 22 bp, Homo sapiens
aggtgaacccaggtgcttcacg

SEQ ID NO: 106693 - DNA, 22 bp, Homo sapiens
aggacgctctcgctgaacttct

SEQ ID NO: 106694 - DNA, 22 bp, Homo sapiens
gaaggaagtcattagtgcagac

SEQ ID NO: 106695 - DNA, 22 bp, Homo sapiens
gaccctgtttctacaaataatt

SEQ ID NO: 106696 - DNA, 22 bp, Homo sapiens
ataaaatttgctactgttaaat

SEQ ID NO: 106697 - DNA, 22 bp, Homo sapiens
ctgcttctagcaccaagtccct

SEQ ID NO: 106698 - DNA, 22 bp, Homo sapiens
gcacagagagggaaggtaactt

SEQ ID NO: 106699 - DNA, 22 bp, Homo sapiens
cacccaggttggagtgcagtgg

SEQ ID NO: 106700 - DNA, 22 bp, Homo sapiens
cattgcactccagcctgggcaa

SEQ ID NO: 106701 - DNA, 22 bp, Homo sapiens
ggctcaggcctgtaatcctagc

SEQ ID NO: 106702 - DNA, 22 bp, Homo sapiens
ttcagcttgctgactgcggcag

SEQ ID NO: 106703 - DNA, 22 bp, Homo sapiens
tgtggctctcatgcactcccag

SEQ ID NO: 106704 - DNA, 22 bp, Homo sapiens
agcctgggccctgcctcttctc

SEQ ID NO: 106705 - DNA, 22 bp, Homo sapiens
agcaggaaggggatgatgggca

SEQ ID NO: 106706 - DNA, 22 bp, Homo sapiens
agggccagcactcctggcagga

SEQ ID NO: 106707 - DNA, 22 bp, Homo sapiens
cagtttcttcctcccccagaga

SEQ ID NO: 106708 - DNA, 22 bp, Homo sapiens
aaggccctggcaggaagcagga

SEQ ID NO: 106709 - DNA, 22 bp, Homo sapiens
cgaggaggaaacgcggagaact

SEQ ID NO: 106710 - DNA, 22 bp, Homo sapiens
gggggaagaaagaacatggcat

SEQ ID NO: 106711 - DNA, 22 bp, Homo sapiens
atgtcttctctgtaggtaaatt

SEQ ID NO: 106712 - DNA, 22 bp, Homo sapiens
gggtattaaaatgaaggagaaa

SEQ ID NO: 106713 - DNA, 22 bp, Homo sapiens
caggtggtcaggcaaggacacg

SEQ ID NO: 106714 - DNA, 22 bp, Homo sapiens
gtgggccagcttttctcctggg

SEQ ID NO: 106715 - DNA, 22 bp, Homo sapiens
gaggcagaagttgcagtgagca

SEQ ID NO: 106716 - DNA, 22 bp, Homo sapiens
caggagttcaaggttgcagtga

SEQ ID NO: 106717 - DNA, 22 bp, Homo sapiens
tgggcgacagagcaagactccg

SEQ ID NO: 106718 - DNA, 22 bp, Homo sapiens
gatggaggagatggcagggtgc

SEQ ID NO: 106719 - DNA, 22 bp, Homo sapiens
aatgctctttaacctattctga

SEQ ID NO: 106720 - DNA, 22 bp, Homo sapiens
cctttcccgctttgagggcaag

SEQ ID NO: 106721 - DNA, 22 bp, Homo sapiens
tttcccagcctcagctcagcag

SEQ ID NO: 106722 - DNA, 22 bp, Homo sapiens
tctgagaaatttctttgtgatg

SEQ ID NO: 106723 - DNA, 22 bp, Homo sapiens
cccaggaggtggagcttgcagt

SEQ ID NO: 106724 - DNA, 22 bp, Homo sapiens
agctctgaaagttatgtcgccg

SEQ ID NO: 106725 - DNA, 22 bp, Homo sapiens
catgctgggtaaaggtggtgaa

SEQ ID NO: 106726 - DNA, 22 bp, Homo sapiens
ctgccgttgtgaagctcttaga

SEQ ID NO: 106727 - DNA, 22 bp, Homo sapiens
cagcctgccgtcagccaggtag

SEQ ID NO: 106728 - DNA, 22 bp, Homo sapiens
catttctgggagacatgctaga

SEQ ID NO: 106729 - DNA, 22 bp, Homo sapiens
ggccactgacctacatctgggg

SEQ ID NO: 106730 - DNA, 22 bp, Homo sapiens
tgccctctttctgtacagctcc

SEQ ID NO: 106731 - DNA, 18 bp, Homo sapiens
agagtatacagacaacaa

SEQ ID NO: 106732 - DNA, 22 bp, Homo sapiens
aggaggggttctcgggtgctga

SEQ ID NO: 106733 - DNA, 22 bp, Homo sapiens
ctcttcatagcaaacatatggg

SEQ ID NO: 106734 - DNA, 22 bp, Homo sapiens
tgaaatgtgttctagtgttttg

SEQ ID NO: 106735 - DNA, 22 bp, Homo sapiens
tcttgggggactttggcatgga

SEQ ID NO: 106736 - DNA, 22 bp, Homo sapiens
ggccagaagttggaaaagagcc

SEQ ID NO: 106737 - DNA, 22 bp, Homo sapiens
ccggctactcgggaggctgacg

SEQ ID NO: 106738 - DNA, 22 bp, Homo sapiens
actcagtacatctggagttggc

SEQ ID NO: 106739 - DNA, 22 bp, Homo sapiens
ggcgggaagttcttgcccactt

SEQ ID NO: 106740 - DNA, 22 bp, Homo sapiens
cccaggccctggcagagcttgt

SEQ ID NO: 106741 - DNA, 22 bp, Homo sapiens
aactctatttaccctactaaac

SEQ ID NO: 106742 - DNA, 22 bp, Homo sapiens
ttttaagttggattgctaagta

SEQ ID NO: 106743 - DNA, 22 bp, Homo sapiens
tctgcaacattcctctccccac

SEQ ID NO: 106744 - DNA, 22 bp, Homo sapiens
gaggcagaggttgcagtgagct

SEQ ID NO: 106745 - DNA, 21 bp, Homo sapiens
gctcctggtgctgcgtggcgc

SEQ ID NO: 106746 - DNA, 22 bp, Homo sapiens
cccaggaagtggaggttgcagt

SEQ ID NO: 106747 - DNA, 22 bp, Homo sapiens
ccagtgtgcattatcatgtgtc

SEQ ID NO: 106748 - DNA, 22 bp, Homo sapiens
ctcctgggaaaggctggacaca

SEQ ID NO: 106749 - DNA, 21 bp, Homo sapiens
tcacgtggtcacatgagcttt

SEQ ID NO: 106750 - DNA, 22 bp, Homo sapiens
gcatatgatcacgtgtgtcggt

SEQ ID NO: 106751 - DNA, 22 bp, Homo sapiens
gacactctttcctcttctggaa

SEQ ID NO: 106752 - DNA, 22 bp, Homo sapiens
aaaatcttgtgacttaggaagg

SEQ ID NO: 106753 - DNA, 22 bp, Homo sapiens
cattccttaacgtggggagtct

SEQ ID NO: 106754 - DNA, 22 bp, Homo sapiens
ggctgtggagctgcagagttgg

SEQ ID NO: 106755 - DNA, 22 bp, Homo sapiens
ggattgcaacaagctagtttag

SEQ ID NO: 106756 - DNA, 22 bp, Homo sapiens
aggctagaggcttctggcttca

SEQ ID NO: 106757 - DNA, 22 bp, Homo sapiens
tctgtggcccaagtgatggctg

SEQ ID NO: 106758 - DNA, 22 bp, Homo sapiens
tcctcagaatcacctggcagct

SEQ ID NO: 106759 - DNA, 22 bp, Homo sapiens
cgttaataggtgcaaggtaagg

SEQ ID NO: 106760 - DNA, 22 bp, Homo sapiens
attaaagctatccagtcatgaa

SEQ ID NO: 106761 - DNA, 22 bp, Homo sapiens
cagagctggtgtgtcctggcat

SEQ ID NO: 106762 - DNA, 22 bp, Homo sapiens
gtaatctcagctacttgggagg

SEQ ID NO: 106763 - DNA, 22 bp, Homo sapiens
gttcagtcacgtgcccaagttc

SEQ ID NO: 106764 - DNA, 22 bp, Homo sapiens
gaaatggtcaagctgcaggata

SEQ ID NO: 106765 - DNA, 22 bp, Homo sapiens
tttacctttgtgggtctccctc

SEQ ID NO: 106766 - DNA, 22 bp, Homo sapiens
aaaagtaattgtggtttttgct

SEQ ID NO: 106767 - DNA, 22 bp, Homo sapiens
aggtggggaggagtgtctcttt

SEQ ID NO: 106768 - DNA, 22 bp, Homo sapiens
cccatgcaccctctaagaagga

SEQ ID NO: 106769 - DNA, 22 bp, Homo sapiens
acaatgaagctccactgagctt

SEQ ID NO: 106770 - DNA, 20 bp, Homo sapiens
gtctccactgggggttaacc

SEQ ID NO: 106771 - DNA, 22 bp, Homo sapiens
caggctggagtacaattgtgtg

SEQ ID NO: 106772 - DNA, 22 bp, Homo sapiens
aggaatgacatagaaaggggag

SEQ ID NO: 106773 - DNA, 22 bp, Homo sapiens
tggttcctcaagcgctggcggc

SEQ ID NO: 106774 - DNA, 22 bp, Homo sapiens
tgtccaggttagcttcaaacac

SEQ ID NO: 106775 - DNA, 22 bp, Homo sapiens
gtctatgcaacttttagtggga

SEQ ID NO: 106776 - DNA, 22 bp, Homo sapiens
gccctgccctctcggcactcgc

SEQ ID NO: 106777 - DNA, 22 bp, Homo sapiens
tatgcaggattatctactacca

SEQ ID NO: 106778 - DNA, 22 bp, Homo sapiens
gagcagtgtttgtggacctgga

SEQ ID NO: 106779 - DNA, 22 bp, Homo sapiens
ctacttgttcactgtaggtcgc

SEQ ID NO: 106780 - DNA, 22 bp, Homo sapiens
gctgcagtgagccaagatcgtg

SEQ ID NO: 106781 - DNA, 22 bp, Homo sapiens
gctccgtgggcattgctaggtg

SEQ ID NO: 106782 - DNA, 22 bp, Homo sapiens
ctgcagggagaggggacagcct

SEQ ID NO: 106783 - DNA, 22 bp, Homo sapiens
cggtcaggtgcagcgttggcac

SEQ ID NO: 106784 - DNA, 22 bp, Homo sapiens
cggggaagcggttctggcggta

SEQ ID NO: 106785 - DNA, 22 bp, Homo sapiens
ccctgtgggaactcctgagttg

SEQ ID NO: 106786 - DNA, 22 bp, Homo sapiens
cccgtgtgtgcgaggctcccgc

SEQ ID NO: 106787 - DNA, 22 bp, Homo sapiens
attgcacttcagcctgggtgac

SEQ ID NO: 106788 - DNA, 22 bp, Homo sapiens
tgggcagggagctggaaccaca

SEQ ID NO: 106789 - DNA, 22 bp, Homo sapiens
aaattgcaaaagtacttttagg

SEQ ID NO: 106790 - DNA, 22 bp, Homo sapiens
ttttctagggtgctaaatgaac

SEQ ID NO: 106791 - DNA, 22 bp, Homo sapiens
cccaggctggagtgtaatggtg

SEQ ID NO: 106792 - DNA, 22 bp, Homo sapiens
ggaaactagaagaatactagtc

SEQ ID NO: 106793 - DNA, 22 bp, Homo sapiens
cccaggaggcctgcctggccgg

SEQ ID NO: 106794 - DNA, 22 bp, Homo sapiens
actttatttcctattgcatcca

SEQ ID NO: 106795 - DNA, 22 bp, Homo sapiens
aaaagaggaactcttatatact

SEQ ID NO: 106796 - DNA, 22 bp, Homo sapiens
ttcaccctggaccagaaattgg

SEQ ID NO: 106797 - DNA, 23 bp, Homo sapiens
tgtgggcgcattgtaagggtagc

SEQ ID NO: 106798 - DNA, 22 bp, Homo sapiens
cttgtcttgcacacggttgcca

SEQ ID NO: 106799 - DNA, 22 bp, Homo sapiens
tgtccaggctggagtgcagtgg

SEQ ID NO: 106800 - DNA, 23 bp, Homo sapiens
aggatgtaggatgtatggcagag

SEQ ID NO: 106801 - DNA, 22 bp, Homo sapiens
tggaagacaatttgaaaacatt

SEQ ID NO: 106802 - DNA, 22 bp, Homo sapiens
aggagctgtcagagtgccagag

SEQ ID NO: 106803 - DNA, 22 bp, Homo sapiens
ttattgaaggaactgaaataaa

SEQ ID NO: 106804 - DNA, 22 bp, Homo sapiens
ccgggttgaggttcccatagat

SEQ ID NO: 106805 - DNA, 22 bp, Homo sapiens
gttgggttaaccaggatgtcaa

SEQ ID NO: 106806 - DNA, 22 bp, Homo sapiens
acccaggctggagtgcagtgat

SEQ ID NO: 106807 - DNA, 22 bp, Homo sapiens
accgggctaatttttgtatctt

SEQ ID NO: 106808 - DNA, 22 bp, Homo sapiens
tcccaggccacacttggggaac

SEQ ID NO: 106809 - DNA, 22 bp, Homo sapiens
gcacatccaatgattgttttga

SEQ ID NO: 106810 - DNA, 22 bp, Homo sapiens
gaccagtcattactcatgccct

SEQ ID NO: 106811 - DNA, 22 bp, Homo sapiens
ggagtgcggtggcaccatctca

SEQ ID NO: 106812 - DNA, 22 bp, Homo sapiens
tagcagtgtctaggtaggccat

SEQ ID NO: 106813 - DNA, 22 bp, Homo sapiens
agggctggagccacagctggga

SEQ ID NO: 106814 - DNA, 22 bp, Homo sapiens
gtgaataaaacacctgccaaga

SEQ ID NO: 106815 - DNA, 22 bp, Homo sapiens
ggtttgacagcttggggctgtc

SEQ ID NO: 106816 - DNA, 22 bp, Homo sapiens
ctcccataattctcatatgtca

SEQ ID NO: 106817 - DNA, 22 bp, Homo sapiens
attttctatgttgtaattgtta

SEQ ID NO: 106818 - DNA, 19 bp, Homo sapiens
gggaatgatggaagacttc

SEQ ID NO: 106819 - DNA, 22 bp, Homo sapiens
aaattctgatttaataagtgta

SEQ ID NO: 106820 - DNA, 22 bp, Homo sapiens
caggcagggagctggaaaggat

SEQ ID NO: 106821 - DNA, 22 bp, Homo sapiens
tttctcatggaacatcgtttag

SEQ ID NO: 106822 - DNA, 22 bp, Homo sapiens
ccaggaggtggagattgcagtg

SEQ ID NO: 106823 - DNA, 22 bp, Homo sapiens
gggccccaagaacctcctcctg

SEQ ID NO: 106824 - DNA, 22 bp, Homo sapiens
aaagtgctgggattacaggctt

SEQ ID NO: 106825 - DNA, 22 bp, Homo sapiens
tgcaaatgtgttttaaaccaaa

SEQ ID NO: 106826 - DNA, 22 bp, Homo sapiens
agtgagagtattaatgtgaact

SEQ ID NO: 106827 - DNA, 22 bp, Homo sapiens
gagaggaagccttctgtacttg

SEQ ID NO: 106828 - DNA, 22 bp, Homo sapiens
ggggtccctgcaccagcatgtc

SEQ ID NO: 106829 - DNA, 22 bp, Homo sapiens
tgtggctcaggcggcttctcct

SEQ ID NO: 106830 - DNA, 22 bp, Homo sapiens
tcctgagataaatctcatgtga

SEQ ID NO: 106831 - DNA, 22 bp, Homo sapiens
aaggctgagacagcacaggtcc

SEQ ID NO: 106832 - DNA, 22 bp, Homo sapiens
tctcccctggtctcgcgcgctg

SEQ ID NO: 106833 - DNA, 22 bp, Homo sapiens
aacccgggaggcggaggttgtg

SEQ ID NO: 106834 - DNA, 22 bp, Homo sapiens
ttccatcattaacaccacaagg

SEQ ID NO: 106835 - DNA, 22 bp, Homo sapiens
cagcagtgtacaaggtgtcaga

SEQ ID NO: 106836 - DNA, 22 bp, Homo sapiens
acaggatcgccctgttgcccag

SEQ ID NO: 106837 - DNA, 22 bp, Homo sapiens
atcggcaagccccacaccgtcc

SEQ ID NO: 106838 - DNA, 22 bp, Homo sapiens
tttgttttcaatgtgtcattca

SEQ ID NO: 106839 - DNA, 22 bp, Homo sapiens
aaggagaaatggtagatgtgca

SEQ ID NO: 106840 - DNA, 22 bp, Homo sapiens
gaggcaggaggattgcttgagc

SEQ ID NO: 106841 - DNA, 22 bp, Homo sapiens
ctgtaatcccagctactcggga

SEQ ID NO: 106842 - DNA, 22 bp, Homo sapiens
tctgtcacccagagtgcagtgg

SEQ ID NO: 106843 - DNA, 22 bp, Homo sapiens
gcccagtagttcaaggttgcag

SEQ ID NO: 106844 - DNA, 22 bp, Homo sapiens
cttgggaggcagaggttgcagt

SEQ ID NO: 106845 - DNA, 22 bp, Homo sapiens
gctgtatgtgaggccacagtga

SEQ ID NO: 106846 - DNA, 18 bp, Homo sapiens
acgtgctgtgccttttgc

SEQ ID NO: 106847 - DNA, 22 bp, Homo sapiens
ggcatggacgtctctgaggcca

SEQ ID NO: 106848 - DNA, 22 bp, Homo sapiens
ctcatcagaaatacctgacaaa

SEQ ID NO: 106849 - DNA, 22 bp, Homo sapiens
aatgttacgatcaacaacacat

SEQ ID NO: 106850 - DNA, 22 bp, Homo sapiens
gaggctgaggcaggaggatcac

SEQ ID NO: 106851 - DNA, 22 bp, Homo sapiens
gaccaagatacagcatcataga

SEQ ID NO: 106852 - DNA, 22 bp, Homo sapiens
aggaaagcttggcaaactaaat

SEQ ID NO: 106853 - DNA, 22 bp, Homo sapiens
agcgcttgccgcactccaagca

SEQ ID NO: 106854 - DNA, 22 bp, Homo sapiens
cttgctttcagtctcggcctca

SEQ ID NO: 106855 - DNA, 22 bp, Homo sapiens
tttccagaaataccatttggtg

SEQ ID NO: 106856 - DNA, 22 bp, Homo sapiens
gggctgtgaggtgagaacttac

SEQ ID NO: 106857 - DNA, 22 bp, Homo sapiens
aataggtttaggaaagcgtttt

SEQ ID NO: 106858 - DNA, 22 bp, Homo sapiens
cttctcggccgtgtggatgcgc

SEQ ID NO: 106859 - DNA, 22 bp, Homo sapiens
ctaaaatgtttggggcagaacc

SEQ ID NO: 106860 - DNA, 22 bp, Homo sapiens
cttcctttgctgttcggaggtt

SEQ ID NO: 106861 - DNA, 22 bp, Homo sapiens
gtgttaaccagctaaactttgc

SEQ ID NO: 106862 - DNA, 22 bp, Homo sapiens
ttcaatatgatattagctgtgg

SEQ ID NO: 106863 - DNA, 22 bp, Homo sapiens
ttctttcagaacacaagtgatt

SEQ ID NO: 106864 - DNA, 22 bp, Homo sapiens
gacaggaggcagagctcaggtg

SEQ ID NO: 106865 - DNA, 22 bp, Homo sapiens
acgtgcaggatctggttggcga

SEQ ID NO: 106866 - DNA, 22 bp, Homo sapiens
agggctgcccagtgtgagagct

SEQ ID NO: 106867 - DNA, 22 bp, Homo sapiens
ctcggaatggaacaacagcggt

SEQ ID NO: 106868 - DNA, 19 bp, Homo sapiens
gctgaggtggaggaaggag

SEQ ID NO: 106869 - DNA, 22 bp, Homo sapiens
gctgtatgtttatttgggaatt

SEQ ID NO: 106870 - DNA, 22 bp, Homo sapiens
aggtggcagatgggggtgctcg

SEQ ID NO: 106871 - DNA, 20 bp, Homo sapiens
attagctcaggtgaggtcat

SEQ ID NO: 106872 - DNA, 22 bp, Homo sapiens
gcctgtcccgcaccggagcccg

SEQ ID NO: 106873 - DNA, 22 bp, Homo sapiens
ggcctcttatctggctcctgca

SEQ ID NO: 106874 - DNA, 22 bp, Homo sapiens
caccaggctggagtgcagtggc

SEQ ID NO: 106875 - DNA, 22 bp, Homo sapiens
catgcctgcctggtgggcgtgg

SEQ ID NO: 106876 - DNA, 22 bp, Homo sapiens
ttgccaggctggagtgcagtgg

SEQ ID NO: 106877 - DNA, 22 bp, Homo sapiens
ttgggcctctcaaagtgctggg

SEQ ID NO: 106878 - DNA, 22 bp, Homo sapiens
cctcagacccctgctgagcttc

SEQ ID NO: 106879 - DNA, 22 bp, Homo sapiens
caggctggagtgcagtggtgcc

SEQ ID NO: 106880 - DNA, 22 bp, Homo sapiens
tgaaatgattatatggtgtttg

SEQ ID NO: 106881 - DNA, 22 bp, Homo sapiens
gtgcgggcctgggggtttctct

SEQ ID NO: 106882 - DNA, 22 bp, Homo sapiens
atcctccatctccatcggactg

SEQ ID NO: 106883 - DNA, 22 bp, Homo sapiens
ggtgttgcagttgaagactggt

SEQ ID NO: 106884 - DNA, 22 bp, Homo sapiens
ttagctcagaaaatttaaactt

SEQ ID NO: 106885 - DNA, 22 bp, Homo sapiens
tggatggctgtggtctttgccc

SEQ ID NO: 106886 - DNA, 22 bp, Homo sapiens
agagcacagggttttgtgccgg

SEQ ID NO: 106887 - DNA, 22 bp, Homo sapiens
aaagtgctgtgattacaggcat

SEQ ID NO: 106888 - DNA, 22 bp, Homo sapiens
ctggctgggagcgagctgctca

SEQ ID NO: 106889 - DNA, 22 bp, Homo sapiens
aggccacggcgggtggattact

SEQ ID NO: 106890 - DNA, 22 bp, Homo sapiens
atgccactgcgctctagcctgg

SEQ ID NO: 106891 - DNA, 22 bp, Homo sapiens
gcagaggacacaggagggcaag

SEQ ID NO: 106892 - DNA, 22 bp, Homo sapiens
tttcagaacataatgtgagcat

SEQ ID NO: 106893 - DNA, 22 bp, Homo sapiens
ttctgattgctgatgaggccca

SEQ ID NO: 106894 - DNA, 22 bp, Homo sapiens
ctagcctgggatttgaacttat

SEQ ID NO: 106895 - DNA, 22 bp, Homo sapiens
taatggttttttggagactgct

SEQ ID NO: 106896 - DNA, 17 bp, Homo sapiens
aatgtccttggaccaca

SEQ ID NO: 106897 - DNA, 22 bp, Homo sapiens
ctggctggagtgcaggtgagtg

SEQ ID NO: 106898 - DNA, 22 bp, Homo sapiens
aagccctggcgggtggagggcc

SEQ ID NO: 106899 - DNA, 22 bp, Homo sapiens
taatgcacccagagtttgaact

SEQ ID NO: 106900 - DNA, 22 bp, Homo sapiens
ttagatttacaagcactgttta

SEQ ID NO: 106901 - DNA, 22 bp, Homo sapiens
gagcctggagctggaacgaagc

SEQ ID NO: 106902 - DNA, 22 bp, Homo sapiens
gagctgggcctgcgagtgctgc

SEQ ID NO: 106903 - DNA, 22 bp, Homo sapiens
tggcagtggcgggactcagggc

SEQ ID NO: 106904 - DNA, 22 bp, Homo sapiens
taagaaatttagttatagaatg

SEQ ID NO: 106905 - DNA, 22 bp, Homo sapiens
ggcctttgcgtccacgccgctt

SEQ ID NO: 106906 - DNA, 22 bp, Homo sapiens
ctgtggctctttagttgagcac

SEQ ID NO: 106907 - DNA, 22 bp, Homo sapiens
gatgcgggcccgctccactgcc

SEQ ID NO: 106908 - DNA, 22 bp, Homo sapiens
aaaagtaattgcggtttttgct

SEQ ID NO: 106909 - DNA, 22 bp, Homo sapiens
aagctgttgttcatcctgaatt

SEQ ID NO: 106910 - DNA, 22 bp, Homo sapiens
ttaggatttgaaaaggggcaga

SEQ ID NO: 106911 - DNA, 22 bp, Homo sapiens
acctcctggcctcaagcaatcc

SEQ ID NO: 106912 - DNA, 22 bp, Homo sapiens
ctggcaggttatagagctgccc

SEQ ID NO: 106913 - DNA, 22 bp, Homo sapiens
gggcggatcacctgaggtcagg

SEQ ID NO: 106914 - DNA, 22 bp, Homo sapiens
agccccttgtgggcgcacagca

SEQ ID NO: 106915 - DNA, 22 bp, Homo sapiens
ctgttcccggtggccgggccag

SEQ ID NO: 106916 - DNA, 22 bp, Homo sapiens
tctaggcctggcttgggcccag

SEQ ID NO: 106917 - DNA, 21 bp, Homo sapiens
agtggctctcagcttgctaag

SEQ ID NO: 106918 - DNA, 22 bp, Homo sapiens
ggcgcacaatgtgcaggtttgt

SEQ ID NO: 106919 - DNA, 22 bp, Homo sapiens
tgctcgccccacatgccctcat

SEQ ID NO: 106920 - DNA, 22 bp, Homo sapiens
aagaataagaggatttagaaca

SEQ ID NO: 106921 - DNA, 22 bp, Homo sapiens
ttatttaatgtgatctgaagag

SEQ ID NO: 106922 - DNA, 22 bp, Homo sapiens
aaagcagaactgagagagctgg

SEQ ID NO: 106923 - DNA, 22 bp, Homo sapiens
caagatcttcctcaatagacct

SEQ ID NO: 106924 - DNA, 22 bp, Homo sapiens
attgttcaatgtaataattttg

SEQ ID NO: 106925 - DNA, 22 bp, Homo sapiens
taaagggtaggttttactgtaa

SEQ ID NO: 106926 - DNA, 22 bp, Homo sapiens
ttgcttcctctagtttcttgaa

SEQ ID NO: 106927 - DNA, 22 bp, Homo sapiens
gctgacccctacaggttgtgtt

SEQ ID NO: 106928 - DNA, 22 bp, Homo sapiens
gccaggaaagggaattccctga

SEQ ID NO: 106929 - DNA, 22 bp, Homo sapiens
ctccccattatgcagtcattat

SEQ ID NO: 106930 - DNA, 22 bp, Homo sapiens
tctttcattctagtctgaggtt

SEQ ID NO: 106931 - DNA, 22 bp, Homo sapiens
agcgccactgcactccagcctg

SEQ ID NO: 106932 - DNA, 22 bp, Homo sapiens
ctagttctagatccctgaggaa

SEQ ID NO: 106933 - DNA, 22 bp, Homo sapiens
gaagagctgacagtgtcatcct

SEQ ID NO: 106934 - DNA, 22 bp, Homo sapiens
ccaggcagcctgctccattctg

SEQ ID NO: 106935 - DNA, 22 bp, Homo sapiens
aagtcgtggcaggcttgcacga

SEQ ID NO: 106936 - DNA, 22 bp, Homo sapiens
aaattagtcatgttgtattact

SEQ ID NO: 106937 - DNA, 22 bp, Homo sapiens
cactgggcgtgtcctgggtgag

SEQ ID NO: 106938 - DNA, 22 bp, Homo sapiens
aaagtgctgggattacaggcat

SEQ ID NO: 106939 - DNA, 22 bp, Homo sapiens
cagtgcatgcacacacatggta

SEQ ID NO: 106940 - DNA, 22 bp, Homo sapiens
tagtaagttctcgcattgttat

SEQ ID NO: 106941 - DNA, 22 bp, Homo sapiens
acccacgaagatgagcggcatg

SEQ ID NO: 106942 - DNA, 21 bp, Homo sapiens
tgcaatccagcctgggcgaca

SEQ ID NO: 106943 - DNA, 19 bp, Homo sapiens
tctcaattctccccactgc

SEQ ID NO: 106944 - DNA, 22 bp, Homo sapiens
tttccctgtgaatatttaaaga

SEQ ID NO: 106945 - DNA, 22 bp, Homo sapiens
ctccaacgaggctggggtacaa

SEQ ID NO: 106946 - DNA, 22 bp, Homo sapiens
aggggatgcctagtggagtctc

SEQ ID NO: 106947 - DNA, 22 bp, Homo sapiens
gtagcccacctggggagggcga

SEQ ID NO: 106948 - DNA, 14 bp, Homo sapiens
gcaggcagatcacc

SEQ ID NO: 106949 - DNA, 22 bp, Homo sapiens
acacttggagcaacacttatgg

SEQ ID NO: 106950 - DNA, 22 bp, Homo sapiens
aaaaagtattggccatggttga

SEQ ID NO: 106951 - DNA, 22 bp, Homo sapiens
ttttcctggagatggagttgtt

SEQ ID NO: 106952 - DNA, 22 bp, Homo sapiens
ctgggaggcagaggttgcagtg

SEQ ID NO: 106953 - DNA, 22 bp, Homo sapiens
aaagcctcccaggttatgagta

SEQ ID NO: 106954 - DNA, 22 bp, Homo sapiens
ctccttctgggcctggcagtgg

SEQ ID NO: 106955 - DNA, 22 bp, Homo sapiens
ggaatgcactagactgtgaaac

SEQ ID NO: 106956 - DNA, 22 bp, Homo sapiens
ctgggatgcggaggttgcggtg

SEQ ID NO: 106957 - DNA, 22 bp, Homo sapiens
gtggcctggctggcaccacctc

SEQ ID NO: 106958 - DNA, 22 bp, Homo sapiens
tggcacgacaattggcaccaat

SEQ ID NO: 106959 - DNA, 22 bp, Homo sapiens
ttcttctcagggtcccacatgg

SEQ ID NO: 106960 - DNA, 22 bp, Homo sapiens
agggatggagtgcggcccggac

SEQ ID NO: 106961 - DNA, 22 bp, Homo sapiens
ggtggctgcaatggctaacttc

SEQ ID NO: 106962 - DNA, 20 bp, Homo sapiens
ggggaagtcactgcagtcag

SEQ ID NO: 106963 - DNA, 22 bp, Homo sapiens
gcccttacagggtggtcagcca

SEQ ID NO: 106964 - DNA, 22 bp, Homo sapiens
aatgtgaggccttggtagttat

SEQ ID NO: 106965 - DNA, 22 bp, Homo sapiens
tttgaagggcacgacaatagtt

SEQ ID NO: 106966 - DNA, 22 bp, Homo sapiens
gcacacggcagcctcctcctga

SEQ ID NO: 106967 - DNA, 22 bp, Homo sapiens
ccaggggggcgtagatgctggg

SEQ ID NO: 106968 - DNA, 22 bp, Homo sapiens
gtcagtaggaacctagggtcaa

SEQ ID NO: 106969 - DNA, 22 bp, Homo sapiens
acccaggctggagtgcagtggc

SEQ ID NO: 106970 - DNA, 22 bp, Homo sapiens
aagtggactaatacaaggacta

SEQ ID NO: 106971 - DNA, 22 bp, Homo sapiens
atggagttctgccagcgctgct

SEQ ID NO: 106972 - DNA, 22 bp, Homo sapiens
ttgaccatagaacatgcgctat

SEQ ID NO: 106973 - DNA, 22 bp, Homo sapiens
gacgcatcaggaggcgaggagc

SEQ ID NO: 106974 - DNA, 22 bp, Homo sapiens
ttcctccagccatgattgtaaa

SEQ ID NO: 106975 - DNA, 22 bp, Homo sapiens
cagctcacccatcacgtctgct

SEQ ID NO: 106976 - DNA, 22 bp, Homo sapiens
agttattgagtgcagagcaggg

SEQ ID NO: 106977 - DNA, 21 bp, Homo sapiens
ccagagcctgagaggattatg

SEQ ID NO: 106978 - DNA, 22 bp, Homo sapiens
ctgaggcctctcccactccagc

SEQ ID NO: 106979 - DNA, 22 bp, Homo sapiens
tcggagctgtagatgaaaccct

SEQ ID NO: 106980 - DNA, 18 bp, Homo sapiens
cagctgccagctcatgga

SEQ ID NO: 106981 - DNA, 22 bp, Homo sapiens
tatctcattttattgcaaatgt

SEQ ID NO: 106982 - DNA, 22 bp, Homo sapiens
tcaggaggtccgcccgggaggg

SEQ ID NO: 106983 - DNA, 22 bp, Homo sapiens
cagcgtctcgttgtgggcctcg

SEQ ID NO: 106984 - DNA, 22 bp, Homo sapiens
tattagttgcaaaacattgact

SEQ ID NO: 106985 - DNA, 22 bp, Homo sapiens
ctgaggctggagtgcagtggtg

SEQ ID NO: 106986 - DNA, 22 bp, Homo sapiens
tttaggttttttcacgtggcta

SEQ ID NO: 106987 - DNA, 22 bp, Homo sapiens
gacgtgaaggcagcggggctcg

SEQ ID NO: 106988 - DNA, 22 bp, Homo sapiens
ttggcataccttagtggtggag

SEQ ID NO: 106989 - DNA, 22 bp, Homo sapiens
cctgtgcttggccagagaggtt

SEQ ID NO: 106990 - DNA, 22 bp, Homo sapiens
gacctccgtgtacacctcccag

SEQ ID NO: 106991 - DNA, 22 bp, Homo sapiens
tcaccagatctctctgtaatgg

SEQ ID NO: 106992 - DNA, 22 bp, Homo sapiens
gggaggcagtgctggaggctgg

SEQ ID NO: 106993 - DNA, 22 bp, Homo sapiens
gcagctggaagtgacactctgt

SEQ ID NO: 106994 - DNA, 22 bp, Homo sapiens
cgggcgcactccgggcagctgt

SEQ ID NO: 106995 - DNA, 22 bp, Homo sapiens
cttctgagatgttgttttacag

SEQ ID NO: 106996 - DNA, 22 bp, Homo sapiens
tcctgggccctccggatcaggt

SEQ ID NO: 106997 - DNA, 22 bp, Homo sapiens
actattagcatatcatgaatgg

SEQ ID NO: 106998 - DNA, 22 bp, Homo sapiens
tctcatctgccatttgcaggag

SEQ ID NO: 106999 - DNA, 22 bp, Homo sapiens
ccagactcatctgccattgctg

SEQ ID NO: 107000 - DNA, 22 bp, Homo sapiens
actagaaagaagttttttgaga

SEQ ID NO: 107001 - DNA, 22 bp, Homo sapiens
aggtggagaagagatgggcagt

SEQ ID NO: 107002 - DNA, 22 bp, Homo sapiens
tcccacaggtggagcttgcagt

SEQ ID NO: 107003 - DNA, 22 bp, Homo sapiens
aagtgctgggattacaggcatg

SEQ ID NO: 107004 - DNA, 22 bp, Homo sapiens
ggccagcctggggctcccagac

SEQ ID NO: 107005 - DNA, 19 bp, Homo sapiens
tggctctgtcgaaggcaca

SEQ ID NO: 107006 - DNA, 22 bp, Homo sapiens
tctcctggtacccttcctagca

SEQ ID NO: 107007 - DNA, 22 bp, Homo sapiens
ggggtgtggacggctgtgccag

SEQ ID NO: 107008 - DNA, 22 bp, Homo sapiens
gatccgaatcattgctctttta

SEQ ID NO: 107009 - DNA, 22 bp, Homo sapiens
agaatccctggggagctgcagc

SEQ ID NO: 107010 - DNA, 22 bp, Homo sapiens
agtggctgagtgactgtgactc

SEQ ID NO: 107011 - DNA, 22 bp, Homo sapiens
tcacttagatggggatcatcac

SEQ ID NO: 107012 - DNA, 22 bp, Homo sapiens
gttcaagaccagcctggccaac

SEQ ID NO: 107013 - DNA, 21 bp, Homo sapiens
gttcaaatcctgacactacac

SEQ ID NO: 107014 - DNA, 20 bp, Homo sapiens
tcacatcctctcccaacatg

SEQ ID NO: 107015 - DNA, 22 bp, Homo sapiens
gcagagctcatgcctgcacctc

SEQ ID NO: 107016 - DNA, 17 bp, Homo sapiens
ggctgcagtccaggagg

SEQ ID NO: 107017 - DNA, 22 bp, Homo sapiens
gtcttgtcccagctctgccact

SEQ ID NO: 107018 - DNA, 22 bp, Homo sapiens
tggtacacatgtccaaggtcag

SEQ ID NO: 107019 - DNA, 22 bp, Homo sapiens
ggagtgcaatggcttgatcttg

SEQ ID NO: 107020 - DNA, 22 bp, Homo sapiens
ttacctaaaatagctcaattta

SEQ ID NO: 107021 - DNA, 22 bp, Homo sapiens
ctccccccacagtgttcttgcc

SEQ ID NO: 107022 - DNA, 22 bp, Homo sapiens
gccctgttgtcggacgtcaagg

SEQ ID NO: 107023 - DNA, 22 bp, Homo sapiens
gcagtggggcaatcatagctca

SEQ ID NO: 107024 - DNA, 19 bp, Homo sapiens
taccatccaagctggtttg

SEQ ID NO: 107025 - DNA, 22 bp, Homo sapiens
gctgatagactgaatgttggga

SEQ ID NO: 107026 - DNA, 22 bp, Homo sapiens
agtcaaagatgaccgagttcct

SEQ ID NO: 107027 - DNA, 22 bp, Homo sapiens
ggtcacgtgaccgcacctgcct

SEQ ID NO: 107028 - DNA, 22 bp, Homo sapiens
ctgctctgctgatcagtgtctc

SEQ ID NO: 107029 - DNA, 22 bp, Homo sapiens
agatgctgctccacaggccagg

SEQ ID NO: 107030 - DNA, 22 bp, Homo sapiens
gctgcagctcgccttccggcct

SEQ ID NO: 107031 - DNA, 22 bp, Homo sapiens
tgaggcaggaggattgcaggat

SEQ ID NO: 107032 - DNA, 22 bp, Homo sapiens
tcaaagatcagatggttgtagg

SEQ ID NO: 107033 - DNA, 22 bp, Homo sapiens
cccaggcttttctcttgcccca

SEQ ID NO: 107034 - DNA, 22 bp, Homo sapiens
ggtattgttctagctttaaagg

SEQ ID NO: 107035 - DNA, 22 bp, Homo sapiens
gaagatacaaatttcttagatg

SEQ ID NO: 107036 - DNA, 22 bp, Homo sapiens
caggcagaagaagtggaaggac

SEQ ID NO: 107037 - DNA, 22 bp, Homo sapiens
cattgcaacttcaaactcctgg

SEQ ID NO: 107038 - DNA, 22 bp, Homo sapiens
gatcctgggcccttctgggtca

SEQ ID NO: 107039 - DNA, 22 bp, Homo sapiens
ctagggtcaggggcctgcgtcg

SEQ ID NO: 107040 - DNA, 22 bp, Homo sapiens
gggttgaggcggatgtcggcgg

SEQ ID NO: 107041 - DNA, 22 bp, Homo sapiens
tctcgctctgtcgcccaggctg

SEQ ID NO: 107042 - DNA, 20 bp, Homo sapiens
agcagagtgcccatcccgga

SEQ ID NO: 107043 - DNA, 22 bp, Homo sapiens
aatgagatggaattcccgccta

SEQ ID NO: 107044 - DNA, 22 bp, Homo sapiens
aagcagaatagaggcccttccc

SEQ ID NO: 107045 - DNA, 22 bp, Homo sapiens
ttatttttaaaagttcacacag

SEQ ID NO: 107046 - DNA, 22 bp, Homo sapiens
atggcatttgaatctgtctttt

SEQ ID NO: 107047 - DNA, 22 bp, Homo sapiens
tcgcccaggctggaagtgcagt

SEQ ID NO: 107048 - DNA, 22 bp, Homo sapiens
atgaccagccgagataaacaga

SEQ ID NO: 107049 - DNA, 22 bp, Homo sapiens
actcttgattgatttagtcttt

SEQ ID NO: 107050 - DNA, 22 bp, Homo sapiens
ctcctgcttcacgggcaccgcc

SEQ ID NO: 107051 - DNA, 22 bp, Homo sapiens
actgattgcattcatagggttt

SEQ ID NO: 107052 - DNA, 22 bp, Homo sapiens
gagcaacacgcagtagtatacg

SEQ ID NO: 107053 - DNA, 22 bp, Homo sapiens
gagggccctggctggctccagc

SEQ ID NO: 107054 - DNA, 22 bp, Homo sapiens
gccagagttgaggcagtttatt

SEQ ID NO: 107055 - DNA, 22 bp, Homo sapiens
tgcctccctggcaagtctctcc

SEQ ID NO: 107056 - DNA, 22 bp, Homo sapiens
caggccagggttgagaagagaa

SEQ ID NO: 107057 - DNA, 22 bp, Homo sapiens
tagcacagcttcttgatgtcac

SEQ ID NO: 107058 - DNA, 22 bp, Homo sapiens
gctgaggtggaggaaggagacc

SEQ ID NO: 107059 - DNA, 22 bp, Homo sapiens
catggcactgagcaggtatgca

SEQ ID NO: 107060 - DNA, 22 bp, Homo sapiens
caggaaagggatgggctgccac

SEQ ID NO: 107061 - DNA, 20 bp, Homo sapiens
ggcagagggcctgggagaag

SEQ ID NO: 107062 - DNA, 22 bp, Homo sapiens
gtcagatctttggggatgctgt

SEQ ID NO: 107063 - DNA, 22 bp, Homo sapiens
cccagcaggtcggtgctgcctg

SEQ ID NO: 107064 - DNA, 22 bp, Homo sapiens
aaggatgattggtaatgacact

SEQ ID NO: 107065 - DNA, 22 bp, Homo sapiens
tggtcttagctggaaggaggga

SEQ ID NO: 107066 - DNA, 22 bp, Homo sapiens
tgttttaagggtcaactgtcac

SEQ ID NO: 107067 - DNA, 22 bp, Homo sapiens
gaggtgctgctgtacttcttgc

SEQ ID NO: 107068 - DNA, 22 bp, Homo sapiens
acactctagagggaagcgcttt

SEQ ID NO: 107069 - DNA, 22 bp, Homo sapiens
tctcgacagcctggcacagtgg

SEQ ID NO: 107070 - DNA, 22 bp, Homo sapiens
aagtgctgagactacaggcatg

SEQ ID NO: 107071 - DNA, 22 bp, Homo sapiens
gtcagaggggcagctgccaggc

SEQ ID NO: 107072 - DNA, 22 bp, Homo sapiens
ttgcaaatcagaagtatagatt

SEQ ID NO: 107073 - DNA, 22 bp, Homo sapiens
aatggctctgatgttgttgtga

SEQ ID NO: 107074 - DNA, 22 bp, Homo sapiens
ttttctaacatctagtaatttg

SEQ ID NO: 107075 - DNA, 22 bp, Homo sapiens
agcctggcctgggcaggcacat

SEQ ID NO: 107076 - DNA, 22 bp, Homo sapiens
caaaatgcatctgagaccaggc

SEQ ID NO: 107077 - DNA, 22 bp, Homo sapiens
gagggaaaggttaatacatgat

SEQ ID NO: 107078 - DNA, 22 bp, Homo sapiens
ggaagggcaaaagagatgaact

SEQ ID NO: 107079 - DNA, 22 bp, Homo sapiens
atttctctgcagtgttcggaat

SEQ ID NO: 107080 - DNA, 22 bp, Homo sapiens
tcatctccatacggtctcgcag

SEQ ID NO: 107081 - DNA, 22 bp, Homo sapiens
caggctggagtgcagtggggcg

SEQ ID NO: 107082 - DNA, 22 bp, Homo sapiens
tgtgaatggacaattaaatcta

SEQ ID NO: 107083 - DNA, 22 bp, Homo sapiens
tctgttgcaatgtgcatggtga

SEQ ID NO: 107084 - DNA, 22 bp, Homo sapiens
tccaggctttggggcaggagcg

SEQ ID NO: 107085 - DNA, 22 bp, Homo sapiens
ctgccctttgaaagaacgtctt

SEQ ID NO: 107086 - DNA, 22 bp, Homo sapiens
gcaggcggaggttgcagtgagc

SEQ ID NO: 107087 - DNA, 22 bp, Homo sapiens
ccctaagaagcaaagtgatacc

SEQ ID NO: 107088 - DNA, 22 bp, Homo sapiens
cagcctttgggtcagaagattc

SEQ ID NO: 107089 - DNA, 22 bp, Homo sapiens
tggaagggagctggaatttgga

SEQ ID NO: 107090 - DNA, 22 bp, Homo sapiens
ccaggaggcggaggttgcagtg

SEQ ID NO: 107091 - DNA, 18 bp, Homo sapiens
agctccatctgtcagcat

SEQ ID NO: 107092 - DNA, 22 bp, Homo sapiens
tcaggaggcggaggttgcagtg

SEQ ID NO: 107093 - DNA, 22 bp, Homo sapiens
cacagtggtccccgaagcccct

SEQ ID NO: 107094 - DNA, 22 bp, Homo sapiens
ggagtgctttgaagccttcatt

SEQ ID NO: 107095 - DNA, 22 bp, Homo sapiens
cagcttggaggaggatctaaga

SEQ ID NO: 107096 - DNA, 22 bp, Homo sapiens
gaatttaagaggatgaatctgt

SEQ ID NO: 107097 - DNA, 22 bp, Homo sapiens
ctgatattctattttgcttgct

SEQ ID NO: 107098 - DNA, 22 bp, Homo sapiens
ctgcttctccctgagatagtgt

SEQ ID NO: 107099 - DNA, 22 bp, Homo sapiens
tgttttaagctctagaagggga

SEQ ID NO: 107100 - DNA, 22 bp, Homo sapiens
aagcatttcaggtagagatatt

SEQ ID NO: 107101 - DNA, 21 bp, Homo sapiens
cagtggcacgatttcggctca

SEQ ID NO: 107102 - DNA, 22 bp, Homo sapiens
tgagccatgggactccaaggga

SEQ ID NO: 107103 - DNA, 22 bp, Homo sapiens
gcccagcacctctctcagggtt

SEQ ID NO: 107104 - DNA, 22 bp, Homo sapiens
gtccaggcctgcctctgaggag

SEQ ID NO: 107105 - DNA, 22 bp, Homo sapiens
tgctcatcaacatgatgatcat

SEQ ID NO: 107106 - DNA, 22 bp, Homo sapiens
gggtccctggaattacttgaca

SEQ ID NO: 107107 - DNA, 22 bp, Homo sapiens
acaagcgggccacagtgctggt

SEQ ID NO: 107108 - DNA, 22 bp, Homo sapiens
cccagagcatgtgctgcctttg

SEQ ID NO: 107109 - DNA, 22 bp, Homo sapiens
cccgggttgtccgcgcgtccgg

SEQ ID NO: 107110 - DNA, 19 bp, Homo sapiens
acacagggatcagagggtt

SEQ ID NO: 107111 - DNA, 22 bp, Homo sapiens
tccttgtgctgagggtgttgct

SEQ ID NO: 107112 - DNA, 22 bp, Homo sapiens
cgcatgagacctgccggccatc

SEQ ID NO: 107113 - DNA, 22 bp, Homo sapiens
gcttggaagtaggattgggaga

SEQ ID NO: 107114 - DNA, 22 bp, Homo sapiens
cggctcactgcagctccgcctc

SEQ ID NO: 107115 - DNA, 22 bp, Homo sapiens
aggcaaggtgctacagacagtg

SEQ ID NO: 107116 - DNA, 22 bp, Homo sapiens
tcggagcgtcactggctggagg

SEQ ID NO: 107117 - DNA, 22 bp, Homo sapiens
gaggtgctgctgtacttcttgc

SEQ ID NO: 107118 - DNA, 22 bp, Homo sapiens
gagtcgagcagaaagccgtcgg

SEQ ID NO: 107119 - DNA, 22 bp, Homo sapiens
tccgggagctgaacgtcttgcg

SEQ ID NO: 107120 - DNA, 22 bp, Homo sapiens
gacaggaggcagagctcaggtg

SEQ ID NO: 107121 - DNA, 22 bp, Homo sapiens
ttttaatactgctattgtagga

SEQ ID NO: 107122 - DNA, 22 bp, Homo sapiens
ggggtgggcgtgcagggacacc

SEQ ID NO: 107123 - DNA, 22 bp, Homo sapiens
gcaggaggttgagccaggactg

SEQ ID NO: 107124 - DNA, 22 bp, Homo sapiens
tctgtatctcacttctttgtgg

SEQ ID NO: 107125 - DNA, 20 bp, Homo sapiens
caaatccctgctctgtgctg

SEQ ID NO: 107126 - DNA, 22 bp, Homo sapiens
tttattctgtgctacatgaaga

SEQ ID NO: 107127 - DNA, 22 bp, Homo sapiens
ttctagtgtccttggacttgct

SEQ ID NO: 107128 - DNA, 22 bp, Homo sapiens
gaccttgtgatctgcctgcctt

SEQ ID NO: 107129 - DNA, 22 bp, Homo sapiens
ggctgtggcagctggaagtggt

SEQ ID NO: 107130 - DNA, 22 bp, Homo sapiens
agggctggagccacagctggga

SEQ ID NO: 107131 - DNA, 22 bp, Homo sapiens
atatgtggcattatttctgagg

SEQ ID NO: 107132 - DNA, 22 bp, Homo sapiens
ccaggaggtggaggttgcggtg

SEQ ID NO: 107133 - DNA, 22 bp, Homo sapiens
tagctcaaaggttaagtgtgga

SEQ ID NO: 107134 - DNA, 22 bp, Homo sapiens
ccaggaggcggaggttgcagtg

SEQ ID NO: 107135 - DNA, 22 bp, Homo sapiens
gcgagggcacgcggttgaaggc

SEQ ID NO: 107136 - DNA, 22 bp, Homo sapiens
atcacccaggctggagtgcagt

SEQ ID NO: 107137 - DNA, 22 bp, Homo sapiens
tttctttatcatagcatctttg

SEQ ID NO: 107138 - DNA, 22 bp, Homo sapiens
agggaagaggaccagagtctct

SEQ ID NO: 107139 - DNA, 22 bp, Homo sapiens
gttttgaatactactagaactt

SEQ ID NO: 107140 - DNA, 22 bp, Homo sapiens
gcttggaagtaggattgggaga

SEQ ID NO: 107141 - DNA, 22 bp, Homo sapiens
tcgcccaggctggaagtgcagt

SEQ ID NO: 107142 - DNA, 22 bp, Homo sapiens
aggctcagatccttgtgtcctg

SEQ ID NO: 107143 - DNA, 23 bp, Homo sapiens
ggctgggagctccgggtgcacgt

SEQ ID NO: 107144 - DNA, 22 bp, Homo sapiens
tctcatggagtcaggagcagaa

SEQ ID NO: 107145 - DNA, 22 bp, Homo sapiens
gtggggtagatctttctcagga

SEQ ID NO: 107146 - DNA, 22 bp, Homo sapiens
gtgtgggctgcagaggcacagc

SEQ ID NO: 107147 - DNA, 22 bp, Homo sapiens
atcacccaagctggagtgcagt

SEQ ID NO: 107148 - DNA, 22 bp, Homo sapiens
ccggtgttcaaagtctggtatg

SEQ ID NO: 107149 - DNA, 22 bp, Homo sapiens
tcttcccccgtgctccagtgca

SEQ ID NO: 107150 - DNA, 18 bp, Homo sapiens
ggtgagggagctggaagc

SEQ ID NO: 107151 - DNA, 22 bp, Homo sapiens
ttgtggttaaccgcacattttt

SEQ ID NO: 107152 - DNA, 22 bp, Homo sapiens
tgatcaaaacattactccacca

SEQ ID NO: 107153 - DNA, 22 bp, Homo sapiens
ttcatatttctttaaggacttt

SEQ ID NO: 107154 - DNA, 22 bp, Homo sapiens
tggtggggccagacttcagctc

SEQ ID NO: 107155 - DNA, 22 bp, Homo sapiens
ctcactgcaagctctgcctcca

SEQ ID NO: 107156 - DNA, 22 bp, Homo sapiens
ccaggaggcagaagttgcagtg

SEQ ID NO: 107157 - DNA, 22 bp, Homo sapiens
gagggtggtggcttaaggtgct

SEQ ID NO: 107158 - DNA, 22 bp, Homo sapiens
tcaggaggtccgcccgggaggg

SEQ ID NO: 107159 - DNA, 22 bp, Homo sapiens
ccaggaggcggaggttgcagcg

SEQ ID NO: 107160 - DNA, 22 bp, Homo sapiens
tctaccctgcggtcttggggca

SEQ ID NO: 107161 - DNA, 22 bp, Homo sapiens
acctggacacctgctgtcatct

SEQ ID NO: 107162 - DNA, 21 bp, Homo sapiens
gcccacagtgaggaggatccc

SEQ ID NO: 107163 - DNA, 22 bp, Homo sapiens
tatcgagctggacgggctggtc

SEQ ID NO: 107164 - DNA, 22 bp, Homo sapiens
gaagaaggtggcccaggggtag

SEQ ID NO: 107165 - DNA, 22 bp, Homo sapiens
agctacctgatccttcttctga

SEQ ID NO: 107166 - DNA, 22 bp, Homo sapiens
caggaaggggctcactctggcc

SEQ ID NO: 107167 - DNA, 22 bp, Homo sapiens
ctgggcagctgtatcagggagt

SEQ ID NO: 107168 - DNA, 22 bp, Homo sapiens
agtgctatcgagttctaatgct

SEQ ID NO: 107169 - DNA, 22 bp, Homo sapiens
gtttcactgcaaactgactttt

SEQ ID NO: 107170 - DNA, 22 bp, Homo sapiens
aagtggactaatacaaggacta

SEQ ID NO: 107171 - DNA, 22 bp, Homo sapiens
tgagatcattgacttgttcctg

SEQ ID NO: 107172 - DNA, 22 bp, Homo sapiens
acccgggaggcaggagtcatag

SEQ ID NO: 107173 - DNA, 22 bp, Homo sapiens
aggttatatgactgtcatgcct

SEQ ID NO: 107174 - DNA, 22 bp, Homo sapiens
aacccgggaggtggaggttatg

SEQ ID NO: 107175 - DNA, 22 bp, Homo sapiens
cccagcagtagagctcatatgg

SEQ ID NO: 107176 - DNA, 22 bp, Homo sapiens
tgtggacgtcattaaagcagtg

SEQ ID NO: 107177 - DNA, 22 bp, Homo sapiens
ccaggaggcggaaggtacagtg

SEQ ID NO: 107178 - DNA, 22 bp, Homo sapiens
caggaggttgagggtgcagtga

SEQ ID NO: 107179 - DNA, 21 bp, Homo sapiens
ctctgaatcctgcttctcagt

SEQ ID NO: 107180 - DNA, 22 bp, Homo sapiens
ggaggcagaatagagtgtgggt

SEQ ID NO: 107181 - DNA, 22 bp, Homo sapiens
acccggagtcggaggttgcagt

SEQ ID NO: 107182 - DNA, 22 bp, Homo sapiens
atggagttgagctctgttgtcc

SEQ ID NO: 107183 - DNA, 22 bp, Homo sapiens
agtggtcttagcttgctgggct

SEQ ID NO: 107184 - DNA, 22 bp, Homo sapiens
gacaattgcttttgccgaataa

SEQ ID NO: 107185 - DNA, 22 bp, Homo sapiens
aggaggaagggaagacaagtaa

SEQ ID NO: 107186 - DNA, 22 bp, Homo sapiens
ttatttaatgtgatctgaagag

SEQ ID NO: 107187 - DNA, 22 bp, Homo sapiens
gggaagagggagctggaatgat

SEQ ID NO: 107188 - DNA, 22 bp, Homo sapiens
aattttctggtgtgtaatgaag

SEQ ID NO: 107189 - DNA, 22 bp, Homo sapiens
gatctggaatctgaaggctgag

SEQ ID NO: 107190 - DNA, 22 bp, Homo sapiens
ctcactgcaacctctgcctccc

SEQ ID NO: 107191 - DNA, 22 bp, Homo sapiens
tgtggcacatacacaggagggc

SEQ ID NO: 107192 - DNA, 22 bp, Homo sapiens
agaggaagtaatcaggacctgc

SEQ ID NO: 107193 - DNA, 22 bp, Homo sapiens
atgatggctaggctggttttga

SEQ ID NO: 107194 - DNA, 17 bp, Homo sapiens
tgtagcttctccttctc

SEQ ID NO: 107195 - DNA, 22 bp, Homo sapiens
ttggccatctaagcccagccac

SEQ ID NO: 107196 - DNA, 22 bp, Homo sapiens
ggcgcccccttcaaacagagca

SEQ ID NO: 107197 - DNA, 22 bp, Homo sapiens
tcaggaggcggaggttgcagtg

SEQ ID NO: 107198 - DNA, 22 bp, Homo sapiens
ggagaagaggagctggaagcct

SEQ ID NO: 107199 - DNA, 19 bp, Homo sapiens
ccagagagctaggtacaga

SEQ ID NO: 107200 - DNA, 22 bp, Homo sapiens
ctacccttaagtttctgtgggg

SEQ ID NO: 107201 - DNA, 22 bp, Homo sapiens
aggtggggaggagtgtctcttt

SEQ ID NO: 107202 - DNA, 22 bp, Homo sapiens
tcagttacttgcttgtttgaaa

SEQ ID NO: 107203 - DNA, 22 bp, Homo sapiens
gttgaaatcctaaccccctagt

SEQ ID NO: 107204 - DNA, 16 bp, Homo sapiens
atgctgctattagagg

SEQ ID NO: 107205 - DNA, 22 bp, Homo sapiens
caaatactacgattcttgcagt

SEQ ID NO: 107206 - DNA, 22 bp, Homo sapiens
ctcactgcaagctctgcctccc

SEQ ID NO: 107207 - DNA, 22 bp, Homo sapiens
ccagaaaaatcctcccttgtcc

SEQ ID NO: 107208 - DNA, 19 bp, Homo sapiens
ttcacattggaagaagtag

SEQ ID NO: 107209 - DNA, 22 bp, Homo sapiens
taattataacagttacatctta

SEQ ID NO: 107210 - DNA, 22 bp, Homo sapiens
tgatgaccgccaacgtttaggt

SEQ ID NO: 107211 - DNA, 16 bp, Homo sapiens
aggctcagaggctgga

SEQ ID NO: 107212 - DNA, 22 bp, Homo sapiens
ccaggaggtggagattgcagtg

SEQ ID NO: 107213 - DNA, 22 bp, Homo sapiens
ccaggaggttgaggctgcagtg

SEQ ID NO: 107214 - DNA, 22 bp, Homo sapiens
tccgggaggcagaggttgcagt

SEQ ID NO: 107215 - DNA, 21 bp, Homo sapiens
gctgctcgagatccagtgctt

SEQ ID NO: 107216 - DNA, 22 bp, Homo sapiens
ctcccagccttcgccagtctga

SEQ ID NO: 107217 - DNA, 22 bp, Homo sapiens
agcggcgccgagcttggccagg

SEQ ID NO: 107218 - DNA, 22 bp, Homo sapiens
tgggaaggggagctggaaagga

SEQ ID NO: 107219 - DNA, 22 bp, Homo sapiens
taagtcaaggtggcatttgaga

SEQ ID NO: 107220 - DNA, 22 bp, Homo sapiens
agggaagaaaatccatcgctgc

SEQ ID NO: 107221 - DNA, 22 bp, Homo sapiens
ccgggagcaggcgccaccgcca

SEQ ID NO: 107222 - DNA, 22 bp, Homo sapiens
gctggtgagcaaaggagaagga

SEQ ID NO: 107223 - DNA, 22 bp, Homo sapiens
ttatttaaaagtggtaagattc

SEQ ID NO: 107224 - DNA, 22 bp, Homo sapiens
tttggtattgcacactgtcttc

SEQ ID NO: 107225 - DNA, 22 bp, Homo sapiens
agtaatcaatttttcggtggat

SEQ ID NO: 107226 - DNA, 22 bp, Homo sapiens
agaggctgcacttgctcatgat

SEQ ID NO: 107227 - DNA, 22 bp, Homo sapiens
ctgagatggagtttcgctcttc

SEQ ID NO: 107228 - DNA, 22 bp, Homo sapiens
ctgaggctggagtgcagtggtg

SEQ ID NO: 107229 - DNA, 22 bp, Homo sapiens
cttcatgctgatatcctcgatg

SEQ ID NO: 107230 - DNA, 22 bp, Homo sapiens
cttgatctacatagtgaaaccc

SEQ ID NO: 107231 - DNA, 22 bp, Homo sapiens
acagtctgtcccccaggtgcta

SEQ ID NO: 107232 - DNA, 22 bp, Homo sapiens
ccaggctggagtgcaatggcgt

SEQ ID NO: 107233 - DNA, 22 bp, Homo sapiens
ggggtgggcgtgcagggacacc

SEQ ID NO: 107234 - DNA, 23 bp, Homo sapiens
cctgcctccccatcagttataca

SEQ ID NO: 107235 - DNA, 22 bp, Homo sapiens
gaggctgaggttgcagtgagcc

SEQ ID NO: 107236 - DNA, 22 bp, Homo sapiens
tgtcctcatcctccagtctgtc

SEQ ID NO: 107237 - DNA, 20 bp, Homo sapiens
gacatgtctttctcacacaa

SEQ ID NO: 107238 - DNA, 22 bp, Homo sapiens
cttctcggggttcccgcgccct

SEQ ID NO: 107239 - DNA, 22 bp, Homo sapiens
ctggccaagatggtgaaacccc

SEQ ID NO: 107240 - DNA, 22 bp, Homo sapiens
tctgagccagggtctcctccct

SEQ ID NO: 107241 - DNA, 22 bp, Homo sapiens
aagaactgtttacaattttcac

SEQ ID NO: 107242 - DNA, 22 bp, Homo sapiens
aagaactgagtacgttaataaa

SEQ ID NO: 107243 - DNA, 22 bp, Homo sapiens
agagaagagtcttgtcaaatta

SEQ ID NO: 107244 - DNA, 22 bp, Homo sapiens
ctgctaaacctctctgagagct

SEQ ID NO: 107245 - DNA, 22 bp, Homo sapiens
ccgaggtcctggacttggccct

SEQ ID NO: 107246 - DNA, 22 bp, Homo sapiens
cagagctgtccaaaccctgaca

SEQ ID NO: 107247 - DNA, 22 bp, Homo sapiens
aagtgctgggattataggcatg

SEQ ID NO: 107248 - DNA, 22 bp, Homo sapiens
gactggtaaggaaattcactaa

SEQ ID NO: 107249 - DNA, 22 bp, Homo sapiens
tgaccctgagagctgaatggct

SEQ ID NO: 107250 - DNA, 22 bp, Homo sapiens
agctcctgaaaatccagactgg

SEQ ID NO: 107251 - DNA, 22 bp, Homo sapiens
caggctgatcagggctgggatg

SEQ ID NO: 107252 - DNA, 22 bp, Homo sapiens
tggagccagagcgcagcctggg

SEQ ID NO: 107253 - DNA, 22 bp, Homo sapiens
cggagcctgcttgttgcagctg

SEQ ID NO: 107254 - DNA, 22 bp, Homo sapiens
tagcccctgcctttgaacctgg

SEQ ID NO: 107255 - DNA, 22 bp, Homo sapiens
agttggagtgaacatgagattg

SEQ ID NO: 107256 - DNA, 22 bp, Homo sapiens
ggggcccctcggacacgtgcgg

SEQ ID NO: 107257 - DNA, 20 bp, Homo sapiens
tgaggcccagcagagtcggg

SEQ ID NO: 107258 - DNA, 22 bp, Homo sapiens
tgtccaggctaaagtgcagtgg

SEQ ID NO: 107259 - DNA, 22 bp, Homo sapiens
aaagattaaatcaaattggtca

SEQ ID NO: 107260 - DNA, 22 bp, Homo sapiens
gttaggatatggtgaaatggag

SEQ ID NO: 107261 - DNA, 22 bp, Homo sapiens
ttgaggtcatctgaagtactag

SEQ ID NO: 107262 - DNA, 20 bp, Homo sapiens
ccagagctgatggctgcccg

SEQ ID NO: 107263 - DNA, 22 bp, Homo sapiens
ccaggctggagtgcagtggcac

SEQ ID NO: 107264 - DNA, 22 bp, Homo sapiens
cgcatgagacctgccggccatc

SEQ ID NO: 107265 - DNA, 19 bp, Homo sapiens
gctgaggtggaggaaggag

SEQ ID NO: 107266 - DNA, 22 bp, Homo sapiens
tactaggaagcagctgcattgg

SEQ ID NO: 107267 - DNA, 20 bp, Homo sapiens
tgtccccaccaaaatttcat

SEQ ID NO: 107268 - DNA, 22 bp, Homo sapiens
gagcactgagctggaattggag

SEQ ID NO: 107269 - DNA, 22 bp, Homo sapiens
tgtgctctgactttctcctggt

SEQ ID NO: 107270 - DNA, 22 bp, Homo sapiens
caccttgtgatcctcttgcctt

SEQ ID NO: 107271 - DNA, 22 bp, Homo sapiens
tctcctggagcccagatgctgg

SEQ ID NO: 107272 - DNA, 22 bp, Homo sapiens
gaggccaaggtgggcagatcac

SEQ ID NO: 107273 - DNA, 22 bp, Homo sapiens
ccctgcctacagggttttcttt

SEQ ID NO: 107274 - DNA, 22 bp, Homo sapiens
atgttggccaggctggtcttga

SEQ ID NO: 107275 - DNA, 22 bp, Homo sapiens
tgcctcagctgaggccgctcca

SEQ ID NO: 107276 - DNA, 22 bp, Homo sapiens
aggtcaccatggcatgctccac

SEQ ID NO: 107277 - DNA, 22 bp, Homo sapiens
aggtcacccgtttgactatcca

SEQ ID NO: 107278 - DNA, 23 bp, Homo sapiens
tcgttgaatagcaatagcacaac

SEQ ID NO: 107279 - DNA, 19 bp, Homo sapiens
cattaggattagagacaag

SEQ ID NO: 107280 - DNA, 22 bp, Homo sapiens
gctcaagccttctgcccacctc

SEQ ID NO: 107281 - DNA, 22 bp, Homo sapiens
ggctgatgggcatgagctgtca

SEQ ID NO: 107282 - DNA, 22 bp, Homo sapiens
gagccaggggtcagctccgagg

SEQ ID NO: 107283 - DNA, 22 bp, Homo sapiens
gaatttaagaggatgaatctgt

SEQ ID NO: 107284 - DNA, 22 bp, Homo sapiens
tgaggctccttgtagagagtgg

SEQ ID NO: 107285 - DNA, 22 bp, Homo sapiens
agtggaccagaagactgaagct

SEQ ID NO: 107286 - DNA, 22 bp, Homo sapiens
ctcctggaggatagtgactggg

SEQ ID NO: 107287 - DNA, 22 bp, Homo sapiens
aatgccttggagagcctagagg

SEQ ID NO: 107288 - DNA, 22 bp, Homo sapiens
ctgagggtcaacttgattgtat

SEQ ID NO: 107289 - DNA, 22 bp, Homo sapiens
gaagccttgaactgcaaacccc

SEQ ID NO: 107290 - DNA, 23 bp, Homo sapiens
actcgtggaattctctgcgatcg

SEQ ID NO: 107291 - DNA, 22 bp, Homo sapiens
ccaggctggagtatagtggcgc

SEQ ID NO: 107292 - DNA, 22 bp, Homo sapiens
accctccccaagaggtcgtgcc

SEQ ID NO: 107293 - DNA, 22 bp, Homo sapiens
acaactccttcttgggtcctgg

SEQ ID NO: 107294 - DNA, 22 bp, Homo sapiens
aggtaaacaggagaaaatgaga

SEQ ID NO: 107295 - DNA, 22 bp, Homo sapiens
gctggaggatggactggaagaa

SEQ ID NO: 107296 - DNA, 22 bp, Homo sapiens
taattataacagttacatctta

SEQ ID NO: 107297 - DNA, 22 bp, Homo sapiens
tctcctggtacccttcctagca

SEQ ID NO: 107298 - DNA, 22 bp, Homo sapiens
cattaggacgccccgcccatac

SEQ ID NO: 107299 - DNA, 20 bp, Homo sapiens
caaatccctgctctgtgctg

SEQ ID NO: 107300 - DNA, 22 bp, Homo sapiens
cggccaagccggggccccgaag

SEQ ID NO: 107301 - DNA, 21 bp, Homo sapiens
atgtagggtttgccttctcta

SEQ ID NO: 107302 - DNA, 20 bp, Homo sapiens
tgagacccgctgacaagttc

SEQ ID NO: 107303 - DNA, 22 bp, Homo sapiens
gctgaggtggaggaaggagacc

SEQ ID NO: 107304 - DNA, 22 bp, Homo sapiens
caccaggctggagtgcagtggc

SEQ ID NO: 107305 - DNA, 16 bp, Homo sapiens
gcgcctcctcggcctc

SEQ ID NO: 107306 - DNA, 22 bp, Homo sapiens
ttttatctgtgacatctggcag

SEQ ID NO: 107307 - DNA, 22 bp, Homo sapiens
aaggctgaggcagtgaggcaga

SEQ ID NO: 107308 - DNA, 22 bp, Homo sapiens
cagcctttgggtcagaagattc

SEQ ID NO: 107309 - DNA, 22 bp, Homo sapiens
gcatctaaataaacgtgggagt

SEQ ID NO: 107310 - DNA, 22 bp, Homo sapiens
gtagttctgcagtgtcacctga

SEQ ID NO: 107311 - DNA, 21 bp, Homo sapiens
cagagctgtccaaaccctgac

SEQ ID NO: 107312 - DNA, 22 bp, Homo sapiens
gagcactgatttatttttgtct

SEQ ID NO: 107313 - DNA, 22 bp, Homo sapiens
taaatacttagttttgtgtcta

SEQ ID NO: 107314 - DNA, 22 bp, Homo sapiens
cgagcatgatgacggctgtggc

SEQ ID NO: 107315 - DNA, 22 bp, Homo sapiens
gggacttcatagctaggcactt

SEQ ID NO: 107316 - DNA, 22 bp, Homo sapiens
ccctggaggttgaggctgcagt

SEQ ID NO: 107317 - DNA, 22 bp, Homo sapiens
ccctggaggcggagcttgcagt

SEQ ID NO: 107318 - DNA, 22 bp, Homo sapiens
agcatgcgcttgatcagctcca

SEQ ID NO: 107319 - DNA, 22 bp, Homo sapiens
aaggctgagacagcacaggtcc

SEQ ID NO: 107320 - DNA, 22 bp, Homo sapiens
ttcaggatccccaccgcgttta

SEQ ID NO: 107321 - DNA, 22 bp, Homo sapiens
gaggctgaggcggatggatcac

SEQ ID NO: 107322 - DNA, 22 bp, Homo sapiens
aagtgctgagactacaggcatg

SEQ ID NO: 107323 - DNA, 22 bp, Homo sapiens
ctcaggatattgggctggagca

SEQ ID NO: 107324 - DNA, 22 bp, Homo sapiens
cttgaaagtcagcagagtggat

SEQ ID NO: 107325 - DNA, 22 bp, Homo sapiens
gtcccataagtagtgcaacttg

SEQ ID NO: 107326 - DNA, 22 bp, Homo sapiens
gaccaaggaagaggggagccag

SEQ ID NO: 107327 - DNA, 22 bp, Homo sapiens
aagcgccatggttcctgcgcag

SEQ ID NO: 107328 - DNA, 22 bp, Homo sapiens
gagcagtgtttgtggacctgga

SEQ ID NO: 107329 - DNA, 20 bp, Homo sapiens
attagagctacatggctaca

SEQ ID NO: 107330 - DNA, 22 bp, Homo sapiens
agagcactttcgagagccggag

SEQ ID NO: 107331 - DNA, 22 bp, Homo sapiens
gaggctgaggttgcagtgagct

SEQ ID NO: 107332 - DNA, 22 bp, Homo sapiens
ttattaggaactcaggattttt

SEQ ID NO: 107333 - DNA, 22 bp, Homo sapiens
gctgcagggagctggaaggctc

SEQ ID NO: 107334 - DNA, 22 bp, Homo sapiens
acatgtttaagtttgttatatg

SEQ ID NO: 107335 - DNA, 22 bp, Homo sapiens
ctggagagaatgtggaatgatt

SEQ ID NO: 107336 - DNA, 22 bp, Homo sapiens
agcataagttggtacagccact

SEQ ID NO: 107337 - DNA, 22 bp, Homo sapiens
ttaagtaacttgtccaaatgag

SEQ ID NO: 107338 - DNA, 22 bp, Homo sapiens
caggctgaagtgcagtggtgtg

SEQ ID NO: 107339 - DNA, 22 bp, Homo sapiens
cttcttatcaagtggcaaatct

SEQ ID NO: 107340 - DNA, 22 bp, Homo sapiens
gggtccctggaattacttgaca

SEQ ID NO: 107341 - DNA, 22 bp, Homo sapiens
aagtagttaggaacattctctc

SEQ ID NO: 107342 - DNA, 22 bp, Homo sapiens
cggggccctggggctgaaggtc

SEQ ID NO: 107343 - DNA, 22 bp, Homo sapiens
aggctgtagtgcatgtgctatg

SEQ ID NO: 107344 - DNA, 22 bp, Homo sapiens
gtggggtagatctttctcagga

SEQ ID NO: 107345 - DNA, 22 bp, Homo sapiens
tacaaaaaattgatactgacga

SEQ ID NO: 107346 - DNA, 22 bp, Homo sapiens
ttgaggtcttcaggatcaggct

SEQ ID NO: 107347 - DNA, 22 bp, Homo sapiens
aagtgctgggattacaggtgtg

SEQ ID NO: 107348 - DNA, 22 bp, Homo sapiens
actattagcatatcatgaatgg

SEQ ID NO: 107349 - DNA, 22 bp, Homo sapiens
tatacactgttgttgggagtct

SEQ ID NO: 107350 - DNA, 22 bp, Homo sapiens
accatgtcatttattggccaaa

SEQ ID NO: 107351 - DNA, 22 bp, Homo sapiens
ccaggctggagtgcaatggcat

SEQ ID NO: 107352 - DNA, 22 bp, Homo sapiens
ctggggtcagggatcagagagc

SEQ ID NO: 107353 - DNA, 22 bp, Homo sapiens
ggcagcactgcagcttgttggg

SEQ ID NO: 107354 - DNA, 22 bp, Homo sapiens
gaaaattattgaaaatggctct

SEQ ID NO: 107355 - DNA, 18 bp, Homo sapiens
cagggctgtggggtcact

SEQ ID NO: 107356 - DNA, 18 bp, Homo sapiens
tgtccctgcaaataacat

SEQ ID NO: 107357 - DNA, 22 bp, Homo sapiens
gatataggttcatagtgttaca

SEQ ID NO: 107358 - DNA, 22 bp, Homo sapiens
ttctaattaaatctacgctagg

SEQ ID NO: 107359 - DNA, 22 bp, Homo sapiens
ggctgcaggttggttggcagct

SEQ ID NO: 107360 - DNA, 22 bp, Homo sapiens
ttgaggtccccagtacccactg

SEQ ID NO: 107361 - DNA, 22 bp, Homo sapiens
tctcgacagcctggcacagtgg

SEQ ID NO: 107362 - DNA, 22 bp, Homo sapiens
catcatcaaaagtgacagagaa

SEQ ID NO: 107363 - DNA, 22 bp, Homo sapiens
tgacagtattgatggcaggatt

SEQ ID NO: 107364 - DNA, 22 bp, Homo sapiens
gagctgagaagcagcgcttgat

SEQ ID NO: 107365 - DNA, 22 bp, Homo sapiens
caaatactacgattcttgcagt

SEQ ID NO: 107366 - DNA, 22 bp, Homo sapiens
aacactgctgctgggttctgtg

SEQ ID NO: 107367 - DNA, 19 bp, Homo sapiens
agggagtttatatttgcac

SEQ ID NO: 107368 - DNA, 22 bp, Homo sapiens
gcaccgccttggaccgcccgct

SEQ ID NO: 107369 - DNA, 22 bp, Homo sapiens
gggctgagacgatggggtcttc

SEQ ID NO: 107370 - DNA, 22 bp, Homo sapiens
gaggctgaggcaggaggatcac

SEQ ID NO: 107371 - DNA, 22 bp, Homo sapiens
ttgagggtctggatctgctgct

SEQ ID NO: 107372 - DNA, 22 bp, Homo sapiens
cagagctggtgtgtcctggcat

SEQ ID NO: 107373 - DNA, 22 bp, Homo sapiens
ctgagatggagttttgctcttg

SEQ ID NO: 107374 - DNA, 22 bp, Homo sapiens
taattataacatgctttctggc

SEQ ID NO: 107375 - DNA, 20 bp, Homo sapiens
aggaaaaatggaaactggag

SEQ ID NO: 107376 - DNA, 22 bp, Homo sapiens
ctgtccccacccaaatctcatc

SEQ ID NO: 107377 - DNA, 22 bp, Homo sapiens
tgtcaccatgcgaggctaattt

SEQ ID NO: 107378 - DNA, 22 bp, Homo sapiens
aatgaattgcagtactgacttg

SEQ ID NO: 107379 - DNA, 22 bp, Homo sapiens
gtggccaacctggccctgaact

SEQ ID NO: 107380 - DNA, 20 bp, Homo sapiens
gctgaggtggaggaaggaga

SEQ ID NO: 107381 - DNA, 22 bp, Homo sapiens
agggactatttacccatctcac

SEQ ID NO: 107382 - DNA, 22 bp, Homo sapiens
tccaactttctcctccggcttg

SEQ ID NO: 107383 - DNA, 23 bp, Homo sapiens
cagtctgcagcccacttgggcag

SEQ ID NO: 107384 - DNA, 22 bp, Homo sapiens
ttcaccttgaatatgtcttaaa

SEQ ID NO: 107385 - DNA, 23 bp, Homo sapiens
cagagctggctcagagctgcctg

SEQ ID NO: 107386 - DNA, 22 bp, Homo sapiens
ttactggctgggcctgagggct

SEQ ID NO: 107387 - DNA, 22 bp, Homo sapiens
ttttaatactgctattgtagga

SEQ ID NO: 107388 - DNA, 21 bp, Homo sapiens
gctcctggtgctgcgtggcgc

SEQ ID NO: 107389 - DNA, 22 bp, Homo sapiens
tttatgtagttacggactatca

SEQ ID NO: 107390 - DNA, 22 bp, Homo sapiens
gcaggctgtctaaagttagagt

SEQ ID NO: 107391 - DNA, 22 bp, Homo sapiens
aggctgagataggtggatcatt

SEQ ID NO: 107392 - DNA, 22 bp, Homo sapiens
tgtccccacccaaatctcatct

SEQ ID NO: 107393 - DNA, 22 bp, Homo sapiens
caaatgaatatttccatgggtt

SEQ ID NO: 107394 - DNA, 22 bp, Homo sapiens
gtggccaaatcatgtcaaaggc

SEQ ID NO: 107395 - DNA, 22 bp, Homo sapiens
agaacgtggaatgtggctcctt

SEQ ID NO: 107396 - DNA, 22 bp, Homo sapiens
ccaggctgctgttggtgtccgc

SEQ ID NO: 107397 - DNA, 20 bp, Homo sapiens
gctgaggggtctatggcata

SEQ ID NO: 107398 - DNA, 22 bp, Homo sapiens
aactcactttgtggcttctgaa

SEQ ID NO: 107399 - DNA, 22 bp, Homo sapiens
ggtcagccttggatttggtagc

SEQ ID NO: 107400 - DNA, 22 bp, Homo sapiens
tggctgagttacgaacagagca

SEQ ID NO: 107401 - DNA, 22 bp, Homo sapiens
gctggccacagatccccaggga

SEQ ID NO: 107402 - DNA, 22 bp, Homo sapiens
agggtcctgggtgcagttgctt

SEQ ID NO: 107403 - DNA, 22 bp, Homo sapiens
taagaaatttagttatagaatg

SEQ ID NO: 107404 - DNA, 22 bp, Homo sapiens
gacaggaggcagagctcaggtg

SEQ ID NO: 107405 - DNA, 22 bp, Homo sapiens
aagaccagcctatgttttccat

SEQ ID NO: 107406 - DNA, 22 bp, Homo sapiens
cgggcaaggcgagactaggccc

SEQ ID NO: 107407 - DNA, 22 bp, Homo sapiens
gtgctccctccttcctcaagga

SEQ ID NO: 107408 - DNA, 20 bp, Homo sapiens
ctgccgaccacagccatgga

SEQ ID NO: 107409 - DNA, 18 bp, Homo sapiens
atggtctcatactgggag

SEQ ID NO: 107410 - DNA, 22 bp, Homo sapiens
actctggccatcttggaccttg

SEQ ID NO: 107411 - DNA, 22 bp, Homo sapiens
tcctgccttgcctgggacatca

SEQ ID NO: 107412 - DNA, 22 bp, Homo sapiens
ataatctttcttttccagatag

SEQ ID NO: 107413 - DNA, 22 bp, Homo sapiens
ttccaaagaagttcacatttac

SEQ ID NO: 107414 - DNA, 23 bp, Homo sapiens
aggatgtaggatgtatggcagag

SEQ ID NO: 107415 - DNA, 22 bp, Homo sapiens
aagtgctgggattacaggcatg

SEQ ID NO: 107416 - DNA, 22 bp, Homo sapiens
gactttctgatgtaaacattta

SEQ ID NO: 107417 - DNA, 22 bp, Homo sapiens
tgtccaggctggagtgcagtgg

SEQ ID NO: 107418 - DNA, 22 bp, Homo sapiens
aagtggactaatacaaggacta

SEQ ID NO: 107419 - DNA, 22 bp, Homo sapiens
gctgctctccaagcctccttga

SEQ ID NO: 107420 - DNA, 22 bp, Homo sapiens
agaggccggccgagcccatggg

SEQ ID NO: 107421 - DNA, 22 bp, Homo sapiens
aagtgctgggattacaggtgtc

SEQ ID NO: 107422 - DNA, 22 bp, Homo sapiens
ttattagagtgctttgagaaag

SEQ ID NO: 107423 - DNA, 22 bp, Homo sapiens
ccagagctgattcctgggactt

SEQ ID NO: 107424 - DNA, 22 bp, Homo sapiens
actttatttcctattgcatcca

SEQ ID NO: 107425 - DNA, 22 bp, Homo sapiens
aggctgaggcaagaggatcact

SEQ ID NO: 107426 - DNA, 21 bp, Homo sapiens
gaccccagaccagcagacaca

SEQ ID NO: 107427 - DNA, 22 bp, Homo sapiens
tccttgactgtgaggaactagc

SEQ ID NO: 107428 - DNA, 22 bp, Homo sapiens
agcactgtgagcaccagcacgc

SEQ ID NO: 107429 - DNA, 22 bp, Homo sapiens
gatagtcacctcccttaacttt

SEQ ID NO: 107430 - DNA, 22 bp, Homo sapiens
tttctggcagcgggacaggggt

SEQ ID NO: 107431 - DNA, 22 bp, Homo sapiens
cagaccagaaggaagccgacaa

SEQ ID NO: 107432 - DNA, 22 bp, Homo sapiens
accccagaggcggaggctgcag

SEQ ID NO: 107433 - DNA, 22 bp, Homo sapiens
agtgctgggctatctactgcta

SEQ ID NO: 107434 - DNA, 22 bp, Homo sapiens
aaagaaatagatggcatttaaa

SEQ ID NO: 107435 - DNA, 22 bp, Homo sapiens
actggccagccaacaacaatag

SEQ ID NO: 107436 - DNA, 22 bp, Homo sapiens
ggccagaagttggaaaagagcc

SEQ ID NO: 107437 - DNA, 22 bp, Homo sapiens
tgtctgcctgcgggccggcaca

SEQ ID NO: 107438 - DNA, 22 bp, Homo sapiens
tgctgagcgcatccggcggccg

SEQ ID NO: 107439 - DNA, 22 bp, Homo sapiens
ctgaagagaaagggagctcttc

SEQ ID NO: 107440 - DNA, 22 bp, Homo sapiens
agctcaatgcaacctccgcctc

SEQ ID NO: 107441 - DNA, 22 bp, Homo sapiens
cctcggaggcggaggctgcagt

SEQ ID NO: 107442 - DNA, 19 bp, Homo sapiens
gcccacggccctgctctgc

SEQ ID NO: 107443 - DNA, 22 bp, Homo sapiens
agaggaggctctgggatcgtcc

SEQ ID NO: 107444 - DNA, 22 bp, Homo sapiens
aagcccttggcgcacaccgggc

SEQ ID NO: 107445 - DNA, 22 bp, Homo sapiens
tcgagctctggagccaaggatg

SEQ ID NO: 107446 - DNA, 22 bp, Homo sapiens
gatagtcacctcccttaacttt

SEQ ID NO: 107447 - DNA, 22 bp, Homo sapiens
tgggaggccgaggcaggtggat

SEQ ID NO: 107448 - DNA, 22 bp, Homo sapiens
tgattcatcagaataggagttt

SEQ ID NO: 107449 - DNA, 22 bp, Homo sapiens
atccccctcttggatggcggca

SEQ ID NO: 107450 - DNA, 22 bp, Homo sapiens
ggctcacgcaattatcccggcc

SEQ ID NO: 107451 - DNA, 22 bp, Homo sapiens
ctgggcagctgtatcagggagt

SEQ ID NO: 107452 - DNA, 22 bp, Homo sapiens
aactaatacattaatacatgtg

SEQ ID NO: 107453 - DNA, 22 bp, Homo sapiens
agccaggatggtctcgatcggc

SEQ ID NO: 107454 - DNA, 22 bp, Homo sapiens
gcccagccacagtcactttcat

SEQ ID NO: 107455 - DNA, 22 bp, Homo sapiens
gcagggtctgaggccacagagg

SEQ ID NO: 107456 - DNA, 22 bp, Homo sapiens
ctagttctagatccctgaggaa

SEQ ID NO: 107457 - DNA, 22 bp, Homo sapiens
acttcttcttcagctgggggat

SEQ ID NO: 107458 - DNA, 22 bp, Homo sapiens
gtcctggggattatagagtgtt

SEQ ID NO: 107459 - DNA, 22 bp, Homo sapiens
gcctggccgggtcttggatttt

SEQ ID NO: 107460 - DNA, 22 bp, Homo sapiens
acactgtgtgacttctgagact

SEQ ID NO: 107461 - DNA, 22 bp, Homo sapiens
atatacacatctttttaaatat

SEQ ID NO: 107462 - DNA, 22 bp, Homo sapiens
gtcttgatctcctgaccttgtg

SEQ ID NO: 107463 - DNA, 22 bp, Homo sapiens
actgcaacacctcctgggttca

SEQ ID NO: 107464 - DNA, 22 bp, Homo sapiens
cagggcctcctaaggcatctaa

SEQ ID NO: 107465 - DNA, 22 bp, Homo sapiens
cacggccactgcagcaccccag

SEQ ID NO: 107466 - DNA, 23 bp, Homo sapiens
ggagcctccggtgtgtgagaggc

SEQ ID NO: 107467 - DNA, 22 bp, Homo sapiens
gaccctgtttctacaaataatt

SEQ ID NO: 107468 - DNA, 22 bp, Homo sapiens
aggcttttctccagaatgtact

SEQ ID NO: 107469 - DNA, 22 bp, Homo sapiens
gaatttcctctaaacccctgag

SEQ ID NO: 107470 - DNA, 22 bp, Homo sapiens
caccagtgtttacctgtgacaa

SEQ ID NO: 107471 - DNA, 22 bp, Homo sapiens
ggccgtgctccaaagtcatcgt

SEQ ID NO: 107472 - DNA, 22 bp, Homo sapiens
tgacctattagatttccttgcc

SEQ ID NO: 107473 - DNA, 22 bp, Homo sapiens
attcacagggggagaagggtat

SEQ ID NO: 107474 - DNA, 22 bp, Homo sapiens
accattgccccctagtgtctgt

SEQ ID NO: 107475 - DNA, 22 bp, Homo sapiens
ctgctcttcacactacacccgt

SEQ ID NO: 107476 - DNA, 22 bp, Homo sapiens
ctgctccccagcctgcgccttt

SEQ ID NO: 107477 - DNA, 22 bp, Homo sapiens
gtccacagctctgaggtctccc

SEQ ID NO: 107478 - DNA, 20 bp, Homo sapiens
tcccccactgtttctgctac

SEQ ID NO: 107479 - DNA, 22 bp, Homo sapiens
atctcagttcaggctccactgt

SEQ ID NO: 107480 - DNA, 22 bp, Homo sapiens
cctgtggcgggggccagtgcct

SEQ ID NO: 107481 - DNA, 22 bp, Homo sapiens
agcccagaggctgggcgtgcat

SEQ ID NO: 107482 - DNA, 22 bp, Homo sapiens
taaaatttgtccctgagtgttg

SEQ ID NO: 107483 - DNA, 22 bp, Homo sapiens
ccactgtgcccagcctcatggg

SEQ ID NO: 107484 - DNA, 22 bp, Homo sapiens
tctcgctctgtcgcccaggctg

SEQ ID NO: 107485 - DNA, 22 bp, Homo sapiens
gagtgtgtcggtcagcgtggcg

SEQ ID NO: 107486 - DNA, 22 bp, Homo sapiens
aggccagcctcaggcagggacc

SEQ ID NO: 107487 - DNA, 22 bp, Homo sapiens
cttagatgaagtcacagaaccc

SEQ ID NO: 107488 - DNA, 22 bp, Homo sapiens
agtgctgtctccttcccccggg

SEQ ID NO: 107489 - DNA, 22 bp, Homo sapiens
ttatttaaaagtggtaagattc

SEQ ID NO: 107490 - DNA, 22 bp, Homo sapiens
ccctgctgtcaggtgctgggag

SEQ ID NO: 107491 - DNA, 22 bp, Homo sapiens
gcactgcaggtgggtggagagg

SEQ ID NO: 107492 - DNA, 22 bp, Homo sapiens
agaggcaggaggttgacttgag

SEQ ID NO: 107493 - DNA, 22 bp, Homo sapiens
caggaggacatactggctcaca

SEQ ID NO: 107494 - DNA, 22 bp, Homo sapiens
ctgaggtgtgaaatggtggcaa

SEQ ID NO: 107495 - DNA, 22 bp, Homo sapiens
aggactgggtgcagagggcatc

SEQ ID NO: 107496 - DNA, 22 bp, Homo sapiens
gtccaggcctgcctctgaggag

SEQ ID NO: 107497 - DNA, 22 bp, Homo sapiens
atgccactgcacttcagcttgg

SEQ ID NO: 107498 - DNA, 22 bp, Homo sapiens
ggtgactggtttatctggcagt

SEQ ID NO: 107499 - DNA, 22 bp, Homo sapiens
tggtatgtaaattgtaactcaa

SEQ ID NO: 107500 - DNA, 22 bp, Homo sapiens
ttgtgaatagtgccgctataaa

SEQ ID NO: 107501 - DNA, 22 bp, Homo sapiens
tccgcccgcacgtatggagtgg

SEQ ID NO: 107502 - DNA, 17 bp, Homo sapiens
gtaaggcttgcagatgc

SEQ ID NO: 107503 - DNA, 23 bp, Homo sapiens
aggcgagctcttctccagcacgt

SEQ ID NO: 107504 - DNA, 22 bp, Homo sapiens
ccagcctggttcagaattggct

SEQ ID NO: 107505 - DNA, 22 bp, Homo sapiens
tgttttaagctctagaagggga

SEQ ID NO: 107506 - DNA, 22 bp, Homo sapiens
ggctcctgggggtgctcctgcc

SEQ ID NO: 107507 - DNA, 22 bp, Homo sapiens
catgtaaagaatttcacacaag

SEQ ID NO: 107508 - DNA, 22 bp, Homo sapiens
agcctggtttaagcattttata

SEQ ID NO: 107509 - DNA, 22 bp, Homo sapiens
gcctggattccttgtttctcag

SEQ ID NO: 107510 - DNA, 22 bp, Homo sapiens
ctgatgaggatatagatacaca

SEQ ID NO: 107511 - DNA, 22 bp, Homo sapiens
ctgggtggcagagcctgcagtg

SEQ ID NO: 107512 - DNA, 22 bp, Homo sapiens
atggggctgttctctgccctgc

SEQ ID NO: 107513 - DNA, 22 bp, Homo sapiens
ttacaattacttgatctcagct

SEQ ID NO: 107514 - DNA, 22 bp, Homo sapiens
tctccccagtatggattctctg

SEQ ID NO: 107515 - DNA, 22 bp, Homo sapiens
tcaggggcttgaggtgcatgtc

SEQ ID NO: 107516 - DNA, 22 bp, Homo sapiens
acattaaacttgcttggctgta

SEQ ID NO: 107517 - DNA, 22 bp, Homo sapiens
tcagggattgcaaaattcatcc

SEQ ID NO: 107518 - DNA, 22 bp, Homo sapiens
ctcactgcaagttccacctacc

SEQ ID NO: 107519 - DNA, 22 bp, Homo sapiens
ctgctctgctgatcagtgtctc

SEQ ID NO: 107520 - DNA, 22 bp, Homo sapiens
gcagcctcaaactccccagctc

SEQ ID NO: 107521 - DNA, 22 bp, Homo sapiens
gaaactctcgcatcctgggaac

SEQ ID NO: 107522 - DNA, 22 bp, Homo sapiens
aggtggagaagagatgggcagt

SEQ ID NO: 107523 - DNA, 22 bp, Homo sapiens
gggctgcatcagcaggacccgg

SEQ ID NO: 107524 - DNA, 22 bp, Homo sapiens
actgggcctgattgggtcggag

SEQ ID NO: 107525 - DNA, 16 bp, Homo sapiens
tgggtgggaggagcgg

SEQ ID NO: 107526 - DNA, 22 bp, Homo sapiens
tgcagtttaaacttggcaactt

SEQ ID NO: 107527 - DNA, 22 bp, Homo sapiens
gcctgcagggcctgggcctacc

SEQ ID NO: 107528 - DNA, 21 bp, Homo sapiens
tcgtgcagcagctgaggcttg

SEQ ID NO: 107529 - DNA, 22 bp, Homo sapiens
cagcatgaatgtgttcgtaggg

SEQ ID NO: 107530 - DNA, 22 bp, Homo sapiens
acagacaagtagttcagacaag

SEQ ID NO: 107531 - DNA, 23 bp, Homo sapiens
atcattactttgataccttttct

SEQ ID NO: 107532 - DNA, 20 bp, Homo sapiens
gaaatgtacacattaccaca

SEQ ID NO: 107533 - DNA, 22 bp, Homo sapiens
ctgctttaaaactgatacatga

SEQ ID NO: 107534 - DNA, 22 bp, Homo sapiens
agagaagagtcttgtcaaatta

SEQ ID NO: 107535 - DNA, 20 bp, Homo sapiens
tgtttgtgtggggccttggc

SEQ ID NO: 107536 - DNA, 22 bp, Homo sapiens
agcgccactgcactccagcctg

SEQ ID NO: 107537 - DNA, 21 bp, Homo sapiens
gggcagaggggcctcctgggt

SEQ ID NO: 107538 - DNA, 22 bp, Homo sapiens
agatcggctttgcagacctcat

SEQ ID NO: 107539 - DNA, 19 bp, Homo sapiens
tggctctgtcgaaggcaca

SEQ ID NO: 107540 - DNA, 22 bp, Homo sapiens
ttgtatgtggcaaatgggggag

SEQ ID NO: 107541 - DNA, 22 bp, Homo sapiens
gcccagagttcaaggctgcagt

SEQ ID NO: 107542 - DNA, 20 bp, Homo sapiens
ctgggtggcaagcaaggggg

SEQ ID NO: 107543 - DNA, 22 bp, Homo sapiens
cttgtcagccaattgtggattt

SEQ ID NO: 107544 - DNA, 22 bp, Homo sapiens
tggagggcatgctgtccatggg

SEQ ID NO: 107545 - DNA, 22 bp, Homo sapiens
tctgacattttgagaatgacat

SEQ ID NO: 107546 - DNA, 22 bp, Homo sapiens
ctgaggcaggcagatcacttga

SEQ ID NO: 107547 - DNA, 22 bp, Homo sapiens
gtcaggactctgacccgtcccg

SEQ ID NO: 107548 - DNA, 22 bp, Homo sapiens
ccacccttgggttcggaggccg

SEQ ID NO: 107549 - DNA, 22 bp, Homo sapiens
actccacatttgaacacagttc

SEQ ID NO: 107550 - DNA, 22 bp, Homo sapiens
ccggcgtctcttccacttccta

SEQ ID NO: 107551 - DNA, 22 bp, Homo sapiens
gcctccggagttgcagtgtctt

SEQ ID NO: 107552 - DNA, 22 bp, Homo sapiens
caagtctgacctctgggtgaag

SEQ ID NO: 107553 - DNA, 22 bp, Homo sapiens
gcagagccatgggaggtttttg

SEQ ID NO: 107554 - DNA, 22 bp, Homo sapiens
tcccagcgcggggggaggatcc

SEQ ID NO: 107555 - DNA, 22 bp, Homo sapiens
aacccgggaggcagaggttgtg

SEQ ID NO: 107556 - DNA, 22 bp, Homo sapiens
agtgggccggacagcccaggcc

SEQ ID NO: 107557 - DNA, 18 bp, Homo sapiens
gatcgggggcgccccaag

SEQ ID NO: 107558 - DNA, 22 bp, Homo sapiens
gggagaggttacccgagcaact

SEQ ID NO: 107559 - DNA, 22 bp, Homo sapiens
ggcctttgcgtccacgccgctt

SEQ ID NO: 107560 - DNA, 22 bp, Homo sapiens
gactttgtgccaaacgccagaa

SEQ ID NO: 107561 - DNA, 22 bp, Homo sapiens
aatgctctttaacctattctga

SEQ ID NO: 107562 - DNA, 22 bp, Homo sapiens
agctgccgatgcccagctgcat

SEQ ID NO: 107563 - DNA, 23 bp, Homo sapiens
gtgcatgtgtctttacagtagca

SEQ ID NO: 107564 - DNA, 22 bp, Homo sapiens
aggctgagataggtggatcatt

SEQ ID NO: 107565 - DNA, 22 bp, Homo sapiens
aaatgtaagtctttgtttctta

SEQ ID NO: 107566 - DNA, 22 bp, Homo sapiens
attgtgaatagtgccgcagtaa

SEQ ID NO: 107567 - DNA, 22 bp, Homo sapiens
gctgggacaacaggtgagcacc

SEQ ID NO: 107568 - DNA, 19 bp, Homo sapiens
tctcaattctccccactgc

SEQ ID NO: 107569 - DNA, 22 bp, Homo sapiens
gcccaggctggagtgcagtggt

SEQ ID NO: 107570 - DNA, 23 bp, Homo sapiens
tcctcgcaggagggagatgatgc

SEQ ID NO: 107571 - DNA, 22 bp, Homo sapiens
cctgggaggctgaggctgcagt

SEQ ID NO: 107572 - DNA, 22 bp, Homo sapiens
gtagcccacctggggagggcga

SEQ ID NO: 107573 - DNA, 22 bp, Homo sapiens
gtgtgaaagcttgtcctctgta

SEQ ID NO: 107574 - DNA, 22 bp, Homo sapiens
gggggagagacgagcggctctg

SEQ ID NO: 107575 - DNA, 22 bp, Homo sapiens
gagctcatccccatggtccgtc

SEQ ID NO: 107576 - DNA, 22 bp, Homo sapiens
tccacaaggcagctcctccagg

SEQ ID NO: 107577 - DNA, 22 bp, Homo sapiens
gaatatcccgctatgcaaagta

SEQ ID NO: 107578 - DNA, 22 bp, Homo sapiens
tagaatgtaaattccaagggca

SEQ ID NO: 107579 - DNA, 22 bp, Homo sapiens
ggtccccgtggaggctggagcg

SEQ ID NO: 107580 - DNA, 22 bp, Homo sapiens
tggcactgaagctggaaagcct

SEQ ID NO: 107581 - DNA, 22 bp, Homo sapiens
ttccctaatgtctaacgctatt

SEQ ID NO: 107582 - DNA, 22 bp, Homo sapiens
gtgggccagcttttctcctggg

SEQ ID NO: 107583 - DNA, 21 bp, Homo sapiens
tagcccttctccacctcgccc

SEQ ID NO: 107584 - DNA, 22 bp, Homo sapiens
taggtttcagaggtgccgggaa

SEQ ID NO: 107585 - DNA, 22 bp, Homo sapiens
agaaatatgctgattagatgaa

SEQ ID NO: 107586 - DNA, 22 bp, Homo sapiens
ggtttattgttaataagtttga

SEQ ID NO: 107587 - DNA, 21 bp, Homo sapiens
tcacgtggtcacatgagcttt

SEQ ID NO: 107588 - DNA, 22 bp, Homo sapiens
cagggccctgctcaatttctcc

SEQ ID NO: 107589 - DNA, 22 bp, Homo sapiens
gctgccaatccagctgtgggag

SEQ ID NO: 107590 - DNA, 22 bp, Homo sapiens
aggcaatcccctgaggatactt

SEQ ID NO: 107591 - DNA, 22 bp, Homo sapiens
tgcaccctcatcagtcaaatgg

SEQ ID NO: 107592 - DNA, 22 bp, Homo sapiens
atatatttgagaatattcatga

SEQ ID NO: 107593 - DNA, 22 bp, Homo sapiens
agtccaggcattccagccattc

SEQ ID NO: 107594 - DNA, 22 bp, Homo sapiens
gaagagtggttatccctgctgt

SEQ ID NO: 107595 - DNA, 22 bp, Homo sapiens
tatgctctgagacctttgtgca

SEQ ID NO: 107596 - DNA, 22 bp, Homo sapiens
ctgactgggttaagttcatgta

SEQ ID NO: 107597 - DNA, 22 bp, Homo sapiens
ggtgacctcacctggtcccacc

SEQ ID NO: 107598 - DNA, 18 bp, Homo sapiens
atggtctcatactgggag

SEQ ID NO: 107599 - DNA, 22 bp, Homo sapiens
cctgggggccaggaaggtgtga

SEQ ID NO: 107600 - DNA, 22 bp, Homo sapiens
agcccaggttgaggctgcagtg

SEQ ID NO: 107601 - DNA, 22 bp, Homo sapiens
ctccaggccatggctgcggagg

SEQ ID NO: 107602 - DNA, 22 bp, Homo sapiens
gggaggttctgttcgcacttga

SEQ ID NO: 107603 - DNA, 22 bp, Homo sapiens
ggcatcttgttgctcaaatcta

SEQ ID NO: 107604 - DNA, 22 bp, Homo sapiens
ctagttgaagaggctgtcatca

SEQ ID NO: 107605 - DNA, 22 bp, Homo sapiens
gacagctccagctcctccaggc

SEQ ID NO: 107606 - DNA, 18 bp, Homo sapiens
tgtccctgcaaataacat

SEQ ID NO: 107607 - DNA, 22 bp, Homo sapiens
cttaatctcacctgcaaagtcc

SEQ ID NO: 107608 - DNA, 22 bp, Homo sapiens
cctgcgcgtctgggtctgtctc

SEQ ID NO: 107609 - DNA, 22 bp, Homo sapiens
aggattgtgcctccagtcagaa

SEQ ID NO: 107610 - DNA, 22 bp, Homo sapiens
gtcatcttgctgttttagatct

SEQ ID NO: 107611 - DNA, 22 bp, Homo sapiens
ggcctcgcggcttctggtggct

SEQ ID NO: 107612 - DNA, 22 bp, Homo sapiens
cttctttcaagaatggattagg

SEQ ID NO: 107613 - DNA, 22 bp, Homo sapiens
tccgggttttacactcacatca

SEQ ID NO: 107614 - DNA, 22 bp, Homo sapiens
aagccctggcgggtggagggcc

SEQ ID NO: 107615 - DNA, 22 bp, Homo sapiens
cggggccctggggctgaaggtc

SEQ ID NO: 107616 - DNA, 22 bp, Homo sapiens
gtgggggcaggcagtgctagga

SEQ ID NO: 107617 - DNA, 22 bp, Homo sapiens
atcaaatacaaagggcataagg

SEQ ID NO: 107618 - DNA, 22 bp, Homo sapiens
gggccagtgaacaatgagggaa

SEQ ID NO: 107619 - DNA, 22 bp, Homo sapiens
ggatgttctggggttctcttgt

SEQ ID NO: 107620 - DNA, 22 bp, Homo sapiens
atgtcttctctgtaggtaaatt

SEQ ID NO: 107621 - DNA, 22 bp, Homo sapiens
aaggctcggcaatgtgcggctc

SEQ ID NO: 107622 - DNA, 22 bp, Homo sapiens
agagcccctgggtcacacagcc

SEQ ID NO: 107623 - DNA, 22 bp, Homo sapiens
tcatcagaggcatctggcaagg

SEQ ID NO: 107624 - DNA, 22 bp, Homo sapiens
cttgatctacatagtgaaaccc

SEQ ID NO: 107625 - DNA, 22 bp, Homo sapiens
ccggtcccaggtgccccggtga

SEQ ID NO: 107626 - DNA, 22 bp, Homo sapiens
agtactgtcagcagggtgttga

SEQ ID NO: 107627 - DNA, 22 bp, Homo sapiens
gccttgatctgctgtgtttgag

SEQ ID NO: 107628 - DNA, 23 bp, Homo sapiens
ttggcaaagcctatgaagtcctc

SEQ ID NO: 107629 - DNA, 22 bp, Homo sapiens
ccaggaggtggagattgcagtg

SEQ ID NO: 107630 - DNA, 22 bp, Homo sapiens
tcttgaatctaatgcagtttct

SEQ ID NO: 107631 - DNA, 22 bp, Homo sapiens
agggctctgagtgggaaagagg

SEQ ID NO: 107632 - DNA, 22 bp, Homo sapiens
aggagcaccattgtgctggtgt

SEQ ID NO: 107633 - DNA, 22 bp, Homo sapiens
atctggttttggctgtgtccct

SEQ ID NO: 107634 - DNA, 22 bp, Homo sapiens
tcgggctcgctctcctagcgga

SEQ ID NO: 107635 - DNA, 22 bp, Homo sapiens
tttcataatactgtacatgaaa

SEQ ID NO: 107636 - DNA, 22 bp, Homo sapiens
gaccttgtgatccagccacctt

SEQ ID NO: 107637 - DNA, 22 bp, Homo sapiens
ccaaagtgctggggttacaggc

SEQ ID NO: 107638 - DNA, 22 bp, Homo sapiens
aattacagtcggagcagcactg

SEQ ID NO: 107639 - DNA, 22 bp, Homo sapiens
ccctctacagggaagcgctttc

SEQ ID NO: 107640 - DNA, 22 bp, Homo sapiens
agtcggaagctgtgcgtaaatc

SEQ ID NO: 107641 - DNA, 22 bp, Homo sapiens
aataaaatggtcagttttctca

SEQ ID NO: 107642 - DNA, 22 bp, Homo sapiens
aggtcacccgtttgactatcca

SEQ ID NO: 107643 - DNA, 22 bp, Homo sapiens
ggggtgggcgtgcagggacacc

SEQ ID NO: 107644 - DNA, 22 bp, Homo sapiens
gaggggctgccctggtgtcagg

SEQ ID NO: 107645 - DNA, 22 bp, Homo sapiens
gtgtatgttctacttaatatta

SEQ ID NO: 107646 - DNA, 22 bp, Homo sapiens
gctccccaaaagctccaggaaa

SEQ ID NO: 107647 - DNA, 20 bp, Homo sapiens
atggggtgagtgacgccctc

SEQ ID NO: 107648 - DNA, 22 bp, Homo sapiens
caatttctaacattccatggat

SEQ ID NO: 107649 - DNA, 22 bp, Homo sapiens
ctggtgtggactccgcgcggag

SEQ ID NO: 107650 - DNA, 22 bp, Homo sapiens
tgttaaatgctcagctcgggga

SEQ ID NO: 107651 - DNA, 22 bp, Homo sapiens
aaccaccattctctcctcttcc

SEQ ID NO: 107652 - DNA, 22 bp, Homo sapiens
tggatctcggcaatgcgggact

SEQ ID NO: 107653 - DNA, 22 bp, Homo sapiens
catcccttcccccgagcatggc

SEQ ID NO: 107654 - DNA, 22 bp, Homo sapiens
cccaggaggcagatgttgcagt

SEQ ID NO: 107655 - DNA, 22 bp, Homo sapiens
ggtgacagtggttaaaatttgt

SEQ ID NO: 107656 - DNA, 22 bp, Homo sapiens
gaccttcttgctgtgtcctaac

SEQ ID NO: 107657 - DNA, 22 bp, Homo sapiens
tgtcttcagcagtcatctgggg

SEQ ID NO: 107658 - DNA, 22 bp, Homo sapiens
aggtcaccatggcatgctccac

SEQ ID NO: 107659 - DNA, 22 bp, Homo sapiens
cgtaggtggctcagcacctggg

SEQ ID NO: 107660 - DNA, 22 bp, Homo sapiens
cccagagcatgtgctgcctttg

SEQ ID NO: 107661 - DNA, 22 bp, Homo sapiens
cgtgccactgcactctagcctg

SEQ ID NO: 107662 - DNA, 22 bp, Homo sapiens
caggcagaagaagtggaaggac

SEQ ID NO: 107663 - DNA, 22 bp, Homo sapiens
agagggtgggcacgtgatggat

SEQ ID NO: 107664 - DNA, 22 bp, Homo sapiens
agcgggtctgcaagccttccct

SEQ ID NO: 107665 - DNA, 22 bp, Homo sapiens
tgggggacaccagtctctctct

SEQ ID NO: 107666 - DNA, 22 bp, Homo sapiens
tgggggtgtcctggtgcacaca

SEQ ID NO: 107667 - DNA, 20 bp, Homo sapiens
gccaacgcgctggggctgcc

SEQ ID NO: 107668 - DNA, 22 bp, Homo sapiens
gtggaggagaggcgccttgcgg

SEQ ID NO: 107669 - DNA, 22 bp, Homo sapiens
tccagggccatctccatgaggc

SEQ ID NO: 107670 - DNA, 22 bp, Homo sapiens
gggcggggggagctggaatgaa

SEQ ID NO: 107671 - DNA, 22 bp, Homo sapiens
gcccccgtagtagatgaggcgc

SEQ ID NO: 107672 - DNA, 22 bp, Homo sapiens
atgaggcaggtggaggctgcca

SEQ ID NO: 107673 - DNA, 23 bp, Homo sapiens
ggcctcagtgatgatgggttaaa

SEQ ID NO: 107674 - DNA, 22 bp, Homo sapiens
ccttacactgcctggggccacg

SEQ ID NO: 107675 - DNA, 22 bp, Homo sapiens
caggaaggggctcactctggcc

SEQ ID NO: 107676 - DNA, 19 bp, Homo sapiens
taggaccctggtggccccc

SEQ ID NO: 107677 - DNA, 22 bp, Homo sapiens
gtgggcatcaccagggcctcca

SEQ ID NO: 107678 - DNA, 22 bp, Homo sapiens
catataaatacaacatgtgtta

SEQ ID NO: 107679 - DNA, 22 bp, Homo sapiens
tctgagccagggtctcctccct

SEQ ID NO: 107680 - DNA, 22 bp, Homo sapiens
tttgccctttctgagcctcatc

SEQ ID NO: 107681 - DNA, 22 bp, Homo sapiens
tggagccagagcgcagcctggg

SEQ ID NO: 107682 - DNA, 22 bp, Homo sapiens
tgagtcatgtaataatgctgct

SEQ ID NO: 107683 - DNA, 22 bp, Homo sapiens
cttgtattaggaagaatgcttt

SEQ ID NO: 107684 - DNA, 22 bp, Homo sapiens
catctttgcccatccacttcca

SEQ ID NO: 107685 - DNA, 22 bp, Homo sapiens
cacgttaacagctaacagatga

SEQ ID NO: 107686 - DNA, 22 bp, Homo sapiens
gaggcagaagttgcagtgagca

SEQ ID NO: 107687 - DNA, 22 bp, Homo sapiens
ggttccacctggcgaggggtat

SEQ ID NO: 107688 - DNA, 22 bp, Homo sapiens
cccaggagttggaggctgcagt

SEQ ID NO: 107689 - DNA, 20 bp, Homo sapiens
aggaaaaatggaaactggag

SEQ ID NO: 107690 - DNA, 22 bp, Homo sapiens
ctcctccacccgctggggccca

SEQ ID NO: 107691 - DNA, 18 bp, Homo sapiens
tctggaacaacttcatgt

SEQ ID NO: 107692 - DNA, 22 bp, Homo sapiens
tcctcggctgggccccaggctt

SEQ ID NO: 107693 - DNA, 22 bp, Homo sapiens
gctcactgcaacctctgcctcc

SEQ ID NO: 107694 - DNA, 21 bp, Homo sapiens
gaccccagaccagcagacaca

SEQ ID NO: 107695 - DNA, 21 bp, Homo sapiens
gtggttctagagaaacagaat

SEQ ID NO: 107696 - DNA, 22 bp, Homo sapiens
aaatcgcttgaacccaggaagt

SEQ ID NO: 107697 - DNA, 22 bp, Homo sapiens
gctgatggaaggacaggcgccg

SEQ ID NO: 107698 - DNA, 22 bp, Homo sapiens
tacgcctgtaatcccagcactt

SEQ ID NO: 107699 - DNA, 22 bp, Homo sapiens
tcactgcaagctcagcctcccg

SEQ ID NO: 107700 - DNA, 22 bp, Homo sapiens
caggctgctgacaggcttggag

SEQ ID NO: 107701 - DNA, 22 bp, Homo sapiens
atgccacttcattccagcctcg

SEQ ID NO: 107702 - DNA, 23 bp, Homo sapiens
ggatggacgtgatgccttagcca

SEQ ID NO: 107703 - DNA, 22 bp, Homo sapiens
tgaggcaggaggttgagaactg

SEQ ID NO: 107704 - DNA, 22 bp, Homo sapiens
acagagcaatgcgtgttctcta

SEQ ID NO: 107705 - DNA, 22 bp, Homo sapiens
tgaggcaggacttgcataaagt

SEQ ID NO: 107706 - DNA, 22 bp, Homo sapiens
ctctgtagaaagagcccaggtg

SEQ ID NO: 107707 - DNA, 22 bp, Homo sapiens
tgaggcaggaggattgcaggat

SEQ ID NO: 107708 - DNA, 22 bp, Homo sapiens
agggaagaaaatccatcgctgc

SEQ ID NO: 107709 - DNA, 22 bp, Homo sapiens
gaccttgtgatccacccgcctt

SEQ ID NO: 107710 - DNA, 22 bp, Homo sapiens
tcactgcaacctctgcctgcca

SEQ ID NO: 107711 - DNA, 22 bp, Homo sapiens
tgtctcatctcttaaccccact

SEQ ID NO: 107712 - DNA, 22 bp, Homo sapiens
gttgcagatgtggaactcgtgc

SEQ ID NO: 107713 - DNA, 22 bp, Homo sapiens
gatttgtggtgtgaggaagagc

SEQ ID NO: 107714 - DNA, 22 bp, Homo sapiens
ctattattagataatctacttg

SEQ ID NO: 107715 - DNA, 22 bp, Homo sapiens
gtgtgggctgcagaggcacagc

SEQ ID NO: 107716 - DNA, 22 bp, Homo sapiens
gtagtcccagctaccccggagg

SEQ ID NO: 107717 - DNA, 22 bp, Homo sapiens
aagagggctgcaatcttattgc

SEQ ID NO: 107718 - DNA, 22 bp, Homo sapiens
agcttagtggttgtatgagtta

SEQ ID NO: 107719 - DNA, 22 bp, Homo sapiens
tcactgcactccagcctgggca

SEQ ID NO: 107720 - DNA, 22 bp, Homo sapiens
tgctgctccccagcacacagca

SEQ ID NO: 107721 - DNA, 22 bp, Homo sapiens
tgttttaagggtcaactgtcac

SEQ ID NO: 107722 - DNA, 22 bp, Homo sapiens
agggactatttacccatctcac

SEQ ID NO: 107723 - DNA, 22 bp, Homo sapiens
agatcacagtggcaactccctt

SEQ ID NO: 107724 - DNA, 22 bp, Homo sapiens
gcctcactgcagccccaggaag

SEQ ID NO: 107725 - DNA, 22 bp, Homo sapiens
acccaggctggagtgcagtgat

SEQ ID NO: 107726 - DNA, 22 bp, Homo sapiens
aggcaaggtgctacagacagtg

SEQ ID NO: 107727 - DNA, 22 bp, Homo sapiens
ccgggcgggggctctcgtcacc

SEQ ID NO: 107728 - DNA, 22 bp, Homo sapiens
cagtctctaaatcaatctgaat

SEQ ID NO: 107729 - DNA, 22 bp, Homo sapiens
cccaggaggtggagcttgcagt

SEQ ID NO: 107730 - DNA, 22 bp, Homo sapiens
tgagtactgatttaagatacac

SEQ ID NO: 107731 - DNA, 22 bp, Homo sapiens
caggctggagtgcagtggggcg

SEQ ID NO: 107732 - DNA, 22 bp, Homo sapiens
gaccttgtgatccacccgcttt

SEQ ID NO: 107733 - DNA, 22 bp, Homo sapiens
tttaatcaggcaaagcataata

SEQ ID NO: 107734 - DNA, 22 bp, Homo sapiens
tggctgtgtccctgtccagagt

SEQ ID NO: 107735 - DNA, 22 bp, Homo sapiens
tgggggagctcagtccagccca

SEQ ID NO: 107736 - DNA, 22 bp, Homo sapiens
tttgttttcaatgtgtcattca

SEQ ID NO: 107737 - DNA, 22 bp, Homo sapiens
taagtcttcatagtctaatgtc

SEQ ID NO: 107738 - DNA, 22 bp, Homo sapiens
tgcactccaggctgggtgacag

SEQ ID NO: 107739 - DNA, 22 bp, Homo sapiens
attgattttcagactatgcgag

SEQ ID NO: 107740 - DNA, 22 bp, Homo sapiens
agggccagcactcctggcagga

SEQ ID NO: 107741 - DNA, 22 bp, Homo sapiens
ataatacatggttgatcttttc

SEQ ID NO: 107742 - DNA, 22 bp, Homo sapiens
tgggaaggggagctggaaagga

SEQ ID NO: 107743 - DNA, 22 bp, Homo sapiens
gcttaattctggctcagtttcc

SEQ ID NO: 107744 - DNA, 22 bp, Homo sapiens
actgcacttcagcctgggtgac

SEQ ID NO: 107745 - DNA, 22 bp, Homo sapiens
cggctggtgtcgggcacagcaa

SEQ ID NO: 107746 - DNA, 22 bp, Homo sapiens
gcctccccaagcagcagggatt

SEQ ID NO: 107747 - DNA, 22 bp, Homo sapiens
aggctagaggcttctggcttca

SEQ ID NO: 107748 - DNA, 22 bp, Homo sapiens
agggaaattaatgtgagcaatg

SEQ ID NO: 107749 - DNA, 22 bp, Homo sapiens
tagtatagattgaagcagatca

SEQ ID NO: 107750 - DNA, 22 bp, Homo sapiens
agagggatcaccctgtttctgg

SEQ ID NO: 107751 - DNA, 22 bp, Homo sapiens
agtccaaagcagatgagggcca

SEQ ID NO: 107752 - DNA, 22 bp, Homo sapiens
aggctcagatccttgtgtcctg

SEQ ID NO: 107753 - DNA, 19 bp, Homo sapiens
ttcacattggaagaagtag

SEQ ID NO: 107754 - DNA, 22 bp, Homo sapiens
tcactgcaacctccacctcctg

SEQ ID NO: 107755 - DNA, 21 bp, Homo sapiens
cctcaaagatgatggggtttc

SEQ ID NO: 107756 - DNA, 22 bp, Homo sapiens
cactaggctggagtgcagtggc

SEQ ID NO: 107757 - DNA, 22 bp, Homo sapiens
tacaaaaaattgatactgacga

SEQ ID NO: 107758 - DNA, 17 bp, Homo sapiens
cccgttctcttcgctgg

SEQ ID NO: 107759 - DNA, 22 bp, Homo sapiens
tccagcttataggtagatttaa

SEQ ID NO: 107760 - DNA, 22 bp, Homo sapiens
atatgggggggcgtgcagagga

SEQ ID NO: 107761 - DNA, 22 bp, Homo sapiens
tctagttctagatccctgagga

SEQ ID NO: 107762 - DNA, 22 bp, Homo sapiens
ccaggaggttgaggctgcagtg

SEQ ID NO: 107763 - DNA, 22 bp, Homo sapiens
atgccactgcgctctagcctgg

SEQ ID NO: 107764 - DNA, 22 bp, Homo sapiens
ctagcctgggatttgaacttat

SEQ ID NO: 107765 - DNA, 22 bp, Homo sapiens
gcaggtggatcaccacgtcagg

SEQ ID NO: 107766 - DNA, 22 bp, Homo sapiens
tagccgggtgtggtggaactcc

SEQ ID NO: 107767 - DNA, 22 bp, Homo sapiens
ctggccagatgttacgtccaat

SEQ ID NO: 107768 - DNA, 19 bp, Homo sapiens
aggagcactgccagcacca

SEQ ID NO: 107769 - DNA, 22 bp, Homo sapiens
tgaaatgtgtaatgtggatgcc

SEQ ID NO: 107770 - DNA, 22 bp, Homo sapiens
gtgtttggtcagacgtccgggg

SEQ ID NO: 107771 - DNA, 22 bp, Homo sapiens
acgcggtgcggcaagttcatgg

SEQ ID NO: 107772 - DNA, 19 bp, Homo sapiens
catggtgaaaccccgtctc

SEQ ID NO: 107773 - DNA, 22 bp, Homo sapiens
ggtgggagccaacacccttctg

SEQ ID NO: 107774 - DNA, 22 bp, Homo sapiens
ggggcattgtgtctgggttcct

SEQ ID NO: 107775 - DNA, 22 bp, Homo sapiens
cctgcacatgtgtgcgcctgta

SEQ ID NO: 107776 - DNA, 22 bp, Homo sapiens
agtcccaacagcttacaaggaa

SEQ ID NO: 107777 - DNA, 22 bp, Homo sapiens
gaaagacatagttgcaagatgg

SEQ ID NO: 107778 - DNA, 22 bp, Homo sapiens
gggagctgaaggagccggcggg

SEQ ID NO: 107779 - DNA, 22 bp, Homo sapiens
gagctctgactgctgggtgaca

SEQ ID NO: 107780 - DNA, 22 bp, Homo sapiens
gagcccaggaagtggaggctga

SEQ ID NO: 107781 - DNA, 22 bp, Homo sapiens
atgtgccaacgtgcaggtttgt

SEQ ID NO: 107782 - DNA, 22 bp, Homo sapiens
cgttttcatgggtagaggttct

SEQ ID NO: 107783 - DNA, 22 bp, Homo sapiens
tgttatcctcagctcacctcta

SEQ ID NO: 107784 - DNA, 22 bp, Homo sapiens
gggtggtggccagcagtgggca

SEQ ID NO: 107785 - DNA, 22 bp, Homo sapiens
gctgctctcagagctcatgctg

SEQ ID NO: 107786 - DNA, 22 bp, Homo sapiens
gttcaagaccagcctggccaac

SEQ ID NO: 107787 - DNA, 22 bp, Homo sapiens
atccaccctgtggtggctttct

SEQ ID NO: 107788 - DNA, 22 bp, Homo sapiens
agctgaaacttcccattaattg

SEQ ID NO: 107789 - DNA, 22 bp, Homo sapiens
tagatgaccttgtgttaggcaa

SEQ ID NO: 107790 - DNA, 22 bp, Homo sapiens
ggctgtggcagctggaagtggt

SEQ ID NO: 107791 - DNA, 22 bp, Homo sapiens
attgcactccagcctgggtgac

SEQ ID NO: 107792 - DNA, 22 bp, Homo sapiens
ttgggtgctgtcatggggcacg

SEQ ID NO: 107793 - DNA, 22 bp, Homo sapiens
ctgagccaaggggacagtgaca

SEQ ID NO: 107794 - DNA, 22 bp, Homo sapiens
accccagaggcggaggctgcag

SEQ ID NO: 107795 - DNA, 22 bp, Homo sapiens
ggcccaggctggagtgcagtgg

SEQ ID NO: 107796 - DNA, 22 bp, Homo sapiens
tctctcaggctggagtgcagtg

SEQ ID NO: 107797 - DNA, 22 bp, Homo sapiens
tcacatctaattccatttctgc

SEQ ID NO: 107798 - DNA, 22 bp, Homo sapiens
tttaagaagttatgttataaat

SEQ ID NO: 107799 - DNA, 23 bp, Homo sapiens
cttcacaggttcaggggattaag

SEQ ID NO: 107800 - DNA, 22 bp, Homo sapiens
ggcctggcagagcgcgcggctg

SEQ ID NO: 107801 - DNA, 22 bp, Homo sapiens
acattaaaattgggtggggtaa

SEQ ID NO: 107802 - DNA, 22 bp, Homo sapiens
gcagtatctatgtgatgggttg

SEQ ID NO: 107803 - DNA, 22 bp, Homo sapiens
gctggaggatggactggaagaa

SEQ ID NO: 107804 - DNA, 22 bp, Homo sapiens
aggccagcagcatgacggcatc

SEQ ID NO: 107805 - DNA, 22 bp, Homo sapiens
ctgggaggcggagcttgcagtg

SEQ ID NO: 107806 - DNA, 22 bp, Homo sapiens
caggaagaccagggctgtggct

SEQ ID NO: 107807 - DNA, 22 bp, Homo sapiens
gatggcctcatggctgcaggcc

SEQ ID NO: 107808 - DNA, 22 bp, Homo sapiens
agtgctatcgagttctaatgct

SEQ ID NO: 107809 - DNA, 22 bp, Homo sapiens
atctccgccatcgcgaacgcct

SEQ ID NO: 107810 - DNA, 22 bp, Homo sapiens
ggctcactgcaacttccgcctc

SEQ ID NO: 107811 - DNA, 22 bp, Homo sapiens
cagcccaggactgcaggtgttt

SEQ ID NO: 107812 - DNA, 22 bp, Homo sapiens
agcccttagtacatttctcaag

SEQ ID NO: 107813 - DNA, 22 bp, Homo sapiens
tggaggagaccgcattttattt

SEQ ID NO: 107814 - DNA, 22 bp, Homo sapiens
ccagatatcactgccgtgttgt

SEQ ID NO: 107815 - DNA, 22 bp, Homo sapiens
gcctggagaaaggaaggtggga

SEQ ID NO: 107816 - DNA, 22 bp, Homo sapiens
gtggggacgggatggctcactg

SEQ ID NO: 107817 - DNA, 22 bp, Homo sapiens
aggacttagaacattatgtact

SEQ ID NO: 107818 - DNA, 22 bp, Homo sapiens
tgccacagacaggacagaacag

SEQ ID NO: 107819 - DNA, 22 bp, Homo sapiens
ctagggtcaggggcctgcgtcg

SEQ ID NO: 107820 - DNA, 22 bp, Homo sapiens
caggaggattgcttgaggccag

SEQ ID NO: 107821 - DNA, 22 bp, Homo sapiens
ttttttgttgggtagaacggaa

SEQ ID NO: 107822 - DNA, 22 bp, Homo sapiens
aggaaataggaccagacaaagc

SEQ ID NO: 107823 - DNA, 22 bp, Homo sapiens
attgagaagaaaatctaatata

SEQ ID NO: 107824 - DNA, 22 bp, Homo sapiens
tctgtcacccagagtgcagtgg

SEQ ID NO: 107825 - DNA, 22 bp, Homo sapiens
agcagcagtatccttccccggc

SEQ ID NO: 107826 - DNA, 22 bp, Homo sapiens
caggctggagtgcagtggcgcc

SEQ ID NO: 107827 - DNA, 22 bp, Homo sapiens
caggagtgtctccacacagcaa

SEQ ID NO: 107828 - DNA, 22 bp, Homo sapiens
agaggcagtatacaatccgagc

SEQ ID NO: 107829 - DNA, 22 bp, Homo sapiens
agttgggtttgtgtcagttgca

SEQ ID NO: 107830 - DNA, 18 bp, Homo sapiens
ggctgtggacaagattag

SEQ ID NO: 107831 - DNA, 22 bp, Homo sapiens
ttggcttttatgcagcttaggt

SEQ ID NO: 107832 - DNA, 16 bp, Homo sapiens
atgctgctattagagg

SEQ ID NO: 107833 - DNA, 18 bp, Homo sapiens
cagctgccagctcatgga

SEQ ID NO: 107834 - DNA, 22 bp, Homo sapiens
agatttatgtggtcacactcag

SEQ ID NO: 107835 - DNA, 22 bp, Homo sapiens
attgtgtcctcattgaccttca

SEQ ID NO: 107836 - DNA, 22 bp, Homo sapiens
gtgaccaatattatgctaatta

SEQ ID NO: 107837 - DNA, 22 bp, Homo sapiens
tgtgtcagaaggcaatggggat

SEQ ID NO: 107838 - DNA, 22 bp, Homo sapiens
tcaaatgaagacagttgacttg

SEQ ID NO: 107839 - DNA, 22 bp, Homo sapiens
atgattagttaccttgatttaa

SEQ ID NO: 107840 - DNA, 22 bp, Homo sapiens
gggtccaggcggcatagttgta

SEQ ID NO: 107841 - DNA, 22 bp, Homo sapiens
ctcagccccagcccagatagca

SEQ ID NO: 107842 - DNA, 22 bp, Homo sapiens
ttctcttacattttctcagcct

SEQ ID NO: 107843 - DNA, 22 bp, Homo sapiens
gcggcaggagtaaaggaggaag

SEQ ID NO: 107844 - DNA, 22 bp, Homo sapiens
accaggggatggttggcactgt

SEQ ID NO: 107845 - DNA, 22 bp, Homo sapiens
ctgggaggcagaggttgcagtg

SEQ ID NO: 107846 - DNA, 23 bp, Homo sapiens
ggggcctgcaccggtctgcgcgg

SEQ ID NO: 107847 - DNA, 22 bp, Homo sapiens
gaagaaggtggcccaggggtag

SEQ ID NO: 107848 - DNA, 22 bp, Homo sapiens
ccagggtggcgtagatgctggg

SEQ ID NO: 107849 - DNA, 22 bp, Homo sapiens
cagcagcccacgcgtgctgtcc

SEQ ID NO: 107850 - DNA, 20 bp, Homo sapiens
agatacagtggtttctttag

SEQ ID NO: 107851 - DNA, 22 bp, Homo sapiens
gttgtgaatagtgccgcaataa

SEQ ID NO: 107852 - DNA, 22 bp, Homo sapiens
gataccagacagggagggagaa

SEQ ID NO: 107853 - DNA, 22 bp, Homo sapiens
ggaggcggaggctgcagtgagc

SEQ ID NO: 107854 - DNA, 22 bp, Homo sapiens
agcctgggccctgcctcttctc

SEQ ID NO: 107855 - DNA, 22 bp, Homo sapiens
ccgggcctcgggacaccgggta

SEQ ID NO: 107856 - DNA, 22 bp, Homo sapiens
tgggggctttatgtaatgcaca

SEQ ID NO: 107857 - DNA, 22 bp, Homo sapiens
gtcccataagtagtgcaacttg

SEQ ID NO: 107858 - DNA, 22 bp, Homo sapiens
tagcataacaggtaagagtgag

SEQ ID NO: 107859 - DNA, 22 bp, Homo sapiens
gaggcagtgaacaattcctgtg

SEQ ID NO: 107860 - DNA, 22 bp, Homo sapiens
caggaggttgagggtgcagtga

SEQ ID NO: 107861 - DNA, 22 bp, Homo sapiens
gacgagagactccatccaccac

SEQ ID NO: 107862 - DNA, 21 bp, Homo sapiens
tctgatggtagatgagatgtg

SEQ ID NO: 107863 - DNA, 19 bp, Homo sapiens
acccagcccaggagtggca

SEQ ID NO: 107864 - DNA, 20 bp, Homo sapiens
tctcgcactcggagcagccg

SEQ ID NO: 107865 - DNA, 22 bp, Homo sapiens
tcagtatcaatagcgtcacaat

SEQ ID NO: 107866 - DNA, 22 bp, Homo sapiens
aagactgtgtctatggctactc

SEQ ID NO: 107867 - DNA, 22 bp, Homo sapiens
acctagaatttaaaacattgct

SEQ ID NO: 107868 - DNA, 22 bp, Homo sapiens
gggacatctttctagtcagggt

SEQ ID NO: 107869 - DNA, 22 bp, Homo sapiens
aaattgcaaaagtacttttagg

SEQ ID NO: 107870 - DNA, 22 bp, Homo sapiens
aggacctactgatatcttagca

SEQ ID NO: 107871 - DNA, 22 bp, Homo sapiens
gtcactgtatccaggttccagc

SEQ ID NO: 107872 - DNA, 22 bp, Homo sapiens
gttatataagacaaatcagagt

SEQ ID NO: 107873 - DNA, 22 bp, Homo sapiens
cccacgtcgaacttgctccaga

SEQ ID NO: 107874 - DNA, 22 bp, Homo sapiens
gcaggcggaggttgcagtgagc

SEQ ID NO: 107875 - DNA, 17 bp, Homo sapiens
tggtccaggtggagcca

SEQ ID NO: 107876 - DNA, 22 bp, Homo sapiens
acacttctttgtcacctgcttc

SEQ ID NO: 107877 - DNA, 22 bp, Homo sapiens
ccctgcctacagggttttcttt

SEQ ID NO: 107878 - DNA, 22 bp, Homo sapiens
cgtgagcaaaatggacactccc

SEQ ID NO: 107879 - DNA, 22 bp, Homo sapiens
tgcttctgactaagctgcatga

SEQ ID NO: 107880 - DNA, 22 bp, Homo sapiens
gctggtgagcaaaggagaagga

SEQ ID NO: 107881 - DNA, 23 bp, Homo sapiens
catctagcatccagtgagtagtg

SEQ ID NO: 107882 - DNA, 22 bp, Homo sapiens
cttgcctttgtcttcaaaggct

SEQ ID NO: 107883 - DNA, 22 bp, Homo sapiens
gaagccttgaactgcaaacccc

SEQ ID NO: 107884 - DNA, 22 bp, Homo sapiens
acagttaattgttgttgggtgt

SEQ ID NO: 107885 - DNA, 22 bp, Homo sapiens
ggaggagcatgagagggtagtg

SEQ ID NO: 107886 - DNA, 22 bp, Homo sapiens
tccctagtcgcatctgtggaga

SEQ ID NO: 107887 - DNA, 22 bp, Homo sapiens
acccaggccattggcaagagtc

SEQ ID NO: 107888 - DNA, 22 bp, Homo sapiens
ggtgccaggctgtagtcagggt

SEQ ID NO: 107889 - DNA, 22 bp, Homo sapiens
tcagccagccagctacaggctt

SEQ ID NO: 107890 - DNA, 20 bp, Homo sapiens
tggcctctgagatgccacgg

SEQ ID NO: 107891 - DNA, 22 bp, Homo sapiens
tccaccatgtaacaagctctgt

SEQ ID NO: 107892 - DNA, 22 bp, Homo sapiens
tgttgatttgtgggctgcaaaa

SEQ ID NO: 107893 - DNA, 22 bp, Homo sapiens
cacagtcctgccagagggcctt

SEQ ID NO: 107894 - DNA, 22 bp, Homo sapiens
cccagttgttgccggctctgga

SEQ ID NO: 107895 - DNA, 22 bp, Homo sapiens
tccacgtgagcttcgtgtgcag

SEQ ID NO: 107896 - DNA, 22 bp, Homo sapiens
acagcagcaatagcagtgacat

SEQ ID NO: 107897 - DNA, 22 bp, Homo sapiens
accctcaacaaattcactctat

SEQ ID NO: 107898 - DNA, 16 bp, Homo sapiens
gaggagcccctctgcc

SEQ ID NO: 107899 - DNA, 22 bp, Homo sapiens
gcccagcacctctctcagggtt

SEQ ID NO: 107900 - DNA, 22 bp, Homo sapiens
aaggagcacacaatctagaacc

SEQ ID NO: 107901 - DNA, 22 bp, Homo sapiens
gaccctctagatggaagcactg

SEQ ID NO: 107902 - DNA, 22 bp, Homo sapiens
tcctagttctctgccagtcgct

SEQ ID NO: 107903 - DNA, 22 bp, Homo sapiens
cccctcgcctgcagagcacagc

SEQ ID NO: 107904 - DNA, 20 bp, Homo sapiens
aactcctagcctcaagtgat

SEQ ID NO: 107905 - DNA, 22 bp, Homo sapiens
aaggagaggttgtccgtgttgt

SEQ ID NO: 107906 - DNA, 20 bp, Homo sapiens
gggcagtggcgctatctcag

SEQ ID NO: 107907 - DNA, 22 bp, Homo sapiens
ctgtggttggagtgcagtgaga

SEQ ID NO: 107908 - DNA, 22 bp, Homo sapiens
tgagctgtagcagatgctgttg

SEQ ID NO: 107909 - DNA, 22 bp, Homo sapiens
gagggggctagcgcagtgccca

SEQ ID NO: 107910 - DNA, 22 bp, Homo sapiens
aaagtgctgggattacaggctt

SEQ ID NO: 107911 - DNA, 22 bp, Homo sapiens
tagagctggccgggacagctgg

SEQ ID NO: 107912 - DNA, 22 bp, Homo sapiens
gtgacaatattagctcaggggc

SEQ ID NO: 107913 - DNA, 22 bp, Homo sapiens
ctgggggtcttgaaagggagag

SEQ ID NO: 107914 - DNA, 22 bp, Homo sapiens
gctcccaccgccgctatgggta

SEQ ID NO: 107915 - DNA, 22 bp, Homo sapiens
tggggtcccaactctgattgat

SEQ ID NO: 107916 - DNA, 22 bp, Homo sapiens
atgtgctgagtgtgtatataca

SEQ ID NO: 107917 - DNA, 22 bp, Homo sapiens
tgcaggctcttggtgacgtggg

SEQ ID NO: 107918 - DNA, 22 bp, Homo sapiens
taacaatacccattctaattac

SEQ ID NO: 107919 - DNA, 22 bp, Homo sapiens
cagagctggtgtgtcctggcat

SEQ ID NO: 107920 - DNA, 22 bp, Homo sapiens
aggcaagggggcgccaccttcc

SEQ ID NO: 107921 - DNA, 22 bp, Homo sapiens
cggctcactgcagctccgcctc

SEQ ID NO: 107922 - DNA, 22 bp, Homo sapiens
tgatctaggttggcttcaactg

SEQ ID NO: 107923 - DNA, 22 bp, Homo sapiens
gtcagaggggcagctgccaggc

SEQ ID NO: 107924 - DNA, 21 bp, Homo sapiens
tgttttccaccttgaggcaag

SEQ ID NO: 107925 - DNA, 22 bp, Homo sapiens
tgaggaaacttacaaggcagaa

SEQ ID NO: 107926 - DNA, 22 bp, Homo sapiens
ttaggctgttcttgtgttgtta

SEQ ID NO: 107927 - DNA, 22 bp, Homo sapiens
ttgagcccaggaggcctgggtg

SEQ ID NO: 107928 - DNA, 22 bp, Homo sapiens
tgtgagcagagacatgaaaagc

SEQ ID NO: 107929 - DNA, 22 bp, Homo sapiens
ctccagattccgtttattcagg

SEQ ID NO: 107930 - DNA, 22 bp, Homo sapiens
aaggatgattggtaatgacact

SEQ ID NO: 107931 - DNA, 22 bp, Homo sapiens
cactgcactccagcctgggcaa

SEQ ID NO: 107932 - DNA, 22 bp, Homo sapiens
aatatttccaaggcctgtcagg

SEQ ID NO: 107933 - DNA, 22 bp, Homo sapiens
atgcagtggcttcagtgtcagt

SEQ ID NO: 107934 - DNA, 22 bp, Homo sapiens
cttctcggggttcccgcgccct

SEQ ID NO: 107935 - DNA, 22 bp, Homo sapiens
tgtaagtagtaatggaaggaca

SEQ ID NO: 107936 - DNA, 22 bp, Homo sapiens
cagtgcagccaaggacaggcac

SEQ ID NO: 107937 - DNA, 22 bp, Homo sapiens
tgaacgcaggtccacatggctc

SEQ ID NO: 107938 - DNA, 22 bp, Homo sapiens
tgtgggagaaggaagcaagctg

SEQ ID NO: 107939 - DNA, 22 bp, Homo sapiens
gcggcctgcgctgctcccgacg

SEQ ID NO: 107940 - DNA, 22 bp, Homo sapiens
agttttcattaccatgctgcaa

SEQ ID NO: 107941 - DNA, 22 bp, Homo sapiens
tctacatgcagcgaggggactt

SEQ ID NO: 107942 - DNA, 22 bp, Homo sapiens
tttgcttgttcaagatttctgt

SEQ ID NO: 107943 - DNA, 22 bp, Homo sapiens
tctctagtctcctttaacctga

SEQ ID NO: 107944 - DNA, 22 bp, Homo sapiens
tcaggaggcggaggttgcagtg

SEQ ID NO: 107945 - DNA, 22 bp, Homo sapiens
ccagcagccaccttctcgaaat

SEQ ID NO: 107946 - DNA, 22 bp, Homo sapiens
cgagagttagctaggagtcaca

SEQ ID NO: 107947 - DNA, 15 bp, Homo sapiens
gcaggcaggtcacct

SEQ ID NO: 107948 - DNA, 22 bp, Homo sapiens
tcttcacgccaagtgcccctca

SEQ ID NO: 107949 - DNA, 22 bp, Homo sapiens
aagatgcggttgaccatggtgt

SEQ ID NO: 107950 - DNA, 22 bp, Homo sapiens
ccggctcggcgaccaggctgaa

SEQ ID NO: 107951 - DNA, 22 bp, Homo sapiens
catcaggcagaggaaaggactg

SEQ ID NO: 107952 - DNA, 22 bp, Homo sapiens
ggagtgactctcggggccacta

SEQ ID NO: 107953 - DNA, 22 bp, Homo sapiens
tcacagagaaatgtggcacaaa

SEQ ID NO: 107954 - DNA, 22 bp, Homo sapiens
ttggatccatctcaggcatagg

SEQ ID NO: 107955 - DNA, 19 bp, Homo sapiens
ccatggcaatgatctgatg

SEQ ID NO: 107956 - DNA, 22 bp, Homo sapiens
gagagtctagtgcacctagttt

SEQ ID NO: 107957 - DNA, 22 bp, Homo sapiens
ttggtggacctcatcagaaccg

SEQ ID NO: 107958 - DNA, 22 bp, Homo sapiens
cagcagcattgctctggattcc

SEQ ID NO: 107959 - DNA, 22 bp, Homo sapiens
ttcttcatgggttcttttagga

SEQ ID NO: 107960 - DNA, 23 bp, Homo sapiens
gcagaggagcaagctggacacca

SEQ ID NO: 107961 - DNA, 22 bp, Homo sapiens
attgcactccggcctgggtgac

SEQ ID NO: 107962 - DNA, 22 bp, Homo sapiens
tcgcccaggctggaagtgcagt

SEQ ID NO: 107963 - DNA, 22 bp, Homo sapiens
gcaccctgtcaaaatggaccaa

SEQ ID NO: 107964 - DNA, 22 bp, Homo sapiens
catggcggtcaggatgtaggtg

SEQ ID NO: 107965 - DNA, 22 bp, Homo sapiens
tttccagagggtgctcagggcg

SEQ ID NO: 107966 - DNA, 22 bp, Homo sapiens
gcctcatcgctgctcggcccgg

SEQ ID NO: 107967 - DNA, 22 bp, Homo sapiens
tgctcattggcgatctgaggga

SEQ ID NO: 107968 - DNA, 22 bp, Homo sapiens
caggagatgacagggaagaacc

SEQ ID NO: 107969 - DNA, 22 bp, Homo sapiens
cagatgtcatttcccatgcagc

SEQ ID NO: 107970 - DNA, 22 bp, Homo sapiens
ttccagctaactcacatccctt

SEQ ID NO: 107971 - DNA, 22 bp, Homo sapiens
ctgggcacagcgttgggctctt

SEQ ID NO: 107972 - DNA, 22 bp, Homo sapiens
tgatttcaagccagggggcgtt

SEQ ID NO: 107973 - DNA, 22 bp, Homo sapiens
acaggggaatttactgtcatta

SEQ ID NO: 107974 - DNA, 22 bp, Homo sapiens
caatccatcaattacacaggct

SEQ ID NO: 107975 - DNA, 22 bp, Homo sapiens
tcttggattttaatggatcaaa

SEQ ID NO: 107976 - DNA, 22 bp, Homo sapiens
ctcactgcaagctcagcctccc

SEQ ID NO: 107977 - DNA, 22 bp, Homo sapiens
ctgggaggtggaggttgcattg

SEQ ID NO: 107978 - DNA, 22 bp, Homo sapiens
gaggcagaggttgttgcagtga

SEQ ID NO: 107979 - DNA, 22 bp, Homo sapiens
tttgaaatgtatcagtataggt

SEQ ID NO: 107980 - DNA, 22 bp, Homo sapiens
ccagaccctccattcaagctcc

SEQ ID NO: 107981 - DNA, 22 bp, Homo sapiens
cacagggcttctcatggggtgc

SEQ ID NO: 107982 - DNA, 22 bp, Homo sapiens
tcaccttgtgatccgcccacct

SEQ ID NO: 107983 - DNA, 22 bp, Homo sapiens
ggctgcaggttggttggcagct

SEQ ID NO: 107984 - DNA, 22 bp, Homo sapiens
cctgcagacacttgtccagcaa

SEQ ID NO: 107985 - DNA, 22 bp, Homo sapiens
actgtgtgtttgtctagcacag

SEQ ID NO: 107986 - DNA, 20 bp, Homo sapiens
tttcaccatcttggccaggc

SEQ ID NO: 107987 - DNA, 22 bp, Homo sapiens
cccaggaggtggagttcacagt

SEQ ID NO: 107988 - DNA, 22 bp, Homo sapiens
gtgttgatgacattttagaaac

SEQ ID NO: 107989 - DNA, 22 bp, Homo sapiens
agtgaggggcagctgagtgggc

SEQ ID NO: 107990 - DNA, 22 bp, Homo sapiens
gcgagggcacgcggttgaaggc

SEQ ID NO: 107991 - DNA, 22 bp, Homo sapiens
accatgttggccaagctggtct

SEQ ID NO: 107992 - DNA, 22 bp, Homo sapiens
ggtgcagaggagccagctgggg

SEQ ID NO: 107993 - DNA, 23 bp, Homo sapiens
ccaagactgttaggagtggggag

SEQ ID NO: 107994 - DNA, 22 bp, Homo sapiens
gagtgctttgtcttgtaattct

SEQ ID NO: 107995 - DNA, 22 bp, Homo sapiens
atgatggctaggctggttttga

SEQ ID NO: 107996 - DNA, 22 bp, Homo sapiens
gtgaaatatttaacgtccaggt

SEQ ID NO: 107997 - DNA, 22 bp, Homo sapiens
tcagtgcagggtgggagagaga

SEQ ID NO: 107998 - DNA, 22 bp, Homo sapiens
ctgaggctggagtgcagtggtg

SEQ ID NO: 107999 - DNA, 22 bp, Homo sapiens
gagctactgaaatattgatttt

SEQ ID NO: 108000 - DNA, 22 bp, Homo sapiens
tctttgctccacactctagaga

SEQ ID NO: 108001 - DNA, 22 bp, Homo sapiens
gctgcagctgtaggacacaatt

SEQ ID NO: 108002 - DNA, 22 bp, Homo sapiens
gcctgctcccagttggcgcctc

SEQ ID NO: 108003 - DNA, 22 bp, Homo sapiens
ttatttaatgtgatctgaagag

SEQ ID NO: 108004 - DNA, 22 bp, Homo sapiens
aagcagatctgatagggccctg

SEQ ID NO: 108005 - DNA, 22 bp, Homo sapiens
ggaggcggaagttgcagtgagc

SEQ ID NO: 108006 - DNA, 22 bp, Homo sapiens
aaggagaaatggtagatgtgca

SEQ ID NO: 108007 - DNA, 22 bp, Homo sapiens
tccagggagagccgctgctcca

SEQ ID NO: 108008 - DNA, 22 bp, Homo sapiens
ataccaccatctatgaaaggta

SEQ ID NO: 108009 - DNA, 22 bp, Homo sapiens
gcctggccaacgtggtgaaacc

SEQ ID NO: 108010 - DNA, 20 bp, Homo sapiens
ataaaataactgccacaaga

SEQ ID NO: 108011 - DNA, 22 bp, Homo sapiens
tggtggggccagacttcagctc

SEQ ID NO: 108012 - DNA, 22 bp, Homo sapiens
tccaggctttggggcaggagcg

SEQ ID NO: 108013 - DNA, 22 bp, Homo sapiens
agatacattgttctaagcattg

SEQ ID NO: 108014 - DNA, 22 bp, Homo sapiens
ggtggttcacgcctataatccc

SEQ ID NO: 108015 - DNA, 22 bp, Homo sapiens
ctccttctgggcctggcagtgg

SEQ ID NO: 108016 - DNA, 22 bp, Homo sapiens
tacagaggaggggattttaata

SEQ ID NO: 108017 - DNA, 22 bp, Homo sapiens
aaaaatcacttttataggcagc

SEQ ID NO: 108018 - DNA, 22 bp, Homo sapiens
gggctgtaggagctggaatggg

SEQ ID NO: 108019 - DNA, 19 bp, Homo sapiens
catctggatgattctcctg

SEQ ID NO: 108020 - DNA, 22 bp, Homo sapiens
ccaggagctggagggtgcagtg

SEQ ID NO: 108021 - DNA, 22 bp, Homo sapiens
catccaccgcgtgcacctctac

SEQ ID NO: 108022 - DNA, 22 bp, Homo sapiens
tgcgggtcccagggtcacaggc

SEQ ID NO: 108023 - DNA, 22 bp, Homo sapiens
tgctcatcaacatgatgatcat

SEQ ID NO: 108024 - DNA, 22 bp, Homo sapiens
aggaattcaagaccagctgggc

SEQ ID NO: 108025 - DNA, 22 bp, Homo sapiens
gggccatgagaggttcatcaac

SEQ ID NO: 108026 - DNA, 22 bp, Homo sapiens
tctgctctgtggcttcagctaa

SEQ ID NO: 108027 - DNA, 21 bp, Homo sapiens
ttagaagctaatgcagctggt

SEQ ID NO: 108028 - DNA, 22 bp, Homo sapiens
tttcctcttctggcaggcaggg

SEQ ID NO: 108029 - DNA, 22 bp, Homo sapiens
tttcaccatcttggccaggctg

SEQ ID NO: 108030 - DNA, 22 bp, Homo sapiens
ggcatcgtcctgggcataggga

SEQ ID NO: 108031 - DNA, 23 bp, Homo sapiens
gggggccgtcctggggattatag

SEQ ID NO: 108032 - DNA, 22 bp, Homo sapiens
ctggcaggttatagagctgccc

SEQ ID NO: 108033 - DNA, 22 bp, Homo sapiens
gtgcatgtgtctttatagtagc

SEQ ID NO: 108034 - DNA, 22 bp, Homo sapiens
aggaccatcctaaggtaggcaa

SEQ ID NO: 108035 - DNA, 22 bp, Homo sapiens
ctggcttttttcccattatgca

SEQ ID NO: 108036 - DNA, 22 bp, Homo sapiens
ccaggctggagtgcaatggcat

SEQ ID NO: 108037 - DNA, 22 bp, Homo sapiens
ggaggaggggtgactgaatgct

SEQ ID NO: 108038 - DNA, 22 bp, Homo sapiens
tgcctgtgtcagcaggtggaag

SEQ ID NO: 108039 - DNA, 22 bp, Homo sapiens
cactgcactccagcctgggtga

SEQ ID NO: 108040 - DNA, 22 bp, Homo sapiens
gggcagagagctggaactcctt

SEQ ID NO: 108041 - DNA, 19 bp, Homo sapiens
ggagccgccgcccttcatt

SEQ ID NO: 108042 - DNA, 22 bp, Homo sapiens
ggagactgatctgagtgataac

SEQ ID NO: 108043 - DNA, 22 bp, Homo sapiens
ttaagtaacttgtccaaatgag

SEQ ID NO: 108044 - DNA, 22 bp, Homo sapiens
atgttgtgtttgactgttaccc

SEQ ID NO: 108045 - DNA, 22 bp, Homo sapiens
ctcccagccttcgccagtctga

SEQ ID NO: 108046 - DNA, 22 bp, Homo sapiens
tttgtcttatccaatctctcag

SEQ ID NO: 108047 - DNA, 22 bp, Homo sapiens
gaggaggcttccgggaggcacg

SEQ ID NO: 108048 - DNA, 20 bp, Homo sapiens
tttgagaccagtctgcccaa

SEQ ID NO: 108049 - DNA, 22 bp, Homo sapiens
gagccaggtcgggccgcggcga

SEQ ID NO: 108050 - DNA, 22 bp, Homo sapiens
tatcactacacctggctaatta

SEQ ID NO: 108051 - DNA, 22 bp, Homo sapiens
ctcagctgcagcctggctggca

SEQ ID NO: 108052 - DNA, 22 bp, Homo sapiens
gcttcggggtccaagcgcgtgt

SEQ ID NO: 108053 - DNA, 22 bp, Homo sapiens
tccagtatcaaagtcctagtcc

SEQ ID NO: 108054 - DNA, 22 bp, Homo sapiens
atttgtgggactataatgcagg

SEQ ID NO: 108055 - DNA, 22 bp, Homo sapiens
agaagccaccagctgaggaaga

SEQ ID NO: 108056 - DNA, 22 bp, Homo sapiens
caggcaggtcagtgaagaagga

SEQ ID NO: 108057 - DNA, 22 bp, Homo sapiens
ccggctactcgggaggctgacg

SEQ ID NO: 108058 - DNA, 22 bp, Homo sapiens
cgccccggacgtctgaccaaac

SEQ ID NO: 108059 - DNA, 22 bp, Homo sapiens
gggaagatagtgttgagggccc

SEQ ID NO: 108060 - DNA, 17 bp, Homo sapiens
aggaggccctggcgttt

SEQ ID NO: 108061 - DNA, 22 bp, Homo sapiens
ttgttgagatgtgtctctcaat

SEQ ID NO: 108062 - DNA, 22 bp, Homo sapiens
gccaggttgctgacgacgatct

SEQ ID NO: 108063 - DNA, 22 bp, Homo sapiens
gggggactggaccgtcctgggt

SEQ ID NO: 108064 - DNA, 22 bp, Homo sapiens
ctccccgagagaggttgtccgc

SEQ ID NO: 108065 - DNA, 22 bp, Homo sapiens
aaaatggtctcagctggcacca

SEQ ID NO: 108066 - DNA, 22 bp, Homo sapiens
gggagctgagctggaagagaat

SEQ ID NO: 108067 - DNA, 22 bp, Homo sapiens
ggggcaggagcccttcttcagc

SEQ ID NO: 108068 - DNA, 22 bp, Homo sapiens
cttcctcctccatctcgaaggc

SEQ ID NO: 108069 - DNA, 22 bp, Homo sapiens
gagaggtggaggttgcagtgag

SEQ ID NO: 108070 - DNA, 22 bp, Homo sapiens
ttgtcccaggacttgcatagat

SEQ ID NO: 108071 - DNA, 22 bp, Homo sapiens
gggggcttggcccggtctggtt

SEQ ID NO: 108072 - DNA, 22 bp, Homo sapiens
tgctcttcacagtttcagcatc

SEQ ID NO: 108073 - DNA, 22 bp, Homo sapiens
tcaacagtggcaaagaggcacg

SEQ ID NO: 108074 - DNA, 22 bp, Homo sapiens
ttttaatactgctattgtagga

SEQ ID NO: 108075 - DNA, 22 bp, Homo sapiens
gaccttgtgatccacctgcctt

SEQ ID NO: 108076 - DNA, 22 bp, Homo sapiens
gttttgaatactactagaactt

SEQ ID NO: 108077 - DNA, 22 bp, Homo sapiens
tggctcctcacgtcctcagagc

SEQ ID NO: 108078 - DNA, 22 bp, Homo sapiens
cactgctacctctgcctcccgg

SEQ ID NO: 108079 - DNA, 22 bp, Homo sapiens
gaggcaggaggattgcttgagc

SEQ ID NO: 108080 - DNA, 22 bp, Homo sapiens
aacagtgtttttcttcagcact

SEQ ID NO: 108081 - DNA, 22 bp, Homo sapiens
tacttttagcctatttgattct

SEQ ID NO: 108082 - DNA, 22 bp, Homo sapiens
gcccaggctggagtgcagtggc

SEQ ID NO: 108083 - DNA, 22 bp, Homo sapiens
acccaggctggagtgcagtggc

SEQ ID NO: 108084 - DNA, 22 bp, Homo sapiens
tataccatgtgtgcacactccc

SEQ ID NO: 108085 - DNA, 22 bp, Homo sapiens
ggggcagagaataaaaacctaa

SEQ ID NO: 108086 - DNA, 22 bp, Homo sapiens
ttgatgtgtttccaggatttgt

SEQ ID NO: 108087 - DNA, 23 bp, Homo sapiens
atgtttgcagtaacccatcctgg

SEQ ID NO: 108088 - DNA, 22 bp, Homo sapiens
gcaggtggatcacctgaggtca

SEQ ID NO: 108089 - DNA, 22 bp, Homo sapiens
ctccatatgttcagttatgcag

SEQ ID NO: 108090 - DNA, 22 bp, Homo sapiens
gagcccaggcagaggttgcagt

SEQ ID NO: 108091 - DNA, 22 bp, Homo sapiens
ggattgcaacaagctagtttag

SEQ ID NO: 108092 - DNA, 22 bp, Homo sapiens
gcctacatttcccagttgaatg

SEQ ID NO: 108093 - DNA, 22 bp, Homo sapiens
ccaggaggcagaagttgcagtg

SEQ ID NO: 108094 - DNA, 22 bp, Homo sapiens
ggctcaatgcaacttctgcctc

SEQ ID NO: 108095 - DNA, 22 bp, Homo sapiens
tcctgccttgcctgggacatca

SEQ ID NO: 108096 - DNA, 22 bp, Homo sapiens
aagtcaggtgtctgatttgaac

SEQ ID NO: 108097 - DNA, 22 bp, Homo sapiens
ctaggaccactgtaacaaagta

SEQ ID NO: 108098 - DNA, 22 bp, Homo sapiens
gctcactgcaagctctgcctcc

SEQ ID NO: 108099 - DNA, 21 bp, Homo sapiens
ccaccaggtcttctgctcggg

SEQ ID NO: 108100 - DNA, 22 bp, Homo sapiens
gcccttacagggtggtcagcca

SEQ ID NO: 108101 - DNA, 22 bp, Homo sapiens
gggcggatcacctgaggtcagg

SEQ ID NO: 108102 - DNA, 22 bp, Homo sapiens
ggcaggactgatcagtgggatg

SEQ ID NO: 108103 - DNA, 22 bp, Homo sapiens
ggcagggcaggaaagtcaggaa

SEQ ID NO: 108104 - DNA, 22 bp, Homo sapiens
gtgatctgccagcctcagcctc

SEQ ID NO: 108105 - DNA, 22 bp, Homo sapiens
cattcatctatcaaatggtacc

SEQ ID NO: 108106 - DNA, 22 bp, Homo sapiens
ctccagtgcttctagaaaatac

SEQ ID NO: 108107 - DNA, 22 bp, Homo sapiens
tttattggatatttacaagata

SEQ ID NO: 108108 - DNA, 19 bp, Homo sapiens
ctgctgccggagactcgtc

SEQ ID NO: 108109 - DNA, 22 bp, Homo sapiens
tgggactcactcttttggccag

SEQ ID NO: 108110 - DNA, 22 bp, Homo sapiens
cacccaggctggagtgcagtgg

SEQ ID NO: 108111 - DNA, 22 bp, Homo sapiens
cccaggctggagtgtaatggtg

SEQ ID NO: 108112 - DNA, 22 bp, Homo sapiens
acccaggctggagtgcagtggg

SEQ ID NO: 108113 - DNA, 22 bp, Homo sapiens
ccacccgtcctgctcgggccgc

SEQ ID NO: 108114 - DNA, 22 bp, Homo sapiens
tgcctgttgcccacctgataaa

SEQ ID NO: 108115 - DNA, 22 bp, Homo sapiens
cgggcagtgcccagcggggcag

SEQ ID NO: 108116 - DNA, 22 bp, Homo sapiens
atgttggccaggctggtcttga

SEQ ID NO: 108117 - DNA, 22 bp, Homo sapiens
tcccacaggtggagcttgcagt

SEQ ID NO: 108118 - DNA, 22 bp, Homo sapiens
tgctgttagtaaggaacatgac

SEQ ID NO: 108119 - DNA, 22 bp, Homo sapiens
atgccactgcactccagcctgg

SEQ ID NO: 108120 - DNA, 22 bp, Homo sapiens
tgaggcaggagaatcaccggaa

SEQ ID NO: 108121 - DNA, 22 bp, Homo sapiens
ctaggtgatccactgctctctt

SEQ ID NO: 108122 - DNA, 22 bp, Homo sapiens
ctgcttctagcaccaagtccct

SEQ ID NO: 108123 - DNA, 22 bp, Homo sapiens
ctctcgccagcggggctgcgct

SEQ ID NO: 108124 - DNA, 22 bp, Homo sapiens
tgaggcaggagaatcacatgaa

SEQ ID NO: 108125 - DNA, 22 bp, Homo sapiens
tggaggctggagtgcagtggcg

SEQ ID NO: 108126 - DNA, 17 bp, Homo sapiens
cgggcatggagggcagg

SEQ ID NO: 108127 - DNA, 22 bp, Homo sapiens
agcattccacactgaagtctgc

SEQ ID NO: 108128 - DNA, 22 bp, Homo sapiens
aggcaggaggatcatggatgca

SEQ ID NO: 108129 - DNA, 22 bp, Homo sapiens
ctggtagtttgcaaaatggtgt

SEQ ID NO: 108130 - DNA, 22 bp, Homo sapiens
ggaggcggaggttgcagtgagc

SEQ ID NO: 108131 - DNA, 22 bp, Homo sapiens
tagggtagtaccatgctgccag

SEQ ID NO: 108132 - DNA, 22 bp, Homo sapiens
cctccccacagcccaggagact

SEQ ID NO: 108133 - DNA, 22 bp, Homo sapiens
atctgtcttttaatgttaatgc

SEQ ID NO: 108134 - DNA, 22 bp, Homo sapiens
ccaggggggcgtagatgctggg

SEQ ID NO: 108135 - DNA, 22 bp, Homo sapiens
tggaggccagaggtactgggac

SEQ ID NO: 108136 - DNA, 22 bp, Homo sapiens
gccaggacctcagatgcagggc

SEQ ID NO: 108137 - DNA, 22 bp, Homo sapiens
ccagagctgattcctgggactt

SEQ ID NO: 108138 - DNA, 22 bp, Homo sapiens
tcactgcaacctctgcctcccg

SEQ ID NO: 108139 - DNA, 22 bp, Homo sapiens
tttgtgaataggttggcttcca

SEQ ID NO: 108140 - DNA, 22 bp, Homo sapiens
ctcggcaggtggaggttgtagt

SEQ ID NO: 108141 - DNA, 22 bp, Homo sapiens
tgggctgtggagcacctttgca

SEQ ID NO: 108142 - DNA, 22 bp, Homo sapiens
agatgtgtttctagttcctgca

SEQ ID NO: 108143 - DNA, 22 bp, Homo sapiens
tgagccatgggactccaaggga

SEQ ID NO: 108144 - DNA, 22 bp, Homo sapiens
agggctggagccacagctggga

SEQ ID NO: 108145 - DNA, 22 bp, Homo sapiens
caggctggagtgcagtggcgct

SEQ ID NO: 108146 - DNA, 22 bp, Homo sapiens
tcacccctccattctctcatgt

SEQ ID NO: 108147 - DNA, 22 bp, Homo sapiens
tctgcaacagtgccctgtaaat

SEQ ID NO: 108148 - DNA, 22 bp, Homo sapiens
tctcgatctcctgaccttgtga

SEQ ID NO: 108149 - DNA, 22 bp, Homo sapiens
tcacttagatggggatcatcac

SEQ ID NO: 108150 - DNA, 22 bp, Homo sapiens
ctgggcgcgtcccctgaggcgg

SEQ ID NO: 108151 - DNA, 22 bp, Homo sapiens
gtaaaaaggccaagcccttgtg

SEQ ID NO: 108152 - DNA, 22 bp, Homo sapiens
atgaaaacggaccagagctatt

SEQ ID NO: 108153 - DNA, 22 bp, Homo sapiens
agaggctgcacttgctcatgat

SEQ ID NO: 108154 - DNA, 22 bp, Homo sapiens
acatcttttactctggttcggg

SEQ ID NO: 108155 - DNA, 22 bp, Homo sapiens
ttatttttaaaagttcacacag

SEQ ID NO: 108156 - DNA, 22 bp, Homo sapiens
tgcaatgatattgtcaaagcat

SEQ ID NO: 108157 - DNA, 22 bp, Homo sapiens
tagatatttctactgtggatta

SEQ ID NO: 108158 - DNA, 22 bp, Homo sapiens
ggcgctcagtgttgccccagag

SEQ ID NO: 108159 - DNA, 22 bp, Homo sapiens
ctctgcctcagtgatttcttta

SEQ ID NO: 108160 - DNA, 22 bp, Homo sapiens
gggcaccttgggtctcaggcaa

SEQ ID NO: 108161 - DNA, 22 bp, Homo sapiens
gtgggctgcccttgaggtcagc

SEQ ID NO: 108162 - DNA, 23 bp, Homo sapiens
ggaagctcacgtagtcctgcact

SEQ ID NO: 108163 - DNA, 22 bp, Homo sapiens
ggtgggaggactgtttgaggca

SEQ ID NO: 108164 - DNA, 22 bp, Homo sapiens
tcctcagaatcacctggcagct

SEQ ID NO: 108165 - DNA, 22 bp, Homo sapiens
agccagggtctctcgctctgtt

SEQ ID NO: 108166 - DNA, 22 bp, Homo sapiens
gctgcgccggatcccacgttcc

SEQ ID NO: 108167 - DNA, 22 bp, Homo sapiens
aacctcaaactcttgggcttaa

SEQ ID NO: 108168 - DNA, 22 bp, Homo sapiens
tccttgtaaaggagctctaaca

SEQ ID NO: 108169 - DNA, 19 bp, Homo sapiens
tccagatgatatggattac

SEQ ID NO: 108170 - DNA, 22 bp, Homo sapiens
gcaccacatcaatgaggggagc

SEQ ID NO: 108171 - DNA, 22 bp, Homo sapiens
tttgaggttagctagcagatca

SEQ ID NO: 108172 - DNA, 22 bp, Homo sapiens
catgcacttacctgaaattcaa

SEQ ID NO: 108173 - DNA, 22 bp, Homo sapiens
agttctgacctaacctttctca

SEQ ID NO: 108174 - DNA, 22 bp, Homo sapiens
tgtcctcgtccgcctcgaactc

SEQ ID NO: 108175 - DNA, 22 bp, Homo sapiens
gccaggcgggtctcaaactcct

SEQ ID NO: 108176 - DNA, 22 bp, Homo sapiens
tgagccagaggaggctgtgtgg

SEQ ID NO: 108177 - DNA, 22 bp, Homo sapiens
cagcagtgtacaaggtgtcaga

SEQ ID NO: 108178 - DNA, 22 bp, Homo sapiens
cccaccagtacagatggtagat

SEQ ID NO: 108179 - DNA, 22 bp, Homo sapiens
ccagatgtccctctcaggtttg

SEQ ID NO: 108180 - DNA, 22 bp, Homo sapiens
tttctcctcatgactggttgtg

SEQ ID NO: 108181 - DNA, 21 bp, Homo sapiens
atctcgggcttctcgcccagc

SEQ ID NO: 108182 - DNA, 18 bp, Homo sapiens
taggagagaatttattta

SEQ ID NO: 108183 - DNA, 22 bp, Homo sapiens
tccattatacttctgattcaaa

SEQ ID NO: 108184 - DNA, 22 bp, Homo sapiens
tgcctgatgcaggagtatcaga

SEQ ID NO: 108185 - DNA, 22 bp, Homo sapiens
tggggcagttaataaacattct

SEQ ID NO: 108186 - DNA, 22 bp, Homo sapiens
ctgtccccacccaaatctcatc

SEQ ID NO: 108187 - DNA, 22 bp, Homo sapiens
gctcactgcaagctccgcctcc

SEQ ID NO: 108188 - DNA, 22 bp, Homo sapiens
ccagctttatagcttcaaagga

SEQ ID NO: 108189 - DNA, 20 bp, Homo sapiens
gtctccactgggggttaacc

SEQ ID NO: 108190 - DNA, 22 bp, Homo sapiens
gggcagatcacctgaggtcagg

SEQ ID NO: 108191 - DNA, 22 bp, Homo sapiens
tctcagggctcagagctcaggc

SEQ ID NO: 108192 - DNA, 22 bp, Homo sapiens
ggaggcagaatagagtgtgggt

SEQ ID NO: 108193 - DNA, 22 bp, Homo sapiens
tttgggcaggcttttccctaga

SEQ ID NO: 108194 - DNA, 22 bp, Homo sapiens
attcatcagctaatggacattt

SEQ ID NO: 108195 - DNA, 22 bp, Homo sapiens
aaggggaagagaccgcagagtc

SEQ ID NO: 108196 - DNA, 22 bp, Homo sapiens
gcagtggcatgatgtgggctca

SEQ ID NO: 108197 - DNA, 22 bp, Homo sapiens
aagggcctgccagctcttcatg

SEQ ID NO: 108198 - DNA, 22 bp, Homo sapiens
ttcctagggcagagccgctggg

SEQ ID NO: 108199 - DNA, 22 bp, Homo sapiens
ctgctcttgagggactgcggtc

SEQ ID NO: 108200 - DNA, 22 bp, Homo sapiens
atatgtggcattatttctgagg

SEQ ID NO: 108201 - DNA, 22 bp, Homo sapiens
tgtctggtgggttgacaggcag

SEQ ID NO: 108202 - DNA, 22 bp, Homo sapiens
aaggaaagctgtggttctgaga

SEQ ID NO: 108203 - DNA, 22 bp, Homo sapiens
actgcacttcaccctgggtgac

SEQ ID NO: 108204 - DNA, 22 bp, Homo sapiens
ccaaagtgctgggattcaggca

SEQ ID NO: 108205 - DNA, 22 bp, Homo sapiens
aatggaatacctaggtggccca

SEQ ID NO: 108206 - DNA, 22 bp, Homo sapiens
gcagcagtgctttggaatcctg

SEQ ID NO: 108207 - DNA, 22 bp, Homo sapiens
tcgcgggttgcacatggccatc

SEQ ID NO: 108208 - DNA, 22 bp, Homo sapiens
ccactattactgtgtggcagtc

SEQ ID NO: 108209 - DNA, 22 bp, Homo sapiens
tctaaattactttgggcagtat

SEQ ID NO: 108210 - DNA, 20 bp, Homo sapiens
aggccccaggtggacactag

SEQ ID NO: 108211 - DNA, 22 bp, Homo sapiens
cactgcactccagcctgggtca

SEQ ID NO: 108212 - DNA, 22 bp, Homo sapiens
tcaccaggctagagtgcagtgg

SEQ ID NO: 108213 - DNA, 22 bp, Homo sapiens
gccgggttcaagccattctcct

SEQ ID NO: 108214 - DNA, 22 bp, Homo sapiens
gtgaggtggtacaatattaact

SEQ ID NO: 108215 - DNA, 22 bp, Homo sapiens
tggtattacttctagacacaag

SEQ ID NO: 108216 - DNA, 22 bp, Homo sapiens
atacacgtgccatgttggtgtg

SEQ ID NO: 108217 - DNA, 22 bp, Homo sapiens
attgtgaatagtgctgcaataa

SEQ ID NO: 108218 - DNA, 22 bp, Homo sapiens
cagtggaggccttgggaccttt

SEQ ID NO: 108219 - DNA, 22 bp, Homo sapiens
gcaaagaatgcagatttgcctc

SEQ ID NO: 108220 - DNA, 22 bp, Homo sapiens
gttcacagtttctaatcccagc

SEQ ID NO: 108221 - DNA, 22 bp, Homo sapiens
gactggaaagcctgtcctcaga

SEQ ID NO: 108222 - DNA, 22 bp, Homo sapiens
tggtggctaccaggtcctgggg

SEQ ID NO: 108223 - DNA, 22 bp, Homo sapiens
atcgcaagtttaaaaatctttg

SEQ ID NO: 108224 - DNA, 22 bp, Homo sapiens
cctagagctctgctttatctaa

SEQ ID NO: 108225 - DNA, 22 bp, Homo sapiens
aggggcgtgctcttccccgacg

SEQ ID NO: 108226 - DNA, 23 bp, Homo sapiens
aggaaagcattcatttttaccat

SEQ ID NO: 108227 - DNA, 22 bp, Homo sapiens
ttaaattttagaaacagactct

SEQ ID NO: 108228 - DNA, 22 bp, Homo sapiens
tggatgctgtaggacacgctct

SEQ ID NO: 108229 - DNA, 17 bp, Homo sapiens
tccttcagtgcctctgc

SEQ ID NO: 108230 - DNA, 22 bp, Homo sapiens
gaaagagaacctgggcctagat

SEQ ID NO: 108231 - DNA, 22 bp, Homo sapiens
agtccaggactgtttcagctga

SEQ ID NO: 108232 - DNA, 22 bp, Homo sapiens
ctgagcctcctgcttctatttc

SEQ ID NO: 108233 - DNA, 22 bp, Homo sapiens
cggctgggttcggctgcaggcc

SEQ ID NO: 108234 - DNA, 22 bp, Homo sapiens
gcctcctgagtagctgggattg

SEQ ID NO: 108235 - DNA, 22 bp, Homo sapiens
tgagcccagagatctgagctat

SEQ ID NO: 108236 - DNA, 23 bp, Homo sapiens
cagggccctgctcaatttctcca

SEQ ID NO: 108237 - DNA, 21 bp, Homo sapiens
agctgcctccacttctgaggc

SEQ ID NO: 108238 - DNA, 22 bp, Homo sapiens
agaagcattggaccaggggccc

SEQ ID NO: 108239 - DNA, 23 bp, Homo sapiens
gacagagtgagaccttgtcttac

SEQ ID NO: 108240 - DNA, 22 bp, Homo sapiens
tggcacaggatctcagcggcca

SEQ ID NO: 108241 - DNA, 22 bp, Homo sapiens
gcaggcaggcttccttgaactg

SEQ ID NO: 108242 - DNA, 22 bp, Homo sapiens
ttgggctcaggagtttgagacc

SEQ ID NO: 108243 - DNA, 22 bp, Homo sapiens
ttcaccctggaccagaaattgg

SEQ ID NO: 108244 - DNA, 22 bp, Homo sapiens
gcaggagaacaaagcaagctgc

SEQ ID NO: 108245 - DNA, 22 bp, Homo sapiens
ggctgggcctctccctcagctg

SEQ ID NO: 108246 - DNA, 20 bp, Homo sapiens
ccagagctgatggctgcccg

SEQ ID NO: 108247 - DNA, 22 bp, Homo sapiens
cctgtatggctattccttggac

SEQ ID NO: 108248 - DNA, 22 bp, Homo sapiens
cagcctggtccccggctcaccc

SEQ ID NO: 108249 - DNA, 22 bp, Homo sapiens
gagcccaggagtttgatgctgc

SEQ ID NO: 108250 - DNA, 22 bp, Homo sapiens
gtgggacaaggatgaagatatt

SEQ ID NO: 108251 - DNA, 22 bp, Homo sapiens
agatgtgagaatcaagtgacca

SEQ ID NO: 108252 - DNA, 20 bp, Homo sapiens
gggcagagccagccagtccc

SEQ ID NO: 108253 - DNA, 22 bp, Homo sapiens
cagggccagcgtctcgggctat

SEQ ID NO: 108254 - DNA, 22 bp, Homo sapiens
gggagctggagctggaagactc

SEQ ID NO: 108255 - DNA, 22 bp, Homo sapiens
accacatcgggcggacactggg

SEQ ID NO: 108256 - DNA, 22 bp, Homo sapiens
cacccaggcaaggattctgcaa

SEQ ID NO: 108257 - DNA, 19 bp, Homo sapiens
agccagccagcaggtatgc

SEQ ID NO: 108258 - DNA, 22 bp, Homo sapiens
gaccttgtgatccgcccgcctt

SEQ ID NO: 108259 - DNA, 22 bp, Homo sapiens
acacagggctgcgcctgacccc

SEQ ID NO: 108260 - DNA, 22 bp, Homo sapiens
ggtagaaggggaagaggtccat

SEQ ID NO: 108261 - DNA, 22 bp, Homo sapiens
ggctgagttgagaggattactt

SEQ ID NO: 108262 - DNA, 22 bp, Homo sapiens
cctgcttaacattgccatgaca

SEQ ID NO: 108263 - DNA, 22 bp, Homo sapiens
gttggagtgcagcttgtgcgat

SEQ ID NO: 108264 - DNA, 22 bp, Homo sapiens
aacttaggaaaataaggcatga

SEQ ID NO: 108265 - DNA, 22 bp, Homo sapiens
tctggtgtcagtattctttgaa

SEQ ID NO: 108266 - DNA, 22 bp, Homo sapiens
gagggccctggctggctccagc

SEQ ID NO: 108267 - DNA, 17 bp, Homo sapiens
tggctctgtcctcagct

SEQ ID NO: 108268 - DNA, 22 bp, Homo sapiens
ctcagggccaaggatgctgttg

SEQ ID NO: 108269 - DNA, 23 bp, Homo sapiens
gggtccagccaattccaaggaaa

SEQ ID NO: 108270 - DNA, 22 bp, Homo sapiens
tggtgggctgagtctcatcgga

SEQ ID NO: 108271 - DNA, 22 bp, Homo sapiens
aaggcaggatgggaaaagattt

SEQ ID NO: 108272 - DNA, 22 bp, Homo sapiens
actgcactccagcctgggtgat

SEQ ID NO: 108273 - DNA, 22 bp, Homo sapiens
tgcgaccctagccccctcactt

SEQ ID NO: 108274 - DNA, 22 bp, Homo sapiens
attgggatgccggctgataaga

SEQ ID NO: 108275 - DNA, 22 bp, Homo sapiens
caggcactgtgctgagctctgc

SEQ ID NO: 108276 - DNA, 22 bp, Homo sapiens
ttctcttttcaccagttgctaa

SEQ ID NO: 108277 - DNA, 22 bp, Homo sapiens
ttccatacgactgaggtctcgg

SEQ ID NO: 108278 - DNA, 22 bp, Homo sapiens
agatgctgctccacaggccagg

SEQ ID NO: 108279 - DNA, 22 bp, Homo sapiens
ttagggttacaccagcctcctg

SEQ ID NO: 108280 - DNA, 22 bp, Homo sapiens
ccaggctgctgttggtgtccgc

SEQ ID NO: 108281 - DNA, 22 bp, Homo sapiens
agctggggctgtggttgtgatt

SEQ ID NO: 108282 - DNA, 22 bp, Homo sapiens
tgtgaagaattaatgtgaatca

SEQ ID NO: 108283 - DNA, 22 bp, Homo sapiens
cccaaagcagttgatgtaccag

SEQ ID NO: 108284 - DNA, 22 bp, Homo sapiens
atcacaaaggtctcagagcaca

SEQ ID NO: 108285 - DNA, 22 bp, Homo sapiens
gcagcctgggcaacagagtgag

SEQ ID NO: 108286 - DNA, 22 bp, Homo sapiens
aaatatcttaggagtatatgag

SEQ ID NO: 108287 - DNA, 22 bp, Homo sapiens
gagagcaggaggcagcgggacg

SEQ ID NO: 108288 - DNA, 22 bp, Homo sapiens
tgcaaatgtgttttaaaccaaa

SEQ ID NO: 108289 - DNA, 22 bp, Homo sapiens
gggcggatcatttgaggtcagg

SEQ ID NO: 108290 - DNA, 22 bp, Homo sapiens
cccaggaggtggaggctgcagt

SEQ ID NO: 108291 - DNA, 22 bp, Homo sapiens
gagcaggaaggccagaagggtc

SEQ ID NO: 108292 - DNA, 22 bp, Homo sapiens
ggagaccagaaggaagcttcga

SEQ ID NO: 108293 - DNA, 19 bp, Homo sapiens
acacagggatcagagggtt

SEQ ID NO: 108294 - DNA, 22 bp, Homo sapiens
cacccaggctggagtgcagtga

SEQ ID NO: 108295 - DNA, 22 bp, Homo sapiens
cacccaggctggaatgcagtgg

SEQ ID NO: 108296 - DNA, 22 bp, Homo sapiens
ggttttcacctccagaatgtgc

SEQ ID NO: 108297 - DNA, 22 bp, Homo sapiens
ctatgaccccagcatgaataag

SEQ ID NO: 108298 - DNA, 22 bp, Homo sapiens
cacctgtacagggccgggctgg

SEQ ID NO: 108299 - DNA, 22 bp, Homo sapiens
aggatgagccgcgcaagctgac

SEQ ID NO: 108300 - DNA, 22 bp, Homo sapiens
agatggggtttcatcatgttgg

SEQ ID NO: 108301 - DNA, 17 bp, Homo sapiens
gggcagggactcctggg

SEQ ID NO: 108302 - DNA, 22 bp, Homo sapiens
ggttgtagttggaggttgtata

SEQ ID NO: 108303 - DNA, 22 bp, Homo sapiens
tacaagatgacaggtgcatgat

SEQ ID NO: 108304 - DNA, 22 bp, Homo sapiens
agggaattcactggaacgccct

SEQ ID NO: 108305 - DNA, 22 bp, Homo sapiens
tctcaatttgattacattcata

SEQ ID NO: 108306 - DNA, 22 bp, Homo sapiens
tgcacgtgtgagcattcacatg

SEQ ID NO: 108307 - DNA, 22 bp, Homo sapiens
ggagagcttggagtgcgatttt

SEQ ID NO: 108308 - DNA, 22 bp, Homo sapiens
gggcttggcacatgggctcagc

SEQ ID NO: 108309 - DNA, 22 bp, Homo sapiens
agaaggacccggtgggagatga

SEQ ID NO: 108310 - DNA, 22 bp, Homo sapiens
ggttggacactaggtaggagcg

SEQ ID NO: 108311 - DNA, 22 bp, Homo sapiens
tgtaggagtccaatcaggagac

SEQ ID NO: 108312 - DNA, 22 bp, Homo sapiens
aggttatatgactgtcatgcct

SEQ ID NO: 108313 - DNA, 22 bp, Homo sapiens
ttgtgaaacattcatggatttg

SEQ ID NO: 108314 - DNA, 22 bp, Homo sapiens
ctgtaatcccagctacctggga

SEQ ID NO: 108315 - DNA, 22 bp, Homo sapiens
ggctgggctccgggagcatgcg

SEQ ID NO: 108316 - DNA, 22 bp, Homo sapiens
tagcccctgcctttgaacctgg

SEQ ID NO: 108317 - DNA, 22 bp, Homo sapiens
ctcgggcttgaggctgtttacc

SEQ ID NO: 108318 - DNA, 22 bp, Homo sapiens
acgtagcactgagagatgcagg

SEQ ID NO: 108319 - DNA, 22 bp, Homo sapiens
tggaatggaaacaaactgagga

SEQ ID NO: 108320 - DNA, 22 bp, Homo sapiens
atccccctgtatctggaagaat

SEQ ID NO: 108321 - DNA, 19 bp, Homo sapiens
agataagagttgactgtgg

SEQ ID NO: 108322 - DNA, 23 bp, Homo sapiens
caggagatggctgctgtgtcagc

SEQ ID NO: 108323 - DNA, 22 bp, Homo sapiens
tttgatccgttgctggtgagga

SEQ ID NO: 108324 - DNA, 18 bp, Homo sapiens
tctgtgggatcagtgagg

SEQ ID NO: 108325 - DNA, 22 bp, Homo sapiens
ctacaaaagtaattgtggtttt

SEQ ID NO: 108326 - DNA, 22 bp, Homo sapiens
ggggaccctcaggactgcgtct

SEQ ID NO: 108327 - DNA, 22 bp, Homo sapiens
cagctgcccctccagggctggg

SEQ ID NO: 108328 - DNA, 22 bp, Homo sapiens
gtgaccatcatctcagctagtt

SEQ ID NO: 108329 - DNA, 22 bp, Homo sapiens
aaaccgcaatcacttttgcacc

SEQ ID NO: 108330 - DNA, 20 bp, Homo sapiens
aagacaccagtggcagcccc

SEQ ID NO: 108331 - DNA, 22 bp, Homo sapiens
aggtgcttggctcgtgcacaca

SEQ ID NO: 108332 - DNA, 22 bp, Homo sapiens
tggcttccccggagtgacatgt

SEQ ID NO: 108333 - DNA, 22 bp, Homo sapiens
cactgcactccatcctgggaaa

SEQ ID NO: 108334 - DNA, 22 bp, Homo sapiens
cacagctgtgagaagggagcct

SEQ ID NO: 108335 - DNA, 22 bp, Homo sapiens
ccctcccagatgggcttgaggt

SEQ ID NO: 108336 - DNA, 22 bp, Homo sapiens
cctgattcagtggtgcccagag

SEQ ID NO: 108337 - DNA, 22 bp, Homo sapiens
aagaaatgctgatgttggatgg

SEQ ID NO: 108338 - DNA, 22 bp, Homo sapiens
taactgattcctttttgaaaat

SEQ ID NO: 108339 - DNA, 22 bp, Homo sapiens
tagcaaaggatgactatgtacc

SEQ ID NO: 108340 - DNA, 22 bp, Homo sapiens
cagcagcagtggctgcagaaca

SEQ ID NO: 108341 - DNA, 22 bp, Homo sapiens
cagtcctgaatactggacggtg

SEQ ID NO: 108342 - DNA, 22 bp, Homo sapiens
ccaccgccatggcgttgtacag

SEQ ID NO: 108343 - DNA, 22 bp, Homo sapiens
atgagctcatccgagtcacact

SEQ ID NO: 108344 - DNA, 22 bp, Homo sapiens
tgtgcgtcctgtgcgcacactg

SEQ ID NO: 108345 - DNA, 23 bp, Homo sapiens
tgttccagatacgccttttcctc

SEQ ID NO: 108346 - DNA, 22 bp, Homo sapiens
gatgctgagaggtggagggaac

SEQ ID NO: 108347 - DNA, 19 bp, Homo sapiens
atcaggcttctattttctc

SEQ ID NO: 108348 - DNA, 22 bp, Homo sapiens
atgtcactgttgttattgttat

SEQ ID NO: 108349 - DNA, 22 bp, Homo sapiens
gagatttccatattttgtaaca

SEQ ID NO: 108350 - DNA, 22 bp, Homo sapiens
agcccaggtccagttcactgca

SEQ ID NO: 108351 - DNA, 22 bp, Homo sapiens
gatggcacacagacatccccgc

SEQ ID NO: 108352 - DNA, 22 bp, Homo sapiens
tgtgactggttgtcccgctttc

SEQ ID NO: 108353 - DNA, 22 bp, Homo sapiens
gaggcagaggttgcagtgagct

SEQ ID NO: 108354 - DNA, 22 bp, Homo sapiens
aggagctgtcagagtgccagag

SEQ ID NO: 108355 - DNA, 22 bp, Homo sapiens
acaaacagagttgaaaaatagg

SEQ ID NO: 108356 - DNA, 22 bp, Homo sapiens
tcagtgatttctggggtgaggg

SEQ ID NO: 108357 - DNA, 22 bp, Homo sapiens
tcactgcagcctctgcctcccg

SEQ ID NO: 108358 - DNA, 22 bp, Homo sapiens
tcagcctggcaggatggcctgg

SEQ ID NO: 108359 - DNA, 22 bp, Homo sapiens
ggccagcctggggctcccagac

SEQ ID NO: 108360 - DNA, 22 bp, Homo sapiens
ttcttctccgaggagggctggt

SEQ ID NO: 108361 - DNA, 22 bp, Homo sapiens
tttgtggcaggagcggagaccg

SEQ ID NO: 108362 - DNA, 22 bp, Homo sapiens
tgtgcctactgatagagccaag

SEQ ID NO: 108363 - DNA, 22 bp, Homo sapiens
cccaggctggagtgcagtggcg

SEQ ID NO: 108364 - DNA, 22 bp, Homo sapiens
aggggagccagggctgcgagtt

SEQ ID NO: 108365 - DNA, 22 bp, Homo sapiens
tgtttgagttctagcgcattta

SEQ ID NO: 108366 - DNA, 22 bp, Homo sapiens
ctgagtttccagataagacctt

SEQ ID NO: 108367 - DNA, 22 bp, Homo sapiens
aggtggggaggagtgtctcttt

SEQ ID NO: 108368 - DNA, 22 bp, Homo sapiens
agagagcccgggccagggcaca

SEQ ID NO: 108369 - DNA, 22 bp, Homo sapiens
atggagttctgccagcgctgct

SEQ ID NO: 108370 - DNA, 22 bp, Homo sapiens
tggctaaaccctagtaaattaa

SEQ ID NO: 108371 - DNA, 22 bp, Homo sapiens
cacagctgaagtagccatgtgg

SEQ ID NO: 108372 - DNA, 22 bp, Homo sapiens
taagaaatttagttatagaatg

SEQ ID NO: 108373 - DNA, 22 bp, Homo sapiens
tcagcctgctccaagtgctgcc

SEQ ID NO: 108374 - DNA, 22 bp, Homo sapiens
cgtcccgggttcacgccattct

SEQ ID NO: 108375 - DNA, 22 bp, Homo sapiens
tacagaagcttttgaaaagatg

SEQ ID NO: 108376 - DNA, 19 bp, Homo sapiens
agtcctggcctgggggacc

SEQ ID NO: 108377 - DNA, 22 bp, Homo sapiens
ccgcggggcgtgggctcttacc

SEQ ID NO: 108378 - DNA, 21 bp, Homo sapiens
cactccacttagaacagggtt

SEQ ID NO: 108379 - DNA, 22 bp, Homo sapiens
tcactgcactccagcctgggtg

SEQ ID NO: 108380 - DNA, 22 bp, Homo sapiens
tagctcaaaggttaagtgtgga

SEQ ID NO: 108381 - DNA, 22 bp, Homo sapiens
ggctagggatctagaccaggac

SEQ ID NO: 108382 - DNA, 22 bp, Homo sapiens
gctcactgcaacctccgccttc

SEQ ID NO: 108383 - DNA, 22 bp, Homo sapiens
ctggctgggagcgagctgctca

SEQ ID NO: 108384 - DNA, 22 bp, Homo sapiens
gcgcaccacctccaggtggccg

SEQ ID NO: 108385 - DNA, 22 bp, Homo sapiens
gcggctccgaagccaggccgcg

SEQ ID NO: 108386 - DNA, 22 bp, Homo sapiens
ggttccccaggcggcccttgga

SEQ ID NO: 108387 - DNA, 22 bp, Homo sapiens
tgtcatagtgtggtagcagtgg

SEQ ID NO: 108388 - DNA, 22 bp, Homo sapiens
ggaggggatttagtagatgcta

SEQ ID NO: 108389 - DNA, 22 bp, Homo sapiens
caggaagctgtgaaggagacgg

SEQ ID NO: 108390 - DNA, 18 bp, Homo sapiens
tgagaggctattttttgc

SEQ ID NO: 108391 - DNA, 22 bp, Homo sapiens
gtgaataaaacacctgccaaga

SEQ ID NO: 108392 - DNA, 22 bp, Homo sapiens
ttgtgaatggtgccgcaataaa

SEQ ID NO: 108393 - DNA, 23 bp, Homo sapiens
gcctgccgcctggctgagaactg

SEQ ID NO: 108394 - DNA, 22 bp, Homo sapiens
ttctcccctttagggcctacgg

SEQ ID NO: 108395 - DNA, 22 bp, Homo sapiens
cacccaggctggagagcagtgg

SEQ ID NO: 108396 - DNA, 22 bp, Homo sapiens
ggcctacgccagtatccccagg

SEQ ID NO: 108397 - DNA, 22 bp, Homo sapiens
gagaaatgcatgcatgtcatca

SEQ ID NO: 108398 - DNA, 22 bp, Homo sapiens
tactgtactgcagttctgcaaa

SEQ ID NO: 108399 - DNA, 22 bp, Homo sapiens
cccaggaggtcgaagctgcagt

SEQ ID NO: 108400 - DNA, 22 bp, Homo sapiens
cccagaaggtcgaggctgcagt

SEQ ID NO: 108401 - DNA, 22 bp, Homo sapiens
ttgctctgactggagtgcagtg

SEQ ID NO: 108402 - DNA, 22 bp, Homo sapiens
ggtcttttctgctgcaggttgt

SEQ ID NO: 108403 - DNA, 22 bp, Homo sapiens
tgaacatgctgttgatggcctg

SEQ ID NO: 108404 - DNA, 23 bp, Homo sapiens
actgagccagggcctgggtcagc

SEQ ID NO: 108405 - DNA, 22 bp, Homo sapiens
aatccaggtggcggaggttgtg

SEQ ID NO: 108406 - DNA, 22 bp, Homo sapiens
tgccgtggggctgaggctggag

SEQ ID NO: 108407 - DNA, 22 bp, Homo sapiens
ggaggacaggggctgcagcaca

SEQ ID NO: 108408 - DNA, 22 bp, Homo sapiens
cggagcctgcttgttgcagctg

SEQ ID NO: 108409 - DNA, 22 bp, Homo sapiens
gagaaagcttctttcccacagg

SEQ ID NO: 108410 - DNA, 22 bp, Homo sapiens
cactctcagcataatgaatgtg

SEQ ID NO: 108411 - DNA, 20 bp, Homo sapiens
gtgcaatggctcagtctcag

SEQ ID NO: 108412 - DNA, 22 bp, Homo sapiens
atttgattgtgtctgagacgat

SEQ ID NO: 108413 - DNA, 22 bp, Homo sapiens
tgacttcctgcactcaggtgat

SEQ ID NO: 108414 - DNA, 22 bp, Homo sapiens
caaccgcggggcccagcggttc

SEQ ID NO: 108415 - DNA, 22 bp, Homo sapiens
tacctcaagttccaggaaagcg

SEQ ID NO: 108416 - DNA, 22 bp, Homo sapiens
ggagtgaatcactagatgcaga

SEQ ID NO: 108417 - DNA, 23 bp, Homo sapiens
acagcaagaggaccagatgtgag

SEQ ID NO: 108418 - DNA, 22 bp, Homo sapiens
ggcagcactgcagcttgttggg

SEQ ID NO: 108419 - DNA, 22 bp, Homo sapiens
tgcctcagctgaggccgctcca

SEQ ID NO: 108420 - DNA, 22 bp, Homo sapiens
ggggccttggatctgtgccccg

SEQ ID NO: 108421 - DNA, 22 bp, Homo sapiens
cattctcagtatcagccagccc

SEQ ID NO: 108422 - DNA, 22 bp, Homo sapiens
cttatttgcccatgtttcttta

SEQ ID NO: 108423 - DNA, 19 bp, Homo sapiens
gggcaaagtgatcgtcctg

SEQ ID NO: 108424 - DNA, 22 bp, Homo sapiens
aggagccagtggagttcctgcc

SEQ ID NO: 108425 - DNA, 22 bp, Homo sapiens
aaggccctggcaggaagcagga

SEQ ID NO: 108426 - DNA, 22 bp, Homo sapiens
gtaatctcagctacttgggagg

SEQ ID NO: 108427 - DNA, 22 bp, Homo sapiens
ggagtgactcacagctgggaca

SEQ ID NO: 108428 - DNA, 22 bp, Homo sapiens
gctgtagtgaatggccgcgttc

SEQ ID NO: 108429 - DNA, 22 bp, Homo sapiens
caggctggagttcagtggtgtg

SEQ ID NO: 108430 - DNA, 19 bp, Homo sapiens
gccgggcccgggttggccg

SEQ ID NO: 108431 - DNA, 22 bp, Homo sapiens
ctgtccctgagcaactcctgtt

SEQ ID NO: 108432 - DNA, 22 bp, Homo sapiens
tgtccaggctggagtgcagtgg

SEQ ID NO: 108433 - DNA, 22 bp, Homo sapiens
aacaattactaccaaggcctgt

SEQ ID NO: 108434 - DNA, 22 bp, Homo sapiens
cacccaggttggagtgcagtgg

SEQ ID NO: 108435 - DNA, 22 bp, Homo sapiens
gaagttctttatagcagtgtga

SEQ ID NO: 108436 - DNA, 22 bp, Homo sapiens
gctgtggcctggcgcagagctg

SEQ ID NO: 108437 - DNA, 22 bp, Homo sapiens
aatgttacgatcaacaacacat

SEQ ID NO: 108438 - DNA, 22 bp, Homo sapiens
ctgtcaggttggtctcagagct

SEQ ID NO: 108439 - DNA, 22 bp, Homo sapiens
tagactagaggatcagcaaggg

SEQ ID NO: 108440 - DNA, 22 bp, Homo sapiens
tcgaactcatagtcgtagctgt

SEQ ID NO: 108441 - DNA, 22 bp, Homo sapiens
tcactgcaatctcagcctcctg

SEQ ID NO: 108442 - DNA, 22 bp, Homo sapiens
ctggcaggtggaggttgcagtg

SEQ ID NO: 108443 - DNA, 22 bp, Homo sapiens
aggagggagcttaagccaggca

SEQ ID NO: 108444 - DNA, 22 bp, Homo sapiens
ctctggaggtggaggttgcagt

SEQ ID NO: 108445 - DNA, 16 bp, Homo sapiens
gcaggcagatcacatg

SEQ ID NO: 108446 - DNA, 21 bp, Homo sapiens
gctcctggtgctgcgtggcgc

SEQ ID NO: 108447 - DNA, 22 bp, Homo sapiens
cattccttaacgtggggagtct

SEQ ID NO: 108448 - DNA, 22 bp, Homo sapiens
gagatggagtctttttctgtca

SEQ ID NO: 108449 - DNA, 22 bp, Homo sapiens
gtggagagagataagcctggtc

SEQ ID NO: 108450 - DNA, 22 bp, Homo sapiens
tgcatttcccattgtgtggctc

SEQ ID NO: 108451 - DNA, 22 bp, Homo sapiens
tcccacacagcccgctcaccgg

SEQ ID NO: 108452 - DNA, 22 bp, Homo sapiens
gaggcaggcagattgcttgagg

SEQ ID NO: 108453 - DNA, 22 bp, Homo sapiens
acaggtgcatgctaccatgtct

SEQ ID NO: 108454 - DNA, 22 bp, Homo sapiens
ccaggctggagtatagtggcgc

SEQ ID NO: 108455 - DNA, 22 bp, Homo sapiens
cggtcaggtgcagcgttggcac

SEQ ID NO: 108456 - DNA, 22 bp, Homo sapiens
tggggagaaatgtctttgttcc

SEQ ID NO: 108457 - DNA, 22 bp, Homo sapiens
ggggatggaggcgtgtggtcct

SEQ ID NO: 108458 - DNA, 22 bp, Homo sapiens
agtgttgtcaaacggctcagca

SEQ ID NO: 108459 - DNA, 22 bp, Homo sapiens
tgcagtggcgccatctcagctc

SEQ ID NO: 108460 - DNA, 22 bp, Homo sapiens
tgctccagcaccaagagctcca

SEQ ID NO: 108461 - DNA, 22 bp, Homo sapiens
catgcggctctttccaaaccgg

SEQ ID NO: 108462 - DNA, 22 bp, Homo sapiens
ttacttaaacagaaatgcagaa

SEQ ID NO: 108463 - DNA, 22 bp, Homo sapiens
ccacagtctatgcaacaaggtc

SEQ ID NO: 108464 - DNA, 22 bp, Homo sapiens
gctcactgcaacctccacctcc

SEQ ID NO: 108465 - DNA, 22 bp, Homo sapiens
agcaggcctgccacctcggggt

SEQ ID NO: 108466 - DNA, 23 bp, Homo sapiens
atgggccaagcaagacccatgac

SEQ ID NO: 108467 - DNA, 17 bp, Homo sapiens
agccgggcatggaccag

SEQ ID NO: 108468 - DNA, 22 bp, Homo sapiens
ggagagtggattccagctgtat

SEQ ID NO: 108469 - DNA, 22 bp, Homo sapiens
gtctttatttgagattgtcatt

SEQ ID NO: 108470 - DNA, 22 bp, Homo sapiens
tcaggcagtagaattgcttgaa

SEQ ID NO: 108471 - DNA, 22 bp, Homo sapiens
atacctgtgtatccacaagcgt

SEQ ID NO: 108472 - DNA, 22 bp, Homo sapiens
cgggttcacgccattctcctgc

SEQ ID NO: 108473 - DNA, 22 bp, Homo sapiens
acccacgaagatgagcggcatg

SEQ ID NO: 108474 - DNA, 22 bp, Homo sapiens
tggtagtcggcctcggtggctc

SEQ ID NO: 108475 - DNA, 22 bp, Homo sapiens
tgttcttgagcctttagaccta

SEQ ID NO: 108476 - DNA, 22 bp, Homo sapiens
ggtgaggggctcctctgcccgg

SEQ ID NO: 108477 - DNA, 22 bp, Homo sapiens
ccatgaattcactccatgctag

SEQ ID NO: 108478 - DNA, 22 bp, Homo sapiens
tggcagtggcgggactcagggc

SEQ ID NO: 108479 - DNA, 22 bp, Homo sapiens
aaagtgctgggattacaggcgt

SEQ ID NO: 108480 - DNA, 21 bp, Homo sapiens
cgcagagcgaacttgcggcgc

SEQ ID NO: 108481 - DNA, 22 bp, Homo sapiens
cacagagatggtctggcaggtg

SEQ ID NO: 108482 - DNA, 22 bp, Homo sapiens
ttcatagtgtttccttccagtg

SEQ ID NO: 108483 - DNA, 22 bp, Homo sapiens
aactcactttgtggcttctgaa

SEQ ID NO: 108484 - DNA, 22 bp, Homo sapiens
gcagggaggtttgctgacctgg

SEQ ID NO: 108485 - DNA, 22 bp, Homo sapiens
agtgcaggccccaggccaggcc

SEQ ID NO: 108486 - DNA, 22 bp, Homo sapiens
gctgtctgtcttcacatctcgc

SEQ ID NO: 108487 - DNA, 20 bp, Homo sapiens
gggcaaggaaacagccccca

SEQ ID NO: 108488 - DNA, 18 bp, Homo sapiens
ccgggctttggtgacaca

SEQ ID NO: 108489 - DNA, 22 bp, Homo sapiens
ctggagggctgcagcgaggctg

SEQ ID NO: 108490 - DNA, 22 bp, Homo sapiens
tgcacgtgggctctctgctctt

SEQ ID NO: 108491 - DNA, 22 bp, Homo sapiens
cgctgctccgccttgtccatat

SEQ ID NO: 108492 - DNA, 22 bp, Homo sapiens
gtccagttgtatgtccagtgtc

SEQ ID NO: 108493 - DNA, 22 bp, Homo sapiens
caggctgaagtgcagtggtgtg

SEQ ID NO: 108494 - DNA, 22 bp, Homo sapiens
taactaggattacaagcgtgcg

SEQ ID NO: 108495 - DNA, 22 bp, Homo sapiens
agcccaggctggagtgcagtgg

SEQ ID NO: 108496 - DNA, 22 bp, Homo sapiens
tctgctttcttactaaaaatga

SEQ ID NO: 108497 - DNA, 22 bp, Homo sapiens
agccagggacgctgcaggctac

SEQ ID NO: 108498 - DNA, 22 bp, Homo sapiens
tgggccacacacagaagaatca

SEQ ID NO: 108499 - DNA, 22 bp, Homo sapiens
ctgcagggagaggggacagcct

SEQ ID NO: 108500 - DNA, 22 bp, Homo sapiens
gccgtgcgtgcgcaggtgctgt

SEQ ID NO: 108501 - DNA, 22 bp, Homo sapiens
gcaaatacatgttgagcaccta

SEQ ID NO: 108502 - DNA, 22 bp, Homo sapiens
tccttcagcctcccagctcaaa

SEQ ID NO: 108503 - DNA, 22 bp, Homo sapiens
tcaccggtgaccctcggctcgc

SEQ ID NO: 108504 - DNA, 22 bp, Homo sapiens
gctgctgggatcctgggtctca

SEQ ID NO: 108505 - DNA, 22 bp, Homo sapiens
tctcgacagcctggcacagtgg

SEQ ID NO: 108506 - DNA, 22 bp, Homo sapiens
actgttttctgtaaagggccag

SEQ ID NO: 108507 - DNA, 22 bp, Homo sapiens
gcgctgcgcctcctcttccgca

SEQ ID NO: 108508 - DNA, 22 bp, Homo sapiens
cccaggccccagggcttgtcag

SEQ ID NO: 108509 - DNA, 22 bp, Homo sapiens
attaagactgcccatgttttta

SEQ ID NO: 108510 - DNA, 22 bp, Homo sapiens
cccaggaggcagagcttgcagt

SEQ ID NO: 108511 - DNA, 22 bp, Homo sapiens
gcttctcgggcctgatgtcgtc

SEQ ID NO: 108512 - DNA, 22 bp, Homo sapiens
ccactgtggaaagcagttcaga

SEQ ID NO: 108513 - DNA, 18 bp, Homo sapiens
cagggctgtggggtcact

SEQ ID NO: 108514 - DNA, 22 bp, Homo sapiens
actcctacatattagcattaac

SEQ ID NO: 108515 - DNA, 22 bp, Homo sapiens
tcactgcaagctccacctcccg

SEQ ID NO: 108516 - DNA, 22 bp, Homo sapiens
gtgcaaccatcaccactgactc

SEQ ID NO: 108517 - DNA, 22 bp, Homo sapiens
ccacaggggcccacgagccgct

SEQ ID NO: 108518 - DNA, 22 bp, Homo sapiens
aaagttctctatggtgtaaaaa

SEQ ID NO: 108519 - DNA, 22 bp, Homo sapiens
aaggtgggtggatcacgaggtc

SEQ ID NO: 108520 - DNA, 22 bp, Homo sapiens
ccttttatagatcagtgtgtta

SEQ ID NO: 108521 - DNA, 22 bp, Homo sapiens
gctaggttggggaagttctcct

SEQ ID NO: 108522 - DNA, 23 bp, Homo sapiens
ctcaaccctagtaagggagtagg

SEQ ID NO: 108523 - DNA, 22 bp, Homo sapiens
gggcaggggtcagtggccccaa

SEQ ID NO: 108524 - DNA, 22 bp, Homo sapiens
tcacaaatgtttgcatgtgtct

SEQ ID NO: 108525 - DNA, 22 bp, Homo sapiens
aaaggctttaaaatgtacatat

SEQ ID NO: 108526 - DNA, 22 bp, Homo sapiens
tactgtgtgcccagccgagctg

SEQ ID NO: 108527 - DNA, 22 bp, Homo sapiens
gctccctggtagccatgctctc

SEQ ID NO: 108528 - DNA, 22 bp, Homo sapiens
ccaggaggcggaggttgcagcg

SEQ ID NO: 108529 - DNA, 22 bp, Homo sapiens
cgtgtggtcccggcaaggcaag

SEQ ID NO: 108530 - DNA, 22 bp, Homo sapiens
cctcttctaggacgtccttgtg

SEQ ID NO: 108531 - DNA, 22 bp, Homo sapiens
ctggctggagtgcaggtgagtg

SEQ ID NO: 108532 - DNA, 22 bp, Homo sapiens
acagttaataagtagtaagtca

SEQ ID NO: 108533 - DNA, 22 bp, Homo sapiens
gagatcggtaaagagcatgcac

SEQ ID NO: 108534 - DNA, 22 bp, Homo sapiens
tcaaagtccttgctttttctgt

SEQ ID NO: 108535 - DNA, 22 bp, Homo sapiens
gaggggcacagtaaagggtccc

SEQ ID NO: 108536 - DNA, 22 bp, Homo sapiens
gaccttgtgatccccctgcctt

SEQ ID NO: 108537 - DNA, 22 bp, Homo sapiens
gggagtgggtttggcctaggcc

SEQ ID NO: 108538 - DNA, 22 bp, Homo sapiens
ggcctgtaatcccagctactca

SEQ ID NO: 108539 - DNA, 22 bp, Homo sapiens
cttaactctacactgcacttta

SEQ ID NO: 108540 - DNA, 22 bp, Homo sapiens
aaggagtctgggccattcagag

SEQ ID NO: 108541 - DNA, 22 bp, Homo sapiens
ttggaggcaatgggaaggaggc

SEQ ID NO: 108542 - DNA, 22 bp, Homo sapiens
cttctgagatgttgttttacag

SEQ ID NO: 108543 - DNA, 18 bp, Homo sapiens
taggttacagccagccag

SEQ ID NO: 108544 - DNA, 22 bp, Homo sapiens
gaaccattgttgaaaagaatag

SEQ ID NO: 108545 - DNA, 22 bp, Homo sapiens
aggagcagaccgtagtcctgca

SEQ ID NO: 108546 - DNA, 22 bp, Homo sapiens
aaagtgctgggattacaggcct

SEQ ID NO: 108547 - DNA, 22 bp, Homo sapiens
gtgcgccagctcaaggggaggc

SEQ ID NO: 108548 - DNA, 22 bp, Homo sapiens
gtagctctgtttaaagttcttt

SEQ ID NO: 108549 - DNA, 22 bp, Homo sapiens
accgggaagtcctgcactgggc

SEQ ID NO: 108550 - DNA, 19 bp, Homo sapiens
agccccttggtactgtcct

SEQ ID NO: 108551 - DNA, 22 bp, Homo sapiens
ttcttttaattgtgggggagtg

SEQ ID NO: 108552 - DNA, 22 bp, Homo sapiens
ctgcttaagcaagaaagcagca

SEQ ID NO: 108553 - DNA, 22 bp, Homo sapiens
aggcttcaggtttgctttgcag

SEQ ID NO: 108554 - DNA, 22 bp, Homo sapiens
gatgtgtttccaggatttgttt

SEQ ID NO: 108555 - DNA, 22 bp, Homo sapiens
aggggatggagctggaaggcag

SEQ ID NO: 108556 - DNA, 22 bp, Homo sapiens
agatgaatccacacatggcaaa

SEQ ID NO: 108557 - DNA, 22 bp, Homo sapiens
gctgtatgtttatttgggaatt

SEQ ID NO: 108558 - DNA, 22 bp, Homo sapiens
gaggcagtccagtgggtaagaa

SEQ ID NO: 108559 - DNA, 22 bp, Homo sapiens
ggaggcggaggttgcagtgagt

SEQ ID NO: 108560 - DNA, 22 bp, Homo sapiens
ggaggtggaggttgcagtgagc

SEQ ID NO: 108561 - DNA, 22 bp, Homo sapiens
ggtcccaggttgacagggagac

SEQ ID NO: 108562 - DNA, 22 bp, Homo sapiens
actgcgtggggagctgtgacta

SEQ ID NO: 108563 - DNA, 22 bp, Homo sapiens
gcatggcttcggggtgctgcct

SEQ ID NO: 108564 - DNA, 22 bp, Homo sapiens
tgagccaggagtttgaggctgt

SEQ ID NO: 108565 - DNA, 22 bp, Homo sapiens
gtggcagagccaaggctggagc

SEQ ID NO: 108566 - DNA, 22 bp, Homo sapiens
ccaggagttggaggttgcagtg

SEQ ID NO: 108567 - DNA, 22 bp, Homo sapiens
tagtaacccacacaacagtaga

SEQ ID NO: 108568 - DNA, 23 bp, Homo sapiens
ggctgggagctccgggtgcacgt

SEQ ID NO: 108569 - DNA, 22 bp, Homo sapiens
ctgggaggcggaggttgtagtg

SEQ ID NO: 108570 - DNA, 22 bp, Homo sapiens
tgcgttgcgctcctgcagcagg

SEQ ID NO: 108571 - DNA, 20 bp, Homo sapiens
tgcagcacgggccctttcca

SEQ ID NO: 108572 - DNA, 22 bp, Homo sapiens
gcccaggagttcaagtctagtg

SEQ ID NO: 108573 - DNA, 18 bp, Homo sapiens
tgagagcattcgaggcaa

SEQ ID NO: 108574 - DNA, 22 bp, Homo sapiens
ttgtacttgccatagaacaaca

SEQ ID NO: 108575 - DNA, 22 bp, Homo sapiens
gaggagggagctggaagctctt

SEQ ID NO: 108576 - DNA, 22 bp, Homo sapiens
gcccagtagttcaaggttgcag

SEQ ID NO: 108577 - DNA, 22 bp, Homo sapiens
tgagcaggcgcagcaggaggtc

SEQ ID NO: 108578 - DNA, 22 bp, Homo sapiens
atattgaaccctacagactgta

SEQ ID NO: 108579 - DNA, 22 bp, Homo sapiens
ttccatttggcacttcactgag

SEQ ID NO: 108580 - DNA, 22 bp, Homo sapiens
ctctctgggcccagttggcacc

SEQ ID NO: 108581 - DNA, 22 bp, Homo sapiens
caggtgcctcaggatgagacaa

SEQ ID NO: 108582 - DNA, 22 bp, Homo sapiens
tcctcagtcacggtagcacatt

SEQ ID NO: 108583 - DNA, 22 bp, Homo sapiens
ccaggaggcggaaggtacagtg

SEQ ID NO: 108584 - DNA, 22 bp, Homo sapiens
tgagcctgggtggtcgaggctg

SEQ ID NO: 108585 - DNA, 22 bp, Homo sapiens
atgaccagccgagataaacaga

SEQ ID NO: 108586 - DNA, 22 bp, Homo sapiens
gggaggttgaggctgcagtgag

SEQ ID NO: 108587 - DNA, 22 bp, Homo sapiens
cagagcccctcgtctccaccac

SEQ ID NO: 108588 - DNA, 22 bp, Homo sapiens
caggctggagtgcagtggtgcc

SEQ ID NO: 108589 - DNA, 22 bp, Homo sapiens
tgcctagttctgtatttacagt

SEQ ID NO: 108590 - DNA, 22 bp, Homo sapiens
tgtccaggttagcttcaaacac

SEQ ID NO: 108591 - DNA, 22 bp, Homo sapiens
gtggagacctcctaggatgtgt

SEQ ID NO: 108592 - DNA, 22 bp, Homo sapiens
agacaaagaaaccgtagaagca

SEQ ID NO: 108593 - DNA, 22 bp, Homo sapiens
gcagctggaagtgacactctgt

SEQ ID NO: 108594 - DNA, 22 bp, Homo sapiens
atcttcccaggctggggagagg

SEQ ID NO: 108595 - DNA, 22 bp, Homo sapiens
taagggaacagcttcaaactca

SEQ ID NO: 108596 - DNA, 22 bp, Homo sapiens
ggggctgaacctggaggtggtc

SEQ ID NO: 108597 - DNA, 20 bp, Homo sapiens
gccctcatgtacaggctgga

SEQ ID NO: 108598 - DNA, 22 bp, Homo sapiens
gcccagcccagaaaggttcgga

SEQ ID NO: 108599 - DNA, 21 bp, Homo sapiens
gggcctggctgcgcaggacgg

SEQ ID NO: 108600 - DNA, 22 bp, Homo sapiens
gccggggctggggagagacatg

SEQ ID NO: 108601 - DNA, 22 bp, Homo sapiens
ctgagatctttatacgaggcac

SEQ ID NO: 108602 - DNA, 22 bp, Homo sapiens
tcttcctgtcaatgagaattaa

SEQ ID NO: 108603 - DNA, 22 bp, Homo sapiens
tgttcagaacaaaggtaaatga

SEQ ID NO: 108604 - DNA, 22 bp, Homo sapiens
gcaactgaacatgtgtgtggcc

SEQ ID NO: 108605 - DNA, 22 bp, Homo sapiens
ttgaccactgaatggttctgaa

SEQ ID NO: 108606 - DNA, 22 bp, Homo sapiens
attacctatttcattttctgtc

SEQ ID NO: 108607 - DNA, 22 bp, Homo sapiens
agtgagagtattaatgtgaact

SEQ ID NO: 108608 - DNA, 22 bp, Homo sapiens
actgcaacctccacctcctggg

SEQ ID NO: 108609 - DNA, 22 bp, Homo sapiens
ccccacaactcatgttgaaact

SEQ ID NO: 108610 - DNA, 22 bp, Homo sapiens
gcaggatgagtgagtacattta

SEQ ID NO: 108611 - DNA, 22 bp, Homo sapiens
gggtacagttcttccagtgtca

SEQ ID NO: 108612 - DNA, 22 bp, Homo sapiens
gggaggctctgctcagcccccg

SEQ ID NO: 108613 - DNA, 22 bp, Homo sapiens
tggcactgagcagccgcggcag

SEQ ID NO: 108614 - DNA, 22 bp, Homo sapiens
gcctccggagtcacagtgtctt

SEQ ID NO: 108615 - DNA, 22 bp, Homo sapiens
acatgagactgggtttgtaggg

SEQ ID NO: 108616 - DNA, 21 bp, Homo sapiens
gccatttcacacagacatttg

SEQ ID NO: 108617 - DNA, 22 bp, Homo sapiens
ggagaagaggagctggaagcct

SEQ ID NO: 108618 - DNA, 22 bp, Homo sapiens
tgttgattagtgtttagactta

SEQ ID NO: 108619 - DNA, 22 bp, Homo sapiens
cagcatgttcttgtctcactgg

SEQ ID NO: 108620 - DNA, 22 bp, Homo sapiens
acaccatactcatgttggttcc

SEQ ID NO: 108621 - DNA, 21 bp, Homo sapiens
cagagctgtccaaaccctgac

SEQ ID NO: 108622 - DNA, 22 bp, Homo sapiens
ggctgggcaggtctgcacaggg

SEQ ID NO: 108623 - DNA, 22 bp, Homo sapiens
tccctctacagggaagcgcttt

SEQ ID NO: 108624 - DNA, 22 bp, Homo sapiens
ggtcgagtcacttgttgccttt

SEQ ID NO: 108625 - DNA, 22 bp, Homo sapiens
tgaatatgtgactttgatttca

SEQ ID NO: 108626 - DNA, 22 bp, Homo sapiens
tctgttgcaatgtgcatggtga

SEQ ID NO: 108627 - DNA, 22 bp, Homo sapiens
tgagacaggcttccttcttggg

SEQ ID NO: 108628 - DNA, 22 bp, Homo sapiens
aaggctgagacagcacaggtcc

SEQ ID NO: 108629 - DNA, 22 bp, Homo sapiens
tggatatccttgttaactttct

SEQ ID NO: 108630 - DNA, 23 bp, Homo sapiens
gcgtccggcctctctcgctcccg

SEQ ID NO: 108631 - DNA, 22 bp, Homo sapiens
tgcgcggctcagtcatctccag

SEQ ID NO: 108632 - DNA, 22 bp, Homo sapiens
cctgggcctctcaaagtgctgg

SEQ ID NO: 108633 - DNA, 22 bp, Homo sapiens
tgaatgtgatgctaaacatatg

SEQ ID NO: 108634 - DNA, 22 bp, Homo sapiens
aggcaggaaaatcgcttgaacc

SEQ ID NO: 108635 - DNA, 22 bp, Homo sapiens
gttctgagtcctcctttgaagg

SEQ ID NO: 108636 - DNA, 22 bp, Homo sapiens
gctctgccagcccaaggcgcag

SEQ ID NO: 108637 - DNA, 22 bp, Homo sapiens
aattcacatccgaccaggtcaa

SEQ ID NO: 108638 - DNA, 22 bp, Homo sapiens
gggtccagtagttggtggccgt

SEQ ID NO: 108639 - DNA, 23 bp, Homo sapiens
aggatgtaggatgtatggcagag

SEQ ID NO: 108640 - DNA, 23 bp, Homo sapiens
ttgcttagagacctcctcatcag

SEQ ID NO: 108641 - DNA, 22 bp, Homo sapiens
ttctgattgctgatgaggccca

SEQ ID NO: 108642 - DNA, 22 bp, Homo sapiens
ccaggaggcggaggttgcagtg

SEQ ID NO: 108643 - DNA, 22 bp, Homo sapiens
aagaatgagctcaaagatctta

SEQ ID NO: 108644 - DNA, 22 bp, Homo sapiens
gccaccccataggtgttaggtg

SEQ ID NO: 108645 - DNA, 22 bp, Homo sapiens
ccctgccttgtctgggctaggt

SEQ ID NO: 108646 - DNA, 21 bp, Homo sapiens
aggcaccacatctccctcccc

SEQ ID NO: 108647 - DNA, 20 bp, Homo sapiens
aaaatatgtataactcttct

SEQ ID NO: 108648 - DNA, 22 bp, Homo sapiens
aaggagtggggcatatcacaga

SEQ ID NO: 108649 - DNA, 22 bp, Homo sapiens
taaagattgctcaaaactgtga

SEQ ID NO: 108650 - DNA, 22 bp, Homo sapiens
acggtgctgggtattggggttc

SEQ ID NO: 108651 - DNA, 22 bp, Homo sapiens
gcaaaagtacagccggatttct

SEQ ID NO: 108652 - DNA, 22 bp, Homo sapiens
accactgcccatggtgaaaact

SEQ ID NO: 108653 - DNA, 22 bp, Homo sapiens
caggagctcagatgacatctca

SEQ ID NO: 108654 - DNA, 21 bp, Homo sapiens
tggctaaaccctagtaaatta

SEQ ID NO: 108655 - DNA, 22 bp, Homo sapiens
aggaggggttctcgggtgctga

SEQ ID NO: 108656 - DNA, 22 bp, Homo sapiens
gctggggaggcagcagagaaca

SEQ ID NO: 108657 - DNA, 22 bp, Homo sapiens
tggtggcactgacatcagacac

SEQ ID NO: 108658 - DNA, 22 bp, Homo sapiens
cactgcactccagcttgggtga

SEQ ID NO: 108659 - DNA, 22 bp, Homo sapiens
ggagagggtaggggtcctgccc

SEQ ID NO: 108660 - DNA, 22 bp, Homo sapiens
attgcacttcagcctgggtgac

SEQ ID NO: 108661 - DNA, 18 bp, Homo sapiens
ccctgccagctcccagca

SEQ ID NO: 108662 - DNA, 22 bp, Homo sapiens
ttcaccatgttggccaggctgg

SEQ ID NO: 108663 - DNA, 22 bp, Homo sapiens
tttgaagactactgggagtgaa

SEQ ID NO: 108664 - DNA, 22 bp, Homo sapiens
agcgcttgccgcactccaagca

SEQ ID NO: 108665 - DNA, 22 bp, Homo sapiens
cattgcaacttcaaactcctgg

SEQ ID NO: 108666 - DNA, 22 bp, Homo sapiens
tcggagctgtagatgaaaccct

SEQ ID NO: 108667 - DNA, 22 bp, Homo sapiens
gatgtagacacttggaggctta

SEQ ID NO: 108668 - DNA, 22 bp, Homo sapiens
atagacgcggccgctgatgcag

SEQ ID NO: 108669 - DNA, 22 bp, Homo sapiens
aagccaggttccatggaggagc

SEQ ID NO: 108670 - DNA, 22 bp, Homo sapiens
atgttattgatgcctgaggctt

SEQ ID NO: 108671 - DNA, 22 bp, Homo sapiens
cccagcaaggccagctcagggc

SEQ ID NO: 108672 - DNA, 22 bp, Homo sapiens
ctcatcagaaatacctgacaaa

SEQ ID NO: 108673 - DNA, 22 bp, Homo sapiens
acagcccagctctttctctgca

SEQ ID NO: 108674 - DNA, 22 bp, Homo sapiens
tgggcagggagctggaaccaca

SEQ ID NO: 108675 - DNA, 22 bp, Homo sapiens
agtctgcaggaccgcgtcacat

SEQ ID NO: 108676 - DNA, 22 bp, Homo sapiens
tccccagcttgctacttctgct

SEQ ID NO: 108677 - DNA, 22 bp, Homo sapiens
aggccaggaatccttgtcccag

SEQ ID NO: 108678 - DNA, 22 bp, Homo sapiens
tcagggctgcagaagaggcagg

SEQ ID NO: 108679 - DNA, 22 bp, Homo sapiens
acccatccagtgtccctgctag

SEQ ID NO: 108680 - DNA, 22 bp, Homo sapiens
cggagtcttgctatgttgccca

SEQ ID NO: 108681 - DNA, 19 bp, Homo sapiens
tcctgcccaccagccaggg

SEQ ID NO: 108682 - DNA, 22 bp, Homo sapiens
tcctccccaaagcccagcctgg

SEQ ID NO: 108683 - DNA, 22 bp, Homo sapiens
ttttcatttttgtagatgcaag

SEQ ID NO: 108684 - DNA, 20 bp, Homo sapiens
tcacatcctctcccaacatg

SEQ ID NO: 108685 - DNA, 22 bp, Homo sapiens
acccaggctggcgtgcagtggc

SEQ ID NO: 108686 - DNA, 22 bp, Homo sapiens
gtgttaaccagctaaactttgc

SEQ ID NO: 108687 - DNA, 22 bp, Homo sapiens
tcaccaggctggagtgcagtgg

SEQ ID NO: 108688 - DNA, 22 bp, Homo sapiens
tggcaccagggaacaagcattt

SEQ ID NO: 108689 - DNA, 22 bp, Homo sapiens
aagtgctgagactacaggcatg

SEQ ID NO: 108690 - DNA, 18 bp, Homo sapiens
ggtgagggagctggaagc

SEQ ID NO: 108691 - DNA, 22 bp, Homo sapiens
tgtgcacaatgtgcaggtttgt

SEQ ID NO: 108692 - DNA, 22 bp, Homo sapiens
ttgtgagtagtgccgcaataaa

SEQ ID NO: 108693 - DNA, 22 bp, Homo sapiens
ttgtatagcccagagagtgaga

SEQ ID NO: 108694 - DNA, 22 bp, Homo sapiens
gtgggccactgggaggcaaggg

SEQ ID NO: 108695 - DNA, 22 bp, Homo sapiens
agtggcctggagccccgcctgg

SEQ ID NO: 108696 - DNA, 22 bp, Homo sapiens
tctatgcttgagacagatgggg

SEQ ID NO: 108697 - DNA, 23 bp, Homo sapiens
ctggggctttcaaatctgggcag

SEQ ID NO: 108698 - DNA, 22 bp, Homo sapiens
gaagccagtgtttgaagaattt

SEQ ID NO: 108699 - DNA, 22 bp, Homo sapiens
actgggccaggtgtgggtgagt

SEQ ID NO: 108700 - DNA, 22 bp, Homo sapiens
ggcctgcctcacagtcagcacc

SEQ ID NO: 108701 - DNA, 22 bp, Homo sapiens
tctaaacttgtaaacaagcata

SEQ ID NO: 108702 - DNA, 22 bp, Homo sapiens
ttctcaagaacatatgtagggt

SEQ ID NO: 108703 - DNA, 22 bp, Homo sapiens
tgtccaggctaaagtgcagtgg

SEQ ID NO: 108704 - DNA, 22 bp, Homo sapiens
ggagcagggaattacagcgcag

SEQ ID NO: 108705 - DNA, 22 bp, Homo sapiens
gtatcacttttgagagtgagaa

SEQ ID NO: 108706 - DNA, 23 bp, Homo sapiens
aagtggttttgaacccggaccct

SEQ ID NO: 108707 - DNA, 22 bp, Homo sapiens
tccacagtggttgaactagttt

SEQ ID NO: 108708 - DNA, 22 bp, Homo sapiens
tcacccaggctggactgcagtg

SEQ ID NO: 108709 - DNA, 22 bp, Homo sapiens
aatcggttgaacccaggaagtg

SEQ ID NO: 108710 - DNA, 22 bp, Homo sapiens
agtccggggtctggacacctgg

SEQ ID NO: 108711 - DNA, 22 bp, Homo sapiens
actgcactccaacctgggtgac

SEQ ID NO: 108712 - DNA, 22 bp, Homo sapiens
tatccaattcaccattgatggg

SEQ ID NO: 108713 - DNA, 22 bp, Homo sapiens
gtctttcttaaacaacagaaca

SEQ ID NO: 108714 - DNA, 19 bp, Homo sapiens
tcctgcctggggccgcctg

SEQ ID NO: 108715 - DNA, 22 bp, Homo sapiens
aggtcacatacaaatgctcctt

SEQ ID NO: 108716 - DNA, 22 bp, Homo sapiens
gctgggttttcttccgggccta

SEQ ID NO: 108717 - DNA, 22 bp, Homo sapiens
tgtcttcgctacaatgaaaagg

SEQ ID NO: 108718 - DNA, 22 bp, Homo sapiens
aagtgctgggattacaggcatg

SEQ ID NO: 108719 - DNA, 22 bp, Homo sapiens
tacatttataaggcttctctgt

SEQ ID NO: 108720 - DNA, 22 bp, Homo sapiens
ggccactgctctccagcctggg

SEQ ID NO: 108721 - DNA, 21 bp, Homo sapiens
agtagtttagcacagggtttg

SEQ ID NO: 108722 - DNA, 22 bp, Homo sapiens
gctcttgtcaaaaattagttga

SEQ ID NO: 108723 - DNA, 22 bp, Homo sapiens
ggcaggaggtgagtggcgggtg

SEQ ID NO: 108724 - DNA, 22 bp, Homo sapiens
agtcacagggggcccctgcaac

SEQ ID NO: 108725 - DNA, 22 bp, Homo sapiens
ggtgtagctctgtgtcccactg

SEQ ID NO: 108726 - DNA, 22 bp, Homo sapiens
cattacagaatatgtaatgatc

SEQ ID NO: 108727 - DNA, 22 bp, Homo sapiens
tgaagctttaggatgggttcat

SEQ ID NO: 108728 - DNA, 22 bp, Homo sapiens
ggagacagggttgaaccacgca

SEQ ID NO: 108729 - DNA, 22 bp, Homo sapiens
ggaggagacagtaaaaagcacg

SEQ ID NO: 108730 - DNA, 22 bp, Homo sapiens
ggtgggagagctctgtctccag

SEQ ID NO: 108731 - DNA, 22 bp, Homo sapiens
cctttcccgctttgagggcaag

SEQ ID NO: 108732 - DNA, 22 bp, Homo sapiens
actccacaccacgggggccgcc

SEQ ID NO: 108733 - DNA, 22 bp, Homo sapiens
aaagtgctgggattacaggcat

SEQ ID NO: 108734 - DNA, 22 bp, Homo sapiens
tcactgcaacctccacctcccg

SEQ ID NO: 108735 - DNA, 22 bp, Homo sapiens
atgtatgtctaaaacggggagg

SEQ ID NO: 108736 - DNA, 22 bp, Homo sapiens
tgatatgtccctcgacatcagg

SEQ ID NO: 108737 - DNA, 22 bp, Homo sapiens
ttgagggtctggatctgctgct

SEQ ID NO: 108738 - DNA, 23 bp, Homo sapiens
cagagctggctcagagctgcctg

SEQ ID NO: 108739 - DNA, 22 bp, Homo sapiens
atacaaaatatatactggagac

SEQ ID NO: 108740 - DNA, 22 bp, Homo sapiens
gcgtctcaaggcccccaggcca

SEQ ID NO: 108741 - DNA, 22 bp, Homo sapiens
cccaggcttttctcttgcccca

SEQ ID NO: 108742 - DNA, 22 bp, Homo sapiens
actgcactccagcctgggtgac

SEQ ID NO: 108743 - DNA, 22 bp, Homo sapiens
gaggtgggcggatcacaaggtc

SEQ ID NO: 108744 - DNA, 22 bp, Homo sapiens
cagtggcgtgatctctgctcac

SEQ ID NO: 108745 - DNA, 22 bp, Homo sapiens
cgcaccactgaattccagcctg

SEQ ID NO: 108746 - DNA, 22 bp, Homo sapiens
cgcagggccgcgagcgggacca

SEQ ID NO: 108747 - DNA, 22 bp, Homo sapiens
tcctgggtccatggcagccgaa

SEQ ID NO: 108748 - DNA, 22 bp, Homo sapiens
tgcaatccccgcctcaacagga

SEQ ID NO: 108749 - DNA, 22 bp, Homo sapiens
aacggctgtggctggcggcagc

SEQ ID NO: 108750 - DNA, 22 bp, Homo sapiens
tcttgggcatgtgtttgatttc

SEQ ID NO: 108751 - DNA, 22 bp, Homo sapiens
cctgggccctcaccgccggtgg

SEQ ID NO: 108752 - DNA, 16 bp, Homo sapiens
aggctcagaggctgga

SEQ ID NO: 108753 - DNA, 22 bp, Homo sapiens
aagggggcggcagccagtggaa

SEQ ID NO: 108754 - DNA, 22 bp, Homo sapiens
gccatcatatcccctgtgacct

SEQ ID NO: 108755 - DNA, 22 bp, Homo sapiens
ctctgcaacttctagcagtgtc

SEQ ID NO: 108756 - DNA, 22 bp, Homo sapiens
tccacagtggttgaactagtaa

SEQ ID NO: 108757 - DNA, 22 bp, Homo sapiens
tgtggcttaagaatgcctttaa

SEQ ID NO: 108758 - DNA, 22 bp, Homo sapiens
ggcgggcagcgtcttgctggcc

SEQ ID NO: 108759 - DNA, 22 bp, Homo sapiens
aagaataagaggatttagaaca

SEQ ID NO: 108760 - DNA, 22 bp, Homo sapiens
tgtagctctccagccagcaagg

SEQ ID NO: 108761 - DNA, 22 bp, Homo sapiens
taattataacatgctttctggc

SEQ ID NO: 108762 - DNA, 22 bp, Homo sapiens
ttctggaaggatgtttctatct

SEQ ID NO: 108763 - DNA, 22 bp, Homo sapiens
atttcctgtaggggcttgcgaa

SEQ ID NO: 108764 - DNA, 22 bp, Homo sapiens
tgagcctgggagatggaggctg

SEQ ID NO: 108765 - DNA, 20 bp, Homo sapiens
ggggcccaagccctcttgcc

SEQ ID NO: 108766 - DNA, 22 bp, Homo sapiens
agcaggagtttgatgcttttat

SEQ ID NO: 108767 - DNA, 22 bp, Homo sapiens
acagattcactgcactggccat

SEQ ID NO: 108768 - DNA, 22 bp, Homo sapiens
agttgcagacgcagagatgttg

SEQ ID NO: 108769 - DNA, 22 bp, Homo sapiens
tttaatcataagaaggaaaata

SEQ ID NO: 108770 - DNA, 22 bp, Homo sapiens
gaaggaagtcattagtgcagac

SEQ ID NO: 108771 - DNA, 22 bp, Homo sapiens
tcacccaggctggagtgtagtg

SEQ ID NO: 108772 - DNA, 22 bp, Homo sapiens
gagccaggttggaggctgcagt

SEQ ID NO: 108773 - DNA, 22 bp, Homo sapiens
tgagatgaataactcctgctaa

SEQ ID NO: 108774 - DNA, 22 bp, Homo sapiens
atctagattaggtataagagct

SEQ ID NO: 108775 - DNA, 22 bp, Homo sapiens
cagccctcctaccctgccaggc

SEQ ID NO: 108776 - DNA, 22 bp, Homo sapiens
tcctcagcttttatttcacttg

SEQ ID NO: 108777 - DNA, 22 bp, Homo sapiens
ctgaggagaggtggcctgtgtt

SEQ ID NO: 108778 - DNA, 22 bp, Homo sapiens
ttctcaaagtgtgctccctgga

SEQ ID NO: 108779 - DNA, 22 bp, Homo sapiens
cacagcgtgatgaatgtagcgt

SEQ ID NO: 108780 - DNA, 22 bp, Homo sapiens
ttccccttgataagcagggttg

SEQ ID NO: 108781 - DNA, 22 bp, Homo sapiens
agccggccatgtggtcttgtgc

SEQ ID NO: 108782 - DNA, 22 bp, Homo sapiens
ggtttgacagcttggggctgtc

SEQ ID NO: 108783 - DNA, 22 bp, Homo sapiens
atcatcctagaaggaagctagg

SEQ ID NO: 108784 - DNA, 17 bp, Homo sapiens
aggtgggtggatcacct

SEQ ID NO: 108785 - DNA, 22 bp, Homo sapiens
aataaacaaaggacaaggaggt

SEQ ID NO: 108786 - DNA, 22 bp, Homo sapiens
tggtatgaccgtggtgcaagca

SEQ ID NO: 108787 - DNA, 22 bp, Homo sapiens
acattacctggcatttgatctt

SEQ ID NO: 108788 - DNA, 22 bp, Homo sapiens
ttcccagtcaaacgaaggactt

SEQ ID NO: 108789 - DNA, 22 bp, Homo sapiens
gtggtgtaggtcacagttagga

SEQ ID NO: 108790 - DNA, 22 bp, Homo sapiens
ccccatcatctttgaggtcatt

SEQ ID NO: 108791 - DNA, 22 bp, Homo sapiens
ctgtaatcccagctactcggga

SEQ ID NO: 108792 - DNA, 17 bp, Homo sapiens
tcggtttgccaggcttc

SEQ ID NO: 108793 - DNA, 22 bp, Homo sapiens
acccagccatgttcagttctct

SEQ ID NO: 108794 - DNA, 22 bp, Homo sapiens
aggggtgaaagagggccctcaa

SEQ ID NO: 108795 - DNA, 22 bp, Homo sapiens
aagccgggcctgagaaatgaca

SEQ ID NO: 108796 - DNA, 22 bp, Homo sapiens
ggcagagcttgcagtgagccga

SEQ ID NO: 108797 - DNA, 22 bp, Homo sapiens
cccaggaggttgaggctgcagt

SEQ ID NO: 108798 - DNA, 22 bp, Homo sapiens
tctaatcctatggtggggaggg

SEQ ID NO: 108799 - DNA, 22 bp, Homo sapiens
agggcagagctgtctaaatggc

SEQ ID NO: 108800 - DNA, 22 bp, Homo sapiens
aatatgcactctgatttagcag

SEQ ID NO: 108801 - DNA, 22 bp, Homo sapiens
gtcaccagtgctaagaggtgga

SEQ ID NO: 108802 - DNA, 22 bp, Homo sapiens
ctctgcaagtccagcccctggc

SEQ ID NO: 108803 - DNA, 20 bp, Homo sapiens
cagcctgcatcatctgcagc

SEQ ID NO: 108804 - DNA, 20 bp, Homo sapiens
cagcagtggatgagagtttt

SEQ ID NO: 108805 - DNA, 22 bp, Homo sapiens
acttttaaatgagtttcagttg

SEQ ID NO: 108806 - DNA, 22 bp, Homo sapiens
atcttggggaatcctctgtgta

SEQ ID NO: 108807 - DNA, 22 bp, Homo sapiens
atgaattgaggaaaacagtcgt

SEQ ID NO: 108808 - DNA, 22 bp, Homo sapiens
tgtccttcttgtcttgcccaaa

SEQ ID NO: 108809 - DNA, 22 bp, Homo sapiens
catgagatctgcagggatgggc

SEQ ID NO: 108810 - DNA, 22 bp, Homo sapiens
tcactgcaagctctgccttccg

SEQ ID NO: 108811 - DNA, 22 bp, Homo sapiens
gagctgggcctgcgagtgctgc

SEQ ID NO: 108812 - DNA, 22 bp, Homo sapiens
ctggcctcggcagcaggaacag

SEQ ID NO: 108813 - DNA, 20 bp, Homo sapiens
ctgccgaccacagccatgga

SEQ ID NO: 108814 - DNA, 18 bp, Homo sapiens
acacttcctggtggtgtg

SEQ ID NO: 108815 - DNA, 22 bp, Homo sapiens
atgccactgcgctccagcctgg

SEQ ID NO: 108816 - DNA, 20 bp, Homo sapiens
caagggtttgcattggcttt

SEQ ID NO: 108817 - DNA, 22 bp, Homo sapiens
ccttttgctctcccatccagaa

SEQ ID NO: 108818 - DNA, 22 bp, Homo sapiens
tcacccaggctggagtgcagtg

SEQ ID NO: 108819 - DNA, 22 bp, Homo sapiens
tctcccaggcaggagtgcagtg

SEQ ID NO: 108820 - DNA, 22 bp, Homo sapiens
gggatttcaccatgttggttgg

SEQ ID NO: 108821 - DNA, 22 bp, Homo sapiens
atttagtagagaaattaagaaa

SEQ ID NO: 108822 - DNA, 22 bp, Homo sapiens
cagtttcttcctcccccagaga

SEQ ID NO: 108823 - DNA, 22 bp, Homo sapiens
taactctgaatcctcacagcag

SEQ ID NO: 108824 - DNA, 22 bp, Homo sapiens
ttgggctgaaccctgcagctga

SEQ ID NO: 108825 - DNA, 22 bp, Homo sapiens
taaaggtagtgtgacatattgt

SEQ ID NO: 108826 - DNA, 22 bp, Homo sapiens
caggcagggagctggaaaggat

SEQ ID NO: 108827 - DNA, 22 bp, Homo sapiens
ccctggaggttgaggctgcagt

SEQ ID NO: 108828 - DNA, 22 bp, Homo sapiens
acaggggattgattggaagtct

SEQ ID NO: 108829 - DNA, 22 bp, Homo sapiens
gcagactgtatcaatgtcagta

SEQ ID NO: 108830 - DNA, 20 bp, Homo sapiens
gtgcaatggcaccatctcag

SEQ ID NO: 108831 - DNA, 22 bp, Homo sapiens
cactgcactccagcctgggaga

SEQ ID NO: 108832 - DNA, 22 bp, Homo sapiens
gcttctcaattctcaccctcca

SEQ ID NO: 108833 - DNA, 22 bp, Homo sapiens
ttgcccaggctggagtgcagta

SEQ ID NO: 108834 - DNA, 22 bp, Homo sapiens
ctgcatccatgttgctgcaaag

SEQ ID NO: 108835 - DNA, 22 bp, Homo sapiens
ctctggaccctcctgctgagag

SEQ ID NO: 108836 - DNA, 21 bp, Homo sapiens
gcccacagtgaggaggatccc

SEQ ID NO: 108837 - DNA, 22 bp, Homo sapiens
cttgggaggcagaggttgcagt

SEQ ID NO: 108838 - DNA, 22 bp, Homo sapiens
agggcaaagccagtgactccca

SEQ ID NO: 108839 - DNA, 22 bp, Homo sapiens
cttctcggccgtgtggatgcgc

SEQ ID NO: 108840 - DNA, 22 bp, Homo sapiens
tcactgcaacctctgcctcttg

SEQ ID NO: 108841 - DNA, 22 bp, Homo sapiens
aaattagtcatgttgtattact

SEQ ID NO: 108842 - DNA, 23 bp, Homo sapiens
ttaaacactagttcgagtagcat

SEQ ID NO: 108843 - DNA, 22 bp, Homo sapiens
agcagcagtgttctggaattct

SEQ ID NO: 108844 - DNA, 22 bp, Homo sapiens
tgccatagcaatggtaagctga

SEQ ID NO: 108845 - DNA, 22 bp, Homo sapiens
ggcctcacccatcggtgccttt

SEQ ID NO: 108846 - DNA, 22 bp, Homo sapiens
taaatacttagttttgtgtcta

SEQ ID NO: 108847 - DNA, 22 bp, Homo sapiens
ctgcggctctgcgggcagctgg

SEQ ID NO: 108848 - DNA, 22 bp, Homo sapiens
ttgcccaggctggagtgcagtg

SEQ ID NO: 108849 - DNA, 22 bp, Homo sapiens
attcacatttagcctctgacat

SEQ ID NO: 108850 - DNA, 22 bp, Homo sapiens
gtgtttgttcgtgactccaaag

SEQ ID NO: 108851 - DNA, 22 bp, Homo sapiens
tcactgcaagctcctcctcctg

SEQ ID NO: 108852 - DNA, 22 bp, Homo sapiens
ctgccatgccactgtgactgca

SEQ ID NO: 108853 - DNA, 22 bp, Homo sapiens
tgagtggacacctgcttcttta

SEQ ID NO: 108854 - DNA, 22 bp, Homo sapiens
gtcttagatttcaccgataatg

SEQ ID NO: 108855 - DNA, 22 bp, Homo sapiens
aaatggaagctatttatgattc

SEQ ID NO: 108856 - DNA, 22 bp, Homo sapiens
ctggtagctcctgaatatccct

SEQ ID NO: 108857 - DNA, 22 bp, Homo sapiens
gaattcttttctttctgaaagt

SEQ ID NO: 108858 - DNA, 22 bp, Homo sapiens
gtgcaaaagtaattgtggtttt

SEQ ID NO: 108859 - DNA, 22 bp, Homo sapiens
ctcctgagctctgaggaagctt

SEQ ID NO: 108860 - DNA, 22 bp, Homo sapiens
cccaggaggcggaggttgcagt

SEQ ID NO: 108861 - DNA, 22 bp, Homo sapiens
tgtgtggattcatctcaaagag

SEQ ID NO: 108862 - DNA, 22 bp, Homo sapiens
gccccagcctcccgagtagctg

SEQ ID NO: 108863 - DNA, 21 bp, Homo sapiens
tgcaatccagcctgggcgaca

SEQ ID NO: 108864 - DNA, 22 bp, Homo sapiens
ctctcagtcctgcgcgcctctg

SEQ ID NO: 108865 - DNA, 22 bp, Homo sapiens
atgctatgtaactggcagatag

SEQ ID NO: 108866 - DNA, 22 bp, Homo sapiens
ttgaataatatgcttcgttctc

SEQ ID NO: 108867 - DNA, 22 bp, Homo sapiens
actttatttcctattgcatcca

SEQ ID NO: 108868 - DNA, 22 bp, Homo sapiens
cctggaggcggaggttgcagtg

SEQ ID NO: 108869 - DNA, 22 bp, Homo sapiens
gcccggcagtcacacacccagg

SEQ ID NO: 108870 - DNA, 22 bp, Homo sapiens
gagtcgagcagaaagccgtcgg

SEQ ID NO: 108871 - DNA, 22 bp, Homo sapiens
ctcgcatgccctgcctcatcca

SEQ ID NO: 108872 - DNA, 22 bp, Homo sapiens
aggagaagccaagttgtgagca

SEQ ID NO: 108873 - DNA, 22 bp, Homo sapiens
acaattctgatggtttcccagt

SEQ ID NO: 108874 - DNA, 22 bp, Homo sapiens
cagagggttgatgtgaggctta

SEQ ID NO: 108875 - DNA, 22 bp, Homo sapiens
gccacctcggctttctctgctc

SEQ ID NO: 108876 - DNA, 22 bp, Homo sapiens
actgcacttcagcctgggtgtc

SEQ ID NO: 108877 - DNA, 22 bp, Homo sapiens
aagcagagaatctgggagcgag

SEQ ID NO: 108878 - DNA, 21 bp, Homo sapiens
tccttcagtctagatgattgt

SEQ ID NO: 108879 - DNA, 22 bp, Homo sapiens
tgccatggcctagacctgtgat

SEQ ID NO: 108880 - DNA, 22 bp, Homo sapiens
ttgtgaatagtgccgcaataaa

SEQ ID NO: 108881 - DNA, 22 bp, Homo sapiens
cagctgctgttcagttttgttt

SEQ ID NO: 108882 - DNA, 22 bp, Homo sapiens
aaggaggcctggcagatgaaga

SEQ ID NO: 108883 - DNA, 22 bp, Homo sapiens
tgtatattctgcctaaaagctt

SEQ ID NO: 108884 - DNA, 22 bp, Homo sapiens
ccagcagagcatggggaggaag

SEQ ID NO: 108885 - DNA, 22 bp, Homo sapiens
cccagcgagtttgccggtgaac

SEQ ID NO: 108886 - DNA, 22 bp, Homo sapiens
aggtgactggtttatctggcag

SEQ ID NO: 108887 - DNA, 22 bp, Homo sapiens
ctgggggcagcaagaagccatg

SEQ ID NO: 108888 - DNA, 22 bp, Homo sapiens
cctcagctcccatgagatctgc

SEQ ID NO: 108889 - DNA, 22 bp, Homo sapiens
agacactgttctcacatgcttg

SEQ ID NO: 108890 - DNA, 22 bp, Homo sapiens
gtgctggggagataggaagaga

SEQ ID NO: 108891 - DNA, 22 bp, Homo sapiens
gcagaggacacaggagggcaag

SEQ ID NO: 108892 - DNA, 21 bp, Homo sapiens
tcctgtaagcttgggtggctc

SEQ ID NO: 108893 - DNA, 22 bp, Homo sapiens
gtccaagagtcaagaagggggc

SEQ ID NO: 108894 - DNA, 22 bp, Homo sapiens
tgggcaaggctggagcctgcag

SEQ ID NO: 108895 - DNA, 22 bp, Homo sapiens
tacaacaatttccacattagaa

SEQ ID NO: 108896 - DNA, 18 bp, Homo sapiens
tcactgtgtgtcttgggt

SEQ ID NO: 108897 - DNA, 19 bp, Homo sapiens
ggggcctgtgatggtcaca

SEQ ID NO: 108898 - DNA, 22 bp, Homo sapiens
aggaaaacagaccaaggagctc

SEQ ID NO: 108899 - DNA, 22 bp, Homo sapiens
aacatgatttcatgcatttaga

SEQ ID NO: 108900 - DNA, 22 bp, Homo sapiens
ctctggagtgtctggccagggt

SEQ ID NO: 108901 - DNA, 22 bp, Homo sapiens
tagcatgtcagtcgccacacgt

SEQ ID NO: 108902 - DNA, 22 bp, Homo sapiens
tttccatgtgtactggccagaa

SEQ ID NO: 108903 - DNA, 22 bp, Homo sapiens
ggttcccggatctccgagtccc

SEQ ID NO: 108904 - DNA, 22 bp, Homo sapiens
ttatttgtggcatatgagacga

SEQ ID NO: 108905 - DNA, 18 bp, Homo sapiens
catgggtgacaggtggat

SEQ ID NO: 108906 - DNA, 22 bp, Homo sapiens
atgattgaaaatgacattgcca

SEQ ID NO: 108907 - DNA, 22 bp, Homo sapiens
cactgcactgcagcctggagac

SEQ ID NO: 108908 - DNA, 22 bp, Homo sapiens
actgtgaacggactgaagccca

SEQ ID NO: 108909 - DNA, 22 bp, Homo sapiens
actggacagaggaaatatggag

SEQ ID NO: 108910 - DNA, 22 bp, Homo sapiens
cagcaggaggtgagtagcaggt

SEQ ID NO: 108911 - DNA, 18 bp, Homo sapiens
ttcggcagatacgcttgg

SEQ ID NO: 108912 - DNA, 22 bp, Homo sapiens
gcgagcctctggagtcctctgg

SEQ ID NO: 108913 - DNA, 22 bp, Homo sapiens
ggccgccctttccacggtttct

SEQ ID NO: 108914 - DNA, 22 bp, Homo sapiens
ctcggaatggaacaacagcggt

SEQ ID NO: 108915 - DNA, 22 bp, Homo sapiens
aggatttctgtgcctggaaaat

SEQ ID NO: 108916 - DNA, 22 bp, Homo sapiens
tcaatcacgtgttccatgttct

SEQ ID NO: 108917 - DNA, 22 bp, Homo sapiens
cactgcacttcagcctgggtga

SEQ ID NO: 108918 - DNA, 22 bp, Homo sapiens
gagagtctaggaacctcatata

SEQ ID NO: 108919 - DNA, 22 bp, Homo sapiens
ccaccagctgcatatgcacgta

SEQ ID NO: 108920 - DNA, 22 bp, Homo sapiens
cctggaagttggaggttgcagt

SEQ ID NO: 108921 - DNA, 22 bp, Homo sapiens
ttggccatctaagcccagccac

SEQ ID NO: 108922 - DNA, 22 bp, Homo sapiens
cgcggtgtagtcgtacatccca

SEQ ID NO: 108923 - DNA, 22 bp, Homo sapiens
tcaccgaggctggagtgcagtg

SEQ ID NO: 108924 - DNA, 22 bp, Homo sapiens
tcacttcccagacggggtggca

SEQ ID NO: 108925 - DNA, 22 bp, Homo sapiens
gtgcatgtcggggtgcatgtca

SEQ ID NO: 108926 - DNA, 22 bp, Homo sapiens
tgaggcaggagttcaggctgcg

SEQ ID NO: 108927 - DNA, 22 bp, Homo sapiens
cctggcaggtggcgccctcggc

SEQ ID NO: 108928 - DNA, 22 bp, Homo sapiens
tggtcgaccagttggaaagtaa

SEQ ID NO: 108929 - DNA, 22 bp, Homo sapiens
gctgtctcatacaaggccctgc

SEQ ID NO: 108930 - DNA, 22 bp, Homo sapiens
gggcctgtgtgttcaggagcct

SEQ ID NO: 108931 - DNA, 22 bp, Homo sapiens
tgtctattaattccacataaaa

SEQ ID NO: 108932 - DNA, 22 bp, Homo sapiens
gctgtgtatcagatgccacggg

SEQ ID NO: 108933 - DNA, 22 bp, Homo sapiens
gagctcattcattcattgcctg

SEQ ID NO: 108934 - DNA, 22 bp, Homo sapiens
gggcatggtggcaggcacctgt

SEQ ID NO: 108935 - DNA, 22 bp, Homo sapiens
gcagctattgtctcctgggccc

SEQ ID NO: 108936 - DNA, 22 bp, Homo sapiens
ttcagagaattggataattcgt

SEQ ID NO: 108937 - DNA, 22 bp, Homo sapiens
ggctccaccctgcttccagaag

SEQ ID NO: 108938 - DNA, 22 bp, Homo sapiens
agcctattccaggatgagctca

SEQ ID NO: 108939 - DNA, 22 bp, Homo sapiens
tttaaaaaactagtctgagtct

SEQ ID NO: 108940 - DNA, 18 bp, Homo sapiens
tttctcagactctctttc

SEQ ID NO: 108941 - DNA, 22 bp, Homo sapiens
agcaggaaggggatgatgggca

SEQ ID NO: 108942 - DNA, 22 bp, Homo sapiens
gagcactgatttatttttgtct

SEQ ID NO: 108943 - DNA, 22 bp, Homo sapiens
tctttctacatcatttgcttct

SEQ ID NO: 108944 - DNA, 22 bp, Homo sapiens
aaagctgtcaaggcaggaggct

SEQ ID NO: 108945 - DNA, 22 bp, Homo sapiens
cccaggaattggaggctgcagt

SEQ ID NO: 108946 - DNA, 22 bp, Homo sapiens
tttattctgtgctacatgaaga

SEQ ID NO: 108947 - DNA, 22 bp, Homo sapiens
gattcactcatattttacgttt

SEQ ID NO: 108948 - DNA, 22 bp, Homo sapiens
atgccactgcactccagcctag

SEQ ID NO: 108949 - DNA, 22 bp, Homo sapiens
ccagggatgcagaggttgcagt

SEQ ID NO: 108950 - DNA, 22 bp, Homo sapiens
ataaaatttgctactgttaaat

SEQ ID NO: 108951 - DNA, 22 bp, Homo sapiens
tcccggcgctgggaggtgggtc

SEQ ID NO: 108952 - DNA, 22 bp, Homo sapiens
ttcttctttccaattacatggt

SEQ ID NO: 108953 - DNA, 22 bp, Homo sapiens
gctgaggctcctcgggaggaca

SEQ ID NO: 108954 - DNA, 22 bp, Homo sapiens
gcacctgcctgggactgaagat

SEQ ID NO: 108955 - DNA, 22 bp, Homo sapiens
agacagctggtagcacttcctg

SEQ ID NO: 108956 - DNA, 22 bp, Homo sapiens
caggccagggttgagaagagaa

SEQ ID NO: 108957 - DNA, 22 bp, Homo sapiens
ttatcacttatgagctttttgc

SEQ ID NO: 108958 - DNA, 22 bp, Homo sapiens
gggcagagactcagaaacagaa

SEQ ID NO: 108959 - DNA, 22 bp, Homo sapiens
gctaggagtggtgggtcaagga

SEQ ID NO: 108960 - DNA, 22 bp, Homo sapiens
actctgcctgcggtgggcggga

SEQ ID NO: 108961 - DNA, 21 bp, Homo sapiens
gcagcagtgttctagaatact

SEQ ID NO: 108962 - DNA, 22 bp, Homo sapiens
tctgcaggtaagcgttcttgga

SEQ ID NO: 108963 - DNA, 22 bp, Homo sapiens
aggggagagttaatgtgaatgt

SEQ ID NO: 108964 - DNA, 22 bp, Homo sapiens
gccacgtagaagtgccgcgaga

SEQ ID NO: 108965 - DNA, 22 bp, Homo sapiens
gctgtatgtgaggccacagtga

SEQ ID NO: 108966 - DNA, 22 bp, Homo sapiens
aaagaaatagatggcatttaaa

SEQ ID NO: 108967 - DNA, 19 bp, Homo sapiens
gggcttggggctgaagcct

SEQ ID NO: 108968 - DNA, 22 bp, Homo sapiens
taaatgttttgtgggttgagtt

SEQ ID NO: 108969 - DNA, 22 bp, Homo sapiens
actgattgcattcatagggttt

SEQ ID NO: 108970 - DNA, 22 bp, Homo sapiens
ggtgggagagcttgctttgatg

SEQ ID NO: 108971 - DNA, 22 bp, Homo sapiens
accacccagccagcttctccct

SEQ ID NO: 108972 - DNA, 22 bp, Homo sapiens
tgggcaggggccctgcttccgt

SEQ ID NO: 108973 - DNA, 22 bp, Homo sapiens
aaaaaattatcatagttcctga

SEQ ID NO: 108974 - DNA, 22 bp, Homo sapiens
gggtaaatctcttttcatggct

SEQ ID NO: 108975 - DNA, 22 bp, Homo sapiens
tgccgcagtgcggggagggccc

SEQ ID NO: 108976 - DNA, 22 bp, Homo sapiens
ggcaggtcaggtccatgaccaa

SEQ ID NO: 108977 - DNA, 22 bp, Homo sapiens
ctcactgcaagctccacctctt

SEQ ID NO: 108978 - DNA, 22 bp, Homo sapiens
tcgcaccattgcactccagcca

SEQ ID NO: 108979 - DNA, 22 bp, Homo sapiens
tctagctctgcttatcatggct

SEQ ID NO: 108980 - DNA, 22 bp, Homo sapiens
actgggcctacccagattggca

SEQ ID NO: 108981 - DNA, 22 bp, Homo sapiens
ggtgtctatgattcagtttatg

SEQ ID NO: 108982 - DNA, 22 bp, Homo sapiens
cactgcactccagcccgggcaa

SEQ ID NO: 108983 - DNA, 22 bp, Homo sapiens
cccaggaggtcaaggctgcagt

SEQ ID NO: 108984 - DNA, 22 bp, Homo sapiens
tggctaacaaggtgaaaccccg

SEQ ID NO: 108985 - DNA, 22 bp, Homo sapiens
gtgctaatgaattggagtgcct

SEQ ID NO: 108986 - DNA, 22 bp, Homo sapiens
gtctctatcatagctgaaccct

SEQ ID NO: 108987 - DNA, 22 bp, Homo sapiens
gcaagacatgtctaaggtttaa

SEQ ID NO: 108988 - DNA, 22 bp, Homo sapiens
acgcctgtaatcccagcacttt

SEQ ID NO: 108989 - DNA, 22 bp, Homo sapiens
tgtgttgtgacattcttggatg

SEQ ID NO: 108990 - DNA, 22 bp, Homo sapiens
tgtcacagtttgtactttatag

SEQ ID NO: 108991 - DNA, 22 bp, Homo sapiens
gtgagccgagtatagttcatag

SEQ ID NO: 108992 - DNA, 22 bp, Homo sapiens
tgtgccataggcagcgtggcca

SEQ ID NO: 108993 - DNA, 22 bp, Homo sapiens
ctgggaggcggaggttgcagtg

SEQ ID NO: 108994 - DNA, 22 bp, Homo sapiens
gaaaattattgaaaatggctct

SEQ ID NO: 108995 - DNA, 22 bp, Homo sapiens
ggccgcggattttcccgctggc

SEQ ID NO: 108996 - DNA, 22 bp, Homo sapiens
tcagtgttaatcagtggtacct

SEQ ID NO: 108997 - DNA, 22 bp, Homo sapiens
atgaaatatcttgaagaaattc

SEQ ID NO: 108998 - DNA, 22 bp, Homo sapiens
cctcgcggcactcgggccggat

SEQ ID NO: 108999 - DNA, 22 bp, Homo sapiens
cagaggaacgtttggattgatt

SEQ ID NO: 109000 - DNA, 22 bp, Homo sapiens
tgcctctgaggaagattgtgtt

SEQ ID NO: 109001 - DNA, 22 bp, Homo sapiens
tgtatgaggcatacatcaggca

SEQ ID NO: 109002 - DNA, 22 bp, Homo sapiens
caggctgatcagggctgggatg

SEQ ID NO: 109003 - DNA, 22 bp, Homo sapiens
cagagctgtccaaaccctgaca

SEQ ID NO: 109004 - DNA, 22 bp, Homo sapiens
ttttcctggagatggagttgtt

SEQ ID NO: 109005 - DNA, 22 bp, Homo sapiens
aggggaggtgtccccaaatctc

SEQ ID NO: 109006 - DNA, 22 bp, Homo sapiens
aaatgtggggctggaggcagga

SEQ ID NO: 109007 - DNA, 22 bp, Homo sapiens
gcctcagtctcccgagtagctg

SEQ ID NO: 109008 - DNA, 22 bp, Homo sapiens
acagagcaataacagggagagg

SEQ ID NO: 109009 - DNA, 22 bp, Homo sapiens
tccagtgcaatggctcattcat

SEQ ID NO: 109010 - DNA, 22 bp, Homo sapiens
gctgcagggagctggaaggctc

SEQ ID NO: 109011 - DNA, 22 bp, Homo sapiens
ccaggagttggaggctgcagtg

SEQ ID NO: 109012 - DNA, 22 bp, Homo sapiens
gagccagactgcctgaagctca

SEQ ID NO: 109013 - DNA, 22 bp, Homo sapiens
ggtggcagtagcactgggcctg

SEQ ID NO: 109014 - DNA, 22 bp, Homo sapiens
atagtggggacaggatggttgg

SEQ ID NO: 109015 - DNA, 19 bp, Homo sapiens
gggtcccactgcccgtctg

SEQ ID NO: 109016 - DNA, 22 bp, Homo sapiens
ttcatcttgatggcttcctaat

SEQ ID NO: 109017 - DNA, 22 bp, Homo sapiens
tagagtgtcataacagtgccca

SEQ ID NO: 109018 - DNA, 22 bp, Homo sapiens
tctttggtttctgtctctgtaa

SEQ ID NO: 109019 - DNA, 22 bp, Homo sapiens
cggggacacactggcagctcct

SEQ ID NO: 109020 - DNA, 22 bp, Homo sapiens
agcaagatttttcaggttagta

SEQ ID NO: 109021 - DNA, 22 bp, Homo sapiens
atgagttgaagctacaagaggc

SEQ ID NO: 109022 - DNA, 23 bp, Homo sapiens
ggttccaggaacacagcctgatg

SEQ ID NO: 109023 - DNA, 22 bp, Homo sapiens
ctggcctggcgcagtggctcac

SEQ ID NO: 109024 - DNA, 22 bp, Homo sapiens
gggttgaggcggatgtcggcgg

SEQ ID NO: 109025 - DNA, 22 bp, Homo sapiens
ggtgctggacacgtggcactcc

SEQ ID NO: 109026 - DNA, 22 bp, Homo sapiens
aaagggaagttgcacatgttcc

SEQ ID NO: 109027 - DNA, 22 bp, Homo sapiens
ttctacagtgactgcagccata

SEQ ID NO: 109028 - DNA, 22 bp, Homo sapiens
ctcattgcaacctccgcctccc

SEQ ID NO: 109029 - DNA, 22 bp, Homo sapiens
ctcggagggcaacagaagtgct

SEQ ID NO: 109030 - DNA, 22 bp, Homo sapiens
aataaacaaatccttccttccc

SEQ ID NO: 109031 - DNA, 22 bp, Homo sapiens
cttgacactgtcactcaggcca

SEQ ID NO: 109032 - DNA, 22 bp, Homo sapiens
gccagatttacagatttgccct

SEQ ID NO: 109033 - DNA, 22 bp, Homo sapiens
ccagaggagttgaggctttggg

SEQ ID NO: 109034 - DNA, 22 bp, Homo sapiens
gtcagtgtcttaacagagatta

SEQ ID NO: 109035 - DNA, 22 bp, Homo sapiens
ccctcccaggagtggccagaga

SEQ ID NO: 109036 - DNA, 22 bp, Homo sapiens
gcggggggaggaacatcttgca

SEQ ID NO: 109037 - DNA, 22 bp, Homo sapiens
attgtgaataatgctgcaataa

SEQ ID NO: 109038 - DNA, 22 bp, Homo sapiens
tagatctgatacaattcatctg

SEQ ID NO: 109039 - DNA, 22 bp, Homo sapiens
accagcctggccaacatggcaa

SEQ ID NO: 109040 - DNA, 22 bp, Homo sapiens
gtaatagtctcaaactcctgga

SEQ ID NO: 109041 - DNA, 22 bp, Homo sapiens
cgcaactcagcaacttaactgc

SEQ ID NO: 109042 - DNA, 22 bp, Homo sapiens
tgaagaaacgcagagaggtagg

SEQ ID NO: 109043 - DNA, 22 bp, Homo sapiens
tgaggcaggtggattacaaggt

SEQ ID NO: 109044 - DNA, 22 bp, Homo sapiens
gaggtgggtgtatcacaggtca

SEQ ID NO: 109045 - DNA, 22 bp, Homo sapiens
tcaccttgtgatctccctgcct

SEQ ID NO: 109046 - DNA, 22 bp, Homo sapiens
taatggattaacgtccctgtcg

SEQ ID NO: 109047 - DNA, 22 bp, Homo sapiens
ccttctagcaaatcaacataaa

SEQ ID NO: 109048 - DNA, 22 bp, Homo sapiens
caaatgaatatttccatgggtt

SEQ ID NO: 109049 - DNA, 22 bp, Homo sapiens
attgcactccagcctgggggac

SEQ ID NO: 109050 - DNA, 22 bp, Homo sapiens
cagggtttcaccatgttagcag

SEQ ID NO: 109051 - DNA, 22 bp, Homo sapiens
tgtgtcccttggaacctcagct

SEQ ID NO: 109052 - DNA, 22 bp, Homo sapiens
gggctgggattgcttgctgtga

SEQ ID NO: 109053 - DNA, 22 bp, Homo sapiens
gacaggaggcagagctcaggtg

SEQ ID NO: 109054 - DNA, 22 bp, Homo sapiens
agtcaaagatgaccgagttcct

SEQ ID NO: 109055 - DNA, 22 bp, Homo sapiens
gcgggccaccttggagagcgct

SEQ ID NO: 109056 - DNA, 23 bp, Homo sapiens
tgctggagaagcaaagttctgag

SEQ ID NO: 109057 - DNA, 22 bp, Homo sapiens
gcaggcagatcacctgtcagga

SEQ ID NO: 109058 - DNA, 23 bp, Homo sapiens
cagagctggcttcatgggtgtgc

SEQ ID NO: 109059 - DNA, 22 bp, Homo sapiens
agcctggcctgggcaggcacat

SEQ ID NO: 109060 - DNA, 21 bp, Homo sapiens
ggtgctcgctgatgaggagtg

SEQ ID NO: 109061 - DNA, 22 bp, Homo sapiens
gctcccagtctgatggaggaga

SEQ ID NO: 109062 - DNA, 22 bp, Homo sapiens
gcccagctgcaccctggtgggt

SEQ ID NO: 109063 - DNA, 22 bp, Homo sapiens
ggaactcctgctccaagcagct

SEQ ID NO: 109064 - DNA, 23 bp, Homo sapiens
tgaggcaggcggatcacgaggtc

SEQ ID NO: 109065 - DNA, 22 bp, Homo sapiens
gggactggagtagaggccggtg

SEQ ID NO: 109066 - DNA, 20 bp, Homo sapiens
ttcatgggagcaaagaggcc

SEQ ID NO: 109067 - DNA, 22 bp, Homo sapiens
gagggagggactagcattctct

SEQ ID NO: 109068 - DNA, 22 bp, Homo sapiens
gctcccaggatgaggagccagg

SEQ ID NO: 109069 - DNA, 22 bp, Homo sapiens
ttaaatattatgttgtctgcaa

SEQ ID NO: 109070 - DNA, 22 bp, Homo sapiens
gctggcagacttcctctggaac

SEQ ID NO: 109071 - DNA, 22 bp, Homo sapiens
tattctcatcatcactggagct

SEQ ID NO: 109072 - DNA, 22 bp, Homo sapiens
gttgtgattgtagctaaactag

SEQ ID NO: 109073 - DNA, 22 bp, Homo sapiens
tcgctgaggctgcacggctgcc

SEQ ID NO: 109074 - DNA, 22 bp, Homo sapiens
tccacgctgtgtgaccttgggc

SEQ ID NO: 109075 - DNA, 22 bp, Homo sapiens
gcaggaggttgagccaggactg

SEQ ID NO: 109076 - DNA, 22 bp, Homo sapiens
attataggcttgagccaccgtg

SEQ ID NO: 109077 - DNA, 22 bp, Homo sapiens
ctgagggtcaacttgattgtat

SEQ ID NO: 109078 - DNA, 22 bp, Homo sapiens
ttccccttgggctgtggaggag

SEQ ID NO: 109079 - DNA, 22 bp, Homo sapiens
ccaggcaggcgatggtgcagtg

SEQ ID NO: 109080 - DNA, 22 bp, Homo sapiens
caattgacaatgacagtgtcaa

SEQ ID NO: 109081 - DNA, 22 bp, Homo sapiens
tattgcaggttccaaccgggaa

SEQ ID NO: 109082 - DNA, 22 bp, Homo sapiens
agccaagcactcaactcctgga

SEQ ID NO: 109083 - DNA, 22 bp, Homo sapiens
tggttgtggtcctccacatcgc

SEQ ID NO: 109084 - DNA, 22 bp, Homo sapiens
agcccaggagtttgaggctgtg

SEQ ID NO: 109085 - DNA, 22 bp, Homo sapiens
atgccactgcacttcagcctgg

SEQ ID NO: 109086 - DNA, 22 bp, Homo sapiens
tcactacaacctccgcctcctg

SEQ ID NO: 109087 - DNA, 22 bp, Homo sapiens
tctaatccttgctacctgggtg

SEQ ID NO: 109088 - DNA, 18 bp, Homo sapiens
gaggatggaaggagatgc

SEQ ID NO: 109089 - DNA, 22 bp, Homo sapiens
gtgggcatctccttggaagcca

SEQ ID NO: 109090 - DNA, 22 bp, Homo sapiens
ctggagcaaaagtgactcctct

SEQ ID NO: 109091 - DNA, 22 bp, Homo sapiens
tgtgctctgactttctcctggt

SEQ ID NO: 109092 - DNA, 22 bp, Homo sapiens
ttgtcttttgtgggaaatatgg

SEQ ID NO: 109093 - DNA, 23 bp, Homo sapiens
agctctgctcgggcatgccctgc

SEQ ID NO: 109094 - DNA, 22 bp, Homo sapiens
agcctctctgttagtcactggg

SEQ ID NO: 109095 - DNA, 22 bp, Homo sapiens
atggctgcctgggcgctggccg

SEQ ID NO: 109096 - DNA, 22 bp, Homo sapiens
agtatacatagtgcttcctctt

SEQ ID NO: 109097 - DNA, 22 bp, Homo sapiens
gcaggcagaggtggaggagaca

SEQ ID NO: 109098 - DNA, 22 bp, Homo sapiens
aacccgggaggcggaggttgtg

SEQ ID NO: 109099 - DNA, 22 bp, Homo sapiens
cggaggttgaggctgcagtgag

SEQ ID NO: 109100 - DNA, 22 bp, Homo sapiens
ccaggctggagtgcaatggcgt

SEQ ID NO: 109101 - DNA, 22 bp, Homo sapiens
ggagagcagggaggctgctctg

SEQ ID NO: 109102 - DNA, 22 bp, Homo sapiens
tagccgggtgttgtgtcatgca

SEQ ID NO: 109103 - DNA, 19 bp, Homo sapiens
ctcgtgcacccatcacctg

SEQ ID NO: 109104 - DNA, 22 bp, Homo sapiens
tttgtttgccacacaaaacagt

SEQ ID NO: 109105 - DNA, 22 bp, Homo sapiens
cccagcaggtcggtgctgcctg

SEQ ID NO: 109106 - DNA, 22 bp, Homo sapiens
acatttttcacatttgtagggt

SEQ ID NO: 109107 - DNA, 22 bp, Homo sapiens
cagggtgccaaagaacaaatat

SEQ ID NO: 109108 - DNA, 22 bp, Homo sapiens
cccaggaggcagaagttgcagt

SEQ ID NO: 109109 - DNA, 22 bp, Homo sapiens
agttggagtgaacatgagattg

SEQ ID NO: 109110 - DNA, 22 bp, Homo sapiens
cactgggcgtgtcctgggtgag

SEQ ID NO: 109111 - DNA, 23 bp, Homo sapiens
cccagaccttgtgctgcccttgg

SEQ ID NO: 109112 - DNA, 22 bp, Homo sapiens
tagtttcatctccaccctgccc

SEQ ID NO: 109113 - DNA, 22 bp, Homo sapiens
ccaggcagcctgctccattctg

SEQ ID NO: 109114 - DNA, 22 bp, Homo sapiens
acagagacacggaagctaaaga

SEQ ID NO: 109115 - DNA, 22 bp, Homo sapiens
gagcctggagctggaacgaagc

SEQ ID NO: 109116 - DNA, 22 bp, Homo sapiens
ttgcaaatcagaagtatagatt

SEQ ID NO: 109117 - DNA, 22 bp, Homo sapiens
gctcaggtagatggggttgtcc

SEQ ID NO: 109118 - DNA, 22 bp, Homo sapiens
tgcccaggctggagtacagtgg

SEQ ID NO: 109119 - DNA, 22 bp, Homo sapiens
tccaagatctacagcagtttag

SEQ ID NO: 109120 - DNA, 22 bp, Homo sapiens
tagtggatgggtaaagtatttt

SEQ ID NO: 109121 - DNA, 22 bp, Homo sapiens
atggtggacgggagacaggact

SEQ ID NO: 109122 - DNA, 22 bp, Homo sapiens
tttcacagaggaggaagctgag

SEQ ID NO: 109123 - DNA, 22 bp, Homo sapiens
tgctgtgaggttgagaaggaag

SEQ ID NO: 109124 - DNA, 22 bp, Homo sapiens
ctgtccatattcaaggggtagg

SEQ ID NO: 109125 - DNA, 22 bp, Homo sapiens
atgaggcaggagtgcagtggca

SEQ ID NO: 109126 - DNA, 22 bp, Homo sapiens
ccccaggacgtggccctcatag

SEQ ID NO: 109127 - DNA, 22 bp, Homo sapiens
aatcacttagaacccaggaagt

SEQ ID NO: 109128 - DNA, 22 bp, Homo sapiens
ttttggccacatccttttgagt

SEQ ID NO: 109129 - DNA, 23 bp, Homo sapiens
ggagtgcaatggcgccatctcgg

SEQ ID NO: 109130 - DNA, 22 bp, Homo sapiens
agggaagaggaccagagtctct

SEQ ID NO: 109131 - DNA, 22 bp, Homo sapiens
ccaatgatggtgcccacgatga

SEQ ID NO: 109132 - DNA, 22 bp, Homo sapiens
tcttaagcagagaagaagttga

SEQ ID NO: 109133 - DNA, 22 bp, Homo sapiens
gatcgggtgggttctgccatca

SEQ ID NO: 109134 - DNA, 22 bp, Homo sapiens
ctgccctggggggcctccttgc

SEQ ID NO: 109135 - DNA, 22 bp, Homo sapiens
ttctgtgaatcttttttcccac

SEQ ID NO: 109136 - DNA, 22 bp, Homo sapiens
gtccccgacgtttggcttgatg

SEQ ID NO: 109137 - DNA, 23 bp, Homo sapiens
ccagtgattgcctggaaggaggt

SEQ ID NO: 109138 - DNA, 22 bp, Homo sapiens
agcctgcgatcccacctggcct

SEQ ID NO: 109139 - DNA, 22 bp, Homo sapiens
ctggcaggagcattcacagagg

SEQ ID NO: 109140 - DNA, 22 bp, Homo sapiens
taaatgttgtaagtacatctaa

SEQ ID NO: 109141 - DNA, 22 bp, Homo sapiens
ggaactgaatgtctcggtataa

SEQ ID NO: 109142 - DNA, 22 bp, Homo sapiens
attttctatgttgtaattgtta

SEQ ID NO: 109143 - DNA, 22 bp, Homo sapiens
atgggttcaagtgattctcctg

SEQ ID NO: 109144 - DNA, 22 bp, Homo sapiens
gctgtcttgctcactcttgcag

SEQ ID NO: 109145 - DNA, 22 bp, Homo sapiens
ggcttttgtttcagctctgcta

SEQ ID NO: 109146 - DNA, 22 bp, Homo sapiens
aagtctctcacatatctggtcc

SEQ ID NO: 109147 - DNA, 22 bp, Homo sapiens
tgtctctgtgactccttccgcc

SEQ ID NO: 109148 - DNA, 22 bp, Homo sapiens
caggaaagggatgggctgccac

SEQ ID NO: 109149 - DNA, 22 bp, Homo sapiens
cggggttcatccatgctgtggc

SEQ ID NO: 109150 - DNA, 22 bp, Homo sapiens
atagagtgatgtaaggtatgtg

SEQ ID NO: 109151 - DNA, 22 bp, Homo sapiens
ttaccaaatgaaatagagattt

SEQ ID NO: 109152 - DNA, 22 bp, Homo sapiens
aatgtcaaaggctatacattca

SEQ ID NO: 109153 - DNA, 22 bp, Homo sapiens
taacagtatatttaccaaacct

SEQ ID NO: 109154 - DNA, 23 bp, Homo sapiens
ggcactcggccgtgaactcgtgc

SEQ ID NO: 109155 - DNA, 22 bp, Homo sapiens
tgtcaccttgctcatcctcgga

SEQ ID NO: 109156 - DNA, 23 bp, Homo sapiens
caccactttctccttctccttgg

SEQ ID NO: 109157 - DNA, 22 bp, Homo sapiens
ggagggcagagtcccctgctga

SEQ ID NO: 109158 - DNA, 22 bp, Homo sapiens
ttcctttctctggactgcagcc

SEQ ID NO: 109159 - DNA, 22 bp, Homo sapiens
ctgggaggcagaggttgtagtg

SEQ ID NO: 109160 - DNA, 22 bp, Homo sapiens
aatgcaatgcagcacctccttg

SEQ ID NO: 109161 - DNA, 22 bp, Homo sapiens
ccaggctggagtgcagtggcac

SEQ ID NO: 109162 - DNA, 22 bp, Homo sapiens
gctgctctccaagcctccttga

SEQ ID NO: 109163 - DNA, 22 bp, Homo sapiens
ggctgtggagctgcagagttgg

SEQ ID NO: 109164 - DNA, 22 bp, Homo sapiens
ggggtactggctggagccccac

SEQ ID NO: 109165 - DNA, 22 bp, Homo sapiens
atttcctgcaaggagtgggttt

SEQ ID NO: 109166 - DNA, 22 bp, Homo sapiens
acactgcagatgaaagcataag

SEQ ID NO: 109167 - DNA, 22 bp, Homo sapiens
gactgtggggaagcagatgcca

SEQ ID NO: 109168 - DNA, 22 bp, Homo sapiens
aaagtgctgtgattacaggcat

SEQ ID NO: 109169 - DNA, 22 bp, Homo sapiens
ctgagataggactctgctggct

SEQ ID NO: 109170 - DNA, 19 bp, Homo sapiens
gttctttcatagtaagagc

SEQ ID NO: 109171 - DNA, 22 bp, Homo sapiens
gggctaaatgcagaaatgcaga

SEQ ID NO: 109172 - DNA, 22 bp, Homo sapiens
aactctatttaccctactaaac

SEQ ID NO: 109173 - DNA, 22 bp, Homo sapiens
cctactctgagcgcctccgcat

SEQ ID NO: 109174 - DNA, 22 bp, Homo sapiens
tgtacttgaacttgactgtaga

SEQ ID NO: 109175 - DNA, 22 bp, Homo sapiens
cactgcaacctccacctcctgg

SEQ ID NO: 109176 - DNA, 22 bp, Homo sapiens
tgtttcttacgtttttagaggc

SEQ ID NO: 109177 - DNA, 22 bp, Homo sapiens
actgcaaagggaagccctttct

SEQ ID NO: 109178 - DNA, 22 bp, Homo sapiens
tgagcctgagttcaaggctgca

SEQ ID NO: 109179 - DNA, 22 bp, Homo sapiens
gcagggcacaaggacgcacagg

SEQ ID NO: 109180 - DNA, 17 bp, Homo sapiens
tgcatgtcctttgttcc

SEQ ID NO: 109181 - DNA, 22 bp, Homo sapiens
ccctggaggcggagcttgcagt

SEQ ID NO: 109182 - DNA, 22 bp, Homo sapiens
acaaagtgaattgcatcgagtt

SEQ ID NO: 109183 - DNA, 22 bp, Homo sapiens
gaggctgaggcaggaggatcac

SEQ ID NO: 109184 - DNA, 22 bp, Homo sapiens
tcggggtctttgacacgctctg

SEQ ID NO: 109185 - DNA, 22 bp, Homo sapiens
atgttggagtcgtaaggcatgg

SEQ ID NO: 109186 - DNA, 22 bp, Homo sapiens
gctgctgcttgaaggctcggag

SEQ ID NO: 109187 - DNA, 22 bp, Homo sapiens
gagcctcgtggcggccactgcg

SEQ ID NO: 109188 - DNA, 22 bp, Homo sapiens
agtcttcccagaggaggtgcca

SEQ ID NO: 109189 - DNA, 22 bp, Homo sapiens
tggcaccatcaaggctgagaac

SEQ ID NO: 109190 - DNA, 22 bp, Homo sapiens
catgagataatttttctccagt

SEQ ID NO: 109191 - DNA, 22 bp, Homo sapiens
cacagacagtgtccctttgttg

SEQ ID NO: 109192 - DNA, 22 bp, Homo sapiens
cctgacgaaaggcgtgctggag

SEQ ID NO: 109193 - DNA, 22 bp, Homo sapiens
tcactgcacttcagcttgggca

SEQ ID NO: 109194 - DNA, 22 bp, Homo sapiens
gaggtgctgctgtacttcttgc

SEQ ID NO: 109195 - DNA, 22 bp, Homo sapiens
gagggtggtggcttaaggtgct

SEQ ID NO: 109196 - DNA, 22 bp, Homo sapiens
tttctttatcatagcatctttg

SEQ ID NO: 109197 - DNA, 14 bp, Homo sapiens
gcaggcagatcacc

SEQ ID NO: 109198 - DNA, 22 bp, Homo sapiens
aagctgcagcacagagaggtgg

SEQ ID NO: 109199 - DNA, 22 bp, Homo sapiens
tccagcagtccatgtgagacac

SEQ ID NO: 109200 - DNA, 22 bp, Homo sapiens
ccacagtcctggcttctgtctg

SEQ ID NO: 109201 - DNA, 22 bp, Homo sapiens
tggcaatgttagcaaagcattt

SEQ ID NO: 109202 - DNA, 22 bp, Homo sapiens
tcactgcaacctccgcctgctg

SEQ ID NO: 109203 - DNA, 22 bp, Homo sapiens
atgagtatatgatatggtttgg

SEQ ID NO: 109204 - DNA, 22 bp, Homo sapiens
gtcccataagtagtgcaacttg

SEQ ID NO: 109205 - DNA, 22 bp, Homo sapiens
ctgctttgcatagctgccagag

SEQ ID NO: 109206 - DNA, 22 bp, Homo sapiens
cagtgcatgcacacacatggta

SEQ ID NO: 109207 - DNA, 23 bp, Homo sapiens
ttgcatagacatcctcatagatt

SEQ ID NO: 109208 - DNA, 22 bp, Homo sapiens
ttcaatatgatattagctgtgg

SEQ ID NO: 109209 - DNA, 22 bp, Homo sapiens
tgttgattagtgtttagactta

SEQ ID NO: 109210 - DNA, 22 bp, Homo sapiens
attaagtgactaaagtaatgct

SEQ ID NO: 109211 - DNA, 22 bp, Homo sapiens
aaagggaagttgcacatgttcc

SEQ ID NO: 109212 - DNA, 22 bp, Homo sapiens
atttagaactttgtttgccaat

SEQ ID NO: 109213 - DNA, 22 bp, Homo sapiens
agtgctgtcagttttatagata

SEQ ID NO: 109214 - DNA, 22 bp, Homo sapiens
tttattctgtgctacatgaaga

SEQ ID NO: 109215 - DNA, 22 bp, Homo sapiens
ggaaatgacttggtgcttcgtt

SEQ ID NO: 109216 - DNA, 20 bp, Homo sapiens
atgctttcttgtgtgctgct

SEQ ID NO: 109217 - DNA, 22 bp, Homo sapiens
agaaaatttaaagagacacaca

SEQ ID NO: 109218 - DNA, 22 bp, Homo sapiens
ttgtgaatagtgccgcaataaa

SEQ ID NO: 109219 - DNA, 22 bp, Homo sapiens
ccattgtaaattctgtggaagt

SEQ ID NO: 109220 - DNA, 22 bp, Homo sapiens
ttttaatactgctattgtagga

SEQ ID NO: 109221 - DNA, 22 bp, Homo sapiens
cctcttctaggacgtccttgtg

SEQ ID NO: 109222 - DNA, 22 bp, Homo sapiens
ctgtatctgtgttggatgagtt

SEQ ID NO: 109223 - DNA, 22 bp, Homo sapiens
atctagattaggtataagagct

SEQ ID NO: 109224 - DNA, 22 bp, Homo sapiens
gagaaatgcatgcatgtcatca

SEQ ID NO: 109225 - DNA, 22 bp, Homo sapiens
acaattctgatggtttcccagt

SEQ ID NO: 109226 - DNA, 22 bp, Homo sapiens
aaagaaatagatggcatttaaa

SEQ ID NO: 109227 - DNA, 22 bp, Homo sapiens
ttgtgaatggtgccgcaataaa

SEQ ID NO: 109228 - DNA, 22 bp, Homo sapiens
tttgagatggagtcttgctctg

SEQ ID NO: 109229 - DNA, 22 bp, Homo sapiens
aataatctcactttatgtggaa

SEQ ID NO: 109230 - DNA, 20 bp, Homo sapiens
tttcttgtcggctgttgctg

SEQ ID NO: 109231 - DNA, 22 bp, Homo sapiens
ctttggcaatgtcattttcaat

SEQ ID NO: 109232 - DNA, 22 bp, Homo sapiens
ttcttctccgaggagggctggt

SEQ ID NO: 109233 - DNA, 22 bp, Homo sapiens
gatgtgtttccaggatttgttt

SEQ ID NO: 109234 - DNA, 22 bp, Homo sapiens
tgctgtgaggttgagaaggaag

SEQ ID NO: 109235 - DNA, 22 bp, Homo sapiens
aaactgctttccacagtggcta

SEQ ID NO: 109236 - DNA, 22 bp, Homo sapiens
tgaaatgattatatggtgtttg

SEQ ID NO: 109237 - DNA, 22 bp, Homo sapiens
gtgattttctcctcctagaagt

SEQ ID NO: 109238 - DNA, 22 bp, Homo sapiens
atcttctcatgtgtaatgaggt

SEQ ID NO: 109239 - DNA, 22 bp, Homo sapiens
tcttgccacttcatcccctttc

SEQ ID NO: 109240 - DNA, 22 bp, Homo sapiens
aagaataagaggatttagaaca

SEQ ID NO: 109241 - DNA, 22 bp, Homo sapiens
ttatgatttgccacagattggt

SEQ ID NO: 109242 - DNA, 22 bp, Homo sapiens
aaatggaagctatttatgattc

SEQ ID NO: 109243 - DNA, 22 bp, Homo sapiens
atatatttgagaatattcatga

SEQ ID NO: 109244 - DNA, 22 bp, Homo sapiens
tcttagaaattccccagtggct

SEQ ID NO: 109245 - DNA, 22 bp, Homo sapiens
aagatattcaaagatttattag

SEQ ID NO: 109246 - DNA, 22 bp, Homo sapiens
aagactgtgtctatggctactc

SEQ ID NO: 109247 - DNA, 22 bp, Homo sapiens
ttgattatagactcactaatct

SEQ ID NO: 109248 - DNA, 22 bp, Homo sapiens
ctgctttggacaactattcttg

SEQ ID NO: 109249 - DNA, 21 bp, Homo sapiens
tttcttaggctctaaaatgac

SEQ ID NO: 109250 - DNA, 22 bp, Homo sapiens
agtgctatcgagttctaatgct

SEQ ID NO: 109251 - DNA, 22 bp, Homo sapiens
ataatggaaaagatcatttcct

SEQ ID NO: 109252 - DNA, 22 bp, Homo sapiens
catgctgtgtgttttagctcca

SEQ ID NO: 109253 - DNA, 22 bp, Homo sapiens
ttaataaagtatgaattggaaa

SEQ ID NO: 109254 - DNA, 22 bp, Homo sapiens
ttcttctcagggtcccacatgg

SEQ ID NO: 109255 - DNA, 21 bp, Homo sapiens
tgtaagtttcatctgaattgg

SEQ ID NO: 109256 - DNA, 22 bp, Homo sapiens
ggaactcctgctccaagcagct

SEQ ID NO: 109257 - DNA, 22 bp, Homo sapiens
tgccatagcaatggtaagctga

SEQ ID NO: 109258 - DNA, 19 bp, Homo sapiens
acacagggatcagagggtt

SEQ ID NO: 109259 - DNA, 22 bp, Homo sapiens
ttctggaaggatgtttctatct

SEQ ID NO: 109260 - DNA, 22 bp, Homo sapiens
attaaagctatccagtcatgaa

SEQ ID NO: 109261 - DNA, 22 bp, Homo sapiens
cccgtgtgtgcgaggctcccgc

SEQ ID NO: 109262 - DNA, 20 bp, Homo sapiens
gggcaaggaaacagccccca

SEQ ID NO: 109263 - DNA, 22 bp, Homo sapiens
catgcctgcctggtgggcgtgg

SEQ ID NO: 109264 - DNA, 22 bp, Homo sapiens
cacatgaaggctggggtcgtga

SEQ ID NO: 109265 - DNA, 22 bp, Homo sapiens
aagaataagaggatttagaaca

SEQ ID NO: 109266 - DNA, 23 bp, Homo sapiens
attttttgtctttgtaactagat

SEQ ID NO: 109267 - DNA, 22 bp, Homo sapiens
caattgacaatgacagtgtcaa

SEQ ID NO: 109268 - DNA, 22 bp, Homo sapiens
atttcagtattatacaactgct

SEQ ID NO: 109269 - DNA, 22 bp, Homo sapiens
cctgctggctctgttgctcggc

SEQ ID NO: 109270 - DNA, 22 bp, Homo sapiens
ggcgtggggccttctgcccgct

SEQ ID NO: 109271 - DNA, 22 bp, Homo sapiens
tttgaagactactgggagtgaa

SEQ ID NO: 109272 - DNA, 22 bp, Homo sapiens
tcattgccatggcatttgcaga

SEQ ID NO: 109273 - DNA, 22 bp, Homo sapiens
ttgtgaaacattcatggatttg

SEQ ID NO: 109274 - DNA, 22 bp, Homo sapiens
ttggagatatcacaccttcaca

SEQ ID NO: 109275 - DNA, 22 bp, Homo sapiens
aacccgggaggcggaggttgtg

SEQ ID NO: 109276 - DNA, 22 bp, Homo sapiens
aggtcaccatggcatgctccac

SEQ ID NO: 109277 - DNA, 22 bp, Homo sapiens
tggatttcaccatgttggtcag

SEQ ID NO: 109278 - DNA, 22 bp, Homo sapiens
cgaggcctcctcgccgccaccg

SEQ ID NO: 109279 - DNA, 22 bp, Homo sapiens
cactcagctgagccctcagccc

SEQ ID NO: 109280 - DNA, 22 bp, Homo sapiens
gcggctccgaagccaggccgcg

SEQ ID NO: 109281 - DNA, 22 bp, Homo sapiens
aactaatacattaatacatgtg

SEQ ID NO: 109282 - DNA, 22 bp, Homo sapiens
gcgctgaggctggaggcgcacg

SEQ ID NO: 109283 - DNA, 22 bp, Homo sapiens
ttgcatcagaattacttggagg

SEQ ID NO: 109284 - DNA, 22 bp, Homo sapiens
actggacagaggaaatatggag

SEQ ID NO: 109285 - DNA, 20 bp, Homo sapiens
ggcagagggcctgggagaag

SEQ ID NO: 109286 - DNA, 23 bp, Homo sapiens
gcctgggagttgcgatctgcccg

SEQ ID NO: 109287 - DNA, 22 bp, Homo sapiens
tccagcccaggctggagtgtag

SEQ ID NO: 109288 - DNA, 22 bp, Homo sapiens
gtaggccatggtggttgtctct

SEQ ID NO: 109289 - DNA, 23 bp, Homo sapiens
aatggcggaaagaacacagaggg

SEQ ID NO: 109290 - DNA, 22 bp, Homo sapiens
gcccatgaggtggaggctgcag

SEQ ID NO: 109291 - DNA, 22 bp, Homo sapiens
tgttgatttgtgggctgcaaaa

SEQ ID NO: 109292 - DNA, 22 bp, Homo sapiens
tcagcctccgaaagtgctggga

SEQ ID NO: 109293 - DNA, 22 bp, Homo sapiens
gccacctcggctttctctgctc

SEQ ID NO: 109294 - DNA, 22 bp, Homo sapiens
tgtgttgtgacattcttggatg

SEQ ID NO: 109295 - DNA, 22 bp, Homo sapiens
ggggcccctcggacacgtgcgg

SEQ ID NO: 109296 - DNA, 22 bp, Homo sapiens
ctgcaagctacccctagcatca

SEQ ID NO: 109297 - DNA, 17 bp, Homo sapiens
tggtccaggtggagcca

SEQ ID NO: 109298 - DNA, 22 bp, Homo sapiens
gtggagggtgattgccggctgt

SEQ ID NO: 109299 - DNA, 22 bp, Homo sapiens
actgcgctccagcctgggtgac

SEQ ID NO: 109300 - DNA, 21 bp, Homo sapiens
ctgtcatgcaaccattctcca

SEQ ID NO: 109301 - DNA, 22 bp, Homo sapiens
gggagtgggtttggcctaggcc

SEQ ID NO: 109302 - DNA, 22 bp, Homo sapiens
cggctgggttcggctgcaggcc

SEQ ID NO: 109303 - DNA, 22 bp, Homo sapiens
aactcactttgtggcttctgaa

SEQ ID NO: 109304 - DNA, 22 bp, Homo sapiens
gaagtttttgtagagacagggt

SEQ ID NO: 109305 - DNA, 22 bp, Homo sapiens
tgggcaggggccctgcttccgt

SEQ ID NO: 109306 - DNA, 22 bp, Homo sapiens
ttggccatctaagcccagccac

SEQ ID NO: 109307 - DNA, 22 bp, Homo sapiens
tcactgcaacctccacctcccg

SEQ ID NO: 109308 - DNA, 21 bp, Homo sapiens
gggcctggctgcgcaggacgg

SEQ ID NO: 109309 - DNA, 22 bp, Homo sapiens
atcctccagctcctgcttctgc

SEQ ID NO: 109310 - DNA, 22 bp, Homo sapiens
cagggtgctgcaccatccctca

SEQ ID NO: 109311 - DNA, 22 bp, Homo sapiens
actggggctgatgcgttcgtgt

SEQ ID NO: 109312 - DNA, 22 bp, Homo sapiens
cagtgccagctgcttggcctac

SEQ ID NO: 109313 - DNA, 22 bp, Homo sapiens
gctgaggctcctcgggaggaca

SEQ ID NO: 109314 - DNA, 22 bp, Homo sapiens
tgacttcctgcactcaggtgat

SEQ ID NO: 109315 - DNA, 22 bp, Homo sapiens
gcttccggagccaaaaggcccc

SEQ ID NO: 109316 - DNA, 22 bp, Homo sapiens
gttggctatgagagctttagtg

SEQ ID NO: 109317 - DNA, 22 bp, Homo sapiens
gatttgtggtgtgaggaagagc

SEQ ID NO: 109318 - DNA, 22 bp, Homo sapiens
ttccatttggcacttcactgag

SEQ ID NO: 109319 - DNA, 22 bp, Homo sapiens
ctgcatccatgttgctgcaaag

SEQ ID NO: 109320 - DNA, 22 bp, Homo sapiens
gttgagtgggttaggatgctga

SEQ ID NO: 109321 - DNA, 22 bp, Homo sapiens
tctgagaatggtggatgtggtg

SEQ ID NO: 109322 - DNA, 22 bp, Homo sapiens
tatgatagttttttaaatgtcc

SEQ ID NO: 109323 - DNA, 22 bp, Homo sapiens
gggactggagtagaggccggtg

SEQ ID NO: 109324 - DNA, 22 bp, Homo sapiens
cagctggttgaagaggagctgg

SEQ ID NO: 109325 - DNA, 22 bp, Homo sapiens
gcctgatgagcttccagctgag

SEQ ID NO: 109326 - DNA, 23 bp, Homo sapiens
atgtttgcagtaacccatcctgg

SEQ ID NO: 109327 - DNA, 22 bp, Homo sapiens
cctgcctatgagacgttttgcc

SEQ ID NO: 109328 - DNA, 22 bp, Homo sapiens
agcccaggtccagttcactgca

SEQ ID NO: 109329 - DNA, 22 bp, Homo sapiens
tctcgctctgtcgcccaggctg

SEQ ID NO: 109330 - DNA, 22 bp, Homo sapiens
tagctcaaaggttaagtgtgga

SEQ ID NO: 109331 - DNA, 17 bp, Homo sapiens
cgggcatggagggcagg

SEQ ID NO: 109332 - DNA, 22 bp, Homo sapiens
attgcactccggcctgggtgac

SEQ ID NO: 109333 - DNA, 22 bp, Homo sapiens
aggcaggaggatcatggatgca

SEQ ID NO: 109334 - DNA, 17 bp, Homo sapiens
ttaaggtggatcagcac

SEQ ID NO: 109335 - DNA, 22 bp, Homo sapiens
tgcagtcttccagctgcacaaa

SEQ ID NO: 109336 - DNA, 22 bp, Homo sapiens
catgagataatttttctccagt

SEQ ID NO: 109337 - DNA, 16 bp, Homo sapiens
atgctgctattagagg

SEQ ID NO: 109338 - DNA, 22 bp, Homo sapiens
ttcacctgtgacaggtagagtt

SEQ ID NO: 109339 - DNA, 22 bp, Homo sapiens
aggtcacgtcctgtgatgtcat

SEQ ID NO: 109340 - DNA, 20 bp, Homo sapiens
tgttgattggtgtcatctca

SEQ ID NO: 109341 - DNA, 22 bp, Homo sapiens
tgtcctcatcctccagtctgtc

SEQ ID NO: 109342 - DNA, 22 bp, Homo sapiens
gcagagccatgggaggtttttg

SEQ ID NO: 109343 - DNA, 22 bp, Homo sapiens
ctgcagggagaggggacagcct

SEQ ID NO: 109344 - DNA, 22 bp, Homo sapiens
tacaacaatttccacattagaa

SEQ ID NO: 109345 - DNA, 23 bp, Homo sapiens
agcctcttgtggatggtcagcga

SEQ ID NO: 109346 - DNA, 22 bp, Homo sapiens
acactgtgtgacttctgagact

SEQ ID NO: 109347 - DNA, 22 bp, Homo sapiens
tggcatggagtggatggcccca

SEQ ID NO: 109348 - DNA, 16 bp, Homo sapiens
gatctgaaggtgctgg

SEQ ID NO: 109349 - DNA, 22 bp, Homo sapiens
caggagtgtctccacacagcaa

SEQ ID NO: 109350 - DNA, 22 bp, Homo sapiens
tgggaggccaaggcaggcggat

SEQ ID NO: 109351 - DNA, 22 bp, Homo sapiens
tttaagaagttatgttataaat

SEQ ID NO: 109352 - DNA, 22 bp, Homo sapiens
agaatagaattctcatagaatt

SEQ ID NO: 109353 - DNA, 22 bp, Homo sapiens
ctctcgccagcggggctgcgct

SEQ ID NO: 109354 - DNA, 22 bp, Homo sapiens
ttttaagttggattgctaagta

SEQ ID NO: 109355 - DNA, 22 bp, Homo sapiens
aatatttccaaggcctgtcagg

SEQ ID NO: 109356 - DNA, 22 bp, Homo sapiens
gtggaggagaggcgccttgcgg

SEQ ID NO: 109357 - DNA, 22 bp, Homo sapiens
tggggtgagattcagatattca

SEQ ID NO: 109358 - DNA, 22 bp, Homo sapiens
tctggagataagcagcaatgaa

SEQ ID NO: 109359 - DNA, 22 bp, Homo sapiens
ggaggcggaggttgcagtgagc

SEQ ID NO: 109360 - DNA, 22 bp, Homo sapiens
tgaggatgtctgtattttgcct

SEQ ID NO: 109361 - DNA, 22 bp, Homo sapiens
ataatggaaaagatcatttcct

SEQ ID NO: 109362 - DNA, 22 bp, Homo sapiens
gcccaggaggagaggctgcagt

SEQ ID NO: 109363 - DNA, 22 bp, Homo sapiens
gccccgtcgtggggccagggat

SEQ ID NO: 109364 - DNA, 22 bp, Homo sapiens
atcatcctagaaggaagctagg

SEQ ID NO: 109365 - DNA, 22 bp, Homo sapiens
agcccggcttccccggttgcta

SEQ ID NO: 109366 - DNA, 22 bp, Homo sapiens
tcactcaggctggagtgcagtg

SEQ ID NO: 109367 - DNA, 22 bp, Homo sapiens
taaagggtaggttttactgtaa

SEQ ID NO: 109368 - DNA, 22 bp, Homo sapiens
tgggaagggtcaacagctggaa

SEQ ID NO: 109369 - DNA, 21 bp, Homo sapiens
gggcagaggggcctcctgggt

SEQ ID NO: 109370 - DNA, 22 bp, Homo sapiens
ggtggttcacgcctataatccc

SEQ ID NO: 109371 - DNA, 22 bp, Homo sapiens
gcgagggcacgcggttgaaggc

SEQ ID NO: 109372 - DNA, 22 bp, Homo sapiens
tcctccccaaagcccagcctgg

SEQ ID NO: 109373 - DNA, 22 bp, Homo sapiens
caggaaggcgcggctgtgcctg

SEQ ID NO: 109374 - DNA, 22 bp, Homo sapiens
acctggacacctgctgtcatct

SEQ ID NO: 109375 - DNA, 21 bp, Homo sapiens
ggagtttttctggaagggact

SEQ ID NO: 109376 - DNA, 22 bp, Homo sapiens
ctgctccccagcctgcgccttt

SEQ ID NO: 109377 - DNA, 22 bp, Homo sapiens
atagaatatgacttttagatcc

SEQ ID NO: 109378 - DNA, 22 bp, Homo sapiens
tagagcattatgacaaccccat

SEQ ID NO: 109379 - DNA, 22 bp, Homo sapiens
accagaagctggagcacaagga

SEQ ID NO: 109380 - DNA, 22 bp, Homo sapiens
gagcccaggagtttgatgctgc

SEQ ID NO: 109381 - DNA, 22 bp, Homo sapiens
cggggccctggggctgaaggtc

SEQ ID NO: 109382 - DNA, 22 bp, Homo sapiens
caggaaggggctcactctggcc

SEQ ID NO: 109383 - DNA, 22 bp, Homo sapiens
tgtgtgattgcaggagatgtgg

SEQ ID NO: 109384 - DNA, 22 bp, Homo sapiens
tactgtgtgcccagccgagctg

SEQ ID NO: 109385 - DNA, 22 bp, Homo sapiens
tcctgggacaagccgtggaagt

SEQ ID NO: 109386 - DNA, 19 bp, Homo sapiens
caggcctcttaccctctct

SEQ ID NO: 109387 - DNA, 22 bp, Homo sapiens
gttggacagtttgggaagggag

SEQ ID NO: 109388 - DNA, 22 bp, Homo sapiens
gtcaggactctgacccgtcccg

SEQ ID NO: 109389 - DNA, 22 bp, Homo sapiens
ctttggagaaaagttcttgggc

SEQ ID NO: 109390 - DNA, 22 bp, Homo sapiens
ggcgtgggcgaggtgctctatc

SEQ ID NO: 109391 - DNA, 22 bp, Homo sapiens
tgtgttaaggtgcatctagtgc

SEQ ID NO: 109392 - DNA, 22 bp, Homo sapiens
ggctctgcttgaggccagcctg

SEQ ID NO: 109393 - DNA, 22 bp, Homo sapiens
gagccaggttggaggctgcagt

SEQ ID NO: 109394 - DNA, 21 bp, Homo sapiens
gccatttcacacagacatttg

SEQ ID NO: 109395 - DNA, 22 bp, Homo sapiens
agaggaggctctgggatcgtcc

SEQ ID NO: 109396 - DNA, 22 bp, Homo sapiens
cttgatctacatagtgaaaccc

SEQ ID NO: 109397 - DNA, 22 bp, Homo sapiens
gtgtgggctgcagaggcacagc

SEQ ID NO: 109398 - DNA, 22 bp, Homo sapiens
ggggtcggggcatagccactta

SEQ ID NO: 109399 - DNA, 20 bp, Homo sapiens
tttcttgtcggctgttgctg

SEQ ID NO: 109400 - DNA, 22 bp, Homo sapiens
gtctatatattgcttgaataat

SEQ ID NO: 109401 - DNA, 22 bp, Homo sapiens
taatttcagtgcaagctcacgg

SEQ ID NO: 109402 - DNA, 22 bp, Homo sapiens
ccgcggggcgtgggctcttacc

SEQ ID NO: 109403 - DNA, 22 bp, Homo sapiens
gccctgggcaaggttctggcca

SEQ ID NO: 109404 - DNA, 22 bp, Homo sapiens
tagactggtgaattagggggaa

SEQ ID NO: 109405 - DNA, 22 bp, Homo sapiens
ccagagtcccttgcagctcagt

SEQ ID NO: 109406 - DNA, 22 bp, Homo sapiens
gaggctgcagctatcagacatt

SEQ ID NO: 109407 - DNA, 22 bp, Homo sapiens
tgggcccgcagctgctgctcca

SEQ ID NO: 109408 - DNA, 22 bp, Homo sapiens
agtgctgggctatctactgcta

SEQ ID NO: 109409 - DNA, 22 bp, Homo sapiens
ggcttggaccagtcacagtggt

SEQ ID NO: 109410 - DNA, 22 bp, Homo sapiens
tcctgggaggcggaggttgcag

SEQ ID NO: 109411 - DNA, 22 bp, Homo sapiens
gggaggttgaggctgcagtgag

SEQ ID NO: 109412 - DNA, 22 bp, Homo sapiens
tcttcctgtcaatgagaattaa

SEQ ID NO: 109413 - DNA, 22 bp, Homo sapiens
tgagacttaagaggtcatgttg

SEQ ID NO: 109414 - DNA, 22 bp, Homo sapiens
gatgaaggggctggtgccctct

SEQ ID NO: 109415 - DNA, 22 bp, Homo sapiens
ccgtggtcacctgagctccttg

SEQ ID NO: 109416 - DNA, 22 bp, Homo sapiens
cagagcccctcgtctccaccac

SEQ ID NO: 109417 - DNA, 22 bp, Homo sapiens
gcaccaggtgcagccgggcccc

SEQ ID NO: 109418 - DNA, 19 bp, Homo sapiens
taggaccctggtggccccc

SEQ ID NO: 109419 - DNA, 22 bp, Homo sapiens
ttgggctcaggagtttgagacc

SEQ ID NO: 109420 - DNA, 19 bp, Homo sapiens
tccaggggctccacctcct

SEQ ID NO: 109421 - DNA, 22 bp, Homo sapiens
ttccccttgggctgtggaggag

SEQ ID NO: 109422 - DNA, 22 bp, Homo sapiens
atgttatgtctgggaaggggta

SEQ ID NO: 109423 - DNA, 22 bp, Homo sapiens
tgttgactcaacactgtgggca

SEQ ID NO: 109424 - DNA, 22 bp, Homo sapiens
tctggacaggggcgctttgggg

SEQ ID NO: 109425 - DNA, 22 bp, Homo sapiens
tgctgggctggggcctcagacc

SEQ ID NO: 109426 - DNA, 22 bp, Homo sapiens
gtgagccgagtatagttcatag

SEQ ID NO: 109427 - DNA, 19 bp, Homo sapiens
aaaggtagtaacctctgat

SEQ ID NO: 109428 - DNA, 22 bp, Homo sapiens
tttgagatctcaatgaggacta

SEQ ID NO: 109429 - DNA, 22 bp, Homo sapiens
tgtggcccgatcttgggagaca

SEQ ID NO: 109430 - DNA, 22 bp, Homo sapiens
ttttggttgttgggtaagagta

SEQ ID NO: 109431 - DNA, 22 bp, Homo sapiens
caagcgtggctgctctgatgga

SEQ ID NO: 109432 - DNA, 22 bp, Homo sapiens
tggttgtggtcctccacatcgc

SEQ ID NO: 109433 - DNA, 22 bp, Homo sapiens
tccaaatgagctctgccttcca

SEQ ID NO: 109434 - DNA, 22 bp, Homo sapiens
gagccaggtcgggccgcggcga

SEQ ID NO: 109435 - DNA, 22 bp, Homo sapiens
gaagccttgaactgcaaacccc

SEQ ID NO: 109436 - DNA, 22 bp, Homo sapiens
aaaggacacacaggaggtgtct

SEQ ID NO: 109437 - DNA, 22 bp, Homo sapiens
gggccatgagaggttcatcaac

SEQ ID NO: 109438 - DNA, 17 bp, Homo sapiens
tggctctgtcctcagct

SEQ ID NO: 109439 - DNA, 22 bp, Homo sapiens
gcagaggacacaggagggcaag

SEQ ID NO: 109440 - DNA, 22 bp, Homo sapiens
aagaacgaactttgctaattgt

SEQ ID NO: 109441 - DNA, 22 bp, Homo sapiens
acccaggctggagtgcagtgat

SEQ ID NO: 109442 - DNA, 22 bp, Homo sapiens
catgcacttacctgaaattcaa

SEQ ID NO: 109443 - DNA, 22 bp, Homo sapiens
ccgccgtgcaggccgcgacgtg

SEQ ID NO: 109444 - DNA, 22 bp, Homo sapiens
tgagaaattacttcagtgatgg

SEQ ID NO: 109445 - DNA, 22 bp, Homo sapiens
atcacctgggaggaaccatcta

SEQ ID NO: 109446 - DNA, 22 bp, Homo sapiens
gggacaatggaggcctctctcc

SEQ ID NO: 109447 - DNA, 20 bp, Homo sapiens
ataaaataactgccacaaga

SEQ ID NO: 109448 - DNA, 22 bp, Homo sapiens
tctgagaaatttctttgtgatg

SEQ ID NO: 109449 - DNA, 22 bp, Homo sapiens
tagaggccgaatgctgagctgg

SEQ ID NO: 109450 - DNA, 22 bp, Homo sapiens
gagatggagtctttttctgtca

SEQ ID NO: 109451 - DNA, 22 bp, Homo sapiens
tttgcttgttcaagatttctgt

SEQ ID NO: 109452 - DNA, 22 bp, Homo sapiens
aacccaggagacaggttgcagt

SEQ ID NO: 109453 - DNA, 22 bp, Homo sapiens
gtgctccctccttcctcaagga

SEQ ID NO: 109454 - DNA, 22 bp, Homo sapiens
tgacttgtctctttgggagaca

SEQ ID NO: 109455 - DNA, 22 bp, Homo sapiens
ccttggcaggcacgtcctgcgg

SEQ ID NO: 109456 - DNA, 22 bp, Homo sapiens
aaagaaatagatggcatttaaa

SEQ ID NO: 109457 - DNA, 22 bp, Homo sapiens
atgggtcagttcagtggccaac

SEQ ID NO: 109458 - DNA, 22 bp, Homo sapiens
gcagctattgtctcctgggccc

SEQ ID NO: 109459 - DNA, 22 bp, Homo sapiens
actgggtctgaaggacagagca

SEQ ID NO: 109460 - DNA, 22 bp, Homo sapiens
ttttcagaattagcataccatt

SEQ ID NO: 109461 - DNA, 22 bp, Homo sapiens
gaggaggcagcctatcccttag

SEQ ID NO: 109462 - DNA, 22 bp, Homo sapiens
tgtgcatgtttgttttcagggt

SEQ ID NO: 109463 - DNA, 22 bp, Homo sapiens
aggtcaagagtaaatttgggta

SEQ ID NO: 109464 - DNA, 22 bp, Homo sapiens
aacccaggagatggaggttgtg

SEQ ID NO: 109465 - DNA, 22 bp, Homo sapiens
atgagaaagttaatcatcatga

SEQ ID NO: 109466 - DNA, 22 bp, Homo sapiens
cggggacacactggcagctcct

SEQ ID NO: 109467 - DNA, 22 bp, Homo sapiens
cttaatctcacctgcaaagtcc

SEQ ID NO: 109468 - DNA, 22 bp, Homo sapiens
tacatagctcctagtgatgcat

SEQ ID NO: 109469 - DNA, 22 bp, Homo sapiens
aaagcttaccttttcagtcttt

SEQ ID NO: 109470 - DNA, 22 bp, Homo sapiens
ctggtctggctacccagcgaat

SEQ ID NO: 109471 - DNA, 22 bp, Homo sapiens
agggactatttacccatctcac

SEQ ID NO: 109472 - DNA, 22 bp, Homo sapiens
agggtgaatctcacaactctta

SEQ ID NO: 109473 - DNA, 22 bp, Homo sapiens
ggctagcaaggtagcagaatgc

SEQ ID NO: 109474 - DNA, 22 bp, Homo sapiens
tgtccagctcgagacactatct

SEQ ID NO: 109475 - DNA, 22 bp, Homo sapiens
gtccacagctctgaggtctccc

SEQ ID NO: 109476 - DNA, 22 bp, Homo sapiens
tctagttctagatccctgagga

SEQ ID NO: 109477 - DNA, 22 bp, Homo sapiens
tagcccaggctggagtgcaggg

SEQ ID NO: 109478 - DNA, 22 bp, Homo sapiens
atccaccctgtggtggctttct

SEQ ID NO: 109479 - DNA, 22 bp, Homo sapiens
acccgggaggcaggagtcatag

SEQ ID NO: 109480 - DNA, 22 bp, Homo sapiens
gggcgccgtgggaaacagccgg

SEQ ID NO: 109481 - DNA, 22 bp, Homo sapiens
agacccaggattggggctgccg

SEQ ID NO: 109482 - DNA, 22 bp, Homo sapiens
cctgggggccaggaaggtgtga

SEQ ID NO: 109483 - DNA, 22 bp, Homo sapiens
agagctgggtggacttgtagtt

SEQ ID NO: 109484 - DNA, 22 bp, Homo sapiens
tccatgaggaccaaattcgtag

SEQ ID NO: 109485 - DNA, 22 bp, Homo sapiens
ctgagatggagttttgctcttg

SEQ ID NO: 109486 - DNA, 22 bp, Homo sapiens
tgtttacagctgatcaggcatc

SEQ ID NO: 109487 - DNA, 22 bp, Homo sapiens
atgtgagctggggcccggccag

SEQ ID NO: 109488 - DNA, 22 bp, Homo sapiens
tccaaggagcagtcttcaacct

SEQ ID NO: 109489 - DNA, 22 bp, Homo sapiens
agtgctatcgagttctaatgct

SEQ ID NO: 109490 - DNA, 22 bp, Homo sapiens
ctgtccgccgacttggccaggc

SEQ ID NO: 109491 - DNA, 22 bp, Homo sapiens
ttgcagcccgggttggtttgtg

SEQ ID NO: 109492 - DNA, 22 bp, Homo sapiens
aatactgcctgtgaggtaactc

SEQ ID NO: 109493 - DNA, 22 bp, Homo sapiens
tctgctcagccgatctgctccg

SEQ ID NO: 109494 - DNA, 22 bp, Homo sapiens
agcgcttgccgcactccaagca

SEQ ID NO: 109495 - DNA, 22 bp, Homo sapiens
atgcctgtaatcccagcacttt

SEQ ID NO: 109496 - DNA, 22 bp, Homo sapiens
caggccagggttgagaagagaa

SEQ ID NO: 109497 - DNA, 22 bp, Homo sapiens
tccaccatgtaacaagctctgt

SEQ ID NO: 109498 - DNA, 22 bp, Homo sapiens
aaggggtgagcagaggcttcgc

SEQ ID NO: 109499 - DNA, 22 bp, Homo sapiens
gggaacagcttgggctctgcca

SEQ ID NO: 109500 - DNA, 22 bp, Homo sapiens
gaggggctgccctggtgtcagg

SEQ ID NO: 109501 - DNA, 22 bp, Homo sapiens
ttgtgcttgccctggaggtgcg

SEQ ID NO: 109502 - DNA, 22 bp, Homo sapiens
ggtgcagaggagccagctgggg

SEQ ID NO: 109503 - DNA, 18 bp, Homo sapiens
tgtccctgcaaataacat

SEQ ID NO: 109504 - DNA, 22 bp, Homo sapiens
ttgggctgaaccctgcagctga

SEQ ID NO: 109505 - DNA, 22 bp, Homo sapiens
aaggtgggtggatcacgaggtc

SEQ ID NO: 109506 - DNA, 22 bp, Homo sapiens
ctgtcaggttggtctcagagct

SEQ ID NO: 109507 - DNA, 22 bp, Homo sapiens
agcaggcctgccacctcggggt

SEQ ID NO: 109508 - DNA, 22 bp, Homo sapiens
tggcatgcatctgttgtcctag

SEQ ID NO: 109509 - DNA, 22 bp, Homo sapiens
gtgggggcaggcagtgctagga

SEQ ID NO: 109510 - DNA, 22 bp, Homo sapiens
gcatatgatcacgtgtgtcggt

SEQ ID NO: 109511 - DNA, 22 bp, Homo sapiens
cttctcttcctttgtcaactga

SEQ ID NO: 109512 - DNA, 22 bp, Homo sapiens
tcgcccaggctggaagtgcagt

SEQ ID NO: 109513 - DNA, 22 bp, Homo sapiens
tgggtgtgtccatattttgact

SEQ ID NO: 109514 - DNA, 22 bp, Homo sapiens
gggtggagagaaagaaacgtga

SEQ ID NO: 109515 - DNA, 22 bp, Homo sapiens
cagctgctgttcagttttgttt

SEQ ID NO: 109516 - DNA, 22 bp, Homo sapiens
caggtagaggctgccatcagct

SEQ ID NO: 109517 - DNA, 22 bp, Homo sapiens
gctgcagggagctggaaggctc

SEQ ID NO: 109518 - DNA, 22 bp, Homo sapiens
tcctccagttccttggtttcag

SEQ ID NO: 109519 - DNA, 22 bp, Homo sapiens
tgcgatggcgtagacaaatccc

SEQ ID NO: 109520 - DNA, 22 bp, Homo sapiens
ctgagataggactctgctggct

SEQ ID NO: 109521 - DNA, 22 bp, Homo sapiens
ggcatcttgttgctcaaatcta

SEQ ID NO: 109522 - DNA, 22 bp, Homo sapiens
gcggggggaggaacatcttgca

SEQ ID NO: 109523 - DNA, 21 bp, Homo sapiens
ttagaagctaatgcagctggt

SEQ ID NO: 109524 - DNA, 22 bp, Homo sapiens
cactgcacttcagcctgggtga

SEQ ID NO: 109525 - DNA, 22 bp, Homo sapiens
ttcaatatgatattagctgtgg

SEQ ID NO: 109526 - DNA, 22 bp, Homo sapiens
gggcagagactcagaaacagaa

SEQ ID NO: 109527 - DNA, 22 bp, Homo sapiens
ggggcagagaataaaaacctaa

SEQ ID NO: 109528 - DNA, 22 bp, Homo sapiens
tgcctctgaggaagattgtgtt

SEQ ID NO: 109529 - DNA, 22 bp, Homo sapiens
tcagaacatgtttgagtaagac

SEQ ID NO: 109530 - DNA, 22 bp, Homo sapiens
gtcttagatttcaccgataatg

SEQ ID NO: 109531 - DNA, 22 bp, Homo sapiens
tgtcatggggttgttttgtaca

SEQ ID NO: 109532 - DNA, 22 bp, Homo sapiens
gaggggagcccccatcctccag

SEQ ID NO: 109533 - DNA, 22 bp, Homo sapiens
actattagcatatcatgaatgg

SEQ ID NO: 109534 - DNA, 22 bp, Homo sapiens
tcaatactaatcttgctggaag

SEQ ID NO: 109535 - DNA, 22 bp, Homo sapiens
aggctctgtcaggcggagcagc

SEQ ID NO: 109536 - DNA, 22 bp, Homo sapiens
tttaatcaggcaaagcataata

SEQ ID NO: 109537 - DNA, 22 bp, Homo sapiens
agcttgacagacagatggtagc

SEQ ID NO: 109538 - DNA, 23 bp, Homo sapiens
gcgtccggcctctctcgctcccg

SEQ ID NO: 109539 - DNA, 22 bp, Homo sapiens
gcccgcagagatctttaacaaa

SEQ ID NO: 109540 - DNA, 18 bp, Homo sapiens
tttctcagactctctttc

SEQ ID NO: 109541 - DNA, 22 bp, Homo sapiens
cgcgctctccttctggcaccca

SEQ ID NO: 109542 - DNA, 22 bp, Homo sapiens
tgagagcctgtgttcaaatgcc

SEQ ID NO: 109543 - DNA, 22 bp, Homo sapiens
gggagctgagctggaagagaat

SEQ ID NO: 109544 - DNA, 22 bp, Homo sapiens
acaaagtgctgacattacaggc

SEQ ID NO: 109545 - DNA, 22 bp, Homo sapiens
cccaggaagtggaggttgcagt

SEQ ID NO: 109546 - DNA, 22 bp, Homo sapiens
ttgcactccagcccgagcaaca

SEQ ID NO: 109547 - DNA, 22 bp, Homo sapiens
cttccccaggacctctgctaaa

SEQ ID NO: 109548 - DNA, 22 bp, Homo sapiens
ctcactgcaagctctgcctcca

SEQ ID NO: 109549 - DNA, 22 bp, Homo sapiens
gagctcatccccatggtccgtc

SEQ ID NO: 109550 - DNA, 19 bp, Homo sapiens
cataatacagtggatctga

SEQ ID NO: 109551 - DNA, 22 bp, Homo sapiens
caccgcggagtgatggagaaac

SEQ ID NO: 109552 - DNA, 22 bp, Homo sapiens
tctcacagcctctggaggtagt

SEQ ID NO: 109553 - DNA, 22 bp, Homo sapiens
ctggaaggcggaggttgtagtg

SEQ ID NO: 109554 - DNA, 22 bp, Homo sapiens
ctgtaatcccagctacctggga

SEQ ID NO: 109555 - DNA, 20 bp, Homo sapiens
gggcagagccagccagtccc

SEQ ID NO: 109556 - DNA, 22 bp, Homo sapiens
cataatttctaccagggccata

SEQ ID NO: 109557 - DNA, 17 bp, Homo sapiens
gagcccctttccaagtt

SEQ ID NO: 109558 - DNA, 22 bp, Homo sapiens
tgtagctctccagccagcaagg

SEQ ID NO: 109559 - DNA, 22 bp, Homo sapiens
tcaggcaccttcctcttatctg

SEQ ID NO: 109560 - DNA, 20 bp, Homo sapiens
ctgggtggcaagcaaggggg

SEQ ID NO: 109561 - DNA, 22 bp, Homo sapiens
attgcacttcagcctgggtgac

SEQ ID NO: 109562 - DNA, 22 bp, Homo sapiens
gagtccctgctgtcaggtgctg

SEQ ID NO: 109563 - DNA, 22 bp, Homo sapiens
gagagtctagtgcacctagttt

SEQ ID NO: 109564 - DNA, 22 bp, Homo sapiens
aggagggtgggaagcagtttta

SEQ ID NO: 109565 - DNA, 22 bp, Homo sapiens
tgagggaatattgatagatccg

SEQ ID NO: 109566 - DNA, 22 bp, Homo sapiens
taaatgttgtaagtacatctaa

SEQ ID NO: 109567 - DNA, 22 bp, Homo sapiens
ggagttgattttggatatatta

SEQ ID NO: 109568 - DNA, 22 bp, Homo sapiens
tggggccatctcacccactgtt

SEQ ID NO: 109569 - DNA, 22 bp, Homo sapiens
ttattagagtgctttgagaaag

SEQ ID NO: 109570 - DNA, 22 bp, Homo sapiens
ggaggcccagaaggaagcccag

SEQ ID NO: 109571 - DNA, 21 bp, Homo sapiens
acagcctccatctcctgggct

SEQ ID NO: 109572 - DNA, 18 bp, Homo sapiens
gaggatggaaggagatgc

SEQ ID NO: 109573 - DNA, 22 bp, Homo sapiens
tgtgtctcaagtcagagcatca

SEQ ID NO: 109574 - DNA, 22 bp, Homo sapiens
ccaggagttggaagctgccatg

SEQ ID NO: 109575 - DNA, 22 bp, Homo sapiens
tggtgctgccaggctcctgcca

SEQ ID NO: 109576 - DNA, 22 bp, Homo sapiens
ggggaccctcaggactgcgtct

SEQ ID NO: 109577 - DNA, 22 bp, Homo sapiens
accaggcccgctgctatggtgg

SEQ ID NO: 109578 - DNA, 22 bp, Homo sapiens
aggtcacccgtttgactatcca

SEQ ID NO: 109579 - DNA, 22 bp, Homo sapiens
tgggggtgtcctggtgcacaca

SEQ ID NO: 109580 - DNA, 23 bp, Homo sapiens
ctggggctttcaaatctgggcag

SEQ ID NO: 109581 - DNA, 22 bp, Homo sapiens
ctgcagtctacctggattttta

SEQ ID NO: 109582 - DNA, 22 bp, Homo sapiens
ccaggctggagtgcaatggcgt

SEQ ID NO: 109583 - DNA, 19 bp, Homo sapiens
tcctggggaggggcatggc

SEQ ID NO: 109584 - DNA, 22 bp, Homo sapiens
tttaaaaaactagtctgagtct

SEQ ID NO: 109585 - DNA, 22 bp, Homo sapiens
tggccactgctctcaagctcag

SEQ ID NO: 109586 - DNA, 22 bp, Homo sapiens
tttctcggcagagatgatgggc

SEQ ID NO: 109587 - DNA, 22 bp, Homo sapiens
tgcctactagtactattttgtg

SEQ ID NO: 109588 - DNA, 22 bp, Homo sapiens
taaaatttgtccctgagtgttg

SEQ ID NO: 109589 - DNA, 22 bp, Homo sapiens
tgcagaaacaagccatcattca

SEQ ID NO: 109590 - DNA, 20 bp, Homo sapiens
atcggcttgcctggaaacaa

SEQ ID NO: 109591 - DNA, 23 bp, Homo sapiens
gcagaggagcaagctggacacca

SEQ ID NO: 109592 - DNA, 22 bp, Homo sapiens
tcagccccacggggtcagccaa

SEQ ID NO: 109593 - DNA, 22 bp, Homo sapiens
aagccaggttccatggaggagc

SEQ ID NO: 109594 - DNA, 22 bp, Homo sapiens
ctcactgcaatctccgtctccc

SEQ ID NO: 109595 - DNA, 21 bp, Homo sapiens
cagggccaatcctgacctcta

SEQ ID NO: 109596 - DNA, 22 bp, Homo sapiens
tgttatatctaaatagccacat

SEQ ID NO: 109597 - DNA, 22 bp, Homo sapiens
gtcacctgtgccacatactggg

SEQ ID NO: 109598 - DNA, 22 bp, Homo sapiens
ttgggacagctgtggtagtgag

SEQ ID NO: 109599 - DNA, 22 bp, Homo sapiens
ttcttttaattgtgggggagtg

SEQ ID NO: 109600 - DNA, 22 bp, Homo sapiens
gcgggccaccttggagagcgct

SEQ ID NO: 109601 - DNA, 22 bp, Homo sapiens
cctctgtgtgatgcgcaaagta

SEQ ID NO: 109602 - DNA, 22 bp, Homo sapiens
tgcacgtgggctctctgctctt

SEQ ID NO: 109603 - DNA, 22 bp, Homo sapiens
gagagtctaggaacctcatata

SEQ ID NO: 109604 - DNA, 22 bp, Homo sapiens
cagggccagggacacgctgtca

SEQ ID NO: 109605 - DNA, 22 bp, Homo sapiens
gggccggagctgggtcccgcgc

SEQ ID NO: 109606 - DNA, 19 bp, Homo sapiens
gttggcactgaaaatggct

SEQ ID NO: 109607 - DNA, 22 bp, Homo sapiens
agagggtgggcacgtgatggat

SEQ ID NO: 109608 - DNA, 22 bp, Homo sapiens
tttgtagattttctctccagta

SEQ ID NO: 109609 - DNA, 22 bp, Homo sapiens
tctgctacaaatacgctgggag

SEQ ID NO: 109610 - DNA, 22 bp, Homo sapiens
tctgctggaaaaccagggaatt

SEQ ID NO: 109611 - DNA, 22 bp, Homo sapiens
agaaatgggccttgggacacaa

SEQ ID NO: 109612 - DNA, 22 bp, Homo sapiens
cagccccacacggtctagctct

SEQ ID NO: 109613 - DNA, 22 bp, Homo sapiens
gacaggaggcagagctcaggtg

SEQ ID NO: 109614 - DNA, 22 bp, Homo sapiens
gcagcctgggcaacagagtgag

SEQ ID NO: 109615 - DNA, 22 bp, Homo sapiens
agagtggctctgctgggcacag

SEQ ID NO: 109616 - DNA, 22 bp, Homo sapiens
tgcttgaacccaggaagtggag

SEQ ID NO: 109617 - DNA, 22 bp, Homo sapiens
gcgggcgggggttcccaggtct

SEQ ID NO: 109618 - DNA, 22 bp, Homo sapiens
gtggatggccctgcacacaggt

SEQ ID NO: 109619 - DNA, 22 bp, Homo sapiens
ctcttcctagtgtgcagcgtgg

SEQ ID NO: 109620 - DNA, 22 bp, Homo sapiens
tggcacagactgggccaaggaa

SEQ ID NO: 109621 - DNA, 22 bp, Homo sapiens
cctgggccctcaccgccggtgg

SEQ ID NO: 109622 - DNA, 22 bp, Homo sapiens
gaggccaactttggagaacagg

SEQ ID NO: 109623 - DNA, 22 bp, Homo sapiens
ctgggaggcggaggttgtagtg

SEQ ID NO: 109624 - DNA, 22 bp, Homo sapiens
atgtacataaaatgtataatga

SEQ ID NO: 109625 - DNA, 22 bp, Homo sapiens
ggggctgaacctggaggtggtc

SEQ ID NO: 109626 - DNA, 22 bp, Homo sapiens
gtgcgcaccctcccggcatccc

SEQ ID NO: 109627 - DNA, 22 bp, Homo sapiens
ggcctctgccccgcggggctcg

SEQ ID NO: 109628 - DNA, 22 bp, Homo sapiens
agctcaagctacacacagagtc

SEQ ID NO: 109629 - DNA, 22 bp, Homo sapiens
agccaagcactcaactcctgga

SEQ ID NO: 109630 - DNA, 22 bp, Homo sapiens
tgtggctctcatgcactcccag

SEQ ID NO: 109631 - DNA, 22 bp, Homo sapiens
tcctgagataaatctcatgtga

SEQ ID NO: 109632 - DNA, 20 bp, Homo sapiens
tgagacccgctgacaagttc

SEQ ID NO: 109633 - DNA, 22 bp, Homo sapiens
tgatttcaagccagggggcgtt

SEQ ID NO: 109634 - DNA, 22 bp, Homo sapiens
aagtcacactagacaactgagg

SEQ ID NO: 109635 - DNA, 16 bp, Homo sapiens
ccacctgcagctctca

SEQ ID NO: 109636 - DNA, 22 bp, Homo sapiens
tcgaaggaggcactcagacatg

SEQ ID NO: 109637 - DNA, 22 bp, Homo sapiens
aggagctcagctaagttggaga

SEQ ID NO: 109638 - DNA, 22 bp, Homo sapiens
gctgaaggcccggaggacaggg

SEQ ID NO: 109639 - DNA, 22 bp, Homo sapiens
agtgtgttgtaggctcaaatgg

SEQ ID NO: 109640 - DNA, 22 bp, Homo sapiens
gatttctctgcacccactcagg

SEQ ID NO: 109641 - DNA, 22 bp, Homo sapiens
ctgtggctctcagaggctgctg

SEQ ID NO: 109642 - DNA, 22 bp, Homo sapiens
caggaggattgcttgaggccag

SEQ ID NO: 109643 - DNA, 22 bp, Homo sapiens
atgccactgcactccagcctag

SEQ ID NO: 109644 - DNA, 22 bp, Homo sapiens
tcagggctgcagaagaggcagg

SEQ ID NO: 109645 - DNA, 22 bp, Homo sapiens
ctatggtctggaccgaggtcct

SEQ ID NO: 109646 - DNA, 18 bp, Homo sapiens
atggtctcatactgggag

SEQ ID NO: 109647 - DNA, 22 bp, Homo sapiens
gctgcagctcgccttccggcct

SEQ ID NO: 109648 - DNA, 22 bp, Homo sapiens
cttatttgcccatgtttcttta

SEQ ID NO: 109649 - DNA, 22 bp, Homo sapiens
ggagctgaggacactacatttt

SEQ ID NO: 109650 - DNA, 22 bp, Homo sapiens
gtcccataagtagtgcaacttg

SEQ ID NO: 109651 - DNA, 20 bp, Homo sapiens
ggtggccgtagcgggcggcg

SEQ ID NO: 109652 - DNA, 22 bp, Homo sapiens
gcggcaggagtaaaggaggaag

SEQ ID NO: 109653 - DNA, 22 bp, Homo sapiens
taaaggtctgaacacagtgagg

SEQ ID NO: 109654 - DNA, 22 bp, Homo sapiens
ttatttttaaaagttcacacag

SEQ ID NO: 109655 - DNA, 20 bp, Homo sapiens
tcagccattccttacctttc

SEQ ID NO: 109656 - DNA, 22 bp, Homo sapiens
actgcacttcagcctgggtgac

SEQ ID NO: 109657 - DNA, 22 bp, Homo sapiens
ggcgccagcactgcagcgcctc

SEQ ID NO: 109658 - DNA, 22 bp, Homo sapiens
ctgagcatcatggcagaatctt

SEQ ID NO: 109659 - DNA, 22 bp, Homo sapiens
tgaaggtgggaattcaccaggt

SEQ ID NO: 109660 - DNA, 22 bp, Homo sapiens
tttctcatggaacatcgtttag

SEQ ID NO: 109661 - DNA, 22 bp, Homo sapiens
tgtgactgaggctccaagctag

SEQ ID NO: 109662 - DNA, 22 bp, Homo sapiens
ggaggcagaatagagtgtgggt

SEQ ID NO: 109663 - DNA, 22 bp, Homo sapiens
tgtggtgccgagagtctggacg

SEQ ID NO: 109664 - DNA, 22 bp, Homo sapiens
ctgggaagaagggacaacagcg

SEQ ID NO: 109665 - DNA, 22 bp, Homo sapiens
gtgggctgcccttgaggtcagc

SEQ ID NO: 109666 - DNA, 23 bp, Homo sapiens
ttgcagaagcagacgaccataat

SEQ ID NO: 109667 - DNA, 22 bp, Homo sapiens
acagagcaataacagggagagg

SEQ ID NO: 109668 - DNA, 22 bp, Homo sapiens
acccaggctggagtgcagtggg

SEQ ID NO: 109669 - DNA, 22 bp, Homo sapiens
taattgtaaagtagtagtacag

SEQ ID NO: 109670 - DNA, 22 bp, Homo sapiens
cagcaggaggtgagtagcaggt

SEQ ID NO: 109671 - DNA, 22 bp, Homo sapiens
ggaggaggggtgactgaatgct

SEQ ID NO: 109672 - DNA, 22 bp, Homo sapiens
aggctcgcatgccctgcaccac

SEQ ID NO: 109673 - DNA, 22 bp, Homo sapiens
ggggtctgggcttagctggaat

SEQ ID NO: 109674 - DNA, 18 bp, Homo sapiens
cttttcccctttggactc

SEQ ID NO: 109675 - DNA, 22 bp, Homo sapiens
gaagatacaaatttcttagatg

SEQ ID NO: 109676 - DNA, 22 bp, Homo sapiens
ttttctgtttgcttcaagacat

SEQ ID NO: 109677 - DNA, 22 bp, Homo sapiens
ctgggcgcgtcccctgaggcgg

SEQ ID NO: 109678 - DNA, 22 bp, Homo sapiens
cgcaccactgaattccagcctg

SEQ ID NO: 109679 - DNA, 22 bp, Homo sapiens
cctggagagctcgggccaggca

SEQ ID NO: 109680 - DNA, 22 bp, Homo sapiens
agcctagggttctgatgtcact

SEQ ID NO: 109681 - DNA, 22 bp, Homo sapiens
tagatgatgtgactctcttgca

SEQ ID NO: 109682 - DNA, 22 bp, Homo sapiens
gcgagtccactggggggcgcag

SEQ ID NO: 109683 - DNA, 22 bp, Homo sapiens
ttatgggagcaattggggaggt

SEQ ID NO: 109684 - DNA, 22 bp, Homo sapiens
tgcactccaggctgggtgacag

SEQ ID NO: 109685 - DNA, 22 bp, Homo sapiens
cttagagatgggttttacttag

SEQ ID NO: 109686 - DNA, 22 bp, Homo sapiens
tccattatacttctgattcaaa

SEQ ID NO: 109687 - DNA, 22 bp, Homo sapiens
ccaggaggcggaaggtacagtg

SEQ ID NO: 109688 - DNA, 21 bp, Homo sapiens
ggccccgcagacccagcacgt

SEQ ID NO: 109689 - DNA, 22 bp, Homo sapiens
agagggaagatggtccaatctt

SEQ ID NO: 109690 - DNA, 22 bp, Homo sapiens
cttggggcagcccaggctgagc

SEQ ID NO: 109691 - DNA, 22 bp, Homo sapiens
tgggtgctctgcgaccgtaggg

SEQ ID NO: 109692 - DNA, 18 bp, Homo sapiens
tcctttctccctcatctt

SEQ ID NO: 109693 - DNA, 22 bp, Homo sapiens
gcagaccctgaactgggcatgg

SEQ ID NO: 109694 - DNA, 22 bp, Homo sapiens
gcgagcctctggagtcctctgg

SEQ ID NO: 109695 - DNA, 22 bp, Homo sapiens
aagtcattggtagcttgatagg

SEQ ID NO: 109696 - DNA, 22 bp, Homo sapiens
ctggctgggagcgagctgctca

SEQ ID NO: 109697 - DNA, 22 bp, Homo sapiens
agggctggagccacagctggga

SEQ ID NO: 109698 - DNA, 22 bp, Homo sapiens
aacccacaaaggatttcagctc

SEQ ID NO: 109699 - DNA, 22 bp, Homo sapiens
tggaggccagaggtactgggac

SEQ ID NO: 109700 - DNA, 22 bp, Homo sapiens
tcaccagatctctctgtaatgg

SEQ ID NO: 109701 - DNA, 22 bp, Homo sapiens
ggccactgctctccagcctggg

SEQ ID NO: 109702 - DNA, 22 bp, Homo sapiens
ttaaatattatgttgtctgcaa

SEQ ID NO: 109703 - DNA, 22 bp, Homo sapiens
acctggccagtggggccgcgct

SEQ ID NO: 109704 - DNA, 22 bp, Homo sapiens
tgagatgaataactcctgctaa

SEQ ID NO: 109705 - DNA, 22 bp, Homo sapiens
ccaccgccatggcgttgtacag

SEQ ID NO: 109706 - DNA, 22 bp, Homo sapiens
atcatccaagcgtagttcttct

SEQ ID NO: 109707 - DNA, 22 bp, Homo sapiens
caggtgttggaagggcagtggg

SEQ ID NO: 109708 - DNA, 22 bp, Homo sapiens
aagacccacaaggctgaatgtt

SEQ ID NO: 109709 - DNA, 22 bp, Homo sapiens
cagagctgtccaaaccctgaca

SEQ ID NO: 109710 - DNA, 22 bp, Homo sapiens
ctggccagatgttacgtccaat

SEQ ID NO: 109711 - DNA, 22 bp, Homo sapiens
actctgtcttcatatttgcatt

SEQ ID NO: 109712 - DNA, 22 bp, Homo sapiens
tgtgctggagatcagcttattt

SEQ ID NO: 109713 - DNA, 22 bp, Homo sapiens
tagtggatgttcagagatttga

SEQ ID NO: 109714 - DNA, 22 bp, Homo sapiens
cgctccttgagcgtgtcggcct

SEQ ID NO: 109715 - DNA, 22 bp, Homo sapiens
aggatgagccgcgcaagctgac

SEQ ID NO: 109716 - DNA, 22 bp, Homo sapiens
atagtatttaatagttagctca

SEQ ID NO: 109717 - DNA, 22 bp, Homo sapiens
tgagcaggcgcagcaggaggtc

SEQ ID NO: 109718 - DNA, 22 bp, Homo sapiens
aagtgatgctacgactttgaca

SEQ ID NO: 109719 - DNA, 22 bp, Homo sapiens
gctatgggatgtgctgtggatg

SEQ ID NO: 109720 - DNA, 22 bp, Homo sapiens
ctggcaggtggaggttgcagtg

SEQ ID NO: 109721 - DNA, 22 bp, Homo sapiens
tgcagcactgttcacaatagcc

SEQ ID NO: 109722 - DNA, 22 bp, Homo sapiens
tctgacattttgagaatgacat

SEQ ID NO: 109723 - DNA, 22 bp, Homo sapiens
tggtgccatcatagctcactgc

SEQ ID NO: 109724 - DNA, 22 bp, Homo sapiens
gggccctgcgactcgcggcgga

SEQ ID NO: 109725 - DNA, 22 bp, Homo sapiens
agacagggtgatcgcttgagcc

SEQ ID NO: 109726 - DNA, 22 bp, Homo sapiens
ctggagtagccggacgggtctg

SEQ ID NO: 109727 - DNA, 22 bp, Homo sapiens
ggccactgacctacatctgggg

SEQ ID NO: 109728 - DNA, 22 bp, Homo sapiens
ggagagggtaggggtcctgccc

SEQ ID NO: 109729 - DNA, 22 bp, Homo sapiens
tataaagagtctcaaagaagtt

SEQ ID NO: 109730 - DNA, 22 bp, Homo sapiens
agtggcaggatctcggttcact

SEQ ID NO: 109731 - DNA, 22 bp, Homo sapiens
attgtaacagacacatcagatt

SEQ ID NO: 109732 - DNA, 22 bp, Homo sapiens
cgaggaggaaacgcggagaact

SEQ ID NO: 109733 - DNA, 23 bp, Homo sapiens
ttaaacactagttcgagtagcat

SEQ ID NO: 109734 - DNA, 22 bp, Homo sapiens
ggctgagttgagaggattactt

SEQ ID NO: 109735 - DNA, 22 bp, Homo sapiens
ctgggaggcggagcttgcagtg

SEQ ID NO: 109736 - DNA, 22 bp, Homo sapiens
gctctctgcagcctccttggag

SEQ ID NO: 109737 - DNA, 22 bp, Homo sapiens
caggtgagaggcggtcctgcat

SEQ ID NO: 109738 - DNA, 22 bp, Homo sapiens
gccactgtggtcctcccatgat

SEQ ID NO: 109739 - DNA, 21 bp, Homo sapiens
tcagtggctcctggtgacgtc

SEQ ID NO: 109740 - DNA, 23 bp, Homo sapiens
tgtgggcgcattgtaagggtagc

SEQ ID NO: 109741 - DNA, 22 bp, Homo sapiens
actgttttctgtaaagggccag

SEQ ID NO: 109742 - DNA, 22 bp, Homo sapiens
agccagtgcagctggaaattca

SEQ ID NO: 109743 - DNA, 22 bp, Homo sapiens
tctgttgcaatgtgcatggtga

SEQ ID NO: 109744 - DNA, 22 bp, Homo sapiens
gatgggcgtggcgcgtttggtg

SEQ ID NO: 109745 - DNA, 22 bp, Homo sapiens
tcagggattgcaaaattcatcc

SEQ ID NO: 109746 - DNA, 22 bp, Homo sapiens
gggccctgggattcagagcaag

SEQ ID NO: 109747 - DNA, 17 bp, Homo sapiens
ggctgcagtccaggagg

SEQ ID NO: 109748 - DNA, 22 bp, Homo sapiens
ggcctctcttgggacagctgtc

SEQ ID NO: 109749 - DNA, 22 bp, Homo sapiens
ctggcaggttatagagctgccc

SEQ ID NO: 109750 - DNA, 22 bp, Homo sapiens
agggttgcaccatgttggtcag

SEQ ID NO: 109751 - DNA, 22 bp, Homo sapiens
acaattctgatggtttcccagt

SEQ ID NO: 109752 - DNA, 22 bp, Homo sapiens
gtggcagagccaaggctggagc

SEQ ID NO: 109753 - DNA, 22 bp, Homo sapiens
cggctggtgtcgggcacagcaa

SEQ ID NO: 109754 - DNA, 22 bp, Homo sapiens
gtggggcctgtggcttccgtgg

SEQ ID NO: 109755 - DNA, 22 bp, Homo sapiens
gctgtgtccaggtgggggtgac

SEQ ID NO: 109756 - DNA, 22 bp, Homo sapiens
tgggaaggggagctggaaagga

SEQ ID NO: 109757 - DNA, 22 bp, Homo sapiens
agtccagaaagtgaacagtgtt

SEQ ID NO: 109758 - DNA, 22 bp, Homo sapiens
ctgcgggctgtcaggcgtgcca

SEQ ID NO: 109759 - DNA, 22 bp, Homo sapiens
cggggcgagcagacggcggcaa

SEQ ID NO: 109760 - DNA, 22 bp, Homo sapiens
aagaggttgtctgtgatgagtt

SEQ ID NO: 109761 - DNA, 22 bp, Homo sapiens
accactgcccatggtgaaaact

SEQ ID NO: 109762 - DNA, 22 bp, Homo sapiens
tttagcgtagctgacagctaat

SEQ ID NO: 109763 - DNA, 22 bp, Homo sapiens
tcccaccttccgtggaacccgt

SEQ ID NO: 109764 - DNA, 19 bp, Homo sapiens
catggtgaaaccccgtctc

SEQ ID NO: 109765 - DNA, 22 bp, Homo sapiens
ctgctcagtaatagtcctatct

SEQ ID NO: 109766 - DNA, 22 bp, Homo sapiens
agttggagtgaacatgagattg

SEQ ID NO: 109767 - DNA, 22 bp, Homo sapiens
cactgcactccatcctgggaaa

SEQ ID NO: 109768 - DNA, 22 bp, Homo sapiens
caaatgaatatttccatgggtt

SEQ ID NO: 109769 - DNA, 22 bp, Homo sapiens
ggcaaggggtcaggctgagaca

SEQ ID NO: 109770 - DNA, 22 bp, Homo sapiens
gctcttgtcaaaaattagttga

SEQ ID NO: 109771 - DNA, 19 bp, Homo sapiens
gagtattttccaacttggt

SEQ ID NO: 109772 - DNA, 22 bp, Homo sapiens
caggcaggtcagtgaagaagga

SEQ ID NO: 109773 - DNA, 22 bp, Homo sapiens
cgctgataaacgtcacgttccc

SEQ ID NO: 109774 - DNA, 22 bp, Homo sapiens
gcccaggctggagtgcagtggc

SEQ ID NO: 109775 - DNA, 22 bp, Homo sapiens
cccccagctctgctgggtcccg

SEQ ID NO: 109776 - DNA, 22 bp, Homo sapiens
ttgtgaatggtgccgcaataaa

SEQ ID NO: 109777 - DNA, 22 bp, Homo sapiens
tgcaatctcggcactttgggag

SEQ ID NO: 109778 - DNA, 22 bp, Homo sapiens
atcagagtagttgttgcccaga

SEQ ID NO: 109779 - DNA, 22 bp, Homo sapiens
ggccctggcagccacgaaagcc

SEQ ID NO: 109780 - DNA, 22 bp, Homo sapiens
ttgtgaatagtgccgctataaa

SEQ ID NO: 109781 - DNA, 22 bp, Homo sapiens
tcttaagcagagaagaagttga

SEQ ID NO: 109782 - DNA, 22 bp, Homo sapiens
ccaggaggcagaagttgcagtg

SEQ ID NO: 109783 - DNA, 22 bp, Homo sapiens
aacccagggtggaggttgcagt

SEQ ID NO: 109784 - DNA, 22 bp, Homo sapiens
cagcctttgggtcagaagattc

SEQ ID NO: 109785 - DNA, 22 bp, Homo sapiens
ggtgccagatgaggcccgcgat

SEQ ID NO: 109786 - DNA, 22 bp, Homo sapiens
gcaccgccttggaccgcccgct

SEQ ID NO: 109787 - DNA, 22 bp, Homo sapiens
ccagtgtatttttgggacctgc

SEQ ID NO: 109788 - DNA, 22 bp, Homo sapiens
atacaaagtattaatcctggat

SEQ ID NO: 109789 - DNA, 22 bp, Homo sapiens
ctggcctaaaaatacagaacaa

SEQ ID NO: 109790 - DNA, 20 bp, Homo sapiens
gctgaggtggaggaaggaga

SEQ ID NO: 109791 - DNA, 22 bp, Homo sapiens
agggggctccttggtgtgcaga

SEQ ID NO: 109792 - DNA, 22 bp, Homo sapiens
tgaggcaggagttcaggctgcg

SEQ ID NO: 109793 - DNA, 19 bp, Homo sapiens
ctgtccttggctgcactgt

SEQ ID NO: 109794 - DNA, 20 bp, Homo sapiens
ttcatgggagcaaagaggcc

SEQ ID NO: 109795 - DNA, 22 bp, Homo sapiens
tactttaatatatgtgaagttc

SEQ ID NO: 109796 - DNA, 22 bp, Homo sapiens
cccagctcttcaagtcaccccc

SEQ ID NO: 109797 - DNA, 22 bp, Homo sapiens
caaggtgccatgctgggcgggg

SEQ ID NO: 109798 - DNA, 22 bp, Homo sapiens
aggagctgtcagagtgccagag

SEQ ID NO: 109799 - DNA, 22 bp, Homo sapiens
ccctctgcatacaggcgaggag

SEQ ID NO: 109800 - DNA, 22 bp, Homo sapiens
gggaggcagtgctggaggctgg

SEQ ID NO: 109801 - DNA, 22 bp, Homo sapiens
tgcctgatgcaggagtatcaga

SEQ ID NO: 109802 - DNA, 22 bp, Homo sapiens
tgtacacatggtgtacactccc

SEQ ID NO: 109803 - DNA, 22 bp, Homo sapiens
taatggtgtttttctgtaattt

SEQ ID NO: 109804 - DNA, 22 bp, Homo sapiens
agtgagagtattaatgtgaact

SEQ ID NO: 109805 - DNA, 22 bp, Homo sapiens
gacaagctcccggtggccctcc

SEQ ID NO: 109806 - DNA, 22 bp, Homo sapiens
actgcactccagcctgggtaac

SEQ ID NO: 109807 - DNA, 22 bp, Homo sapiens
actgcactccaacctgggtgac

SEQ ID NO: 109808 - DNA, 22 bp, Homo sapiens
tcaggaggtccgcccgggaggg

SEQ ID NO: 109809 - DNA, 22 bp, Homo sapiens
ggttgctgggggtggcagagct

SEQ ID NO: 109810 - DNA, 22 bp, Homo sapiens
tgcctagttctgtatttacagt

SEQ ID NO: 109811 - DNA, 22 bp, Homo sapiens
aaggatacttttagagcctgag

SEQ ID NO: 109812 - DNA, 19 bp, Homo sapiens
tcctgcccaccagccaggg

SEQ ID NO: 109813 - DNA, 22 bp, Homo sapiens
ggctgcaggttggttggcagct

SEQ ID NO: 109814 - DNA, 22 bp, Homo sapiens
tgtagatattaattattccttt

SEQ ID NO: 109815 - DNA, 22 bp, Homo sapiens
gagctcattcattcattgcctg

SEQ ID NO: 109816 - DNA, 21 bp, Homo sapiens
tggtaggtactggcttcaggc

SEQ ID NO: 109817 - DNA, 22 bp, Homo sapiens
tgacatttcctagtgctttgtg

SEQ ID NO: 109818 - DNA, 16 bp, Homo sapiens
ggcaggcgcggagccc

SEQ ID NO: 109819 - DNA, 22 bp, Homo sapiens
tgcctgtgtcagcaggtggaag

SEQ ID NO: 109820 - DNA, 22 bp, Homo sapiens
tgttatctgagcaacgtcgacg

SEQ ID NO: 109821 - DNA, 22 bp, Homo sapiens
gttgctcaggcaggagtacagt

SEQ ID NO: 109822 - DNA, 18 bp, Homo sapiens
ggaaggtgattcagtttt

SEQ ID NO: 109823 - DNA, 22 bp, Homo sapiens
cctggaagttggaggttgcagt

SEQ ID NO: 109824 - DNA, 22 bp, Homo sapiens
gctgacccctacaggttgtgtt

SEQ ID NO: 109825 - DNA, 22 bp, Homo sapiens
aaatatcttaggagtatatgag

SEQ ID NO: 109826 - DNA, 22 bp, Homo sapiens
tttccctttagcctgagaatcc

SEQ ID NO: 109827 - DNA, 22 bp, Homo sapiens
cggagcgctgggggactctgca

SEQ ID NO: 109828 - DNA, 22 bp, Homo sapiens
ccaggctggagtgcaatggcat

SEQ ID NO: 109829 - DNA, 22 bp, Homo sapiens
gcctgtgtggatgcgccggtgc

SEQ ID NO: 109830 - DNA, 22 bp, Homo sapiens
cccagggaggcccaggctctgc

SEQ ID NO: 109831 - DNA, 22 bp, Homo sapiens
aacctgggcttgaacagtgcct

SEQ ID NO: 109832 - DNA, 22 bp, Homo sapiens
ctggcttttttcccattatgca

SEQ ID NO: 109833 - DNA, 22 bp, Homo sapiens
tgggctgcaggggttgagagct

SEQ ID NO: 109834 - DNA, 22 bp, Homo sapiens
gatgcgggcccgctccactgcc

SEQ ID NO: 109835 - DNA, 22 bp, Homo sapiens
ttccacaatggttaagctcgtt

SEQ ID NO: 109836 - DNA, 22 bp, Homo sapiens
tgtaggacatgtacttgtaaca

SEQ ID NO: 109837 - DNA, 22 bp, Homo sapiens
cagaatcaagtccaattagcac

SEQ ID NO: 109838 - DNA, 22 bp, Homo sapiens
tctgccacttgaggtcattggc

SEQ ID NO: 109839 - DNA, 22 bp, Homo sapiens
cactgcactccagcctgggtca

SEQ ID NO: 109840 - DNA, 22 bp, Homo sapiens
agtgaccgaggcacttggcaac

SEQ ID NO: 109841 - DNA, 22 bp, Homo sapiens
aaacccagggttttgtcttccc

SEQ ID NO: 109842 - DNA, 22 bp, Homo sapiens
acccgatgttggtgctctagta

SEQ ID NO: 109843 - DNA, 22 bp, Homo sapiens
aggggctcctttgtgctgcgtc

SEQ ID NO: 109844 - DNA, 22 bp, Homo sapiens
gcaactgaacatgtgtgtggcc

SEQ ID NO: 109845 - DNA, 22 bp, Homo sapiens
tctgtagtaggttgtagttctt

SEQ ID NO: 109846 - DNA, 22 bp, Homo sapiens
tggaaacacccacgcatgcata

SEQ ID NO: 109847 - DNA, 23 bp, Homo sapiens
ccaagactgttaggagtggggag

SEQ ID NO: 109848 - DNA, 22 bp, Homo sapiens
attggccatttgcatgtattat

SEQ ID NO: 109849 - DNA, 22 bp, Homo sapiens
ttgagcatctgaggattttcct

SEQ ID NO: 109850 - DNA, 22 bp, Homo sapiens
tcaccggtgaccctcggctcgc

SEQ ID NO: 109851 - DNA, 22 bp, Homo sapiens
gaggaggcttccgggaggcacg

SEQ ID NO: 109852 - DNA, 22 bp, Homo sapiens
gtttctctgtctgttacattgg

SEQ ID NO: 109853 - DNA, 22 bp, Homo sapiens
aggtggagaagagatgggcagt

SEQ ID NO: 109854 - DNA, 22 bp, Homo sapiens
cttagatgaagtcacagaaccc

SEQ ID NO: 109855 - DNA, 22 bp, Homo sapiens
agccacacagcttaatgacaga

SEQ ID NO: 109856 - DNA, 22 bp, Homo sapiens
gctgggctgcgtcggggaagcc

SEQ ID NO: 109857 - DNA, 18 bp, Homo sapiens
tctggaacaacttcatgt

SEQ ID NO: 109858 - DNA, 22 bp, Homo sapiens
tacagtgcttggtatctagtaa

SEQ ID NO: 109859 - DNA, 22 bp, Homo sapiens
catcactgtccaaagttcagtt

SEQ ID NO: 109860 - DNA, 22 bp, Homo sapiens
gaagcctcaacatctctgcgtc

SEQ ID NO: 109861 - DNA, 22 bp, Homo sapiens
tgagcctgggagatggaggctg

SEQ ID NO: 109862 - DNA, 15 bp, Homo sapiens
tggcccacccgttga

SEQ ID NO: 109863 - DNA, 22 bp, Homo sapiens
tagctgggactactggccctgc

SEQ ID NO: 109864 - DNA, 22 bp, Homo sapiens
tgcccagggtggagtgcagtgg

SEQ ID NO: 109865 - DNA, 22 bp, Homo sapiens
cccgggaggcggaggttgcagt

SEQ ID NO: 109866 - DNA, 22 bp, Homo sapiens
actgcaacacctcctgggttca

SEQ ID NO: 109867 - DNA, 22 bp, Homo sapiens
cagggtttcaccatgttagcag

SEQ ID NO: 109868 - DNA, 22 bp, Homo sapiens
acatttttcacatttgtagggt

SEQ ID NO: 109869 - DNA, 22 bp, Homo sapiens
cccaggagttggaggctgcagt

SEQ ID NO: 109870 - DNA, 22 bp, Homo sapiens
gagccaggaggcagagactgca

SEQ ID NO: 109871 - DNA, 22 bp, Homo sapiens
caggctggagtgcagtggcgcc

SEQ ID NO: 109872 - DNA, 22 bp, Homo sapiens
ctctggaccctcctgctgagag

SEQ ID NO: 109873 - DNA, 22 bp, Homo sapiens
gccgggaccaaggccacggagc

SEQ ID NO: 109874 - DNA, 22 bp, Homo sapiens
gggctgactcctattggatgaa

SEQ ID NO: 109875 - DNA, 22 bp, Homo sapiens
gtagggttggagagcacaacca

SEQ ID NO: 109876 - DNA, 22 bp, Homo sapiens
caggctggagtgcagtggtgcc

SEQ ID NO: 109877 - DNA, 22 bp, Homo sapiens
cacggccactgcagcaccccag

SEQ ID NO: 109878 - DNA, 22 bp, Homo sapiens
tttcataatactgtacatgaaa

SEQ ID NO: 109879 - DNA, 22 bp, Homo sapiens
aggccgaggcgggcggatcacc

SEQ ID NO: 109880 - DNA, 21 bp, Homo sapiens
gaacccagcagcagtgctctg

SEQ ID NO: 109881 - DNA, 22 bp, Homo sapiens
ggagagtggattccagctgtat

SEQ ID NO: 109882 - DNA, 22 bp, Homo sapiens
aaaaaattatcatagttcctga

SEQ ID NO: 109883 - DNA, 22 bp, Homo sapiens
agggtctatataggtcaggacc

SEQ ID NO: 109884 - DNA, 22 bp, Homo sapiens
tgggaggccgaggcaggtggat

SEQ ID NO: 109885 - DNA, 22 bp, Homo sapiens
cgagagatgggttggcaggggc

SEQ ID NO: 109886 - DNA, 20 bp, Homo sapiens
gccactgggcaccagcaggg

SEQ ID NO: 109887 - DNA, 22 bp, Homo sapiens
ttatgatttgccacagattggt

SEQ ID NO: 109888 - DNA, 22 bp, Homo sapiens
gtggtgagattgctggatcaaa

SEQ ID NO: 109889 - DNA, 22 bp, Homo sapiens
gggcggggggagctggaatgaa

SEQ ID NO: 109890 - DNA, 22 bp, Homo sapiens
gggctgcatcagcaggacccgg

SEQ ID NO: 109891 - DNA, 23 bp, Homo sapiens
tgcaatggcatgatttcagctca

SEQ ID NO: 109892 - DNA, 22 bp, Homo sapiens
tgtgaatggacaattaaatcta

SEQ ID NO: 109893 - DNA, 22 bp, Homo sapiens
tgcctgttgcccacctgataaa

SEQ ID NO: 109894 - DNA, 22 bp, Homo sapiens
atgaaaacggaccagagctatt

SEQ ID NO: 109895 - DNA, 22 bp, Homo sapiens
ggagaagaggagctggaagcct

SEQ ID NO: 109896 - DNA, 22 bp, Homo sapiens
ctctggcaattgctgctgactc

SEQ ID NO: 109897 - DNA, 22 bp, Homo sapiens
acgtggcggccgccgtgagcgg

SEQ ID NO: 109898 - DNA, 22 bp, Homo sapiens
ggtcgggcactctccagggctg

SEQ ID NO: 109899 - DNA, 22 bp, Homo sapiens
aagttgttgttgaggtgggtaa

SEQ ID NO: 109900 - DNA, 22 bp, Homo sapiens
agatggtagactatggaacgta

SEQ ID NO: 109901 - DNA, 22 bp, Homo sapiens
atttagaactttgtttgccaat

SEQ ID NO: 109902 - DNA, 22 bp, Homo sapiens
tgccgcagtgcggggagggccc

SEQ ID NO: 109903 - DNA, 22 bp, Homo sapiens
cacccaggctggagtgcagtgg

SEQ ID NO: 109904 - DNA, 22 bp, Homo sapiens
aggtattattagcatctctatt

SEQ ID NO: 109905 - DNA, 22 bp, Homo sapiens
ttagatttacaagcactgttta

SEQ ID NO: 109906 - DNA, 22 bp, Homo sapiens
tgcttgtgacagaactgtgtcc

SEQ ID NO: 109907 - DNA, 22 bp, Homo sapiens
gattccacagcttcgaggtctt

SEQ ID NO: 109908 - DNA, 22 bp, Homo sapiens
tgcgggagggcaacgcggcatt

SEQ ID NO: 109909 - DNA, 22 bp, Homo sapiens
tagatagattctcctatagagt

SEQ ID NO: 109910 - DNA, 22 bp, Homo sapiens
agtgcaggccccaggccaggcc

SEQ ID NO: 109911 - DNA, 22 bp, Homo sapiens
ctgagctcacgccattctcctt

SEQ ID NO: 109912 - DNA, 22 bp, Homo sapiens
gagccccaccctagacattctg

SEQ ID NO: 109913 - DNA, 22 bp, Homo sapiens
tccggcggccggcctgagcccg

SEQ ID NO: 109914 - DNA, 22 bp, Homo sapiens
cattccttaacgtggggagtct

SEQ ID NO: 109915 - DNA, 22 bp, Homo sapiens
actgcactccagcctgggtgat

SEQ ID NO: 109916 - DNA, 22 bp, Homo sapiens
tgagactcagcacttgtgtgtc

SEQ ID NO: 109917 - DNA, 22 bp, Homo sapiens
agagcccctgggtcacacagcc

SEQ ID NO: 109918 - DNA, 22 bp, Homo sapiens
tccacgtgagcttcgtgtgcag

SEQ ID NO: 109919 - DNA, 22 bp, Homo sapiens
ggagaggggaacttgttgcttg

SEQ ID NO: 109920 - DNA, 22 bp, Homo sapiens
caaatgtataaatgtactttct

SEQ ID NO: 109921 - DNA, 22 bp, Homo sapiens
gggctctcccacaacgtgccag

SEQ ID NO: 109922 - DNA, 22 bp, Homo sapiens
tgaacatgctgttgatggcctg

SEQ ID NO: 109923 - DNA, 22 bp, Homo sapiens
ctcattgcagctgcattactgt

SEQ ID NO: 109924 - DNA, 23 bp, Homo sapiens
cgcccagcctcagtgacctgggc

SEQ ID NO: 109925 - DNA, 22 bp, Homo sapiens
ccgtggggggccgtcgtccctg

SEQ ID NO: 109926 - DNA, 22 bp, Homo sapiens
agcccgcatctcgctaaagata

SEQ ID NO: 109927 - DNA, 22 bp, Homo sapiens
tcaacagtggcaaagaggcacg

SEQ ID NO: 109928 - DNA, 22 bp, Homo sapiens
cccagttgttgccggctctgga

SEQ ID NO: 109929 - DNA, 16 bp, Homo sapiens
aggctcagaggctgga

SEQ ID NO: 109930 - DNA, 22 bp, Homo sapiens
cactgcaagctctgccacctgg

SEQ ID NO: 109931 - DNA, 22 bp, Homo sapiens
actgcactccagcctcggggtc

SEQ ID NO: 109932 - DNA, 22 bp, Homo sapiens
ccctggaggttgaggctgcagt

SEQ ID NO: 109933 - DNA, 22 bp, Homo sapiens
tgaccaatactgtggatgccag

SEQ ID NO: 109934 - DNA, 16 bp, Homo sapiens
tgggtgggaggagcgg

SEQ ID NO: 109935 - DNA, 22 bp, Homo sapiens
gggaggcacgaggcgcgcagtg

SEQ ID NO: 109936 - DNA, 22 bp, Homo sapiens
taaatgttttgtgggttgagtt

SEQ ID NO: 109937 - DNA, 22 bp, Homo sapiens
tcctgggatcaagtgatcctcc

SEQ ID NO: 109938 - DNA, 22 bp, Homo sapiens
tagaaaagccccagctggaggg

SEQ ID NO: 109939 - DNA, 22 bp, Homo sapiens
ttatttaatgtgatctgaagag

SEQ ID NO: 109940 - DNA, 22 bp, Homo sapiens
cgggagcctctgggtcacactg

SEQ ID NO: 109941 - DNA, 22 bp, Homo sapiens
agagggcgcccaggcccacgcc

SEQ ID NO: 109942 - DNA, 22 bp, Homo sapiens
gtgccactgcactctagcctag

SEQ ID NO: 109943 - DNA, 22 bp, Homo sapiens
tcccacaggtggagcttgcagt

SEQ ID NO: 109944 - DNA, 22 bp, Homo sapiens
gtggatggagctggaagccatt

SEQ ID NO: 109945 - DNA, 22 bp, Homo sapiens
tggccggggctgatggacagtg

SEQ ID NO: 109946 - DNA, 22 bp, Homo sapiens
acgcccagactcccatactttg

SEQ ID NO: 109947 - DNA, 22 bp, Homo sapiens
gagtggggggtccgtctcagtg

SEQ ID NO: 109948 - DNA, 22 bp, Homo sapiens
cccacacacatttatgatagga

SEQ ID NO: 109949 - DNA, 22 bp, Homo sapiens
atacaaaaattagccgggagta

SEQ ID NO: 109950 - DNA, 22 bp, Homo sapiens
tctttctacatcatttgcttct

SEQ ID NO: 109951 - DNA, 22 bp, Homo sapiens
gacctggttgactgtgagcagg

SEQ ID NO: 109952 - DNA, 22 bp, Homo sapiens
ctccggccgcggtgcccagcgc

SEQ ID NO: 109953 - DNA, 21 bp, Homo sapiens
acatggactgtgaatggggac

SEQ ID NO: 109954 - DNA, 22 bp, Homo sapiens
gccctagcgccagctcagcacc

SEQ ID NO: 109955 - DNA, 22 bp, Homo sapiens
agacaaagaaaccgtagaagca

SEQ ID NO: 109956 - DNA, 22 bp, Homo sapiens
ggcctcacccatcggtgccttt

SEQ ID NO: 109957 - DNA, 22 bp, Homo sapiens
tagcatgtcagtcgccacacgt

SEQ ID NO: 109958 - DNA, 22 bp, Homo sapiens
agtactgtcagcagggtgttga

SEQ ID NO: 109959 - DNA, 22 bp, Homo sapiens
gtgaggtggtacaatattaact

SEQ ID NO: 109960 - DNA, 22 bp, Homo sapiens
cacgcacgctgggtggaggcgc

SEQ ID NO: 109961 - DNA, 22 bp, Homo sapiens
cctgcgggctgtgctgaagcct

SEQ ID NO: 109962 - DNA, 22 bp, Homo sapiens
ctcagactagcctgtaccgaca

SEQ ID NO: 109963 - DNA, 22 bp, Homo sapiens
attcttcctcatcaatctgtag

SEQ ID NO: 109964 - DNA, 23 bp, Homo sapiens
ggggcctgcaccggtctgcgcgg

SEQ ID NO: 109965 - DNA, 22 bp, Homo sapiens
tgtgtgagtaaggctgagagag

SEQ ID NO: 109966 - DNA, 22 bp, Homo sapiens
cggtctcccgtgtgtgtgcgct

SEQ ID NO: 109967 - DNA, 22 bp, Homo sapiens
gctccctggtagccatgctctc

SEQ ID NO: 109968 - DNA, 22 bp, Homo sapiens
acatgattgtctggcttggcca

SEQ ID NO: 109969 - DNA, 21 bp, Homo sapiens
tctgatggtagatgagatgtg

SEQ ID NO: 109970 - DNA, 22 bp, Homo sapiens
ggccagcctggggctcccagac

SEQ ID NO: 109971 - DNA, 22 bp, Homo sapiens
cacaaaccttctgcagcctgta

SEQ ID NO: 109972 - DNA, 18 bp, Homo sapiens
tcaaatactttgggcagt

SEQ ID NO: 109973 - DNA, 22 bp, Homo sapiens
cgggcagtgtggctccagagtc

SEQ ID NO: 109974 - DNA, 22 bp, Homo sapiens
gcaggaggttgagccaggactg

SEQ ID NO: 109975 - DNA, 22 bp, Homo sapiens
gttatataagacaaatcagagt

SEQ ID NO: 109976 - DNA, 22 bp, Homo sapiens
tgggaagctgcattttaacaag

SEQ ID NO: 109977 - DNA, 19 bp, Homo sapiens
agcggttctcaaagtcagg

SEQ ID NO: 109978 - DNA, 23 bp, Homo sapiens
tcagaacagttcttggtgcatag

SEQ ID NO: 109979 - DNA, 22 bp, Homo sapiens
agtgggccggacagcccaggcc

SEQ ID NO: 109980 - DNA, 22 bp, Homo sapiens
taaagttggacctgattttatt

SEQ ID NO: 109981 - DNA, 22 bp, Homo sapiens
ggaggggatttagtagatgcta

SEQ ID NO: 109982 - DNA, 21 bp, Homo sapiens
cagaggcctatcacagactcc

SEQ ID NO: 109983 - DNA, 22 bp, Homo sapiens
agcaagattgaggcttcctcag

SEQ ID NO: 109984 - DNA, 22 bp, Homo sapiens
ttatttaaaagtggtaagattc

SEQ ID NO: 109985 - DNA, 22 bp, Homo sapiens
ccaggaggcggaggttgcagcg

SEQ ID NO: 109986 - DNA, 22 bp, Homo sapiens
ccctgggattcaatttcactct

SEQ ID NO: 109987 - DNA, 22 bp, Homo sapiens
gtaatctcagctacttgggagg

SEQ ID NO: 109988 - DNA, 22 bp, Homo sapiens
ttaataaagtatgaattggaaa

SEQ ID NO: 109989 - DNA, 22 bp, Homo sapiens
gggcagagagctggaactcctt

SEQ ID NO: 109990 - DNA, 22 bp, Homo sapiens
tttgcattgcattaagtattct

SEQ ID NO: 109991 - DNA, 22 bp, Homo sapiens
gaaggagccgagctcttcccca

SEQ ID NO: 109992 - DNA, 22 bp, Homo sapiens
atgagtatatgatatggtttgg

SEQ ID NO: 109993 - DNA, 22 bp, Homo sapiens
attgtcgtcaatggacacatag

SEQ ID NO: 109994 - DNA, 22 bp, Homo sapiens
ccaagctacttaggagtctgag

SEQ ID NO: 109995 - DNA, 22 bp, Homo sapiens
ctgctcctgtccagcagggcca

SEQ ID NO: 109996 - DNA, 22 bp, Homo sapiens
ctgctaaacctctctgagagct

SEQ ID NO: 109997 - DNA, 22 bp, Homo sapiens
cttggattcctcatatgcacag

SEQ ID NO: 109998 - DNA, 22 bp, Homo sapiens
ggctgtggcagctggaagtggt

SEQ ID NO: 109999 - DNA, 22 bp, Homo sapiens
tcttgaattgtactcccataag

SEQ ID NO: 110000 - DNA, 22 bp, Homo sapiens
tgtcaatatgtaataactgaat

SEQ ID NO: 110001 - DNA, 22 bp, Homo sapiens
cgcggaggaggtcaggaggtga

SEQ ID NO: 110002 - DNA, 22 bp, Homo sapiens
tgagcacatttcacatgacagg

SEQ ID NO: 110003 - DNA, 22 bp, Homo sapiens
ctgggagtggtgacagctctcg

SEQ ID NO: 110004 - DNA, 22 bp, Homo sapiens
ataatacatggttgatcttttc

SEQ ID NO: 110005 - DNA, 22 bp, Homo sapiens
catcgatggaagtagtataggg

SEQ ID NO: 110006 - DNA, 22 bp, Homo sapiens
gaaagcatccgcctggaggtgg

SEQ ID NO: 110007 - DNA, 22 bp, Homo sapiens
ttccagttcactccatttctgg

SEQ ID NO: 110008 - DNA, 22 bp, Homo sapiens
ggaggcggaggttgcagtgagt

SEQ ID NO: 110009 - DNA, 22 bp, Homo sapiens
ggaggtggaggttgcagtgagc

SEQ ID NO: 110010 - DNA, 22 bp, Homo sapiens
agggatgtaaattcttcttctt

SEQ ID NO: 110011 - DNA, 22 bp, Homo sapiens
taatgtataacaaatactcatc

SEQ ID NO: 110012 - DNA, 22 bp, Homo sapiens
tgagctgtgtcttggtgagagt

SEQ ID NO: 110013 - DNA, 22 bp, Homo sapiens
cgagcatgatgacggctgtggc

SEQ ID NO: 110014 - DNA, 22 bp, Homo sapiens
atgccactgacatggacaattt

SEQ ID NO: 110015 - DNA, 22 bp, Homo sapiens
ctgagcagatgaccagccccag

SEQ ID NO: 110016 - DNA, 22 bp, Homo sapiens
cagagagaatcttggcagctga

SEQ ID NO: 110017 - DNA, 22 bp, Homo sapiens
ccgggcgggggctctcgtcacc

SEQ ID NO: 110018 - DNA, 19 bp, Homo sapiens
ccagagagctaggtacaga

SEQ ID NO: 110019 - DNA, 22 bp, Homo sapiens
tcctgccttgcctgggacatca

SEQ ID NO: 110020 - DNA, 22 bp, Homo sapiens
ccttctcagccccagctcccgc

SEQ ID NO: 110021 - DNA, 22 bp, Homo sapiens
ataatctttcttttccagatag

SEQ ID NO: 110022 - DNA, 22 bp, Homo sapiens
caaagtgggtgccctgatgctc

SEQ ID NO: 110023 - DNA, 22 bp, Homo sapiens
tcagagagcagaacttttttac

SEQ ID NO: 110024 - DNA, 22 bp, Homo sapiens
ctgggaggcggaggttgcagtg

SEQ ID NO: 110025 - DNA, 22 bp, Homo sapiens
tggagggcatgctgtccatggg

SEQ ID NO: 110026 - DNA, 22 bp, Homo sapiens
tcacgtgagggacctgtgtctg

SEQ ID NO: 110027 - DNA, 22 bp, Homo sapiens
ggacacgtggctgaaggcggcc

SEQ ID NO: 110028 - DNA, 22 bp, Homo sapiens
tgggctttgagctcggtcacct

SEQ ID NO: 110029 - DNA, 22 bp, Homo sapiens
ggtgccaggctgtagtcagggt

SEQ ID NO: 110030 - DNA, 22 bp, Homo sapiens
tgaaatgtgttctagtgttttg

SEQ ID NO: 110031 - DNA, 22 bp, Homo sapiens
atgctgtttgcttttagtctgc

SEQ ID NO: 110032 - DNA, 22 bp, Homo sapiens
taactaggattacaagcgtgcg

SEQ ID NO: 110033 - DNA, 23 bp, Homo sapiens
catctagcatccagtgagtagtg

SEQ ID NO: 110034 - DNA, 22 bp, Homo sapiens
atcacagggtgaggattagacc

SEQ ID NO: 110035 - DNA, 22 bp, Homo sapiens
gggtccctggaattacttgaca

SEQ ID NO: 110036 - DNA, 22 bp, Homo sapiens
gggaaggaaagttattagcaga

SEQ ID NO: 110037 - DNA, 19 bp, Homo sapiens
gagaaagcaggcacagcac

SEQ ID NO: 110038 - DNA, 18 bp, Homo sapiens
gaccccgggatctgtcga

SEQ ID NO: 110039 - DNA, 20 bp, Homo sapiens
atcctctcctgattaattca

SEQ ID NO: 110040 - DNA, 22 bp, Homo sapiens
acacccaggctggcgtgcagtg

SEQ ID NO: 110041 - DNA, 22 bp, Homo sapiens
gcaggctgtctaaagttagagt

SEQ ID NO: 110042 - DNA, 22 bp, Homo sapiens
ggccctggtcctaggggtggaa

SEQ ID NO: 110043 - DNA, 22 bp, Homo sapiens
cggggcctcgtcactctttgcg

SEQ ID NO: 110044 - DNA, 22 bp, Homo sapiens
aaatggaagctatttatgattc

SEQ ID NO: 110045 - DNA, 22 bp, Homo sapiens
cagtgcatgcacacacatggta

SEQ ID NO: 110046 - DNA, 22 bp, Homo sapiens
aaaaatcacttttataggcagc

SEQ ID NO: 110047 - DNA, 22 bp, Homo sapiens
gcgggttgaagggcgcatcgaa

SEQ ID NO: 110048 - DNA, 22 bp, Homo sapiens
cagagggttgatgtgaggctta

SEQ ID NO: 110049 - DNA, 19 bp, Homo sapiens
tccaaagaagttcacattt

SEQ ID NO: 110050 - DNA, 22 bp, Homo sapiens
gaaacactcaatttagtaattc

SEQ ID NO: 110051 - DNA, 22 bp, Homo sapiens
aacactatctgccttacaggga

SEQ ID NO: 110052 - DNA, 22 bp, Homo sapiens
cagctgttcattgttgccaccc

SEQ ID NO: 110053 - DNA, 22 bp, Homo sapiens
cagggatggcgctggctgcccg

SEQ ID NO: 110054 - DNA, 22 bp, Homo sapiens
tcgaatggcaaggaaagaggct

SEQ ID NO: 110055 - DNA, 22 bp, Homo sapiens
gagctgggcctgcgagtgctgc

SEQ ID NO: 110056 - DNA, 22 bp, Homo sapiens
ccatgaattcactccatgctag

SEQ ID NO: 110057 - DNA, 22 bp, Homo sapiens
tgtaagtagtaatggaaggaca

SEQ ID NO: 110058 - DNA, 22 bp, Homo sapiens
ggagtgactcacagctgggaca

SEQ ID NO: 110059 - DNA, 22 bp, Homo sapiens
tggcatttgagctggaaggatg

SEQ ID NO: 110060 - DNA, 22 bp, Homo sapiens
atgtttaaagggttgagaaata

SEQ ID NO: 110061 - DNA, 22 bp, Homo sapiens
cgcccaggctggagtgcagtga

SEQ ID NO: 110062 - DNA, 22 bp, Homo sapiens
gctgctgcttgaaggctcggag

SEQ ID NO: 110063 - DNA, 22 bp, Homo sapiens
gccgtggggagagagggtgcgt

SEQ ID NO: 110064 - DNA, 22 bp, Homo sapiens
aaggggtgcaagttaatcagca

SEQ ID NO: 110065 - DNA, 22 bp, Homo sapiens
taaaggtagtgtgacatattgt

SEQ ID NO: 110066 - DNA, 22 bp, Homo sapiens
cctggcaggtggcgccctcggc

SEQ ID NO: 110067 - DNA, 22 bp, Homo sapiens
aggacttagaacattatgtact

SEQ ID NO: 110068 - DNA, 22 bp, Homo sapiens
gcggcccgagcaggacgggtgg

SEQ ID NO: 110069 - DNA, 22 bp, Homo sapiens
agttgcagacgcagagatgttg

SEQ ID NO: 110070 - DNA, 22 bp, Homo sapiens
gaaatcatattctcagtccttc

SEQ ID NO: 110071 - DNA, 22 bp, Homo sapiens
gccatcatatcccctgtgacct

SEQ ID NO: 110072 - DNA, 22 bp, Homo sapiens
ctgcttctccctgagatagtgt

SEQ ID NO: 110073 - DNA, 22 bp, Homo sapiens
ttcagcttgctgactgcggcag

SEQ ID NO: 110074 - DNA, 22 bp, Homo sapiens
tttaatcataagaaggaaaata

SEQ ID NO: 110075 - DNA, 22 bp, Homo sapiens
ggttggacactaggtaggagcg

SEQ ID NO: 110076 - DNA, 22 bp, Homo sapiens
gaactttgcgcagttcccgggg

SEQ ID NO: 110077 - DNA, 23 bp, Homo sapiens
gggtccagccaattccaaggaaa

SEQ ID NO: 110078 - DNA, 22 bp, Homo sapiens
ggaggtcccaggcctggcagca

SEQ ID NO: 110079 - DNA, 22 bp, Homo sapiens
tctgcgcgctgctggtaccgaa

SEQ ID NO: 110080 - DNA, 22 bp, Homo sapiens
ctcgggcaccctggttctggtg

SEQ ID NO: 110081 - DNA, 22 bp, Homo sapiens
gaggtgctgctgtacttcttgc

SEQ ID NO: 110082 - DNA, 22 bp, Homo sapiens
tagattcagatatttaggacaa

SEQ ID NO: 110083 - DNA, 21 bp, Homo sapiens
aaactgaccttgcctgagaca

SEQ ID NO: 110084 - DNA, 22 bp, Homo sapiens
agcccaggagtttgaggctgtg

SEQ ID NO: 110085 - DNA, 22 bp, Homo sapiens
gccctcctggcaggcagtgatg

SEQ ID NO: 110086 - DNA, 22 bp, Homo sapiens
cgtcctctagagggaagcactt

SEQ ID NO: 110087 - DNA, 22 bp, Homo sapiens
ttgtctaatgagctccacttca

SEQ ID NO: 110088 - DNA, 22 bp, Homo sapiens
aagcctggactatcgcgtgtgc

SEQ ID NO: 110089 - DNA, 22 bp, Homo sapiens
aaaaagtattggccatggttga

SEQ ID NO: 110090 - DNA, 21 bp, Homo sapiens
gctctgtgttacaagttgggg

SEQ ID NO: 110091 - DNA, 22 bp, Homo sapiens
aaacttttttaggttcataggc

SEQ ID NO: 110092 - DNA, 22 bp, Homo sapiens
aataatctcactttatgtggaa

SEQ ID NO: 110093 - DNA, 22 bp, Homo sapiens
aacccgggaggcagaggttgtg

SEQ ID NO: 110094 - DNA, 22 bp, Homo sapiens
tgaggcaggagaatcaccggaa

SEQ ID NO: 110095 - DNA, 20 bp, Homo sapiens
ccaccctgtccggggcggag

SEQ ID NO: 110096 - DNA, 22 bp, Homo sapiens
tttataatagatttggggcggc

SEQ ID NO: 110097 - DNA, 22 bp, Homo sapiens
gaggtaacactgttcagtgggc

SEQ ID NO: 110098 - DNA, 22 bp, Homo sapiens
attgctaggaacaggttgcacc

SEQ ID NO: 110099 - DNA, 22 bp, Homo sapiens
gggtaaatctcttttcatggct

SEQ ID NO: 110100 - DNA, 22 bp, Homo sapiens
ctcctctttagccccagctgga

SEQ ID NO: 110101 - DNA, 22 bp, Homo sapiens
tattgtccaataggatgttcct

SEQ ID NO: 110102 - DNA, 22 bp, Homo sapiens
aggagggagcttaagccaggca

SEQ ID NO: 110103 - DNA, 22 bp, Homo sapiens
tgacaggaaacatgcagtgatt

SEQ ID NO: 110104 - DNA, 22 bp, Homo sapiens
ccaagggcgcctccgttccccc

SEQ ID NO: 110105 - DNA, 22 bp, Homo sapiens
ctgatagacaatcaccatggga

SEQ ID NO: 110106 - DNA, 22 bp, Homo sapiens
tgtacaatgctgaggtttgggg

SEQ ID NO: 110107 - DNA, 22 bp, Homo sapiens
ggcccagacccaagagtggtgg

SEQ ID NO: 110108 - DNA, 22 bp, Homo sapiens
atgccactgcacttcagcctgg

SEQ ID NO: 110109 - DNA, 22 bp, Homo sapiens
cctgcaccacaaggcttcagag

SEQ ID NO: 110110 - DNA, 22 bp, Homo sapiens
tgagatgtaaggtatgcttact

SEQ ID NO: 110111 - DNA, 22 bp, Homo sapiens
gcaggcagaggtggaggagaca

SEQ ID NO: 110112 - DNA, 22 bp, Homo sapiens
gggaaggccttgtcagcggatt

SEQ ID NO: 110113 - DNA, 21 bp, Homo sapiens
tgaaggggtggcagtgtgctt

SEQ ID NO: 110114 - DNA, 22 bp, Homo sapiens
agcgctgtgggcgtgcgaggag

SEQ ID NO: 110115 - DNA, 22 bp, Homo sapiens
ccactattactgtgtggcagtc

SEQ ID NO: 110116 - DNA, 22 bp, Homo sapiens
gaaggaagtcattagtgcagac

SEQ ID NO: 110117 - DNA, 22 bp, Homo sapiens
atcagagtgtaagttctttcct

SEQ ID NO: 110118 - DNA, 22 bp, Homo sapiens
catggcggtcaggatgtaggtg

SEQ ID NO: 110119 - DNA, 22 bp, Homo sapiens
gggctgtaggagctggaatggg

SEQ ID NO: 110120 - DNA, 22 bp, Homo sapiens
tccagggccatctccatgaggc

SEQ ID NO: 110121 - DNA, 20 bp, Homo sapiens
acgtggccaccagtggctta

SEQ ID NO: 110122 - DNA, 22 bp, Homo sapiens
ccaggagttggaggctgcagtg

SEQ ID NO: 110123 - DNA, 22 bp, Homo sapiens
gccatgcttggtatgctgtgag

SEQ ID NO: 110124 - DNA, 22 bp, Homo sapiens
ctgagatggagtttcgctcttc

SEQ ID NO: 110125 - DNA, 22 bp, Homo sapiens
ggagggcagagtcccctgctga

SEQ ID NO: 110126 - DNA, 22 bp, Homo sapiens
gggaggctctgctcagcccccg

SEQ ID NO: 110127 - DNA, 22 bp, Homo sapiens
atggccaggcacctctggctga

SEQ ID NO: 110128 - DNA, 22 bp, Homo sapiens
tctgctctgtggcttcagctaa

SEQ ID NO: 110129 - DNA, 22 bp, Homo sapiens
ctgtcatggtttgaatgctcgc

SEQ ID NO: 110130 - DNA, 22 bp, Homo sapiens
gtccccgacgtttggcttgatg

SEQ ID NO: 110131 - DNA, 22 bp, Homo sapiens
agtggagcttttcctatcagag

SEQ ID NO: 110132 - DNA, 22 bp, Homo sapiens
tacaaaaaattgatactgacga

SEQ ID NO: 110133 - DNA, 23 bp, Homo sapiens
gttttacaggtgagaaaatggag

SEQ ID NO: 110134 - DNA, 22 bp, Homo sapiens
aaggtagggatgtattcagctt

SEQ ID NO: 110135 - DNA, 19 bp, Homo sapiens
ctctggagtcattgctccc

SEQ ID NO: 110136 - DNA, 22 bp, Homo sapiens
ttcagacatgcaggctgaggct

SEQ ID NO: 110137 - DNA, 22 bp, Homo sapiens
gcgcgggcaggccttccgagtg

SEQ ID NO: 110138 - DNA, 22 bp, Homo sapiens
gcgcactgggcgcacgcgtagg

SEQ ID NO: 110139 - DNA, 22 bp, Homo sapiens
gaggttggggctgcagtgagct

SEQ ID NO: 110140 - DNA, 22 bp, Homo sapiens
tcaggggcttgaggtgcatgtc

SEQ ID NO: 110141 - DNA, 22 bp, Homo sapiens
ggtggctgcaatggctaacttc

SEQ ID NO: 110142 - DNA, 22 bp, Homo sapiens
tgccaggcgtggtggtgcgcac

SEQ ID NO: 110143 - DNA, 23 bp, Homo sapiens
ttgcttgagcccaggaagtggag

SEQ ID NO: 110144 - DNA, 22 bp, Homo sapiens
aggtaggcctgacgctggggtg

SEQ ID NO: 110145 - DNA, 22 bp, Homo sapiens
gaggagggagctggaagctctt

SEQ ID NO: 110146 - DNA, 22 bp, Homo sapiens
cagtggaggccttgggaccttt

SEQ ID NO: 110147 - DNA, 22 bp, Homo sapiens
gaagtccgggaggatcatgttc

SEQ ID NO: 110148 - DNA, 20 bp, Homo sapiens
ggggcccaagccctcttgcc

SEQ ID NO: 110149 - DNA, 22 bp, Homo sapiens
cgggcgcactccgggcagctgt

SEQ ID NO: 110150 - DNA, 22 bp, Homo sapiens
cccaggaggcagaagttgcagt

SEQ ID NO: 110151 - DNA, 22 bp, Homo sapiens
acagattcactgcactggccat

SEQ ID NO: 110152 - DNA, 22 bp, Homo sapiens
agcggcgccgagcttggccagg

SEQ ID NO: 110153 - DNA, 22 bp, Homo sapiens
gagggagggactagcattctct

SEQ ID NO: 110154 - DNA, 22 bp, Homo sapiens
ctgggtggcagagcctgcagtg

SEQ ID NO: 110155 - DNA, 22 bp, Homo sapiens
ctggaggccactgtacagattg

SEQ ID NO: 110156 - DNA, 22 bp, Homo sapiens
attggtagttttgtatttctct

SEQ ID NO: 110157 - DNA, 22 bp, Homo sapiens
ataaaaactgacccatcctttg

SEQ ID NO: 110158 - DNA, 22 bp, Homo sapiens
gggagaagaatgtgtcaattgt

SEQ ID NO: 110159 - DNA, 22 bp, Homo sapiens
ttgtgggatctccctgttgctc

SEQ ID NO: 110160 - DNA, 22 bp, Homo sapiens
gctggaggatggactggaagaa

SEQ ID NO: 110161 - DNA, 22 bp, Homo sapiens
cttcctcctccatctcgaaggc

SEQ ID NO: 110162 - DNA, 22 bp, Homo sapiens
ttcccacattctttacattcat

SEQ ID NO: 110163 - DNA, 22 bp, Homo sapiens
tataactacttgaagagttcag

SEQ ID NO: 110164 - DNA, 22 bp, Homo sapiens
ctgcaccctcaaactcctgggc

SEQ ID NO: 110165 - DNA, 22 bp, Homo sapiens
ccggggacagcaggtccgactt

SEQ ID NO: 110166 - DNA, 22 bp, Homo sapiens
ctgagcacgtagttagggtcca

SEQ ID NO: 110167 - DNA, 22 bp, Homo sapiens
taaggcaggaactggctgtttt

SEQ ID NO: 110168 - DNA, 22 bp, Homo sapiens
ggctgggcaggtctgcacaggg

SEQ ID NO: 110169 - DNA, 22 bp, Homo sapiens
tgcctcagctgaggccgctcca

SEQ ID NO: 110170 - DNA, 22 bp, Homo sapiens
tgggggagctcagtccagccca

SEQ ID NO: 110171 - DNA, 22 bp, Homo sapiens
agaaaatttaaagagacacaca

SEQ ID NO: 110172 - DNA, 22 bp, Homo sapiens
ttagctcagaaaatttaaactt

SEQ ID NO: 110173 - DNA, 22 bp, Homo sapiens
ttggatccatctcaggcatagg

SEQ ID NO: 110174 - DNA, 22 bp, Homo sapiens
ttctgattgctgatgaggccca

SEQ ID NO: 110175 - DNA, 22 bp, Homo sapiens
cttcagctgcagttatgtttag

SEQ ID NO: 110176 - DNA, 22 bp, Homo sapiens
ggtgaggggctcctctgcccgg

SEQ ID NO: 110177 - DNA, 22 bp, Homo sapiens
ggtcgagtcacttgttgccttt

SEQ ID NO: 110178 - DNA, 22 bp, Homo sapiens
atatatttgagaatattcatga

SEQ ID NO: 110179 - DNA, 22 bp, Homo sapiens
gcagtgagttatgatcatgcca

SEQ ID NO: 110180 - DNA, 22 bp, Homo sapiens
ccctggctggctctgcccggac

SEQ ID NO: 110181 - DNA, 22 bp, Homo sapiens
acatttatataactcactagga

SEQ ID NO: 110182 - DNA, 22 bp, Homo sapiens
tagtatagattgaagcagatca

SEQ ID NO: 110183 - DNA, 22 bp, Homo sapiens
tgccaccccggaccccgaagtg

SEQ ID NO: 110184 - DNA, 22 bp, Homo sapiens
ttctatttttgtggaactgtag

SEQ ID NO: 110185 - DNA, 22 bp, Homo sapiens
cctcttctaggacgtccttgtg

SEQ ID NO: 110186 - DNA, 22 bp, Homo sapiens
agctggtgctcggggagctggc

SEQ ID NO: 110187 - DNA, 22 bp, Homo sapiens
agccagggacgctgcaggctac

SEQ ID NO: 110188 - DNA, 23 bp, Homo sapiens
aaataggagtatctggatcatga

SEQ ID NO: 110189 - DNA, 22 bp, Homo sapiens
gcttaattctggctcagtttcc

SEQ ID NO: 110190 - DNA, 22 bp, Homo sapiens
tttacacagaggacactgggct

SEQ ID NO: 110191 - DNA, 22 bp, Homo sapiens
gcttggccagcagccgggatgc

SEQ ID NO: 110192 - DNA, 22 bp, Homo sapiens
cactgcactccagcctgggcaa

SEQ ID NO: 110193 - DNA, 22 bp, Homo sapiens
agggaaattaatgtgagcaatg

SEQ ID NO: 110194 - DNA, 22 bp, Homo sapiens
caggctggagttcagtggtgtg

SEQ ID NO: 110195 - DNA, 22 bp, Homo sapiens
agcgccactgcactccagcctg

SEQ ID NO: 110196 - DNA, 22 bp, Homo sapiens
tgcagcctggcttcgcgcctcc

SEQ ID NO: 110197 - DNA, 22 bp, Homo sapiens
gtttgtcttaattaggcatcga

SEQ ID NO: 110198 - DNA, 22 bp, Homo sapiens
cggtcaggtgcagcgttggcac

SEQ ID NO: 110199 - DNA, 22 bp, Homo sapiens
tctaatccttgctacctgggtg

SEQ ID NO: 110200 - DNA, 22 bp, Homo sapiens
ctatacagcagcttactagtta

SEQ ID NO: 110201 - DNA, 22 bp, Homo sapiens
cagccctcctaccctgccaggc

SEQ ID NO: 110202 - DNA, 22 bp, Homo sapiens
tcgttagcctcgagatctttgt

SEQ ID NO: 110203 - DNA, 20 bp, Homo sapiens
ctttaactggaaggctgctt

SEQ ID NO: 110204 - DNA, 22 bp, Homo sapiens
gcttctggtgaggcctcaggaa

SEQ ID NO: 110205 - DNA, 22 bp, Homo sapiens
gttgcctaggctggtcttgaac

SEQ ID NO: 110206 - DNA, 22 bp, Homo sapiens
ccgcggggtcatggctgggccg

SEQ ID NO: 110207 - DNA, 22 bp, Homo sapiens
ttcccaggaagcctctccaagc

SEQ ID NO: 110208 - DNA, 22 bp, Homo sapiens
acccaggctggcgtgcagtggc

SEQ ID NO: 110209 - DNA, 22 bp, Homo sapiens
aagaagcattctttcattggtt

SEQ ID NO: 110210 - DNA, 22 bp, Homo sapiens
aacccaggagttggaggctgtg

SEQ ID NO: 110211 - DNA, 22 bp, Homo sapiens
actgcaacctccgcctgccagg

SEQ ID NO: 110212 - DNA, 22 bp, Homo sapiens
ccaggaggcggaggttgcagtg

SEQ ID NO: 110213 - DNA, 22 bp, Homo sapiens
ctgtaatcccagctactcggga

SEQ ID NO: 110214 - DNA, 22 bp, Homo sapiens
cctccccacagcccaggagact

SEQ ID NO: 110215 - DNA, 22 bp, Homo sapiens
agctatgggtgtgggttccatt

SEQ ID NO: 110216 - DNA, 22 bp, Homo sapiens
gacgagagactccatccaccac

SEQ ID NO: 110217 - DNA, 22 bp, Homo sapiens
gctggggaggcagcagagaaca

SEQ ID NO: 110218 - DNA, 18 bp, Homo sapiens
cagctgccagctcatgga

SEQ ID NO: 110219 - DNA, 22 bp, Homo sapiens
ccacaggggcccacgagccgct

SEQ ID NO: 110220 - DNA, 22 bp, Homo sapiens
cctacagttatattcttgattg

SEQ ID NO: 110221 - DNA, 21 bp, Homo sapiens
ccaccaggtcttctgctcggg

SEQ ID NO: 110222 - DNA, 21 bp, Homo sapiens
tctctttctggaagcttccct

SEQ ID NO: 110223 - DNA, 22 bp, Homo sapiens
gggcggggtggctcatgcctgt

SEQ ID NO: 110224 - DNA, 22 bp, Homo sapiens
gtgcctcagttggaaatgcaga

SEQ ID NO: 110225 - DNA, 22 bp, Homo sapiens
gctggccacagatccccaggga

SEQ ID NO: 110226 - DNA, 22 bp, Homo sapiens
ccaggaggtggagattgcagtg

SEQ ID NO: 110227 - DNA, 23 bp, Homo sapiens
cccagaccttgtgctgcccttgg

SEQ ID NO: 110228 - DNA, 22 bp, Homo sapiens
gcagactgtatcaatgtcagta

SEQ ID NO: 110229 - DNA, 22 bp, Homo sapiens
tgatgcctaatatacttcaatt

SEQ ID NO: 110230 - DNA, 22 bp, Homo sapiens
gcccagcccagaaaggttcgga

SEQ ID NO: 110231 - DNA, 22 bp, Homo sapiens
actgcactcctgcctgggtaac

SEQ ID NO: 110232 - DNA, 22 bp, Homo sapiens
gctgctaagcgtttctgttcca

SEQ ID NO: 110233 - DNA, 22 bp, Homo sapiens
cctccagagggaagtactttct

SEQ ID NO: 110234 - DNA, 18 bp, Homo sapiens
gcagtgaagaaagagctt

SEQ ID NO: 110235 - DNA, 23 bp, Homo sapiens
tgaatgtttattctcggtgcaga

SEQ ID NO: 110236 - DNA, 22 bp, Homo sapiens
aagacacaatgtagcccagcac

SEQ ID NO: 110237 - DNA, 22 bp, Homo sapiens
ggacaagcctgtgagtgggttt

SEQ ID NO: 110238 - DNA, 22 bp, Homo sapiens
ttcaccctggaccagaaattgg

SEQ ID NO: 110239 - DNA, 22 bp, Homo sapiens
aagcacaatgaacatcttagat

SEQ ID NO: 110240 - DNA, 22 bp, Homo sapiens
agggcgctgaaatactaacatg

SEQ ID NO: 110241 - DNA, 22 bp, Homo sapiens
cctgaggatgccagcatgggtg

SEQ ID NO: 110242 - DNA, 22 bp, Homo sapiens
ttttggccacatccttttgagt

SEQ ID NO: 110243 - DNA, 20 bp, Homo sapiens
ttgttagaggaatgccatag

SEQ ID NO: 110244 - DNA, 22 bp, Homo sapiens
tgagctgacacccaatcatact

SEQ ID NO: 110245 - DNA, 22 bp, Homo sapiens
ttccagctaactcacatccctt

SEQ ID NO: 110246 - DNA, 22 bp, Homo sapiens
aagaagcaggtcacagacaggg

SEQ ID NO: 110247 - DNA, 22 bp, Homo sapiens
ccgggagcaggcgccaccgcca

SEQ ID NO: 110248 - DNA, 22 bp, Homo sapiens
gcctggagaaaggaaggtggga

SEQ ID NO: 110249 - DNA, 22 bp, Homo sapiens
gtcatggtgctagcgggaatgt

SEQ ID NO: 110250 - DNA, 22 bp, Homo sapiens
tctcctggtacccttcctagca

SEQ ID NO: 110251 - DNA, 22 bp, Homo sapiens
atacaaaatatatactggagac

SEQ ID NO: 110252 - DNA, 22 bp, Homo sapiens
ccaggtgtgctctgcagtggat

SEQ ID NO: 110253 - DNA, 20 bp, Homo sapiens
caagggtttgcattggcttt

SEQ ID NO: 110254 - DNA, 22 bp, Homo sapiens
ggctccaccctgcttccagaag

SEQ ID NO: 110255 - DNA, 21 bp, Homo sapiens
tgcaatccagcctgggcgaca

SEQ ID NO: 110256 - DNA, 22 bp, Homo sapiens
tggctgttggagctggaagatg

SEQ ID NO: 110257 - DNA, 22 bp, Homo sapiens
gagaaagcttctttcccacagg

SEQ ID NO: 110258 - DNA, 22 bp, Homo sapiens
actgcaacctccacctcctggg

SEQ ID NO: 110259 - DNA, 22 bp, Homo sapiens
cgcggtggcggcctccagcgcc

SEQ ID NO: 110260 - DNA, 22 bp, Homo sapiens
gcagtggggcaatcatagctca

SEQ ID NO: 110261 - DNA, 21 bp, Homo sapiens
tggcggggacttgtggctgcc

SEQ ID NO: 110262 - DNA, 22 bp, Homo sapiens
tggccgggaagggacagtgtgg

SEQ ID NO: 110263 - DNA, 22 bp, Homo sapiens
aggggtgaaagagggccctcaa

SEQ ID NO: 110264 - DNA, 22 bp, Homo sapiens
gattgtggaagtcagtggttct

SEQ ID NO: 110265 - DNA, 18 bp, Homo sapiens
gacatagctcagagctca

SEQ ID NO: 110266 - DNA, 22 bp, Homo sapiens
gccggggctggggagagacatg

SEQ ID NO: 110267 - DNA, 22 bp, Homo sapiens
ccagatatcactgccgtgttgt

SEQ ID NO: 110268 - DNA, 22 bp, Homo sapiens
ggcctgggctccgggagttact

SEQ ID NO: 110269 - DNA, 22 bp, Homo sapiens
atccatttgacataatttcagc

SEQ ID NO: 110270 - DNA, 22 bp, Homo sapiens
tgttgcccaggttctctcctgc

SEQ ID NO: 110271 - DNA, 18 bp, Homo sapiens
ggcgggtgttttattcac

SEQ ID NO: 110272 - DNA, 22 bp, Homo sapiens
aacattgaacttggcacaccca

SEQ ID NO: 110273 - DNA, 21 bp, Homo sapiens
ggtgctcgctgatgaggagtg

SEQ ID NO: 110274 - DNA, 22 bp, Homo sapiens
ctttggcaatgtcattttcaat

SEQ ID NO: 110275 - DNA, 22 bp, Homo sapiens
tcctttgcttctgtcattctcc

SEQ ID NO: 110276 - DNA, 22 bp, Homo sapiens
cccaggaggcagagatagcagt

SEQ ID NO: 110277 - DNA, 22 bp, Homo sapiens
aataaaatggtcagttttctca

SEQ ID NO: 110278 - DNA, 22 bp, Homo sapiens
agaggggcccggttctccgtct

SEQ ID NO: 110279 - DNA, 22 bp, Homo sapiens
cttttcattgtttgtacatgca

SEQ ID NO: 110280 - DNA, 22 bp, Homo sapiens
tccgatgcttccagggccacct

SEQ ID NO: 110281 - DNA, 22 bp, Homo sapiens
gtggcccaggttggagtgcagt

SEQ ID NO: 110282 - DNA, 22 bp, Homo sapiens
cctcggggcaccgcggcctgct

SEQ ID NO: 110283 - DNA, 22 bp, Homo sapiens
cccaggaggcggaggttgcagt

SEQ ID NO: 110284 - DNA, 22 bp, Homo sapiens
gccaggacctcagatgcagggc

SEQ ID NO: 110285 - DNA, 22 bp, Homo sapiens
cactgcaacctccacctcctgg

SEQ ID NO: 110286 - DNA, 22 bp, Homo sapiens
acccaggccattggcaagagtc

SEQ ID NO: 110287 - DNA, 22 bp, Homo sapiens
tgggcggactcgggcatggaat

SEQ ID NO: 110288 - DNA, 18 bp, Homo sapiens
tggcgatggtcatttttc

SEQ ID NO: 110289 - DNA, 22 bp, Homo sapiens
tccaactttctcctccggcttg

SEQ ID NO: 110290 - DNA, 22 bp, Homo sapiens
ggggtgaaggttttctgaaagc

SEQ ID NO: 110291 - DNA, 22 bp, Homo sapiens
aaggagaggttgtccgtgttgt

SEQ ID NO: 110292 - DNA, 22 bp, Homo sapiens
tctgttgactcctagcagccat

SEQ ID NO: 110293 - DNA, 22 bp, Homo sapiens
ttcaccagcagctcactagtca

SEQ ID NO: 110294 - DNA, 22 bp, Homo sapiens
tgggaagaggggtataaagaag

SEQ ID NO: 110295 - DNA, 22 bp, Homo sapiens
cagcccaggactgcaggtgttt

SEQ ID NO: 110296 - DNA, 22 bp, Homo sapiens
tggacacaaagatcaaatattg

SEQ ID NO: 110297 - DNA, 22 bp, Homo sapiens
cgttttcatgggtagaggttct

SEQ ID NO: 110298 - DNA, 22 bp, Homo sapiens
gggaagtgatggagccaggatt

SEQ ID NO: 110299 - DNA, 22 bp, Homo sapiens
ggaggagcatgagagggtagtg

SEQ ID NO: 110300 - DNA, 22 bp, Homo sapiens
ctcctgggaaaggctggacaca

SEQ ID NO: 110301 - DNA, 22 bp, Homo sapiens
tgtggactggcgggacgcaatg

SEQ ID NO: 110302 - DNA, 22 bp, Homo sapiens
cagttccctccgccagcacttc

SEQ ID NO: 110303 - DNA, 22 bp, Homo sapiens
aggggcgtgctcttccccgacg

SEQ ID NO: 110304 - DNA, 22 bp, Homo sapiens
gaggccacggaagggagctgtg

SEQ ID NO: 110305 - DNA, 22 bp, Homo sapiens
tgagtgtggggaatgtcatgag

SEQ ID NO: 110306 - DNA, 22 bp, Homo sapiens
gaccctgtttctacaaataatt

SEQ ID NO: 110307 - DNA, 22 bp, Homo sapiens
gtgggccactgggaggcaaggg

SEQ ID NO: 110308 - DNA, 22 bp, Homo sapiens
cccactgtttccctgaggctct

SEQ ID NO: 110309 - DNA, 22 bp, Homo sapiens
gtggattacaagacagttgaga

SEQ ID NO: 110310 - DNA, 22 bp, Homo sapiens
tagatgaccttgtgttaggcaa

SEQ ID NO: 110311 - DNA, 22 bp, Homo sapiens
caccaagaatcttcacttttta

SEQ ID NO: 110312 - DNA, 22 bp, Homo sapiens
gcagagctcatgcctgcacctc

SEQ ID NO: 110313 - DNA, 22 bp, Homo sapiens
gggctgtgaggtgagaacttac

SEQ ID NO: 110314 - DNA, 22 bp, Homo sapiens
cgtgaggggggtaaggcgtccg

SEQ ID NO: 110315 - DNA, 22 bp, Homo sapiens
gctcatgactgtaatcccagca

SEQ ID NO: 110316 - DNA, 22 bp, Homo sapiens
tcgcggggaagtggtgggctaa

SEQ ID NO: 110317 - DNA, 22 bp, Homo sapiens
gccaggttgctgacgacgatct

SEQ ID NO: 110318 - DNA, 20 bp, Homo sapiens
tttgagaccagtctgcccaa

SEQ ID NO: 110319 - DNA, 22 bp, Homo sapiens
ccttgctcaagctagtgacggg

SEQ ID NO: 110320 - DNA, 22 bp, Homo sapiens
gggacatctttctagtcagggt

SEQ ID NO: 110321 - DNA, 22 bp, Homo sapiens
tggacaacatagtgagacctca

SEQ ID NO: 110322 - DNA, 22 bp, Homo sapiens
gcttccacctactaaatgccac

SEQ ID NO: 110323 - DNA, 22 bp, Homo sapiens
gttcaagaccagcctggccaac

SEQ ID NO: 110324 - DNA, 22 bp, Homo sapiens
tagcacagcttcttgatgtcac

SEQ ID NO: 110325 - DNA, 22 bp, Homo sapiens
gagcccaggaagtggaggctga

SEQ ID NO: 110326 - DNA, 22 bp, Homo sapiens
ggggcaggagcccttcttcagc

SEQ ID NO: 110327 - DNA, 22 bp, Homo sapiens
aaagtaattgcagtttctgcca

SEQ ID NO: 110328 - DNA, 22 bp, Homo sapiens
ctggagggctgcagcgaggctg

SEQ ID NO: 110329 - DNA, 22 bp, Homo sapiens
ggcagccccatcagagacgctg

SEQ ID NO: 110330 - DNA, 20 bp, Homo sapiens
tatttctgggcaaccattta

SEQ ID NO: 110331 - DNA, 22 bp, Homo sapiens
tttgaagggcacgacaatagtt

SEQ ID NO: 110332 - DNA, 22 bp, Homo sapiens
acatgtttaagtttgttatatg

SEQ ID NO: 110333 - DNA, 22 bp, Homo sapiens
gcactgcaggtgggtggagagg

SEQ ID NO: 110334 - DNA, 16 bp, Homo sapiens
cttggtgttggcagag

SEQ ID NO: 110335 - DNA, 22 bp, Homo sapiens
ggaaggcagaggtgtcgtgggg

SEQ ID NO: 110336 - DNA, 22 bp, Homo sapiens
aaaactacatttgacattttgt

SEQ ID NO: 110337 - DNA, 22 bp, Homo sapiens
cggagcctgcttgttgcagctg

SEQ ID NO: 110338 - DNA, 22 bp, Homo sapiens
cagcgtctcgttgtgggcctcg

SEQ ID NO: 110339 - DNA, 22 bp, Homo sapiens
tcccagattcctgctcttatat

SEQ ID NO: 110340 - DNA, 22 bp, Homo sapiens
cctggcctttgaacgctagact

SEQ ID NO: 110341 - DNA, 22 bp, Homo sapiens
ccactgtgcccagcctcatggg

SEQ ID NO: 110342 - DNA, 22 bp, Homo sapiens
cgttggtctgtcccctggcacc

SEQ ID NO: 110343 - DNA, 22 bp, Homo sapiens
gaagaaagatcaaatagtttcc

SEQ ID NO: 110344 - DNA, 22 bp, Homo sapiens
ccgggccccacggtgacctcag

SEQ ID NO: 110345 - DNA, 22 bp, Homo sapiens
aggagcagaccgtagtcctgca

SEQ ID NO: 110346 - DNA, 22 bp, Homo sapiens
gtgcttccatctagagggtcac

SEQ ID NO: 110347 - DNA, 22 bp, Homo sapiens
ggtcttcctatggcggggccct

SEQ ID NO: 110348 - DNA, 22 bp, Homo sapiens
caggcgggcaggtgcggcccct

SEQ ID NO: 110349 - DNA, 22 bp, Homo sapiens
acagagcaatgcgtgttctcta

SEQ ID NO: 110350 - DNA, 18 bp, Homo sapiens
tcttccaacactgacacc

SEQ ID NO: 110351 - DNA, 22 bp, Homo sapiens
cactgcactccagcctgggaga

SEQ ID NO: 110352 - DNA, 22 bp, Homo sapiens
aggccaggaatccttgtcccag

SEQ ID NO: 110353 - DNA, 22 bp, Homo sapiens
cctgggaatcggtgcgttgagg

SEQ ID NO: 110354 - DNA, 22 bp, Homo sapiens
tggctaacaaggtgaaaccccg

SEQ ID NO: 110355 - DNA, 22 bp, Homo sapiens
tgcacgtgtgagcattcacatg

SEQ ID NO: 110356 - DNA, 22 bp, Homo sapiens
ttcttcagcctaccttgacctc

SEQ ID NO: 110357 - DNA, 22 bp, Homo sapiens
cgtgagcaaaatggacactccc

SEQ ID NO: 110358 - DNA, 22 bp, Homo sapiens
tcacaaatgtttgcatgtgtct

SEQ ID NO: 110359 - DNA, 22 bp, Homo sapiens
cagggccagcgtctcgggctat

SEQ ID NO: 110360 - DNA, 22 bp, Homo sapiens
tgtgcatgtgtctttatagtag

SEQ ID NO: 110361 - DNA, 22 bp, Homo sapiens
agcaggaaggggatgatgggca

SEQ ID NO: 110362 - DNA, 22 bp, Homo sapiens
ggaggcggaggctgcagtgagc

SEQ ID NO: 110363 - DNA, 22 bp, Homo sapiens
agagcagctcgctacctctcta

SEQ ID NO: 110364 - DNA, 22 bp, Homo sapiens
gatggcacacagacatccccgc

SEQ ID NO: 110365 - DNA, 22 bp, Homo sapiens
ggggcgtcaccggggcacctgg

SEQ ID NO: 110366 - DNA, 22 bp, Homo sapiens
cagtggccaacttcctgcctct

SEQ ID NO: 110367 - DNA, 22 bp, Homo sapiens
gcaggtggatcacctgaggtca

SEQ ID NO: 110368 - DNA, 22 bp, Homo sapiens
gtggtggatgtctgtaatctca

SEQ ID NO: 110369 - DNA, 22 bp, Homo sapiens
ttactttaagggtgtcttatta

SEQ ID NO: 110370 - DNA, 22 bp, Homo sapiens
actgcacttcaccctgggtgac

SEQ ID NO: 110371 - DNA, 22 bp, Homo sapiens
gggagctgaaggagccggcggg

SEQ ID NO: 110372 - DNA, 20 bp, Homo sapiens
cctgtcatcccagcattttg

SEQ ID NO: 110373 - DNA, 22 bp, Homo sapiens
agccagggtctctcgctctgtt

SEQ ID NO: 110374 - DNA, 22 bp, Homo sapiens
agcctgggccctgcctcttctc

SEQ ID NO: 110375 - DNA, 22 bp, Homo sapiens
acagcagagcctggtacttact

SEQ ID NO: 110376 - DNA, 22 bp, Homo sapiens
cctgggaggctgaggctgcagt

SEQ ID NO: 110377 - DNA, 22 bp, Homo sapiens
agacgcggtggtgcatgcctgt

SEQ ID NO: 110378 - DNA, 22 bp, Homo sapiens
aggaaataagggacaagacaaa

SEQ ID NO: 110379 - DNA, 23 bp, Homo sapiens
ctcaccaagcgccgccgctgtgt

SEQ ID NO: 110380 - DNA, 19 bp, Homo sapiens
aggaatggaattaattctg

SEQ ID NO: 110381 - DNA, 22 bp, Homo sapiens
aatgaattgcagtactgacttg

SEQ ID NO: 110382 - DNA, 22 bp, Homo sapiens
agagggatcaccctgtttctgg

SEQ ID NO: 110383 - DNA, 22 bp, Homo sapiens
cctttgatttcccccgtctcag

SEQ ID NO: 110384 - DNA, 22 bp, Homo sapiens
aaaagcaattgcgggttttgcc

SEQ ID NO: 110385 - DNA, 22 bp, Homo sapiens
gttaaggatcttgagatgagga

SEQ ID NO: 110386 - DNA, 22 bp, Homo sapiens
acttttaaatgagtttcagttg

SEQ ID NO: 110387 - DNA, 22 bp, Homo sapiens
agaacctcaattatttttgcac

SEQ ID NO: 110388 - DNA, 20 bp, Homo sapiens
attagagctacatggctaca

SEQ ID NO: 110389 - DNA, 22 bp, Homo sapiens
gaggtgggtgtatcacaggtca

SEQ ID NO: 110390 - DNA, 22 bp, Homo sapiens
tctgcaacagtgccctgtaaat

SEQ ID NO: 110391 - DNA, 22 bp, Homo sapiens
tgcgcatgagtctgtgcataca

SEQ ID NO: 110392 - DNA, 22 bp, Homo sapiens
aggccttaccatagctgtagca

SEQ ID NO: 110393 - DNA, 22 bp, Homo sapiens
acgggctgggacggggaagctc

SEQ ID NO: 110394 - DNA, 22 bp, Homo sapiens
caggaattcatagcattgttct

SEQ ID NO: 110395 - DNA, 22 bp, Homo sapiens
tcagcagtgagaattaatgttg

SEQ ID NO: 110396 - DNA, 22 bp, Homo sapiens
tgttgattagtgtttagactta

SEQ ID NO: 110397 - DNA, 22 bp, Homo sapiens
ctcgcggcgcccgaagcccttg

SEQ ID NO: 110398 - DNA, 22 bp, Homo sapiens
gggtggtggccagcagtgggca

SEQ ID NO: 110399 - DNA, 22 bp, Homo sapiens
gatagtcacctcccttaacttt

SEQ ID NO: 110400 - DNA, 22 bp, Homo sapiens
tgcgatgcaacagcttggcgga

SEQ ID NO: 110401 - DNA, 22 bp, Homo sapiens
tggaggctggagtgcagtggcg

SEQ ID NO: 110402 - DNA, 22 bp, Homo sapiens
cttccttctcactagcagcgcc

SEQ ID NO: 110403 - DNA, 22 bp, Homo sapiens
atttcctgcaaggagtgggttt

SEQ ID NO: 110404 - DNA, 21 bp, Homo sapiens
tcacgtggtcacatgagcttt

SEQ ID NO: 110405 - DNA, 22 bp, Homo sapiens
gaggtggctgcttgctgggaaa

SEQ ID NO: 110406 - DNA, 22 bp, Homo sapiens
gggggagagacgagcggctctg

SEQ ID NO: 110407 - DNA, 22 bp, Homo sapiens
ctcactgcaagctccacctctt

SEQ ID NO: 110408 - DNA, 22 bp, Homo sapiens
agcattccacactgaagtctgc

SEQ ID NO: 110409 - DNA, 22 bp, Homo sapiens
cacgcctgtaatcccagcactt

SEQ ID NO: 110410 - DNA, 22 bp, Homo sapiens
gccgccgctgtgcaatttagca

SEQ ID NO: 110411 - DNA, 22 bp, Homo sapiens
gatggcggtcgtcgacggtcct

SEQ ID NO: 110412 - DNA, 18 bp, Homo sapiens
tgtagagccaggtttgcc

SEQ ID NO: 110413 - DNA, 22 bp, Homo sapiens
accagctagggtagcacatctc

SEQ ID NO: 110414 - DNA, 22 bp, Homo sapiens
actttcttggtcccatgtttga

SEQ ID NO: 110415 - DNA, 19 bp, Homo sapiens
gactccaactttaagcatg

SEQ ID NO: 110416 - DNA, 22 bp, Homo sapiens
ggcccaggctggagtgcagtgg

SEQ ID NO: 110417 - DNA, 22 bp, Homo sapiens
tctggcttcgcagctcccagcc

SEQ ID NO: 110418 - DNA, 22 bp, Homo sapiens
atgtgagctctcttctgattgg

SEQ ID NO: 110419 - DNA, 22 bp, Homo sapiens
ttggcataccttagtggtggag

SEQ ID NO: 110420 - DNA, 22 bp, Homo sapiens
aggacagagggaccagagccca

SEQ ID NO: 110421 - DNA, 22 bp, Homo sapiens
tagaataatctgaggaaatgct

SEQ ID NO: 110422 - DNA, 22 bp, Homo sapiens
gcaggtctatcaggctgcaggt

SEQ ID NO: 110423 - DNA, 22 bp, Homo sapiens
ggctcactgcaacttccgcctc

SEQ ID NO: 110424 - DNA, 22 bp, Homo sapiens
tgcctgtggaaaggctggtgct

SEQ ID NO: 110425 - DNA, 22 bp, Homo sapiens
ctgtatctgtgttggatgagtt

SEQ ID NO: 110426 - DNA, 21 bp, Homo sapiens
ctacttaagtaggggattagg

SEQ ID NO: 110427 - DNA, 22 bp, Homo sapiens
cgcgaggtggaggttgcagtga

SEQ ID NO: 110428 - DNA, 22 bp, Homo sapiens
cttcccaccaaagcccttgttg

SEQ ID NO: 110429 - DNA, 22 bp, Homo sapiens
tggttcctcaagcgctggcggc

SEQ ID NO: 110430 - DNA, 22 bp, Homo sapiens
tgtattctaaatacatcttacc

SEQ ID NO: 110431 - DNA, 22 bp, Homo sapiens
tcgcaccattgcactccagcca

SEQ ID NO: 110432 - DNA, 22 bp, Homo sapiens
tgtctttgttattgtggacagg

SEQ ID NO: 110433 - DNA, 22 bp, Homo sapiens
aaacactcatgtgttactctcc

SEQ ID NO: 110434 - DNA, 22 bp, Homo sapiens
tctaatcctatggtggggaggg

SEQ ID NO: 110435 - DNA, 22 bp, Homo sapiens
atatgggggggcgtgcagagga

SEQ ID NO: 110436 - DNA, 22 bp, Homo sapiens
aatgtgaggccttggtagttat

SEQ ID NO: 110437 - DNA, 22 bp, Homo sapiens
cagccagtgtgaccgaggagga

SEQ ID NO: 110438 - DNA, 22 bp, Homo sapiens
aatattatcaaaagctttttca

SEQ ID NO: 110439 - DNA, 22 bp, Homo sapiens
atgagctagaaaaccatgtgga

SEQ ID NO: 110440 - DNA, 22 bp, Homo sapiens
ggaaggggtgggtgagcctcag

SEQ ID NO: 110441 - DNA, 20 bp, Homo sapiens
aggggcacctgcgacggggc

SEQ ID NO: 110442 - DNA, 20 bp, Homo sapiens
tcacatcctctcccaacatg

SEQ ID NO: 110443 - DNA, 22 bp, Homo sapiens
caagaggattattaataaataa

SEQ ID NO: 110444 - DNA, 22 bp, Homo sapiens
gagacacaggcacagaagaggc

SEQ ID NO: 110445 - DNA, 22 bp, Homo sapiens
gggttgaggcggatgtcggcgg

SEQ ID NO: 110446 - DNA, 22 bp, Homo sapiens
tgaggcaggaggttgagaactg

SEQ ID NO: 110447 - DNA, 22 bp, Homo sapiens
ttcaccttgaatatgtcttaaa

SEQ ID NO: 110448 - DNA, 22 bp, Homo sapiens
aaggtttcgggagcgggtctgg

SEQ ID NO: 110449 - DNA, 22 bp, Homo sapiens
gtaggtcagacataagaggaca

SEQ ID NO: 110450 - DNA, 18 bp, Homo sapiens
tcaagccattctcctgcc

SEQ ID NO: 110451 - DNA, 22 bp, Homo sapiens
atgcacctgaactccatcagct

SEQ ID NO: 110452 - DNA, 22 bp, Homo sapiens
agtattacatggccaatctcct

SEQ ID NO: 110453 - DNA, 22 bp, Homo sapiens
cactgcactccagcactccagc

SEQ ID NO: 110454 - DNA, 22 bp, Homo sapiens
gcccagtggtaaaagcaggcct

SEQ ID NO: 110455 - DNA, 22 bp, Homo sapiens
ttgtgtgtactggttatgggca

SEQ ID NO: 110456 - DNA, 22 bp, Homo sapiens
acaagaagggtgattaggggca

SEQ ID NO: 110457 - DNA, 19 bp, Homo sapiens
atgtacccagtgtcaatcc

SEQ ID NO: 110458 - DNA, 22 bp, Homo sapiens
tgctcccaaacctgacaggctc

SEQ ID NO: 110459 - DNA, 22 bp, Homo sapiens
ctggagggtggagagaagtctc

SEQ ID NO: 110460 - DNA, 22 bp, Homo sapiens
ctcactgcaagctctgcctccc

SEQ ID NO: 110461 - DNA, 22 bp, Homo sapiens
cctgcctactgagttttatatt

SEQ ID NO: 110462 - DNA, 22 bp, Homo sapiens
cattaaacaaccttgaatcaat

SEQ ID NO: 110463 - DNA, 20 bp, Homo sapiens
acctcctggcgggcatcctc

SEQ ID NO: 110464 - DNA, 22 bp, Homo sapiens
tgactggattgtcattacgacg

SEQ ID NO: 110465 - DNA, 22 bp, Homo sapiens
cacagagatggtctggcaggtg

SEQ ID NO: 110466 - DNA, 22 bp, Homo sapiens
ggcgctcagtgttgccccagag

SEQ ID NO: 110467 - DNA, 22 bp, Homo sapiens
catataaatacaacatgtgtta

SEQ ID NO: 110468 - DNA, 22 bp, Homo sapiens
gagagagctctgtgcctgggat

SEQ ID NO: 110469 - DNA, 22 bp, Homo sapiens
tcagtgccatgggcagacaggc

SEQ ID NO: 110470 - DNA, 22 bp, Homo sapiens
ttggatggaggttcaagcacta

SEQ ID NO: 110471 - DNA, 22 bp, Homo sapiens
ttcagcccaggagttggaggct

SEQ ID NO: 110472 - DNA, 22 bp, Homo sapiens
ggagagcttggagtgcgatttt

SEQ ID NO: 110473 - DNA, 22 bp, Homo sapiens
ttccccttgataagcagggttg

SEQ ID NO: 110474 - DNA, 23 bp, Homo sapiens
ccagtgattgcctggaaggaggt

SEQ ID NO: 110475 - DNA, 22 bp, Homo sapiens
ctggcaggagcattcacagagg

SEQ ID NO: 110476 - DNA, 22 bp, Homo sapiens
actgattgcattcatagggttt

SEQ ID NO: 110477 - DNA, 22 bp, Homo sapiens
atagagtgatgtaaggtatgtg

SEQ ID NO: 110478 - DNA, 22 bp, Homo sapiens
gcgaggaggggtgctgggcccc

SEQ ID NO: 110479 - DNA, 22 bp, Homo sapiens
agattctaccagagctagtttg

SEQ ID NO: 110480 - DNA, 22 bp, Homo sapiens
acaggatcgccctgttgcccag

SEQ ID NO: 110481 - DNA, 22 bp, Homo sapiens
cagtgcagccaaggacaggcac

SEQ ID NO: 110482 - DNA, 22 bp, Homo sapiens
ctcgcatccaggataccctgag

SEQ ID NO: 110483 - DNA, 21 bp, Homo sapiens
gctcctggtgctgcgtggcgc

SEQ ID NO: 110484 - DNA, 22 bp, Homo sapiens
gggaggttctgttcgcacttga

SEQ ID NO: 110485 - DNA, 21 bp, Homo sapiens
cactccacttagaacagggtt

SEQ ID NO: 110486 - DNA, 22 bp, Homo sapiens
ggctgggcctctccctcagctg

SEQ ID NO: 110487 - DNA, 22 bp, Homo sapiens
gcacagagagggaaggtaactt

SEQ ID NO: 110488 - DNA, 22 bp, Homo sapiens
cactgcactccagcctgggtga

SEQ ID NO: 110489 - DNA, 22 bp, Homo sapiens
catcttgtctttttgggcctga

SEQ ID NO: 110490 - DNA, 17 bp, Homo sapiens
gaggccaaggcaggcgg

SEQ ID NO: 110491 - DNA, 19 bp, Homo sapiens
tggctctgtcgaaggcaca

SEQ ID NO: 110492 - DNA, 19 bp, Homo sapiens
catctggatgattctcctg

SEQ ID NO: 110493 - DNA, 22 bp, Homo sapiens
aggaaataggaccagacaaagc

SEQ ID NO: 110494 - DNA, 22 bp, Homo sapiens
cttctgagatgttgttttacag

SEQ ID NO: 110495 - DNA, 22 bp, Homo sapiens
atacttctttagcatattgaac

SEQ ID NO: 110496 - DNA, 22 bp, Homo sapiens
aagatacagacagagccaaaat

SEQ ID NO: 110497 - DNA, 22 bp, Homo sapiens
tggtgggctgagtctcatcgga

SEQ ID NO: 110498 - DNA, 22 bp, Homo sapiens
aagaggagaaaggctggctttg

SEQ ID NO: 110499 - DNA, 19 bp, Homo sapiens
gcataaatacactattgtc

SEQ ID NO: 110500 - DNA, 18 bp, Homo sapiens
gcctggcttcggagccgc

SEQ ID NO: 110501 - DNA, 20 bp, Homo sapiens
aaaatatgtataactcttct

SEQ ID NO: 110502 - DNA, 22 bp, Homo sapiens
accccaggaagtggaggtcatg

SEQ ID NO: 110503 - DNA, 16 bp, Homo sapiens
gcagaggaaaggggag

SEQ ID NO: 110504 - DNA, 22 bp, Homo sapiens
ggacagccgagtggccttctcc

SEQ ID NO: 110505 - DNA, 22 bp, Homo sapiens
aagcgccatggttcctgcgcag

SEQ ID NO: 110506 - DNA, 22 bp, Homo sapiens
gctgtagtgaatggccgcgttc

SEQ ID NO: 110507 - DNA, 22 bp, Homo sapiens
gagcagtgccaaagaatttgcg

SEQ ID NO: 110508 - DNA, 20 bp, Homo sapiens
tttgcgaggccaaggcgggc

SEQ ID NO: 110509 - DNA, 22 bp, Homo sapiens
cccaggaggttgaggctgcagt

SEQ ID NO: 110510 - DNA, 22 bp, Homo sapiens
ctggctcgcattatattttggg

SEQ ID NO: 110511 - DNA, 22 bp, Homo sapiens
cagatgtacatgaagggcaatg

SEQ ID NO: 110512 - DNA, 22 bp, Homo sapiens
tggtctgctgaacagccgtatc

SEQ ID NO: 110513 - DNA, 22 bp, Homo sapiens
caccttggccttgctatttctc

SEQ ID NO: 110514 - DNA, 22 bp, Homo sapiens
cagagctggtgtgtcctggcat

SEQ ID NO: 110515 - DNA, 23 bp, Homo sapiens
atgggccaagcaagacccatgac

SEQ ID NO: 110516 - DNA, 22 bp, Homo sapiens
gtctatgatattttgttatagc

SEQ ID NO: 110517 - DNA, 22 bp, Homo sapiens
aaggctgaggcagtgaggcaga

SEQ ID NO: 110518 - DNA, 23 bp, Homo sapiens
gtcacagtgggtggtgcctacat

SEQ ID NO: 110519 - DNA, 22 bp, Homo sapiens
gcggggcctgactctgacccgc

SEQ ID NO: 110520 - DNA, 22 bp, Homo sapiens
aaagaaggtagggctggtgact

SEQ ID NO: 110521 - DNA, 22 bp, Homo sapiens
agcttgtgctggaattacatgt

SEQ ID NO: 110522 - DNA, 22 bp, Homo sapiens
aggtcctcgtcgtgctgggcca

SEQ ID NO: 110523 - DNA, 22 bp, Homo sapiens
agaaggggcccaaggatgtcag

SEQ ID NO: 110524 - DNA, 22 bp, Homo sapiens
cccaggaggcctgcctggccgg

SEQ ID NO: 110525 - DNA, 22 bp, Homo sapiens
tgagtggacacctgcttcttta

SEQ ID NO: 110526 - DNA, 22 bp, Homo sapiens
ctcccagccttcgccagtctga

SEQ ID NO: 110527 - DNA, 22 bp, Homo sapiens
tctgcaggaagctggcggctga

SEQ ID NO: 110528 - DNA, 22 bp, Homo sapiens
ctggtagctcctgaatatccct

SEQ ID NO: 110529 - DNA, 22 bp, Homo sapiens
ggtcagaggtcccagaagaagc

SEQ ID NO: 110530 - DNA, 22 bp, Homo sapiens
tggaagggagctggaatttgga

SEQ ID NO: 110531 - DNA, 22 bp, Homo sapiens
cgccaggcttggtagctcatgc

SEQ ID NO: 110532 - DNA, 21 bp, Homo sapiens
atgtagggtttgccttctcta

SEQ ID NO: 110533 - DNA, 22 bp, Homo sapiens
tggcacagcctccatgtcgtcc

SEQ ID NO: 110534 - DNA, 22 bp, Homo sapiens
gtctctatcatagctgaaccct

SEQ ID NO: 110535 - DNA, 22 bp, Homo sapiens
ttgtgttaaggtgcatctagtg

SEQ ID NO: 110536 - DNA, 22 bp, Homo sapiens
cctgtctctgcagggccctgcc

SEQ ID NO: 110537 - DNA, 22 bp, Homo sapiens
agacattttcgttggagaggtt

SEQ ID NO: 110538 - DNA, 22 bp, Homo sapiens
tacaaaggaggtgcatagaaca

SEQ ID NO: 110539 - DNA, 22 bp, Homo sapiens
gctccggcttggtgtgcagggt

SEQ ID NO: 110540 - DNA, 22 bp, Homo sapiens
cccaggaggtggagcttgcagt

SEQ ID NO: 110541 - DNA, 22 bp, Homo sapiens
tccacttccacgtgtgcagaat

SEQ ID NO: 110542 - DNA, 22 bp, Homo sapiens
actgcacttcagcctgggtgtc

SEQ ID NO: 110543 - DNA, 22 bp, Homo sapiens
gttactcttgagaggctgaggt

SEQ ID NO: 110544 - DNA, 22 bp, Homo sapiens
tttctggcagcgggacaggggt

SEQ ID NO: 110545 - DNA, 22 bp, Homo sapiens
ttcccttaaattatggcatcta

SEQ ID NO: 110546 - DNA, 21 bp, Homo sapiens
tggtacaccttgcctgtcaga

SEQ ID NO: 110547 - DNA, 22 bp, Homo sapiens
tattactgtcaatatcacagaa

SEQ ID NO: 110548 - DNA, 22 bp, Homo sapiens
aatgccttggagagcctagagg

SEQ ID NO: 110549 - DNA, 22 bp, Homo sapiens
gtctccggccgccctggtgctg

SEQ ID NO: 110550 - DNA, 22 bp, Homo sapiens
cgcgctgcagacagcggaggcc

SEQ ID NO: 110551 - DNA, 22 bp, Homo sapiens
tggagccagagcgcagcctggg

SEQ ID NO: 110552 - DNA, 22 bp, Homo sapiens
taggtcagaacaagcagtatcg

SEQ ID NO: 110553 - DNA, 22 bp, Homo sapiens
ccccgaggctggagtgcagtgg

SEQ ID NO: 110554 - DNA, 22 bp, Homo sapiens
cacccaggttggagtgcagtgg

SEQ ID NO: 110555 - DNA, 22 bp, Homo sapiens
catagacagatggtaagaagct

SEQ ID NO: 110556 - DNA, 22 bp, Homo sapiens
gatatcatgggaaggtgtactt

SEQ ID NO: 110557 - DNA, 22 bp, Homo sapiens
aaaggtcaaaatcgtgacattg

SEQ ID NO: 110558 - DNA, 21 bp, Homo sapiens
ctggccactgcacctcttcct

SEQ ID NO: 110559 - DNA, 22 bp, Homo sapiens
gaggtaggtgtaggaggcctgc

SEQ ID NO: 110560 - DNA, 22 bp, Homo sapiens
gagcctggagctggaacgaagc

SEQ ID NO: 110561 - DNA, 22 bp, Homo sapiens
ctctccattccctacagttttc

SEQ ID NO: 110562 - DNA, 22 bp, Homo sapiens
cccctcttggcattgagtgcca

SEQ ID NO: 110563 - DNA, 22 bp, Homo sapiens
ttcctggtctatttagaattgc

SEQ ID NO: 110564 - DNA, 21 bp, Homo sapiens
tttcttaggctctaaaatgac

SEQ ID NO: 110565 - DNA, 22 bp, Homo sapiens
ggctgggctccgggagcatgcg

SEQ ID NO: 110566 - DNA, 22 bp, Homo sapiens
tgcgccatgtgctctcggccct

SEQ ID NO: 110567 - DNA, 22 bp, Homo sapiens
acccaggctggagtgcagtggc

SEQ ID NO: 110568 - DNA, 22 bp, Homo sapiens
ttctccgctaagttctctgcag

SEQ ID NO: 110569 - DNA, 22 bp, Homo sapiens
gcgccccatctacagtactttt

SEQ ID NO: 110570 - DNA, 22 bp, Homo sapiens
cccgggaggcagaggttgcagt

SEQ ID NO: 110571 - DNA, 22 bp, Homo sapiens
tggagccagcggcctgctgagg

SEQ ID NO: 110572 - DNA, 22 bp, Homo sapiens
agagtccctcttcccaggaggc

SEQ ID NO: 110573 - DNA, 22 bp, Homo sapiens
taccagggaacagggatattaa

SEQ ID NO: 110574 - DNA, 22 bp, Homo sapiens
gggaggaggaatgttttgtgta

SEQ ID NO: 110575 - DNA, 22 bp, Homo sapiens
tgacagtgcgggtacatcatag

SEQ ID NO: 110576 - DNA, 21 bp, Homo sapiens
cagagctgtccaaaccctgac

SEQ ID NO: 110577 - DNA, 18 bp, Homo sapiens
actctttctgcccacagg

SEQ ID NO: 110578 - DNA, 22 bp, Homo sapiens
gaatttcacaaggtgaggataa

SEQ ID NO: 110579 - DNA, 22 bp, Homo sapiens
ctcagtgaattggaggatggcc

SEQ ID NO: 110580 - DNA, 22 bp, Homo sapiens
ggccagaagttggaaaagagcc

SEQ ID NO: 110581 - DNA, 21 bp, Homo sapiens
tgactgaggcttcttcacaca

SEQ ID NO: 110582 - DNA, 22 bp, Homo sapiens
cgggcccgagcacggcacccac

SEQ ID NO: 110583 - DNA, 22 bp, Homo sapiens
ggggttaacagtattgctcatg

SEQ ID NO: 110584 - DNA, 23 bp, Homo sapiens
ctcctcgtaactctgtggtgggt

SEQ ID NO: 110585 - DNA, 22 bp, Homo sapiens
ggtggcagtagcactgggcctg

SEQ ID NO: 110586 - DNA, 22 bp, Homo sapiens
acaaccaagaacagagggaaag

SEQ ID NO: 110587 - DNA, 18 bp, Homo sapiens
tggaggaaaaatctcatg

SEQ ID NO: 110588 - DNA, 22 bp, Homo sapiens
ctggtaggggtgactgttatcg

SEQ ID NO: 110589 - DNA, 22 bp, Homo sapiens
ttttaatactgctattgtagga

SEQ ID NO: 110590 - DNA, 22 bp, Homo sapiens
tggaatgtcagctacaagaggg

SEQ ID NO: 110591 - DNA, 22 bp, Homo sapiens
gttgacagtgaccctgaaagca

SEQ ID NO: 110592 - DNA, 22 bp, Homo sapiens
gtagtcccagctaccccggagg

SEQ ID NO: 110593 - DNA, 22 bp, Homo sapiens
agtcaaagatgaccgagttcct

SEQ ID NO: 110594 - DNA, 22 bp, Homo sapiens
cagcctgccgtcagccaggtag

SEQ ID NO: 110595 - DNA, 21 bp, Homo sapiens
gcagcagtgttctagaatact

SEQ ID NO: 110596 - DNA, 18 bp, Homo sapiens
tggtcactgtggatagtg

SEQ ID NO: 110597 - DNA, 22 bp, Homo sapiens
catggtgggtgtagtttccgcc

SEQ ID NO: 110598 - DNA, 22 bp, Homo sapiens
tcaccttgtgatctccctgcct

SEQ ID NO: 110599 - DNA, 22 bp, Homo sapiens
atttttctctttccactgagat

SEQ ID NO: 110600 - DNA, 22 bp, Homo sapiens
ctgctttgcatagctgccagag

SEQ ID NO: 110601 - DNA, 22 bp, Homo sapiens
tgcgcctctaatctcgggcgtc

SEQ ID NO: 110602 - DNA, 22 bp, Homo sapiens
gaggcacagagtaggtgcacac

SEQ ID NO: 110603 - DNA, 21 bp, Homo sapiens
aggcttggatctagacaggcc

SEQ ID NO: 110604 - DNA, 22 bp, Homo sapiens
gcaggcggaggttgcagtgagc

SEQ ID NO: 110605 - DNA, 22 bp, Homo sapiens
tggctgtgtccctgtccagagt

SEQ ID NO: 110606 - DNA, 22 bp, Homo sapiens
atgtgtattacctcgattgtga

SEQ ID NO: 110607 - DNA, 22 bp, Homo sapiens
cagggcctcctaaggcatctaa

SEQ ID NO: 110608 - DNA, 22 bp, Homo sapiens
ttccgctgtttagttgaagttt

SEQ ID NO: 110609 - DNA, 22 bp, Homo sapiens
ggagaccagaaggaagcttcga

SEQ ID NO: 110610 - DNA, 22 bp, Homo sapiens
gcaaatacatgttgagcaccta

SEQ ID NO: 110611 - DNA, 22 bp, Homo sapiens
agccacacttgccaggggaagg

SEQ ID NO: 110612 - DNA, 22 bp, Homo sapiens
cactgcaccctcaaactcctgg

SEQ ID NO: 110613 - DNA, 22 bp, Homo sapiens
taacatttaaatttttcacata

SEQ ID NO: 110614 - DNA, 22 bp, Homo sapiens
caagtgatcctcccatcttggc

SEQ ID NO: 110615 - DNA, 22 bp, Homo sapiens
tgtttcttacgtttttagaggc

SEQ ID NO: 110616 - DNA, 21 bp, Homo sapiens
tactgtagccttgcactgtag

SEQ ID NO: 110617 - DNA, 17 bp, Homo sapiens
aggaggccctggcgttt

SEQ ID NO: 110618 - DNA, 22 bp, Homo sapiens
gtgtttgttcgtgactccaaag

SEQ ID NO: 110619 - DNA, 23 bp, Homo sapiens
aggtaggttattgctgctacctg

SEQ ID NO: 110620 - DNA, 22 bp, Homo sapiens
tctgacattagattaattggaa

SEQ ID NO: 110621 - DNA, 22 bp, Homo sapiens
ttagatttgtagtgagttcaga

SEQ ID NO: 110622 - DNA, 23 bp, Homo sapiens
aatgggtgcaactatccatgaca

SEQ ID NO: 110623 - DNA, 22 bp, Homo sapiens
tgggcagggagctggaaccaca

SEQ ID NO: 110624 - DNA, 22 bp, Homo sapiens
tgtagtagcattcacgaagtgt

SEQ ID NO: 110625 - DNA, 19 bp, Homo sapiens
agtgagtgtacagtagaat

SEQ ID NO: 110626 - DNA, 22 bp, Homo sapiens
cgcccaggctggagtgcagtgg

SEQ ID NO: 110627 - DNA, 22 bp, Homo sapiens
agcatgcgcttgatcagctcca

SEQ ID NO: 110628 - DNA, 21 bp, Homo sapiens
aggtgctggcgccccaggaga

SEQ ID NO: 110629 - DNA, 22 bp, Homo sapiens
ctggaggtgcttcgctggccac

SEQ ID NO: 110630 - DNA, 22 bp, Homo sapiens
tttcacagaggaggaagctgag

SEQ ID NO: 110631 - DNA, 22 bp, Homo sapiens
acaagcatgggctttgacatca

SEQ ID NO: 110632 - DNA, 22 bp, Homo sapiens
ctcactgcaacctctgcctccc

SEQ ID NO: 110633 - DNA, 22 bp, Homo sapiens
gtgctggggagataggaagaga

SEQ ID NO: 110634 - DNA, 22 bp, Homo sapiens
agagctccagggttttgtagtg

SEQ ID NO: 110635 - DNA, 22 bp, Homo sapiens
aaagcagaggttgcagtgagct

SEQ ID NO: 110636 - DNA, 22 bp, Homo sapiens
ggaagaaaggtggacaacaggt

SEQ ID NO: 110637 - DNA, 22 bp, Homo sapiens
ggaagggcaaaagagatgaact

SEQ ID NO: 110638 - DNA, 22 bp, Homo sapiens
tcttcattttacaggcagacct

SEQ ID NO: 110639 - DNA, 20 bp, Homo sapiens
agcggctggcggaggacacg

SEQ ID NO: 110640 - DNA, 22 bp, Homo sapiens
caggctggagtgcagtggcgct

SEQ ID NO: 110641 - DNA, 22 bp, Homo sapiens
aggcctgaggaccagataaatg

SEQ ID NO: 110642 - DNA, 22 bp, Homo sapiens
cgtctctggcccggcccctggg

SEQ ID NO: 110643 - DNA, 22 bp, Homo sapiens
gcaggtccagtcaccagagaga

SEQ ID NO: 110644 - DNA, 22 bp, Homo sapiens
gggcggatcacctgaggtcagg

SEQ ID NO: 110645 - DNA, 22 bp, Homo sapiens
ggggccgaccgcggttcaggcc

SEQ ID NO: 110646 - DNA, 22 bp, Homo sapiens
ccttcccacattccttacatgc

SEQ ID NO: 110647 - DNA, 22 bp, Homo sapiens
ctggggaacgcagcgagcagcg

SEQ ID NO: 110648 - DNA, 22 bp, Homo sapiens
atataatttttggttagctcaa

SEQ ID NO: 110649 - DNA, 22 bp, Homo sapiens
caggcgctgtggctcccacctg

SEQ ID NO: 110650 - DNA, 22 bp, Homo sapiens
gggagctggagctggaagactc

SEQ ID NO: 110651 - DNA, 22 bp, Homo sapiens
tggagataggctgaggcagggc

SEQ ID NO: 110652 - DNA, 22 bp, Homo sapiens
aaacatctactgtaggctggag

SEQ ID NO: 110653 - DNA, 22 bp, Homo sapiens
cctagagctctgctttatctaa

SEQ ID NO: 110654 - DNA, 22 bp, Homo sapiens
aacccaggaggtggaggttgtg

SEQ ID NO: 110655 - DNA, 18 bp, Homo sapiens
tctgccccagccgcactg

SEQ ID NO: 110656 - DNA, 22 bp, Homo sapiens
caaagcaggaagctcctgacag

SEQ ID NO: 110657 - DNA, 22 bp, Homo sapiens
cccaaagcagttgatgtaccag

SEQ ID NO: 110658 - DNA, 22 bp, Homo sapiens
agatttggtgtctggttgatat

SEQ ID NO: 110659 - DNA, 22 bp, Homo sapiens
ggaggtggagctggaagttcca

SEQ ID NO: 110660 - DNA, 22 bp, Homo sapiens
atttcagcagcccatgtttgga

SEQ ID NO: 110661 - DNA, 22 bp, Homo sapiens
ttacttaaacagaaatgcagaa

SEQ ID NO: 110662 - DNA, 22 bp, Homo sapiens
tctgaggaactggcaaagatgg

SEQ ID NO: 110663 - DNA, 18 bp, Homo sapiens
cagggctgtggggtcact

SEQ ID NO: 110664 - DNA, 22 bp, Homo sapiens
ggaggctgaggcaggcggatca

SEQ ID NO: 110665 - DNA, 22 bp, Homo sapiens
gattgagtctgaggatgctgca

SEQ ID NO: 110666 - DNA, 22 bp, Homo sapiens
tttgttttcaatgtgtcattca

SEQ ID NO: 110667 - DNA, 22 bp, Homo sapiens
atgccactgcactccagcctgg

SEQ ID NO: 110668 - DNA, 22 bp, Homo sapiens
caggctggagtgcaatgacgcc

SEQ ID NO: 110669 - DNA, 22 bp, Homo sapiens
ttcacagtggtagtgcatttag

SEQ ID NO: 110670 - DNA, 21 bp, Homo sapiens
ggcctcccggaccgcagcgcc

SEQ ID NO: 110671 - DNA, 22 bp, Homo sapiens
tgatgggaggtgctgcaggacc

SEQ ID NO: 110672 - DNA, 22 bp, Homo sapiens
tgagcctgggtggtcgaggctg

SEQ ID NO: 110673 - DNA, 22 bp, Homo sapiens
acatcctcccgatctactggct

SEQ ID NO: 110674 - DNA, 22 bp, Homo sapiens
agaggaagtaatcaggacctgc

SEQ ID NO: 110675 - DNA, 22 bp, Homo sapiens
caggctggagtgcagtggggcg

SEQ ID NO: 110676 - DNA, 22 bp, Homo sapiens
gctcgcgccgcaccggtccacc

SEQ ID NO: 110677 - DNA, 22 bp, Homo sapiens
gctgtggcctggcgcagagctg

SEQ ID NO: 110678 - DNA, 22 bp, Homo sapiens
ttaggctgttcttgtgttgtta

SEQ ID NO: 110679 - DNA, 22 bp, Homo sapiens
cctgagagcattccacactgaa

SEQ ID NO: 110680 - DNA, 22 bp, Homo sapiens
aggcggaagatggccccataga

SEQ ID NO: 110681 - DNA, 22 bp, Homo sapiens
tcccgttgatgacggtgcatcc

SEQ ID NO: 110682 - DNA, 22 bp, Homo sapiens
agggccagcactcctggcagga

SEQ ID NO: 110683 - DNA, 22 bp, Homo sapiens
tcctccactttgtctagcaaca

SEQ ID NO: 110684 - DNA, 22 bp, Homo sapiens
cctgtgcttggccagagaggtt

SEQ ID NO: 110685 - DNA, 20 bp, Homo sapiens
tgggtgaagacagctgtagc

SEQ ID NO: 110686 - DNA, 22 bp, Homo sapiens
tgctccagcaccaagagctcca

SEQ ID NO: 110687 - DNA, 22 bp, Homo sapiens
atgccactgcacttcagcttgg

SEQ ID NO: 110688 - DNA, 22 bp, Homo sapiens
gcaggcaggcttccttgaactg

SEQ ID NO: 110689 - DNA, 22 bp, Homo sapiens
cccaggaggcagagcttgcagt

SEQ ID NO: 110690 - DNA, 22 bp, Homo sapiens
ttgcaattgctatggagagcgt

SEQ ID NO: 110691 - DNA, 22 bp, Homo sapiens
gctcactgcaagctctgcctcc

SEQ ID NO: 110692 - DNA, 22 bp, Homo sapiens
acgcctgtaatcccagcacttt

SEQ ID NO: 110693 - DNA, 22 bp, Homo sapiens
agggcagagctgtctaaatggc

SEQ ID NO: 110694 - DNA, 22 bp, Homo sapiens
caggaggagggcagccgcctcc

SEQ ID NO: 110695 - DNA, 22 bp, Homo sapiens
ccatcacagtccccatcgtgat

SEQ ID NO: 110696 - DNA, 22 bp, Homo sapiens
taggttttcctaaaattctggt

SEQ ID NO: 110697 - DNA, 22 bp, Homo sapiens
cacccaggctggagtgcagtga

SEQ ID NO: 110698 - DNA, 22 bp, Homo sapiens
cacccaggctggaatgcagtgg

SEQ ID NO: 110699 - DNA, 19 bp, Homo sapiens
ggggcccggggtctgcgag

SEQ ID NO: 110700 - DNA, 22 bp, Homo sapiens
gaccacacttttcccctgctag

SEQ ID NO: 110701 - DNA, 22 bp, Homo sapiens
tctcttgagctcagttctgatg

SEQ ID NO: 110702 - DNA, 22 bp, Homo sapiens
ctgaggctggagtgcagtggtg

SEQ ID NO: 110703 - DNA, 22 bp, Homo sapiens
aatgactaaatctgaagatagg

SEQ ID NO: 110704 - DNA, 22 bp, Homo sapiens
ggcctttgcgtccacgccgctt

SEQ ID NO: 110705 - DNA, 22 bp, Homo sapiens
cttggtgccacagcagcttgcg

SEQ ID NO: 110706 - DNA, 22 bp, Homo sapiens
tctgccttttactagctggatg

SEQ ID NO: 110707 - DNA, 22 bp, Homo sapiens
atatattttttgagacagagtc

SEQ ID NO: 110708 - DNA, 22 bp, Homo sapiens
gcaggtggatcaccacgtcagg

SEQ ID NO: 110709 - DNA, 22 bp, Homo sapiens
gacggagctggttgctgcggct

SEQ ID NO: 110710 - DNA, 17 bp, Homo sapiens
cccgttctcttcgctgg

SEQ ID NO: 110711 - DNA, 22 bp, Homo sapiens
tgtcttcaggagtaaatatcat

SEQ ID NO: 110712 - DNA, 22 bp, Homo sapiens
tgattcatcagaataggagttt

SEQ ID NO: 110713 - DNA, 22 bp, Homo sapiens
gccaggcgggtctcaaactcct

SEQ ID NO: 110714 - DNA, 22 bp, Homo sapiens
cacccaggcaaggattctgcaa

SEQ ID NO: 110715 - DNA, 22 bp, Homo sapiens
ggtcacgtgaccgcacctgcct

SEQ ID NO: 110716 - DNA, 22 bp, Homo sapiens
ttgcactccagtctgggaacaa

SEQ ID NO: 110717 - DNA, 22 bp, Homo sapiens
atttacaggtagaattttaagt

SEQ ID NO: 110718 - DNA, 22 bp, Homo sapiens
aagagggctgcaatcttattgc

SEQ ID NO: 110719 - DNA, 22 bp, Homo sapiens
agcccttagtacatttctcaag

SEQ ID NO: 110720 - DNA, 22 bp, Homo sapiens
ttaagctagtgaagtccctcaa

SEQ ID NO: 110721 - DNA, 22 bp, Homo sapiens
gtgcgggcctgggggtttctct

SEQ ID NO: 110722 - DNA, 22 bp, Homo sapiens
aggagccagtggagttcctgcc

SEQ ID NO: 110723 - DNA, 22 bp, Homo sapiens
ccaggtagccaaggggtctggg

SEQ ID NO: 110724 - DNA, 22 bp, Homo sapiens
atgcagaagactgaaaagctga

SEQ ID NO: 110725 - DNA, 22 bp, Homo sapiens
tggtggcgggcagggccgtcac

SEQ ID NO: 110726 - DNA, 22 bp, Homo sapiens
atttcacttagtgtaatgtctt

SEQ ID NO: 110727 - DNA, 23 bp, Homo sapiens
gacagagtgagaccttgtcttac

SEQ ID NO: 110728 - DNA, 22 bp, Homo sapiens
ttttcatttttgtagatgcaag

SEQ ID NO: 110729 - DNA, 22 bp, Homo sapiens
agaggccggccgagcccatggg

SEQ ID NO: 110730 - DNA, 22 bp, Homo sapiens
ggaggcggaagttgcagtgagc

SEQ ID NO: 110731 - DNA, 22 bp, Homo sapiens
taatactgtatactgcaaattt

SEQ ID NO: 110732 - DNA, 22 bp, Homo sapiens
tgtccttcttgtcttgcccaaa

SEQ ID NO: 110733 - DNA, 22 bp, Homo sapiens
atggtggacgggagacaggact

SEQ ID NO: 110734 - DNA, 22 bp, Homo sapiens
ctgagcctcctgcttctatttc

SEQ ID NO: 110735 - DNA, 18 bp, Homo sapiens
ccctgccagctcccagca

SEQ ID NO: 110736 - DNA, 18 bp, Homo sapiens
ggtgagggagctggaagc

SEQ ID NO: 110737 - DNA, 22 bp, Homo sapiens
ccactgtggaaagcagttcaga

SEQ ID NO: 110738 - DNA, 22 bp, Homo sapiens
acccaggagacggaggtgcagt

SEQ ID NO: 110739 - DNA, 22 bp, Homo sapiens
gattcactcatattttacgttt

SEQ ID NO: 110740 - DNA, 22 bp, Homo sapiens
cccgggaggtggaggttgcagt

SEQ ID NO: 110741 - DNA, 22 bp, Homo sapiens
tttggactgcatgatgatctgg

SEQ ID NO: 110742 - DNA, 22 bp, Homo sapiens
agaagcattggaccaggggccc

SEQ ID NO: 110743 - DNA, 22 bp, Homo sapiens
ttgtgaatagtgccgcaataaa

SEQ ID NO: 110744 - DNA, 22 bp, Homo sapiens
ctcactgcaagctcagcctccc

SEQ ID NO: 110745 - DNA, 22 bp, Homo sapiens
ctggaaggcagaggttgcagtg

SEQ ID NO: 110746 - DNA, 22 bp, Homo sapiens
tatttcttttcgtgacttattg

SEQ ID NO: 110747 - DNA, 22 bp, Homo sapiens
attgcaggctctgacaccaggc

SEQ ID NO: 110748 - DNA, 22 bp, Homo sapiens
cttgtcagccaattgtggattt

SEQ ID NO: 110749 - DNA, 22 bp, Homo sapiens
agcctgggcaacagagcaaaac

SEQ ID NO: 110750 - DNA, 22 bp, Homo sapiens
ctgaagcagggagtgatgaagt

SEQ ID NO: 110751 - DNA, 22 bp, Homo sapiens
ggtccccgtggaggctggagcg

SEQ ID NO: 110752 - DNA, 22 bp, Homo sapiens
agccaggatggtctcgatcggc

SEQ ID NO: 110753 - DNA, 22 bp, Homo sapiens
catggcagctcctccagtgtga

SEQ ID NO: 110754 - DNA, 22 bp, Homo sapiens
agtgaggggcagctgagtgggc

SEQ ID NO: 110755 - DNA, 22 bp, Homo sapiens
actgggaagtcagagagaggct

SEQ ID NO: 110756 - DNA, 22 bp, Homo sapiens
cagtggctggttagggacagga

SEQ ID NO: 110757 - DNA, 22 bp, Homo sapiens
aaagggaagttgcacatgttcc

SEQ ID NO: 110758 - DNA, 22 bp, Homo sapiens
gagcacgttgaagcgcactgtc

SEQ ID NO: 110759 - DNA, 17 bp, Homo sapiens
ttcttttctgagccttg

SEQ ID NO: 110760 - DNA, 22 bp, Homo sapiens
cgtcagggttgagcaggtagat

SEQ ID NO: 110761 - DNA, 22 bp, Homo sapiens
cgtctggcttctccacggtaaa

SEQ ID NO: 110762 - DNA, 22 bp, Homo sapiens
ccaggcaggcgatggtgcagtg

SEQ ID NO: 110763 - DNA, 22 bp, Homo sapiens
tgttcttaggtatttgacagtc

SEQ ID NO: 110764 - DNA, 22 bp, Homo sapiens
ccctgcctacagggttttcttt

SEQ ID NO: 110765 - DNA, 22 bp, Homo sapiens
tctgcaacattcctctccccac

SEQ ID NO: 110766 - DNA, 22 bp, Homo sapiens
cagggggctcaaaggagagtgc

SEQ ID NO: 110767 - DNA, 22 bp, Homo sapiens
tccaggtgggctgcacccaggc

SEQ ID NO: 110768 - DNA, 22 bp, Homo sapiens
attgtgtcctcattgaccttca

SEQ ID NO: 110769 - DNA, 20 bp, Homo sapiens
tgcagcacgggccctttcca

SEQ ID NO: 110770 - DNA, 22 bp, Homo sapiens
ctgagatctttatacgaggcac

SEQ ID NO: 110771 - DNA, 22 bp, Homo sapiens
gtatagaaacccagaaagatag

SEQ ID NO: 110772 - DNA, 22 bp, Homo sapiens
tggtttgtctaaatgagtaata

SEQ ID NO: 110773 - DNA, 16 bp, Homo sapiens
aggtggagaagttcac

SEQ ID NO: 110774 - DNA, 22 bp, Homo sapiens
gcagggtctgaggccacagagg

SEQ ID NO: 110775 - DNA, 22 bp, Homo sapiens
ctgctgaggtggagattgcagt

SEQ ID NO: 110776 - DNA, 22 bp, Homo sapiens
atttaagggatttggagaccaa

SEQ ID NO: 110777 - DNA, 22 bp, Homo sapiens
gcctcactgcagccccaggaag

SEQ ID NO: 110778 - DNA, 22 bp, Homo sapiens
agctggtgtgccagttccagtt

SEQ ID NO: 110779 - DNA, 19 bp, Homo sapiens
atcccaaggagctgggact

SEQ ID NO: 110780 - DNA, 22 bp, Homo sapiens
ctggcctggcgcagtggctcac

SEQ ID NO: 110781 - DNA, 22 bp, Homo sapiens
cactctgcgctgggcgccagcg

SEQ ID NO: 110782 - DNA, 22 bp, Homo sapiens
gggctgggattgcttgctgtga

SEQ ID NO: 110783 - DNA, 22 bp, Homo sapiens
ctcactgcaagttccacctacc

SEQ ID NO: 110784 - DNA, 22 bp, Homo sapiens
ggcgccgcactcggtgcagccg

SEQ ID NO: 110785 - DNA, 22 bp, Homo sapiens
agaaaacataggagacaggaaa

SEQ ID NO: 110786 - DNA, 22 bp, Homo sapiens
gttgaggagcaagcatgtgtct

SEQ ID NO: 110787 - DNA, 21 bp, Homo sapiens
ctggaggcaggtggtgccagg

SEQ ID NO: 110788 - DNA, 22 bp, Homo sapiens
tatactctgagaaacgtgtcac

SEQ ID NO: 110789 - DNA, 22 bp, Homo sapiens
gcggcggagacagcaggaagcc

SEQ ID NO: 110790 - DNA, 22 bp, Homo sapiens
aggtctgtttaacaaagtcagg

SEQ ID NO: 110791 - DNA, 22 bp, Homo sapiens
ccgccgtgtcgacaggccctgg

SEQ ID NO: 110792 - DNA, 22 bp, Homo sapiens
tacatttataaggcttctctgt

SEQ ID NO: 110793 - DNA, 22 bp, Homo sapiens
tgtgtgcatgcttggggcagca

SEQ ID NO: 110794 - DNA, 22 bp, Homo sapiens
ctgggaggcagaggttgtagtg

SEQ ID NO: 110795 - DNA, 22 bp, Homo sapiens
attgcactccagcctgggtgac

SEQ ID NO: 110796 - DNA, 22 bp, Homo sapiens
tgcagtggtacaatttcggctc

SEQ ID NO: 110797 - DNA, 22 bp, Homo sapiens
gctggcagacttcctctggaac

SEQ ID NO: 110798 - DNA, 22 bp, Homo sapiens
ccgggcctcgggacaccgggta

SEQ ID NO: 110799 - DNA, 22 bp, Homo sapiens
taaattgagattattagggtaa

SEQ ID NO: 110800 - DNA, 22 bp, Homo sapiens
gaggcctgggcaagggggtctg

SEQ ID NO: 110801 - DNA, 22 bp, Homo sapiens
agcccaggttgaggctgcagtg

SEQ ID NO: 110802 - DNA, 22 bp, Homo sapiens
cagtgatatttatcctactcac

SEQ ID NO: 110803 - DNA, 22 bp, Homo sapiens
aggacaaaggaccagatctgga

SEQ ID NO: 110804 - DNA, 20 bp, Homo sapiens
aaattactgccacacatttc

SEQ ID NO: 110805 - DNA, 21 bp, Homo sapiens
agaaggcaaaagcagacatct

SEQ ID NO: 110806 - DNA, 22 bp, Homo sapiens
ccggctactcgggaggctgacg

SEQ ID NO: 110807 - DNA, 22 bp, Homo sapiens
acagaactgggaaatgcacata

SEQ ID NO: 110808 - DNA, 22 bp, Homo sapiens
tcactgcaacctccacctcctg

SEQ ID NO: 110809 - DNA, 22 bp, Homo sapiens
gctctgccagcccaaggcgcag

SEQ ID NO: 110810 - DNA, 22 bp, Homo sapiens
aggtggaaatggctttcctagg

SEQ ID NO: 110811 - DNA, 22 bp, Homo sapiens
gctgctctcagagctcatgctg

SEQ ID NO: 110812 - DNA, 22 bp, Homo sapiens
attgattttcagactatgcgag

SEQ ID NO: 110813 - DNA, 18 bp, Homo sapiens
cccacggtgctgtagggc

SEQ ID NO: 110814 - DNA, 22 bp, Homo sapiens
ctcggcaggtggaggttgtagt

SEQ ID NO: 110815 - DNA, 22 bp, Homo sapiens
tcagtgtgaattcaggagccta

SEQ ID NO: 110816 - DNA, 22 bp, Homo sapiens
ctttaattgtagctcccataat

SEQ ID NO: 110817 - DNA, 22 bp, Homo sapiens
gtgggggctggaaatcttgcca

SEQ ID NO: 110818 - DNA, 22 bp, Homo sapiens
ggctctgcgcctgcggggactt

SEQ ID NO: 110819 - DNA, 22 bp, Homo sapiens
ggagtgcagtggtgggatctca

SEQ ID NO: 110820 - DNA, 22 bp, Homo sapiens
tatccaattcaccattgatggg

SEQ ID NO: 110821 - DNA, 22 bp, Homo sapiens
tctgcggtccccttctcgccct

SEQ ID NO: 110822 - DNA, 22 bp, Homo sapiens
gaattcttttctttctgaaagt

SEQ ID NO: 110823 - DNA, 22 bp, Homo sapiens
cgttaataggtgcaaggtaagg

SEQ ID NO: 110824 - DNA, 22 bp, Homo sapiens
aaaagagcttggttgattttgc

SEQ ID NO: 110825 - DNA, 22 bp, Homo sapiens
gaccaaggaagaggggagccag

SEQ ID NO: 110826 - DNA, 22 bp, Homo sapiens
tgcccaggctggagtacagtgg

SEQ ID NO: 110827 - DNA, 22 bp, Homo sapiens
aagtaaatatctgtagtcttta

SEQ ID NO: 110828 - DNA, 22 bp, Homo sapiens
agaggctgcacttgctcatgat

SEQ ID NO: 110829 - DNA, 21 bp, Homo sapiens
ccaggccaggcctacggggat

SEQ ID NO: 110830 - DNA, 22 bp, Homo sapiens
acccagggctcaagcgtaggca

SEQ ID NO: 110831 - DNA, 22 bp, Homo sapiens
aggccagcagcatgacggcatc

SEQ ID NO: 110832 - DNA, 22 bp, Homo sapiens
tgccgtggggctgaggctggag

SEQ ID NO: 110833 - DNA, 22 bp, Homo sapiens
ggtgacagtggttaaaatttgt

SEQ ID NO: 110834 - DNA, 22 bp, Homo sapiens
tttattctgtgctacatgaaga

SEQ ID NO: 110835 - DNA, 22 bp, Homo sapiens
tctgcgtgaaactagatggcag

SEQ ID NO: 110836 - DNA, 19 bp, Homo sapiens
agggaatccggctgaggga

SEQ ID NO: 110837 - DNA, 22 bp, Homo sapiens
gggtccagtagttggtggccgt

SEQ ID NO: 110838 - DNA, 22 bp, Homo sapiens
aatgttacgatcaacaacacat

SEQ ID NO: 110839 - DNA, 22 bp, Homo sapiens
actgtgaacggactgaagccca

SEQ ID NO: 110840 - DNA, 22 bp, Homo sapiens
cctggaggcggaggttgcagtg

SEQ ID NO: 110841 - DNA, 22 bp, Homo sapiens
tgcccaggctggagtgcagtgg

SEQ ID NO: 110842 - DNA, 22 bp, Homo sapiens
agcccaggctggagtgcagtgg

SEQ ID NO: 110843 - DNA, 22 bp, Homo sapiens
aaagcctcccaggttatgagta

SEQ ID NO: 110844 - DNA, 22 bp, Homo sapiens
tctcaagcttgttggtatgttt

SEQ ID NO: 110845 - DNA, 21 bp, Homo sapiens
taagagcctaacacagaaagg

SEQ ID NO: 110846 - DNA, 22 bp, Homo sapiens
caggagctcagatgacatctca

SEQ ID NO: 110847 - DNA, 22 bp, Homo sapiens
agagggcattaactctgtcttg

SEQ ID NO: 110848 - DNA, 22 bp, Homo sapiens
agagcgagtctggggctcggat

SEQ ID NO: 110849 - DNA, 22 bp, Homo sapiens
gtgccccagacacgcatgtggg

SEQ ID NO: 110850 - DNA, 22 bp, Homo sapiens
gccatgggcaaatgcagagctg

SEQ ID NO: 110851 - DNA, 22 bp, Homo sapiens
gcccagagtttgaagatacagt

SEQ ID NO: 110852 - DNA, 22 bp, Homo sapiens
aaccccgctcaggctgggtgag

SEQ ID NO: 110853 - DNA, 22 bp, Homo sapiens
gaaagacatagttgcaagatgg

SEQ ID NO: 110854 - DNA, 22 bp, Homo sapiens
ccagggtggcgtagatgctggg

SEQ ID NO: 110855 - DNA, 22 bp, Homo sapiens
caaagcccagaggcctcacttt

SEQ ID NO: 110856 - DNA, 22 bp, Homo sapiens
atgattgaaaatgacattgcca

SEQ ID NO: 110857 - DNA, 22 bp, Homo sapiens
atgccactgcgctccagcctgg

SEQ ID NO: 110858 - DNA, 22 bp, Homo sapiens
ggtgtccgcgctgtagaaggtc

SEQ ID NO: 110859 - DNA, 18 bp, Homo sapiens
gcactgaggaaaacctct

SEQ ID NO: 110860 - DNA, 22 bp, Homo sapiens
atgttgactcagagtgagggta

SEQ ID NO: 110861 - DNA, 22 bp, Homo sapiens
caattctgaggcctgctttgtt

SEQ ID NO: 110862 - DNA, 22 bp, Homo sapiens
aggaaggactccatggtccgtc

SEQ ID NO: 110863 - DNA, 22 bp, Homo sapiens
ctcctccacccgctggggccca

SEQ ID NO: 110864 - DNA, 22 bp, Homo sapiens
cgggcagcggcgtggccatggt

SEQ ID NO: 110865 - DNA, 22 bp, Homo sapiens
gcttagtcaattataaataggc

SEQ ID NO: 110866 - DNA, 22 bp, Homo sapiens
agggctgcccagtgtgagagct

SEQ ID NO: 110867 - DNA, 22 bp, Homo sapiens
aggcgggttcagggctgccatg

SEQ ID NO: 110868 - DNA, 22 bp, Homo sapiens
ggtgatccaccagcctcggcct

SEQ ID NO: 110869 - DNA, 22 bp, Homo sapiens
gcctccccaagcagcagggatt

SEQ ID NO: 110870 - DNA, 22 bp, Homo sapiens
ggctccccaggtccaggagctg

SEQ ID NO: 110871 - DNA, 22 bp, Homo sapiens
atggatttgcttatacacatgt

SEQ ID NO: 110872 - DNA, 22 bp, Homo sapiens
actttatttcctattgcatcca

SEQ ID NO: 110873 - DNA, 22 bp, Homo sapiens
tgtgacctcatcttaactggaa

SEQ ID NO: 110874 - DNA, 22 bp, Homo sapiens
ctgattgagaaggaaggggatc

SEQ ID NO: 110875 - DNA, 22 bp, Homo sapiens
ttcctagggcagagccgctggg

SEQ ID NO: 110876 - DNA, 22 bp, Homo sapiens
cttcatgctgatatcctcgatg

SEQ ID NO: 110877 - DNA, 22 bp, Homo sapiens
ctggcctcggcagcaggaacag

SEQ ID NO: 110878 - DNA, 22 bp, Homo sapiens
tgaagttgttaaggttgccatt

SEQ ID NO: 110879 - DNA, 22 bp, Homo sapiens
cggccaagccggggccccgaag

SEQ ID NO: 110880 - DNA, 22 bp, Homo sapiens
atgccacttcattccagcctcg

SEQ ID NO: 110881 - DNA, 22 bp, Homo sapiens
tgatattttatgagctttcata

SEQ ID NO: 110882 - DNA, 23 bp, Homo sapiens
caggagatggctgctgtgtcagc

SEQ ID NO: 110883 - DNA, 22 bp, Homo sapiens
gtttcgtcaggcttattctatc

SEQ ID NO: 110884 - DNA, 22 bp, Homo sapiens
ttccgagggctcggcggccgcc

SEQ ID NO: 110885 - DNA, 22 bp, Homo sapiens
gcagtatctatgtgatgggttg

SEQ ID NO: 110886 - DNA, 22 bp, Homo sapiens
gttcccaccatgctgcacccat

SEQ ID NO: 110887 - DNA, 22 bp, Homo sapiens
gcgtctcaaggcccccaggcca

SEQ ID NO: 110888 - DNA, 23 bp, Homo sapiens
ttgcttagagacctcctcatcag

SEQ ID NO: 110889 - DNA, 22 bp, Homo sapiens
gaggctggacgtgcatttctac

SEQ ID NO: 110890 - DNA, 18 bp, Homo sapiens
cttgttcttctcttggcg

SEQ ID NO: 110891 - DNA, 21 bp, Homo sapiens
atcagggatgggttggacacc

SEQ ID NO: 110892 - DNA, 22 bp, Homo sapiens
ttggatgagagggtgtggtaca

SEQ ID NO: 110893 - DNA, 22 bp, Homo sapiens
attgttgggtctcactcctaga

SEQ ID NO: 110894 - DNA, 22 bp, Homo sapiens
ggccgctctccggtgtggatct

SEQ ID NO: 110895 - DNA, 22 bp, Homo sapiens
gggttcagtccctcttgctact

SEQ ID NO: 110896 - DNA, 22 bp, Homo sapiens
gatactcttcaggtcttgcaga

SEQ ID NO: 110897 - DNA, 21 bp, Homo sapiens
cgtgactgggtccgtctggct

SEQ ID NO: 110898 - DNA, 22 bp, Homo sapiens
ctgggaggcagaggttgcagtg

SEQ ID NO: 110899 - DNA, 21 bp, Homo sapiens
cttccccaggctggtctgtat

SEQ ID NO: 110900 - DNA, 22 bp, Homo sapiens
aaagcagaactgagagagctgg

SEQ ID NO: 110901 - DNA, 22 bp, Homo sapiens
taattataacagttacatctta

SEQ ID NO: 110902 - DNA, 22 bp, Homo sapiens
tgtgggagaaggaagcaagctg

SEQ ID NO: 110903 - DNA, 22 bp, Homo sapiens
tgtcagtgtctatgaagaattt

SEQ ID NO: 110904 - DNA, 22 bp, Homo sapiens
acaggggattgattggaagtct

SEQ ID NO: 110905 - DNA, 22 bp, Homo sapiens
ttgtggttaaccgcacattttt

SEQ ID NO: 110906 - DNA, 22 bp, Homo sapiens
ttcctttctctggactgcagcc

SEQ ID NO: 110907 - DNA, 22 bp, Homo sapiens
ccacagtcctggcttctgtctg

SEQ ID NO: 110908 - DNA, 22 bp, Homo sapiens
gaagccagtgtttgaagaattt

SEQ ID NO: 110909 - DNA, 22 bp, Homo sapiens
tagatctgatacaattcatctg

SEQ ID NO: 110910 - DNA, 22 bp, Homo sapiens
gggccaccccactgcccacgct

SEQ ID NO: 110911 - DNA, 22 bp, Homo sapiens
cacccaggctggattgcagtgg

SEQ ID NO: 110912 - DNA, 22 bp, Homo sapiens
cctgacgaaaggcgtgctggag

SEQ ID NO: 110913 - DNA, 22 bp, Homo sapiens
tattgagaccagtgcttgctta

SEQ ID NO: 110914 - DNA, 22 bp, Homo sapiens
ctctgcctgtctcatcctgcaa

SEQ ID NO: 110915 - DNA, 22 bp, Homo sapiens
gtgccgcgacgcagtcggtgcc

SEQ ID NO: 110916 - DNA, 19 bp, Homo sapiens
gcctcatttccacctcccc

SEQ ID NO: 110917 - DNA, 22 bp, Homo sapiens
gcggggcccggacccagcctct

SEQ ID NO: 110918 - DNA, 22 bp, Homo sapiens
gtgcatgtgtctttatagtagc

SEQ ID NO: 110919 - DNA, 22 bp, Homo sapiens
cagaggatatactatctggaaa

SEQ ID NO: 110920 - DNA, 22 bp, Homo sapiens
cggaggttgaggctgcagtgag

SEQ ID NO: 110921 - DNA, 22 bp, Homo sapiens
gtggcatgaaagcatctgtgat

SEQ ID NO: 110922 - DNA, 22 bp, Homo sapiens
ggggtgtggacggctgtgccag

SEQ ID NO: 110923 - DNA, 22 bp, Homo sapiens
agttattactctttaacatatt

SEQ ID NO: 110924 - DNA, 22 bp, Homo sapiens
tgactctgataagacatatggc

SEQ ID NO: 110925 - DNA, 22 bp, Homo sapiens
cacatttttactgccaacttaa

SEQ ID NO: 110926 - DNA, 22 bp, Homo sapiens
tccataaattttatgaacatat

SEQ ID NO: 110927 - DNA, 22 bp, Homo sapiens
aggggaggtgtccccaaatctc

SEQ ID NO: 110928 - DNA, 23 bp, Homo sapiens
cagtacaatgtggaaaaggagtg

SEQ ID NO: 110929 - DNA, 22 bp, Homo sapiens
actggccagccaacaacaatag

SEQ ID NO: 110930 - DNA, 22 bp, Homo sapiens
cctcgcggcactcgggccggat

SEQ ID NO: 110931 - DNA, 22 bp, Homo sapiens
gagatatgttggcagctggtat

SEQ ID NO: 110932 - DNA, 22 bp, Homo sapiens
ggagcagggaattacagcgcag

SEQ ID NO: 110933 - DNA, 22 bp, Homo sapiens
cacctagggtttcgcctttctt

SEQ ID NO: 110934 - DNA, 22 bp, Homo sapiens
ccatgtacatgaacacggcggc

SEQ ID NO: 110935 - DNA, 22 bp, Homo sapiens
attcgcgggcctggagggtggg

SEQ ID NO: 110936 - DNA, 22 bp, Homo sapiens
cggccgcagcagtgtcggccca

SEQ ID NO: 110937 - DNA, 22 bp, Homo sapiens
agtcttagaactacagtgccta

SEQ ID NO: 110938 - DNA, 22 bp, Homo sapiens
cagtagatttggtaaactagga

SEQ ID NO: 110939 - DNA, 19 bp, Homo sapiens
ggagccgccgcccttcatt

SEQ ID NO: 110940 - DNA, 22 bp, Homo sapiens
tgtcagggatttccaactcccc

SEQ ID NO: 110941 - DNA, 18 bp, Homo sapiens
tcatgagaatagcagggg

SEQ ID NO: 110942 - DNA, 22 bp, Homo sapiens
cccaggggttctgagcagcagc

SEQ ID NO: 110943 - DNA, 22 bp, Homo sapiens
tgcagtttaaacttggcaactt

SEQ ID NO: 110944 - DNA, 22 bp, Homo sapiens
tccctctacagggaagcgcttt

SEQ ID NO: 110945 - DNA, 22 bp, Homo sapiens
ctctggagtgtctggccagggt

SEQ ID NO: 110946 - DNA, 22 bp, Homo sapiens
cagcagcagtggctgcagaaca

SEQ ID NO: 110947 - DNA, 22 bp, Homo sapiens
gcccaggctggagtgcagtggt

SEQ ID NO: 110948 - DNA, 22 bp, Homo sapiens
cagccccatggtgtgctccagc

SEQ ID NO: 110949 - DNA, 22 bp, Homo sapiens
tacaccattcccaggtggattt

SEQ ID NO: 110950 - DNA, 22 bp, Homo sapiens
ttgcatgttccaaagaattttg

SEQ ID NO: 110951 - DNA, 22 bp, Homo sapiens
accccactcacacatggacctg

SEQ ID NO: 110952 - DNA, 22 bp, Homo sapiens
ttgattatagactcactaatct

SEQ ID NO: 110953 - DNA, 22 bp, Homo sapiens
tctccgatcacaggttttcaat

SEQ ID NO: 110954 - DNA, 22 bp, Homo sapiens
gagggtggtggcttaaggtgct

SEQ ID NO: 110955 - DNA, 22 bp, Homo sapiens
ccctggctgcgtgatggatgaa

SEQ ID NO: 110956 - DNA, 22 bp, Homo sapiens
tgcctcaagccctccactgcac

SEQ ID NO: 110957 - DNA, 22 bp, Homo sapiens
cacagggcttctcatggggtgc

SEQ ID NO: 110958 - DNA, 22 bp, Homo sapiens
ctccagttggccccagttggtt

SEQ ID NO: 110959 - DNA, 22 bp, Homo sapiens
ggccaggcgatgacccctccac

SEQ ID NO: 110960 - DNA, 22 bp, Homo sapiens
attaagtgactaaagtaatgct

SEQ ID NO: 110961 - DNA, 20 bp, Homo sapiens
tggcctctgagatgccacgg

SEQ ID NO: 110962 - DNA, 22 bp, Homo sapiens
agggatggagtgcggcccggac

SEQ ID NO: 110963 - DNA, 21 bp, Homo sapiens
cccagaagttccatggggggc

SEQ ID NO: 110964 - DNA, 18 bp, Homo sapiens
ggaaaaggagtgtctagc

SEQ ID NO: 110965 - DNA, 22 bp, Homo sapiens
ctgggcagctgtatcagggagt

SEQ ID NO: 110966 - DNA, 22 bp, Homo sapiens
ctctggaggtggaggttgcagt

SEQ ID NO: 110967 - DNA, 22 bp, Homo sapiens
aggaaaacagaccaaggagctc

SEQ ID NO: 110968 - DNA, 22 bp, Homo sapiens
agaaatatgctgattagatgaa

SEQ ID NO: 110969 - DNA, 22 bp, Homo sapiens
aggaccatcctaaggtaggcaa

SEQ ID NO: 110970 - DNA, 22 bp, Homo sapiens
gccctgagaagaagtcggaggg

SEQ ID NO: 110971 - DNA, 22 bp, Homo sapiens
atgaaatatcttgaagaaattc

SEQ ID NO: 110972 - DNA, 22 bp, Homo sapiens
tgatttatgcattatactgttg

SEQ ID NO: 110973 - DNA, 22 bp, Homo sapiens
ctcagctcattgtggatccggt

SEQ ID NO: 110974 - DNA, 22 bp, Homo sapiens
ggctcctgggggtgctcctgcc

SEQ ID NO: 110975 - DNA, 22 bp, Homo sapiens
agcctattccaggatgagctca

SEQ ID NO: 110976 - DNA, 22 bp, Homo sapiens
ttggaaacgtcaccttttcctt

SEQ ID NO: 110977 - DNA, 22 bp, Homo sapiens
cccaggccctggcagagcttgt

SEQ ID NO: 110978 - DNA, 22 bp, Homo sapiens
agtggagacaggacagtcgata

SEQ ID NO: 110979 - DNA, 22 bp, Homo sapiens
aagatattcaaagatttattag

SEQ ID NO: 110980 - DNA, 22 bp, Homo sapiens
acagacaagtagttcagacaag

SEQ ID NO: 110981 - DNA, 22 bp, Homo sapiens
agaagcagaaactgggcttgtg

SEQ ID NO: 110982 - DNA, 22 bp, Homo sapiens
ccttttatagatcagtgtgtta

SEQ ID NO: 110983 - DNA, 22 bp, Homo sapiens
atgaccagccgagataaacaga

SEQ ID NO: 110984 - DNA, 22 bp, Homo sapiens
actgctggggctcattcatctc

SEQ ID NO: 110985 - DNA, 22 bp, Homo sapiens
gctcactgcaacctctgcctcc

SEQ ID NO: 110986 - DNA, 22 bp, Homo sapiens
tggtatgaccgtggtgcaagca

SEQ ID NO: 110987 - DNA, 22 bp, Homo sapiens
ctcactgcaacctccgtctccc

SEQ ID NO: 110988 - DNA, 22 bp, Homo sapiens
ggctcactgcaacctctgcctc

SEQ ID NO: 110989 - DNA, 22 bp, Homo sapiens
cctcgtccacaatccttgcaca

SEQ ID NO: 110990 - DNA, 22 bp, Homo sapiens
ttgctaccattgataccagcac

SEQ ID NO: 110991 - DNA, 22 bp, Homo sapiens
tagagtgtcataacagtgccca

SEQ ID NO: 110992 - DNA, 22 bp, Homo sapiens
caggctggagtacaattgtgtg

SEQ ID NO: 110993 - DNA, 22 bp, Homo sapiens
tggggtcccaactctgattgat

SEQ ID NO: 110994 - DNA, 22 bp, Homo sapiens
catgaaattgtattggcctcaa

SEQ ID NO: 110995 - DNA, 22 bp, Homo sapiens
gaggcgggcagatcacctgagg

SEQ ID NO: 110996 - DNA, 22 bp, Homo sapiens
tatttcacatctatgaagtgag

SEQ ID NO: 110997 - DNA, 22 bp, Homo sapiens
tggcccgaagatccgagggtca

SEQ ID NO: 110998 - DNA, 22 bp, Homo sapiens
catgatctggtcctactgtggg

SEQ ID NO: 110999 - DNA, 18 bp, Homo sapiens
agtgtcagctgcagctca

SEQ ID NO: 111000 - DNA, 17 bp, Homo sapiens
tgcatgtcctttgttcc

SEQ ID NO: 111001 - DNA, 22 bp, Homo sapiens
ggccttggagtcagccttgagc

SEQ ID NO: 111002 - DNA, 22 bp, Homo sapiens
cagcagcagtgttctagaatct

SEQ ID NO: 111003 - DNA, 22 bp, Homo sapiens
gtggggtagatctttctcagga

SEQ ID NO: 111004 - DNA, 22 bp, Homo sapiens
gcagcgaggtgatgaaatagct

SEQ ID NO: 111005 - DNA, 22 bp, Homo sapiens
gcttggaagtaggattgggaga

SEQ ID NO: 111006 - DNA, 22 bp, Homo sapiens
aggggcacgagtagagctctag

SEQ ID NO: 111007 - DNA, 22 bp, Homo sapiens
gaggagctgcccgtgtgtctgc

SEQ ID NO: 111008 - DNA, 22 bp, Homo sapiens
agcctctcagagtgctgggatt

SEQ ID NO: 111009 - DNA, 22 bp, Homo sapiens
tataccatgtgtgcacactccc

SEQ ID NO: 111010 - DNA, 22 bp, Homo sapiens
taggattccagaacagtgctgc

SEQ ID NO: 111011 - DNA, 18 bp, Homo sapiens
tctgtgggatcagtgagg

SEQ ID NO: 111012 - DNA, 22 bp, Homo sapiens
cattcattacactcataaggtt

SEQ ID NO: 111013 - DNA, 22 bp, Homo sapiens
ataaaatttgctactgttaaat

SEQ ID NO: 111014 - DNA, 22 bp, Homo sapiens
gagcacagtaaagcagtgtcac

SEQ ID NO: 111015 - DNA, 22 bp, Homo sapiens
gaatttcctctaaacccctgag

SEQ ID NO: 111016 - DNA, 22 bp, Homo sapiens
gtcggccacgcaggtgcggtag

SEQ ID NO: 111017 - DNA, 22 bp, Homo sapiens
aagaggtagcagtcacaaaaga

SEQ ID NO: 111018 - DNA, 22 bp, Homo sapiens
ggggccttttctgaatgtggaa

SEQ ID NO: 111019 - DNA, 22 bp, Homo sapiens
tgctccatgcgctcggccggcg

SEQ ID NO: 111020 - DNA, 21 bp, Homo sapiens
gctgctcgagatccagtgctt

SEQ ID NO: 111021 - DNA, 22 bp, Homo sapiens
gacccaggggcagggagaaagt

SEQ ID NO: 111022 - DNA, 22 bp, Homo sapiens
tatgtaagttgcaaatgaagga

SEQ ID NO: 111023 - DNA, 22 bp, Homo sapiens
gcagcctcaaactccccagctc

SEQ ID NO: 111024 - DNA, 22 bp, Homo sapiens
gtgctgacaggagcctggcggt

SEQ ID NO: 111025 - DNA, 22 bp, Homo sapiens
aggaggcagtctgtcccttagc

SEQ ID NO: 111026 - DNA, 22 bp, Homo sapiens
tgaaggggttcagcatgggggt

SEQ ID NO: 111027 - DNA, 22 bp, Homo sapiens
tcgtgaggctctgcatcgcaca

SEQ ID NO: 111028 - DNA, 22 bp, Homo sapiens
gtcactgtatccaggttccagc

SEQ ID NO: 111029 - DNA, 22 bp, Homo sapiens
ctctgtagaaagagcccaggtg

SEQ ID NO: 111030 - DNA, 21 bp, Homo sapiens
tgttttccaccttgaggcaag

SEQ ID NO: 111031 - DNA, 22 bp, Homo sapiens
ctctctgggcccagttggcacc

SEQ ID NO: 111032 - DNA, 22 bp, Homo sapiens
cgcccaggctggagagcagtgg

SEQ ID NO: 111033 - DNA, 22 bp, Homo sapiens
gctgtgtatcagatgccacggg

SEQ ID NO: 111034 - DNA, 17 bp, Homo sapiens
gggcagggactcctggg

SEQ ID NO: 111035 - DNA, 22 bp, Homo sapiens
cccaggaattggaggctgcagt

SEQ ID NO: 111036 - DNA, 22 bp, Homo sapiens
cacctgtacagggccgggctgg

SEQ ID NO: 111037 - DNA, 22 bp, Homo sapiens
tgcaaatgtgttttaaaccaaa

SEQ ID NO: 111038 - DNA, 22 bp, Homo sapiens
ggcaggaggtgagtggcgggtg

SEQ ID NO: 111039 - DNA, 20 bp, Homo sapiens
gctgaggggtctatggcata

SEQ ID NO: 111040 - DNA, 22 bp, Homo sapiens
ggggccttggatctgtgccccg

SEQ ID NO: 111041 - DNA, 22 bp, Homo sapiens
ggccggggcctgctcgcctgtg

SEQ ID NO: 111042 - DNA, 22 bp, Homo sapiens
cagctggtgtcaggcactgcag

SEQ ID NO: 111043 - DNA, 22 bp, Homo sapiens
gtgcatgtcggggtgcatgtca

SEQ ID NO: 111044 - DNA, 22 bp, Homo sapiens
ctgagctcaagcgatcctccca

SEQ ID NO: 111045 - DNA, 22 bp, Homo sapiens
aaaactgaaatacgatccaatg

SEQ ID NO: 111046 - DNA, 22 bp, Homo sapiens
ccttttgctctcccatccagaa

SEQ ID NO: 111047 - DNA, 22 bp, Homo sapiens
tgtcttcgctacaatgaaaagg

SEQ ID NO: 111048 - DNA, 22 bp, Homo sapiens
ggcgggacggggcgtgcacaga

SEQ ID NO: 111049 - DNA, 22 bp, Homo sapiens
tcacaacgcctctgcaaatcct

SEQ ID NO: 111050 - DNA, 22 bp, Homo sapiens
gtcttgatctcctgaccttgtg

SEQ ID NO: 111051 - DNA, 22 bp, Homo sapiens
ggactgggaatcagggagatgc

SEQ ID NO: 111052 - DNA, 22 bp, Homo sapiens
gggctagcctcttccctgctcc

SEQ ID NO: 111053 - DNA, 22 bp, Homo sapiens
ctcacagtctgcctttcccttg

SEQ ID NO: 111054 - DNA, 22 bp, Homo sapiens
ccaggctgctgttggtgtccgc

SEQ ID NO: 111055 - DNA, 22 bp, Homo sapiens
agtccggggtctggacacctgg

SEQ ID NO: 111056 - DNA, 22 bp, Homo sapiens
cccggcctctgcctggtggcct

SEQ ID NO: 111057 - DNA, 22 bp, Homo sapiens
tatgcacaacatgcaggtttgt

SEQ ID NO: 111058 - DNA, 22 bp, Homo sapiens
tggccaccaccaatacttgcct

SEQ ID NO: 111059 - DNA, 22 bp, Homo sapiens
aaatgcctcattttctctcact

SEQ ID NO: 111060 - DNA, 22 bp, Homo sapiens
atatacacatctttttaaatat

SEQ ID NO: 111061 - DNA, 22 bp, Homo sapiens
gcaggcagatcacctgtcagga

SEQ ID NO: 111062 - DNA, 22 bp, Homo sapiens
gatgcactgcagtatatactgt

SEQ ID NO: 111063 - DNA, 22 bp, Homo sapiens
tgatctttggtaatctggcaca

SEQ ID NO: 111064 - DNA, 22 bp, Homo sapiens
tacagatgaggaaactgaggca

SEQ ID NO: 111065 - DNA, 22 bp, Homo sapiens
caggcagggagctggaaaggat

SEQ ID NO: 111066 - DNA, 22 bp, Homo sapiens
gtcctggggattatagagtgtt

SEQ ID NO: 111067 - DNA, 19 bp, Homo sapiens
tcctgcctggggccgcctg

SEQ ID NO: 111068 - DNA, 19 bp, Homo sapiens
tctagttttgagagacttc

SEQ ID NO: 111069 - DNA, 22 bp, Homo sapiens
acccacaacagctctaggaagt

SEQ ID NO: 111070 - DNA, 23 bp, Homo sapiens
ggctgggagctccgggtgcacgt

SEQ ID NO: 111071 - DNA, 22 bp, Homo sapiens
cgatggtatcggccagccccgg

SEQ ID NO: 111072 - DNA, 22 bp, Homo sapiens
atgatactctaggtgatttaca

SEQ ID NO: 111073 - DNA, 21 bp, Homo sapiens
agggttttatagatctcttcc

SEQ ID NO: 111074 - DNA, 22 bp, Homo sapiens
cccatggcttaggagggagtgt

SEQ ID NO: 111075 - DNA, 22 bp, Homo sapiens
caggtgcctcaggatgagacaa

SEQ ID NO: 111076 - DNA, 22 bp, Homo sapiens
tcagttacttgcttgtttgaaa

SEQ ID NO: 111077 - DNA, 22 bp, Homo sapiens
gcaagacctatctagttgctgt

SEQ ID NO: 111078 - DNA, 22 bp, Homo sapiens
tttatgtagttacggactatca

SEQ ID NO: 111079 - DNA, 22 bp, Homo sapiens
cagcatgaatgtgttcgtaggg

SEQ ID NO: 111080 - DNA, 22 bp, Homo sapiens
tttaggttttttcacgtggcta

SEQ ID NO: 111081 - DNA, 22 bp, Homo sapiens
actgtacctcaaactctggaac

SEQ ID NO: 111082 - DNA, 22 bp, Homo sapiens
gagcccgagcgcgtacccggcg

SEQ ID NO: 111083 - DNA, 22 bp, Homo sapiens
ggaccggtggcttcctcgggtc

SEQ ID NO: 111084 - DNA, 19 bp, Homo sapiens
gctgaggtggaggaaggag

SEQ ID NO: 111085 - DNA, 22 bp, Homo sapiens
acagttaataagtagtaagtca

SEQ ID NO: 111086 - DNA, 22 bp, Homo sapiens
gggcttcagttctgaccatctt

SEQ ID NO: 111087 - DNA, 18 bp, Homo sapiens
actctgcggaggccccag

SEQ ID NO: 111088 - DNA, 22 bp, Homo sapiens
agctgctgagccaggctgatgt

SEQ ID NO: 111089 - DNA, 22 bp, Homo sapiens
atattacacacggtatcacggg

SEQ ID NO: 111090 - DNA, 23 bp, Homo sapiens
cagagctggctcagagctgcctg

SEQ ID NO: 111091 - DNA, 22 bp, Homo sapiens
tcagcctgctccaagtgctgcc

SEQ ID NO: 111092 - DNA, 22 bp, Homo sapiens
gatggaggagatggcagggtgc

SEQ ID NO: 111093 - DNA, 22 bp, Homo sapiens
attgagaagaaaatctaatata

SEQ ID NO: 111094 - DNA, 22 bp, Homo sapiens
cactgggcgtgtcctgggtgag

SEQ ID NO: 111095 - DNA, 22 bp, Homo sapiens
caagaatcaacattatttagtg

SEQ ID NO: 111096 - DNA, 22 bp, Homo sapiens
cagaggctggcggccgccccga

SEQ ID NO: 111097 - DNA, 22 bp, Homo sapiens
atcacagttttaccatttggta

SEQ ID NO: 111098 - DNA, 22 bp, Homo sapiens
aaagtaattgtggttcttgcca

SEQ ID NO: 111099 - DNA, 22 bp, Homo sapiens
ctcctggaggatagtgactggg

SEQ ID NO: 111100 - DNA, 22 bp, Homo sapiens
accctccccaagaggtcgtgcc

SEQ ID NO: 111101 - DNA, 22 bp, Homo sapiens
catttacatttaaggttaatat

SEQ ID NO: 111102 - DNA, 22 bp, Homo sapiens
aggtgggcgctgctcccgctgg

SEQ ID NO: 111103 - DNA, 22 bp, Homo sapiens
tgtgctctgactttctcctggt

SEQ ID NO: 111104 - DNA, 22 bp, Homo sapiens
gccctgccctctcggcactcgc

SEQ ID NO: 111105 - DNA, 22 bp, Homo sapiens
acacttggagcaacacttatgg

SEQ ID NO: 111106 - DNA, 22 bp, Homo sapiens
tccacgctgtgtgaccttgggc

SEQ ID NO: 111107 - DNA, 22 bp, Homo sapiens
ctgggcctggggctgttgagag

SEQ ID NO: 111108 - DNA, 22 bp, Homo sapiens
atgagttgaagctacaagaggc

SEQ ID NO: 111109 - DNA, 22 bp, Homo sapiens
gtgaaatatttaacgtccaggt

SEQ ID NO: 111110 - DNA, 22 bp, Homo sapiens
atgccaataaatgttaatatct

SEQ ID NO: 111111 - DNA, 22 bp, Homo sapiens
tagatacctgctggacctcatt

SEQ ID NO: 111112 - DNA, 22 bp, Homo sapiens
tagggcaatatttcccagaaaa

SEQ ID NO: 111113 - DNA, 22 bp, Homo sapiens
ggcaggactgatcagtgggatg

SEQ ID NO: 111114 - DNA, 22 bp, Homo sapiens
tgcactactgtgatacacagcc

SEQ ID NO: 111115 - DNA, 22 bp, Homo sapiens
gtccaagagtcaagaagggggc

SEQ ID NO: 111116 - DNA, 22 bp, Homo sapiens
aaggagaaatggtagatgtgca

SEQ ID NO: 111117 - DNA, 22 bp, Homo sapiens
tgtcttcagcagtcatctgggg

SEQ ID NO: 111118 - DNA, 22 bp, Homo sapiens
ttgcaaatcagaagtatagatt

SEQ ID NO: 111119 - DNA, 22 bp, Homo sapiens
agcatttatcttttgtttgagt

SEQ ID NO: 111120 - DNA, 22 bp, Homo sapiens
gctttatccgcttgacccttac

SEQ ID NO: 111121 - DNA, 22 bp, Homo sapiens
tagcgaggtgtttctaggactg

SEQ ID NO: 111122 - DNA, 22 bp, Homo sapiens
cactgcactccagcttgggtga

SEQ ID NO: 111123 - DNA, 22 bp, Homo sapiens
ctgatcctcctttaagtagctg

SEQ ID NO: 111124 - DNA, 22 bp, Homo sapiens
atctggggtgaataggttatgt

SEQ ID NO: 111125 - DNA, 22 bp, Homo sapiens
ctccttctgggcctggcagtgg

SEQ ID NO: 111126 - DNA, 22 bp, Homo sapiens
tcactgtatcatgttgcactta

SEQ ID NO: 111127 - DNA, 22 bp, Homo sapiens
tcgcttgaacccaggaagtgga

SEQ ID NO: 111128 - DNA, 22 bp, Homo sapiens
aaccaccattctctcctcttcc

SEQ ID NO: 111129 - DNA, 22 bp, Homo sapiens
cctggggccccgagccagaagc

SEQ ID NO: 111130 - DNA, 23 bp, Homo sapiens
acagtcgtaggtatccttttcct

SEQ ID NO: 111131 - DNA, 22 bp, Homo sapiens
acaggggcaagggctcacggcc

SEQ ID NO: 111132 - DNA, 22 bp, Homo sapiens
ataaaagatcccttctgagctc

SEQ ID NO: 111133 - DNA, 22 bp, Homo sapiens
ttcattttctttcacgctgctg

SEQ ID NO: 111134 - DNA, 23 bp, Homo sapiens
aatggtcttcctccacccctctg

SEQ ID NO: 111135 - DNA, 22 bp, Homo sapiens
tctgtgagaaccagtgccaggg

SEQ ID NO: 111136 - DNA, 22 bp, Homo sapiens
ggcagcactgcagcttgttggg

SEQ ID NO: 111137 - DNA, 21 bp, Homo sapiens
tgctccaggagggggcagtcc

SEQ ID NO: 111138 - DNA, 22 bp, Homo sapiens
tgtctggatagagcctaggccc

SEQ ID NO: 111139 - DNA, 22 bp, Homo sapiens
acaagaagtaaaggtcggatgc

SEQ ID NO: 111140 - DNA, 22 bp, Homo sapiens
agcctggtttaagcattttata

SEQ ID NO: 111141 - DNA, 22 bp, Homo sapiens
aggctggagtgcagtggtgtga

SEQ ID NO: 111142 - DNA, 22 bp, Homo sapiens
cggggaagcggttctggcggta

SEQ ID NO: 111143 - DNA, 22 bp, Homo sapiens
ggagtgcagtggcgtgagctcg

SEQ ID NO: 111144 - DNA, 23 bp, Homo sapiens
acagcaagaggaccagatgtgag

SEQ ID NO: 111145 - DNA, 22 bp, Homo sapiens
tgttcttgagcctttagaccta

SEQ ID NO: 111146 - DNA, 22 bp, Homo sapiens
ggcgcccccttcaaacagagca

SEQ ID NO: 111147 - DNA, 22 bp, Homo sapiens
tttctcttcactgtgtgcctca

SEQ ID NO: 111148 - DNA, 22 bp, Homo sapiens
tagtgccctcccctttgggata

SEQ ID NO: 111149 - DNA, 22 bp, Homo sapiens
tgagccaggagtttgaggctgt

SEQ ID NO: 111150 - DNA, 22 bp, Homo sapiens
ctggctttgatcagagtgacct

SEQ ID NO: 111151 - DNA, 22 bp, Homo sapiens
agcataagttggtacagccact

SEQ ID NO: 111152 - DNA, 22 bp, Homo sapiens
gtaagggatttgaacataggtt

SEQ ID NO: 111153 - DNA, 22 bp, Homo sapiens
tggttgcctctcagagattccg

SEQ ID NO: 111154 - DNA, 22 bp, Homo sapiens
ggctagggatctagaccaggac

SEQ ID NO: 111155 - DNA, 22 bp, Homo sapiens
attttctatgttgtaattgtta

SEQ ID NO: 111156 - DNA, 22 bp, Homo sapiens
cttgtgcttttatgaatgcaga

SEQ ID NO: 111157 - DNA, 22 bp, Homo sapiens
tcccctctttctggaaacacaa

SEQ ID NO: 111158 - DNA, 22 bp, Homo sapiens
caggggcgggtaaaaggcctcc

SEQ ID NO: 111159 - DNA, 22 bp, Homo sapiens
agtgcattcctggggaagaagc

SEQ ID NO: 111160 - DNA, 22 bp, Homo sapiens
gcgctgcgcctcctcttccgca

SEQ ID NO: 111161 - DNA, 22 bp, Homo sapiens
cccaggggttcaaggctgcagt

SEQ ID NO: 111162 - DNA, 22 bp, Homo sapiens
gctactgattgaccttggagag

SEQ ID NO: 111163 - DNA, 22 bp, Homo sapiens
gctcaagccttctgcccacctc

SEQ ID NO: 111164 - DNA, 22 bp, Homo sapiens
tatctattatgttctatgtgtc

SEQ ID NO: 111165 - DNA, 22 bp, Homo sapiens
agacggattacctgaggtcagg

SEQ ID NO: 111166 - DNA, 19 bp, Homo sapiens
tctcaattctccccactgc

SEQ ID NO: 111167 - DNA, 22 bp, Homo sapiens
agaggcaggaggttgacttgag

SEQ ID NO: 111168 - DNA, 22 bp, Homo sapiens
actccacatttgaacacagttc

SEQ ID NO: 111169 - DNA, 22 bp, Homo sapiens
cccaggaggtcaaggctgcagt

SEQ ID NO: 111170 - DNA, 22 bp, Homo sapiens
gagcccaggcagaggttgcagt

SEQ ID NO: 111171 - DNA, 22 bp, Homo sapiens
aggaattcaagaccagctgggc

SEQ ID NO: 111172 - DNA, 22 bp, Homo sapiens
tcacccaggctggagtgcagtg

SEQ ID NO: 111173 - DNA, 22 bp, Homo sapiens
tctcccaggcaggagtgcagtg

SEQ ID NO: 111174 - DNA, 22 bp, Homo sapiens
gaggggcacagtaaagggtccc

SEQ ID NO: 111175 - DNA, 22 bp, Homo sapiens
aacccaggaggcggaggttgtg

SEQ ID NO: 111176 - DNA, 22 bp, Homo sapiens
ggcctcgcggcttctggtggct

SEQ ID NO: 111177 - DNA, 22 bp, Homo sapiens
aaggtgggcagatcacaaggtc

SEQ ID NO: 111178 - DNA, 22 bp, Homo sapiens
tgctagtgtgtgagatgttcaa

SEQ ID NO: 111179 - DNA, 22 bp, Homo sapiens
tctgccgtgcgaggtcccacca

SEQ ID NO: 111180 - DNA, 22 bp, Homo sapiens
tgctgggggtagctctgcgtag

SEQ ID NO: 111181 - DNA, 22 bp, Homo sapiens
taacaatacccattctaattac

SEQ ID NO: 111182 - DNA, 22 bp, Homo sapiens
ttctgtggttgaaaggagagat

SEQ ID NO: 111183 - DNA, 22 bp, Homo sapiens
cgtgtgttgaaagatgtacatc

SEQ ID NO: 111184 - DNA, 18 bp, Homo sapiens
ccatcaccctaactagtg

SEQ ID NO: 111185 - DNA, 22 bp, Homo sapiens
ggcctgcctcacagtcagcacc

SEQ ID NO: 111186 - DNA, 22 bp, Homo sapiens
ttcttctcagggtcccacatgg

SEQ ID NO: 111187 - DNA, 22 bp, Homo sapiens
ggctgccttccctgagccccgg

SEQ ID NO: 111188 - DNA, 22 bp, Homo sapiens
gacccacctcaccaagcatgtg

SEQ ID NO: 111189 - DNA, 22 bp, Homo sapiens
agatttatgtggtcacactcag

SEQ ID NO: 111190 - DNA, 22 bp, Homo sapiens
gagaaagctaaataagttgatt

SEQ ID NO: 111191 - DNA, 22 bp, Homo sapiens
tccaaggtcagcgagagtcact

SEQ ID NO: 111192 - DNA, 22 bp, Homo sapiens
gtacaaatgcaggtttgttaca

SEQ ID NO: 111193 - DNA, 22 bp, Homo sapiens
cttgatgagtcagaactgaagg

SEQ ID NO: 111194 - DNA, 22 bp, Homo sapiens
cggccaggcacagtggcccacg

SEQ ID NO: 111195 - DNA, 22 bp, Homo sapiens
tagaggattttgcatttcatat

SEQ ID NO: 111196 - DNA, 23 bp, Homo sapiens
agctctgctcgggcatgccctgc

SEQ ID NO: 111197 - DNA, 22 bp, Homo sapiens
ctcagccccagcccagatagca

SEQ ID NO: 111198 - DNA, 22 bp, Homo sapiens
cattgcaacttcaaactcctgg

SEQ ID NO: 111199 - DNA, 22 bp, Homo sapiens
aatggctctgatgttgttgtga

SEQ ID NO: 111200 - DNA, 22 bp, Homo sapiens
aagaaggcggaccagaagggag

SEQ ID NO: 111201 - DNA, 22 bp, Homo sapiens
aggactcatccctgcttgtcag

SEQ ID NO: 111202 - DNA, 22 bp, Homo sapiens
ggcatggacgtctctgaggcca

SEQ ID NO: 111203 - DNA, 22 bp, Homo sapiens
gagaacagaagcattcctaatt

SEQ ID NO: 111204 - DNA, 22 bp, Homo sapiens
ctgctgagccgcacccaggagc

SEQ ID NO: 111205 - DNA, 22 bp, Homo sapiens
tgtcatagtgtggtagcagtgg

SEQ ID NO: 111206 - DNA, 22 bp, Homo sapiens
gcagggcacaaggacgcacagg

SEQ ID NO: 111207 - DNA, 22 bp, Homo sapiens
gagggccctggctggctccagc

SEQ ID NO: 111208 - DNA, 22 bp, Homo sapiens
cagaagactgcagggaagggac

SEQ ID NO: 111209 - DNA, 22 bp, Homo sapiens
atttactttgctgagatccatc

SEQ ID NO: 111210 - DNA, 22 bp, Homo sapiens
actttaattaatgaactgtggc

SEQ ID NO: 111211 - DNA, 22 bp, Homo sapiens
aacccaggagccggaggttgtg

SEQ ID NO: 111212 - DNA, 22 bp, Homo sapiens
atctagattaggtataagagct

SEQ ID NO: 111213 - DNA, 22 bp, Homo sapiens
agaagccaccagctgaggaaga

SEQ ID NO: 111214 - DNA, 22 bp, Homo sapiens
cgtgtggacatgactagctgcc

SEQ ID NO: 111215 - DNA, 22 bp, Homo sapiens
cccaggaggtggaggctgcagt

SEQ ID NO: 111216 - DNA, 22 bp, Homo sapiens
ccaggctagaaactgaggcaca

SEQ ID NO: 111217 - DNA, 22 bp, Homo sapiens
gagcaggaaggccagaagggtc

SEQ ID NO: 111218 - DNA, 22 bp, Homo sapiens
acgtagcactgagagatgcagg

SEQ ID NO: 111219 - DNA, 22 bp, Homo sapiens
ttccactctacacactgctggc

SEQ ID NO: 111220 - DNA, 22 bp, Homo sapiens
aggaggggttctcgggtgctga

SEQ ID NO: 111221 - DNA, 22 bp, Homo sapiens
cttcctctgtggccagagtgta

SEQ ID NO: 111222 - DNA, 22 bp, Homo sapiens
tgttaaggcagcaacggatgaa

SEQ ID NO: 111223 - DNA, 22 bp, Homo sapiens
ctgggctagaaggaccaggatg

SEQ ID NO: 111224 - DNA, 22 bp, Homo sapiens
aggggatggagctggaaggcag

SEQ ID NO: 111225 - DNA, 22 bp, Homo sapiens
gatgatcatctgtaaagttaga

SEQ ID NO: 111226 - DNA, 22 bp, Homo sapiens
aatcacttagaacccaggaagt

SEQ ID NO: 111227 - DNA, 22 bp, Homo sapiens
gcagatggatgtggacggcgcc

SEQ ID NO: 111228 - DNA, 22 bp, Homo sapiens
actgggcctacccagattggca

SEQ ID NO: 111229 - DNA, 22 bp, Homo sapiens
atatccagcagcaggtgagtat

SEQ ID NO: 111230 - DNA, 22 bp, Homo sapiens
acctggaggcagaggttgcagt

SEQ ID NO: 111231 - DNA, 22 bp, Homo sapiens
atttggcagtataaattctggc

SEQ ID NO: 111232 - DNA, 22 bp, Homo sapiens
gagcctgagcaatgtgatgttt

SEQ ID NO: 111233 - DNA, 22 bp, Homo sapiens
ccactgcactccagcctgccaa

SEQ ID NO: 111234 - DNA, 22 bp, Homo sapiens
ctgggaggtggaggttgcattg

SEQ ID NO: 111235 - DNA, 22 bp, Homo sapiens
aggtggggaggagtgtctcttt

SEQ ID NO: 111236 - DNA, 22 bp, Homo sapiens
attgaaaataaggccagaaaca

SEQ ID NO: 111237 - DNA, 22 bp, Homo sapiens
cctcagacccctgctgagcttc

SEQ ID NO: 111238 - DNA, 22 bp, Homo sapiens
atggggggatgaaggagtccaa

SEQ ID NO: 111239 - DNA, 22 bp, Homo sapiens
tgtatgaggcatacatcaggca

SEQ ID NO: 111240 - DNA, 20 bp, Homo sapiens
gctctgtggtttgagtctcc

SEQ ID NO: 111241 - DNA, 22 bp, Homo sapiens
cagggtgacaagtggcaaggag

SEQ ID NO: 111242 - DNA, 22 bp, Homo sapiens
acagtctgtcccccaggtgcta

SEQ ID NO: 111243 - DNA, 22 bp, Homo sapiens
gtggagaggaacccagctctgt

SEQ ID NO: 111244 - DNA, 17 bp, Homo sapiens
tgtagcttctccttctc

SEQ ID NO: 111245 - DNA, 22 bp, Homo sapiens
caagcttgtttctcctgggggt

SEQ ID NO: 111246 - DNA, 22 bp, Homo sapiens
aagctgcagcacagagaggtgg

SEQ ID NO: 111247 - DNA, 22 bp, Homo sapiens
cccatgaggtggaggttgcagt

SEQ ID NO: 111248 - DNA, 22 bp, Homo sapiens
aaattctgatttaataagtgta

SEQ ID NO: 111249 - DNA, 22 bp, Homo sapiens
atgtatatgcatgcattcaaag

SEQ ID NO: 111250 - DNA, 22 bp, Homo sapiens
atctggttcttcttaggcatca

SEQ ID NO: 111251 - DNA, 22 bp, Homo sapiens
acagcccagctctttctctgca

SEQ ID NO: 111252 - DNA, 22 bp, Homo sapiens
tgagcttgcagtgccagccttg

SEQ ID NO: 111253 - DNA, 22 bp, Homo sapiens
ttattttaccttcctctgagct

SEQ ID NO: 111254 - DNA, 23 bp, Homo sapiens
gtgcatgtgtctttacagtagca

SEQ ID NO: 111255 - DNA, 22 bp, Homo sapiens
tgctgagcccagaacggcctgg

SEQ ID NO: 111256 - DNA, 22 bp, Homo sapiens
ttcccacagtgactccagagaa

SEQ ID NO: 111257 - DNA, 22 bp, Homo sapiens
atgctaaggcccaggagaaaat

SEQ ID NO: 111258 - DNA, 22 bp, Homo sapiens
gaagagctgacagtgtcatcct

SEQ ID NO: 111259 - DNA, 22 bp, Homo sapiens
gaacccggggaggttgcagtga

SEQ ID NO: 111260 - DNA, 22 bp, Homo sapiens
tttgaggttagctagcagatca

SEQ ID NO: 111261 - DNA, 22 bp, Homo sapiens
ttgtgagtagtgccgcaataaa

SEQ ID NO: 111262 - DNA, 22 bp, Homo sapiens
ccaggaggttgaggctgcagtg

SEQ ID NO: 111263 - DNA, 19 bp, Homo sapiens
gccgggcccgggttggccg

SEQ ID NO: 111264 - DNA, 22 bp, Homo sapiens
ggggtgggcgtgcagggacacc

SEQ ID NO: 111265 - DNA, 22 bp, Homo sapiens
cccaggccccagggcttgtcag

SEQ ID NO: 111266 - DNA, 22 bp, Homo sapiens
gctgaggtggaggaaggagacc

SEQ ID NO: 111267 - DNA, 22 bp, Homo sapiens
aagaatgagctcaaagatctta

SEQ ID NO: 111268 - DNA, 21 bp, Homo sapiens
acacaggcagtgtcccgaggt

SEQ ID NO: 111269 - DNA, 22 bp, Homo sapiens
cgcggctctgcgggccgctgag

SEQ ID NO: 111270 - DNA, 22 bp, Homo sapiens
tccgggtgcccacgtgccccta

SEQ ID NO: 111271 - DNA, 22 bp, Homo sapiens
ggaggagacagtaaaaagcacg

SEQ ID NO: 111272 - DNA, 23 bp, Homo sapiens
atgacactcctgtgcgcaccctg

SEQ ID NO: 111273 - DNA, 22 bp, Homo sapiens
gggatcgtcatggaaagtgcta

SEQ ID NO: 111274 - DNA, 22 bp, Homo sapiens
cacccaggctggagagcagtgg

SEQ ID NO: 111275 - DNA, 22 bp, Homo sapiens
gggcggatcatttgaggtcagg

SEQ ID NO: 111276 - DNA, 22 bp, Homo sapiens
tggtattacttctagacacaag

SEQ ID NO: 111277 - DNA, 22 bp, Homo sapiens
ccggagtgtctggcctgctggg

SEQ ID NO: 111278 - DNA, 22 bp, Homo sapiens
actgcactccagcctgggtgac

SEQ ID NO: 111279 - DNA, 22 bp, Homo sapiens
cctcgacctccccaggctcagg

SEQ ID NO: 111280 - DNA, 22 bp, Homo sapiens
taggcatgcaaataaatgtgca

SEQ ID NO: 111281 - DNA, 22 bp, Homo sapiens
agactttaacaatgggtatgaa

SEQ ID NO: 111282 - DNA, 22 bp, Homo sapiens
gacctcatgatccacctgcctt

SEQ ID NO: 111283 - DNA, 22 bp, Homo sapiens
gctgcagtgagccaagatcgtg

SEQ ID NO: 111284 - DNA, 22 bp, Homo sapiens
gtggcccaggctggagtgcagt

SEQ ID NO: 111285 - DNA, 19 bp, Homo sapiens
gatttaaacgtggctctat

SEQ ID NO: 111286 - DNA, 22 bp, Homo sapiens
cactgcactccagcccgggcaa

SEQ ID NO: 111287 - DNA, 22 bp, Homo sapiens
ccaggctggagtatagtggcgc

SEQ ID NO: 111288 - DNA, 22 bp, Homo sapiens
ctgaggagaggtggcctgtgtt

SEQ ID NO: 111289 - DNA, 22 bp, Homo sapiens
ggccttggcctagccctccagg

SEQ ID NO: 111290 - DNA, 22 bp, Homo sapiens
agggaagaggaccagagtctct

SEQ ID NO: 111291 - DNA, 22 bp, Homo sapiens
aggcaatcccctgaggatactt

SEQ ID NO: 111292 - DNA, 22 bp, Homo sapiens
ggggtggatttcaggcggtgtc

SEQ ID NO: 111293 - DNA, 22 bp, Homo sapiens
gggaagagggagctggaatgat

SEQ ID NO: 111294 - DNA, 22 bp, Homo sapiens
ggcagggcaggaaagtcaggaa

SEQ ID NO: 111295 - DNA, 19 bp, Homo sapiens
ggggcctgtgatggtcaca

SEQ ID NO: 111296 - DNA, 22 bp, Homo sapiens
tcacagacccttgctgagctct

SEQ ID NO: 111297 - DNA, 22 bp, Homo sapiens
tgctgtgttactgagatccggc

SEQ ID NO: 111298 - DNA, 22 bp, Homo sapiens
ccaggctggagtgcagtggcac

SEQ ID NO: 111299 - DNA, 22 bp, Homo sapiens
gaggtggatgttgcagtgagct

SEQ ID NO: 111300 - DNA, 22 bp, Homo sapiens
ggaaacttggatgccagcactc

SEQ ID NO: 111301 - DNA, 22 bp, Homo sapiens
tttgtgaataggttggcttcca

SEQ ID NO: 111302 - DNA, 22 bp, Homo sapiens
gaaaggagagggttaaggagct

SEQ ID NO: 111303 - DNA, 22 bp, Homo sapiens
atcacaaaggtctcagagcaca

SEQ ID NO: 111304 - DNA, 22 bp, Homo sapiens
gaagaaggtggcccaggggtag

SEQ ID NO: 111305 - DNA, 22 bp, Homo sapiens
tcacttagatggggatcatcac

SEQ ID NO: 111306 - DNA, 22 bp, Homo sapiens
tttccagagggtgctcagggcg

SEQ ID NO: 111307 - DNA, 22 bp, Homo sapiens
atgattgaccatctgctgggct

SEQ ID NO: 111308 - DNA, 22 bp, Homo sapiens
tgcgcggctcagtcatctccag

SEQ ID NO: 111309 - DNA, 22 bp, Homo sapiens
cgcagggccgcgagcgggacca

SEQ ID NO: 111310 - DNA, 22 bp, Homo sapiens
tgccagaatttgcttccaatgt

SEQ ID NO: 111311 - DNA, 22 bp, Homo sapiens
agggcgacaatggagagcgttt

SEQ ID NO: 111312 - DNA, 22 bp, Homo sapiens
ggcagggagtggagactcccta

SEQ ID NO: 111313 - DNA, 22 bp, Homo sapiens
gaggtgggcggatcacaaggtc

SEQ ID NO: 111314 - DNA, 22 bp, Homo sapiens
tggggcagttaataaacattct

SEQ ID NO: 111315 - DNA, 22 bp, Homo sapiens
gtacactccccctgtgaagttg

SEQ ID NO: 111316 - DNA, 22 bp, Homo sapiens
aggccagcctcaggcagggacc

SEQ ID NO: 111317 - DNA, 22 bp, Homo sapiens
ccagaagtcaagtaagatgaag

SEQ ID NO: 111318 - DNA, 22 bp, Homo sapiens
ggaatgcactagactgtgaaac

SEQ ID NO: 111319 - DNA, 22 bp, Homo sapiens
gagggggctagcgcagtgccca

SEQ ID NO: 111320 - DNA, 22 bp, Homo sapiens
caggaaagggatgggctgccac

SEQ ID NO: 111321 - DNA, 22 bp, Homo sapiens
tcttcctggatgggggttgatg

SEQ ID NO: 111322 - DNA, 22 bp, Homo sapiens
agtcaataaaagctttagattc

SEQ ID NO: 111323 - DNA, 22 bp, Homo sapiens
acccatccagtgtccctgctag

SEQ ID NO: 111324 - DNA, 22 bp, Homo sapiens
ccaggaggtggaggttgcggtg

SEQ ID NO: 111325 - DNA, 22 bp, Homo sapiens
tgcatggacgtgacttggccaa

SEQ ID NO: 111326 - DNA, 22 bp, Homo sapiens
accgagttagccaggatggtct

SEQ ID NO: 111327 - DNA, 22 bp, Homo sapiens
tggagaattctatgttgagggg

SEQ ID NO: 111328 - DNA, 21 bp, Homo sapiens
ctcccagggtgactgttcaac

SEQ ID NO: 111329 - DNA, 22 bp, Homo sapiens
tatcacagtaaatctgggtgca

SEQ ID NO: 111330 - DNA, 22 bp, Homo sapiens
ccgaggctggagtgcagtggcg

SEQ ID NO: 111331 - DNA, 22 bp, Homo sapiens
tgcagtggcgccatctcagctc

SEQ ID NO: 111332 - DNA, 22 bp, Homo sapiens
aggtgggcggattcatgaggtc

SEQ ID NO: 111333 - DNA, 22 bp, Homo sapiens
taaatcttctacatcatcataa

SEQ ID NO: 111334 - DNA, 22 bp, Homo sapiens
gttactcttccccggggtctgg

SEQ ID NO: 111335 - DNA, 22 bp, Homo sapiens
tgatctaggttggcttcaactg

SEQ ID NO: 111336 - DNA, 22 bp, Homo sapiens
tctcatgaagatagaatagtat

SEQ ID NO: 111337 - DNA, 22 bp, Homo sapiens
tcagtgcagggtgggagagaga

SEQ ID NO: 111338 - DNA, 22 bp, Homo sapiens
agtgaatgtccccgcgggtcag

SEQ ID NO: 111339 - DNA, 22 bp, Homo sapiens
gctggagaggatcccaaagcca

SEQ ID NO: 111340 - DNA, 22 bp, Homo sapiens
ggagctcctggcagtgacagag

SEQ ID NO: 111341 - DNA, 22 bp, Homo sapiens
gcccagcacctctctcagggtt

SEQ ID NO: 111342 - DNA, 22 bp, Homo sapiens
aacagactccattacctggctt

SEQ ID NO: 111343 - DNA, 22 bp, Homo sapiens
caaccccactacacgttggaga

SEQ ID NO: 111344 - DNA, 20 bp, Homo sapiens
aaactaaaggtgtttggttt

SEQ ID NO: 111345 - DNA, 22 bp, Homo sapiens
tccaagatctacagcagtttag

SEQ ID NO: 111346 - DNA, 22 bp, Homo sapiens
ctcaggagttggaggctacagt

SEQ ID NO: 111347 - DNA, 22 bp, Homo sapiens
atcttcccaggctggggagagg

SEQ ID NO: 111348 - DNA, 22 bp, Homo sapiens
accattgcactctagcctgggc

SEQ ID NO: 111349 - DNA, 22 bp, Homo sapiens
cccacgtcgaacttgctccaga

SEQ ID NO: 111350 - DNA, 22 bp, Homo sapiens
taacaaagtattgtttgtgtat

SEQ ID NO: 111351 - DNA, 22 bp, Homo sapiens
gcctccggagttgcagtgtctt

SEQ ID NO: 111352 - DNA, 22 bp, Homo sapiens
cctctgtgtctccaagaggcct

SEQ ID NO: 111353 - DNA, 22 bp, Homo sapiens
ccctggaggcggagcttgcagt

SEQ ID NO: 111354 - DNA, 22 bp, Homo sapiens
gactggaaagcctgtcctcaga

SEQ ID NO: 111355 - DNA, 22 bp, Homo sapiens
cttgtagaattgaaatggtctc

SEQ ID NO: 111356 - DNA, 22 bp, Homo sapiens
gggcaggggtcagtggccccaa

SEQ ID NO: 111357 - DNA, 22 bp, Homo sapiens
gggagaggttacccgagcaact

SEQ ID NO: 111358 - DNA, 22 bp, Homo sapiens
ggtcgctgtgtaggttcagcta

SEQ ID NO: 111359 - DNA, 20 bp, Homo sapiens
ggccggggagctctccaggg

SEQ ID NO: 111360 - DNA, 22 bp, Homo sapiens
tgtgtcagaaggcaatggggat

SEQ ID NO: 111361 - DNA, 22 bp, Homo sapiens
tgtgtggattcatctcaaagag

SEQ ID NO: 111362 - DNA, 22 bp, Homo sapiens
agggagcattgtgacatatcac

SEQ ID NO: 111363 - DNA, 22 bp, Homo sapiens
tgctcattggcgatctgaggga

SEQ ID NO: 111364 - DNA, 22 bp, Homo sapiens
tctttgttattgtgaatagggt

SEQ ID NO: 111365 - DNA, 22 bp, Homo sapiens
gcctccggagtcacagtgtctt

SEQ ID NO: 111366 - DNA, 22 bp, Homo sapiens
ttacctaaaatagctcaattta

SEQ ID NO: 111367 - DNA, 22 bp, Homo sapiens
caggggcggtggctcacgcctg

SEQ ID NO: 111368 - DNA, 23 bp, Homo sapiens
tctgtgtctccacccaaatctca

SEQ ID NO: 111369 - DNA, 22 bp, Homo sapiens
gttcagatttgactggtttctc

SEQ ID NO: 111370 - DNA, 22 bp, Homo sapiens
gcctcctgtcccaggctgagga

SEQ ID NO: 111371 - DNA, 22 bp, Homo sapiens
atgcagtggcttcagtgtcagt

SEQ ID NO: 111372 - DNA, 22 bp, Homo sapiens
ctacattaaattggcttactta

SEQ ID NO: 111373 - DNA, 22 bp, Homo sapiens
ccgcgaggtggaggttgcagtg

SEQ ID NO: 111374 - DNA, 22 bp, Homo sapiens
cagtggcaggatttcagctcag

SEQ ID NO: 111375 - DNA, 19 bp, Homo sapiens
tctcacagctctactatgt

SEQ ID NO: 111376 - DNA, 22 bp, Homo sapiens
cccaggaggtcgaagctgcagt

SEQ ID NO: 111377 - DNA, 22 bp, Homo sapiens
gaggtggccaagcgaggaaggg

SEQ ID NO: 111378 - DNA, 22 bp, Homo sapiens
atctggttttggctgtgtccct

SEQ ID NO: 111379 - DNA, 22 bp, Homo sapiens
gcccatgcactttctgtgatgg

SEQ ID NO: 111380 - DNA, 21 bp, Homo sapiens
gcccacagtgaggaggatccc

SEQ ID NO: 111381 - DNA, 22 bp, Homo sapiens
atgtatacgtgcaagtcacagg

SEQ ID NO: 111382 - DNA, 22 bp, Homo sapiens
cccattcatcctcgcttccttc

SEQ ID NO: 111383 - DNA, 22 bp, Homo sapiens
caggcactgtgctgagctctgc

SEQ ID NO: 111384 - DNA, 22 bp, Homo sapiens
agctgccgatgcccagctgcat

SEQ ID NO: 111385 - DNA, 22 bp, Homo sapiens
ggtgtcagactttgcatatcct

SEQ ID NO: 111386 - DNA, 22 bp, Homo sapiens
ggggatggaggcgtgtggtcct

SEQ ID NO: 111387 - DNA, 22 bp, Homo sapiens
aggacgctctcgctgaacttct

SEQ ID NO: 111388 - DNA, 22 bp, Homo sapiens
ctgtgggatcccatgactttcc

SEQ ID NO: 111389 - DNA, 22 bp, Homo sapiens
gcgtggcttagagtggggtacc

SEQ ID NO: 111390 - DNA, 22 bp, Homo sapiens
aggggaatgggtagactgttga

SEQ ID NO: 111391 - DNA, 20 bp, Homo sapiens
gaaatgtacacattaccaca

SEQ ID NO: 111392 - DNA, 22 bp, Homo sapiens
agctggggctgtggttgtgatt

SEQ ID NO: 111393 - DNA, 22 bp, Homo sapiens
cgtttagttgtcccttcttaaa

SEQ ID NO: 111394 - DNA, 22 bp, Homo sapiens
atgattgaaaatgacattgcca

SEQ ID NO: 111395 - DNA, 22 bp, Homo sapiens
tggtatgtaaattgtaactcaa

SEQ ID NO: 111396 - DNA, 22 bp, Homo sapiens
acggtgctgggtattggggttc

SEQ ID NO: 111397 - DNA, 22 bp, Homo sapiens
tgctcttcacagtttcagcatc

SEQ ID NO: 111398 - DNA, 22 bp, Homo sapiens
agggaacatttgcactgttggt

SEQ ID NO: 111399 - DNA, 22 bp, Homo sapiens
tactgtgtgcccagccgagctg

SEQ ID NO: 111400 - DNA, 22 bp, Homo sapiens
atagagtgatgtaaggtatgtg

SEQ ID NO: 111401 - DNA, 22 bp, Homo sapiens
atatatttgagaatattcatga

SEQ ID NO: 111402 - DNA, 22 bp, Homo sapiens
tgggaacagaggacttgactgt

SEQ ID NO: 111403 - DNA, 22 bp, Homo sapiens
atcctagaatcagcccttgctg

SEQ ID NO: 111404 - DNA, 22 bp, Homo sapiens
tgtgtggattcatctcaaagag

SEQ ID NO: 111405 - DNA, 22 bp, Homo sapiens
gatttagtggcccttggtacac

SEQ ID NO: 111406 - DNA, 22 bp, Homo sapiens
ctccagttggccccagttggtt

SEQ ID NO: 111407 - DNA, 22 bp, Homo sapiens
tgtctggtgggttgacaggcag

SEQ ID NO: 111408 - DNA, 22 bp, Homo sapiens
tggaacaagggcgtggcggtcg

SEQ ID NO: 111409 - DNA, 22 bp, Homo sapiens
gggacttaatgcagagagggac

SEQ ID NO: 111410 - DNA, 22 bp, Homo sapiens
atctggttttggctgtgtccct

SEQ ID NO: 111411 - DNA, 22 bp, Homo sapiens
tcctttaaacaaccagctctca

SEQ ID NO: 111412 - DNA, 22 bp, Homo sapiens
ggatgctctgtctcttgctgtt

SEQ ID NO: 111413 - DNA, 22 bp, Homo sapiens
ttattaggaactcaggattttt

SEQ ID NO: 111414 - DNA, 22 bp, Homo sapiens
ggttggacactaggtaggagcg

SEQ ID NO: 111415 - DNA, 22 bp, Homo sapiens
tggatctcggcaatgcgggact

SEQ ID NO: 111416 - DNA, 22 bp, Homo sapiens
agccagatgaagaggtccttaa

SEQ ID NO: 111417 - DNA, 22 bp, Homo sapiens
gggaggttgaggctgcagtgag

SEQ ID NO: 111418 - DNA, 22 bp, Homo sapiens
aaaagtaattgcggtttttgct

SEQ ID NO: 111419 - DNA, 22 bp, Homo sapiens
aacttaggaaaataaggcatga

SEQ ID NO: 111420 - DNA, 22 bp, Homo sapiens
ggatgttctggggttctcttgt

SEQ ID NO: 111421 - DNA, 22 bp, Homo sapiens
tcccagtttttctccactaagg

SEQ ID NO: 111422 - DNA, 22 bp, Homo sapiens
ccagggatgcagaggttgcagt

SEQ ID NO: 111423 - DNA, 22 bp, Homo sapiens
cccagtttcaactttccagtgg

SEQ ID NO: 111424 - DNA, 22 bp, Homo sapiens
tagatgcttgttcagaaatagg

SEQ ID NO: 111425 - DNA, 22 bp, Homo sapiens
taagagaatgttgtggctaggt

SEQ ID NO: 111426 - DNA, 23 bp, Homo sapiens
aggatgtaggatgtatggcagag

SEQ ID NO: 111427 - DNA, 22 bp, Homo sapiens
ttattgaaggaactgaaataaa

SEQ ID NO: 111428 - DNA, 22 bp, Homo sapiens
ctccagattccgtttattcagg

SEQ ID NO: 111429 - DNA, 22 bp, Homo sapiens
ctgctcttcacactacacccgt

SEQ ID NO: 111430 - DNA, 22 bp, Homo sapiens
tggaatggaaacaaactgagga

SEQ ID NO: 111431 - DNA, 22 bp, Homo sapiens
cttaatctcacctgcaaagtcc

SEQ ID NO: 111432 - DNA, 22 bp, Homo sapiens
aaaagtaattgtggtttttgct

SEQ ID NO: 111433 - DNA, 22 bp, Homo sapiens
tcagggattgcaaaattcatcc

SEQ ID NO: 111434 - DNA, 22 bp, Homo sapiens
tgttcttgagcctttagaccta

SEQ ID NO: 111435 - DNA, 22 bp, Homo sapiens
tccagggagagccgctgctcca

SEQ ID NO: 111436 - DNA, 22 bp, Homo sapiens
cttctcggccgtgtggatgcgc

SEQ ID NO: 111437 - DNA, 22 bp, Homo sapiens
actttaattaatgaactgtggc

SEQ ID NO: 111438 - DNA, 22 bp, Homo sapiens
gaatatcccgctatgcaaagta

SEQ ID NO: 111439 - DNA, 22 bp, Homo sapiens
tggtatgaccgtggtgcaagca

SEQ ID NO: 111440 - DNA, 21 bp, Homo sapiens
tggacttatggagtgtttctt

SEQ ID NO: 111441 - DNA, 22 bp, Homo sapiens
ggccgtgctccaaagtcatcgt

SEQ ID NO: 111442 - DNA, 22 bp, Homo sapiens
ctgctcttgagggactgcggtc

SEQ ID NO: 111443 - DNA, 22 bp, Homo sapiens
gctgtgtatcagatgccacggg

SEQ ID NO: 111444 - DNA, 22 bp, Homo sapiens
gcctggattccttgtttctcag

SEQ ID NO: 111445 - DNA, 20 bp, Homo sapiens
cattggacttggcttcatgg

SEQ ID NO: 111446 - DNA, 22 bp, Homo sapiens
aggacttagaacattatgtact

SEQ ID NO: 111447 - DNA, 22 bp, Homo sapiens
ttgtgaatagtgccgcaataaa

SEQ ID NO: 111448 - DNA, 22 bp, Homo sapiens
ttgtgaatagtgccgctataaa

SEQ ID NO: 111449 - DNA, 22 bp, Homo sapiens
gatttttatataaagtgagaaa

SEQ ID NO: 111450 - DNA, 22 bp, Homo sapiens
tttttgagatggatttagctct

SEQ ID NO: 111451 - DNA, 18 bp, Homo sapiens
gcagctagccaggggggc

SEQ ID NO: 111452 - DNA, 22 bp, Homo sapiens
gcaggtggatcacctgaggtca

SEQ ID NO: 111453 - DNA, 22 bp, Homo sapiens
gacaggaggcagagctcaggtg

SEQ ID NO: 111454 - DNA, 22 bp, Homo sapiens
cttcagctgcagttatgtttag

SEQ ID NO: 111455 - DNA, 21 bp, Homo sapiens
taggtgggagccccagtatgc

SEQ ID NO: 111456 - DNA, 22 bp, Homo sapiens
atgaagcgttcgagataggtag

SEQ ID NO: 111457 - DNA, 22 bp, Homo sapiens
aggtggggaggagtgtctcttt

SEQ ID NO: 111458 - DNA, 22 bp, Homo sapiens
agagtgcaaccgaaacaagcag

SEQ ID NO: 111459 - DNA, 22 bp, Homo sapiens
aaggtgggtggatcacgaggtc

SEQ ID NO: 111460 - DNA, 22 bp, Homo sapiens
aaggtgggcagatcacaaggtc

SEQ ID NO: 111461 - DNA, 22 bp, Homo sapiens
gacaggtgctaagggacctggc

SEQ ID NO: 111462 - DNA, 19 bp, Homo sapiens
tctcaattctccccactgc

SEQ ID NO: 111463 - DNA, 22 bp, Homo sapiens
actttatttcctattgcatcca

SEQ ID NO: 111464 - DNA, 22 bp, Homo sapiens
aaagcagaactgagagagctgg

SEQ ID NO: 111465 - DNA, 22 bp, Homo sapiens
tggtggggccagacttcagctc

SEQ ID NO: 111466 - DNA, 22 bp, Homo sapiens
ttatttttaaaagttcacacag

SEQ ID NO: 111467 - DNA, 22 bp, Homo sapiens
gcaggtggatcaccacgtcagg

SEQ ID NO: 111468 - DNA, 22 bp, Homo sapiens
ggggtgtggacggctgtgccag

SEQ ID NO: 111469 - DNA, 22 bp, Homo sapiens
gaggtgggtgtatcacaggtca

SEQ ID NO: 111470 - DNA, 22 bp, Homo sapiens
ggctcaatgcaacttctgcctc

SEQ ID NO: 111471 - DNA, 22 bp, Homo sapiens
gaggtgggcggatcacaaggtc

SEQ ID NO: 111472 - DNA, 22 bp, Homo sapiens
gagtaggttgtcagactccaaa

SEQ ID NO: 111473 - DNA, 22 bp, Homo sapiens
ttgtgaatggtgccgcaataaa

SEQ ID NO: 111474 - DNA, 22 bp, Homo sapiens
cagaagactgcagggaagggac

SEQ ID NO: 111475 - DNA, 22 bp, Homo sapiens
ttaggcctttgattggggtgct

SEQ ID NO: 111476 - DNA, 22 bp, Homo sapiens
acctggacacctgctgtcatct

SEQ ID NO: 111477 - DNA, 22 bp, Homo sapiens
cgcaggtgaaagaggctgggca

SEQ ID NO: 111478 - DNA, 22 bp, Homo sapiens
aaagcagaggttgcagtgagct

SEQ ID NO: 111479 - DNA, 22 bp, Homo sapiens
agctcaatgcaacctccgcctc

SEQ ID NO: 111480 - DNA, 22 bp, Homo sapiens
caaagcaggaagctcctgacag

SEQ ID NO: 111481 - DNA, 20 bp, Homo sapiens
tgtttgtgtggggccttggc

SEQ ID NO: 111482 - DNA, 22 bp, Homo sapiens
gaactttataactgtaaatgtc

SEQ ID NO: 111483 - DNA, 22 bp, Homo sapiens
ggctcacgcaattatcccggcc

SEQ ID NO: 111484 - DNA, 23 bp, Homo sapiens
gcgtccggcctctctcgctcccg

SEQ ID NO: 111485 - DNA, 22 bp, Homo sapiens
tgagaactgcctgtatttatct

SEQ ID NO: 111486 - DNA, 18 bp, Homo sapiens
tgagaggctattttttgc

SEQ ID NO: 111487 - DNA, 18 bp, Homo sapiens
ggagactaaactgttgac

SEQ ID NO: 111488 - DNA, 22 bp, Homo sapiens
tactttaatatatgtgaagttc

SEQ ID NO: 111489 - DNA, 22 bp, Homo sapiens
tcccggcgctgggaggtgggtc

SEQ ID NO: 111490 - DNA, 22 bp, Homo sapiens
ctggtaggggtgactgttatcg

SEQ ID NO: 111491 - DNA, 22 bp, Homo sapiens
cggctcactgcagctccgcctc

SEQ ID NO: 111492 - DNA, 22 bp, Homo sapiens
actttaattaatgaactgtggc

SEQ ID NO: 111493 - DNA, 22 bp, Homo sapiens
gcgagtgccgagagggcagggc

SEQ ID NO: 111494 - DNA, 22 bp, Homo sapiens
aggcggaagatggccccataga

SEQ ID NO: 111495 - DNA, 22 bp, Homo sapiens
cgccgcctgctgcagcagctgt

SEQ ID NO: 111496 - DNA, 22 bp, Homo sapiens
gggctagcctcttccctgctcc

SEQ ID NO: 111497 - DNA, 22 bp, Homo sapiens
ccggctcggcgaccaggctgaa

SEQ ID NO: 111498 - DNA, 22 bp, Homo sapiens
ttccacggggctccccgctctt

SEQ ID NO: 111499 - DNA, 22 bp, Homo sapiens
tcaccggcagacgtggcctgat

SEQ ID NO: 111500 - DNA, 22 bp, Homo sapiens
cgggcgcactccgggcagctgt

SEQ ID NO: 111501 - DNA, 22 bp, Homo sapiens
ctgatagacaatcaccatggga

SEQ ID NO: 111502 - DNA, 22 bp, Homo sapiens
cgccggcttgaggcaggcggca

SEQ ID NO: 111503 - DNA, 22 bp, Homo sapiens
tgggatgccggcaggaggcaat

SEQ ID NO: 111504 - DNA, 22 bp, Homo sapiens
agcgccactgcactccagcctg

SEQ ID NO: 111505 - DNA, 22 bp, Homo sapiens
agagtactgcctcagttatgaa

SEQ ID NO: 111506 - DNA, 22 bp, Homo sapiens
ccggcgtctcttccacttccta

SEQ ID NO: 111507 - DNA, 22 bp, Homo sapiens
gccggggctggggagagacatg

SEQ ID NO: 111508 - DNA, 22 bp, Homo sapiens
tactaggaagcagctgcattgg

SEQ ID NO: 111509 - DNA, 22 bp, Homo sapiens
ggcgcccccttcaaacagagca

SEQ ID NO: 111510 - DNA, 22 bp, Homo sapiens
cctcggctgggccttggccact

SEQ ID NO: 111511 - DNA, 22 bp, Homo sapiens
cgcgctctccttctggcaccca

SEQ ID NO: 111512 - DNA, 22 bp, Homo sapiens
tagactagaggatcagcaaggg

SEQ ID NO: 111513 - DNA, 22 bp, Homo sapiens
atgattgaccatctgctgggct

SEQ ID NO: 111514 - DNA, 22 bp, Homo sapiens
tcatctaagagtcttacattta

SEQ ID NO: 111515 - DNA, 22 bp, Homo sapiens
tcagcctgctccaagtgctgcc

SEQ ID NO: 111516 - DNA, 22 bp, Homo sapiens
ctgcccgcaccatccccgggct

SEQ ID NO: 111517 - DNA, 22 bp, Homo sapiens
tcaggcagtagaattgcttgaa

SEQ ID NO: 111518 - DNA, 22 bp, Homo sapiens
tctctttgcctgctgccatcca

SEQ ID NO: 111519 - DNA, 22 bp, Homo sapiens
tatttaataaaactatggcatg

SEQ ID NO: 111520 - DNA, 22 bp, Homo sapiens
gagggagggactagcattctct

SEQ ID NO: 111521 - DNA, 22 bp, Homo sapiens
gagtcgagcagaaagccgtcgg

SEQ ID NO: 111522 - DNA, 22 bp, Homo sapiens
ctgcagtatgagctacccaggt

SEQ ID NO: 111523 - DNA, 22 bp, Homo sapiens
cgcccaggctggagtgcagtga

SEQ ID NO: 111524 - DNA, 22 bp, Homo sapiens
ccccacaactcatgttgaaact

SEQ ID NO: 111525 - DNA, 22 bp, Homo sapiens
cccagctcttcaagtcaccccc

SEQ ID NO: 111526 - DNA, 22 bp, Homo sapiens
cccagttgttgccggctctgga

SEQ ID NO: 111527 - DNA, 22 bp, Homo sapiens
acagttaattgttgttgggtgt

SEQ ID NO: 111528 - DNA, 22 bp, Homo sapiens
catgagataatttttctccagt

SEQ ID NO: 111529 - DNA, 18 bp, Homo sapiens
gatatggaaggccatgcc

SEQ ID NO: 111530 - DNA, 22 bp, Homo sapiens
tcccagtttttctccactaagg

SEQ ID NO: 111531 - DNA, 22 bp, Homo sapiens
aactctatttaccctactaaac

SEQ ID NO: 111532 - DNA, 22 bp, Homo sapiens
ctcattgcagctgcattactgt

SEQ ID NO: 111533 - DNA, 22 bp, Homo sapiens
tagaatgtaaattccaagggca

SEQ ID NO: 111534 - DNA, 22 bp, Homo sapiens
ggaggcggaagttgcagtgagc

SEQ ID NO: 111535 - DNA, 22 bp, Homo sapiens
attggtagttttgtatttctct

SEQ ID NO: 111536 - DNA, 22 bp, Homo sapiens
gtagctctgtttaaagttcttt

SEQ ID NO: 111537 - DNA, 22 bp, Homo sapiens
aggtctcttgctgtctctgggc

SEQ ID NO: 111538 - DNA, 22 bp, Homo sapiens
caggctggagtgcagtggtgcc

SEQ ID NO: 111539 - DNA, 22 bp, Homo sapiens
tgttaaatgctcagctcgggga

SEQ ID NO: 111540 - DNA, 22 bp, Homo sapiens
tccagggccatctccatgaggc

SEQ ID NO: 111541 - DNA, 22 bp, Homo sapiens
tggttcctcaagcgctggcggc

SEQ ID NO: 111542 - DNA, 22 bp, Homo sapiens
cggggcgagcagacggcggcaa

SEQ ID NO: 111543 - DNA, 22 bp, Homo sapiens
tgcctactagtactattttgtg

SEQ ID NO: 111544 - DNA, 22 bp, Homo sapiens
tcacttagatggggatcatcac

SEQ ID NO: 111545 - DNA, 22 bp, Homo sapiens
tgaaatgtgtaatgtggatgcc

SEQ ID NO: 111546 - DNA, 22 bp, Homo sapiens
aagcttcctgcatgggactgct

SEQ ID NO: 111547 - DNA, 22 bp, Homo sapiens
cacagagctggaaaggctgggc

SEQ ID NO: 111548 - DNA, 22 bp, Homo sapiens
cagagcccctcgtctccaccac

SEQ ID NO: 111549 - DNA, 22 bp, Homo sapiens
cttctttcaagaatggattagg

SEQ ID NO: 111550 - DNA, 22 bp, Homo sapiens
gatctggaatctgaaggctgag

SEQ ID NO: 111551 - DNA, 22 bp, Homo sapiens
gagatggagtctttttctgtca

SEQ ID NO: 111552 - DNA, 22 bp, Homo sapiens
gggagctgagctggaagagaat

SEQ ID NO: 111553 - DNA, 22 bp, Homo sapiens
tgtctggtgggttgacaggcag

SEQ ID NO: 111554 - DNA, 22 bp, Homo sapiens
tcaccttgtgatctccctgcct

SEQ ID NO: 111555 - DNA, 22 bp, Homo sapiens
gcccagagttcaaggctgcagt

SEQ ID NO: 111556 - DNA, 22 bp, Homo sapiens
aatgcaatgcagcacctccttg

SEQ ID NO: 111557 - DNA, 22 bp, Homo sapiens
ggaggcggaggttgcagtgagc

SEQ ID NO: 111558 - DNA, 22 bp, Homo sapiens
tctgtggcccaagtgatggctg

SEQ ID NO: 111559 - DNA, 22 bp, Homo sapiens
ttctcttttcaccagttgctaa

SEQ ID NO: 111560 - DNA, 22 bp, Homo sapiens
gggaggcacgaggcgcgcagtg

SEQ ID NO: 111561 - DNA, 22 bp, Homo sapiens
gcacggctaatttttgtatttt

SEQ ID NO: 111562 - DNA, 22 bp, Homo sapiens
ctggaggtgcttcgctggccac

SEQ ID NO: 111563 - DNA, 22 bp, Homo sapiens
tttctttatcatagcatctttg

SEQ ID NO: 111564 - DNA, 22 bp, Homo sapiens
atgaaatatcttgaagaaattc

SEQ ID NO: 111565 - DNA, 22 bp, Homo sapiens
ccacactccccgcaggcgtagg

SEQ ID NO: 111566 - DNA, 22 bp, Homo sapiens
ccagcagagcatggggaggaag

SEQ ID NO: 111567 - DNA, 22 bp, Homo sapiens
tgagcaggcgcagcaggaggtc

SEQ ID NO: 111568 - DNA, 22 bp, Homo sapiens
gagatgggcgagaaggtggact

SEQ ID NO: 111569 - DNA, 22 bp, Homo sapiens
agtgctatcgagttctaatgct

SEQ ID NO: 111570 - DNA, 22 bp, Homo sapiens
ggagtgactcacagctgggaca

SEQ ID NO: 111571 - DNA, 22 bp, Homo sapiens
tcccacacagcccgctcaccgg

SEQ ID NO: 111572 - DNA, 22 bp, Homo sapiens
ggaggaggggtgactgaatgct

SEQ ID NO: 111573 - DNA, 22 bp, Homo sapiens
tgtaagtagtaatggaaggaca

SEQ ID NO: 111574 - DNA, 22 bp, Homo sapiens
tcgcgcccccaagcgtcattgg

SEQ ID NO: 111575 - DNA, 22 bp, Homo sapiens
aaccaccattctctcctcttcc

SEQ ID NO: 111576 - DNA, 22 bp, Homo sapiens
ttctggtgggactcaggctttc

SEQ ID NO: 111577 - DNA, 22 bp, Homo sapiens
gtcttagatttcaccgataatg

SEQ ID NO: 111578 - DNA, 22 bp, Homo sapiens
tataaactcctcttgcattcct

SEQ ID NO: 111579 - DNA, 19 bp, Homo sapiens
accttctgggaaacattcc

SEQ ID NO: 111580 - DNA, 22 bp, Homo sapiens
atgcaggcagacactgtgggca

SEQ ID NO: 111581 - DNA, 22 bp, Homo sapiens
ctgggctcaagtgatccaccca

SEQ ID NO: 111582 - DNA, 18 bp, Homo sapiens
tctgccccagccgcactg

SEQ ID NO: 111583 - DNA, 22 bp, Homo sapiens
tgcccaggctggagtgcagtgg

SEQ ID NO: 111584 - DNA, 22 bp, Homo sapiens
ggagaggcttccagagtcgtgc

SEQ ID NO: 111585 - DNA, 22 bp, Homo sapiens
tgcagtcttccagctgcacaaa

SEQ ID NO: 111586 - DNA, 22 bp, Homo sapiens
tttctcctcatgactggttgtg

SEQ ID NO: 111587 - DNA, 22 bp, Homo sapiens
cagccccatggtgtgctccagc

SEQ ID NO: 111588 - DNA, 22 bp, Homo sapiens
ccagtgacttgccaggtggatc

SEQ ID NO: 111589 - DNA, 22 bp, Homo sapiens
tgtgtttctgagaatcccacct

SEQ ID NO: 111590 - DNA, 22 bp, Homo sapiens
gcacatgcatgcatattcctgg

SEQ ID NO: 111591 - DNA, 22 bp, Homo sapiens
ttctgattgctgatgaggccca

SEQ ID NO: 111592 - DNA, 22 bp, Homo sapiens
atattacacacggtatcacggg

SEQ ID NO: 111593 - DNA, 22 bp, Homo sapiens
actcatgtaagcggaatgtagt

SEQ ID NO: 111594 - DNA, 22 bp, Homo sapiens
tcccaccttccgtggaacccgt

SEQ ID NO: 111595 - DNA, 22 bp, Homo sapiens
cccaggaggtggaggctgcagt

SEQ ID NO: 111596 - DNA, 22 bp, Homo sapiens
ctgattctcctcaagactttcg

SEQ ID NO: 111597 - DNA, 22 bp, Homo sapiens
gggagcctgtggatgtctgact

SEQ ID NO: 111598 - DNA, 22 bp, Homo sapiens
aggggaatgggtagactgttga

SEQ ID NO: 111599 - DNA, 22 bp, Homo sapiens
ttggagatatcacaccttcaca

SEQ ID NO: 111600 - DNA, 22 bp, Homo sapiens
ctgtccagcgactaggggatgg

SEQ ID NO: 111601 - DNA, 22 bp, Homo sapiens
ggtgggagagctctgtctccag

SEQ ID NO: 111602 - DNA, 20 bp, Homo sapiens
tcccccactgtttctgctac

SEQ ID NO: 111603 - DNA, 22 bp, Homo sapiens
gtttctctgtctgttacattgg

SEQ ID NO: 111604 - DNA, 22 bp, Homo sapiens
ctgtcctgccagtcctggactc

SEQ ID NO: 111605 - DNA, 22 bp, Homo sapiens
ctgtggctctttagttgagcac

SEQ ID NO: 111606 - DNA, 22 bp, Homo sapiens
tccctgaggatggttgtattta

SEQ ID NO: 111607 - DNA, 22 bp, Homo sapiens
agcaggagtttgatgcttttat

SEQ ID NO: 111608 - DNA, 22 bp, Homo sapiens
gaatgcttggaacctgaagttc

SEQ ID NO: 111609 - DNA, 22 bp, Homo sapiens
taagggttcagaatgcagtggt

SEQ ID NO: 111610 - DNA, 22 bp, Homo sapiens
gaactcattagcctgctttcag

SEQ ID NO: 111611 - DNA, 22 bp, Homo sapiens
tctaccctgcggtcttggggca

SEQ ID NO: 111612 - DNA, 22 bp, Homo sapiens
gaggggcacagtaaagggtccc

SEQ ID NO: 111613 - DNA, 22 bp, Homo sapiens
gccaggtatgaattacgcacga

SEQ ID NO: 111614 - DNA, 22 bp, Homo sapiens
tgcacgtgtgagcattcacatg

SEQ ID NO: 111615 - DNA, 22 bp, Homo sapiens
ggcagcactgcagcttgttggg

SEQ ID NO: 111616 - DNA, 22 bp, Homo sapiens
tgtggctctcatgcactcccag

SEQ ID NO: 111617 - DNA, 22 bp, Homo sapiens
tccttgccctaaatgtctgtgt

SEQ ID NO: 111618 - DNA, 23 bp, Homo sapiens
aggtaggttattgctgctacctg

SEQ ID NO: 111619 - DNA, 17 bp, Homo sapiens
gagcccctttccaagtt

SEQ ID NO: 111620 - DNA, 22 bp, Homo sapiens
agtactgtcagcagggtgttga

SEQ ID NO: 111621 - DNA, 22 bp, Homo sapiens
caggcagggagctggaaaggat

SEQ ID NO: 111622 - DNA, 22 bp, Homo sapiens
tacaaaaaattgatactgacga

SEQ ID NO: 111623 - DNA, 22 bp, Homo sapiens
tggagccagcggcctgctgagg

SEQ ID NO: 111624 - DNA, 22 bp, Homo sapiens
aacactgctgctgggttctgtg

SEQ ID NO: 111625 - DNA, 22 bp, Homo sapiens
gagtgcaatggcatgatctggg

SEQ ID NO: 111626 - DNA, 23 bp, Homo sapiens
gctcatcaggcttagagtcaagg

SEQ ID NO: 111627 - DNA, 22 bp, Homo sapiens
tgtcagggatttccaactcccc

SEQ ID NO: 111628 - DNA, 22 bp, Homo sapiens
atatacacatctttttaaatat

SEQ ID NO: 111629 - DNA, 22 bp, Homo sapiens
caccatgcccggctaattttgg

SEQ ID NO: 111630 - DNA, 14 bp, Homo sapiens
gcaggcagatcacc

SEQ ID NO: 111631 - DNA, 20 bp, Homo sapiens
acgtggccaccagtggctta

SEQ ID NO: 111632 - DNA, 22 bp, Homo sapiens
aagtggactaatacaaggacta

SEQ ID NO: 111633 - DNA, 22 bp, Homo sapiens
tgccgtggggctgaggctggag

SEQ ID NO: 111634 - DNA, 22 bp, Homo sapiens
tagcacagcttcttgatgtcac

SEQ ID NO: 111635 - DNA, 22 bp, Homo sapiens
tcacaaatgtttgcatgtgtct

SEQ ID NO: 111636 - DNA, 19 bp, Homo sapiens
ggctgccttctgctcatct

SEQ ID NO: 111637 - DNA, 22 bp, Homo sapiens
ttacctaaaatagctcaattta

SEQ ID NO: 111638 - DNA, 22 bp, Homo sapiens
tacatttataaggcttctctgt

SEQ ID NO: 111639 - DNA, 19 bp, Homo sapiens
tcctgcccaccagccaggg

SEQ ID NO: 111640 - DNA, 22 bp, Homo sapiens
actccacatttgaacacagttc

SEQ ID NO: 111641 - DNA, 22 bp, Homo sapiens
caggctggagttcagtggtgtg

SEQ ID NO: 111642 - DNA, 22 bp, Homo sapiens
ggccactgctctccagcctggg

SEQ ID NO: 111643 - DNA, 22 bp, Homo sapiens
tgggcagggagctggaaccaca

SEQ ID NO: 111644 - DNA, 22 bp, Homo sapiens
cattgcaacttcaaactcctgg

SEQ ID NO: 111645 - DNA, 22 bp, Homo sapiens
ttcattcttcagagctgcgctt

SEQ ID NO: 111646 - DNA, 22 bp, Homo sapiens
caaatactacgattcttgcagt

SEQ ID NO: 111647 - DNA, 22 bp, Homo sapiens
ggggtgggcgtgcagggacacc

SEQ ID NO: 111648 - DNA, 22 bp, Homo sapiens
tgctccagcaccaagagctcca

SEQ ID NO: 111649 - DNA, 22 bp, Homo sapiens
atgcgagtgatgcagagtggct

SEQ ID NO: 111650 - DNA, 22 bp, Homo sapiens
gcggcggcggtcattgagcatg

SEQ ID NO: 111651 - DNA, 22 bp, Homo sapiens
aaccccgctcaggctgggtgag

SEQ ID NO: 111652 - DNA, 22 bp, Homo sapiens
cttcatcagctggcttactgtt

SEQ ID NO: 111653 - DNA, 22 bp, Homo sapiens
agtgctgtctccttcccccggg

SEQ ID NO: 111654 - DNA, 22 bp, Homo sapiens
tgtgactaggcctgagctcttg

SEQ ID NO: 111655 - DNA, 22 bp, Homo sapiens
cccatgcaccctctaagaagga

SEQ ID NO: 111656 - DNA, 22 bp, Homo sapiens
tagcccaggctggagtgcaggg

SEQ ID NO: 111657 - DNA, 22 bp, Homo sapiens
tcctcattcttggtgcatcaaa

SEQ ID NO: 111658 - DNA, 22 bp, Homo sapiens
tcagacattattttcaagataa

SEQ ID NO: 111659 - DNA, 22 bp, Homo sapiens
agccagactgtgatgtgattaa

SEQ ID NO: 111660 - DNA, 22 bp, Homo sapiens
cccaggaattggaggctgcagt

SEQ ID NO: 111661 - DNA, 23 bp, Homo sapiens
gtatacgtgcaagtcacagggga

SEQ ID NO: 111662 - DNA, 22 bp, Homo sapiens
gcaggcagatcacctgtcagga

SEQ ID NO: 111663 - DNA, 22 bp, Homo sapiens
ggttccccaggcggcccttgga

SEQ ID NO: 111664 - DNA, 22 bp, Homo sapiens
tgatgcgtctcctctttcaggt

SEQ ID NO: 111665 - DNA, 22 bp, Homo sapiens
cgggcagtgtggctccagagtc

SEQ ID NO: 111666 - DNA, 21 bp, Homo sapiens
tgactgaggcttcttcacaca

SEQ ID NO: 111667 - DNA, 22 bp, Homo sapiens
ctgggaggcagaggttgtagtg

SEQ ID NO: 111668 - DNA, 22 bp, Homo sapiens
agcccaggctggagtgcagtgg

SEQ ID NO: 111669 - DNA, 22 bp, Homo sapiens
acagcccagctctttctctgca

SEQ ID NO: 111670 - DNA, 22 bp, Homo sapiens
aactatgttaataagtttcatt

SEQ ID NO: 111671 - DNA, 22 bp, Homo sapiens
caggcaggtcagtgaagaagga

SEQ ID NO: 111672 - DNA, 22 bp, Homo sapiens
tcaggctcaggttaggggccaa

SEQ ID NO: 111673 - DNA, 22 bp, Homo sapiens
tctaaattactttgggcagtat

SEQ ID NO: 111674 - DNA, 22 bp, Homo sapiens
tcattctcacactcgtcaatgt

SEQ ID NO: 111675 - DNA, 22 bp, Homo sapiens
cgccccggacgtctgaccaaac

SEQ ID NO: 111676 - DNA, 22 bp, Homo sapiens
ttctttgcccatgtttcctaag

SEQ ID NO: 111677 - DNA, 22 bp, Homo sapiens
gaatatcccgctatgcaaagta

SEQ ID NO: 111678 - DNA, 22 bp, Homo sapiens
tcctcagtcacggtagcacatt

SEQ ID NO: 111679 - DNA, 22 bp, Homo sapiens
agggaagaggaccagagtctct

SEQ ID NO: 111680 - DNA, 22 bp, Homo sapiens
tgttgcacggccttcacagagc

SEQ ID NO: 111681 - DNA, 22 bp, Homo sapiens
tagcagcatttttgtagagtat

SEQ ID NO: 111682 - DNA, 23 bp, Homo sapiens
tagatgtattaagtgcattttca

SEQ ID NO: 111683 - DNA, 22 bp, Homo sapiens
tcacagctcactgtagcctcga

SEQ ID NO: 111684 - DNA, 22 bp, Homo sapiens
atatatttgagaatattcatga

SEQ ID NO: 111685 - DNA, 22 bp, Homo sapiens
tttgaagactactgggagtgaa

SEQ ID NO: 111686 - DNA, 22 bp, Homo sapiens
tggcacagactgggccaaggaa

SEQ ID NO: 111687 - DNA, 22 bp, Homo sapiens
cagccctcctaccctgccaggc

SEQ ID NO: 111688 - DNA, 20 bp, Homo sapiens
aaaatatgtataactcttct

SEQ ID NO: 111689 - DNA, 22 bp, Homo sapiens
tgagacaggcttccttcttggg

SEQ ID NO: 111690 - DNA, 22 bp, Homo sapiens
tttctcttcactgtgtgcctca

SEQ ID NO: 111691 - DNA, 22 bp, Homo sapiens
ttgtaagtcacaccagggcagg

SEQ ID NO: 111692 - DNA, 22 bp, Homo sapiens
taggggcaggatcctttgagcc

SEQ ID NO: 111693 - DNA, 22 bp, Homo sapiens
ttcacagcttaataaggctcag

SEQ ID NO: 111694 - DNA, 22 bp, Homo sapiens
gcccaggagttcaagtctagtg

SEQ ID NO: 111695 - DNA, 23 bp, Homo sapiens
tctacaaagctgtgtcaggaccc

SEQ ID NO: 111696 - DNA, 22 bp, Homo sapiens
ctgggatccacgggctcccaag

SEQ ID NO: 111697 - DNA, 22 bp, Homo sapiens
tgcagattcaaatgaaatgcaa

SEQ ID NO: 111698 - DNA, 22 bp, Homo sapiens
tgcgttgcgctcctgcagcagg

SEQ ID NO: 111699 - DNA, 21 bp, Homo sapiens
tgctccaggagggggcagtcc

SEQ ID NO: 111700 - DNA, 23 bp, Homo sapiens
tgttccagatacgccttttcctc

SEQ ID NO: 111701 - DNA, 22 bp, Homo sapiens
ggaggagcatgagagggtagtg

SEQ ID NO: 111702 - DNA, 18 bp, Homo sapiens
cagggctgtggggtcact

SEQ ID NO: 111703 - DNA, 22 bp, Homo sapiens
gggcagagagctggaactcctt

SEQ ID NO: 111704 - DNA, 22 bp, Homo sapiens
cccccagctctgctgggtcccg

SEQ ID NO: 111705 - DNA, 22 bp, Homo sapiens
aagaagagaactggcatcctaa

SEQ ID NO: 111706 - DNA, 22 bp, Homo sapiens
agcttgacagacagatggtagc

SEQ ID NO: 111707 - DNA, 22 bp, Homo sapiens
gagcccaggagtttgatgctgc

SEQ ID NO: 111708 - DNA, 22 bp, Homo sapiens
caggccagggttgagaagagaa

SEQ ID NO: 111709 - DNA, 22 bp, Homo sapiens
tgcatctgcctggagtagcgcc

SEQ ID NO: 111710 - DNA, 22 bp, Homo sapiens
atcacagggtgaggattagacc

SEQ ID NO: 111711 - DNA, 22 bp, Homo sapiens
gtgtaagtatctttgtatcttt

SEQ ID NO: 111712 - DNA, 22 bp, Homo sapiens
cttcctttgctgttcggaggtt

SEQ ID NO: 111713 - DNA, 22 bp, Homo sapiens
ccaggctggagtatagtggcgc

SEQ ID NO: 111714 - DNA, 22 bp, Homo sapiens
cccctcttggcattgagtgcca

SEQ ID NO: 111715 - DNA, 22 bp, Homo sapiens
cccattcttcatacaagtctaa

SEQ ID NO: 111716 - DNA, 22 bp, Homo sapiens
gtagagcagggagcaggaagct

SEQ ID NO: 111717 - DNA, 22 bp, Homo sapiens
acagttaataagtagtaagtca

SEQ ID NO: 111718 - DNA, 22 bp, Homo sapiens
accctctagagggaagcacttt

SEQ ID NO: 111719 - DNA, 22 bp, Homo sapiens
atgatactctaggtgatttaca

SEQ ID NO: 111720 - DNA, 22 bp, Homo sapiens
cctcccctcagacagagactgg

SEQ ID NO: 111721 - DNA, 22 bp, Homo sapiens
tgaacatgctgttgatggcctg

SEQ ID NO: 111722 - DNA, 22 bp, Homo sapiens
ccagaagcagagcctgaggcag

SEQ ID NO: 111723 - DNA, 22 bp, Homo sapiens
tgctccatgcgctcggccggcg

SEQ ID NO: 111724 - DNA, 19 bp, Homo sapiens
gttctttcatagtaagagc

SEQ ID NO: 111725 - DNA, 22 bp, Homo sapiens
aagaaatgtgaatattgaatag

SEQ ID NO: 111726 - DNA, 22 bp, Homo sapiens
cggagcctgcttgttgcagctg

SEQ ID NO: 111727 - DNA, 22 bp, Homo sapiens
cccaggagttggaggctgcagt

SEQ ID NO: 111728 - DNA, 22 bp, Homo sapiens
ttaataaagtatgaattggaaa

SEQ ID NO: 111729 - DNA, 22 bp, Homo sapiens
tgtctggatagagcctaggccc

SEQ ID NO: 111730 - DNA, 22 bp, Homo sapiens
cgcccaggctggagagcagtgg

SEQ ID NO: 111731 - DNA, 22 bp, Homo sapiens
cctttcctgtgtccttttaagg

SEQ ID NO: 111732 - DNA, 22 bp, Homo sapiens
cccaggcttttctcttgcccca

SEQ ID NO: 111733 - DNA, 22 bp, Homo sapiens
ttgagacacagtttcactctgt

SEQ ID NO: 111734 - DNA, 22 bp, Homo sapiens
gcccaggctggagtgcagtggt

SEQ ID NO: 111735 - DNA, 22 bp, Homo sapiens
ccccatgaagtagggtctctga

SEQ ID NO: 111736 - DNA, 22 bp, Homo sapiens
tctttggtttctgtctctgtaa

SEQ ID NO: 111737 - DNA, 22 bp, Homo sapiens
acatcttttactctggttcggg

SEQ ID NO: 111738 - DNA, 22 bp, Homo sapiens
tgaagcaaattgtttagcctga

SEQ ID NO: 111739 - DNA, 22 bp, Homo sapiens
gtcacccgtttgactatccacc

SEQ ID NO: 111740 - DNA, 22 bp, Homo sapiens
atcaaatacaaagggcataagg

SEQ ID NO: 111741 - DNA, 20 bp, Homo sapiens
aagacaccagtggcagcccc

SEQ ID NO: 111742 - DNA, 22 bp, Homo sapiens
tgctagtgtgtgagatgttcaa

SEQ ID NO: 111743 - DNA, 22 bp, Homo sapiens
cggggttcatccatgctgtggc

SEQ ID NO: 111744 - DNA, 22 bp, Homo sapiens
tggaatggaaacaaactgagga

SEQ ID NO: 111745 - DNA, 22 bp, Homo sapiens
ccaggaggttgaggctgcagtg

SEQ ID NO: 111746 - DNA, 22 bp, Homo sapiens
ttcagacaggcagctgggctgg

SEQ ID NO: 111747 - DNA, 22 bp, Homo sapiens
actttaaaactgatcatcagag

SEQ ID NO: 111748 - DNA, 22 bp, Homo sapiens
ggcctgtaatcccagctactca

SEQ ID NO: 111749 - DNA, 21 bp, Homo sapiens
tccctgagcccaaggggctcc

SEQ ID NO: 111750 - DNA, 22 bp, Homo sapiens
aacctgggcttgaacagtgcct

SEQ ID NO: 111751 - DNA, 22 bp, Homo sapiens
gggctgggattgcttgctgtga

SEQ ID NO: 111752 - DNA, 22 bp, Homo sapiens
acatttttcacatttgtagggt

SEQ ID NO: 111753 - DNA, 22 bp, Homo sapiens
agagcagctcgctacctctcta

SEQ ID NO: 111754 - DNA, 22 bp, Homo sapiens
ccctggctgataccggaaaggc

SEQ ID NO: 111755 - DNA, 22 bp, Homo sapiens
ggctcctgggggtgctcctgcc

SEQ ID NO: 111756 - DNA, 22 bp, Homo sapiens
ctctagtagctgagattacagg

SEQ ID NO: 111757 - DNA, 22 bp, Homo sapiens
gttggctatgagagctttagtg

SEQ ID NO: 111758 - DNA, 20 bp, Homo sapiens
cagagccagggttttgtttt

SEQ ID NO: 111759 - DNA, 22 bp, Homo sapiens
atttctctgcagtgttcggaat

SEQ ID NO: 111760 - DNA, 22 bp, Homo sapiens
gcctcctgagtagctgggattg

SEQ ID NO: 111761 - DNA, 22 bp, Homo sapiens
tttaagaagttatgttataaat

SEQ ID NO: 111762 - DNA, 22 bp, Homo sapiens
caggcagaagaagtggaaggac

SEQ ID NO: 111763 - DNA, 22 bp, Homo sapiens
gaggcaggaggattgcttgagc

SEQ ID NO: 111764 - DNA, 22 bp, Homo sapiens
cccagggaggcccaggctctgc

SEQ ID NO: 111765 - DNA, 22 bp, Homo sapiens
tttaaaaaactagtctgagtct

SEQ ID NO: 111766 - DNA, 22 bp, Homo sapiens
cacctgtacagggccgggctgg

SEQ ID NO: 111767 - DNA, 22 bp, Homo sapiens
gagtcggaggcaggagacctgg

SEQ ID NO: 111768 - DNA, 22 bp, Homo sapiens
gctcccaccttaaccttcacat

SEQ ID NO: 111769 - DNA, 22 bp, Homo sapiens
agagggatcaccctgtttctgg

SEQ ID NO: 111770 - DNA, 22 bp, Homo sapiens
agatttatgtggtcacactcag

SEQ ID NO: 111771 - DNA, 22 bp, Homo sapiens
tcagccccacggggtcagccaa

SEQ ID NO: 111772 - DNA, 22 bp, Homo sapiens
gtctctatcatagctgaaccct

SEQ ID NO: 111773 - DNA, 22 bp, Homo sapiens
agaggaagtaatcaggacctgc

SEQ ID NO: 111774 - DNA, 22 bp, Homo sapiens
caggaaggggctcactctggcc

SEQ ID NO: 111775 - DNA, 22 bp, Homo sapiens
ggagagtggattccagctgtat

SEQ ID NO: 111776 - DNA, 22 bp, Homo sapiens
atcacaaaggtctcagagcaca

SEQ ID NO: 111777 - DNA, 22 bp, Homo sapiens
gagagttagttgagcagtctga

SEQ ID NO: 111778 - DNA, 22 bp, Homo sapiens
acatttatataactcactagga

SEQ ID NO: 111779 - DNA, 22 bp, Homo sapiens
ttggatccatctcaggcatagg

SEQ ID NO: 111780 - DNA, 22 bp, Homo sapiens
tccactgctacaacctcccaga

SEQ ID NO: 111781 - DNA, 22 bp, Homo sapiens
caggaaggcgcggctgtgcctg

SEQ ID NO: 111782 - DNA, 22 bp, Homo sapiens
gggaggcagtgctggaggctgg

SEQ ID NO: 111783 - DNA, 22 bp, Homo sapiens
gggccctgggattcagagcaag

SEQ ID NO: 111784 - DNA, 22 bp, Homo sapiens
gaggagggagctggaagctctt

SEQ ID NO: 111785 - DNA, 22 bp, Homo sapiens
ccaggcagcctgctccattctg

SEQ ID NO: 111786 - DNA, 22 bp, Homo sapiens
actcatgtcctaggagtaaagc

SEQ ID NO: 111787 - DNA, 22 bp, Homo sapiens
aaagaaggtagggctggtgact

SEQ ID NO: 111788 - DNA, 22 bp, Homo sapiens
ataatacatggttgatcttttc

SEQ ID NO: 111789 - DNA, 22 bp, Homo sapiens
tgcaaatgtgttttaaaccaaa

SEQ ID NO: 111790 - DNA, 22 bp, Homo sapiens
gcagttaaaaataaaccttcat

SEQ ID NO: 111791 - DNA, 22 bp, Homo sapiens
cccaggaggcagaagttgcagt

SEQ ID NO: 111792 - DNA, 22 bp, Homo sapiens
ttccagctaactcacatccctt

SEQ ID NO: 111793 - DNA, 17 bp, Homo sapiens
tgcatgtcctttgttcc

SEQ ID NO: 111794 - DNA, 19 bp, Homo sapiens
ctctggagtcattgctccc

SEQ ID NO: 111795 - DNA, 22 bp, Homo sapiens
ggagtagctgcattccgagcac

SEQ ID NO: 111796 - DNA, 22 bp, Homo sapiens
cccaggaggtcaaggctgcagt

SEQ ID NO: 111797 - DNA, 22 bp, Homo sapiens
tttgttttcaatgtgtcattca

SEQ ID NO: 111798 - DNA, 22 bp, Homo sapiens
cttccccaggacctctgctaaa

SEQ ID NO: 111799 - DNA, 22 bp, Homo sapiens
ccaggctggagtgcaatggcat

SEQ ID NO: 111800 - DNA, 22 bp, Homo sapiens
ggcgcccccttcaaacagagca

SEQ ID NO: 111801 - DNA, 22 bp, Homo sapiens
tcagcaatcctcccacaggtgg

SEQ ID NO: 111802 - DNA, 22 bp, Homo sapiens
ctttcaggagaggattataaca

SEQ ID NO: 111803 - DNA, 22 bp, Homo sapiens
ccctcccggcgtgctgggctcg

SEQ ID NO: 111804 - DNA, 21 bp, Homo sapiens
ctgtcatgcaaccattctcca

SEQ ID NO: 111805 - DNA, 15 bp, Homo sapiens
gcaggcaggtcacct

SEQ ID NO: 111806 - DNA, 22 bp, Homo sapiens
ttatttttaaaagttcacacag

SEQ ID NO: 111807 - DNA, 22 bp, Homo sapiens
ggctgtggcagctggaagtggt

SEQ ID NO: 111808 - DNA, 22 bp, Homo sapiens
gctccccaaaagctccaggaaa

SEQ ID NO: 111809 - DNA, 22 bp, Homo sapiens
acagattcactgcactggccat

SEQ ID NO: 111810 - DNA, 22 bp, Homo sapiens
gacctcgtgatccgccctcctt

SEQ ID NO: 111811 - DNA, 22 bp, Homo sapiens
cttagctgcgggccctcctcgc

SEQ ID NO: 111812 - DNA, 22 bp, Homo sapiens
gggcggggggagctggaatgaa

SEQ ID NO: 111813 - DNA, 22 bp, Homo sapiens
agtggctgagtgactgtgactc

SEQ ID NO: 111814 - DNA, 22 bp, Homo sapiens
tagattatccctgatttgtcca

SEQ ID NO: 111815 - DNA, 22 bp, Homo sapiens
cacgaatggaagggtcttggct

SEQ ID NO: 111816 - DNA, 22 bp, Homo sapiens
tccacagtggttgaactagtaa

SEQ ID NO: 111817 - DNA, 22 bp, Homo sapiens
tgaccctgagagctgaatggct

SEQ ID NO: 111818 - DNA, 22 bp, Homo sapiens
gtacactccccctgtgaagttg

SEQ ID NO: 111819 - DNA, 23 bp, Homo sapiens
ctggggctttcaaatctgggcag

SEQ ID NO: 111820 - DNA, 22 bp, Homo sapiens
tccacagtggttgaactagttt

SEQ ID NO: 111821 - DNA, 22 bp, Homo sapiens
tggacaacatagtgagacctca

SEQ ID NO: 111822 - DNA, 22 bp, Homo sapiens
ggctgagtctgtgacccatgcg

SEQ ID NO: 111823 - DNA, 22 bp, Homo sapiens
acccggagtcggaggttgcagt

SEQ ID NO: 111824 - DNA, 22 bp, Homo sapiens
ggaggcggaggctgcagtgagc

SEQ ID NO: 111825 - DNA, 22 bp, Homo sapiens
tggctcctcacgtcctcagagc

SEQ ID NO: 111826 - DNA, 22 bp, Homo sapiens
ctgcagggagaggggacagcct

SEQ ID NO: 111827 - DNA, 18 bp, Homo sapiens
ggtgagggagctggaagc

SEQ ID NO: 111828 - DNA, 22 bp, Homo sapiens
tgatgcaattagattgtaattt

SEQ ID NO: 111829 - DNA, 22 bp, Homo sapiens
cagtgacgtaaactgcatgtgc

SEQ ID NO: 111830 - DNA, 22 bp, Homo sapiens
atgaccagccgagataaacaga

SEQ ID NO: 111831 - DNA, 22 bp, Homo sapiens
actttatttcctattgcatcca

SEQ ID NO: 111832 - DNA, 22 bp, Homo sapiens
tcccggcgctgggaggtgggtc

SEQ ID NO: 111833 - DNA, 22 bp, Homo sapiens
aaaaatcacttttataggcagc

SEQ ID NO: 111834 - DNA, 22 bp, Homo sapiens
ctccaggccatggctgcggagg

SEQ ID NO: 111835 - DNA, 22 bp, Homo sapiens
aagagagtcagtctgagcacca

SEQ ID NO: 111836 - DNA, 22 bp, Homo sapiens
caggaacagggtgtcctggcag

SEQ ID NO: 111837 - DNA, 22 bp, Homo sapiens
ggcccaggctggagtgcagtgg

SEQ ID NO: 111838 - DNA, 22 bp, Homo sapiens
accccagaggcggaggctgcag

SEQ ID NO: 111839 - DNA, 22 bp, Homo sapiens
gaaaggagagggttaaggagct

SEQ ID NO: 111840 - DNA, 22 bp, Homo sapiens
aggccagcctcaggcagggacc

SEQ ID NO: 111841 - DNA, 22 bp, Homo sapiens
cagccccacacggtctagctct

SEQ ID NO: 111842 - DNA, 22 bp, Homo sapiens
agctcctgaaaatccagactgg

SEQ ID NO: 111843 - DNA, 22 bp, Homo sapiens
gggaagagggagctggaatgat

SEQ ID NO: 111844 - DNA, 22 bp, Homo sapiens
tgtcttcgctacaatgaaaagg

SEQ ID NO: 111845 - DNA, 22 bp, Homo sapiens
tcccagagctctggaggttgga

SEQ ID NO: 111846 - DNA, 23 bp, Homo sapiens
aaataggagtatctggatcatga

SEQ ID NO: 111847 - DNA, 17 bp, Homo sapiens
cttcccaccatctcctg

SEQ ID NO: 111848 - DNA, 22 bp, Homo sapiens
taggttctccacaggttctcca

SEQ ID NO: 111849 - DNA, 22 bp, Homo sapiens
gaattttattactagtcaactg

SEQ ID NO: 111850 - DNA, 22 bp, Homo sapiens
tgtcctcatcctccagtctgtc

SEQ ID NO: 111851 - DNA, 22 bp, Homo sapiens
atggagttctgccagcgctgct

SEQ ID NO: 111852 - DNA, 22 bp, Homo sapiens
ggaggacaggggctgcagcaca

SEQ ID NO: 111853 - DNA, 22 bp, Homo sapiens
ttgctcagtggcagggctggta

SEQ ID NO: 111854 - DNA, 22 bp, Homo sapiens
tgatctggtcctactgtgggca

SEQ ID NO: 111855 - DNA, 22 bp, Homo sapiens
gctggtagacctcactgcactc

SEQ ID NO: 111856 - DNA, 22 bp, Homo sapiens
cacagctgaagtagccatgtgg

SEQ ID NO: 111857 - DNA, 22 bp, Homo sapiens
gggctgtgaggtgagaacttac

SEQ ID NO: 111858 - DNA, 22 bp, Homo sapiens
gtgtggctgaaatcaaggcagg

SEQ ID NO: 111859 - DNA, 22 bp, Homo sapiens
ctggtagtttgcaaaatggtgt

SEQ ID NO: 111860 - DNA, 22 bp, Homo sapiens
catataaatacaacatgtgtta

SEQ ID NO: 111861 - DNA, 22 bp, Homo sapiens
aaggctccagtgaatgctggca

SEQ ID NO: 111862 - DNA, 22 bp, Homo sapiens
ttgtgaatagtgctgcaataaa

SEQ ID NO: 111863 - DNA, 22 bp, Homo sapiens
tggtccgctcctattcgccgca

SEQ ID NO: 111864 - DNA, 22 bp, Homo sapiens
ttttatctgtgacatctggcag

SEQ ID NO: 111865 - DNA, 22 bp, Homo sapiens
gggtggtggccagcagtgggca

SEQ ID NO: 111866 - DNA, 22 bp, Homo sapiens
cagcagagaaattacatatttg

SEQ ID NO: 111867 - DNA, 22 bp, Homo sapiens
tgcccaggctggagtacagtgg

SEQ ID NO: 111868 - DNA, 22 bp, Homo sapiens
cttgcctttgtcttcaaaggct

SEQ ID NO: 111869 - DNA, 22 bp, Homo sapiens
aagcagcacagcaatgactcta

SEQ ID NO: 111870 - DNA, 22 bp, Homo sapiens
gattcactcatattttacgttt

SEQ ID NO: 111871 - DNA, 22 bp, Homo sapiens
ctgcaccctcaaactcctgggc

SEQ ID NO: 111872 - DNA, 22 bp, Homo sapiens
tgagcctgggagatggaggctg

SEQ ID NO: 111873 - DNA, 22 bp, Homo sapiens
attctaaatcagagagctctgt

SEQ ID NO: 111874 - DNA, 22 bp, Homo sapiens
aggaatggtgctcagcagaaat

SEQ ID NO: 111875 - DNA, 22 bp, Homo sapiens
aggagggagcttaagccaggca

SEQ ID NO: 111876 - DNA, 22 bp, Homo sapiens
agtcacagggggcccctgcaac

SEQ ID NO: 111877 - DNA, 22 bp, Homo sapiens
gactttgtgccaaacgccagaa

SEQ ID NO: 111878 - DNA, 22 bp, Homo sapiens
ttgggctcaggagtttgagacc

SEQ ID NO: 111879 - DNA, 22 bp, Homo sapiens
gcccagagtttgaagatacagt

SEQ ID NO: 111880 - DNA, 22 bp, Homo sapiens
tgagtggacacctgcttcttta

SEQ ID NO: 111881 - DNA, 22 bp, Homo sapiens
tttacacagaggacactgggct

SEQ ID NO: 111882 - DNA, 22 bp, Homo sapiens
gggagaggttacccgagcaact

SEQ ID NO: 111883 - DNA, 22 bp, Homo sapiens
cctggggccccgagccagaagc

SEQ ID NO: 111884 - DNA, 22 bp, Homo sapiens
gcaggcaggcttccttgaactg

SEQ ID NO: 111885 - DNA, 22 bp, Homo sapiens
attgcagatgatccccaagtta

SEQ ID NO: 111886 - DNA, 22 bp, Homo sapiens
ttcattcttttacatgtgaata

SEQ ID NO: 111887 - DNA, 22 bp, Homo sapiens
gctggaggatggactggaagaa

SEQ ID NO: 111888 - DNA, 22 bp, Homo sapiens
ctgtctgcaggatagtaccctc

SEQ ID NO: 111889 - DNA, 22 bp, Homo sapiens
ctgagcctcctgcttctatttc

SEQ ID NO: 111890 - DNA, 22 bp, Homo sapiens
ctggcaggagcattcacagagg

SEQ ID NO: 111891 - DNA, 22 bp, Homo sapiens
aatactgcctgtgaggtaactc

SEQ ID NO: 111892 - DNA, 22 bp, Homo sapiens
ttctcctttcattccctgtaga

SEQ ID NO: 111893 - DNA, 22 bp, Homo sapiens
ctgggaggtggaggttgcattg

SEQ ID NO: 111894 - DNA, 22 bp, Homo sapiens
aggtttctttatgctgctagaa

SEQ ID NO: 111895 - DNA, 21 bp, Homo sapiens
tggtacaccttgcctgtcaga

SEQ ID NO: 111896 - DNA, 19 bp, Homo sapiens
atctgccttagtgctgctg

SEQ ID NO: 111897 - DNA, 22 bp, Homo sapiens
ttttaatactgctattgtagga

SEQ ID NO: 111898 - DNA, 22 bp, Homo sapiens
atgctatgtaactggcagatag

SEQ ID NO: 111899 - DNA, 22 bp, Homo sapiens
gcagatggatgtggacggcgcc

SEQ ID NO: 111900 - DNA, 22 bp, Homo sapiens
gggccaccccactgcccacgct

SEQ ID NO: 111901 - DNA, 22 bp, Homo sapiens
ttgctttgcagtgcctatagga

SEQ ID NO: 111902 - DNA, 22 bp, Homo sapiens
atttagtagagaaattaagaaa

SEQ ID NO: 111903 - DNA, 22 bp, Homo sapiens
aggacaaaggaccagatctgga

SEQ ID NO: 111904 - DNA, 22 bp, Homo sapiens
ggcaatagttgtgggttcttta

SEQ ID NO: 111905 - DNA, 22 bp, Homo sapiens
ttgatcaaatcagctactgagg

SEQ ID NO: 111906 - DNA, 22 bp, Homo sapiens
atggggagctcaccacctgttt

SEQ ID NO: 111907 - DNA, 22 bp, Homo sapiens
aggtggggaggagtgtctcttt

SEQ ID NO: 111908 - DNA, 22 bp, Homo sapiens
gacctcgtgatccgcccgcttt

SEQ ID NO: 111909 - DNA, 22 bp, Homo sapiens
gggaagatagtgttgagggccc

SEQ ID NO: 111910 - DNA, 23 bp, Homo sapiens
tgaggcaggcggatcacgaggtc

SEQ ID NO: 111911 - DNA, 22 bp, Homo sapiens
tgagccatgggactccaaggga

SEQ ID NO: 111912 - DNA, 22 bp, Homo sapiens
gacccggctccaggcccagcag

SEQ ID NO: 111913 - DNA, 22 bp, Homo sapiens
gcaggcagaggtggaggagaca

SEQ ID NO: 111914 - DNA, 22 bp, Homo sapiens
tctcatctgccatttgcaggag

SEQ ID NO: 111915 - DNA, 22 bp, Homo sapiens
agttgcagacgcagagatgttg

SEQ ID NO: 111916 - DNA, 22 bp, Homo sapiens
tgggactcactcttttggccag

SEQ ID NO: 111917 - DNA, 22 bp, Homo sapiens
tccaagatctacagcagtttag

SEQ ID NO: 111918 - DNA, 22 bp, Homo sapiens
ggtcgctgtgtaggttcagcta

SEQ ID NO: 111919 - DNA, 22 bp, Homo sapiens
tctggagataagcagcaatgaa

SEQ ID NO: 111920 - DNA, 22 bp, Homo sapiens
ccaggcaggcgatggtgcagtg

SEQ ID NO: 111921 - DNA, 22 bp, Homo sapiens
ttagatttacaagcactgttta

SEQ ID NO: 111922 - DNA, 22 bp, Homo sapiens
ttaaactgcttgaattgggttt

SEQ ID NO: 111923 - DNA, 22 bp, Homo sapiens
caggaagaccagggctgtggct

SEQ ID NO: 111924 - DNA, 21 bp, Homo sapiens
taaacataaccttgtatggct

SEQ ID NO: 111925 - DNA, 22 bp, Homo sapiens
tctcaacagtgcaagctgctcc

SEQ ID NO: 111926 - DNA, 22 bp, Homo sapiens
aggaaataggaccagacaaagc

SEQ ID NO: 111927 - DNA, 20 bp, Homo sapiens
tcagccttgaatgcttgaaa

SEQ ID NO: 111928 - DNA, 22 bp, Homo sapiens
aaggcaggatgggaaaagattt

SEQ ID NO: 111929 - DNA, 22 bp, Homo sapiens
taattataacagttacatctta

SEQ ID NO: 111930 - DNA, 22 bp, Homo sapiens
cacgttaacagctaacagatga

SEQ ID NO: 111931 - DNA, 22 bp, Homo sapiens
agcccaggtccagttcactgca

SEQ ID NO: 111932 - DNA, 22 bp, Homo sapiens
ccgccgtgcaggccgcgacgtg

SEQ ID NO: 111933 - DNA, 22 bp, Homo sapiens
cctcctgcacctccaggaactc

SEQ ID NO: 111934 - DNA, 22 bp, Homo sapiens
caagatcttcctcaatagacct

SEQ ID NO: 111935 - DNA, 22 bp, Homo sapiens
tttctaatctgattctcctacc

SEQ ID NO: 111936 - DNA, 22 bp, Homo sapiens
agtgactggtgtgaagttaaat

SEQ ID NO: 111937 - DNA, 22 bp, Homo sapiens
gaggggagcccccatcctccag

SEQ ID NO: 111938 - DNA, 22 bp, Homo sapiens
ttcatagtgtttccttccagtg

SEQ ID NO: 111939 - DNA, 22 bp, Homo sapiens
tggccaccaccaatacttgcct

SEQ ID NO: 111940 - DNA, 22 bp, Homo sapiens
cttgtcagccaattgtggattt

SEQ ID NO: 111941 - DNA, 22 bp, Homo sapiens
gcggggggaggaacatcttgca

SEQ ID NO: 111942 - DNA, 22 bp, Homo sapiens
agctttggcatctgactagccg

SEQ ID NO: 111943 - DNA, 22 bp, Homo sapiens
tcagggattgcaaaattcatcc

SEQ ID NO: 111944 - DNA, 22 bp, Homo sapiens
ctgggagtggtgacagctctcg

SEQ ID NO: 111945 - DNA, 23 bp, Homo sapiens
tgaatgtttattctcggtgcaga

SEQ ID NO: 111946 - DNA, 15 bp, Homo sapiens
aggagtcactgtgct

SEQ ID NO: 111947 - DNA, 22 bp, Homo sapiens
ataaaatttgctactgttaaat

SEQ ID NO: 111948 - DNA, 22 bp, Homo sapiens
cgcccaggctggagtgcagtgg

SEQ ID NO: 111949 - DNA, 22 bp, Homo sapiens
tagactggtgaattagggggaa

SEQ ID NO: 111950 - DNA, 22 bp, Homo sapiens
atgattgaaaatgacattgcca

SEQ ID NO: 111951 - DNA, 22 bp, Homo sapiens
catggggcccatgtgctccaag

SEQ ID NO: 111952 - DNA, 19 bp, Homo sapiens
atgtacccagtgtcaatcc

SEQ ID NO: 111953 - DNA, 22 bp, Homo sapiens
gggcctgctgcaggttcaggat

SEQ ID NO: 111954 - DNA, 22 bp, Homo sapiens
ttaaatattatgttgtctgcaa

SEQ ID NO: 111955 - DNA, 22 bp, Homo sapiens
ttgtgctcctgtgagaatctag

SEQ ID NO: 111956 - DNA, 22 bp, Homo sapiens
tctcacagcctctggaggtagt

SEQ ID NO: 111957 - DNA, 22 bp, Homo sapiens
cccaggaggttgaggctgcagt

SEQ ID NO: 111958 - DNA, 22 bp, Homo sapiens
gaatttcctctaaacccctgag

SEQ ID NO: 111959 - DNA, 22 bp, Homo sapiens
tctttcttgtgggtgccctttt

SEQ ID NO: 111960 - DNA, 22 bp, Homo sapiens
cctgagagcattccacactgaa

SEQ ID NO: 111961 - DNA, 22 bp, Homo sapiens
gttgaggtgatgccagccctgc

SEQ ID NO: 111962 - DNA, 15 bp, Homo sapiens
catatcactgggaat

SEQ ID NO: 111963 - DNA, 22 bp, Homo sapiens
ctgcagtcatctgaagattttg

SEQ ID NO: 111964 - DNA, 22 bp, Homo sapiens
ctccagattccgtttattcagg

SEQ ID NO: 111965 - DNA, 22 bp, Homo sapiens
tgatatgggaaaagggctcgga

SEQ ID NO: 111966 - DNA, 22 bp, Homo sapiens
agctgattccactttttcccca

SEQ ID NO: 111967 - DNA, 22 bp, Homo sapiens
attttctatgttgtaattgtta

SEQ ID NO: 111968 - DNA, 22 bp, Homo sapiens
actggggctgatgcgttcgtgt

SEQ ID NO: 111969 - DNA, 22 bp, Homo sapiens
tttcttctatgtgtgatatttt

SEQ ID NO: 111970 - DNA, 23 bp, Homo sapiens
ggctgggagctccgggtgcacgt

SEQ ID NO: 111971 - DNA, 22 bp, Homo sapiens
aatgctctttaacctattctga

SEQ ID NO: 111972 - DNA, 22 bp, Homo sapiens
tgcccagggtggagtgcagtgg

SEQ ID NO: 111973 - DNA, 22 bp, Homo sapiens
gatggaggagatggcagggtgc

SEQ ID NO: 111974 - DNA, 22 bp, Homo sapiens
tttattctgtgctacatgaaga

SEQ ID NO: 111975 - DNA, 22 bp, Homo sapiens
ccaggctggagtgcagtggcac

SEQ ID NO: 111976 - DNA, 22 bp, Homo sapiens
atccaccctgtggtggctttct

SEQ ID NO: 111977 - DNA, 22 bp, Homo sapiens
agctgaaacttcccattaattg

SEQ ID NO: 111978 - DNA, 22 bp, Homo sapiens
gtctttatttgagattgtcatt

SEQ ID NO: 111979 - DNA, 22 bp, Homo sapiens
ctgggaggcggagcttgcagtg

SEQ ID NO: 111980 - DNA, 22 bp, Homo sapiens
ttacatgtttatgtggtacatg

SEQ ID NO: 111981 - DNA, 22 bp, Homo sapiens
caggagtccatctggcctggtg

SEQ ID NO: 111982 - DNA, 19 bp, Homo sapiens
tctcacagctctactatgt

SEQ ID NO: 111983 - DNA, 22 bp, Homo sapiens
gtcatcttgctgttttagatct

SEQ ID NO: 111984 - DNA, 23 bp, Homo sapiens
caccccaccctgaggaggaggga

SEQ ID NO: 111985 - DNA, 22 bp, Homo sapiens
tgtttcttacgtttttagaggc

SEQ ID NO: 111986 - DNA, 22 bp, Homo sapiens
gcggctgccgagacaagccggt

SEQ ID NO: 111987 - DNA, 22 bp, Homo sapiens
tgagcctgtcattattcagaga

SEQ ID NO: 111988 - DNA, 22 bp, Homo sapiens
gggtggagagaaagaaacgtga

SEQ ID NO: 111989 - DNA, 22 bp, Homo sapiens
gcaaacaaggacatacatcctg

SEQ ID NO: 111990 - DNA, 22 bp, Homo sapiens
actgttttctgtaaagggccag

SEQ ID NO: 111991 - DNA, 23 bp, Homo sapiens
aggatgtaggatgtatggcagag

SEQ ID NO: 111992 - DNA, 21 bp, Homo sapiens
ggagtttttctggaagggact

SEQ ID NO: 111993 - DNA, 22 bp, Homo sapiens
tctgtagtaggttgtagttctt

SEQ ID NO: 111994 - DNA, 22 bp, Homo sapiens
catggcattgcataacggggct

SEQ ID NO: 111995 - DNA, 22 bp, Homo sapiens
catctgctgttccttggactca

SEQ ID NO: 111996 - DNA, 22 bp, Homo sapiens
aggccctattcaatggggccca

SEQ ID NO: 111997 - DNA, 22 bp, Homo sapiens
cagtgcagccaaggacaggcac

SEQ ID NO: 111998 - DNA, 22 bp, Homo sapiens
tgggaaggggagctggaaagga

SEQ ID NO: 111999 - DNA, 22 bp, Homo sapiens
gaatttaagaggatgaatctgt

SEQ ID NO: 112000 - DNA, 22 bp, Homo sapiens
caccatgcctggctaatttttt

SEQ ID NO: 112001 - DNA, 16 bp, Homo sapiens
gcaggcagatcacatg

SEQ ID NO: 112002 - DNA, 22 bp, Homo sapiens
aaattctgatttaataagtgta

SEQ ID NO: 112003 - DNA, 22 bp, Homo sapiens
tctggctctggagtccacctgc

SEQ ID NO: 112004 - DNA, 22 bp, Homo sapiens
ataaaaactgacccatcctttg

SEQ ID NO: 112005 - DNA, 22 bp, Homo sapiens
gaagccttgaactgcaaacccc

SEQ ID NO: 112006 - DNA, 22 bp, Homo sapiens
catccctgtcgtcaagtctctg

SEQ ID NO: 112007 - DNA, 22 bp, Homo sapiens
ctggagagaatgtggaatgatt

SEQ ID NO: 112008 - DNA, 22 bp, Homo sapiens
gtcacaaagcgcggtggtcggt

SEQ ID NO: 112009 - DNA, 22 bp, Homo sapiens
tctgacattttgagaatgacat

SEQ ID NO: 112010 - DNA, 22 bp, Homo sapiens
aataaaatggtcagttttctca

SEQ ID NO: 112011 - DNA, 22 bp, Homo sapiens
agggactatttacccatctcac

SEQ ID NO: 112012 - DNA, 22 bp, Homo sapiens
cctccccacagcccaggagact

SEQ ID NO: 112013 - DNA, 22 bp, Homo sapiens
tgactggattgtcattacgacg

SEQ ID NO: 112014 - DNA, 22 bp, Homo sapiens
ccaggctggagtgcaatggcgt

SEQ ID NO: 112015 - DNA, 22 bp, Homo sapiens
ggagttgattttggatatatta

SEQ ID NO: 112016 - DNA, 22 bp, Homo sapiens
gggggagagacgagcggctctg

SEQ ID NO: 112017 - DNA, 22 bp, Homo sapiens
accctcaacaaattcactctat

SEQ ID NO: 112018 - DNA, 22 bp, Homo sapiens
tctcctggagcccagatgctgg

SEQ ID NO: 112019 - DNA, 22 bp, Homo sapiens
aactcactttgtggcttctgaa

SEQ ID NO: 112020 - DNA, 22 bp, Homo sapiens
tgatttcaagccagggggcgtt

SEQ ID NO: 112021 - DNA, 20 bp, Homo sapiens
tgatatggtttggctgtgtt

SEQ ID NO: 112022 - DNA, 22 bp, Homo sapiens
gtcacctgtgccacatactggg

SEQ ID NO: 112023 - DNA, 22 bp, Homo sapiens
gcttggccagcagccgggatgc

SEQ ID NO: 112024 - DNA, 22 bp, Homo sapiens
cacttgttggtggtgaaatcac

SEQ ID NO: 112025 - DNA, 21 bp, Homo sapiens
gacactgcttactctgaccta

SEQ ID NO: 112026 - DNA, 22 bp, Homo sapiens
aggtgggtgcctatgtatgtat

SEQ ID NO: 112027 - DNA, 20 bp, Homo sapiens
tttctgtgagaaacactgtt

SEQ ID NO: 112028 - DNA, 22 bp, Homo sapiens
gtctgctcatgctaccgcgggc

SEQ ID NO: 112029 - DNA, 22 bp, Homo sapiens
ttgtgctctgtgttatttaagg

SEQ ID NO: 112030 - DNA, 22 bp, Homo sapiens
cggccaagccggggccccgaag

SEQ ID NO: 112031 - DNA, 22 bp, Homo sapiens
gcccgcgccagcctctccatct

SEQ ID NO: 112032 - DNA, 22 bp, Homo sapiens
gatataggttcatagtgttaca

SEQ ID NO: 112033 - DNA, 22 bp, Homo sapiens
actggggtttaggcctgggcaa

SEQ ID NO: 112034 - DNA, 19 bp, Homo sapiens
tcctggggaggggcatggc

SEQ ID NO: 112035 - DNA, 20 bp, Homo sapiens
agcagagtgcccatcccgga

SEQ ID NO: 112036 - DNA, 22 bp, Homo sapiens
acccgccgcacgtccaggctga

SEQ ID NO: 112037 - DNA, 22 bp, Homo sapiens
tgcagcaccgtcccactggcta

SEQ ID NO: 112038 - DNA, 22 bp, Homo sapiens
cctggcactgctgaagtcctgg

SEQ ID NO: 112039 - DNA, 16 bp, Homo sapiens
gcgcctcctcggcctc

SEQ ID NO: 112040 - DNA, 22 bp, Homo sapiens
actgcaacctccacctcctggg

SEQ ID NO: 112041 - DNA, 22 bp, Homo sapiens
gcagcctgggcaacagagtgag

SEQ ID NO: 112042 - DNA, 22 bp, Homo sapiens
aggacgctctcgctgaacttct

SEQ ID NO: 112043 - DNA, 22 bp, Homo sapiens
ctgtggcgccgctgagagcaga

SEQ ID NO: 112044 - DNA, 22 bp, Homo sapiens
tcatgctatgagcgagggcctg

SEQ ID NO: 112045 - DNA, 21 bp, Homo sapiens
gcccacagtgaggaggatccc

SEQ ID NO: 112046 - DNA, 22 bp, Homo sapiens
ttctatttttgtggaactgtag

SEQ ID NO: 112047 - DNA, 22 bp, Homo sapiens
gctgtagtgaatggccgcgttc

SEQ ID NO: 112048 - DNA, 22 bp, Homo sapiens
cagtggcaggatttcagctcag

SEQ ID NO: 112049 - DNA, 22 bp, Homo sapiens
cctgccagagcagcttgtcctc

SEQ ID NO: 112050 - DNA, 21 bp, Homo sapiens
tctgccagctgaagaggtgga

SEQ ID NO: 112051 - DNA, 22 bp, Homo sapiens
ctcctgaattgtccctcacagc

SEQ ID NO: 112052 - DNA, 22 bp, Homo sapiens
gtatgtgaggttggtttccagg

SEQ ID NO: 112053 - DNA, 22 bp, Homo sapiens
tagtgtctcttcctgtttgaaa

SEQ ID NO: 112054 - DNA, 22 bp, Homo sapiens
ccttgctcaagctagtgacggg

SEQ ID NO: 112055 - DNA, 22 bp, Homo sapiens
agaaatatgctgattagatgaa

SEQ ID NO: 112056 - DNA, 22 bp, Homo sapiens
actccacaccacgggggccgcc

SEQ ID NO: 112057 - DNA, 22 bp, Homo sapiens
gacgagagactccatccaccac

SEQ ID NO: 112058 - DNA, 22 bp, Homo sapiens
ttgtgctcctatgagaatctaa

SEQ ID NO: 112059 - DNA, 22 bp, Homo sapiens
atgtgggccgtgcgggtgtcct

SEQ ID NO: 112060 - DNA, 20 bp, Homo sapiens
tctgccacgtctggtgactg

SEQ ID NO: 112061 - DNA, 22 bp, Homo sapiens
gcgaatctcagctggtgctgcg

SEQ ID NO: 112062 - DNA, 22 bp, Homo sapiens
agggctggagccacagctggga

SEQ ID NO: 112063 - DNA, 22 bp, Homo sapiens
cctgcacagccggacccctgct

SEQ ID NO: 112064 - DNA, 22 bp, Homo sapiens
attaaagctatccagtcatgaa

SEQ ID NO: 112065 - DNA, 22 bp, Homo sapiens
tttgaagggcacgacaatagtt

SEQ ID NO: 112066 - DNA, 22 bp, Homo sapiens
aagaggagaaaggctggctttg

SEQ ID NO: 112067 - DNA, 22 bp, Homo sapiens
taaatgttgtaagtacatctaa

SEQ ID NO: 112068 - DNA, 22 bp, Homo sapiens
atagaatatgacttttagatcc

SEQ ID NO: 112069 - DNA, 22 bp, Homo sapiens
atgcacctgaactccatcagct

SEQ ID NO: 112070 - DNA, 22 bp, Homo sapiens
tgcaggctcttggtgacgtggg

SEQ ID NO: 112071 - DNA, 22 bp, Homo sapiens
agggcgacaatggagagcgttt

SEQ ID NO: 112072 - DNA, 22 bp, Homo sapiens
cccacacacatttatgatagga

SEQ ID NO: 112073 - DNA, 22 bp, Homo sapiens
ctgtggctcaggcctgtaagcc

SEQ ID NO: 112074 - DNA, 22 bp, Homo sapiens
agggccagcactcctggcagga

SEQ ID NO: 112075 - DNA, 22 bp, Homo sapiens
cgggcaaggcgagactaggccc

SEQ ID NO: 112076 - DNA, 22 bp, Homo sapiens
ggattgcaacaagctagtttag

SEQ ID NO: 112077 - DNA, 22 bp, Homo sapiens
gccctgagaagaagtcggaggg

SEQ ID NO: 112078 - DNA, 19 bp, Homo sapiens
ctgctgccggagactcgtc

SEQ ID NO: 112079 - DNA, 22 bp, Homo sapiens
ctcatcagaaatacctgacaaa

SEQ ID NO: 112080 - DNA, 22 bp, Homo sapiens
cccacgtcgaacttgctccaga

SEQ ID NO: 112081 - DNA, 22 bp, Homo sapiens
ctgctaaacctctctgagagct

SEQ ID NO: 112082 - DNA, 19 bp, Homo sapiens
taggaccctggtggccccc

SEQ ID NO: 112083 - DNA, 22 bp, Homo sapiens
gtgctggggagataggaagaga

SEQ ID NO: 112084 - DNA, 22 bp, Homo sapiens
cccaggaggtcgaagctgcagt

SEQ ID NO: 112085 - DNA, 22 bp, Homo sapiens
cccagaaggtcgaggctgcagt

SEQ ID NO: 112086 - DNA, 22 bp, Homo sapiens
cccagcaggtcggtgctgcctg

SEQ ID NO: 112087 - DNA, 22 bp, Homo sapiens
gctaatcaatgttaaggctgtg

SEQ ID NO: 112088 - DNA, 22 bp, Homo sapiens
actgccaatggtagtttgatgg

SEQ ID NO: 112089 - DNA, 22 bp, Homo sapiens
ttccaaagaagttcacatttac

SEQ ID NO: 112090 - DNA, 22 bp, Homo sapiens
ctgctttgcatagctgccagag

SEQ ID NO: 112091 - DNA, 22 bp, Homo sapiens
tcttgggggactttggcatgga

SEQ ID NO: 112092 - DNA, 22 bp, Homo sapiens
tagatctgatacaattcatctg

SEQ ID NO: 112093 - DNA, 22 bp, Homo sapiens
gtgctccctccttcctcaagga

SEQ ID NO: 112094 - DNA, 19 bp, Homo sapiens
gactccaactttaagcatg

SEQ ID NO: 112095 - DNA, 22 bp, Homo sapiens
tatacgtgcaggtcacagggga

SEQ ID NO: 112096 - DNA, 22 bp, Homo sapiens
ctgggcagctgtatcagggagt

SEQ ID NO: 112097 - DNA, 22 bp, Homo sapiens
ggcagccccatcagagacgctg

SEQ ID NO: 112098 - DNA, 22 bp, Homo sapiens
tttgtggcaggagcggagaccg

SEQ ID NO: 112099 - DNA, 22 bp, Homo sapiens
gtgccccagacacgcatgtggg

SEQ ID NO: 112100 - DNA, 22 bp, Homo sapiens
ggaggtggaggttgcagtgagc

SEQ ID NO: 112101 - DNA, 22 bp, Homo sapiens
ggaggcggaggttgcagtgagt

SEQ ID NO: 112102 - DNA, 22 bp, Homo sapiens
gctcccaggatgaggagccagg

SEQ ID NO: 112103 - DNA, 22 bp, Homo sapiens
tcctccccaaagcccagcctgg

SEQ ID NO: 112104 - DNA, 22 bp, Homo sapiens
tgggaagctgcattttaacaag

SEQ ID NO: 112105 - DNA, 22 bp, Homo sapiens
gagctctgactgctgggtgaca

SEQ ID NO: 112106 - DNA, 22 bp, Homo sapiens
gccagccagaaacgtcacactg

SEQ ID NO: 112107 - DNA, 22 bp, Homo sapiens
tagcaaaggatgactatgtacc

SEQ ID NO: 112108 - DNA, 23 bp, Homo sapiens
catctagcatccagtgagtagtg

SEQ ID NO: 112109 - DNA, 22 bp, Homo sapiens
tcaatcacgtgttccatgttct

SEQ ID NO: 112110 - DNA, 22 bp, Homo sapiens
ttaaattttagaaacagactct

SEQ ID NO: 112111 - DNA, 22 bp, Homo sapiens
gagcccaggaagtggaggctga

SEQ ID NO: 112112 - DNA, 22 bp, Homo sapiens
gtccaggcctgcctctgaggag

SEQ ID NO: 112113 - DNA, 17 bp, Homo sapiens
ggctgcagtccaggagg

SEQ ID NO: 112114 - DNA, 22 bp, Homo sapiens
tagctcaaaggttaagtgtgga

SEQ ID NO: 112115 - DNA, 22 bp, Homo sapiens
aggtcaagagtaaatttgggta

SEQ ID NO: 112116 - DNA, 22 bp, Homo sapiens
tgggcaggggccctgcttccgt

SEQ ID NO: 112117 - DNA, 22 bp, Homo sapiens
ggcgccgcactcggtgcagccg

SEQ ID NO: 112118 - DNA, 22 bp, Homo sapiens
aggtggaaatggctttcctagg

SEQ ID NO: 112119 - DNA, 22 bp, Homo sapiens
gaaaattattgaaaatggctct

SEQ ID NO: 112120 - DNA, 22 bp, Homo sapiens
acgcccagactcccatactttg

SEQ ID NO: 112121 - DNA, 22 bp, Homo sapiens
gaggaggcttccgggaggcacg

SEQ ID NO: 112122 - DNA, 16 bp, Homo sapiens
atgctgctattagagg

SEQ ID NO: 112123 - DNA, 22 bp, Homo sapiens
ctggcttttttcccattatgca

SEQ ID NO: 112124 - DNA, 22 bp, Homo sapiens
attgagaagaaaatctaatata

SEQ ID NO: 112125 - DNA, 22 bp, Homo sapiens
cctggctctgccacttactgcc

SEQ ID NO: 112126 - DNA, 22 bp, Homo sapiens
ctgggaagaagggacaacagcg

SEQ ID NO: 112127 - DNA, 22 bp, Homo sapiens
tgcactactgtgatacacagcc

SEQ ID NO: 112128 - DNA, 22 bp, Homo sapiens
gtaaaaaggccaagcccttgtg

SEQ ID NO: 112129 - DNA, 22 bp, Homo sapiens
tgcagaaacaagccatcattca

SEQ ID NO: 112130 - DNA, 22 bp, Homo sapiens
catctttgcccatccacttcca

SEQ ID NO: 112131 - DNA, 22 bp, Homo sapiens
gagcaggaaggccagaagggtc

SEQ ID NO: 112132 - DNA, 22 bp, Homo sapiens
aggcaagggggcgccaccttcc

SEQ ID NO: 112133 - DNA, 22 bp, Homo sapiens
tccagcagtccatgtgagacac

SEQ ID NO: 112134 - DNA, 22 bp, Homo sapiens
ttgctcttgaaaattgatgctg

SEQ ID NO: 112135 - DNA, 22 bp, Homo sapiens
ttacaattacttgatctcagct

SEQ ID NO: 112136 - DNA, 22 bp, Homo sapiens
caggcactgtgctgagctctgc

SEQ ID NO: 112137 - DNA, 22 bp, Homo sapiens
gtgaaatatttaacgtccaggt

SEQ ID NO: 112138 - DNA, 22 bp, Homo sapiens
atgccactgcacttcagcctgg

SEQ ID NO: 112139 - DNA, 22 bp, Homo sapiens
taggcatgcaaataaatgtgca

SEQ ID NO: 112140 - DNA, 22 bp, Homo sapiens
tccattatacttctgattcaaa

SEQ ID NO: 112141 - DNA, 22 bp, Homo sapiens
ttccatttggcacttcactgag

SEQ ID NO: 112142 - DNA, 22 bp, Homo sapiens
gccgggaccaaggccacggagc

SEQ ID NO: 112143 - DNA, 22 bp, Homo sapiens
attaagtgactaaagtaatgct

SEQ ID NO: 112144 - DNA, 22 bp, Homo sapiens
ggctcctggcaatgtaacttta

SEQ ID NO: 112145 - DNA, 19 bp, Homo sapiens
cggcccctcctctcgcgcc

SEQ ID NO: 112146 - DNA, 22 bp, Homo sapiens
gctgggttttcttccgggccta

SEQ ID NO: 112147 - DNA, 22 bp, Homo sapiens
gcctccccaagcagcagggatt

SEQ ID NO: 112148 - DNA, 22 bp, Homo sapiens
taaatacttagttttgtgtcta

SEQ ID NO: 112149 - DNA, 22 bp, Homo sapiens
agaaaatttaaagagacacaca

SEQ ID NO: 112150 - DNA, 22 bp, Homo sapiens
tagcccctgcctttgaacctgg

SEQ ID NO: 112151 - DNA, 22 bp, Homo sapiens
catttctgggagacatgctaga

SEQ ID NO: 112152 - DNA, 18 bp, Homo sapiens
actctgcggaggccccag

SEQ ID NO: 112153 - DNA, 22 bp, Homo sapiens
tgcctgtggaaaggctggtgct

SEQ ID NO: 112154 - DNA, 22 bp, Homo sapiens
gggagctggagctggaagactc

SEQ ID NO: 112155 - DNA, 22 bp, Homo sapiens
tgctgttagtaaggaacatgac

SEQ ID NO: 112156 - DNA, 22 bp, Homo sapiens
gggccatgagaggttcatcaac

SEQ ID NO: 112157 - DNA, 22 bp, Homo sapiens
tcctgagataaatctcatgtga

SEQ ID NO: 112158 - DNA, 22 bp, Homo sapiens
ctctggagtgtctggccagggt

SEQ ID NO: 112159 - DNA, 19 bp, Homo sapiens
agggaatccggctgaggga

SEQ ID NO: 112160 - DNA, 22 bp, Homo sapiens
tttattggatatttacaagata

SEQ ID NO: 112161 - DNA, 22 bp, Homo sapiens
agctacctgatccttcttctga

SEQ ID NO: 112162 - DNA, 22 bp, Homo sapiens
ggcatggacgtctctgaggcca

SEQ ID NO: 112163 - DNA, 22 bp, Homo sapiens
ctgctgagagccccagctgaga

SEQ ID NO: 112164 - DNA, 22 bp, Homo sapiens
ctggctcctgtttaaccagctg

SEQ ID NO: 112165 - DNA, 22 bp, Homo sapiens
agcaacctgccagtcactcagt

SEQ ID NO: 112166 - DNA, 22 bp, Homo sapiens
gctgtggcctggcgcagagctg

SEQ ID NO: 112167 - DNA, 22 bp, Homo sapiens
tgcccagagcctgagaggatta

SEQ ID NO: 112168 - DNA, 22 bp, Homo sapiens
gagcccaggcagaggttgcagt

SEQ ID NO: 112169 - DNA, 19 bp, Homo sapiens
aggaatggaattaattctg

SEQ ID NO: 112170 - DNA, 23 bp, Homo sapiens
ggatggacgtgatgccttagcca

SEQ ID NO: 112171 - DNA, 22 bp, Homo sapiens
atattgaaccctacagactgta

SEQ ID NO: 112172 - DNA, 22 bp, Homo sapiens
tgagaaacttgccaagcatctc

SEQ ID NO: 112173 - DNA, 22 bp, Homo sapiens
actaggggctcaggcccaggga

SEQ ID NO: 112174 - DNA, 17 bp, Homo sapiens
aggtgggtggatcacct

SEQ ID NO: 112175 - DNA, 22 bp, Homo sapiens
aggaggcagtctgtcccttagc

SEQ ID NO: 112176 - DNA, 22 bp, Homo sapiens
tcttaattctgtgtcttcacta

SEQ ID NO: 112177 - DNA, 22 bp, Homo sapiens
gtggatggagctggaagccatt

SEQ ID NO: 112178 - DNA, 22 bp, Homo sapiens
gaggcaggcagattgcttgagg

SEQ ID NO: 112179 - DNA, 22 bp, Homo sapiens
gaccctgtttctacaaataatt

SEQ ID NO: 112180 - DNA, 21 bp, Homo sapiens
gccatttcacacagacatttg

SEQ ID NO: 112181 - DNA, 22 bp, Homo sapiens
aagccggctgggccgaggctgc

SEQ ID NO: 112182 - DNA, 22 bp, Homo sapiens
tcacctctactcagcctagttc

SEQ ID NO: 112183 - DNA, 22 bp, Homo sapiens
ctgtctgaatcctaagcttcct

SEQ ID NO: 112184 - DNA, 20 bp, Homo sapiens
aactcctagcctcaagtgat

SEQ ID NO: 112185 - DNA, 22 bp, Homo sapiens
atctggggtgaataggttatgt

SEQ ID NO: 112186 - DNA, 22 bp, Homo sapiens
accattgccccctagtgtctgt

SEQ ID NO: 112187 - DNA, 22 bp, Homo sapiens
gccatcatatcccctgtgacct

SEQ ID NO: 112188 - DNA, 22 bp, Homo sapiens
tggcctcggcatccagcaagag

SEQ ID NO: 112189 - DNA, 22 bp, Homo sapiens
accatgttggccaagctggtct

SEQ ID NO: 112190 - DNA, 22 bp, Homo sapiens
ttttctcttccctctggacctg

SEQ ID NO: 112191 - DNA, 22 bp, Homo sapiens
agcctgcgatcccacctggcct

SEQ ID NO: 112192 - DNA, 22 bp, Homo sapiens
cctactctgagcgcctccgcat

SEQ ID NO: 112193 - DNA, 22 bp, Homo sapiens
tagttcaacgagttggggttgc

SEQ ID NO: 112194 - DNA, 18 bp, Homo sapiens
ggcgggtgttttattcac

SEQ ID NO: 112195 - DNA, 22 bp, Homo sapiens
ggggaccctcaggactgcgtct

SEQ ID NO: 112196 - DNA, 22 bp, Homo sapiens
gtccacagctctgaggtctccc

SEQ ID NO: 112197 - DNA, 22 bp, Homo sapiens
aggaaataagggacaagacaaa

SEQ ID NO: 112198 - DNA, 22 bp, Homo sapiens
ttgctttgtttaaaagtggtat

SEQ ID NO: 112199 - DNA, 22 bp, Homo sapiens
tgacttgtctctttgggagaca

SEQ ID NO: 112200 - DNA, 22 bp, Homo sapiens
catgagatttgggaggggccag

SEQ ID NO: 112201 - DNA, 20 bp, Homo sapiens
aaacgagccatcattctggt

SEQ ID NO: 112202 - DNA, 22 bp, Homo sapiens
acatcatttgtctgtagctgaa

SEQ ID NO: 112203 - DNA, 22 bp, Homo sapiens
gactggaaagcctgtcctcaga

SEQ ID NO: 112204 - DNA, 22 bp, Homo sapiens
gggaggttgaggctgcagtgag

SEQ ID NO: 112205 - DNA, 22 bp, Homo sapiens
gtcaggactctgacccgtcccg

SEQ ID NO: 112206 - DNA, 22 bp, Homo sapiens
gaggtagacttcttggaagtag

SEQ ID NO: 112207 - DNA, 22 bp, Homo sapiens
agaaggacccggtgggagatga

SEQ ID NO: 112208 - DNA, 22 bp, Homo sapiens
tttgagatggagtcttgctctg

SEQ ID NO: 112209 - DNA, 18 bp, Homo sapiens
tcctttctccctcatctt

SEQ ID NO: 112210 - DNA, 22 bp, Homo sapiens
ttctacagtgactgcagccata

SEQ ID NO: 112211 - DNA, 22 bp, Homo sapiens
gccaccccataggtgttaggtg

SEQ ID NO: 112212 - DNA, 22 bp, Homo sapiens
aaaatatgtataactcttctgc

SEQ ID NO: 112213 - DNA, 22 bp, Homo sapiens
atgccactgcgctctagcctgg

SEQ ID NO: 112214 - DNA, 22 bp, Homo sapiens
ttgtcttttgtgggaaatatgg

SEQ ID NO: 112215 - DNA, 22 bp, Homo sapiens
tgagactcagcacttgtgtgtc

SEQ ID NO: 112216 - DNA, 19 bp, Homo sapiens
agtcctggcctgggggacc

SEQ ID NO: 112217 - DNA, 22 bp, Homo sapiens
ataaagtggaggtagtattcat

SEQ ID NO: 112218 - DNA, 18 bp, Homo sapiens
gaccccgggatctgtcga

SEQ ID NO: 112219 - DNA, 22 bp, Homo sapiens
gagtcacatactatgtaataga

SEQ ID NO: 112220 - DNA, 22 bp, Homo sapiens
ggagaagaggagctggaagcct

SEQ ID NO: 112221 - DNA, 22 bp, Homo sapiens
tgagatcattgacttgttcctg

SEQ ID NO: 112222 - DNA, 22 bp, Homo sapiens
gtcctaccatgaattcactcca

SEQ ID NO: 112223 - DNA, 22 bp, Homo sapiens
ctcctggaggatagtgactggg

SEQ ID NO: 112224 - DNA, 22 bp, Homo sapiens
agtcaaggtggaccagaaaaat

SEQ ID NO: 112225 - DNA, 22 bp, Homo sapiens
ggccgccctttccacggtttct

SEQ ID NO: 112226 - DNA, 23 bp, Homo sapiens
ccagtgattgcctggaaggaggt

SEQ ID NO: 112227 - DNA, 22 bp, Homo sapiens
ttccaaaggctgcaccttgccc

SEQ ID NO: 112228 - DNA, 22 bp, Homo sapiens
aataaacaaatccttccttccc

SEQ ID NO: 112229 - DNA, 22 bp, Homo sapiens
tgcaataactactttaatgttg

SEQ ID NO: 112230 - DNA, 22 bp, Homo sapiens
tatgctctgagacctttgtgca

SEQ ID NO: 112231 - DNA, 22 bp, Homo sapiens
gctgcgccggatcccacgttcc

SEQ ID NO: 112232 - DNA, 22 bp, Homo sapiens
gaagatgttatggagagctcag

SEQ ID NO: 112233 - DNA, 22 bp, Homo sapiens
ctgtggctctcagaggctgctg

SEQ ID NO: 112234 - DNA, 23 bp, Homo sapiens
ggagtgcaatggcgccatctcgg

SEQ ID NO: 112235 - DNA, 22 bp, Homo sapiens
ctccccagccctggtattctga

SEQ ID NO: 112236 - DNA, 22 bp, Homo sapiens
gctgccaatccagctgtgggag

SEQ ID NO: 112237 - DNA, 22 bp, Homo sapiens
ccaagctacttaggagtctgag

SEQ ID NO: 112238 - DNA, 20 bp, Homo sapiens
aggccccaggtggacactag

SEQ ID NO: 112239 - DNA, 22 bp, Homo sapiens
tgggaggccgaggcaggtggat

SEQ ID NO: 112240 - DNA, 20 bp, Homo sapiens
tatttctgggcaaccattta

SEQ ID NO: 112241 - DNA, 22 bp, Homo sapiens
tgaagaaacgcagagaggtagg

SEQ ID NO: 112242 - DNA, 22 bp, Homo sapiens
ttactttaagggtgtcttatta

SEQ ID NO: 112243 - DNA, 22 bp, Homo sapiens
acccggaggcgggggatgcagt

SEQ ID NO: 112244 - DNA, 22 bp, Homo sapiens
agcccaggttgaggctgcagtg

SEQ ID NO: 112245 - DNA, 22 bp, Homo sapiens
gcctgacttgtgtattttacat

SEQ ID NO: 112246 - DNA, 22 bp, Homo sapiens
tttgcattgcattaagtattct

SEQ ID NO: 112247 - DNA, 22 bp, Homo sapiens
agacgctattttgaggggtcta

SEQ ID NO: 112248 - DNA, 18 bp, Homo sapiens
gaggatggaaggagatgc

SEQ ID NO: 112249 - DNA, 22 bp, Homo sapiens
cctgggtttggagcctgcagaa

SEQ ID NO: 112250 - DNA, 22 bp, Homo sapiens
atgcccaatgtcacaatttttg

SEQ ID NO: 112251 - DNA, 22 bp, Homo sapiens
cactgcaacctccacctcctgg

SEQ ID NO: 112252 - DNA, 22 bp, Homo sapiens
actctgctctgtatttcactgt

SEQ ID NO: 112253 - DNA, 22 bp, Homo sapiens
ataaaagatcccttctgagctc

SEQ ID NO: 112254 - DNA, 22 bp, Homo sapiens
ctctggaggtggaggttgcagt

SEQ ID NO: 112255 - DNA, 22 bp, Homo sapiens
attacctatttcattttctgtc

SEQ ID NO: 112256 - DNA, 22 bp, Homo sapiens
cagttccctccgccagcacttc

SEQ ID NO: 112257 - DNA, 21 bp, Homo sapiens
cactccacttagaacagggtt

SEQ ID NO: 112258 - DNA, 15 bp, Homo sapiens
tggcccacccgttga

SEQ ID NO: 112259 - DNA, 22 bp, Homo sapiens
gcagtatctatgtgatgggttg

SEQ ID NO: 112260 - DNA, 22 bp, Homo sapiens
gcccaggctggagtgcagtggc

SEQ ID NO: 112261 - DNA, 22 bp, Homo sapiens
gactatctgccaggtcccaggg

SEQ ID NO: 112262 - DNA, 22 bp, Homo sapiens
tagtggatgggtaaagtatttt

SEQ ID NO: 112263 - DNA, 16 bp, Homo sapiens
tgggtgggaggagcgg

SEQ ID NO: 112264 - DNA, 22 bp, Homo sapiens
caccagcagcggtgtgagggtg

SEQ ID NO: 112265 - DNA, 22 bp, Homo sapiens
agaggctgcacttgctcatgat

SEQ ID NO: 112266 - DNA, 22 bp, Homo sapiens
aaggccctggcaggaagcagga

SEQ ID NO: 112267 - DNA, 23 bp, Homo sapiens
cctgcctccccatcagttataca

SEQ ID NO: 112268 - DNA, 19 bp, Homo sapiens
tccaaagaagttcacattt

SEQ ID NO: 112269 - DNA, 17 bp, Homo sapiens
gtaaggcttgcagatgc

SEQ ID NO: 112270 - DNA, 22 bp, Homo sapiens
atatattttttgagacagagtc

SEQ ID NO: 112271 - DNA, 22 bp, Homo sapiens
gccaatgacagtctcagttctg

SEQ ID NO: 112272 - DNA, 22 bp, Homo sapiens
gtctctcaaaactagaagagaa

SEQ ID NO: 112273 - DNA, 22 bp, Homo sapiens
tggaagaatatgggggtacaga

SEQ ID NO: 112274 - DNA, 22 bp, Homo sapiens
ctgggaggcggaggttgtagtg

SEQ ID NO: 112275 - DNA, 22 bp, Homo sapiens
tagtggatgttcagagatttga

SEQ ID NO: 112276 - DNA, 20 bp, Homo sapiens
ttgttagaggaatgccatag

SEQ ID NO: 112277 - DNA, 22 bp, Homo sapiens
ggctcatatcccggccatcatt

SEQ ID NO: 112278 - DNA, 22 bp, Homo sapiens
ttggatgggcattaggaaagtc

SEQ ID NO: 112279 - DNA, 22 bp, Homo sapiens
ttcccttaaattatggcatcta

SEQ ID NO: 112280 - DNA, 22 bp, Homo sapiens
agcccaggagtttgaggctgtg

SEQ ID NO: 112281 - DNA, 22 bp, Homo sapiens
gaaggaagtcattagtgcagac

SEQ ID NO: 112282 - DNA, 22 bp, Homo sapiens
aaagaaatagatggcatttaaa

SEQ ID NO: 112283 - DNA, 22 bp, Homo sapiens
caggagtgttgattgctcagga

SEQ ID NO: 112284 - DNA, 22 bp, Homo sapiens
tcagtgccatgggcagacaggc

SEQ ID NO: 112285 - DNA, 22 bp, Homo sapiens
ggcatcgtcctgggcataggga

SEQ ID NO: 112286 - DNA, 22 bp, Homo sapiens
aaacttttttaggttcataggc

SEQ ID NO: 112287 - DNA, 22 bp, Homo sapiens
aggaggggttctcgggtgctga

SEQ ID NO: 112288 - DNA, 22 bp, Homo sapiens
ggctcaatgcaacttctgcctc

SEQ ID NO: 112289 - DNA, 22 bp, Homo sapiens
aatggcactttataaatgttaa

SEQ ID NO: 112290 - DNA, 22 bp, Homo sapiens
ctgtcaggttggtctcagagct

SEQ ID NO: 112291 - DNA, 22 bp, Homo sapiens
gctgtatgtgaggccacagtga

SEQ ID NO: 112292 - DNA, 21 bp, Homo sapiens
aggagcattgttgtggtggag

SEQ ID NO: 112293 - DNA, 22 bp, Homo sapiens
attaagtgttttacatacatta

SEQ ID NO: 112294 - DNA, 22 bp, Homo sapiens
cagtggctggttagggacagga

SEQ ID NO: 112295 - DNA, 22 bp, Homo sapiens
ctctgcctgtctcatcctgcaa

SEQ ID NO: 112296 - DNA, 22 bp, Homo sapiens
aaggaaagctgtggttctgaga

SEQ ID NO: 112297 - DNA, 22 bp, Homo sapiens
gtagttctgcagtgtcacctga

SEQ ID NO: 112298 - DNA, 22 bp, Homo sapiens
cgcaactcagcaacttaactgc

SEQ ID NO: 112299 - DNA, 22 bp, Homo sapiens
tcctcagcttttatttcacttg

SEQ ID NO: 112300 - DNA, 22 bp, Homo sapiens
atgaaaacggaccagagctatt

SEQ ID NO: 112301 - DNA, 20 bp, Homo sapiens
tgtttgtgtggggccttggc

SEQ ID NO: 112302 - DNA, 18 bp, Homo sapiens
actctttctgcccacagg

SEQ ID NO: 112303 - DNA, 22 bp, Homo sapiens
ccggcgaccgctgtcggaggcg

SEQ ID NO: 112304 - DNA, 22 bp, Homo sapiens
ctggcaagaaatatatatctta

SEQ ID NO: 112305 - DNA, 23 bp, Homo sapiens
tcggtgggcgtggaggccgaggc

SEQ ID NO: 112306 - DNA, 22 bp, Homo sapiens
tcgttaccatagccttgtccct

SEQ ID NO: 112307 - DNA, 22 bp, Homo sapiens
tggtacacatgtccaaggtcag

SEQ ID NO: 112308 - DNA, 22 bp, Homo sapiens
gtgggctgcccttgaggtcagc

SEQ ID NO: 112309 - DNA, 22 bp, Homo sapiens
taaatacttagttttgtgtcta

SEQ ID NO: 112310 - DNA, 22 bp, Homo sapiens
tggagagttctgtagatatcta

SEQ ID NO: 112311 - DNA, 22 bp, Homo sapiens
cttgtagaattgaaatggtctc

SEQ ID NO: 112312 - DNA, 22 bp, Homo sapiens
gctatgggatgtgctgtggatg

SEQ ID NO: 112313 - DNA, 22 bp, Homo sapiens
gccttattacctgcactttgaa

SEQ ID NO: 112314 - DNA, 22 bp, Homo sapiens
acactggttggttgaatttact

SEQ ID NO: 112315 - DNA, 18 bp, Homo sapiens
ggaaaaggagtgtctagc

SEQ ID NO: 112316 - DNA, 22 bp, Homo sapiens
cctggcaggtggcgccctcggc

SEQ ID NO: 112317 - DNA, 22 bp, Homo sapiens
atgagcacactgataagcccct

SEQ ID NO: 112318 - DNA, 22 bp, Homo sapiens
cacagcctcctctggctcacgg

SEQ ID NO: 112319 - DNA, 22 bp, Homo sapiens
gacagctgcatcctcagacaca

SEQ ID NO: 112320 - DNA, 22 bp, Homo sapiens
ggcccagacccaagagtggtgg

SEQ ID NO: 112321 - DNA, 22 bp, Homo sapiens
caggaattcatagcattgttct

SEQ ID NO: 112322 - DNA, 21 bp, Homo sapiens
cagagctgtccaaaccctgac

SEQ ID NO: 112323 - DNA, 22 bp, Homo sapiens
ccttctcagccccagctcccgc

SEQ ID NO: 112324 - DNA, 22 bp, Homo sapiens
tccgaggccaaagctgtgaata

SEQ ID NO: 112325 - DNA, 22 bp, Homo sapiens
aaattagtcatgttgtattact

SEQ ID NO: 112326 - DNA, 22 bp, Homo sapiens
gcccaggctggagtgcagtggc

SEQ ID NO: 112327 - DNA, 22 bp, Homo sapiens
atatatttgagaatattcatga

SEQ ID NO: 112328 - DNA, 22 bp, Homo sapiens
tcagcctgctccaagtgctgcc

SEQ ID NO: 112329 - DNA, 22 bp, Homo sapiens
acagagcaataacagggagagg

SEQ ID NO: 112330 - DNA, 22 bp, Homo sapiens
aggaaaatggaccagagttgtt

SEQ ID NO: 112331 - DNA, 22 bp, Homo sapiens
cttagatgaagtcacagaaccc

SEQ ID NO: 112332 - DNA, 22 bp, Homo sapiens
ctgtcctgccagtcctggactc

SEQ ID NO: 112333 - DNA, 22 bp, Homo sapiens
aggaaataggaccagacaaagc

SEQ ID NO: 112334 - DNA, 19 bp, Homo sapiens
gccttcccaccacccgtcc

SEQ ID NO: 112335 - DNA, 22 bp, Homo sapiens
ctgagcagatgaccagccccag

SEQ ID NO: 112336 - DNA, 18 bp, Homo sapiens
tgtagagccaggtttgcc

SEQ ID NO: 112337 - DNA, 22 bp, Homo sapiens
gtcccataagtagtgcaacttg

SEQ ID NO: 112338 - DNA, 22 bp, Homo sapiens
actgcactccagcctgggtaac

SEQ ID NO: 112339 - DNA, 22 bp, Homo sapiens
actgcactccaacctgggtgac

SEQ ID NO: 112340 - DNA, 22 bp, Homo sapiens
cccaggaggtggaggctgcagt

SEQ ID NO: 112341 - DNA, 22 bp, Homo sapiens
tggtggctcacgtctgtaatct

SEQ ID NO: 112342 - DNA, 23 bp, Homo sapiens
catctagcatccagtgagtagtg

SEQ ID NO: 112343 - DNA, 22 bp, Homo sapiens
gagagtctagtgcacctagttt

SEQ ID NO: 112344 - DNA, 22 bp, Homo sapiens
tccattatacttctgattcaaa

SEQ ID NO: 112345 - DNA, 22 bp, Homo sapiens
gctgctgcttgaaggctcggag

SEQ ID NO: 112346 - DNA, 22 bp, Homo sapiens
tgggggtgtcctggtgcacaca

SEQ ID NO: 112347 - DNA, 22 bp, Homo sapiens
tgcctgtggaaaggctggtgct

SEQ ID NO: 112348 - DNA, 22 bp, Homo sapiens
cggggaagcggttctggcggta

SEQ ID NO: 112349 - DNA, 22 bp, Homo sapiens
ttcaaagcagagggtcaataca

SEQ ID NO: 112350 - DNA, 22 bp, Homo sapiens
ttgtgaatagtgccgctataaa

SEQ ID NO: 112351 - DNA, 22 bp, Homo sapiens
gaagattgaaggctgggaatta

SEQ ID NO: 112352 - DNA, 20 bp, Homo sapiens
ttcgctgggagtggccaggc

SEQ ID NO: 112353 - DNA, 22 bp, Homo sapiens
gctgggacaacaggtgagcacc

SEQ ID NO: 112354 - DNA, 22 bp, Homo sapiens
atgccactgcactccagcctgg

SEQ ID NO: 112355 - DNA, 22 bp, Homo sapiens
taaaggtagtgtgacatattgt

SEQ ID NO: 112356 - DNA, 22 bp, Homo sapiens
ggtccccccatggtgagcactg

SEQ ID NO: 112357 - DNA, 22 bp, Homo sapiens
agtggagacaggacagtcgata

SEQ ID NO: 112358 - DNA, 22 bp, Homo sapiens
ttttgacaatgctaatctcaat

SEQ ID NO: 112359 - DNA, 22 bp, Homo sapiens
gagccaggaggcagagactgca

SEQ ID NO: 112360 - DNA, 22 bp, Homo sapiens
aagccgggcctgagaaatgaca

SEQ ID NO: 112361 - DNA, 22 bp, Homo sapiens
gggagaggttacccgagcaact

SEQ ID NO: 112362 - DNA, 22 bp, Homo sapiens
tctgaccctactcagcactttg

SEQ ID NO: 112363 - DNA, 22 bp, Homo sapiens
gctggtgagcaaaggagaagga

SEQ ID NO: 112364 - DNA, 22 bp, Homo sapiens
ggccctggcagccacgaaagcc

SEQ ID NO: 112365 - DNA, 17 bp, Homo sapiens
tggctctgtcctcagct

SEQ ID NO: 112366 - DNA, 22 bp, Homo sapiens
taaaatttgtccctgagtgttg

SEQ ID NO: 112367 - DNA, 22 bp, Homo sapiens
gccctgtgcaggtgtgcagcag

SEQ ID NO: 112368 - DNA, 22 bp, Homo sapiens
atggaatgtttatacacagttg

SEQ ID NO: 112369 - DNA, 22 bp, Homo sapiens
tgagacgaagtcttgctctgtt

SEQ ID NO: 112370 - DNA, 22 bp, Homo sapiens
catcatcaaaagtgacagagaa

SEQ ID NO: 112371 - DNA, 22 bp, Homo sapiens
tactgatattttcaactagaag

SEQ ID NO: 112372 - DNA, 22 bp, Homo sapiens
gggaagagggagctggaatgat

SEQ ID NO: 112373 - DNA, 22 bp, Homo sapiens
cagtgatatttatcctactcac

SEQ ID NO: 112374 - DNA, 22 bp, Homo sapiens
gcttcggggtccaagcgcgtgt

SEQ ID NO: 112375 - DNA, 22 bp, Homo sapiens
ggctgggctccgggagcatgcg

SEQ ID NO: 112376 - DNA, 22 bp, Homo sapiens
tcactgcaacctctgcctcccg

SEQ ID NO: 112377 - DNA, 22 bp, Homo sapiens
gaatgctaagcatgtgggagtt

SEQ ID NO: 112378 - DNA, 22 bp, Homo sapiens
gaaagacatagttgcaagatgg

SEQ ID NO: 112379 - DNA, 22 bp, Homo sapiens
gtgtatgttctacttaatatta

SEQ ID NO: 112380 - DNA, 22 bp, Homo sapiens
aagatgcggttgaccatggtgt

SEQ ID NO: 112381 - DNA, 22 bp, Homo sapiens
gggatttcaccatgttggttgg

SEQ ID NO: 112382 - DNA, 22 bp, Homo sapiens
tgtttcaaattacttgaggatt

SEQ ID NO: 112383 - DNA, 22 bp, Homo sapiens
aaaagtcttggggaaggccagg

SEQ ID NO: 112384 - DNA, 22 bp, Homo sapiens
ttgtgagtagtgccgcaataaa

SEQ ID NO: 112385 - DNA, 22 bp, Homo sapiens
ggaggcggaggctgcagtgagc

SEQ ID NO: 112386 - DNA, 22 bp, Homo sapiens
ggacctgaacataaaacgaggc

SEQ ID NO: 112387 - DNA, 22 bp, Homo sapiens
acccgggaggcaggagtcatag

SEQ ID NO: 112388 - DNA, 22 bp, Homo sapiens
gaggccactgtccctgccttcc

SEQ ID NO: 112389 - DNA, 22 bp, Homo sapiens
ggtgacgaatccatagcatcga

SEQ ID NO: 112390 - DNA, 22 bp, Homo sapiens
tgtgggacctcagagggtcccc

SEQ ID NO: 112391 - DNA, 22 bp, Homo sapiens
tttttagtagaggtgggtttca

SEQ ID NO: 112392 - DNA, 22 bp, Homo sapiens
aaactgtcctcccgaggtttcc

SEQ ID NO: 112393 - DNA, 22 bp, Homo sapiens
tttctttatcatagcatctttg

SEQ ID NO: 112394 - DNA, 22 bp, Homo sapiens
atgccactgcacttcagcttgg

SEQ ID NO: 112395 - DNA, 22 bp, Homo sapiens
ggaaggggtgggtgagcctcag

SEQ ID NO: 112396 - DNA, 22 bp, Homo sapiens
cccaggaggcagagcttgcagt

SEQ ID NO: 112397 - DNA, 22 bp, Homo sapiens
gctcccagtctgatggaggaga

SEQ ID NO: 112398 - DNA, 22 bp, Homo sapiens
atatacacatctttttaaatat

SEQ ID NO: 112399 - DNA, 23 bp, Homo sapiens
gacagagtgagaccttgtcttac

SEQ ID NO: 112400 - DNA, 22 bp, Homo sapiens
tttgaaatgtatcagtataggt

SEQ ID NO: 112401 - DNA, 22 bp, Homo sapiens
acactgcagatgaaagcataag

SEQ ID NO: 112402 - DNA, 19 bp, Homo sapiens
tcctgcccaccagccaggg

SEQ ID NO: 112403 - DNA, 22 bp, Homo sapiens
ttgagcaggatggctatgcaca

SEQ ID NO: 112404 - DNA, 22 bp, Homo sapiens
aagaggtttaactgactcacag

SEQ ID NO: 112405 - DNA, 22 bp, Homo sapiens
tcactgcacttcagcttgggca

SEQ ID NO: 112406 - DNA, 22 bp, Homo sapiens
tgttgcccaggttctctcctgc

SEQ ID NO: 112407 - DNA, 22 bp, Homo sapiens
gtgctccctccttcctcaagga

SEQ ID NO: 112408 - DNA, 22 bp, Homo sapiens
gggaggttctgttcgcacttga

SEQ ID NO: 112409 - DNA, 22 bp, Homo sapiens
cggcatgggcgtccccctcact

SEQ ID NO: 112410 - DNA, 22 bp, Homo sapiens
ttgagtgtactttagtcatctg

SEQ ID NO: 112411 - DNA, 22 bp, Homo sapiens
ctgggaggcggaggttgtagtg

SEQ ID NO: 112412 - DNA, 22 bp, Homo sapiens
tgttccgaccgtggggtttgat

SEQ ID NO: 112413 - DNA, 22 bp, Homo sapiens
acctagaatttaaaacattgct

SEQ ID NO: 112414 - DNA, 19 bp, Homo sapiens
tctgaagaattagagagca

SEQ ID NO: 112415 - DNA, 22 bp, Homo sapiens
gaggcaggaggattgcttgagc

SEQ ID NO: 112416 - DNA, 22 bp, Homo sapiens
ctcccagccttcgccagtctga

SEQ ID NO: 112417 - DNA, 22 bp, Homo sapiens
accctggaggtggaggtgcagt

SEQ ID NO: 112418 - DNA, 22 bp, Homo sapiens
ttgaggcctgctggaaggtgtt

SEQ ID NO: 112419 - DNA, 22 bp, Homo sapiens
aaacatctactgtaggctggag

SEQ ID NO: 112420 - DNA, 22 bp, Homo sapiens
gtagaggggtgattctgtgaga

SEQ ID NO: 112421 - DNA, 22 bp, Homo sapiens
aggcctgaggaccagataaatg

SEQ ID NO: 112422 - DNA, 22 bp, Homo sapiens
gtgttgatgacattttagaaac

SEQ ID NO: 112423 - DNA, 22 bp, Homo sapiens
ctgtccatggtccttattacca

SEQ ID NO: 112424 - DNA, 22 bp, Homo sapiens
atggccaggcacctctggctga

SEQ ID NO: 112425 - DNA, 22 bp, Homo sapiens
ttggaagacaatgctgattctc

SEQ ID NO: 112426 - DNA, 22 bp, Homo sapiens
taggtttaggagtgaaggtgaa

SEQ ID NO: 112427 - DNA, 22 bp, Homo sapiens
ggaatgaatttccagctgggtc

SEQ ID NO: 112428 - DNA, 21 bp, Homo sapiens
tactgtagccttgcactgtag

SEQ ID NO: 112429 - DNA, 22 bp, Homo sapiens
gcccggcagtcacacacccagg

SEQ ID NO: 112430 - DNA, 22 bp, Homo sapiens
actcaagtggccttgatggctt

SEQ ID NO: 112431 - DNA, 22 bp, Homo sapiens
tgatcagcatcttcccagctcg

SEQ ID NO: 112432 - DNA, 22 bp, Homo sapiens
tgtgaagatagctgttacatct

SEQ ID NO: 112433 - DNA, 22 bp, Homo sapiens
ttatttaatgtgatctgaagag

SEQ ID NO: 112434 - DNA, 23 bp, Homo sapiens
ggatggacgtgatgccttagcca

SEQ ID NO: 112435 - DNA, 22 bp, Homo sapiens
ttacatgtttatgggggtacat

SEQ ID NO: 112436 - DNA, 22 bp, Homo sapiens
gcggtcggcagaggggctctgc

SEQ ID NO: 112437 - DNA, 22 bp, Homo sapiens
gctaatcaatgttaaggctgtg

SEQ ID NO: 112438 - DNA, 22 bp, Homo sapiens
gaggtgctgctgtacttcttgc

SEQ ID NO: 112439 - DNA, 22 bp, Homo sapiens
gacaggaggcagagctcaggtg

SEQ ID NO: 112440 - DNA, 22 bp, Homo sapiens
gacagacacaattgatccatga

SEQ ID NO: 112441 - DNA, 22 bp, Homo sapiens
ttcagcttgctgactgcggcag

SEQ ID NO: 112442 - DNA, 22 bp, Homo sapiens
tttggtattgcacactgtcttc

SEQ ID NO: 112443 - DNA, 22 bp, Homo sapiens
tatgccactgctctccatccta

SEQ ID NO: 112444 - DNA, 22 bp, Homo sapiens
ttatgatttgccacagattggt

SEQ ID NO: 112445 - DNA, 22 bp, Homo sapiens
cacatttttactgccaacttaa

SEQ ID NO: 112446 - DNA, 22 bp, Homo sapiens
aactatgttaataagtttcatt

SEQ ID NO: 112447 - DNA, 22 bp, Homo sapiens
gctgtgcagaggtgagaatcca

SEQ ID NO: 112448 - DNA, 22 bp, Homo sapiens
agggaagaggaccagagtctct

SEQ ID NO: 112449 - DNA, 22 bp, Homo sapiens
ccaggaggtggagattgcagtg

SEQ ID NO: 112450 - DNA, 22 bp, Homo sapiens
atggcaccttccccagagctca

SEQ ID NO: 112451 - DNA, 22 bp, Homo sapiens
gagctgggcctgcgagtgctgc

SEQ ID NO: 112452 - DNA, 22 bp, Homo sapiens
tgctgggctggggcctcagacc

SEQ ID NO: 112453 - DNA, 22 bp, Homo sapiens
agatcacagtggcaactccctt

SEQ ID NO: 112454 - DNA, 22 bp, Homo sapiens
gcggcccgagcaggacgggtgg

SEQ ID NO: 112455 - DNA, 22 bp, Homo sapiens
acaaccaagaacagagggaaag

SEQ ID NO: 112456 - DNA, 22 bp, Homo sapiens
gagctgagaagcagcgcttgat

SEQ ID NO: 112457 - DNA, 22 bp, Homo sapiens
tagcacagcttcttgatgtcac

SEQ ID NO: 112458 - DNA, 22 bp, Homo sapiens
gggccccaagaacctcctcctg

SEQ ID NO: 112459 - DNA, 22 bp, Homo sapiens
cagtggaggccttgggaccttt

SEQ ID NO: 112460 - DNA, 22 bp, Homo sapiens
aagttactggcaagggctgcag

SEQ ID NO: 112461 - DNA, 22 bp, Homo sapiens
agggctggagccacagctggga

SEQ ID NO: 112462 - DNA, 22 bp, Homo sapiens
caaccccactacacgttggaga

SEQ ID NO: 112463 - DNA, 22 bp, Homo sapiens
cagcagcagtggctgcagaaca

SEQ ID NO: 112464 - DNA, 22 bp, Homo sapiens
ccaccgccatggcgttgtacag

SEQ ID NO: 112465 - DNA, 22 bp, Homo sapiens
gattcactcatattttacgttt

SEQ ID NO: 112466 - DNA, 22 bp, Homo sapiens
tcactgcaagctccacctcccg

SEQ ID NO: 112467 - DNA, 22 bp, Homo sapiens
tgcctccctggcaagtctctcc

SEQ ID NO: 112468 - DNA, 22 bp, Homo sapiens
aaggagcacacaatctagaacc

SEQ ID NO: 112469 - DNA, 22 bp, Homo sapiens
ttcagcactgactgagtggtta

SEQ ID NO: 112470 - DNA, 22 bp, Homo sapiens
tgagccaggagtttgaggctgt

SEQ ID NO: 112471 - DNA, 22 bp, Homo sapiens
agttgcatgtccaagggggtag

SEQ ID NO: 112472 - DNA, 21 bp, Homo sapiens
ttgctgttttcccaatgcagt

SEQ ID NO: 112473 - DNA, 22 bp, Homo sapiens
gtgtaagtatctttgtatcttt

SEQ ID NO: 112474 - DNA, 22 bp, Homo sapiens
gtgtgggctgcagaggcacagc

SEQ ID NO: 112475 - DNA, 22 bp, Homo sapiens
actgcacttcagcctgggtgac

SEQ ID NO: 112476 - DNA, 22 bp, Homo sapiens
ttgcttctcagggcctgatgca

SEQ ID NO: 112477 - DNA, 22 bp, Homo sapiens
caggctggagtgcagtggcgcc

SEQ ID NO: 112478 - DNA, 22 bp, Homo sapiens
ccgggcctcgggacaccgggta

SEQ ID NO: 112479 - DNA, 22 bp, Homo sapiens
ctgagccaaggggacagtgaca

SEQ ID NO: 112480 - DNA, 19 bp, Homo sapiens
cggtccatccgattttaca

SEQ ID NO: 112481 - DNA, 22 bp, Homo sapiens
ctgaggagaggtggcctgtgtt

SEQ ID NO: 112482 - DNA, 22 bp, Homo sapiens
tctgaggctgaatggactccgt

SEQ ID NO: 112483 - DNA, 22 bp, Homo sapiens
agatacattgcacgatgcagat

SEQ ID NO: 112484 - DNA, 22 bp, Homo sapiens
ggtgctggacacgtggcactcc

SEQ ID NO: 112485 - DNA, 22 bp, Homo sapiens
cgttctctcatgatcttcccga

SEQ ID NO: 112486 - DNA, 18 bp, Homo sapiens
gctgtggaagtctttata

SEQ ID NO: 112487 - DNA, 22 bp, Homo sapiens
ttaaatattatgttgtctgcaa

SEQ ID NO: 112488 - DNA, 22 bp, Homo sapiens
gaaaggagagggttaaggagct

SEQ ID NO: 112489 - DNA, 22 bp, Homo sapiens
aacaattactaccaaggcctgt

SEQ ID NO: 112490 - DNA, 22 bp, Homo sapiens
tctctctgcagcccgggacact

SEQ ID NO: 112491 - DNA, 22 bp, Homo sapiens
tcgctgaggctgcacggctgcc

SEQ ID NO: 112492 - DNA, 22 bp, Homo sapiens
atcaacatgtcataaagtgaaa

SEQ ID NO: 112493 - DNA, 22 bp, Homo sapiens
caatagtgtctgcttgtttcta

SEQ ID NO: 112494 - DNA, 22 bp, Homo sapiens
attgtcgtcaatggacacatag

SEQ ID NO: 112495 - DNA, 22 bp, Homo sapiens
caggcaggtcagtgaagaagga

SEQ ID NO: 112496 - DNA, 22 bp, Homo sapiens
gagaaagcttctttcccacagg

SEQ ID NO: 112497 - DNA, 22 bp, Homo sapiens
actgcactcctgcctgggtaac

SEQ ID NO: 112498 - DNA, 22 bp, Homo sapiens
tttgtagcagcatgatttataa

SEQ ID NO: 112499 - DNA, 22 bp, Homo sapiens
ctggcaggagcattcacagagg

SEQ ID NO: 112500 - DNA, 22 bp, Homo sapiens
gtgcgtcctgggggctgggtcg

SEQ ID NO: 112501 - DNA, 22 bp, Homo sapiens
ctggcctggcgcagtggctcac

SEQ ID NO: 112502 - DNA, 22 bp, Homo sapiens
tgaatatgtgactttgatttca

SEQ ID NO: 112503 - DNA, 22 bp, Homo sapiens
tgggcagggagctggaaccaca

SEQ ID NO: 112504 - DNA, 22 bp, Homo sapiens
aacttgatcctgctgggtacta

SEQ ID NO: 112505 - DNA, 19 bp, Homo sapiens
catggtgaaaccccgtctc

SEQ ID NO: 112506 - DNA, 22 bp, Homo sapiens
tacagggattgttttaatcacc

SEQ ID NO: 112507 - DNA, 20 bp, Homo sapiens
caggtccagcacgtgcacgg

SEQ ID NO: 112508 - DNA, 22 bp, Homo sapiens
gtcgtggagctcacagtgtgcc

SEQ ID NO: 112509 - DNA, 22 bp, Homo sapiens
gcccagccacagtcactttcat

SEQ ID NO: 112510 - DNA, 23 bp, Homo sapiens
cttcacaggttcaggggattaag

SEQ ID NO: 112511 - DNA, 19 bp, Homo sapiens
taggaccctggtggccccc

SEQ ID NO: 112512 - DNA, 23 bp, Homo sapiens
gttttacaggtgagaaaatggag

SEQ ID NO: 112513 - DNA, 22 bp, Homo sapiens
tttctcctcatgactggttgtg

SEQ ID NO: 112514 - DNA, 22 bp, Homo sapiens
cgttaataggtgcaaggtaagg

SEQ ID NO: 112515 - DNA, 22 bp, Homo sapiens
gaggttggggctgcagtgagct

SEQ ID NO: 112516 - DNA, 22 bp, Homo sapiens
tgaatgtgatgctaaacatatg

SEQ ID NO: 112517 - DNA, 22 bp, Homo sapiens
tgcttgtgacagaactgtgtcc

SEQ ID NO: 112518 - DNA, 22 bp, Homo sapiens
attaagtgactaaagtaatgct

SEQ ID NO: 112519 - DNA, 22 bp, Homo sapiens
tggtgccatcatagctcactgc

SEQ ID NO: 112520 - DNA, 22 bp, Homo sapiens
aaaagcaattgcagttcttgcc

SEQ ID NO: 112521 - DNA, 22 bp, Homo sapiens
gtgaaatatttaacgtccaggt

SEQ ID NO: 112522 - DNA, 22 bp, Homo sapiens
agctcaatgcaacctccgcctc

SEQ ID NO: 112523 - DNA, 22 bp, Homo sapiens
caagggaattgtgtgtgagagg

SEQ ID NO: 112524 - DNA, 22 bp, Homo sapiens
gtgagcagagatcgcgtgattg

SEQ ID NO: 112525 - DNA, 22 bp, Homo sapiens
taggctgggggtaggaattgag

SEQ ID NO: 112526 - DNA, 22 bp, Homo sapiens
tgagcaggcgcagcaggaggtc

SEQ ID NO: 112527 - DNA, 22 bp, Homo sapiens
tggcacaggatctcagcggcca

SEQ ID NO: 112528 - DNA, 22 bp, Homo sapiens
tttaaaaaactagtctgagtct

SEQ ID NO: 112529 - DNA, 22 bp, Homo sapiens
cagagctggtgtgtcctggcat

SEQ ID NO: 112530 - DNA, 21 bp, Homo sapiens
acagcctccatctcctgggct

SEQ ID NO: 112531 - DNA, 22 bp, Homo sapiens
tcaccgaggctggagtgcagtg

SEQ ID NO: 112532 - DNA, 22 bp, Homo sapiens
gtgtttggtcagacgtccgggg

SEQ ID NO: 112533 - DNA, 22 bp, Homo sapiens
tttaggttttttcacgtggcta

SEQ ID NO: 112534 - DNA, 22 bp, Homo sapiens
agagggatcaccctgtttctgg

SEQ ID NO: 112535 - DNA, 22 bp, Homo sapiens
actattagcatatcatgaatgg

SEQ ID NO: 112536 - DNA, 22 bp, Homo sapiens
gggtaattggggccttgcagtg

SEQ ID NO: 112537 - DNA, 22 bp, Homo sapiens
attcactgtgggtcctttggat

SEQ ID NO: 112538 - DNA, 22 bp, Homo sapiens
tttctataaaaagtgctaggat

SEQ ID NO: 112539 - DNA, 22 bp, Homo sapiens
gggacatctttctagtcagggt

SEQ ID NO: 112540 - DNA, 22 bp, Homo sapiens
ccctgtgggaactcctgagttg

SEQ ID NO: 112541 - DNA, 22 bp, Homo sapiens
agtccgcctgctgccgtggcag

SEQ ID NO: 112542 - DNA, 22 bp, Homo sapiens
agacgcgcagaaggaagcggcc

SEQ ID NO: 112543 - DNA, 22 bp, Homo sapiens
aggctgagataggtggatcatt

SEQ ID NO: 112544 - DNA, 22 bp, Homo sapiens
tgggaggtgattaaattatggg

SEQ ID NO: 112545 - DNA, 22 bp, Homo sapiens
gggaggctctgctcagcccccg

SEQ ID NO: 112546 - DNA, 22 bp, Homo sapiens
cttgatctacatagtgaaaccc

SEQ ID NO: 112547 - DNA, 22 bp, Homo sapiens
ctggaatctttggagaatgtgg

SEQ ID NO: 112548 - DNA, 22 bp, Homo sapiens
caaagcaggaagctcctgacag

SEQ ID NO: 112549 - DNA, 22 bp, Homo sapiens
tcatctaagagtcttacattta

SEQ ID NO: 112550 - DNA, 22 bp, Homo sapiens
gacccaggggcagggagaaagt

SEQ ID NO: 112551 - DNA, 22 bp, Homo sapiens
tgggaatgcaaggaaagctgtt

SEQ ID NO: 112552 - DNA, 22 bp, Homo sapiens
tgccatagcaatggtaagctga

SEQ ID NO: 112553 - DNA, 19 bp, Homo sapiens
acacagggatcagagggtt

SEQ ID NO: 112554 - DNA, 22 bp, Homo sapiens
tggccaccaccaatacttgcct

SEQ ID NO: 112555 - DNA, 22 bp, Homo sapiens
gagtgtgtcggtcagcgtggcg

SEQ ID NO: 112556 - DNA, 22 bp, Homo sapiens
tttgaggttagctagcagatca

SEQ ID NO: 112557 - DNA, 22 bp, Homo sapiens
gaagttctttatagcagtgtga

SEQ ID NO: 112558 - DNA, 23 bp, Homo sapiens
gggggccgtcctggggattatag

SEQ ID NO: 112559 - DNA, 22 bp, Homo sapiens
attttctatgttgtaattgtta

SEQ ID NO: 112560 - DNA, 22 bp, Homo sapiens
agggcgacaatggagagcgttt

SEQ ID NO: 112561 - DNA, 22 bp, Homo sapiens
gcctccggagttgcagtgtctt

SEQ ID NO: 112562 - DNA, 22 bp, Homo sapiens
cagggcctcctaaggcatctaa

SEQ ID NO: 112563 - DNA, 22 bp, Homo sapiens
aagtggcagttcaggaagcaga

SEQ ID NO: 112564 - DNA, 22 bp, Homo sapiens
ctgcgggctgtcaggcgtgcca

SEQ ID NO: 112565 - DNA, 22 bp, Homo sapiens
aacatagaataaatgagttagg

SEQ ID NO: 112566 - DNA, 22 bp, Homo sapiens
tcactgcaagctctgccttccg

SEQ ID NO: 112567 - DNA, 22 bp, Homo sapiens
gagggggctagcgcagtgccca

SEQ ID NO: 112568 - DNA, 22 bp, Homo sapiens
gctgccttgccctcttcccata

SEQ ID NO: 112569 - DNA, 22 bp, Homo sapiens
ccaaagtgctgagattacaggt

SEQ ID NO: 112570 - DNA, 22 bp, Homo sapiens
tctaatcctatggtggggaggg

SEQ ID NO: 112571 - DNA, 22 bp, Homo sapiens
gccggggctggggagagacatg

SEQ ID NO: 112572 - DNA, 22 bp, Homo sapiens
tagcttatcccacagtgcccag

SEQ ID NO: 112573 - DNA, 22 bp, Homo sapiens
caggagttttaaatctagcatg

SEQ ID NO: 112574 - DNA, 22 bp, Homo sapiens
tgatatgtaactactccttata

SEQ ID NO: 112575 - DNA, 22 bp, Homo sapiens
gagccaggggtcagctccgagg

SEQ ID NO: 112576 - DNA, 22 bp, Homo sapiens
tgactcagtacatctggagttg

SEQ ID NO: 112577 - DNA, 22 bp, Homo sapiens
ggacagaaaccatatgagtgta

SEQ ID NO: 112578 - DNA, 22 bp, Homo sapiens
tgacatttcctagtgctttgtg

SEQ ID NO: 112579 - DNA, 22 bp, Homo sapiens
gaggcacagagtaggtgcacac

SEQ ID NO: 112580 - DNA, 22 bp, Homo sapiens
cagccccatggtgtgctccagc

SEQ ID NO: 112581 - DNA, 19 bp, Homo sapiens
tccacagtggttgaactag

SEQ ID NO: 112582 - DNA, 22 bp, Homo sapiens
tttgctattgtgaatagtgcca

SEQ ID NO: 112583 - DNA, 22 bp, Homo sapiens
agaggcaggaggttgacttgag

SEQ ID NO: 112584 - DNA, 22 bp, Homo sapiens
tatgaagtgatgttgaattttg

SEQ ID NO: 112585 - DNA, 22 bp, Homo sapiens
ctgctgtttctcaaaattaagt

SEQ ID NO: 112586 - DNA, 22 bp, Homo sapiens
tcagcctccgaaagtgctggga

SEQ ID NO: 112587 - DNA, 22 bp, Homo sapiens
cctttcccgctttgagggcaag

SEQ ID NO: 112588 - DNA, 22 bp, Homo sapiens
ggagtgaagtggcgcgatctcg

SEQ ID NO: 112589 - DNA, 22 bp, Homo sapiens
ccccatgaagtagggtctctga

SEQ ID NO: 112590 - DNA, 22 bp, Homo sapiens
ttcttctccgaggagggctggt

SEQ ID NO: 112591 - DNA, 20 bp, Homo sapiens
tcaggtgacacacgtggcac

SEQ ID NO: 112592 - DNA, 22 bp, Homo sapiens
ctcctaggtaacagggtggttt

SEQ ID NO: 112593 - DNA, 22 bp, Homo sapiens
gtgggggcaggcagtgctagga

SEQ ID NO: 112594 - DNA, 21 bp, Homo sapiens
tcagataccagactcaagggg

SEQ ID NO: 112595 - DNA, 22 bp, Homo sapiens
agaggggcccggttctccgtct

SEQ ID NO: 112596 - DNA, 20 bp, Homo sapiens
cagcagtggatgagagtttt

SEQ ID NO: 112597 - DNA, 22 bp, Homo sapiens
ctcatcagaaatacctgacaaa

SEQ ID NO: 112598 - DNA, 22 bp, Homo sapiens
cagggggctcaaaggagagtgc

SEQ ID NO: 112599 - DNA, 22 bp, Homo sapiens
gcagaagcacaggtgacgggcc

SEQ ID NO: 112600 - DNA, 22 bp, Homo sapiens
tctgccgtgcgaggtcccacca

SEQ ID NO: 112601 - DNA, 22 bp, Homo sapiens
tgctcattggcgatctgaggga

SEQ ID NO: 112602 - DNA, 22 bp, Homo sapiens
cctgggaggctgaggctgcagt

SEQ ID NO: 112603 - DNA, 22 bp, Homo sapiens
tcaccttgtgatccgcccacct

SEQ ID NO: 112604 - DNA, 17 bp, Homo sapiens
ttcttttctgagccttg

SEQ ID NO: 112605 - DNA, 22 bp, Homo sapiens
gctgctgggatcctgggtctca

SEQ ID NO: 112606 - DNA, 21 bp, Homo sapiens
gaacccagcagcagtgctctg

SEQ ID NO: 112607 - DNA, 22 bp, Homo sapiens
caggctgctgcctagaatgaca

SEQ ID NO: 112608 - DNA, 22 bp, Homo sapiens
atcccaggcggcacaggttgca

SEQ ID NO: 112609 - DNA, 22 bp, Homo sapiens
tgccctctttctgtacagctcc

SEQ ID NO: 112610 - DNA, 23 bp, Homo sapiens
aggaaagcattcatttttaccat

SEQ ID NO: 112611 - DNA, 19 bp, Homo sapiens
ttttggaaatgtgaacagc

SEQ ID NO: 112612 - DNA, 22 bp, Homo sapiens
cccagggagagcgcggaggcgg

SEQ ID NO: 112613 - DNA, 22 bp, Homo sapiens
tggcgcgacgtgccccctgctt

SEQ ID NO: 112614 - DNA, 22 bp, Homo sapiens
gctgcagctgtaggacacaatt

SEQ ID NO: 112615 - DNA, 22 bp, Homo sapiens
tttttgggtccaggctgtatct

SEQ ID NO: 112616 - DNA, 22 bp, Homo sapiens
gactttgtgccaaacgccagaa

SEQ ID NO: 112617 - DNA, 22 bp, Homo sapiens
caggctgatcagggctgggatg

SEQ ID NO: 112618 - DNA, 22 bp, Homo sapiens
gcccccgtagtagatgaggcgc

SEQ ID NO: 112619 - DNA, 22 bp, Homo sapiens
gtggcccaggttggagtgcagt

SEQ ID NO: 112620 - DNA, 22 bp, Homo sapiens
gaagtattactctgaatgtatt

SEQ ID NO: 112621 - DNA, 22 bp, Homo sapiens
gaccctgtttctacaaataatt

SEQ ID NO: 112622 - DNA, 22 bp, Homo sapiens
ccagaggtgctctttggaagtg

SEQ ID NO: 112623 - DNA, 22 bp, Homo sapiens
tggtggggccagacttcagctc

SEQ ID NO: 112624 - DNA, 22 bp, Homo sapiens
gcctccggagtcacagtgtctt

SEQ ID NO: 112625 - DNA, 22 bp, Homo sapiens
gggggctaccgtctctggagct

SEQ ID NO: 112626 - DNA, 22 bp, Homo sapiens
tgagccgtggtctctgagggtg

SEQ ID NO: 112627 - DNA, 22 bp, Homo sapiens
ggcaggaggtgagtggcgggtg

SEQ ID NO: 112628 - DNA, 22 bp, Homo sapiens
actatagatgctggcgaggctg

SEQ ID NO: 112629 - DNA, 23 bp, Homo sapiens
tcggtgggcgtggaggccgaggc

SEQ ID NO: 112630 - DNA, 22 bp, Homo sapiens
ttccggaaggttctctagaatt

SEQ ID NO: 112631 - DNA, 22 bp, Homo sapiens
aggtcacgtcctgtgatgtcat

SEQ ID NO: 112632 - DNA, 22 bp, Homo sapiens
tttgtgaataggttggcttcca

SEQ ID NO: 112633 - DNA, 22 bp, Homo sapiens
gagatgggcgagaaggtggact

SEQ ID NO: 112634 - DNA, 21 bp, Homo sapiens
cgcagagcgaacttgcggcgc

SEQ ID NO: 112635 - DNA, 22 bp, Homo sapiens
ttgcccagagtcacccagctca

SEQ ID NO: 112636 - DNA, 22 bp, Homo sapiens
atgagaaagttaatcatcatga

SEQ ID NO: 112637 - DNA, 22 bp, Homo sapiens
gacaggcttccactatgttgcc

SEQ ID NO: 112638 - DNA, 22 bp, Homo sapiens
gcagactgtatcaatgtcagta

SEQ ID NO: 112639 - DNA, 22 bp, Homo sapiens
gtctttcttaaacaacagaaca

SEQ ID NO: 112640 - DNA, 22 bp, Homo sapiens
ggtccccgtggaggctggagcg

SEQ ID NO: 112641 - DNA, 22 bp, Homo sapiens
acaagtattggtgaggatgtag

SEQ ID NO: 112642 - DNA, 22 bp, Homo sapiens
agggactatttacccatctcac

SEQ ID NO: 112643 - DNA, 22 bp, Homo sapiens
caggaagctgtgaaggagacgg

SEQ ID NO: 112644 - DNA, 22 bp, Homo sapiens
gaggtggatgttgcagtgagct

SEQ ID NO: 112645 - DNA, 22 bp, Homo sapiens
cttggggcagcccaggctgagc

SEQ ID NO: 112646 - DNA, 22 bp, Homo sapiens
gtaaaaaggccaagcccttgtg

SEQ ID NO: 112647 - DNA, 22 bp, Homo sapiens
tgtaggagtccaatcaggagac

SEQ ID NO: 112648 - DNA, 22 bp, Homo sapiens
cccagtttcaactttccagtgg

SEQ ID NO: 112649 - DNA, 22 bp, Homo sapiens
ttacaattacttgatctcagct

SEQ ID NO: 112650 - DNA, 22 bp, Homo sapiens
agcataagttggtacagccact

SEQ ID NO: 112651 - DNA, 18 bp, Homo sapiens
tcttcatctcctgagctg

SEQ ID NO: 112652 - DNA, 22 bp, Homo sapiens
agcattccacactgaagtctgc

SEQ ID NO: 112653 - DNA, 22 bp, Homo sapiens
taacaatacccattctaattac

SEQ ID NO: 112654 - DNA, 22 bp, Homo sapiens
tgaggcaggtggattacaaggt

SEQ ID NO: 112655 - DNA, 22 bp, Homo sapiens
aaagttctctatggtgtaaaaa

SEQ ID NO: 112656 - DNA, 22 bp, Homo sapiens
tggtgctgccaggctcctgcca

SEQ ID NO: 112657 - DNA, 22 bp, Homo sapiens
gtacagaggttgctggaggctc

SEQ ID NO: 112658 - DNA, 22 bp, Homo sapiens
ggcagcactgcagcttgttggg

SEQ ID NO: 112659 - DNA, 22 bp, Homo sapiens
tgttatctgagcaacgtcgacg

SEQ ID NO: 112660 - DNA, 22 bp, Homo sapiens
atggccgcctgtccttcccgcc

SEQ ID NO: 112661 - DNA, 22 bp, Homo sapiens
ctgggtggcagagcctgcagtg

SEQ ID NO: 112662 - DNA, 22 bp, Homo sapiens
gagaggtggaggttgcagtgag

SEQ ID NO: 112663 - DNA, 23 bp, Homo sapiens
ccccactaccgtgatgtgcgagg

SEQ ID NO: 112664 - DNA, 22 bp, Homo sapiens
gcccagcacctctctcagggtt

SEQ ID NO: 112665 - DNA, 22 bp, Homo sapiens
aagatgattatgtagattggga

SEQ ID NO: 112666 - DNA, 22 bp, Homo sapiens
ggctcacgcaattatcccggcc

SEQ ID NO: 112667 - DNA, 22 bp, Homo sapiens
ccaggaggcagaagttgcagtg

SEQ ID NO: 112668 - DNA, 22 bp, Homo sapiens
aaagccttcttgtatcgagcca

SEQ ID NO: 112669 - DNA, 22 bp, Homo sapiens
tgagtgtggggaatgtcatgag

SEQ ID NO: 112670 - DNA, 22 bp, Homo sapiens
gaaagtgctctctctatacaca

SEQ ID NO: 112671 - DNA, 22 bp, Homo sapiens
tgagccagaggaggctgtgtgg

SEQ ID NO: 112672 - DNA, 21 bp, Homo sapiens
gttcttgcaggatttccttcc

SEQ ID NO: 112673 - DNA, 22 bp, Homo sapiens
agactttaacaatgggtatgaa

SEQ ID NO: 112674 - DNA, 22 bp, Homo sapiens
cttggaggtggaagttgcagtg

SEQ ID NO: 112675 - DNA, 21 bp, Homo sapiens
tctgatggtagatgagatgtg

SEQ ID NO: 112676 - DNA, 22 bp, Homo sapiens
ctccagttggccccagttggtt

SEQ ID NO: 112677 - DNA, 20 bp, Homo sapiens
tcacatcctctcccaacatg

SEQ ID NO: 112678 - DNA, 23 bp, Homo sapiens
ccaagactgttaggagtggggag

SEQ ID NO: 112679 - DNA, 22 bp, Homo sapiens
cactgctacctctgcctcccgg

SEQ ID NO: 112680 - DNA, 22 bp, Homo sapiens
gctgctaagcgtttctgttcca

SEQ ID NO: 112681 - DNA, 22 bp, Homo sapiens
ggaactgaatgtctcggtataa

SEQ ID NO: 112682 - DNA, 23 bp, Homo sapiens
tcctcgcaggagggagatgatgc

SEQ ID NO: 112683 - DNA, 22 bp, Homo sapiens
gcagctggaagtgacactctgt

SEQ ID NO: 112684 - DNA, 22 bp, Homo sapiens
cctcggaggcggaggctgcagt

SEQ ID NO: 112685 - DNA, 22 bp, Homo sapiens
aggtatatattctggtccttat

SEQ ID NO: 112686 - DNA, 22 bp, Homo sapiens
ttgtgctcctgtgagaatctag

SEQ ID NO: 112687 - DNA, 22 bp, Homo sapiens
ggctcatatcccggccatcatt

SEQ ID NO: 112688 - DNA, 22 bp, Homo sapiens
cctgtggcgggggccagtgcct

SEQ ID NO: 112689 - DNA, 22 bp, Homo sapiens
gtgcacatcgtgcaggtttgtt

SEQ ID NO: 112690 - DNA, 22 bp, Homo sapiens
aaggctgtggttctatacagaa

SEQ ID NO: 112691 - DNA, 22 bp, Homo sapiens
ttgaatctgggtacttgtaata

SEQ ID NO: 112692 - DNA, 22 bp, Homo sapiens
tccttagacaaagagtgggctt

SEQ ID NO: 112693 - DNA, 22 bp, Homo sapiens
gggtgctttggctcacgcctgt

SEQ ID NO: 112694 - DNA, 22 bp, Homo sapiens
caggggcgggtaaaaggcctcc

SEQ ID NO: 112695 - DNA, 22 bp, Homo sapiens
ggagagcttggagtgcgatttt

SEQ ID NO: 112696 - DNA, 22 bp, Homo sapiens
gaaactctcgcatcctgggaac

SEQ ID NO: 112697 - DNA, 22 bp, Homo sapiens
tgcagcactgttcacaatagcc

SEQ ID NO: 112698 - DNA, 22 bp, Homo sapiens
ggtaacttagctcatggctgtg

SEQ ID NO: 112699 - DNA, 22 bp, Homo sapiens
ttttctcttccctctggacctg

SEQ ID NO: 112700 - DNA, 22 bp, Homo sapiens
tcccgcttcttccgaatcgcga

SEQ ID NO: 112701 - DNA, 22 bp, Homo sapiens
gtctccttgtggatctcaagga

SEQ ID NO: 112702 - DNA, 22 bp, Homo sapiens
cactgcactccagcttgggtga

SEQ ID NO: 112703 - DNA, 22 bp, Homo sapiens
gatttagtggcccttggtacac

SEQ ID NO: 112704 - DNA, 22 bp, Homo sapiens
tcaggagtgccagtaccttttg

SEQ ID NO: 112705 - DNA, 19 bp, Homo sapiens
gagtattttccaacttggt

SEQ ID NO: 112706 - DNA, 22 bp, Homo sapiens
aaaagtaattgcggtttttgct

SEQ ID NO: 112707 - DNA, 22 bp, Homo sapiens
tgaacatgctgttgatggcctg

SEQ ID NO: 112708 - DNA, 22 bp, Homo sapiens
agaggacagagtgctggattta

SEQ ID NO: 112709 - DNA, 22 bp, Homo sapiens
cagaagatctcttagtggaggg

SEQ ID NO: 112710 - DNA, 22 bp, Homo sapiens
cctcctgcacctccaggaactc

SEQ ID NO: 112711 - DNA, 22 bp, Homo sapiens
aaaaatcacttttataggcagc

SEQ ID NO: 112712 - DNA, 22 bp, Homo sapiens
gaggtgggtgtatcacaggtca

SEQ ID NO: 112713 - DNA, 22 bp, Homo sapiens
tttctcttcactgtgtgcctca

SEQ ID NO: 112714 - DNA, 21 bp, Homo sapiens
ggcaagaaacacaatcaagta

SEQ ID NO: 112715 - DNA, 22 bp, Homo sapiens
acggcctggtgcagcaggtcgc

SEQ ID NO: 112716 - DNA, 22 bp, Homo sapiens
acatttatataactcactagga

SEQ ID NO: 112717 - DNA, 22 bp, Homo sapiens
ttgactgtgatgggctcagctg

SEQ ID NO: 112718 - DNA, 22 bp, Homo sapiens
tgccgcagtgcggggagggccc

SEQ ID NO: 112719 - DNA, 22 bp, Homo sapiens
gctgcaagtgcatgttgcaact

SEQ ID NO: 112720 - DNA, 22 bp, Homo sapiens
tgttccagatttagccaaccga

SEQ ID NO: 112721 - DNA, 22 bp, Homo sapiens
ttatttaaaagtggtaagattc

SEQ ID NO: 112722 - DNA, 22 bp, Homo sapiens
gccctagcgccagctcagcacc

SEQ ID NO: 112723 - DNA, 22 bp, Homo sapiens
gaggccacggaagggagctgtg

SEQ ID NO: 112724 - DNA, 22 bp, Homo sapiens
gcaggtggatcaccacgtcagg

SEQ ID NO: 112725 - DNA, 22 bp, Homo sapiens
cagtcaccttgaggactcagac

SEQ ID NO: 112726 - DNA, 22 bp, Homo sapiens
ggagtgactcacagctgggaca

SEQ ID NO: 112727 - DNA, 22 bp, Homo sapiens
tctgagaaatttctttgtgatg

SEQ ID NO: 112728 - DNA, 22 bp, Homo sapiens
aggaggaagggaagacaagtaa

SEQ ID NO: 112729 - DNA, 22 bp, Homo sapiens
accagcctggccaacatggtga

SEQ ID NO: 112730 - DNA, 22 bp, Homo sapiens
actgcactccagcctgggtgat

SEQ ID NO: 112731 - DNA, 22 bp, Homo sapiens
atattagtttggagactacaat

SEQ ID NO: 112732 - DNA, 22 bp, Homo sapiens
ttccttacattcatatggcttc

SEQ ID NO: 112733 - DNA, 22 bp, Homo sapiens
tttggcggactgagaacgcggg

SEQ ID NO: 112734 - DNA, 22 bp, Homo sapiens
ccagaggagttgaggctttggg

SEQ ID NO: 112735 - DNA, 22 bp, Homo sapiens
aaggtgggtggatcacgaggtc

SEQ ID NO: 112736 - DNA, 23 bp, Homo sapiens
cagggccctgctcaatttctcca

SEQ ID NO: 112737 - DNA, 22 bp, Homo sapiens
gcaaacaaggacatacatcctg

SEQ ID NO: 112738 - DNA, 22 bp, Homo sapiens
cctggctctgccacttactgcc

SEQ ID NO: 112739 - DNA, 22 bp, Homo sapiens
ggcaaaaaccataattactttt

SEQ ID NO: 112740 - DNA, 16 bp, Homo sapiens
tgggtgggaggagcgg

SEQ ID NO: 112741 - DNA, 23 bp, Homo sapiens
aaactacaacgccaggcactgag

SEQ ID NO: 112742 - DNA, 22 bp, Homo sapiens
tgtctattaattccacataaaa

SEQ ID NO: 112743 - DNA, 22 bp, Homo sapiens
ggtagactgtcaaacactagcc

SEQ ID NO: 112744 - DNA, 22 bp, Homo sapiens
tcctggcaaagatgttggtgtt

SEQ ID NO: 112745 - DNA, 22 bp, Homo sapiens
gactttggttcagggctcagag

SEQ ID NO: 112746 - DNA, 22 bp, Homo sapiens
ggaccggtggcttcctcgggtc

SEQ ID NO: 112747 - DNA, 22 bp, Homo sapiens
gtggcaggagggcatcacttgg

SEQ ID NO: 112748 - DNA, 22 bp, Homo sapiens
ctgcttctagcaccaagtccct

SEQ ID NO: 112749 - DNA, 22 bp, Homo sapiens
tgggccacacacagaagaatca

SEQ ID NO: 112750 - DNA, 22 bp, Homo sapiens
acaaagtgaattgcatcgagtt

SEQ ID NO: 112751 - DNA, 22 bp, Homo sapiens
agggaacatttgcactgttggt

SEQ ID NO: 112752 - DNA, 22 bp, Homo sapiens
ctgggaggtggaggttgcattg

SEQ ID NO: 112753 - DNA, 22 bp, Homo sapiens
gccgtgtcatctgcgggtggca

SEQ ID NO: 112754 - DNA, 21 bp, Homo sapiens
cagggccaatcctgacctcta

SEQ ID NO: 112755 - DNA, 22 bp, Homo sapiens
tgtatagttgagtcaagtttca

SEQ ID NO: 112756 - DNA, 22 bp, Homo sapiens
cagcccaggactgcaggtgttt

SEQ ID NO: 112757 - DNA, 22 bp, Homo sapiens
actttcttggtcccatgtttga

SEQ ID NO: 112758 - DNA, 22 bp, Homo sapiens
aaggatacttttagagcctgag

SEQ ID NO: 112759 - DNA, 22 bp, Homo sapiens
cacagagatggtctggcaggtg

SEQ ID NO: 112760 - DNA, 22 bp, Homo sapiens
gctggcagacttcctctggaac

SEQ ID NO: 112761 - DNA, 22 bp, Homo sapiens
ctgaggaggctaatttgaggat

SEQ ID NO: 112762 - DNA, 23 bp, Homo sapiens
aagttagtttcaataaagcaatt

SEQ ID NO: 112763 - DNA, 22 bp, Homo sapiens
gaggcagaggttgcagtgagct

SEQ ID NO: 112764 - DNA, 22 bp, Homo sapiens
gttggagtgcagcttgtgcgat

SEQ ID NO: 112765 - DNA, 22 bp, Homo sapiens
agcctattccaggatgagctca

SEQ ID NO: 112766 - DNA, 22 bp, Homo sapiens
cgttgtttgagattttcagaat

SEQ ID NO: 112767 - DNA, 22 bp, Homo sapiens
aggaatgacatagaaaggggag

SEQ ID NO: 112768 - DNA, 21 bp, Homo sapiens
ggccccgcagacccagcacgt

SEQ ID NO: 112769 - DNA, 22 bp, Homo sapiens
cttttgattgagcagtttcaaa

SEQ ID NO: 112770 - DNA, 22 bp, Homo sapiens
gtgtcaataaatagcggtgtgg

SEQ ID NO: 112771 - DNA, 22 bp, Homo sapiens
tgcctgatgcaggagtatcaga

SEQ ID NO: 112772 - DNA, 22 bp, Homo sapiens
ctagcctgggatttgaacttat

SEQ ID NO: 112773 - DNA, 22 bp, Homo sapiens
ttcccacattctttacattcat

SEQ ID NO: 112774 - DNA, 22 bp, Homo sapiens
gcgagaaactaagtgccctttg

SEQ ID NO: 112775 - DNA, 22 bp, Homo sapiens
gctcatgactgtaatcccagca

SEQ ID NO: 112776 - DNA, 22 bp, Homo sapiens
aggctcccaagcactgacccca

SEQ ID NO: 112777 - DNA, 22 bp, Homo sapiens
gtagcccacctggggagggcga

SEQ ID NO: 112778 - DNA, 21 bp, Homo sapiens
acataggcgaatgttcgggag

SEQ ID NO: 112779 - DNA, 22 bp, Homo sapiens
atacaaagtattgatcctgagt

SEQ ID NO: 112780 - DNA, 22 bp, Homo sapiens
ctcaggagttggaggctacagt

SEQ ID NO: 112781 - DNA, 22 bp, Homo sapiens
aaaatcttgtgacttaggaagg

SEQ ID NO: 112782 - DNA, 22 bp, Homo sapiens
aggcaagggggcgccaccttcc

SEQ ID NO: 112783 - DNA, 22 bp, Homo sapiens
gctttatccgcttgacccttac

SEQ ID NO: 112784 - DNA, 22 bp, Homo sapiens
ctgctctgctgatcagtgtctc

SEQ ID NO: 112785 - DNA, 21 bp, Homo sapiens
gggcctggctgcgcaggacgg

SEQ ID NO: 112786 - DNA, 22 bp, Homo sapiens
tttatgtagttacggactatca

SEQ ID NO: 112787 - DNA, 22 bp, Homo sapiens
ctgcgtggtaggactcagttct

SEQ ID NO: 112788 - DNA, 22 bp, Homo sapiens
caggcagaagaagtggaaggac

SEQ ID NO: 112789 - DNA, 22 bp, Homo sapiens
gtcagtgtcttaacagagatta

SEQ ID NO: 112790 - DNA, 22 bp, Homo sapiens
ctgccaggattctgtgaacccc

SEQ ID NO: 112791 - DNA, 22 bp, Homo sapiens
actaaagctcacagagttgaac

SEQ ID NO: 112792 - DNA, 22 bp, Homo sapiens
gaaggtggcgagcggattgctg

SEQ ID NO: 112793 - DNA, 22 bp, Homo sapiens
tgttaaaccagttttgcatcat

SEQ ID NO: 112794 - DNA, 20 bp, Homo sapiens
taagcatagttgtcagggtc

SEQ ID NO: 112795 - DNA, 22 bp, Homo sapiens
gaagagctgacagtgtcatcct

SEQ ID NO: 112796 - DNA, 22 bp, Homo sapiens
gcaggcagatcacctgtcagga

SEQ ID NO: 112797 - DNA, 22 bp, Homo sapiens
gtctatgatattttgttatagc

SEQ ID NO: 112798 - DNA, 17 bp, Homo sapiens
ggctgcagtccaggagg

SEQ ID NO: 112799 - DNA, 22 bp, Homo sapiens
tggtaaggttccagatctagaa

SEQ ID NO: 112800 - DNA, 22 bp, Homo sapiens
ggagaggcttccagagtcgtgc

SEQ ID NO: 112801 - DNA, 22 bp, Homo sapiens
ttacctaaaatagctcaattta

SEQ ID NO: 112802 - DNA, 22 bp, Homo sapiens
ccaaagtgctgggattcaggca

SEQ ID NO: 112803 - DNA, 22 bp, Homo sapiens
cttctgagatgttgttttacag

SEQ ID NO: 112804 - DNA, 23 bp, Homo sapiens
aggatgtaggatgtatggcagag

SEQ ID NO: 112805 - DNA, 22 bp, Homo sapiens
gctgctctcagagctcatgctg

SEQ ID NO: 112806 - DNA, 22 bp, Homo sapiens
ctccatatgttcagttatgcag

SEQ ID NO: 112807 - DNA, 20 bp, Homo sapiens
cagtgcattgcttctgattt

SEQ ID NO: 112808 - DNA, 18 bp, Homo sapiens
ctgtaccaccctgagggc

SEQ ID NO: 112809 - DNA, 22 bp, Homo sapiens
cactgcactccagcctgggtga

SEQ ID NO: 112810 - DNA, 22 bp, Homo sapiens
gctgtggcctggcgcagagctg

SEQ ID NO: 112811 - DNA, 22 bp, Homo sapiens
ttcccagtcaaacgaaggactt

SEQ ID NO: 112812 - DNA, 22 bp, Homo sapiens
tgagatcattgacttgttcctg

SEQ ID NO: 112813 - DNA, 22 bp, Homo sapiens
ttaggatttgaaaaggggcaga

SEQ ID NO: 112814 - DNA, 19 bp, Homo sapiens
ctctgggcaagtcacttaa

SEQ ID NO: 112815 - DNA, 22 bp, Homo sapiens
caggctgaagtgcagtggtgtg

SEQ ID NO: 112816 - DNA, 22 bp, Homo sapiens
tgagagcctgtgttcaaatgcc

SEQ ID NO: 112817 - DNA, 22 bp, Homo sapiens
agacgctattttgaggggtcta

SEQ ID NO: 112818 - DNA, 22 bp, Homo sapiens
tccgggagctgaacgtcttgcg

SEQ ID NO: 112819 - DNA, 22 bp, Homo sapiens
aagcctaggcctactctggttt

SEQ ID NO: 112820 - DNA, 22 bp, Homo sapiens
gtgcccagcagcagcgtccccg

SEQ ID NO: 112821 - DNA, 22 bp, Homo sapiens
cagcctgccgtcagccaggtag

SEQ ID NO: 112822 - DNA, 22 bp, Homo sapiens
aaattagtgcaccaggttgaag

SEQ ID NO: 112823 - DNA, 22 bp, Homo sapiens
tgtcacagtttgtactttatag

SEQ ID NO: 112824 - DNA, 22 bp, Homo sapiens
agttttcattaccatgctgcaa

SEQ ID NO: 112825 - DNA, 22 bp, Homo sapiens
taccagggaacagggatattaa

SEQ ID NO: 112826 - DNA, 22 bp, Homo sapiens
ctgggaggcagaggttgcagtg

SEQ ID NO: 112827 - DNA, 22 bp, Homo sapiens
atgggtcagttcagtggccaac

SEQ ID NO: 112828 - DNA, 21 bp, Homo sapiens
gacattgagcgtgtcgcagtg

SEQ ID NO: 112829 - DNA, 22 bp, Homo sapiens
ggaagaaaggtggacaacaggt

SEQ ID NO: 112830 - DNA, 22 bp, Homo sapiens
tggttttagggaatcaatctat

SEQ ID NO: 112831 - DNA, 22 bp, Homo sapiens
agcgctgtgggcgtgcgaggag

SEQ ID NO: 112832 - DNA, 22 bp, Homo sapiens
agcctggcctgggcaggcacat

SEQ ID NO: 112833 - DNA, 22 bp, Homo sapiens
tcttcattttacaggcagacct

SEQ ID NO: 112834 - DNA, 22 bp, Homo sapiens
ccaagcagagcagcctctctgg

SEQ ID NO: 112835 - DNA, 22 bp, Homo sapiens
agcccaggtccagttcactgca

SEQ ID NO: 112836 - DNA, 22 bp, Homo sapiens
tcttttgtgattctttagttac

SEQ ID NO: 112837 - DNA, 22 bp, Homo sapiens
agacagggtgatcgcttgagcc

SEQ ID NO: 112838 - DNA, 22 bp, Homo sapiens
gtggcctggctggcaccacctc

SEQ ID NO: 112839 - DNA, 21 bp, Homo sapiens
ccaccaggtcttctgctcggg

SEQ ID NO: 112840 - DNA, 22 bp, Homo sapiens
aaaactacatttgacattttgt

SEQ ID NO: 112841 - DNA, 22 bp, Homo sapiens
tgtacacatggtgtacactccc

SEQ ID NO: 112842 - DNA, 22 bp, Homo sapiens
ggctccaccctgcttccagaag

SEQ ID NO: 112843 - DNA, 22 bp, Homo sapiens
tgtctctgtgactccttccgcc

SEQ ID NO: 112844 - DNA, 22 bp, Homo sapiens
cattgcaacttcaaactcctgg

SEQ ID NO: 112845 - DNA, 22 bp, Homo sapiens
attctaatggcagagactcctg

SEQ ID NO: 112846 - DNA, 22 bp, Homo sapiens
ctgatcctcctttaagtagctg

SEQ ID NO: 112847 - DNA, 17 bp, Homo sapiens
tggtccaggtggagcca

SEQ ID NO: 112848 - DNA, 22 bp, Homo sapiens
gagctgtgtatgcatcattctg

SEQ ID NO: 112849 - DNA, 22 bp, Homo sapiens
ttcataaacaaattaaggcctg

SEQ ID NO: 112850 - DNA, 22 bp, Homo sapiens
gggtccctggaattacttgaca

SEQ ID NO: 112851 - DNA, 19 bp, Homo sapiens
agggttacccgctgccacc

SEQ ID NO: 112852 - DNA, 22 bp, Homo sapiens
cgcgaggtggaggttgcagtga

SEQ ID NO: 112853 - DNA, 22 bp, Homo sapiens
tctatgtctcgacccaagacaa

SEQ ID NO: 112854 - DNA, 22 bp, Homo sapiens
aaaggctttaaaatgtacatat

SEQ ID NO: 112855 - DNA, 22 bp, Homo sapiens
tgcaatctcggcactttgggag

SEQ ID NO: 112856 - DNA, 22 bp, Homo sapiens
gcttctggtgaggcctcaggaa

SEQ ID NO: 112857 - DNA, 22 bp, Homo sapiens
tctgtgttgagaaggatcatga

SEQ ID NO: 112858 - DNA, 22 bp, Homo sapiens
ctcactgcaagttccacctacc

SEQ ID NO: 112859 - DNA, 22 bp, Homo sapiens
gaggtaggtgtaggaggcctgc

SEQ ID NO: 112860 - DNA, 22 bp, Homo sapiens
aggttatatgactgtcatgcct

SEQ ID NO: 112861 - DNA, 19 bp, Homo sapiens
ggcttcgaggctggggaag

SEQ ID NO: 112862 - DNA, 22 bp, Homo sapiens
cgtctaggccgtgccctgaggt

SEQ ID NO: 112863 - DNA, 22 bp, Homo sapiens
tcagcctggcaggatggcctgg

SEQ ID NO: 112864 - DNA, 22 bp, Homo sapiens
gcacatgaggctgtctttgtct

SEQ ID NO: 112865 - DNA, 22 bp, Homo sapiens
gatctccatctgcagtgtctgg

SEQ ID NO: 112866 - DNA, 22 bp, Homo sapiens
cgtgattggcttctgcattgga

SEQ ID NO: 112867 - DNA, 22 bp, Homo sapiens
gctcccaccttaaccttcacat

SEQ ID NO: 112868 - DNA, 22 bp, Homo sapiens
gggaggttgaggctgcagtgag

SEQ ID NO: 112869 - DNA, 22 bp, Homo sapiens
atgttctacagatggaaagggg

SEQ ID NO: 112870 - DNA, 22 bp, Homo sapiens
gactttgctgtgtcagcttcag

SEQ ID NO: 112871 - DNA, 22 bp, Homo sapiens
taggtttactgaattagtggaa

SEQ ID NO: 112872 - DNA, 22 bp, Homo sapiens
atgtaaactactgactacacta

SEQ ID NO: 112873 - DNA, 22 bp, Homo sapiens
tattgtccaataggatgttcct

SEQ ID NO: 112874 - DNA, 22 bp, Homo sapiens
aagtccattaggcccctgcctg

SEQ ID NO: 112875 - DNA, 22 bp, Homo sapiens
tgggattcaccatgggcttcag

SEQ ID NO: 112876 - DNA, 22 bp, Homo sapiens
gcagggaggtttgctgacctgg

SEQ ID NO: 112877 - DNA, 22 bp, Homo sapiens
tcagtgttaatcagtggtacct

SEQ ID NO: 112878 - DNA, 22 bp, Homo sapiens
tttgtggcaggagcggagaccg

SEQ ID NO: 112879 - DNA, 22 bp, Homo sapiens
gagcccaggagtttgatgctgc

SEQ ID NO: 112880 - DNA, 22 bp, Homo sapiens
tatttcttttcgtgacttattg

SEQ ID NO: 112881 - DNA, 22 bp, Homo sapiens
taactctgaatcctcacagcag

SEQ ID NO: 112882 - DNA, 22 bp, Homo sapiens
gattgtggaagtcagtggttct

SEQ ID NO: 112883 - DNA, 22 bp, Homo sapiens
gtccaggcctgcctctgaggag

SEQ ID NO: 112884 - DNA, 22 bp, Homo sapiens
gtatgtgaggttggtttccagg

SEQ ID NO: 112885 - DNA, 22 bp, Homo sapiens
tcacccaggctggagtgcagtg

SEQ ID NO: 112886 - DNA, 22 bp, Homo sapiens
tctcccaggcaggagtgcagtg

SEQ ID NO: 112887 - DNA, 22 bp, Homo sapiens
cacccaggctggaatgcagtgg

SEQ ID NO: 112888 - DNA, 22 bp, Homo sapiens
cacccaggctggagtgcagtga

SEQ ID NO: 112889 - DNA, 22 bp, Homo sapiens
gggtaggcaaagcaatgacgtt

SEQ ID NO: 112890 - DNA, 22 bp, Homo sapiens
aatgttacgatcaacaacacat

SEQ ID NO: 112891 - DNA, 22 bp, Homo sapiens
cggctgggttcggctgcaggcc

SEQ ID NO: 112892 - DNA, 22 bp, Homo sapiens
atctattttaaatggcagtaaa

SEQ ID NO: 112893 - DNA, 22 bp, Homo sapiens
aaagagactggtggcattttgc

SEQ ID NO: 112894 - DNA, 22 bp, Homo sapiens
ttttcctttgattcccagatgt

SEQ ID NO: 112895 - DNA, 22 bp, Homo sapiens
ggagtgactctcggggccacta

SEQ ID NO: 112896 - DNA, 22 bp, Homo sapiens
agcagctttcacctccccgcct

SEQ ID NO: 112897 - DNA, 22 bp, Homo sapiens
tgtgtctgtgtatacacggcat

SEQ ID NO: 112898 - DNA, 22 bp, Homo sapiens
ttccagttcactccatttctgg

SEQ ID NO: 112899 - DNA, 22 bp, Homo sapiens
aaggtgggcagatcacaaggtc

SEQ ID NO: 112900 - DNA, 22 bp, Homo sapiens
acagtgcttagcacagagtaga

SEQ ID NO: 112901 - DNA, 22 bp, Homo sapiens
cagcagtgtacaaggtgtcaga

SEQ ID NO: 112902 - DNA, 22 bp, Homo sapiens
aggaggcagtctgtcccttagc

SEQ ID NO: 112903 - DNA, 22 bp, Homo sapiens
accgggctaatttttgtatctt

SEQ ID NO: 112904 - DNA, 22 bp, Homo sapiens
ccacagaattctgtctccagga

SEQ ID NO: 112905 - DNA, 22 bp, Homo sapiens
tgcaaagttgaggaaggcatgg

SEQ ID NO: 112906 - DNA, 22 bp, Homo sapiens
agctggaagtgcatttctcact

SEQ ID NO: 112907 - DNA, 22 bp, Homo sapiens
actttaaaactgatcatcagag

SEQ ID NO: 112908 - DNA, 22 bp, Homo sapiens
atcaaatacaaagggcataagg

SEQ ID NO: 112909 - DNA, 23 bp, Homo sapiens
aaacttgctatggctgaaatcat

SEQ ID NO: 112910 - DNA, 22 bp, Homo sapiens
cagccagtgtgaccgaggagga

SEQ ID NO: 112911 - DNA, 22 bp, Homo sapiens
tgcgggtcccagggtcacaggc

SEQ ID NO: 112912 - DNA, 22 bp, Homo sapiens
cagtcacaagcgtacctaattt

SEQ ID NO: 112913 - DNA, 22 bp, Homo sapiens
cttgcctttgtcttcaaaggct

SEQ ID NO: 112914 - DNA, 21 bp, Homo sapiens
cactccacttagaacagggtt

SEQ ID NO: 112915 - DNA, 22 bp, Homo sapiens
gggacaatggaggcctctctcc

SEQ ID NO: 112916 - DNA, 22 bp, Homo sapiens
acacccaggctggcgtgcagtg

SEQ ID NO: 112917 - DNA, 22 bp, Homo sapiens
aagaaatgtgaatattgaatag

SEQ ID NO: 112918 - DNA, 22 bp, Homo sapiens
gagcctcgtggcggccactgcg

SEQ ID NO: 112919 - DNA, 22 bp, Homo sapiens
gagcccaggaagtggaggctga

SEQ ID NO: 112920 - DNA, 22 bp, Homo sapiens
tgagcttccctcctgcactaca

SEQ ID NO: 112921 - DNA, 22 bp, Homo sapiens
agctgctgagccaggctgatgt

SEQ ID NO: 112922 - DNA, 22 bp, Homo sapiens
tcagggattaaggtcaaaggtg

SEQ ID NO: 112923 - DNA, 22 bp, Homo sapiens
atgtttttaaatagacttacag

SEQ ID NO: 112924 - DNA, 20 bp, Homo sapiens
gtgtggccaggagctgcgct

SEQ ID NO: 112925 - DNA, 21 bp, Homo sapiens
ccgccgctgatagctctgggc

SEQ ID NO: 112926 - DNA, 22 bp, Homo sapiens
ggaaacttggatgccagcactc

SEQ ID NO: 112927 - DNA, 22 bp, Homo sapiens
cagtgcagccaaggacaggcac

SEQ ID NO: 112928 - DNA, 22 bp, Homo sapiens
catgatctggtcctactgtggg

SEQ ID NO: 112929 - DNA, 22 bp, Homo sapiens
caatttctaacattccatggat

SEQ ID NO: 112930 - DNA, 22 bp, Homo sapiens
ataaagctattcctctcttttt

SEQ ID NO: 112931 - DNA, 22 bp, Homo sapiens
ggctagggatctagaccaggac

SEQ ID NO: 112932 - DNA, 22 bp, Homo sapiens
gatctggaatctgaaggctgag

SEQ ID NO: 112933 - DNA, 22 bp, Homo sapiens
gcttccacctactaaatgccac

SEQ ID NO: 112934 - DNA, 22 bp, Homo sapiens
ggtgtccgcgctgtagaaggtc

SEQ ID NO: 112935 - DNA, 22 bp, Homo sapiens
cgtcacttcttagtctattttc

SEQ ID NO: 112936 - DNA, 22 bp, Homo sapiens
agcgagtgggtcagcgttgcag

SEQ ID NO: 112937 - DNA, 22 bp, Homo sapiens
gagagtgagatcctcctgggga

SEQ ID NO: 112938 - DNA, 23 bp, Homo sapiens
aatatcaaggtgatgttcccaga

SEQ ID NO: 112939 - DNA, 22 bp, Homo sapiens
aaggtatatctgatccatgagg

SEQ ID NO: 112940 - DNA, 22 bp, Homo sapiens
aatatttcttctaaagcccttt

SEQ ID NO: 112941 - DNA, 22 bp, Homo sapiens
aaatgtaagtctttgtttctta

SEQ ID NO: 112942 - DNA, 22 bp, Homo sapiens
cagtttcttcctcccccagaga

SEQ ID NO: 112943 - DNA, 17 bp, Homo sapiens
aggaggccctggcgttt

SEQ ID NO: 112944 - DNA, 22 bp, Homo sapiens
ggctttagtgtaggtttctgtt

SEQ ID NO: 112945 - DNA, 22 bp, Homo sapiens
aaaaaattatcatagttcctga

SEQ ID NO: 112946 - DNA, 23 bp, Homo sapiens
agcctcttgtggatggtcagcga

SEQ ID NO: 112947 - DNA, 22 bp, Homo sapiens
caggtgagaggcggtcctgcat

SEQ ID NO: 112948 - DNA, 22 bp, Homo sapiens
tcagtggagagcttccaggatt

SEQ ID NO: 112949 - DNA, 22 bp, Homo sapiens
ctgctttaaaactgatacatga

SEQ ID NO: 112950 - DNA, 22 bp, Homo sapiens
actaggggctcaggcccaggga

SEQ ID NO: 112951 - DNA, 22 bp, Homo sapiens
gatggcacacagacatccccgc

SEQ ID NO: 112952 - DNA, 22 bp, Homo sapiens
acaaggcactttatgaagagga

SEQ ID NO: 112953 - DNA, 22 bp, Homo sapiens
ctctttggatagaattacaaag

SEQ ID NO: 112954 - DNA, 22 bp, Homo sapiens
tcactgcactccagcctgggtg

SEQ ID NO: 112955 - DNA, 22 bp, Homo sapiens
agaaactctggaagaactttta

SEQ ID NO: 112956 - DNA, 22 bp, Homo sapiens
tgacagtattgatggcaggatt

SEQ ID NO: 112957 - DNA, 19 bp, Homo sapiens
gctgaaggaggtgcctgca

SEQ ID NO: 112958 - DNA, 22 bp, Homo sapiens
gtagtcccagctaccccggagg

SEQ ID NO: 112959 - DNA, 19 bp, Homo sapiens
tccaggggctccacctcct

SEQ ID NO: 112960 - DNA, 22 bp, Homo sapiens
ttgcaattgctatggagagcgt

SEQ ID NO: 112961 - DNA, 22 bp, Homo sapiens
ccttcccatgcagcctgtctga

SEQ ID NO: 112962 - DNA, 22 bp, Homo sapiens
aaatgcctcattttctctcact

SEQ ID NO: 112963 - DNA, 22 bp, Homo sapiens
ctgtcaggttggtctcagagct

SEQ ID NO: 112964 - DNA, 22 bp, Homo sapiens
tttgcttgttcaagatttctgt

SEQ ID NO: 112965 - DNA, 22 bp, Homo sapiens
aaggagtctgggccattcagag

SEQ ID NO: 112966 - DNA, 22 bp, Homo sapiens
ccactgcacttcagcctgggtg

SEQ ID NO: 112967 - DNA, 22 bp, Homo sapiens
tcactgcaagctcctcctcctg

SEQ ID NO: 112968 - DNA, 22 bp, Homo sapiens
gcacggctaatttttgtatttt

SEQ ID NO: 112969 - DNA, 22 bp, Homo sapiens
actgtgaacggactgaagccca

SEQ ID NO: 112970 - DNA, 22 bp, Homo sapiens
cattaaacaaccttgaatcaat

SEQ ID NO: 112971 - DNA, 22 bp, Homo sapiens
cttaatctcacctgcaaagtcc

SEQ ID NO: 112972 - DNA, 22 bp, Homo sapiens
acccacgaagatgagcggcatg

SEQ ID NO: 112973 - DNA, 22 bp, Homo sapiens
ggaggcggaggttgcagtgagc

SEQ ID NO: 112974 - DNA, 19 bp, Homo sapiens
tcctgcctggggccgcctg

SEQ ID NO: 112975 - DNA, 23 bp, Homo sapiens
tgagctgggcctgcaggggtctc

SEQ ID NO: 112976 - DNA, 22 bp, Homo sapiens
ctctcgccagcggggctgcgct

SEQ ID NO: 112977 - DNA, 22 bp, Homo sapiens
atgtacataaaatgtataatga

SEQ ID NO: 112978 - DNA, 22 bp, Homo sapiens
ctcactgcaagctccgcctccc

SEQ ID NO: 112979 - DNA, 21 bp, Homo sapiens
gctgctcgagatccagtgctt

SEQ ID NO: 112980 - DNA, 22 bp, Homo sapiens
aggaattggcacggccttctca

SEQ ID NO: 112981 - DNA, 22 bp, Homo sapiens
gggctgagacgatggggtcttc

SEQ ID NO: 112982 - DNA, 14 bp, Homo sapiens
aagatcaccttcct

SEQ ID NO: 112983 - DNA, 22 bp, Homo sapiens
agaacctcaattatttttgcac

SEQ ID NO: 112984 - DNA, 22 bp, Homo sapiens
ctgtaatcccagctacctggga

SEQ ID NO: 112985 - DNA, 22 bp, Homo sapiens
actccacatttgaacacagttc

SEQ ID NO: 112986 - DNA, 23 bp, Homo sapiens
tgaggcaggcggatcacgaggtc

SEQ ID NO: 112987 - DNA, 22 bp, Homo sapiens
tgcaccctcatcagtcaaatgg

SEQ ID NO: 112988 - DNA, 22 bp, Homo sapiens
ttaccaaatgaaatagagattt

SEQ ID NO: 112989 - DNA, 23 bp, Homo sapiens
tgctggagaagcaaagttctgag

SEQ ID NO: 112990 - DNA, 22 bp, Homo sapiens
tccaactttctcctccggcttg

SEQ ID NO: 112991 - DNA, 22 bp, Homo sapiens
tttacaacccaagtccagagag

SEQ ID NO: 112992 - DNA, 22 bp, Homo sapiens
ttgtgaatagtgctgcaataaa

SEQ ID NO: 112993 - DNA, 22 bp, Homo sapiens
gcgagtgccgagagggcagggc

SEQ ID NO: 112994 - DNA, 22 bp, Homo sapiens
ggctagcaaggtagcagaatgc

SEQ ID NO: 112995 - DNA, 22 bp, Homo sapiens
ggggtggatttcaggcggtgtc

SEQ ID NO: 112996 - DNA, 22 bp, Homo sapiens
cagaccagaaggaagccgacaa

SEQ ID NO: 112997 - DNA, 22 bp, Homo sapiens
ccagaagtcaagtaagatgaag

SEQ ID NO: 112998 - DNA, 23 bp, Homo sapiens
catgatgttaactttgttatgct

SEQ ID NO: 112999 - DNA, 20 bp, Homo sapiens
cgcccagtgcggttctgacc

SEQ ID NO: 113000 - DNA, 22 bp, Homo sapiens
ctgggcacagcgttgggctctt

SEQ ID NO: 113001 - DNA, 22 bp, Homo sapiens
acagaactgggaaatgcacata

SEQ ID NO: 113002 - DNA, 22 bp, Homo sapiens
ctgaacttattgagtgcttgct

SEQ ID NO: 113003 - DNA, 22 bp, Homo sapiens
gagacctcttggtatcgctagg

SEQ ID NO: 113004 - DNA, 22 bp, Homo sapiens
ctgggaggcggagcttgcagtg

SEQ ID NO: 113005 - DNA, 22 bp, Homo sapiens
ggaggagacagtaaaaagcacg

SEQ ID NO: 113006 - DNA, 22 bp, Homo sapiens
cagagatgtgatccagctgtct

SEQ ID NO: 113007 - DNA, 22 bp, Homo sapiens
caggagatgacagggaagaacc

SEQ ID NO: 113008 - DNA, 22 bp, Homo sapiens
ggagagggtaggggtcctgccc

SEQ ID NO: 113009 - DNA, 22 bp, Homo sapiens
tgtgtgcatgcttggggcagca

SEQ ID NO: 113010 - DNA, 18 bp, Homo sapiens
ccctgccagctcccagca

SEQ ID NO: 113011 - DNA, 22 bp, Homo sapiens
tggcccagtatgtataatctta

SEQ ID NO: 113012 - DNA, 22 bp, Homo sapiens
ctgcatgtttacatttttgaga

SEQ ID NO: 113013 - DNA, 20 bp, Homo sapiens
gctgaggggtctatggcata

SEQ ID NO: 113014 - DNA, 22 bp, Homo sapiens
ctgaggggtcgtgggagcccag

SEQ ID NO: 113015 - DNA, 19 bp, Homo sapiens
gactcacaccttccgctgt

SEQ ID NO: 113016 - DNA, 22 bp, Homo sapiens
gggcttggcacatgggctcagc

SEQ ID NO: 113017 - DNA, 22 bp, Homo sapiens
agggggctccttggtgtgcaga

SEQ ID NO: 113018 - DNA, 22 bp, Homo sapiens
cagtggcgtgatctctgctcac

SEQ ID NO: 113019 - DNA, 22 bp, Homo sapiens
agagcacagggttttgtgccgg

SEQ ID NO: 113020 - DNA, 22 bp, Homo sapiens
gagtgcagtggcgtgatctctg

SEQ ID NO: 113021 - DNA, 22 bp, Homo sapiens
ctggagcaaaagtgactcctct

SEQ ID NO: 113022 - DNA, 22 bp, Homo sapiens
cttccctctgctccttggtcca

SEQ ID NO: 113023 - DNA, 22 bp, Homo sapiens
accgggaagtcctgcactgggc

SEQ ID NO: 113024 - DNA, 22 bp, Homo sapiens
ctgggaagaagggacaacagcg

SEQ ID NO: 113025 - DNA, 22 bp, Homo sapiens
ttcaggcccagcacagcgcgtg

SEQ ID NO: 113026 - DNA, 22 bp, Homo sapiens
ttccacattccttacattcata

SEQ ID NO: 113027 - DNA, 22 bp, Homo sapiens
atgtatatgcatgcattcaaag

SEQ ID NO: 113028 - DNA, 22 bp, Homo sapiens
attgataaattgcaatggggct

SEQ ID NO: 113029 - DNA, 22 bp, Homo sapiens
tggtctttgtccctccttgatc

SEQ ID NO: 113030 - DNA, 22 bp, Homo sapiens
gaggtggccaagcgaggaaggg

SEQ ID NO: 113031 - DNA, 22 bp, Homo sapiens
agagtactgcctcagttatgaa

SEQ ID NO: 113032 - DNA, 22 bp, Homo sapiens
ccaggctggagtgcagtggcac

SEQ ID NO: 113033 - DNA, 22 bp, Homo sapiens
tccccagcttgctacttctgct

SEQ ID NO: 113034 - DNA, 22 bp, Homo sapiens
cgcggtggcggcctccagcgcc

SEQ ID NO: 113035 - DNA, 23 bp, Homo sapiens
aaataggagtatctggatcatga

SEQ ID NO: 113036 - DNA, 22 bp, Homo sapiens
ccagaaaaatcctcccttgtcc

SEQ ID NO: 113037 - DNA, 22 bp, Homo sapiens
gcccatagtctctttctttctt

SEQ ID NO: 113038 - DNA, 22 bp, Homo sapiens
tggggatcataaattgatggag

SEQ ID NO: 113039 - DNA, 22 bp, Homo sapiens
aaagggaagttgcacatgttcc

SEQ ID NO: 113040 - DNA, 22 bp, Homo sapiens
gcgttggggaccccgaagctgg

SEQ ID NO: 113041 - DNA, 22 bp, Homo sapiens
gcccagagttcaaggctgcagt

SEQ ID NO: 113042 - DNA, 22 bp, Homo sapiens
agcccttggtattttccgatcc

SEQ ID NO: 113043 - DNA, 22 bp, Homo sapiens
ccagtaacacctcgcagactcc

SEQ ID NO: 113044 - DNA, 19 bp, Homo sapiens
ctctggagtcattgctccc

SEQ ID NO: 113045 - DNA, 22 bp, Homo sapiens
tggggaaaatgcttgtagtcag

SEQ ID NO: 113046 - DNA, 22 bp, Homo sapiens
aactaatacattaatacatgtg

SEQ ID NO: 113047 - DNA, 22 bp, Homo sapiens
cccattcatcctcgcttccttc

SEQ ID NO: 113048 - DNA, 22 bp, Homo sapiens
gaatttcacaaggtgaggataa

SEQ ID NO: 113049 - DNA, 22 bp, Homo sapiens
aggcaaggtgctacagacagtg

SEQ ID NO: 113050 - DNA, 22 bp, Homo sapiens
tgtgcctactgatagagccaag

SEQ ID NO: 113051 - DNA, 22 bp, Homo sapiens
atcttctcatgtgtaatgaggt

SEQ ID NO: 113052 - DNA, 22 bp, Homo sapiens
gacttctgaattcctatcaggt

SEQ ID NO: 113053 - DNA, 22 bp, Homo sapiens
actgcgctccagcctgggtgac

SEQ ID NO: 113054 - DNA, 20 bp, Homo sapiens
cagcctgcatcatctgcagc

SEQ ID NO: 113055 - DNA, 22 bp, Homo sapiens
ccagcagagcatggggaggaag

SEQ ID NO: 113056 - DNA, 22 bp, Homo sapiens
tggaatgcagtgggagcttacc

SEQ ID NO: 113057 - DNA, 22 bp, Homo sapiens
cactgcactccagcctgggaga

SEQ ID NO: 113058 - DNA, 22 bp, Homo sapiens
aaactgaggctcccgagggtgt

SEQ ID NO: 113059 - DNA, 22 bp, Homo sapiens
gccgtgcgtgcgcaggtgctgt

SEQ ID NO: 113060 - DNA, 22 bp, Homo sapiens
ccagctttatagcttcaaagga

SEQ ID NO: 113061 - DNA, 22 bp, Homo sapiens
ctagttctagatccctgaggaa

SEQ ID NO: 113062 - DNA, 22 bp, Homo sapiens
ccctgctgtgtagcggaggaac

SEQ ID NO: 113063 - DNA, 22 bp, Homo sapiens
gctgtagtgaatggccgcgttc

SEQ ID NO: 113064 - DNA, 22 bp, Homo sapiens
aaattgcaaaagtacttttagg

SEQ ID NO: 113065 - DNA, 22 bp, Homo sapiens
gccatgactctccataccaaag

SEQ ID NO: 113066 - DNA, 22 bp, Homo sapiens
gcttggccagcagccgggatgc

SEQ ID NO: 113067 - DNA, 22 bp, Homo sapiens
ggaactcctgctccaagcagct

SEQ ID NO: 113068 - DNA, 22 bp, Homo sapiens
tctagtcattcatgctatgatt

SEQ ID NO: 113069 - DNA, 22 bp, Homo sapiens
gggccctgcgactcgcggcgga

SEQ ID NO: 113070 - DNA, 22 bp, Homo sapiens
agggctgcccagtgtgagagct

SEQ ID NO: 113071 - DNA, 22 bp, Homo sapiens
gccacctcggctttctctgctc

SEQ ID NO: 113072 - DNA, 22 bp, Homo sapiens
cattgcactcctgcctgggcaa

SEQ ID NO: 113073 - DNA, 22 bp, Homo sapiens
gccaatgacagtctcagttctg

SEQ ID NO: 113074 - DNA, 22 bp, Homo sapiens
acccagtctggagtgcagtgac

SEQ ID NO: 113075 - DNA, 22 bp, Homo sapiens
ggctccctgcaacctccgcctc

SEQ ID NO: 113076 - DNA, 22 bp, Homo sapiens
taagaaatttagttatagaatg

SEQ ID NO: 113077 - DNA, 22 bp, Homo sapiens
tgccgtggggctgaggctggag

SEQ ID NO: 113078 - DNA, 22 bp, Homo sapiens
tgtatatacacactcccatgtt

SEQ ID NO: 113079 - DNA, 22 bp, Homo sapiens
tgggaaggggagctggaaagga

SEQ ID NO: 113080 - DNA, 22 bp, Homo sapiens
aaggaggttatcccagtggact

SEQ ID NO: 113081 - DNA, 22 bp, Homo sapiens
ggtgagcagctgtctgtatgga

SEQ ID NO: 113082 - DNA, 22 bp, Homo sapiens
agaggtgagtcattacctagtg

SEQ ID NO: 113083 - DNA, 22 bp, Homo sapiens
cccaggctggagtgcagtggcg

SEQ ID NO: 113084 - DNA, 22 bp, Homo sapiens
gtgtgtctcccaagaaggccca

SEQ ID NO: 113085 - DNA, 19 bp, Homo sapiens
tcctggggaggggcatggc

SEQ ID NO: 113086 - DNA, 22 bp, Homo sapiens
atgctatgtaactggcagatag

SEQ ID NO: 113087 - DNA, 22 bp, Homo sapiens
gggagctggagctggaagactc

SEQ ID NO: 113088 - DNA, 22 bp, Homo sapiens
gctgaaggcccggaggacaggg

SEQ ID NO: 113089 - DNA, 22 bp, Homo sapiens
gtgcagagaggaccttggggag

SEQ ID NO: 113090 - DNA, 22 bp, Homo sapiens
ccaaagtgctggggttacaggc

SEQ ID NO: 113091 - DNA, 20 bp, Homo sapiens
ttcatgggagcaaagaggcc

SEQ ID NO: 113092 - DNA, 22 bp, Homo sapiens
cttagagatgggttttacttag

SEQ ID NO: 113093 - DNA, 22 bp, Homo sapiens
tgcactccaggctgggtgacag

SEQ ID NO: 113094 - DNA, 22 bp, Homo sapiens
ctatacagcagcttactagtta

SEQ ID NO: 113095 - DNA, 22 bp, Homo sapiens
tctgttttgcataatgttcttt

SEQ ID NO: 113096 - DNA, 21 bp, Homo sapiens
ctggaggcaggtggtgccagg

SEQ ID NO: 113097 - DNA, 22 bp, Homo sapiens
ttgctcttgaaaattgatgctg

SEQ ID NO: 113098 - DNA, 22 bp, Homo sapiens
gaggagggagctggaagctctt

SEQ ID NO: 113099 - DNA, 22 bp, Homo sapiens
gtcactgtatccaggttccagc

SEQ ID NO: 113100 - DNA, 22 bp, Homo sapiens
aagacttgaccaggttgaaggc

SEQ ID NO: 113101 - DNA, 22 bp, Homo sapiens
ctgggaggcagaggttgtagtg

SEQ ID NO: 113102 - DNA, 22 bp, Homo sapiens
ggaggctgagaggtcgcagtgg

SEQ ID NO: 113103 - DNA, 22 bp, Homo sapiens
tgtcaatatgtaataactgaat

SEQ ID NO: 113104 - DNA, 22 bp, Homo sapiens
gagccaggttggaggctgcagt

SEQ ID NO: 113105 - DNA, 22 bp, Homo sapiens
tgtggtgccgagagtctggacg

SEQ ID NO: 113106 - DNA, 22 bp, Homo sapiens
cttgtcttgcacacggttgcca

SEQ ID NO: 113107 - DNA, 22 bp, Homo sapiens
cacttcaacctctgagtcctgg

SEQ ID NO: 113108 - DNA, 22 bp, Homo sapiens
cacccaggctggagtgcagtgg

SEQ ID NO: 113109 - DNA, 22 bp, Homo sapiens
acaggggaatttactgtcatta

SEQ ID NO: 113110 - DNA, 22 bp, Homo sapiens
gagagaagggggatatgagcct

SEQ ID NO: 113111 - DNA, 22 bp, Homo sapiens
catttacatttaaggttaatat

SEQ ID NO: 113112 - DNA, 22 bp, Homo sapiens
cccgtgtggatgcgctggtgct

SEQ ID NO: 113113 - DNA, 22 bp, Homo sapiens
atgccactgcactccagcctag

SEQ ID NO: 113114 - DNA, 22 bp, Homo sapiens
agagtggagagaaacaactctg

SEQ ID NO: 113115 - DNA, 22 bp, Homo sapiens
cttccccaggacctctgctaaa

SEQ ID NO: 113116 - DNA, 22 bp, Homo sapiens
atccccctcttggatggcggca

SEQ ID NO: 113117 - DNA, 22 bp, Homo sapiens
tgtcagtgtctatgaagaattt

SEQ ID NO: 113118 - DNA, 22 bp, Homo sapiens
tgagcacatttcacatgacagg

SEQ ID NO: 113119 - DNA, 22 bp, Homo sapiens
tgtgacagcacggttcaactgc

SEQ ID NO: 113120 - DNA, 22 bp, Homo sapiens
ccaggctggagtatagtggcgc

SEQ ID NO: 113121 - DNA, 20 bp, Homo sapiens
gggtgtgtgcagggcctggt

SEQ ID NO: 113122 - DNA, 22 bp, Homo sapiens
gcacagagagggaaggtaactt

SEQ ID NO: 113123 - DNA, 22 bp, Homo sapiens
gaaaaggcctggggcaaagtgt

SEQ ID NO: 113124 - DNA, 22 bp, Homo sapiens
attgggatgccggctgataaga

SEQ ID NO: 113125 - DNA, 22 bp, Homo sapiens
ttctctgcctcacaggtctaag

SEQ ID NO: 113126 - DNA, 22 bp, Homo sapiens
ggatgttgattgaatggccatt

SEQ ID NO: 113127 - DNA, 22 bp, Homo sapiens
cctactctgagcgcctccgcat

SEQ ID NO: 113128 - DNA, 22 bp, Homo sapiens
tagagtgtcataacagtgccca

SEQ ID NO: 113129 - DNA, 22 bp, Homo sapiens
ggaggtcccaggcctggcagca

SEQ ID NO: 113130 - DNA, 22 bp, Homo sapiens
ttagggttacaccagcctcctg

SEQ ID NO: 113131 - DNA, 22 bp, Homo sapiens
aagtgcttccatgtttgagtgt

SEQ ID NO: 113132 - DNA, 22 bp, Homo sapiens
cgcgctgcagacagcggaggcc

SEQ ID NO: 113133 - DNA, 22 bp, Homo sapiens
cagtgcttttaaaacaacatca

SEQ ID NO: 113134 - DNA, 22 bp, Homo sapiens
cacagctgtgagaagggagcct

SEQ ID NO: 113135 - DNA, 21 bp, Homo sapiens
tatcagagacattgagaggca

SEQ ID NO: 113136 - DNA, 22 bp, Homo sapiens
tcttaagcagagaagaagttga

SEQ ID NO: 113137 - DNA, 22 bp, Homo sapiens
ccagactcatctgccattgctg

SEQ ID NO: 113138 - DNA, 22 bp, Homo sapiens
gaagccagtgtttgaagaattt

SEQ ID NO: 113139 - DNA, 22 bp, Homo sapiens
gtagaccatttatctggggagt

SEQ ID NO: 113140 - DNA, 21 bp, Homo sapiens
agcgtcaatatcgtcaacagg

SEQ ID NO: 113141 - DNA, 22 bp, Homo sapiens
gagaggaagccttctgtacttg

SEQ ID NO: 113142 - DNA, 22 bp, Homo sapiens
tgggtggcagcttcagcatgtt

SEQ ID NO: 113143 - DNA, 22 bp, Homo sapiens
ttgggctgaaccctgcagctga

SEQ ID NO: 113144 - DNA, 22 bp, Homo sapiens
gctgtcttgctcactcttgcag

SEQ ID NO: 113145 - DNA, 22 bp, Homo sapiens
aagcatttcaggtagagatatt

SEQ ID NO: 113146 - DNA, 22 bp, Homo sapiens
ttaattctgcctttcatgtaac

SEQ ID NO: 113147 - DNA, 22 bp, Homo sapiens
atgtccttcctgagatccctgt

SEQ ID NO: 113148 - DNA, 22 bp, Homo sapiens
tggcaaattccaaagttaattc

SEQ ID NO: 113149 - DNA, 22 bp, Homo sapiens
tcatcagggatattggcctgaa

SEQ ID NO: 113150 - DNA, 22 bp, Homo sapiens
tgcgcgccagctcccaggttcg

SEQ ID NO: 113151 - DNA, 22 bp, Homo sapiens
ttgatgtaggtttatctattgt

SEQ ID NO: 113152 - DNA, 22 bp, Homo sapiens
tgaggcaggaggattgcaggat

SEQ ID NO: 113153 - DNA, 22 bp, Homo sapiens
agaggaggctctgggatcgtcc

SEQ ID NO: 113154 - DNA, 22 bp, Homo sapiens
atagaataatggttgtcaggag

SEQ ID NO: 113155 - DNA, 22 bp, Homo sapiens
tggatgctgtaggacacgctct

SEQ ID NO: 113156 - DNA, 22 bp, Homo sapiens
cccatgcaccctctaagaagga

SEQ ID NO: 113157 - DNA, 19 bp, Homo sapiens
gttttgcaggcagagggga

SEQ ID NO: 113158 - DNA, 22 bp, Homo sapiens
gttctgagtcctcctttgaagg

SEQ ID NO: 113159 - DNA, 22 bp, Homo sapiens
aacccgtgatcctgactcccct

SEQ ID NO: 113160 - DNA, 22 bp, Homo sapiens
acttgccccagaattgctgctg

SEQ ID NO: 113161 - DNA, 22 bp, Homo sapiens
tctgcgttgctcacgctgggag

SEQ ID NO: 113162 - DNA, 22 bp, Homo sapiens
gaaaaggcagagttccggggaa

SEQ ID NO: 113163 - DNA, 22 bp, Homo sapiens
agccaagcactcaactcctgga

SEQ ID NO: 113164 - DNA, 22 bp, Homo sapiens
atgcagtggcttcagtgtcagt

SEQ ID NO: 113165 - DNA, 22 bp, Homo sapiens
caggagttcaaggttgcagtga

SEQ ID NO: 113166 - DNA, 22 bp, Homo sapiens
agagaagagtcttgtcaaatta

SEQ ID NO: 113167 - DNA, 22 bp, Homo sapiens
aagaagcattctttcattggtt

SEQ ID NO: 113168 - DNA, 20 bp, Homo sapiens
aatgctgcttctttttgcat

SEQ ID NO: 113169 - DNA, 22 bp, Homo sapiens
ctggccagatgttacgtccaat

SEQ ID NO: 113170 - DNA, 22 bp, Homo sapiens
gcaggagaacaaagcaagctgc

SEQ ID NO: 113171 - DNA, 22 bp, Homo sapiens
ttcccaggaagcctctccaagc

SEQ ID NO: 113172 - DNA, 22 bp, Homo sapiens
gaggctgaggcggatggatcac

SEQ ID NO: 113173 - DNA, 22 bp, Homo sapiens
aggtggtgtttggttacatgag

SEQ ID NO: 113174 - DNA, 22 bp, Homo sapiens
gaattcttttctttctgaaagt

SEQ ID NO: 113175 - DNA, 22 bp, Homo sapiens
ctctggagtgtctggccagggt

SEQ ID NO: 113176 - DNA, 22 bp, Homo sapiens
cggtcaggtgcagcgttggcac

SEQ ID NO: 113177 - DNA, 22 bp, Homo sapiens
ctgcagggagaggggacagcct

SEQ ID NO: 113178 - DNA, 22 bp, Homo sapiens
agatgctgctccacaggccagg

SEQ ID NO: 113179 - DNA, 22 bp, Homo sapiens
tccagcagtccatgtgagacac

SEQ ID NO: 113180 - DNA, 22 bp, Homo sapiens
tgcctcaagccctccactgcac

SEQ ID NO: 113181 - DNA, 22 bp, Homo sapiens
atcatcatgcccacttgagact

SEQ ID NO: 113182 - DNA, 22 bp, Homo sapiens
caagcgtggctgctctgatgga

SEQ ID NO: 113183 - DNA, 22 bp, Homo sapiens
agatttatgtggtcacactcag

SEQ ID NO: 113184 - DNA, 22 bp, Homo sapiens
aaacttgagccaagggcttggg

SEQ ID NO: 113185 - DNA, 22 bp, Homo sapiens
cccaggaggttgaggctgcagt

SEQ ID NO: 113186 - DNA, 22 bp, Homo sapiens
tctcgacagcctggcacagtgg

SEQ ID NO: 113187 - DNA, 22 bp, Homo sapiens
ggccagaagttggaaaagagcc

SEQ ID NO: 113188 - DNA, 22 bp, Homo sapiens
cctgggggccaggaaggtgtga

SEQ ID NO: 113189 - DNA, 22 bp, Homo sapiens
aaagatcacgtcccaggactcg

SEQ ID NO: 113190 - DNA, 22 bp, Homo sapiens
atgggctgtccattgctggctg

SEQ ID NO: 113191 - DNA, 22 bp, Homo sapiens
ggtcacacaccaggacctgcag

SEQ ID NO: 113192 - DNA, 22 bp, Homo sapiens
gcactttgcccctcctttggca

SEQ ID NO: 113193 - DNA, 22 bp, Homo sapiens
ccctggaggttgaggctgcagt

SEQ ID NO: 113194 - DNA, 22 bp, Homo sapiens
acagcagcaatagcagtgacat

SEQ ID NO: 113195 - DNA, 21 bp, Homo sapiens
cggaaaggactagggctcaga

SEQ ID NO: 113196 - DNA, 20 bp, Homo sapiens
ggcagagggcctgggagaag

SEQ ID NO: 113197 - DNA, 22 bp, Homo sapiens
cacttcattgggaccagggctg

SEQ ID NO: 113198 - DNA, 22 bp, Homo sapiens
ggagtgaatcactagatgcaga

SEQ ID NO: 113199 - DNA, 22 bp, Homo sapiens
gggaagtgatggagccaggatt

SEQ ID NO: 113200 - DNA, 22 bp, Homo sapiens
cagccccacacggtctagctct

SEQ ID NO: 113201 - DNA, 22 bp, Homo sapiens
atacctgtgtatccacaagcgt

SEQ ID NO: 113202 - DNA, 22 bp, Homo sapiens
ttctgtggttgaaaggagagat

SEQ ID NO: 113203 - DNA, 22 bp, Homo sapiens
atggctagcaccgcgttgctgg

SEQ ID NO: 113204 - DNA, 22 bp, Homo sapiens
cgagtgtccctaccatttccta

SEQ ID NO: 113205 - DNA, 22 bp, Homo sapiens
tgctcgaggtccccaccggctc

SEQ ID NO: 113206 - DNA, 22 bp, Homo sapiens
atgtttaaagggttgagaaata

SEQ ID NO: 113207 - DNA, 22 bp, Homo sapiens
aatctgagggaacttgaactcc

SEQ ID NO: 113208 - DNA, 22 bp, Homo sapiens
gtggcccatcacgtttcgcctt

SEQ ID NO: 113209 - DNA, 22 bp, Homo sapiens
tctgttgactcctagcagccat

SEQ ID NO: 113210 - DNA, 22 bp, Homo sapiens
gggcggatcacctgaggtcagg

SEQ ID NO: 113211 - DNA, 22 bp, Homo sapiens
tgagcctgagttcaaggctgca

SEQ ID NO: 113212 - DNA, 22 bp, Homo sapiens
taggtcagaacaagcagtatcg

SEQ ID NO: 113213 - DNA, 22 bp, Homo sapiens
atcagagtgggttttaaaagtg

SEQ ID NO: 113214 - DNA, 22 bp, Homo sapiens
gtacaaatgcaggtttgttaca

SEQ ID NO: 113215 - DNA, 22 bp, Homo sapiens
tgatcaggtctgaacagggagg

SEQ ID NO: 113216 - DNA, 22 bp, Homo sapiens
caaagtgctaggattacaggcg

SEQ ID NO: 113217 - DNA, 22 bp, Homo sapiens
gcttggaagtaggattgggaga

SEQ ID NO: 113218 - DNA, 22 bp, Homo sapiens
aggctcagatccttgtgtcctg

SEQ ID NO: 113219 - DNA, 22 bp, Homo sapiens
agttattactctttaacatatt

SEQ ID NO: 113220 - DNA, 22 bp, Homo sapiens
gctcactgcctgggcaacaaga

SEQ ID NO: 113221 - DNA, 22 bp, Homo sapiens
aacattgaacttggcacaccca

SEQ ID NO: 113222 - DNA, 22 bp, Homo sapiens
aagtgctgggattacaggcatg

SEQ ID NO: 113223 - DNA, 22 bp, Homo sapiens
aggagccagtggagttcctgcc

SEQ ID NO: 113224 - DNA, 22 bp, Homo sapiens
ggagacagggttgaaccacgca

SEQ ID NO: 113225 - DNA, 22 bp, Homo sapiens
tatactacgcaccaaacaaagg

SEQ ID NO: 113226 - DNA, 22 bp, Homo sapiens
caggctggagtgcagtggggcg

SEQ ID NO: 113227 - DNA, 22 bp, Homo sapiens
ttacttaaacagaaatgcagaa

SEQ ID NO: 113228 - DNA, 20 bp, Homo sapiens
gctctgtggtttgagtctcc

SEQ ID NO: 113229 - DNA, 22 bp, Homo sapiens
cccaggggttcaaggctgcagt

SEQ ID NO: 113230 - DNA, 22 bp, Homo sapiens
cgtgagcaaaatggacactccc

SEQ ID NO: 113231 - DNA, 22 bp, Homo sapiens
tacctcaagttccaggaaagcg

SEQ ID NO: 113232 - DNA, 22 bp, Homo sapiens
cccaggaggcagagatagcagt

SEQ ID NO: 113233 - DNA, 22 bp, Homo sapiens
cactccagcctcagtgacagag

SEQ ID NO: 113234 - DNA, 22 bp, Homo sapiens
tctagttctagatccctgagga

SEQ ID NO: 113235 - DNA, 22 bp, Homo sapiens
attgcacttcagcctgggtgac

SEQ ID NO: 113236 - DNA, 22 bp, Homo sapiens
caggaaggcgcggctgtgcctg

SEQ ID NO: 113237 - DNA, 22 bp, Homo sapiens
aaattacagccttgggtagctt

SEQ ID NO: 113238 - DNA, 22 bp, Homo sapiens
ctggagggctgcagcgaggctg

SEQ ID NO: 113239 - DNA, 22 bp, Homo sapiens
cctcaagtcattccggagacct

SEQ ID NO: 113240 - DNA, 22 bp, Homo sapiens
ggaggcagaatagagtgtgggt

SEQ ID NO: 113241 - DNA, 22 bp, Homo sapiens
gtggaatttttacctatgaatg

SEQ ID NO: 113242 - DNA, 22 bp, Homo sapiens
ccatgaattcactccatgctag

SEQ ID NO: 113243 - DNA, 22 bp, Homo sapiens
ggcaggaacacagatggtgccg

SEQ ID NO: 113244 - DNA, 22 bp, Homo sapiens
tgagcctgggtggtcgaggctg

SEQ ID NO: 113245 - DNA, 22 bp, Homo sapiens
atttttctctttccactgagat

SEQ ID NO: 113246 - DNA, 22 bp, Homo sapiens
tgaaatgttaaacaagtggctc

SEQ ID NO: 113247 - DNA, 22 bp, Homo sapiens
ttctcttttcaccagttgctaa

SEQ ID NO: 113248 - DNA, 22 bp, Homo sapiens
gacctcatgatccacctgcctt

SEQ ID NO: 113249 - DNA, 22 bp, Homo sapiens
ctcactgcaacctccgcctcct

SEQ ID NO: 113250 - DNA, 22 bp, Homo sapiens
ggggtgggcgtgcagggacacc

SEQ ID NO: 113251 - DNA, 22 bp, Homo sapiens
ggctgtggagctgcagagttgg

SEQ ID NO: 113252 - DNA, 22 bp, Homo sapiens
atggcagcggagctggaaatga

SEQ ID NO: 113253 - DNA, 23 bp, Homo sapiens
atgggccaagcaagacccatgac

SEQ ID NO: 113254 - DNA, 23 bp, Homo sapiens
ctggggctttcaaatctgggcag

SEQ ID NO: 113255 - DNA, 22 bp, Homo sapiens
caggaaagggatgggctgccac

SEQ ID NO: 113256 - DNA, 22 bp, Homo sapiens
tggtacacatgtccaaggtcag

SEQ ID NO: 113257 - DNA, 22 bp, Homo sapiens
gacccttagaatgtgatcttat

SEQ ID NO: 113258 - DNA, 22 bp, Homo sapiens
ttaataaagtatgaattggaaa

SEQ ID NO: 113259 - DNA, 22 bp, Homo sapiens
ctcctccacccgctggggccca

SEQ ID NO: 113260 - DNA, 22 bp, Homo sapiens
taggctaggctgaaggttttgg

SEQ ID NO: 113261 - DNA, 22 bp, Homo sapiens
tagcagtattccggaatacttt

SEQ ID NO: 113262 - DNA, 22 bp, Homo sapiens
cctccaaccataggtccagggg

SEQ ID NO: 113263 - DNA, 22 bp, Homo sapiens
ggaagggcaaaagagatgaact

SEQ ID NO: 113264 - DNA, 22 bp, Homo sapiens
aaaggcttcggatcagaaggta

SEQ ID NO: 113265 - DNA, 22 bp, Homo sapiens
ggcagacctctccagccccaca

SEQ ID NO: 113266 - DNA, 22 bp, Homo sapiens
gaggaggcttccgggaggcacg

SEQ ID NO: 113267 - DNA, 22 bp, Homo sapiens
tggaggctggagtgcagtggcg

SEQ ID NO: 113268 - DNA, 22 bp, Homo sapiens
tccgggcaactgaagggaggtt

SEQ ID NO: 113269 - DNA, 22 bp, Homo sapiens
ctgaggcctctcccactccagc

SEQ ID NO: 113270 - DNA, 22 bp, Homo sapiens
ttttctaacatctagtaatttg

SEQ ID NO: 113271 - DNA, 22 bp, Homo sapiens
tccgggaggcagaggttgcagt

SEQ ID NO: 113272 - DNA, 22 bp, Homo sapiens
agtccgtggccagactcaagag

SEQ ID NO: 113273 - DNA, 22 bp, Homo sapiens
aatattatcaaaagctttttca

SEQ ID NO: 113274 - DNA, 22 bp, Homo sapiens
cccaactactctcaggcagctt

SEQ ID NO: 113275 - DNA, 22 bp, Homo sapiens
ctttggaacacccagctctgtg

SEQ ID NO: 113276 - DNA, 22 bp, Homo sapiens
acagagacacggaagctaaaga

SEQ ID NO: 113277 - DNA, 20 bp, Homo sapiens
acgtggccaccagtggctta

SEQ ID NO: 113278 - DNA, 22 bp, Homo sapiens
tgcctaggctggagtgtagtgg

SEQ ID NO: 113279 - DNA, 22 bp, Homo sapiens
ccctggaggcggagcttgcagt

SEQ ID NO: 113280 - DNA, 22 bp, Homo sapiens
ccttctagcaaatcaacataaa

SEQ ID NO: 113281 - DNA, 22 bp, Homo sapiens
gcaaatacatgttgagcaccta

SEQ ID NO: 113282 - DNA, 16 bp, Homo sapiens
atgctgctattagagg

SEQ ID NO: 113283 - DNA, 22 bp, Homo sapiens
ggctgatgggcatgagctgtca

SEQ ID NO: 113284 - DNA, 22 bp, Homo sapiens
tagggtacatgtgcacaacatg

SEQ ID NO: 113285 - DNA, 22 bp, Homo sapiens
ccagatgtccctctcaggtttg

SEQ ID NO: 113286 - DNA, 22 bp, Homo sapiens
gcagtgagttatgatcatgcca

SEQ ID NO: 113287 - DNA, 22 bp, Homo sapiens
accctgctttatgccgtcctct

SEQ ID NO: 113288 - DNA, 18 bp, Homo sapiens
cagcctctgattggttgc

SEQ ID NO: 113289 - DNA, 22 bp, Homo sapiens
aggctctgtcaggcggagcagc

SEQ ID NO: 113290 - DNA, 22 bp, Homo sapiens
tccctgtgtcctgggggcacct

SEQ ID NO: 113291 - DNA, 21 bp, Homo sapiens
gctcctggtgctgcgtggcgc

SEQ ID NO: 113292 - DNA, 22 bp, Homo sapiens
caggctgctgacaggcttggag

SEQ ID NO: 113293 - DNA, 22 bp, Homo sapiens
gagagagctctgtgcctgggat

SEQ ID NO: 113294 - DNA, 22 bp, Homo sapiens
tggcagttcaggttggactctt

SEQ ID NO: 113295 - DNA, 22 bp, Homo sapiens
aagaggagaaaggctggctttg

SEQ ID NO: 113296 - DNA, 22 bp, Homo sapiens
ctggcaggttatagagctgccc

SEQ ID NO: 113297 - DNA, 22 bp, Homo sapiens
gggaagatagtgttgagggccc

SEQ ID NO: 113298 - DNA, 22 bp, Homo sapiens
ccaggctggagtgcaatggcat

SEQ ID NO: 113299 - DNA, 22 bp, Homo sapiens
acccaggctggcgtgcagtggc

SEQ ID NO: 113300 - DNA, 22 bp, Homo sapiens
ggcctcgcggcttctggtggct

SEQ ID NO: 113301 - DNA, 22 bp, Homo sapiens
caaagtgctggaattacaggtg

SEQ ID NO: 113302 - DNA, 22 bp, Homo sapiens
caatagtaaattacggaggaga

SEQ ID NO: 113303 - DNA, 22 bp, Homo sapiens
tcaggtccaagatggccatcca

SEQ ID NO: 113304 - DNA, 22 bp, Homo sapiens
ctgtctgtagacatttttggtt

SEQ ID NO: 113305 - DNA, 22 bp, Homo sapiens
tctctcttttttgaacccgctc

SEQ ID NO: 113306 - DNA, 22 bp, Homo sapiens
agaaatatgctgattagatgaa

SEQ ID NO: 113307 - DNA, 22 bp, Homo sapiens
cctgtgcttggccagagaggtt

SEQ ID NO: 113308 - DNA, 22 bp, Homo sapiens
ttgcgcgcggctaggtctcggt

SEQ ID NO: 113309 - DNA, 22 bp, Homo sapiens
aaaagtaattgtggttttggcc

SEQ ID NO: 113310 - DNA, 22 bp, Homo sapiens
gaagccttgaactgcaaacccc

SEQ ID NO: 113311 - DNA, 22 bp, Homo sapiens
gctgcagctcgccttccggcct

SEQ ID NO: 113312 - DNA, 22 bp, Homo sapiens
cattgcactccagcctgggcaa

SEQ ID NO: 113313 - DNA, 22 bp, Homo sapiens
tcacccaggctggagtgtagtg

SEQ ID NO: 113314 - DNA, 22 bp, Homo sapiens
aatggctctgatgttgttgtga

SEQ ID NO: 113315 - DNA, 22 bp, Homo sapiens
attataggcttgagccaccgtg

SEQ ID NO: 113316 - DNA, 18 bp, Homo sapiens
atggtctcatactgggag

SEQ ID NO: 113317 - DNA, 22 bp, Homo sapiens
gggctccgcccttggctgagct

SEQ ID NO: 113318 - DNA, 22 bp, Homo sapiens
ttatatgtttctgtttggaggc

SEQ ID NO: 113319 - DNA, 19 bp, Homo sapiens
agataagagttgactgtgg

SEQ ID NO: 113320 - DNA, 22 bp, Homo sapiens
agcagcttgaggctggattcca

SEQ ID NO: 113321 - DNA, 22 bp, Homo sapiens
ctatggtgatagaaatcagaat

SEQ ID NO: 113322 - DNA, 22 bp, Homo sapiens
ctaggctggagtgcagtggcac

SEQ ID NO: 113323 - DNA, 22 bp, Homo sapiens
tttcaacagatctgtcttcagg

SEQ ID NO: 113324 - DNA, 22 bp, Homo sapiens
gggcggatcatttgaggtcagg

SEQ ID NO: 113325 - DNA, 22 bp, Homo sapiens
tggaagggagctggaatttgga

SEQ ID NO: 113326 - DNA, 22 bp, Homo sapiens
tttcaggacacctttaaaaacg

SEQ ID NO: 113327 - DNA, 22 bp, Homo sapiens
gtggcccaggctggagtgcagt

SEQ ID NO: 113328 - DNA, 22 bp, Homo sapiens
ggggacctgggcttcaagggtt

SEQ ID NO: 113329 - DNA, 22 bp, Homo sapiens
gatatcattgagcccaggagtt

SEQ ID NO: 113330 - DNA, 22 bp, Homo sapiens
taatgtataacaaatactcatc

SEQ ID NO: 113331 - DNA, 22 bp, Homo sapiens
gcccaggctggagttcagtggt

SEQ ID NO: 113332 - DNA, 22 bp, Homo sapiens
tagcgaggtgtttctaggactg

SEQ ID NO: 113333 - DNA, 22 bp, Homo sapiens
gaggggcacagtaaagggtccc

SEQ ID NO: 113334 - DNA, 22 bp, Homo sapiens
tcactgcaacctctgcctcttg

SEQ ID NO: 113335 - DNA, 22 bp, Homo sapiens
tgccacagacaggacagaacag

SEQ ID NO: 113336 - DNA, 22 bp, Homo sapiens
cttgtgcatttcattcctcagg

SEQ ID NO: 113337 - DNA, 22 bp, Homo sapiens
gtggtgagattgctggatcaaa

SEQ ID NO: 113338 - DNA, 22 bp, Homo sapiens
acgtggcggccgccgtgagcgg

SEQ ID NO: 113339 - DNA, 22 bp, Homo sapiens
ggagaccagaaggaagcttcga

SEQ ID NO: 113340 - DNA, 22 bp, Homo sapiens
agtgctgtctccttcccccggg

SEQ ID NO: 113341 - DNA, 22 bp, Homo sapiens
caaagggaaaagccatgtgggc

SEQ ID NO: 113342 - DNA, 22 bp, Homo sapiens
cagtcactggaatagctgagga

SEQ ID NO: 113343 - DNA, 22 bp, Homo sapiens
actccacaccacgggggccgcc

SEQ ID NO: 113344 - DNA, 18 bp, Homo sapiens
gagtcgtcggagagtctg

SEQ ID NO: 113345 - DNA, 22 bp, Homo sapiens
aggccaggaatccttgtcccag

SEQ ID NO: 113346 - DNA, 22 bp, Homo sapiens
tatcacatttggagatttatga

SEQ ID NO: 113347 - DNA, 22 bp, Homo sapiens
taggcaagtggaccagaggttt

SEQ ID NO: 113348 - DNA, 21 bp, Homo sapiens
ttgaccaagggtgcgtgctcc

SEQ ID NO: 113349 - DNA, 22 bp, Homo sapiens
tgatctggtcctactgtgggca

SEQ ID NO: 113350 - DNA, 22 bp, Homo sapiens
ggaggcggaggttgcagtgagt

SEQ ID NO: 113351 - DNA, 22 bp, Homo sapiens
ggaggtggaggttgcagtgagc

SEQ ID NO: 113352 - DNA, 22 bp, Homo sapiens
tattatccaaagagctgggagc

SEQ ID NO: 113353 - DNA, 22 bp, Homo sapiens
cctagagctctgctttatctaa

SEQ ID NO: 113354 - DNA, 22 bp, Homo sapiens
gtccaagagtcaagaagggggc

SEQ ID NO: 113355 - DNA, 22 bp, Homo sapiens
gggcggggtggctcatgcctgt

SEQ ID NO: 113356 - DNA, 22 bp, Homo sapiens
cagggtgctgcaccatccctca

SEQ ID NO: 113357 - DNA, 22 bp, Homo sapiens
cccaggccctggcagagcttgt

SEQ ID NO: 113358 - DNA, 22 bp, Homo sapiens
ttcaaatgatggcagtcctggc

SEQ ID NO: 113359 - DNA, 23 bp, Homo sapiens
tatgaactgcattgctggtgtgt

SEQ ID NO: 113360 - DNA, 22 bp, Homo sapiens
cttgtctgctataaaaatccag

SEQ ID NO: 113361 - DNA, 22 bp, Homo sapiens
cctccccacagcccaggagact

SEQ ID NO: 113362 - DNA, 22 bp, Homo sapiens
gggttcagtccctcttgctact

SEQ ID NO: 113363 - DNA, 22 bp, Homo sapiens
tatttaataaaactatggcatg

SEQ ID NO: 113364 - DNA, 22 bp, Homo sapiens
gcttcaaactgagcttcaagtg

SEQ ID NO: 113365 - DNA, 22 bp, Homo sapiens
gagccagactgcctgaagctca

SEQ ID NO: 113366 - DNA, 22 bp, Homo sapiens
atgtttttggaaatgggaacat

SEQ ID NO: 113367 - DNA, 22 bp, Homo sapiens
ggagaagaggagctggaagcct

SEQ ID NO: 113368 - DNA, 22 bp, Homo sapiens
ggggtgtggacggctgtgccag

SEQ ID NO: 113369 - DNA, 22 bp, Homo sapiens
aggaattcaagaccagctgggc

SEQ ID NO: 113370 - DNA, 22 bp, Homo sapiens
ttctgcaggctgtacaagaagc

SEQ ID NO: 113371 - DNA, 22 bp, Homo sapiens
ggccagcctggggctcccagac

SEQ ID NO: 113372 - DNA, 17 bp, Homo sapiens
gaacttgttcactgtga

SEQ ID NO: 113373 - DNA, 22 bp, Homo sapiens
aaaagagcttggttgattttgc

SEQ ID NO: 113374 - DNA, 22 bp, Homo sapiens
aagcagcacagcaatgactcta

SEQ ID NO: 113375 - DNA, 22 bp, Homo sapiens
aggctccctgaatcgcccgttc

SEQ ID NO: 113376 - DNA, 22 bp, Homo sapiens
gcgggccaccttggagagcgct

SEQ ID NO: 113377 - DNA, 22 bp, Homo sapiens
accctcaacaaattcactctat

SEQ ID NO: 113378 - DNA, 23 bp, Homo sapiens
tttctgatgagggatgtggtatg

SEQ ID NO: 113379 - DNA, 23 bp, Homo sapiens
acagcaagaggaccagatgtgag

SEQ ID NO: 113380 - DNA, 22 bp, Homo sapiens
aggcgcctgcgggatccttgcc

SEQ ID NO: 113381 - DNA, 22 bp, Homo sapiens
ccgaggctggagtgcagtggcg

SEQ ID NO: 113382 - DNA, 22 bp, Homo sapiens
gttgctcaggcaggagtacagt

SEQ ID NO: 113383 - DNA, 22 bp, Homo sapiens
tctctatttgcctaggcttgtg

SEQ ID NO: 113384 - DNA, 22 bp, Homo sapiens
atcacaaaggtctcagagcaca

SEQ ID NO: 113385 - DNA, 22 bp, Homo sapiens
ttgtgctctgtgttatttaagg

SEQ ID NO: 113386 - DNA, 22 bp, Homo sapiens
gctcactgcaacctccgccttc

SEQ ID NO: 113387 - DNA, 23 bp, Homo sapiens
agaaagtcatggccaggtttgat

SEQ ID NO: 113388 - DNA, 22 bp, Homo sapiens
tatgaagtctctgatgttgagt

SEQ ID NO: 113389 - DNA, 22 bp, Homo sapiens
cagctacaaatacttttgtatg

SEQ ID NO: 113390 - DNA, 22 bp, Homo sapiens
tatctatgtgctctgacctctc

SEQ ID NO: 113391 - DNA, 22 bp, Homo sapiens
tcacagagttaaaagtttcttt

SEQ ID NO: 113392 - DNA, 22 bp, Homo sapiens
tttccctttagcctgagaatcc

SEQ ID NO: 113393 - DNA, 18 bp, Homo sapiens
tctggaacaacttcatgt

SEQ ID NO: 113394 - DNA, 22 bp, Homo sapiens
gttccaggtggtcacagagctc

SEQ ID NO: 113395 - DNA, 22 bp, Homo sapiens
agatttccagaccaatttctca

SEQ ID NO: 113396 - DNA, 22 bp, Homo sapiens
ttctcaaagtgtgctccctgga

SEQ ID NO: 113397 - DNA, 22 bp, Homo sapiens
tttggaggggaagaccttggag

SEQ ID NO: 113398 - DNA, 22 bp, Homo sapiens
gtgggccactgggaggcaaggg

SEQ ID NO: 113399 - DNA, 21 bp, Homo sapiens
caaaagagactgattcttgga

SEQ ID NO: 113400 - DNA, 22 bp, Homo sapiens
ccagtggctacaggggggttga

SEQ ID NO: 113401 - DNA, 22 bp, Homo sapiens
agtattctggaattctatgtga

SEQ ID NO: 113402 - DNA, 22 bp, Homo sapiens
gacaattgcttttgccgaataa

SEQ ID NO: 113403 - DNA, 22 bp, Homo sapiens
attgtaaatagtgccacaataa

SEQ ID NO: 113404 - DNA, 22 bp, Homo sapiens
ggactgggaatcagggagatgc

SEQ ID NO: 113405 - DNA, 22 bp, Homo sapiens
aactcactttgtggcttctgaa

SEQ ID NO: 113406 - DNA, 22 bp, Homo sapiens
ttcctgggattattgtcaagca

SEQ ID NO: 113407 - DNA, 22 bp, Homo sapiens
ttctacagtgactgcagccata

SEQ ID NO: 113408 - DNA, 22 bp, Homo sapiens
ttcattttctttcacgctgctg

SEQ ID NO: 113409 - DNA, 22 bp, Homo sapiens
aggactgggtgcagagggcatc

SEQ ID NO: 113410 - DNA, 23 bp, Homo sapiens
gcagaggagcaagctggacacca

SEQ ID NO: 113411 - DNA, 22 bp, Homo sapiens
gtggggtagatctttctcagga

SEQ ID NO: 113412 - DNA, 22 bp, Homo sapiens
aaaagaggaactcttatatact

SEQ ID NO: 113413 - DNA, 23 bp, Homo sapiens
aggtaggttattgctgctacctg

SEQ ID NO: 113414 - DNA, 22 bp, Homo sapiens
cacccaggttggagtgcagtgg

SEQ ID NO: 113415 - DNA, 22 bp, Homo sapiens
agagagcccgggccagggcaca

SEQ ID NO: 113416 - DNA, 21 bp, Homo sapiens
ttagaagctaatgcagctggt

SEQ ID NO: 113417 - DNA, 22 bp, Homo sapiens
ggtcgctgtgtaggttcagcta

SEQ ID NO: 113418 - DNA, 18 bp, Homo sapiens
agctccatctgtcagcat

SEQ ID NO: 113419 - DNA, 22 bp, Homo sapiens
gagctcatccccatggtccgtc

SEQ ID NO: 113420 - DNA, 22 bp, Homo sapiens
aaggccctggcaggaagcagga

SEQ ID NO: 113421 - DNA, 22 bp, Homo sapiens
atccatttgacataatttcagc

SEQ ID NO: 113422 - DNA, 22 bp, Homo sapiens
gcccagagtttgaagatacagt

SEQ ID NO: 113423 - DNA, 22 bp, Homo sapiens
caggccctgtgctgggtgatgt

SEQ ID NO: 113424 - DNA, 22 bp, Homo sapiens
ggtcccaggttgacagggagac

SEQ ID NO: 113425 - DNA, 22 bp, Homo sapiens
ctcctgggaaaggctggacaca

SEQ ID NO: 113426 - DNA, 20 bp, Homo sapiens
gccaacgcgctggggctgcc

SEQ ID NO: 113427 - DNA, 22 bp, Homo sapiens
gggggactggaccgtcctgggt

SEQ ID NO: 113428 - DNA, 22 bp, Homo sapiens
tggagaagattggtcaccattc

SEQ ID NO: 113429 - DNA, 22 bp, Homo sapiens
accctggacatcttgtcatagc

SEQ ID NO: 113430 - DNA, 22 bp, Homo sapiens
tggctgagttacgaacagagca

SEQ ID NO: 113431 - DNA, 21 bp, Homo sapiens
tctgccagctgaagaggtgga

SEQ ID NO: 113432 - DNA, 22 bp, Homo sapiens
taggcctggatctctgggagca

SEQ ID NO: 113433 - DNA, 22 bp, Homo sapiens
gcttacaggtgaggcagcaaga

SEQ ID NO: 113434 - DNA, 22 bp, Homo sapiens
ggaggaggggtgactgaatgct

SEQ ID NO: 113435 - DNA, 22 bp, Homo sapiens
tggtggctcacacctgtaatcc

SEQ ID NO: 113436 - DNA, 22 bp, Homo sapiens
atgccaggaacaaacagtggtg

SEQ ID NO: 113437 - DNA, 23 bp, Homo sapiens
tctacaaagctgtgtcaggaccc

SEQ ID NO: 113438 - DNA, 22 bp, Homo sapiens
tacccagtctggagtgcagtga

SEQ ID NO: 113439 - DNA, 22 bp, Homo sapiens
gaaaagagacagggtgggtgat

SEQ ID NO: 113440 - DNA, 22 bp, Homo sapiens
ggcagggagtggagactcccta

SEQ ID NO: 113441 - DNA, 22 bp, Homo sapiens
aggctgaggcaagaggatcact

SEQ ID NO: 113442 - DNA, 22 bp, Homo sapiens
gctcccaccgccgctatgggta

SEQ ID NO: 113443 - DNA, 22 bp, Homo sapiens
gcaggaggttgagccaggactg

SEQ ID NO: 113444 - DNA, 22 bp, Homo sapiens
ttgtgtgtactggttatgggca

SEQ ID NO: 113445 - DNA, 22 bp, Homo sapiens
cccaggccccagggcttgtcag

SEQ ID NO: 113446 - DNA, 20 bp, Homo sapiens
gtgtgacctcctgtggatgc

SEQ ID NO: 113447 - DNA, 22 bp, Homo sapiens
ttgtgttaaggtgcatctagtg

SEQ ID NO: 113448 - DNA, 22 bp, Homo sapiens
gaggccaactttggagaacagg

SEQ ID NO: 113449 - DNA, 22 bp, Homo sapiens
ccttttgtcctgcttggtttcg

SEQ ID NO: 113450 - DNA, 22 bp, Homo sapiens
cggaggttgaggctgcagtgag

SEQ ID NO: 113451 - DNA, 22 bp, Homo sapiens
gctctagtaggaatgtccctct

SEQ ID NO: 113452 - DNA, 22 bp, Homo sapiens
aggggaatgggtagactgttga

SEQ ID NO: 113453 - DNA, 22 bp, Homo sapiens
ccaggctggagtgcaatggcgt

SEQ ID NO: 113454 - DNA, 22 bp, Homo sapiens
tagtttcatctccaccctgccc

SEQ ID NO: 113455 - DNA, 22 bp, Homo sapiens
cagagagaatcttggcagctga

SEQ ID NO: 113456 - DNA, 22 bp, Homo sapiens
catgtaaagaatttcacacaag

SEQ ID NO: 113457 - DNA, 21 bp, Homo sapiens
aagaggaagcattatggcata

SEQ ID NO: 113458 - DNA, 22 bp, Homo sapiens
ttcttctcagggtcccacatgg

SEQ ID NO: 113459 - DNA, 22 bp, Homo sapiens
acaaagtgctgacattacaggc

SEQ ID NO: 113460 - DNA, 22 bp, Homo sapiens
tagaggctttcagcggtaggtc

SEQ ID NO: 113461 - DNA, 22 bp, Homo sapiens
taggtataggattctaggttgg

SEQ ID NO: 113462 - DNA, 22 bp, Homo sapiens
gttctgggagatcttgagcttc

SEQ ID NO: 113463 - DNA, 19 bp, Homo sapiens
aggcttcaggccacatgct

SEQ ID NO: 113464 - DNA, 22 bp, Homo sapiens
tggcactgagcagccgcggcag

SEQ ID NO: 113465 - DNA, 22 bp, Homo sapiens
gagggtggtggcttaaggtgct

SEQ ID NO: 113466 - DNA, 22 bp, Homo sapiens
cattggccttttatcctagagg

SEQ ID NO: 113467 - DNA, 22 bp, Homo sapiens
acatgtttaagtttgttatatg

SEQ ID NO: 113468 - DNA, 19 bp, Homo sapiens
ccagagagctaggtacaga

SEQ ID NO: 113469 - DNA, 22 bp, Homo sapiens
tttcataatactgtacatgaaa

SEQ ID NO: 113470 - DNA, 22 bp, Homo sapiens
gcccttacagggtggtcagcca

SEQ ID NO: 113471 - DNA, 22 bp, Homo sapiens
ggccgtgctccaaagtcatcgt

SEQ ID NO: 113472 - DNA, 22 bp, Homo sapiens
gcccagctgcaccctggtgggt

SEQ ID NO: 113473 - DNA, 22 bp, Homo sapiens
agatacattgttctaagcattg

SEQ ID NO: 113474 - DNA, 22 bp, Homo sapiens
ttttggccacatccttttgagt

SEQ ID NO: 113475 - DNA, 22 bp, Homo sapiens
cagcgtctcgttgtgggcctcg

SEQ ID NO: 113476 - DNA, 22 bp, Homo sapiens
agtggcaggatctcggttcact

SEQ ID NO: 113477 - DNA, 22 bp, Homo sapiens
tgtgttaaggtgcatctagtgc

SEQ ID NO: 113478 - DNA, 22 bp, Homo sapiens
caggccagggttgagaagagaa

SEQ ID NO: 113479 - DNA, 22 bp, Homo sapiens
ggcgtgggcgaggtgctctatc

SEQ ID NO: 113480 - DNA, 22 bp, Homo sapiens
actgtgtgtttgtctagcacag

SEQ ID NO: 113481 - DNA, 22 bp, Homo sapiens
aaagaaggtagggctggtgact

SEQ ID NO: 113482 - DNA, 22 bp, Homo sapiens
tgctccatgcgctcggccggcg

SEQ ID NO: 113483 - DNA, 21 bp, Homo sapiens
tctgagactgggttagaatgt

SEQ ID NO: 113484 - DNA, 22 bp, Homo sapiens
cagggatggcgctggctgcccg

SEQ ID NO: 113485 - DNA, 22 bp, Homo sapiens
ccaggctgctgttggtgtccgc

SEQ ID NO: 113486 - DNA, 22 bp, Homo sapiens
ctgcgttctgcctggcggccta

SEQ ID NO: 113487 - DNA, 22 bp, Homo sapiens
tagagctggccgggacagctgg

SEQ ID NO: 113488 - DNA, 22 bp, Homo sapiens
aacccgggaggcagaggttgtg

SEQ ID NO: 113489 - DNA, 22 bp, Homo sapiens
cgggcagcggcgtggccatggt

SEQ ID NO: 113490 - DNA, 22 bp, Homo sapiens
tgctgggggtagctctgcgtag

SEQ ID NO: 113491 - DNA, 22 bp, Homo sapiens
tgacacccatctgtgccagtcc

SEQ ID NO: 113492 - DNA, 22 bp, Homo sapiens
ccggctactcgggaggctgacg

SEQ ID NO: 113493 - DNA, 22 bp, Homo sapiens
ctgggcagctgtatcagggagt

SEQ ID NO: 113494 - DNA, 22 bp, Homo sapiens
ctgggaggcggaggttgcagtg

SEQ ID NO: 113495 - DNA, 22 bp, Homo sapiens
agaggaagtaatcaggacctgc

SEQ ID NO: 113496 - DNA, 22 bp, Homo sapiens
caggctggagtgcagtggtgcc

SEQ ID NO: 113497 - DNA, 22 bp, Homo sapiens
gtgacacccgcatgccactgtg

SEQ ID NO: 113498 - DNA, 22 bp, Homo sapiens
aaatcggttggttcaaggtaat

SEQ ID NO: 113499 - DNA, 22 bp, Homo sapiens
aaagtgctggtattacaggtgt

SEQ ID NO: 113500 - DNA, 22 bp, Homo sapiens
tcttagaaattccccagtggct

SEQ ID NO: 113501 - DNA, 22 bp, Homo sapiens
cccagcgagtttgccggtgaac

SEQ ID NO: 113502 - DNA, 22 bp, Homo sapiens
tcctccccaaagcccagcctgg

SEQ ID NO: 113503 - DNA, 22 bp, Homo sapiens
attcacatttagcctctgacat

SEQ ID NO: 113504 - DNA, 22 bp, Homo sapiens
tgagagttctctcttcaggtgg

SEQ ID NO: 113505 - DNA, 22 bp, Homo sapiens
gggcgcatcacctgaggtcagg

SEQ ID NO: 113506 - DNA, 22 bp, Homo sapiens
gtgaccatcatctcagctagtt

SEQ ID NO: 113507 - DNA, 22 bp, Homo sapiens
gtgatatcttacaattctcttt

SEQ ID NO: 113508 - DNA, 22 bp, Homo sapiens
atatcactagagaagttgttaa

SEQ ID NO: 113509 - DNA, 22 bp, Homo sapiens
cagcaggaggtgagtagcaggt

SEQ ID NO: 113510 - DNA, 22 bp, Homo sapiens
gctgaggtggaggaaggagacc

SEQ ID NO: 113511 - DNA, 22 bp, Homo sapiens
tctaaacttgtaaacaagcata

SEQ ID NO: 113512 - DNA, 22 bp, Homo sapiens
tctgctctgtggcttcagctaa

SEQ ID NO: 113513 - DNA, 22 bp, Homo sapiens
catggcggtcaggatgtaggtg

SEQ ID NO: 113514 - DNA, 22 bp, Homo sapiens
gttatataagacaaatcagagt

SEQ ID NO: 113515 - DNA, 22 bp, Homo sapiens
acattaaaattgggtggggtaa

SEQ ID NO: 113516 - DNA, 22 bp, Homo sapiens
ccctgccttgtctgggctaggt

SEQ ID NO: 113517 - DNA, 22 bp, Homo sapiens
tgttcattacccatcccaggtc

SEQ ID NO: 113518 - DNA, 22 bp, Homo sapiens
tgtgactgaggctccaagctag

SEQ ID NO: 113519 - DNA, 22 bp, Homo sapiens
tgtgaagaattaatgtgaatca

SEQ ID NO: 113520 - DNA, 22 bp, Homo sapiens
actcatgtcctaggagtaaagc

SEQ ID NO: 113521 - DNA, 22 bp, Homo sapiens
gcctcactgcagccccaggaag

SEQ ID NO: 113522 - DNA, 22 bp, Homo sapiens
tacaaaaaattgatactgacga

SEQ ID NO: 113523 - DNA, 22 bp, Homo sapiens
ctggaaggcagaggttgcagtg

SEQ ID NO: 113524 - DNA, 22 bp, Homo sapiens
tgcctgcctaggaagctgtgaa

SEQ ID NO: 113525 - DNA, 22 bp, Homo sapiens
ccaaagtgctaggattacaggc

SEQ ID NO: 113526 - DNA, 22 bp, Homo sapiens
tcctgggccctccggatcaggt

SEQ ID NO: 113527 - DNA, 22 bp, Homo sapiens
gtcctggggattatagagtgtt

SEQ ID NO: 113528 - DNA, 22 bp, Homo sapiens
agcaggagtttgatgcttttat

SEQ ID NO: 113529 - DNA, 22 bp, Homo sapiens
tcaagcaattctcctgcctcag

SEQ ID NO: 113530 - DNA, 22 bp, Homo sapiens
gtcctgacggctgattggcctg

SEQ ID NO: 113531 - DNA, 22 bp, Homo sapiens
cggccaggcacagtggcccacg

SEQ ID NO: 113532 - DNA, 22 bp, Homo sapiens
ggggccttttctgaatgtggaa

SEQ ID NO: 113533 - DNA, 22 bp, Homo sapiens
ttggcttttatgcagcttaggt

SEQ ID NO: 113534 - DNA, 22 bp, Homo sapiens
tttctggcagcgggacaggggt

SEQ ID NO: 113535 - DNA, 22 bp, Homo sapiens
taggtttcagaggtgccgggaa

SEQ ID NO: 113536 - DNA, 22 bp, Homo sapiens
gggtggagagaaagaaacgtga

SEQ ID NO: 113537 - DNA, 22 bp, Homo sapiens
agagtgcaaccgaaacaagcag

SEQ ID NO: 113538 - DNA, 22 bp, Homo sapiens
catgagataatttttctccagt

SEQ ID NO: 113539 - DNA, 22 bp, Homo sapiens
ttcaatatgatattagctgtgg

SEQ ID NO: 113540 - DNA, 22 bp, Homo sapiens
aaaaagtattggccatggttga

SEQ ID NO: 113541 - DNA, 22 bp, Homo sapiens
gagatggagtctttttctgtca

SEQ ID NO: 113542 - DNA, 17 bp, Homo sapiens
tgtagcttctccttctc

SEQ ID NO: 113543 - DNA, 22 bp, Homo sapiens
gtggagggtgattgccggctgt

SEQ ID NO: 113544 - DNA, 22 bp, Homo sapiens
aacagtgtttttcttcagcact

SEQ ID NO: 113545 - DNA, 22 bp, Homo sapiens
cctgcttaacattgccatgaca

SEQ ID NO: 113546 - DNA, 22 bp, Homo sapiens
gtgcatgtcggggtgcatgtca

SEQ ID NO: 113547 - DNA, 22 bp, Homo sapiens
gcagggtctgaggccacagagg

SEQ ID NO: 113548 - DNA, 22 bp, Homo sapiens
ccttgctcaagctagtgacggg

SEQ ID NO: 113549 - DNA, 22 bp, Homo sapiens
gcagcctcaaactccccagctc

SEQ ID NO: 113550 - DNA, 22 bp, Homo sapiens
agaggctgcacttgctcatgat

SEQ ID NO: 113551 - DNA, 23 bp, Homo sapiens
tgagtgtgaaaatcctggagatg

SEQ ID NO: 113552 - DNA, 22 bp, Homo sapiens
cgcagggccgcgagcgggacca

SEQ ID NO: 113553 - DNA, 22 bp, Homo sapiens
ggctgcaggttggttggcagct

SEQ ID NO: 113554 - DNA, 22 bp, Homo sapiens
tcttggccactaccacctggag

SEQ ID NO: 113555 - DNA, 22 bp, Homo sapiens
caggtgcctcaggatgagacaa

SEQ ID NO: 113556 - DNA, 22 bp, Homo sapiens
aaagctgtcaaggcaggaggct

SEQ ID NO: 113557 - DNA, 22 bp, Homo sapiens
ctgtccccacccaaatctcatc

SEQ ID NO: 113558 - DNA, 21 bp, Homo sapiens
tgtaagtttcatctgaattgg

SEQ ID NO: 113559 - DNA, 22 bp, Homo sapiens
cctggaggcggaggttgcagtg

SEQ ID NO: 113560 - DNA, 22 bp, Homo sapiens
taaatgttgtaagtacatctaa

SEQ ID NO: 113561 - DNA, 22 bp, Homo sapiens
tacttttcctggaaccactgct

SEQ ID NO: 113562 - DNA, 22 bp, Homo sapiens
tcctttgcttctgtcattctcc

SEQ ID NO: 113563 - DNA, 22 bp, Homo sapiens
ctgtaatcccagctactcggga

SEQ ID NO: 113564 - DNA, 22 bp, Homo sapiens
accatgtcatttattggccaaa

SEQ ID NO: 113565 - DNA, 22 bp, Homo sapiens
tattttgtgccatgcactgcct

SEQ ID NO: 113566 - DNA, 22 bp, Homo sapiens
ccagaccctccattcaagctcc

SEQ ID NO: 113567 - DNA, 22 bp, Homo sapiens
agtgactggtgtgaagttaaat

SEQ ID NO: 113568 - DNA, 22 bp, Homo sapiens
cactgcaccctcaaactcctgg

SEQ ID NO: 113569 - DNA, 22 bp, Homo sapiens
aggggagagttaatgtgaatgt

SEQ ID NO: 113570 - DNA, 22 bp, Homo sapiens
tctctcaggctggagtgcagtg

SEQ ID NO: 113571 - DNA, 22 bp, Homo sapiens
gatgcgggcccgctccactgcc

SEQ ID NO: 113572 - DNA, 17 bp, Homo sapiens
gagcccctttccaagtt

SEQ ID NO: 113573 - DNA, 22 bp, Homo sapiens
atgtgtattacctcgattgtga

SEQ ID NO: 113574 - DNA, 22 bp, Homo sapiens
tgcagcaccgtcccactggcta

SEQ ID NO: 113575 - DNA, 22 bp, Homo sapiens
tgtgctctgactttctcctggt

SEQ ID NO: 113576 - DNA, 22 bp, Homo sapiens
tccaagatctacagcagtttag

SEQ ID NO: 113577 - DNA, 22 bp, Homo sapiens
gtagatgagctcacatgacctt

SEQ ID NO: 113578 - DNA, 22 bp, Homo sapiens
tctcagggctcagagctcaggc

SEQ ID NO: 113579 - DNA, 22 bp, Homo sapiens
agaggccgggtgcctgctcaga

SEQ ID NO: 113580 - DNA, 22 bp, Homo sapiens
tacagctgcaagggtttctggg

SEQ ID NO: 113581 - DNA, 22 bp, Homo sapiens
tagaagaaagtgaagctgggga

SEQ ID NO: 113582 - DNA, 22 bp, Homo sapiens
aagacacaatgtagcccagcac

SEQ ID NO: 113583 - DNA, 22 bp, Homo sapiens
aagaataagaggatttagaaca

SEQ ID NO: 113584 - DNA, 22 bp, Homo sapiens
tggtattacttctagacacaag

SEQ ID NO: 113585 - DNA, 22 bp, Homo sapiens
ttagccaggggagcagcttgtc

SEQ ID NO: 113586 - DNA, 22 bp, Homo sapiens
cactaggctggagtgcagtggc

SEQ ID NO: 113587 - DNA, 22 bp, Homo sapiens
tcactgcaacctccacctcctg

SEQ ID NO: 113588 - DNA, 22 bp, Homo sapiens
tacaaagtcttgggttctaggc

SEQ ID NO: 113589 - DNA, 22 bp, Homo sapiens
gctcgcgccgcaccggtccacc

SEQ ID NO: 113590 - DNA, 22 bp, Homo sapiens
agaacagaggccttatgtttca

SEQ ID NO: 113591 - DNA, 22 bp, Homo sapiens
tgcatattatgtgtatctgtct

SEQ ID NO: 113592 - DNA, 23 bp, Homo sapiens
tactatggttattatccctctcc

SEQ ID NO: 113593 - DNA, 22 bp, Homo sapiens
cagcagcagtgttctagaatct

SEQ ID NO: 113594 - DNA, 22 bp, Homo sapiens
ctggaaggcggaggttgtagtg

SEQ ID NO: 113595 - DNA, 22 bp, Homo sapiens
gaagggaactgggtctccttgt

SEQ ID NO: 113596 - DNA, 22 bp, Homo sapiens
tctcttgagctcagttctgatg

SEQ ID NO: 113597 - DNA, 22 bp, Homo sapiens
atcctagaatcagcccttgctg

SEQ ID NO: 113598 - DNA, 22 bp, Homo sapiens
tggttaacttctgagcaggctg

SEQ ID NO: 113599 - DNA, 22 bp, Homo sapiens
cacagggcttctcatggggtgc

SEQ ID NO: 113600 - DNA, 22 bp, Homo sapiens
ctcactgcaagctccacctctt

SEQ ID NO: 113601 - DNA, 23 bp, Homo sapiens
ccagtgattgcctggaaggaggt

SEQ ID NO: 113602 - DNA, 22 bp, Homo sapiens
aactcaaagatgcatgacgctt

SEQ ID NO: 113603 - DNA, 22 bp, Homo sapiens
aggtaaagacagtgaaagaggg

SEQ ID NO: 113604 - DNA, 22 bp, Homo sapiens
atatgggggggcgtgcagagga

SEQ ID NO: 113605 - DNA, 22 bp, Homo sapiens
tggaatgtcagctacaagaggg

SEQ ID NO: 113606 - DNA, 22 bp, Homo sapiens
gggggaagaaagaacatggcat

SEQ ID NO: 113607 - DNA, 22 bp, Homo sapiens
tttcttctatgtgtgatatttt

SEQ ID NO: 113608 - DNA, 22 bp, Homo sapiens
cttggtgccacagcagcttgcg

SEQ ID NO: 113609 - DNA, 22 bp, Homo sapiens
ttctcatgaaactcgcttcctc

SEQ ID NO: 113610 - DNA, 22 bp, Homo sapiens
tagcatgtcagtcgccacacgt

SEQ ID NO: 113611 - DNA, 22 bp, Homo sapiens
aggtcagagcaatgtattgctt

SEQ ID NO: 113612 - DNA, 22 bp, Homo sapiens
atccccctgtatctggaagaat

SEQ ID NO: 113613 - DNA, 22 bp, Homo sapiens
ttagtctctttgcattgccata

SEQ ID NO: 113614 - DNA, 22 bp, Homo sapiens
gatgctgagaggtggagggaac

SEQ ID NO: 113615 - DNA, 22 bp, Homo sapiens
tcagtgccatgggcagacaggc

SEQ ID NO: 113616 - DNA, 22 bp, Homo sapiens
ttcattcttttacatgtgaata

SEQ ID NO: 113617 - DNA, 22 bp, Homo sapiens
aggcttcaggtttgctttgcag

SEQ ID NO: 113618 - DNA, 22 bp, Homo sapiens
actttatttcctattgcatcca

SEQ ID NO: 113619 - DNA, 22 bp, Homo sapiens
atgaattgaggaaaacagtcgt

SEQ ID NO: 113620 - DNA, 22 bp, Homo sapiens
acgcctgtaatcccagcacttt

SEQ ID NO: 113621 - DNA, 22 bp, Homo sapiens
ataaaatttgctactgttaaat

SEQ ID NO: 113622 - DNA, 22 bp, Homo sapiens
aggccctattcaatggggccca

SEQ ID NO: 113623 - DNA, 22 bp, Homo sapiens
actctgctctgtatttcactgt

SEQ ID NO: 113624 - DNA, 17 bp, Homo sapiens
gaggccaaggcaggcgg

SEQ ID NO: 113625 - DNA, 22 bp, Homo sapiens
ctgggcgcgtcccctgaggcgg

SEQ ID NO: 113626 - DNA, 22 bp, Homo sapiens
taagggttcagaatgcagtggt

SEQ ID NO: 113627 - DNA, 22 bp, Homo sapiens
accattgccccctagtgtctgt

SEQ ID NO: 113628 - DNA, 22 bp, Homo sapiens
aggagaagccaagttgtgagca

SEQ ID NO: 113629 - DNA, 22 bp, Homo sapiens
tggagacacaggaccagactgc

SEQ ID NO: 113630 - DNA, 22 bp, Homo sapiens
tctgtgaagctctgaacagcag

SEQ ID NO: 113631 - DNA, 22 bp, Homo sapiens
tcccagattcctgctcttatat

SEQ ID NO: 113632 - DNA, 22 bp, Homo sapiens
agccaggatggtctcgatcggc

SEQ ID NO: 113633 - DNA, 22 bp, Homo sapiens
tctcctggtacccttcctagca

SEQ ID NO: 113634 - DNA, 22 bp, Homo sapiens
aaggcaggatgggaaaagattt

SEQ ID NO: 113635 - DNA, 22 bp, Homo sapiens
ttctgattgctgatgaggccca

SEQ ID NO: 113636 - DNA, 22 bp, Homo sapiens
tagactggtgaattagggggaa

SEQ ID NO: 113637 - DNA, 22 bp, Homo sapiens
agaagccaccagctgaggaaga

SEQ ID NO: 113638 - DNA, 22 bp, Homo sapiens
ggcttggaaactagagtgtgca

SEQ ID NO: 113639 - DNA, 22 bp, Homo sapiens
ggaggctgaggcaggcggatca

SEQ ID NO: 113640 - DNA, 22 bp, Homo sapiens
tgtgaatggacaattaaatcta

SEQ ID NO: 113641 - DNA, 22 bp, Homo sapiens
attttctctttgtatatgctag

SEQ ID NO: 113642 - DNA, 22 bp, Homo sapiens
ggttcagggctaccagtgggtg

SEQ ID NO: 113643 - DNA, 22 bp, Homo sapiens
tggttcctcaagcgctggcggc

SEQ ID NO: 113644 - DNA, 22 bp, Homo sapiens
ctgaggtgtgaaatggtggcaa

SEQ ID NO: 113645 - DNA, 22 bp, Homo sapiens
gcccagtagttcaaggttgcag

SEQ ID NO: 113646 - DNA, 22 bp, Homo sapiens
tagagatggggtcttgctatga

SEQ ID NO: 113647 - DNA, 22 bp, Homo sapiens
cagtggcaggatttcagctcag

SEQ ID NO: 113648 - DNA, 22 bp, Homo sapiens
aaggctgagacagcacaggtcc

SEQ ID NO: 113649 - DNA, 21 bp, Homo sapiens
cgtgactgggtccgtctggct

SEQ ID NO: 113650 - DNA, 22 bp, Homo sapiens
tcactgcaagctcagcctcccg

SEQ ID NO: 113651 - DNA, 19 bp, Homo sapiens
tggctctgtcgaaggcaca

SEQ ID NO: 113652 - DNA, 22 bp, Homo sapiens
caggctggagtgcagtggcgct

SEQ ID NO: 113653 - DNA, 22 bp, Homo sapiens
tctagcaagctcgtgctcaagg

SEQ ID NO: 113654 - DNA, 22 bp, Homo sapiens
ggcaagaaccacaattactttt

SEQ ID NO: 113655 - DNA, 22 bp, Homo sapiens
ggggatggaggcgtgtggtcct

SEQ ID NO: 113656 - DNA, 22 bp, Homo sapiens
ggggaaggaaagttattagcag

SEQ ID NO: 113657 - DNA, 22 bp, Homo sapiens
tggagaattctatgttgagggg

SEQ ID NO: 113658 - DNA, 22 bp, Homo sapiens
aagctgcagcacagagaggtgg

SEQ ID NO: 113659 - DNA, 22 bp, Homo sapiens
ggcgctcagtgttgccccagag

SEQ ID NO: 113660 - DNA, 22 bp, Homo sapiens
tacaacaatttccacattagaa

SEQ ID NO: 113661 - DNA, 22 bp, Homo sapiens
tgggcgacagagcaagactccg

SEQ ID NO: 113662 - DNA, 22 bp, Homo sapiens
agagaggtctcaggagaaacca

SEQ ID NO: 113663 - DNA, 22 bp, Homo sapiens
aacactgctgctgggttctgtg

SEQ ID NO: 113664 - DNA, 22 bp, Homo sapiens
gcactgcaggtgggtggagagg

SEQ ID NO: 113665 - DNA, 22 bp, Homo sapiens
attgtgaatagtgccgcagtaa

SEQ ID NO: 113666 - DNA, 22 bp, Homo sapiens
accccagaggcggaggctgcag

SEQ ID NO: 113667 - DNA, 22 bp, Homo sapiens
aggacaaaggaccagatctgga

SEQ ID NO: 113668 - DNA, 22 bp, Homo sapiens
ctctggaggtggaggttgcagt

SEQ ID NO: 113669 - DNA, 22 bp, Homo sapiens
tatcactacacctggctaatta

SEQ ID NO: 113670 - DNA, 22 bp, Homo sapiens
tgtcaccttgctcatcctcgga

SEQ ID NO: 113671 - DNA, 22 bp, Homo sapiens
ctgcaagctacccctagcatca

SEQ ID NO: 113672 - DNA, 22 bp, Homo sapiens
ctggctgggagcgagctgctca

SEQ ID NO: 113673 - DNA, 22 bp, Homo sapiens
ttcagagaattggataattcgt

SEQ ID NO: 113674 - DNA, 22 bp, Homo sapiens
ggtgacctcacctggtcccacc

SEQ ID NO: 113675 - DNA, 22 bp, Homo sapiens
tgctgtgaggttgagaaggaag

SEQ ID NO: 113676 - DNA, 22 bp, Homo sapiens
ttctttgcccatgtttcctaag

SEQ ID NO: 113677 - DNA, 22 bp, Homo sapiens
aaggatgattggtaatgacact

SEQ ID NO: 113678 - DNA, 22 bp, Homo sapiens
aggtgggcgctgctcccgctgg

SEQ ID NO: 113679 - DNA, 22 bp, Homo sapiens
aagaagcaggtcacagacaggg

SEQ ID NO: 113680 - DNA, 22 bp, Homo sapiens
agttatgtcctcagcaaatcaa

SEQ ID NO: 113681 - DNA, 22 bp, Homo sapiens
ccaggaggcggaggttgcagtg

SEQ ID NO: 113682 - DNA, 22 bp, Homo sapiens
agttggagtgaacatgagattg

SEQ ID NO: 113683 - DNA, 22 bp, Homo sapiens
ggagctcctggcagtgacagag

SEQ ID NO: 113684 - DNA, 22 bp, Homo sapiens
tctcgctctgtcgcccaggctg

SEQ ID NO: 113685 - DNA, 22 bp, Homo sapiens
atagttttaaaacctcaggaag

SEQ ID NO: 113686 - DNA, 22 bp, Homo sapiens
cccaggaggcggaggttgcagt

SEQ ID NO: 113687 - DNA, 22 bp, Homo sapiens
tctcccaagcctggcaggggca

SEQ ID NO: 113688 - DNA, 22 bp, Homo sapiens
catcaagtggttctccaggttg

SEQ ID NO: 113689 - DNA, 22 bp, Homo sapiens
cccacgtcgaacttgctccaga

SEQ ID NO: 113690 - DNA, 22 bp, Homo sapiens
aaaagttattgatgcaggacaa

SEQ ID NO: 113691 - DNA, 22 bp, Homo sapiens
ctggcaggtggaggttgcagtg

SEQ ID NO: 113692 - DNA, 21 bp, Homo sapiens
tcttttctcagctttgtggtt

SEQ ID NO: 113693 - DNA, 22 bp, Homo sapiens
ccaagcaaataatcacccacta

SEQ ID NO: 113694 - DNA, 22 bp, Homo sapiens
acaactccttcttgggtcctgg

SEQ ID NO: 113695 - DNA, 22 bp, Homo sapiens
gctggggaggcagcagagaaca

SEQ ID NO: 113696 - DNA, 22 bp, Homo sapiens
aattgaaaatattgtagaccat

SEQ ID NO: 113697 - DNA, 22 bp, Homo sapiens
tttggcggggcaattctgaagc

SEQ ID NO: 113698 - DNA, 22 bp, Homo sapiens
aaagaggcaatcaatgtagcaa

SEQ ID NO: 113699 - DNA, 22 bp, Homo sapiens
cattcatctatcaaatggtacc

SEQ ID NO: 113700 - DNA, 22 bp, Homo sapiens
tcgtctgtgaaattgggataag

SEQ ID NO: 113701 - DNA, 22 bp, Homo sapiens
cttggtctataggagagattgt

SEQ ID NO: 113702 - DNA, 22 bp, Homo sapiens
tcactgcagcctctgcctcccg

SEQ ID NO: 113703 - DNA, 20 bp, Homo sapiens
agagtgagactccatctcag

SEQ ID NO: 113704 - DNA, 22 bp, Homo sapiens
tccaaggtcagcgagagtcact

SEQ ID NO: 113705 - DNA, 22 bp, Homo sapiens
tggtatttctgtgcccagctca

SEQ ID NO: 113706 - DNA, 22 bp, Homo sapiens
ctctgcctgtctcatcctgcaa

SEQ ID NO: 113707 - DNA, 22 bp, Homo sapiens
ggaggagcatgagagggtagtg

SEQ ID NO: 113708 - DNA, 22 bp, Homo sapiens
atgtgggccgtgcgggtgtcct

SEQ ID NO: 113709 - DNA, 20 bp, Homo sapiens
ttggatgtgcatggccgtgc

SEQ ID NO: 113710 - DNA, 22 bp, Homo sapiens
agtgcactggcaccatctcagc

SEQ ID NO: 113711 - DNA, 19 bp, Homo sapiens
gggaatgatggaagacttc

SEQ ID NO: 113712 - DNA, 22 bp, Homo sapiens
tcaccttgtgatctccctgcct

SEQ ID NO: 113713 - DNA, 22 bp, Homo sapiens
agtcttagaactacagtgccta

SEQ ID NO: 113714 - DNA, 22 bp, Homo sapiens
ctacccttaagtttctgtgggg

SEQ ID NO: 113715 - DNA, 22 bp, Homo sapiens
gctactgattgaccttggagag

SEQ ID NO: 113716 - DNA, 22 bp, Homo sapiens
tccacagtggttgaactagttt

SEQ ID NO: 113717 - DNA, 22 bp, Homo sapiens
ggagggcgacagggcgaccgcg

SEQ ID NO: 113718 - DNA, 22 bp, Homo sapiens
ggccaggcgatgacccctccac

SEQ ID NO: 113719 - DNA, 20 bp, Homo sapiens
aactcctagcctcaagtgat

SEQ ID NO: 113720 - DNA, 22 bp, Homo sapiens
tgcttctgactaagctgcatga

SEQ ID NO: 113721 - DNA, 22 bp, Homo sapiens
aggtggggaggagtgtctcttt

SEQ ID NO: 113722 - DNA, 22 bp, Homo sapiens
atacttctttagcatattgaac

SEQ ID NO: 113723 - DNA, 22 bp, Homo sapiens
acattaaacttgcttggctgta

SEQ ID NO: 113724 - DNA, 22 bp, Homo sapiens
tatttccttgagacggagtctc

SEQ ID NO: 113725 - DNA, 22 bp, Homo sapiens
caggaaggggctcactctggcc

SEQ ID NO: 113726 - DNA, 22 bp, Homo sapiens
ctgcagtctacctggattttta

SEQ ID NO: 113727 - DNA, 22 bp, Homo sapiens
tcacaatatttatcttccaatt

SEQ ID NO: 113728 - DNA, 22 bp, Homo sapiens
gggcctgtgtgttcaggagcct

SEQ ID NO: 113729 - DNA, 21 bp, Homo sapiens
atgtagggtttgccttctcta

SEQ ID NO: 113730 - DNA, 22 bp, Homo sapiens
ctcctggaggatagtgactggg

SEQ ID NO: 113731 - DNA, 22 bp, Homo sapiens
tgggggacaccagtctctctct

SEQ ID NO: 113732 - DNA, 22 bp, Homo sapiens
caggcactgtgctgagctctgc

SEQ ID NO: 113733 - DNA, 22 bp, Homo sapiens
gctcactgcaacctctgcctcc

SEQ ID NO: 113734 - DNA, 22 bp, Homo sapiens
ctctggcaattgctgctgactc

SEQ ID NO: 113735 - DNA, 22 bp, Homo sapiens
aggtcaccatggcatgctccac

SEQ ID NO: 113736 - DNA, 22 bp, Homo sapiens
tcacccaggctggactgcagtg

SEQ ID NO: 113737 - DNA, 22 bp, Homo sapiens
tgtcttcaggagtaaatatcat

SEQ ID NO: 113738 - DNA, 22 bp, Homo sapiens
ggcatgagcacgaagtggtacc

SEQ ID NO: 113739 - DNA, 22 bp, Homo sapiens
tcctcattcttggtgcatcaaa

SEQ ID NO: 113740 - DNA, 22 bp, Homo sapiens
agcccaggagtttgaggctgtg

SEQ ID NO: 113741 - DNA, 22 bp, Homo sapiens
aaggctccagtgaatgctggca

SEQ ID NO: 113742 - DNA, 22 bp, Homo sapiens
cccaggaggtggagcttgcagt

SEQ ID NO: 113743 - DNA, 22 bp, Homo sapiens
acccagggctcaagcgtaggca

SEQ ID NO: 113744 - DNA, 22 bp, Homo sapiens
tctctttgcctgctgccatcca

SEQ ID NO: 113745 - DNA, 22 bp, Homo sapiens
ttccatttggcacttcactgag

SEQ ID NO: 113746 - DNA, 22 bp, Homo sapiens
gctgcagggagctggaaggctc

SEQ ID NO: 113747 - DNA, 22 bp, Homo sapiens
agggagcaaaggtttcagggtt

SEQ ID NO: 113748 - DNA, 22 bp, Homo sapiens
ttttaatactgctattgtagga

SEQ ID NO: 113749 - DNA, 22 bp, Homo sapiens
ctcactgcaagctctgcctccc

SEQ ID NO: 113750 - DNA, 22 bp, Homo sapiens
taaatcttctacatcatcataa

SEQ ID NO: 113751 - DNA, 22 bp, Homo sapiens
ttgtgaaacattcatggatttg

SEQ ID NO: 113752 - DNA, 22 bp, Homo sapiens
tcactgcaacctccacctcccg

SEQ ID NO: 113753 - DNA, 22 bp, Homo sapiens
cagaggaacgtttggattgatt

SEQ ID NO: 113754 - DNA, 22 bp, Homo sapiens
aggggatggagctggaaggcag

SEQ ID NO: 113755 - DNA, 22 bp, Homo sapiens
tcctgccttgcctgggacatca

SEQ ID NO: 113756 - DNA, 22 bp, Homo sapiens
cacctgtacagggccgggctgg

SEQ ID NO: 113757 - DNA, 22 bp, Homo sapiens
tcaggggcttgaggtgcatgtc

SEQ ID NO: 113758 - DNA, 22 bp, Homo sapiens
ggctcctgggggtgctcctgcc

SEQ ID NO: 113759 - DNA, 22 bp, Homo sapiens
agaatagaattctcatagaatt

SEQ ID NO: 113760 - DNA, 22 bp, Homo sapiens
gatggaggagatggcagggtgc

SEQ ID NO: 113761 - DNA, 22 bp, Homo sapiens
aagtgctgagactacaggcatg

SEQ ID NO: 113762 - DNA, 22 bp, Homo sapiens
agctcaagctacacacagagtc

SEQ ID NO: 113763 - DNA, 22 bp, Homo sapiens
gagacacaggcacagaagaggc

SEQ ID NO: 113764 - DNA, 22 bp, Homo sapiens
ggaggcggaagttgcagtgagc

SEQ ID NO: 113765 - DNA, 21 bp, Homo sapiens
cttccccaggctggtctgtat

SEQ ID NO: 113766 - DNA, 22 bp, Homo sapiens
agcctggcggtcgtcggtcagg

SEQ ID NO: 113767 - DNA, 20 bp, Homo sapiens
agcagagtgcccatcccgga

SEQ ID NO: 113768 - DNA, 19 bp, Homo sapiens
gcctcatttccacctcccc

SEQ ID NO: 113769 - DNA, 22 bp, Homo sapiens
tcgcaccattgcactccagcca

SEQ ID NO: 113770 - DNA, 22 bp, Homo sapiens
aatgtcaaaggctatacattca

SEQ ID NO: 113771 - DNA, 22 bp, Homo sapiens
cataatttctaccagggccata

SEQ ID NO: 113772 - DNA, 22 bp, Homo sapiens
gcatatgatcacgtgtgtcggt

SEQ ID NO: 113773 - DNA, 22 bp, Homo sapiens
tcttcctgtcaatgagaattaa

SEQ ID NO: 113774 - DNA, 22 bp, Homo sapiens
gccatgggcaaatgcagagctg

SEQ ID NO: 113775 - DNA, 22 bp, Homo sapiens
ctacaaaagtaattgtggtttt

SEQ ID NO: 113776 - DNA, 22 bp, Homo sapiens
atgaaaacggaccagagctatt

SEQ ID NO: 113777 - DNA, 22 bp, Homo sapiens
tgagccatgggactccaaggga

SEQ ID NO: 113778 - DNA, 22 bp, Homo sapiens
tccaaggagcagtcttcaacct

SEQ ID NO: 113779 - DNA, 22 bp, Homo sapiens
tacaaaggaggtgcatagaaca

SEQ ID NO: 113780 - DNA, 22 bp, Homo sapiens
cccaggaggcagaagttgcagt

SEQ ID NO: 113781 - DNA, 22 bp, Homo sapiens
aatgaattgcagtactgacttg

SEQ ID NO: 113782 - DNA, 23 bp, Homo sapiens
tcaagcaattctcctgcctcggc

SEQ ID NO: 113783 - DNA, 22 bp, Homo sapiens
acttttaaatgagtttcagttg

SEQ ID NO: 113784 - DNA, 18 bp, Homo sapiens
tgtccctgcaaataacat

SEQ ID NO: 113785 - DNA, 22 bp, Homo sapiens
atgcgagtgatgcagagtggct

SEQ ID NO: 113786 - DNA, 21 bp, Homo sapiens
accctgctttatgccgtcctc

SEQ ID NO: 113787 - DNA, 22 bp, Homo sapiens
ttcctgcgcccttctcgcccgc

SEQ ID NO: 113788 - DNA, 22 bp, Homo sapiens
ggtgttgcagttgaagactggt

SEQ ID NO: 113789 - DNA, 22 bp, Homo sapiens
ttttccttcatatcccttatgt

SEQ ID NO: 113790 - DNA, 22 bp, Homo sapiens
tcagtgcagggtgggagagaga

SEQ ID NO: 113791 - DNA, 22 bp, Homo sapiens
gctgctctccaagcctccttga

SEQ ID NO: 113792 - DNA, 22 bp, Homo sapiens
gaaagagaacctgggcctagat

SEQ ID NO: 113793 - DNA, 22 bp, Homo sapiens
ttattagagtgctttgagaaag

SEQ ID NO: 113794 - DNA, 22 bp, Homo sapiens
caaagtgctaggattataggtg

SEQ ID NO: 113795 - DNA, 22 bp, Homo sapiens
cacccaggctggagagcagtgg

SEQ ID NO: 113796 - DNA, 22 bp, Homo sapiens
gtgctcatagatgatgctcttt

SEQ ID NO: 113797 - DNA, 22 bp, Homo sapiens
gagtggggggtccgtctcagtg

SEQ ID NO: 113798 - DNA, 22 bp, Homo sapiens
agatttggtgtctggttgatat

SEQ ID NO: 113799 - DNA, 22 bp, Homo sapiens
ggtgacagtggttaaaatttgt

SEQ ID NO: 113800 - DNA, 22 bp, Homo sapiens
tcaggaggtccgcccgggaggg

SEQ ID NO: 113801 - DNA, 22 bp, Homo sapiens
gggcaccttgggtctcaggcaa

SEQ ID NO: 113802 - DNA, 22 bp, Homo sapiens
cattggctcctgtgggacatga

SEQ ID NO: 113803 - DNA, 22 bp, Homo sapiens
cggaagagggacagcgccagcc

SEQ ID NO: 113804 - DNA, 22 bp, Homo sapiens
ccaggtgtgctctgcagtggat

SEQ ID NO: 113805 - DNA, 22 bp, Homo sapiens
cccaggaggcctgcctggccgg

SEQ ID NO: 113806 - DNA, 22 bp, Homo sapiens
tgaagcaaattgtttagcctga

SEQ ID NO: 113807 - DNA, 22 bp, Homo sapiens
caagaatcaacattatttagtg

SEQ ID NO: 113808 - DNA, 22 bp, Homo sapiens
attctaaatcagagagctctgt

SEQ ID NO: 113809 - DNA, 22 bp, Homo sapiens
aggccttaccatagctgtagca

SEQ ID NO: 113810 - DNA, 22 bp, Homo sapiens
gccatcatatcccctgtgacct

SEQ ID NO: 113811 - DNA, 22 bp, Homo sapiens
gtgcacttgatctagacagatt

SEQ ID NO: 113812 - DNA, 22 bp, Homo sapiens
ataaaaactgacccatcctttg

SEQ ID NO: 113813 - DNA, 22 bp, Homo sapiens
ggtgtcagactttgcatatcct

SEQ ID NO: 113814 - DNA, 19 bp, Homo sapiens
acccagcccaggagtggca

SEQ ID NO: 113815 - DNA, 22 bp, Homo sapiens
ttatagcagcatgatttacaat

SEQ ID NO: 113816 - DNA, 22 bp, Homo sapiens
aaggccttgccgaaggatgcca

SEQ ID NO: 113817 - DNA, 22 bp, Homo sapiens
agggaaattaatgtgagcaatg

SEQ ID NO: 113818 - DNA, 22 bp, Homo sapiens
aggcaggaaaatcgcttgaacc

SEQ ID NO: 113819 - DNA, 22 bp, Homo sapiens
ctcactgcaagctctgcctcca

SEQ ID NO: 113820 - DNA, 22 bp, Homo sapiens
cccaggaggtcaaggctgcagt

SEQ ID NO: 113821 - DNA, 22 bp, Homo sapiens
cggtctcccgtgtgtgtgcgct

SEQ ID NO: 113822 - DNA, 22 bp, Homo sapiens
tccacagtggttgaactagtaa

SEQ ID NO: 113823 - DNA, 19 bp, Homo sapiens
aggctaaagagtcttgcgt

SEQ ID NO: 113824 - DNA, 22 bp, Homo sapiens
ggcctgcctcacagtcagcacc

SEQ ID NO: 113825 - DNA, 22 bp, Homo sapiens
gctctgagtcacactgccctgt

SEQ ID NO: 113826 - DNA, 22 bp, Homo sapiens
ccagatatcactgccgtgttgt

SEQ ID NO: 113827 - DNA, 22 bp, Homo sapiens
caaggtgccatgctgggcgggg

SEQ ID NO: 113828 - DNA, 22 bp, Homo sapiens
cacaaaccttctgcagcctgta

SEQ ID NO: 113829 - DNA, 22 bp, Homo sapiens
gcgccccatctacagtactttt

SEQ ID NO: 113830 - DNA, 19 bp, Homo sapiens
agcggttctcaaagtcagg

SEQ ID NO: 113831 - DNA, 22 bp, Homo sapiens
ccattgtaaattctgtggaagt

SEQ ID NO: 113832 - DNA, 22 bp, Homo sapiens
tagcagaagttgcaaactaggg

SEQ ID NO: 113833 - DNA, 21 bp, Homo sapiens
gccatttcacacagacatttg

SEQ ID NO: 113834 - DNA, 22 bp, Homo sapiens
agaagcctgttgagagggccgt

SEQ ID NO: 113835 - DNA, 22 bp, Homo sapiens
aggtcacccgtttgactatcca

SEQ ID NO: 113836 - DNA, 23 bp, Homo sapiens
ggggcctgcaccggtctgcgcgg

SEQ ID NO: 113837 - DNA, 22 bp, Homo sapiens
gcagcgaggtgatgaaatagct

SEQ ID NO: 113838 - DNA, 22 bp, Homo sapiens
ggtttgacagcttggggctgtc

SEQ ID NO: 113839 - DNA, 22 bp, Homo sapiens
gctgtctcatacaaggccctgc

SEQ ID NO: 113840 - DNA, 22 bp, Homo sapiens
aatggaatacctaggtggccca

SEQ ID NO: 113841 - DNA, 23 bp, Homo sapiens
ctcaccaagcgccgccgctgtgt

SEQ ID NO: 113842 - DNA, 22 bp, Homo sapiens
gtgccgcgacgcagtcggtgcc

SEQ ID NO: 113843 - DNA, 22 bp, Homo sapiens
tctaattttggcattttaacct

SEQ ID NO: 113844 - DNA, 22 bp, Homo sapiens
tcactgcaacctctgcctgcca

SEQ ID NO: 113845 - DNA, 22 bp, Homo sapiens
caggagctcagatgacatctca

SEQ ID NO: 113846 - DNA, 22 bp, Homo sapiens
aggaaataagggacaagacaaa

SEQ ID NO: 113847 - DNA, 22 bp, Homo sapiens
gaagcgcggcgtcggcgtgggt

SEQ ID NO: 113848 - DNA, 22 bp, Homo sapiens
tgccaggcgtggtggtgcgcac

SEQ ID NO: 113849 - DNA, 22 bp, Homo sapiens
gctcactgcaacctccacctcc

SEQ ID NO: 113850 - DNA, 22 bp, Homo sapiens
gcaggcagaggtggaggagaca

SEQ ID NO: 113851 - DNA, 22 bp, Homo sapiens
tgggtgtgtccatattttgact

SEQ ID NO: 113852 - DNA, 22 bp, Homo sapiens
cagcagcattgctctggattcc

SEQ ID NO: 113853 - DNA, 22 bp, Homo sapiens
gctccctggtagccatgctctc

SEQ ID NO: 113854 - DNA, 22 bp, Homo sapiens
aagcacaatgaacatcttagat

SEQ ID NO: 113855 - DNA, 22 bp, Homo sapiens
ccagcagccaccttctcgaaat

SEQ ID NO: 113856 - DNA, 22 bp, Homo sapiens
ggtcagaggtcccagaagaagc

SEQ ID NO: 113857 - DNA, 22 bp, Homo sapiens
tagttctagggcatcatcccag

SEQ ID NO: 113858 - DNA, 22 bp, Homo sapiens
caaagctggaaaaggaggctgg

SEQ ID NO: 113859 - DNA, 22 bp, Homo sapiens
ggggaccctcaggactgcgtct

SEQ ID NO: 113860 - DNA, 22 bp, Homo sapiens
ctgcgtgcatgtctgcgtgcat

SEQ ID NO: 113861 - DNA, 22 bp, Homo sapiens
tactttaatatatgtgaagttc

SEQ ID NO: 113862 - DNA, 22 bp, Homo sapiens
cactgcaacctccacctcctgg

SEQ ID NO: 113863 - DNA, 22 bp, Homo sapiens
aaggaaagctgtggttctgaga

SEQ ID NO: 113864 - DNA, 22 bp, Homo sapiens
ggtgacggggcccaggtttcct

SEQ ID NO: 113865 - DNA, 23 bp, Homo sapiens
ggctgggagctccgggtgcacgt

SEQ ID NO: 113866 - DNA, 22 bp, Homo sapiens
tgaacgcaggtccacatggctc

SEQ ID NO: 113867 - DNA, 22 bp, Homo sapiens
atcagagtgtaagttctttcct

SEQ ID NO: 113868 - DNA, 22 bp, Homo sapiens
tgaggcaggagttcaggctgcg

SEQ ID NO: 113869 - DNA, 22 bp, Homo sapiens
gcctggattccttgtttctcag

SEQ ID NO: 113870 - DNA, 22 bp, Homo sapiens
tcttggattttaatggatcaaa

SEQ ID NO: 113871 - DNA, 22 bp, Homo sapiens
gggcagcagccactcatttagc

SEQ ID NO: 113872 - DNA, 22 bp, Homo sapiens
tggattcacaccattctcctgc

SEQ ID NO: 113873 - DNA, 22 bp, Homo sapiens
cccccaaagtttgcacggataa

SEQ ID NO: 113874 - DNA, 23 bp, Homo sapiens
gtctctagagtgtggagcaaaga

SEQ ID NO: 113875 - DNA, 22 bp, Homo sapiens
aaaatatgtataactcttctgc

SEQ ID NO: 113876 - DNA, 22 bp, Homo sapiens
tctggtgtcagtattctttgaa

SEQ ID NO: 113877 - DNA, 22 bp, Homo sapiens
tcgcccagctcatctcccacaa

SEQ ID NO: 113878 - DNA, 22 bp, Homo sapiens
tctgtcacccagagtgcagtgg

SEQ ID NO: 113879 - DNA, 22 bp, Homo sapiens
caatccatcaattacacaggct

SEQ ID NO: 113880 - DNA, 22 bp, Homo sapiens
tcatggggccacagctgccagc

SEQ ID NO: 113881 - DNA, 22 bp, Homo sapiens
ggctgagttgagaggattactt

SEQ ID NO: 113882 - DNA, 22 bp, Homo sapiens
tgccagctgcttgtcccccaca

SEQ ID NO: 113883 - DNA, 22 bp, Homo sapiens
caggcagggagctggaaaggat

SEQ ID NO: 113884 - DNA, 22 bp, Homo sapiens
tcttcatgtcatggtatattga

SEQ ID NO: 113885 - DNA, 22 bp, Homo sapiens
ggcaaaaagttcccatcagtgt

SEQ ID NO: 113886 - DNA, 22 bp, Homo sapiens
tgtccagatcaatgcccacatg

SEQ ID NO: 113887 - DNA, 19 bp, Homo sapiens
caggcctcttaccctctct

SEQ ID NO: 113888 - DNA, 22 bp, Homo sapiens
catggcagctcctccagtgtga

SEQ ID NO: 113889 - DNA, 22 bp, Homo sapiens
ttcttttaattgtgggggagtg

SEQ ID NO: 113890 - DNA, 22 bp, Homo sapiens
tccgatgcttccagggccacct

SEQ ID NO: 113891 - DNA, 22 bp, Homo sapiens
atgggtaaagcaggaagagagt

SEQ ID NO: 113892 - DNA, 22 bp, Homo sapiens
ccagttccagtgctcacatcca

SEQ ID NO: 113893 - DNA, 22 bp, Homo sapiens
aagatattcaaagatttattag

SEQ ID NO: 113894 - DNA, 22 bp, Homo sapiens
ctcttcctagtgtgcagcgtgg

SEQ ID NO: 113895 - DNA, 22 bp, Homo sapiens
cacgggagacgtgatcttggac

SEQ ID NO: 113896 - DNA, 22 bp, Homo sapiens
gagcacagtaaagcagtgtcac

SEQ ID NO: 113897 - DNA, 22 bp, Homo sapiens
agagcacagccaccatttacaa

SEQ ID NO: 113898 - DNA, 23 bp, Homo sapiens
agcaatctgtgtttcagcaagcc

SEQ ID NO: 113899 - DNA, 22 bp, Homo sapiens
gggtggtggccagcagtgggca

SEQ ID NO: 113900 - DNA, 22 bp, Homo sapiens
tgtttcttacgtttttagaggc

SEQ ID NO: 113901 - DNA, 22 bp, Homo sapiens
ctgagctcacgccattctcctt

SEQ ID NO: 113902 - DNA, 22 bp, Homo sapiens
tttaatcaggcaaagcataata

SEQ ID NO: 113903 - DNA, 22 bp, Homo sapiens
gggccggagctgggtcccgcgc

SEQ ID NO: 113904 - DNA, 22 bp, Homo sapiens
gtgtggtcgaagttctcccgga

SEQ ID NO: 113905 - DNA, 22 bp, Homo sapiens
ggcaaggggtcaggctgagaca

SEQ ID NO: 113906 - DNA, 22 bp, Homo sapiens
atgtatacgtgcaggtcacagg

SEQ ID NO: 113907 - DNA, 22 bp, Homo sapiens
aggggtgacacatatcagtgca

SEQ ID NO: 113908 - DNA, 19 bp, Homo sapiens
gggcttggggctgaagcct

SEQ ID NO: 113909 - DNA, 22 bp, Homo sapiens
tctgctggaaaaccagggaatt

SEQ ID NO: 113910 - DNA, 22 bp, Homo sapiens
aaggttcctctctccacccagc

SEQ ID NO: 113911 - DNA, 22 bp, Homo sapiens
atcaagtgaagggctcttgaag

SEQ ID NO: 113912 - DNA, 22 bp, Homo sapiens
acaggggacctaggaccctcgg

SEQ ID NO: 113913 - DNA, 22 bp, Homo sapiens
agggccagcactcctggcagga

SEQ ID NO: 113914 - DNA, 22 bp, Homo sapiens
agcttgtgtttttctaagtatc

SEQ ID NO: 113915 - DNA, 22 bp, Homo sapiens
atagaatatgacttttagatcc

SEQ ID NO: 113916 - DNA, 22 bp, Homo sapiens
cggagcctgcttgttgcagctg

SEQ ID NO: 113917 - DNA, 22 bp, Homo sapiens
acaggatcgccctgttgcccag

SEQ ID NO: 113918 - DNA, 22 bp, Homo sapiens
tgaactcctgacctcatgatcc

SEQ ID NO: 113919 - DNA, 22 bp, Homo sapiens
gaactttgcgcagttcccgggg

SEQ ID NO: 113920 - DNA, 22 bp, Homo sapiens
gaatgcagatggctggtgtatg

SEQ ID NO: 113921 - DNA, 22 bp, Homo sapiens
tagaacctccacaggacctcca

SEQ ID NO: 113922 - DNA, 22 bp, Homo sapiens
ggtgtagctctgtgtcccactg

SEQ ID NO: 113923 - DNA, 22 bp, Homo sapiens
gactacaggtgtgtgccaccat

SEQ ID NO: 113924 - DNA, 19 bp, Homo sapiens
atgtacccagtgtcaatcc

SEQ ID NO: 113925 - DNA, 22 bp, Homo sapiens
ttgacacagtcaacttgatttt

SEQ ID NO: 113926 - DNA, 22 bp, Homo sapiens
ggagttccagaccagactggcc

SEQ ID NO: 113927 - DNA, 22 bp, Homo sapiens
ttttatctgtgacatctggcag

SEQ ID NO: 113928 - DNA, 22 bp, Homo sapiens
attgtgtcctcattgaccttca

SEQ ID NO: 113929 - DNA, 22 bp, Homo sapiens
tcaagcaaagtttagctggtta

SEQ ID NO: 113930 - DNA, 19 bp, Homo sapiens
gactccaactttaagcatg

SEQ ID NO: 113931 - DNA, 22 bp, Homo sapiens
ctcattgcccagatccccacag

SEQ ID NO: 113932 - DNA, 22 bp, Homo sapiens
tagcccctgcctttgaacctgg

SEQ ID NO: 113933 - DNA, 22 bp, Homo sapiens
ccagagtcccttgcagctcagt

SEQ ID NO: 113934 - DNA, 22 bp, Homo sapiens
acaactttgacccttgttctta

SEQ ID NO: 113935 - DNA, 22 bp, Homo sapiens
cccattgtggttgttgaggata

SEQ ID NO: 113936 - DNA, 22 bp, Homo sapiens
aataaacaaatccttccttccc

SEQ ID NO: 113937 - DNA, 22 bp, Homo sapiens
actacagtgtgataagaggggc

SEQ ID NO: 113938 - DNA, 22 bp, Homo sapiens
ctgccctggggggcctccttgc

SEQ ID NO: 113939 - DNA, 22 bp, Homo sapiens
tgtgtcagaaggcaatggggat

SEQ ID NO: 113940 - DNA, 22 bp, Homo sapiens
cctggggccccgagccagaagc

SEQ ID NO: 113941 - DNA, 22 bp, Homo sapiens
cctgagagcattccacactgaa

SEQ ID NO: 113942 - DNA, 22 bp, Homo sapiens
gagagcaggaggcagcgggacg

SEQ ID NO: 113943 - DNA, 22 bp, Homo sapiens
agtgttgtcaaacggctcagca

SEQ ID NO: 113944 - DNA, 22 bp, Homo sapiens
tgaaatgtgttctagtgttttg

SEQ ID NO: 113945 - DNA, 22 bp, Homo sapiens
tagactagaggatcagcaaggg

SEQ ID NO: 113946 - DNA, 22 bp, Homo sapiens
tagcagcaaagcaggatctgct

SEQ ID NO: 113947 - DNA, 22 bp, Homo sapiens
tgctccagcaccaagagctcca

SEQ ID NO: 113948 - DNA, 22 bp, Homo sapiens
gcgagggcacgcggttgaaggc

SEQ ID NO: 113949 - DNA, 21 bp, Homo sapiens
ggcctcccggaccgcagcgcc

SEQ ID NO: 113950 - DNA, 21 bp, Homo sapiens
acatggactgtgaatggggac

SEQ ID NO: 113951 - DNA, 22 bp, Homo sapiens
cacttgttggtggtgaaatcac

SEQ ID NO: 113952 - DNA, 22 bp, Homo sapiens
taggccacagagaggagatttc

SEQ ID NO: 113953 - DNA, 20 bp, Homo sapiens
tctgccacgtctggtgactg

SEQ ID NO: 113954 - DNA, 22 bp, Homo sapiens
agttgttcgtggtggattcgct

SEQ ID NO: 113955 - DNA, 18 bp, Homo sapiens
ggtgagggagctggaagc

SEQ ID NO: 113956 - DNA, 20 bp, Homo sapiens
tgtttgtgtggggccttggc

SEQ ID NO: 113957 - DNA, 22 bp, Homo sapiens
cgccaggcttggtagctcatgc

SEQ ID NO: 113958 - DNA, 22 bp, Homo sapiens
aagccaggttccatggaggagc

SEQ ID NO: 113959 - DNA, 22 bp, Homo sapiens
cccaggagttggaggctgcagt

SEQ ID NO: 113960 - DNA, 22 bp, Homo sapiens
tgtgtcccttggaacctcagct

SEQ ID NO: 113961 - DNA, 22 bp, Homo sapiens
agtggcctggagccccgcctgg

SEQ ID NO: 113962 - DNA, 22 bp, Homo sapiens
tagggcaatatttcccagaaaa

SEQ ID NO: 113963 - DNA, 22 bp, Homo sapiens
actgttgaagtgccagcttgat

SEQ ID NO: 113964 - DNA, 22 bp, Homo sapiens
cactgcacttcagcctgggtga

SEQ ID NO: 113965 - DNA, 22 bp, Homo sapiens
agctgattccactttttcccca

SEQ ID NO: 113966 - DNA, 22 bp, Homo sapiens
tgtaatattgtagtgacagtac

SEQ ID NO: 113967 - DNA, 22 bp, Homo sapiens
aggagctgtcagagtgccagag

SEQ ID NO: 113968 - DNA, 22 bp, Homo sapiens
ccttttatagatcagtgtgtta

SEQ ID NO: 113969 - DNA, 22 bp, Homo sapiens
tatgttgcaccaacctaataat

SEQ ID NO: 113970 - DNA, 22 bp, Homo sapiens
ttctagtgtccttggacttgct

SEQ ID NO: 113971 - DNA, 22 bp, Homo sapiens
tatcttaaaaatcgaagcagat

SEQ ID NO: 113972 - DNA, 22 bp, Homo sapiens
gggttactgcttcaaaaaatta

SEQ ID NO: 113973 - DNA, 22 bp, Homo sapiens
tctgacattagattaattggaa

SEQ ID NO: 113974 - DNA, 22 bp, Homo sapiens
tgtgcatgtgtctttatagtag

SEQ ID NO: 113975 - DNA, 22 bp, Homo sapiens
ccctcccaggagtggccagaga

SEQ ID NO: 113976 - DNA, 23 bp, Homo sapiens
ggcccccggaacgctctgtgacc

SEQ ID NO: 113977 - DNA, 22 bp, Homo sapiens
ggagagtggattccagctgtat

SEQ ID NO: 113978 - DNA, 22 bp, Homo sapiens
gctcaagccttctgcccacctc

SEQ ID NO: 113979 - DNA, 22 bp, Homo sapiens
aaagaaatagatggcatttaaa

SEQ ID NO: 113980 - DNA, 22 bp, Homo sapiens
ggtgaggggctcctctgcccgg

SEQ ID NO: 113981 - DNA, 22 bp, Homo sapiens
ggcaagagggcagatggagtgc

SEQ ID NO: 113982 - DNA, 18 bp, Homo sapiens
tgggaatgctcaaggccc

SEQ ID NO: 113983 - DNA, 22 bp, Homo sapiens
atagagtgatgtaaggtatgtg

SEQ ID NO: 113984 - DNA, 22 bp, Homo sapiens
cttttcattgtttgtacatgca

SEQ ID NO: 113985 - DNA, 22 bp, Homo sapiens
aatgagatggaattcccgccta

SEQ ID NO: 113986 - DNA, 22 bp, Homo sapiens
aaggagcgcttagggggcagaa

SEQ ID NO: 113987 - DNA, 22 bp, Homo sapiens
ccaaagtgctaggattacaggt

SEQ ID NO: 113988 - DNA, 19 bp, Homo sapiens
cttgaaactactgttgaga

SEQ ID NO: 113989 - DNA, 23 bp, Homo sapiens
cagagctggctcagagctgcctg

SEQ ID NO: 113990 - DNA, 22 bp, Homo sapiens
aggcaggaggatcatggatgca

SEQ ID NO: 113991 - DNA, 22 bp, Homo sapiens
cggggttcatccatgctgtggc

SEQ ID NO: 113992 - DNA, 22 bp, Homo sapiens
ggctgccttccctgagccccgg

SEQ ID NO: 113993 - DNA, 20 bp, Homo sapiens
aggaaaaatggaaactggag

SEQ ID NO: 113994 - DNA, 22 bp, Homo sapiens
gggagctgagctggaagagaat

SEQ ID NO: 113995 - DNA, 22 bp, Homo sapiens
ctgaggctggagtgcagtggtg

SEQ ID NO: 113996 - DNA, 18 bp, Homo sapiens
tccctcagaattatagaa

SEQ ID NO: 113997 - DNA, 22 bp, Homo sapiens
acacttggctctgagtcactac

SEQ ID NO: 113998 - DNA, 22 bp, Homo sapiens
accctaataatcacagactagt

SEQ ID NO: 113999 - DNA, 20 bp, Homo sapiens
agacaccccctgacagggaa

SEQ ID NO: 114000 - DNA, 22 bp, Homo sapiens
cccatttcttgagttcagctct

SEQ ID NO: 114001 - DNA, 22 bp, Homo sapiens
tgaagaaacgcagagaggtagg

SEQ ID NO: 114002 - DNA, 21 bp, Homo sapiens
tgactgaggcttcttcacaca

SEQ ID NO: 114003 - DNA, 22 bp, Homo sapiens
ttattttaccttcctctgagct

SEQ ID NO: 114004 - DNA, 20 bp, Homo sapiens
gagattaactgagaatctag

SEQ ID NO: 114005 - DNA, 22 bp, Homo sapiens
accttcaggtgagcacacagat

SEQ ID NO: 114006 - DNA, 22 bp, Homo sapiens
tcagccagccagctacaggctt

SEQ ID NO: 114007 - DNA, 22 bp, Homo sapiens
aggattgtgcctccagtcagaa

SEQ ID NO: 114008 - DNA, 22 bp, Homo sapiens
ttaggcaattttgtcattgtgt

SEQ ID NO: 114009 - DNA, 20 bp, Homo sapiens
ttgagcttttagtacagaca

SEQ ID NO: 114010 - DNA, 22 bp, Homo sapiens
aagatacagacagagccaaaat

SEQ ID NO: 114011 - DNA, 20 bp, Homo sapiens
gccactgggcaccagcaggg

SEQ ID NO: 114012 - DNA, 22 bp, Homo sapiens
agggttcagtgaggtgtactcc

SEQ ID NO: 114013 - DNA, 22 bp, Homo sapiens
atttacaggtagaattttaagt

SEQ ID NO: 114014 - DNA, 22 bp, Homo sapiens
tgcctctgaggaagattgtgtt

SEQ ID NO: 114015 - DNA, 23 bp, Homo sapiens
tgcaatggcatgatttcagctca

SEQ ID NO: 114016 - DNA, 22 bp, Homo sapiens
tcacattttcaaaagctggtgc

SEQ ID NO: 114017 - DNA, 22 bp, Homo sapiens
tatgtttggcctggcaatttca

SEQ ID NO: 114018 - DNA, 22 bp, Homo sapiens
gctaggttggggaagttctcct

SEQ ID NO: 114019 - DNA, 22 bp, Homo sapiens
ctgggcctggggctgttgagag

SEQ ID NO: 114020 - DNA, 22 bp, Homo sapiens
atcagagtagttgttgcccaga

SEQ ID NO: 114021 - DNA, 22 bp, Homo sapiens
ccacactccccgcaggcgtagg

SEQ ID NO: 114022 - DNA, 22 bp, Homo sapiens
cgtgtggtcccggcaaggcaag

SEQ ID NO: 114023 - DNA, 22 bp, Homo sapiens
ctgccgtgtttttcatgttaaa

SEQ ID NO: 114024 - DNA, 22 bp, Homo sapiens
tcatctccatacggtctcgcag

SEQ ID NO: 114025 - DNA, 22 bp, Homo sapiens
taactaggattacaagcgtgcg

SEQ ID NO: 114026 - DNA, 22 bp, Homo sapiens
tgttggagcccgagtcagggag

SEQ ID NO: 114027 - DNA, 18 bp, Homo sapiens
cagggctgtggggtcact

SEQ ID NO: 114028 - DNA, 22 bp, Homo sapiens
attgcactccggcctgggtgac

SEQ ID NO: 114029 - DNA, 22 bp, Homo sapiens
caggctggagtacaattgtgtg

SEQ ID NO: 114030 - DNA, 22 bp, Homo sapiens
ctaggtgatccactgctctctt

SEQ ID NO: 114031 - DNA, 22 bp, Homo sapiens
ggtaccaccaattcagctgcca

SEQ ID NO: 114032 - DNA, 22 bp, Homo sapiens
tgggtactcctattagttcagt

SEQ ID NO: 114033 - DNA, 22 bp, Homo sapiens
aagtcgtggcaggcttgcacga

SEQ ID NO: 114034 - DNA, 22 bp, Homo sapiens
gggcagagagctggaactcctt

SEQ ID NO: 114035 - DNA, 22 bp, Homo sapiens
ctggagagaatgtggaatgatt

SEQ ID NO: 114036 - DNA, 22 bp, Homo sapiens
aaccaccattctctcctcttcc

SEQ ID NO: 114037 - DNA, 16 bp, Homo sapiens
aggtggagaagttcac

SEQ ID NO: 114038 - DNA, 22 bp, Homo sapiens
cagaggctggcggccgccccga

SEQ ID NO: 114039 - DNA, 22 bp, Homo sapiens
agcgccgcccctgctggtgttg

SEQ ID NO: 114040 - DNA, 22 bp, Homo sapiens
tggggtacttgtatcaaagcac

SEQ ID NO: 114041 - DNA, 22 bp, Homo sapiens
atgttattgatgcctgaggctt

SEQ ID NO: 114042 - DNA, 22 bp, Homo sapiens
aggccagcctcaggcagggacc

SEQ ID NO: 114043 - DNA, 22 bp, Homo sapiens
tcacttcccagacggggtggca

SEQ ID NO: 114044 - DNA, 22 bp, Homo sapiens
ctcattgcaacctccgcctccc

SEQ ID NO: 114045 - DNA, 22 bp, Homo sapiens
agaaaatttaaagagacacaca

SEQ ID NO: 114046 - DNA, 22 bp, Homo sapiens
gggttggatcctggtggctgcc

SEQ ID NO: 114047 - DNA, 22 bp, Homo sapiens
gctgccaatccagctgtgggag

SEQ ID NO: 114048 - DNA, 22 bp, Homo sapiens
tctcagctcatggcagccttga

SEQ ID NO: 114049 - DNA, 18 bp, Homo sapiens
tggttccttgaaggggca

SEQ ID NO: 114050 - DNA, 22 bp, Homo sapiens
tcacttagatggggatcatcac

SEQ ID NO: 114051 - DNA, 22 bp, Homo sapiens
caggaagaccagggctgtggct

SEQ ID NO: 114052 - DNA, 22 bp, Homo sapiens
cattgcactccagcctgggcca

SEQ ID NO: 114053 - DNA, 22 bp, Homo sapiens
ctgggggcagcaagaagccatg

SEQ ID NO: 114054 - DNA, 22 bp, Homo sapiens
tggcatttgagctggaaggatg

SEQ ID NO: 114055 - DNA, 22 bp, Homo sapiens
tgttttaagctctagaagggga

SEQ ID NO: 114056 - DNA, 20 bp, Homo sapiens
tgcagcacgggccctttcca

SEQ ID NO: 114057 - DNA, 22 bp, Homo sapiens
tgtgtgattgcaggagatgtgg

SEQ ID NO: 114058 - DNA, 22 bp, Homo sapiens
gctgggctgcgtcggggaagcc

SEQ ID NO: 114059 - DNA, 22 bp, Homo sapiens
attctggacaaggcaagctcct

SEQ ID NO: 114060 - DNA, 22 bp, Homo sapiens
aggccagcctgcccaaagctgc

SEQ ID NO: 114061 - DNA, 22 bp, Homo sapiens
cactgcactccagcactccagc

SEQ ID NO: 114062 - DNA, 22 bp, Homo sapiens
tctgttgcaatgtgcatggtga

SEQ ID NO: 114063 - DNA, 22 bp, Homo sapiens
gtgctggggagataggaagaga

SEQ ID NO: 114064 - DNA, 22 bp, Homo sapiens
ctcctctttagccccagctgga

SEQ ID NO: 114065 - DNA, 22 bp, Homo sapiens
ctgggctcaagtgatccaccca

SEQ ID NO: 114066 - DNA, 22 bp, Homo sapiens
tacatagctcctagtgatgcat

SEQ ID NO: 114067 - DNA, 22 bp, Homo sapiens
tgggagaaagaaccctgagtga

SEQ ID NO: 114068 - DNA, 18 bp, Homo sapiens
acgtgctgtgccttttgc

SEQ ID NO: 114069 - DNA, 22 bp, Homo sapiens
gtggagagagataagcctggtc

SEQ ID NO: 114070 - DNA, 22 bp, Homo sapiens
tgggcaggggccctgcttccgt

SEQ ID NO: 114071 - DNA, 22 bp, Homo sapiens
acagttaataagtagtaagtca

SEQ ID NO: 114072 - DNA, 22 bp, Homo sapiens
tccataaattttatgaacatat

SEQ ID NO: 114073 - DNA, 22 bp, Homo sapiens
ctagggtcaggggcctgcgtcg

SEQ ID NO: 114074 - DNA, 18 bp, Homo sapiens
aggcttacagcagcaggc

SEQ ID NO: 114075 - DNA, 22 bp, Homo sapiens
aggaggggttctcgggtgctga

SEQ ID NO: 114076 - DNA, 22 bp, Homo sapiens
cagggtgacaagtggcaaggag

SEQ ID NO: 114077 - DNA, 22 bp, Homo sapiens
cgagagttagctaggagtcaca

SEQ ID NO: 114078 - DNA, 22 bp, Homo sapiens
ccttttgctctcccatccagaa

SEQ ID NO: 114079 - DNA, 22 bp, Homo sapiens
gcgctgcgcctcctcttccgca

SEQ ID NO: 114080 - DNA, 22 bp, Homo sapiens
ttcctagggcagagccgctggg

SEQ ID NO: 114081 - DNA, 22 bp, Homo sapiens
atgttgtgtttgactgttaccc

SEQ ID NO: 114082 - DNA, 22 bp, Homo sapiens
atgatgtaaaataagttgtgag

SEQ ID NO: 114083 - DNA, 22 bp, Homo sapiens
gaggccaaggtgggcagatcac

SEQ ID NO: 114084 - DNA, 22 bp, Homo sapiens
gtgcatgtgtctttatagtagc

SEQ ID NO: 114085 - DNA, 20 bp, Homo sapiens
ggggaagtcactgcagtcag

SEQ ID NO: 114086 - DNA, 22 bp, Homo sapiens
tgcagtggcgccatctcagctc

SEQ ID NO: 114087 - DNA, 21 bp, Homo sapiens
aaactgaccttgcctgagaca

SEQ ID NO: 114088 - DNA, 22 bp, Homo sapiens
tgtttcctttctggtgagcata

SEQ ID NO: 114089 - DNA, 22 bp, Homo sapiens
aagtttgtgtagtttagcatcc

SEQ ID NO: 114090 - DNA, 22 bp, Homo sapiens
ccaagggcgcctccgttccccc

SEQ ID NO: 114091 - DNA, 22 bp, Homo sapiens
attggtggtgaggacatgccag

SEQ ID NO: 114092 - DNA, 22 bp, Homo sapiens
atcttcccaggctggggagagg

SEQ ID NO: 114093 - DNA, 22 bp, Homo sapiens
ttggatccatctcaggcatagg

SEQ ID NO: 114094 - DNA, 22 bp, Homo sapiens
tgtgggagaaggaagcaagctg

SEQ ID NO: 114095 - DNA, 22 bp, Homo sapiens
tgcctactagtactattttgtg

SEQ ID NO: 114096 - DNA, 22 bp, Homo sapiens
ggcttagcaactcctgaggctc

SEQ ID NO: 114097 - DNA, 22 bp, Homo sapiens
cccttagaattttgtagttatt

SEQ ID NO: 114098 - DNA, 23 bp, Homo sapiens
actgagccagggcctgggtcagc

SEQ ID NO: 114099 - DNA, 22 bp, Homo sapiens
ctgagctcaagcgatcctccca

SEQ ID NO: 114100 - DNA, 22 bp, Homo sapiens
tgatctaggttggcttcaactg

SEQ ID NO: 114101 - DNA, 23 bp, Homo sapiens
gtgcatgtgtctttacagtagca

SEQ ID NO: 114102 - DNA, 22 bp, Homo sapiens
tagatacctgctggacctcatt

SEQ ID NO: 114103 - DNA, 22 bp, Homo sapiens
gttgcctaggctggagtgcagt

SEQ ID NO: 114104 - DNA, 22 bp, Homo sapiens
aatggtttctgaagttaggcag

SEQ ID NO: 114105 - DNA, 22 bp, Homo sapiens
gccagatttacagatttgccct

SEQ ID NO: 114106 - DNA, 22 bp, Homo sapiens
tcccggcgctgggaggtgggtc

SEQ ID NO: 114107 - DNA, 22 bp, Homo sapiens
taggctgggaagaaagattctc

SEQ ID NO: 114108 - DNA, 22 bp, Homo sapiens
tatgttaacatgttaggaactg

SEQ ID NO: 114109 - DNA, 22 bp, Homo sapiens
taaatgttttgtgggttgagtt

SEQ ID NO: 114110 - DNA, 20 bp, Homo sapiens
gaaatgtacacattaccaca

SEQ ID NO: 114111 - DNA, 21 bp, Homo sapiens
agtagtttagcacagggtttg

SEQ ID NO: 114112 - DNA, 22 bp, Homo sapiens
agcctggtttaagcattttata

SEQ ID NO: 114113 - DNA, 22 bp, Homo sapiens
ctgtctgaatcctaagcttcct

SEQ ID NO: 114114 - DNA, 22 bp, Homo sapiens
tcatcataatatggaatcttgt

SEQ ID NO: 114115 - DNA, 22 bp, Homo sapiens
aagagggaaattgttggctgct

SEQ ID NO: 114116 - DNA, 22 bp, Homo sapiens
agctacctgatccttcttctga

SEQ ID NO: 114117 - DNA, 22 bp, Homo sapiens
catcaagtaggtcctttcaaga

SEQ ID NO: 114118 - DNA, 22 bp, Homo sapiens
tgagagcaacacgcagtagtat

SEQ ID NO: 114119 - DNA, 23 bp, Homo sapiens
aattatctatttcaaatttagca

SEQ ID NO: 114120 - DNA, 22 bp, Homo sapiens
cactgcactccagcctgggtca

SEQ ID NO: 114121 - DNA, 21 bp, Homo sapiens
ggagtttttctggaagggact

SEQ ID NO: 114122 - DNA, 22 bp, Homo sapiens
aaagtgctgggattacaagtgt

SEQ ID NO: 114123 - DNA, 22 bp, Homo sapiens
ccaggcaggcgatggtgcagtg

SEQ ID NO: 114124 - DNA, 22 bp, Homo sapiens
cggctggtgtcgggcacagcaa

SEQ ID NO: 114125 - DNA, 22 bp, Homo sapiens
ttccaactttgtcatatattat

SEQ ID NO: 114126 - DNA, 22 bp, Homo sapiens
gtagggctcagtaaatactttg

SEQ ID NO: 114127 - DNA, 22 bp, Homo sapiens
gaggctggacgtgcatttctac

SEQ ID NO: 114128 - DNA, 22 bp, Homo sapiens
agacgcggtggtgcatgcctgt

SEQ ID NO: 114129 - DNA, 22 bp, Homo sapiens
caattgtcagtgctgtttaaat

SEQ ID NO: 114130 - DNA, 22 bp, Homo sapiens
gtgagaaatgacaaatgtgtcg

SEQ ID NO: 114131 - DNA, 22 bp, Homo sapiens
tacaccattcccaggtggattt

SEQ ID NO: 114132 - DNA, 22 bp, Homo sapiens
agttgagggtgggagagaaatg

SEQ ID NO: 114133 - DNA, 22 bp, Homo sapiens
cattgcacaccagcctgggcaa

SEQ ID NO: 114134 - DNA, 22 bp, Homo sapiens
atatattttttgagacagagtc

SEQ ID NO: 114135 - DNA, 22 bp, Homo sapiens
gtgctgacaggagcctggcggt

SEQ ID NO: 114136 - DNA, 22 bp, Homo sapiens
ttgaaattttaggccttgcaat

SEQ ID NO: 114137 - DNA, 22 bp, Homo sapiens
ccctgcctacagggttttcttt

SEQ ID NO: 114138 - DNA, 22 bp, Homo sapiens
gtaatctcagctacttgggagg

SEQ ID NO: 114139 - DNA, 22 bp, Homo sapiens
aaggagaaatggtagatgtgca

SEQ ID NO: 114140 - DNA, 22 bp, Homo sapiens
cagagctgtccaaaccctgaca

SEQ ID NO: 114141 - DNA, 22 bp, Homo sapiens
ggaggacaggggctgcagcaca

SEQ ID NO: 114142 - DNA, 19 bp, Homo sapiens
tctcaattctccccactgc

SEQ ID NO: 114143 - DNA, 22 bp, Homo sapiens
agagcccctgggtcacacagcc

SEQ ID NO: 114144 - DNA, 21 bp, Homo sapiens
tggtacaccttgcctgtcaga

SEQ ID NO: 114145 - DNA, 22 bp, Homo sapiens
tcataaattctggtgctgtgag

SEQ ID NO: 114146 - DNA, 22 bp, Homo sapiens
actgtactccagcctgggaaac

SEQ ID NO: 114147 - DNA, 22 bp, Homo sapiens
gaatcccttgcattatcccttt

SEQ ID NO: 114148 - DNA, 22 bp, Homo sapiens
aaaggctcagatgaggccctgg

SEQ ID NO: 114149 - DNA, 17 bp, Homo sapiens
catccgtgagctcggca

SEQ ID NO: 114150 - DNA, 17 bp, Homo sapiens
gggcagggactcctggg

SEQ ID NO: 114151 - DNA, 22 bp, Homo sapiens
taacagtatatttaccaaacct

SEQ ID NO: 114152 - DNA, 22 bp, Homo sapiens
ggggccgaccgcggttcaggcc

SEQ ID NO: 114153 - DNA, 22 bp, Homo sapiens
ttatttttaaaagttcacacag

SEQ ID NO: 114154 - DNA, 22 bp, Homo sapiens
taattataacatgctttctggc

SEQ ID NO: 114155 - DNA, 22 bp, Homo sapiens
tgatctttggtaatctggcaca

SEQ ID NO: 114156 - DNA, 18 bp, Homo sapiens
gcagtgaagaaagagctt

SEQ ID NO: 114157 - DNA, 22 bp, Homo sapiens
agacaaagaaaccgtagaagca

SEQ ID NO: 114158 - DNA, 21 bp, Homo sapiens
tgcaatccagcctgggcgaca

SEQ ID NO: 114159 - DNA, 22 bp, Homo sapiens
tggctcatttctaaacccagct

SEQ ID NO: 114160 - DNA, 22 bp, Homo sapiens
cagagcccctcgtctccaccac

SEQ ID NO: 114161 - DNA, 22 bp, Homo sapiens
gtatccatgggggattggttcc

SEQ ID NO: 114162 - DNA, 22 bp, Homo sapiens
ttcttctttccaattacatggt

SEQ ID NO: 114163 - DNA, 22 bp, Homo sapiens
aaagtgctgggattacaggtgt

SEQ ID NO: 114164 - DNA, 22 bp, Homo sapiens
aggaattgtgttgtagtggaga

SEQ ID NO: 114165 - DNA, 22 bp, Homo sapiens
gaaggaagtcattagtgcagac

SEQ ID NO: 114166 - DNA, 22 bp, Homo sapiens
catctgctgttccttggactca

SEQ ID NO: 114167 - DNA, 22 bp, Homo sapiens
agcccagaggctgggcgtgcat

SEQ ID NO: 114168 - DNA, 23 bp, Homo sapiens
cagtacaatgtggaaaaggagtg

SEQ ID NO: 114169 - DNA, 22 bp, Homo sapiens
ggggcaggagcccttcttcagc

SEQ ID NO: 114170 - DNA, 22 bp, Homo sapiens
cccacacacatttatgatagga

SEQ ID NO: 114171 - DNA, 22 bp, Homo sapiens
actgttttctgtaaagggccag

SEQ ID NO: 114172 - DNA, 22 bp, Homo sapiens
acaagcgggccacagtgctggt

SEQ ID NO: 114173 - DNA, 22 bp, Homo sapiens
ggcagggcaggaaagtcaggaa

SEQ ID NO: 114174 - DNA, 22 bp, Homo sapiens
actgtacctcaaactctggaac

SEQ ID NO: 114175 - DNA, 23 bp, Homo sapiens
atcattaacagtgcaggggtagg

SEQ ID NO: 114176 - DNA, 22 bp, Homo sapiens
ccaggagttggaggttgcagtg

SEQ ID NO: 114177 - DNA, 22 bp, Homo sapiens
tgacttcctgcactcaggtgat

SEQ ID NO: 114178 - DNA, 22 bp, Homo sapiens
agccgcaagaagtacagcagca

SEQ ID NO: 114179 - DNA, 22 bp, Homo sapiens
gagcccaggcagaggttgcagt

SEQ ID NO: 114180 - DNA, 21 bp, Homo sapiens
aggagcattgttgtggtggag

SEQ ID NO: 114181 - DNA, 22 bp, Homo sapiens
gcagagctcatgcctgcacctc

SEQ ID NO: 114182 - DNA, 22 bp, Homo sapiens
gctcttgtcaaaaattagttga

SEQ ID NO: 114183 - DNA, 22 bp, Homo sapiens
gctggaggatggactggaagaa

SEQ ID NO: 114184 - DNA, 22 bp, Homo sapiens
cccaggaggtcgaagctgcagt

SEQ ID NO: 114185 - DNA, 22 bp, Homo sapiens
cccagaaggtcgaggctgcagt

SEQ ID NO: 114186 - DNA, 22 bp, Homo sapiens
gctcccaggatgaggagccagg

SEQ ID NO: 114187 - DNA, 22 bp, Homo sapiens
ggagactgatctgagtgataac

SEQ ID NO: 114188 - DNA, 22 bp, Homo sapiens
tatccaattcaccattgatggg

SEQ ID NO: 114189 - DNA, 22 bp, Homo sapiens
aagagggctcgatttggcaaaa

SEQ ID NO: 114190 - DNA, 23 bp, Homo sapiens
cagagctggcttcatgggtgtgc

SEQ ID NO: 114191 - DNA, 21 bp, Homo sapiens
aggcttggatctagacaggcc

SEQ ID NO: 114192 - DNA, 22 bp, Homo sapiens
ttctcaagaacatatgtagggt

SEQ ID NO: 114193 - DNA, 22 bp, Homo sapiens
tctgcggtccccttctcgccct

SEQ ID NO: 114194 - DNA, 22 bp, Homo sapiens
cttcactttaagccaatcatga

SEQ ID NO: 114195 - DNA, 18 bp, Homo sapiens
actctttctgcccacagg

SEQ ID NO: 114196 - DNA, 20 bp, Homo sapiens
ctgggtggcaagcaaggggg

SEQ ID NO: 114197 - DNA, 22 bp, Homo sapiens
actcagtacatctggagttggc

SEQ ID NO: 114198 - DNA, 22 bp, Homo sapiens
cctgcagacacttgtccagcaa

SEQ ID NO: 114199 - DNA, 22 bp, Homo sapiens
tcaacgcatgctccaagaaaga

SEQ ID NO: 114200 - DNA, 22 bp, Homo sapiens
ggagaagcagcttcttgatgaa

SEQ ID NO: 114201 - DNA, 22 bp, Homo sapiens
caggaggacatactggctcaca

SEQ ID NO: 114202 - DNA, 23 bp, Homo sapiens
gctcatcaggcttagagtcaagg

SEQ ID NO: 114203 - DNA, 22 bp, Homo sapiens
tagcaaaggatgactatgtacc

SEQ ID NO: 114204 - DNA, 22 bp, Homo sapiens
tttctgagaaattaaacacttt

SEQ ID NO: 114205 - DNA, 22 bp, Homo sapiens
aatttgtataaaatggtgtttt

SEQ ID NO: 114206 - DNA, 22 bp, Homo sapiens
tcactgcaacctccgcctgctg

SEQ ID NO: 114207 - DNA, 22 bp, Homo sapiens
actgcactccagcctgggtgac

SEQ ID NO: 114208 - DNA, 22 bp, Homo sapiens
tgaggaaacttacaaggcagaa

SEQ ID NO: 114209 - DNA, 22 bp, Homo sapiens
tgttgattagtgtttagactta

SEQ ID NO: 114210 - DNA, 22 bp, Homo sapiens
gttcaagaccagcctggccaac

SEQ ID NO: 114211 - DNA, 22 bp, Homo sapiens
tgttatatctaaatagccacat

SEQ ID NO: 114212 - DNA, 19 bp, Homo sapiens
cgcgccgtcgggtccagcc

SEQ ID NO: 114213 - DNA, 22 bp, Homo sapiens
ggctgggcaggtctgcacaggg

SEQ ID NO: 114214 - DNA, 22 bp, Homo sapiens
aaaggacacacaggaggtgtct

SEQ ID NO: 114215 - DNA, 22 bp, Homo sapiens
gctgtctgtcttcacatctcgc

SEQ ID NO: 114216 - DNA, 22 bp, Homo sapiens
acccagccatgttcagttctct

SEQ ID NO: 114217 - DNA, 22 bp, Homo sapiens
ctgtaacctcctctttccattc

SEQ ID NO: 114218 - DNA, 22 bp, Homo sapiens
ggcctgtaatcccagctactca

SEQ ID NO: 114219 - DNA, 22 bp, Homo sapiens
tagccgggtgttgtgtcatgca

SEQ ID NO: 114220 - DNA, 19 bp, Homo sapiens
gcagacaggtccagagagg

SEQ ID NO: 114221 - DNA, 22 bp, Homo sapiens
gcagaggacacaggagggcaag

SEQ ID NO: 114222 - DNA, 22 bp, Homo sapiens
ctctccattccctacagttttc

SEQ ID NO: 114223 - DNA, 22 bp, Homo sapiens
gaggacaagctgtgagtggggt

SEQ ID NO: 114224 - DNA, 22 bp, Homo sapiens
agcgccactgcactccagcctg

SEQ ID NO: 114225 - DNA, 22 bp, Homo sapiens
ggctcactgcaacttccgcctc

SEQ ID NO: 114226 - DNA, 22 bp, Homo sapiens
gttgtgaatagtgccgcaataa

SEQ ID NO: 114227 - DNA, 22 bp, Homo sapiens
gttaggtagaagtttactttga

SEQ ID NO: 114228 - DNA, 22 bp, Homo sapiens
atgttggagtcgtaaggcatgg

SEQ ID NO: 114229 - DNA, 22 bp, Homo sapiens
tgactacaacctccacctcccg

SEQ ID NO: 114230 - DNA, 22 bp, Homo sapiens
cttctggcgttggaggtctgag

SEQ ID NO: 114231 - DNA, 22 bp, Homo sapiens
tccagggccatctccatgaggc

SEQ ID NO: 114232 - DNA, 22 bp, Homo sapiens
aggccagcagcatgacggcatc

SEQ ID NO: 114233 - DNA, 22 bp, Homo sapiens
aggtacatggggtgtgtgcacg

SEQ ID NO: 114234 - DNA, 21 bp, Homo sapiens
gggcagaggggcctcctgggt

SEQ ID NO: 114235 - DNA, 22 bp, Homo sapiens
caaagtaattacggttttggcc

SEQ ID NO: 114236 - DNA, 17 bp, Homo sapiens
cgggcatggagggcagg

SEQ ID NO: 114237 - DNA, 22 bp, Homo sapiens
atgccactgcgctccagcctgg

SEQ ID NO: 114238 - DNA, 19 bp, Homo sapiens
gatttaaacgtggctctat

SEQ ID NO: 114239 - DNA, 22 bp, Homo sapiens
gactggaaagcctgtcctcaga

SEQ ID NO: 114240 - DNA, 22 bp, Homo sapiens
gcaggcaggcttccttgaactg

SEQ ID NO: 114241 - DNA, 22 bp, Homo sapiens
tgagctgtagcagatgctgttg

SEQ ID NO: 114242 - DNA, 22 bp, Homo sapiens
gcttaattctggctcagtttcc

SEQ ID NO: 114243 - DNA, 22 bp, Homo sapiens
gggcttcagttctgaccatctt

SEQ ID NO: 114244 - DNA, 22 bp, Homo sapiens
acacagagccaaaccatatcac

SEQ ID NO: 114245 - DNA, 22 bp, Homo sapiens
ttgttcttgtctttgccttcac

SEQ ID NO: 114246 - DNA, 22 bp, Homo sapiens
tataaagagtctcaaagaagtt

SEQ ID NO: 114247 - DNA, 20 bp, Homo sapiens
gggcagagccagccagtccc

SEQ ID NO: 114248 - DNA, 22 bp, Homo sapiens
gtagggttggagagcacaacca

SEQ ID NO: 114249 - DNA, 22 bp, Homo sapiens
gcttctcaattctcaccctcca

SEQ ID NO: 114250 - DNA, 22 bp, Homo sapiens
tcgtgaggctctgcatcgcaca

SEQ ID NO: 114251 - DNA, 22 bp, Homo sapiens
gcccaggctggagtgcagtggt

SEQ ID NO: 114252 - DNA, 22 bp, Homo sapiens
ctctgtagaaagagcccaggtg

SEQ ID NO: 114253 - DNA, 22 bp, Homo sapiens
gggcaggggtcagtggccccaa

SEQ ID NO: 114254 - DNA, 22 bp, Homo sapiens
atggatcagaatcccgggaggg

SEQ ID NO: 114255 - DNA, 22 bp, Homo sapiens
aggaatggtgctcagcagaaat

SEQ ID NO: 114256 - DNA, 22 bp, Homo sapiens
atgccacttcattccagcctcg

SEQ ID NO: 114257 - DNA, 22 bp, Homo sapiens
tgaagttgttaaggttgccatt

SEQ ID NO: 114258 - DNA, 22 bp, Homo sapiens
atacaaaatatatactggagac

SEQ ID NO: 114259 - DNA, 22 bp, Homo sapiens
tgatgggaggtgctgcaggacc

SEQ ID NO: 114260 - DNA, 22 bp, Homo sapiens
tcttgcacttcatgaatatgtt

SEQ ID NO: 114261 - DNA, 22 bp, Homo sapiens
ttggaacatgccggggtccagg

SEQ ID NO: 114262 - DNA, 22 bp, Homo sapiens
gccaaataagtgtccggccctc

SEQ ID NO: 114263 - DNA, 22 bp, Homo sapiens
accaggcccgctgctatggtgg

SEQ ID NO: 114264 - DNA, 22 bp, Homo sapiens
ttgtgctcctatgagaatctaa

SEQ ID NO: 114265 - DNA, 22 bp, Homo sapiens
ttgtgaatagtgccgcaataaa

SEQ ID NO: 114266 - DNA, 22 bp, Homo sapiens
ttaggcctttgattggggtgct

SEQ ID NO: 114267 - DNA, 22 bp, Homo sapiens
gagaatgatgatttccaatttc

SEQ ID NO: 114268 - DNA, 22 bp, Homo sapiens
tcgcgggttgcacatggccatc

SEQ ID NO: 114269 - DNA, 22 bp, Homo sapiens
ctgtgcgtaagtagccaaaata

SEQ ID NO: 114270 - DNA, 22 bp, Homo sapiens
ccaggagttggaggctgcagtg

SEQ ID NO: 114271 - DNA, 22 bp, Homo sapiens
tcctggatggcctgcaggcggt

SEQ ID NO: 114272 - DNA, 22 bp, Homo sapiens
tcaccaggctggagtgcagtgg

SEQ ID NO: 114273 - DNA, 22 bp, Homo sapiens
gaggctgaggcaggaggatcac

SEQ ID NO: 114274 - DNA, 18 bp, Homo sapiens
cttttcccctttggactc

SEQ ID NO: 114275 - DNA, 22 bp, Homo sapiens
tacgcctgtaatcccagcactt

SEQ ID NO: 114276 - DNA, 22 bp, Homo sapiens
gcccagtggtaaaagcaggcct

SEQ ID NO: 114277 - DNA, 20 bp, Homo sapiens
ttctccagtgcggtagccat

SEQ ID NO: 114278 - DNA, 22 bp, Homo sapiens
caaagtgctgggattacaggct

SEQ ID NO: 114279 - DNA, 22 bp, Homo sapiens
ttagtttataattcatttctgt

SEQ ID NO: 114280 - DNA, 22 bp, Homo sapiens
gactacaggccggcatcagaga

SEQ ID NO: 114281 - DNA, 18 bp, Homo sapiens
cagctgccagctcatgga

SEQ ID NO: 114282 - DNA, 22 bp, Homo sapiens
gaggggagcccccatcctccag

SEQ ID NO: 114283 - DNA, 22 bp, Homo sapiens
gtaggtcagacataagaggaca

SEQ ID NO: 114284 - DNA, 22 bp, Homo sapiens
atgcttgcccatgtttctgaag

SEQ ID NO: 114285 - DNA, 22 bp, Homo sapiens
gagaaatgcatgcatgtcatca

SEQ ID NO: 114286 - DNA, 22 bp, Homo sapiens
aagaatgagctcaaagatctta

SEQ ID NO: 114287 - DNA, 22 bp, Homo sapiens
gcctggccgggtcttggatttt

SEQ ID NO: 114288 - DNA, 22 bp, Homo sapiens
tagccgggtgtggtggaactcc

SEQ ID NO: 114289 - DNA, 22 bp, Homo sapiens
gggctagcctcttccctgctcc

SEQ ID NO: 114290 - DNA, 23 bp, Homo sapiens
caccactttctccttctccttgg

SEQ ID NO: 114291 - DNA, 22 bp, Homo sapiens
acccaggctggagtgcagtggg

SEQ ID NO: 114292 - DNA, 22 bp, Homo sapiens
acaaacagagttgaaaaatagg

SEQ ID NO: 114293 - DNA, 22 bp, Homo sapiens
gataccagacagggagggagaa

SEQ ID NO: 114294 - DNA, 22 bp, Homo sapiens
gtggactgcgcttgagggggcc

SEQ ID NO: 114295 - DNA, 22 bp, Homo sapiens
tgaggcaggagaatcaccggaa

SEQ ID NO: 114296 - DNA, 22 bp, Homo sapiens
ggacacgtggctgaaggcggcc

SEQ ID NO: 114297 - DNA, 20 bp, Homo sapiens
ccagagctgatggctgcccg

SEQ ID NO: 114298 - DNA, 22 bp, Homo sapiens
aacccgggaggcggaggttgtg

SEQ ID NO: 114299 - DNA, 22 bp, Homo sapiens
ggggccttggatctgtgccccg

SEQ ID NO: 114300 - DNA, 22 bp, Homo sapiens
ggtgtgtctgccaggaactgca

SEQ ID NO: 114301 - DNA, 22 bp, Homo sapiens
gggaggcagtgctggaggctgg

SEQ ID NO: 114302 - DNA, 22 bp, Homo sapiens
gggagtgggtttggcctaggcc

SEQ ID NO: 114303 - DNA, 22 bp, Homo sapiens
ttcaacagacccttctttcttt

SEQ ID NO: 114304 - DNA, 22 bp, Homo sapiens
ggtggttcacgcctataatccc

SEQ ID NO: 114305 - DNA, 22 bp, Homo sapiens
caaagtgctgggattataggca

SEQ ID NO: 114306 - DNA, 20 bp, Homo sapiens
cagagccagggttttgtttt

SEQ ID NO: 114307 - DNA, 22 bp, Homo sapiens
tagaaaagccccagctggaggg

SEQ ID NO: 114308 - DNA, 22 bp, Homo sapiens
ttgtttccataattaagtgtga

SEQ ID NO: 114309 - DNA, 22 bp, Homo sapiens
ccaggagctggagggtgcagtg

SEQ ID NO: 114310 - DNA, 22 bp, Homo sapiens
caggctggagttcagtggtgtg

SEQ ID NO: 114311 - DNA, 22 bp, Homo sapiens
tcattccctcattgttcactgg

SEQ ID NO: 114312 - DNA, 20 bp, Homo sapiens
gttaggaggttggacatgga

SEQ ID NO: 114313 - DNA, 22 bp, Homo sapiens
ggttttatcctacccacacagc

SEQ ID NO: 114314 - DNA, 22 bp, Homo sapiens
ggggctgaacctggaggtggtc

SEQ ID NO: 114315 - DNA, 22 bp, Homo sapiens
ttttaagttggattgctaagta

SEQ ID NO: 114316 - DNA, 22 bp, Homo sapiens
atcatcctagaaggaagctagg

SEQ ID NO: 114317 - DNA, 22 bp, Homo sapiens
ccaggaggtggaggttgcggtg

SEQ ID NO: 114318 - DNA, 22 bp, Homo sapiens
ttgtatagcccagagagtgaga

SEQ ID NO: 114319 - DNA, 22 bp, Homo sapiens
tagggggctttgctgcttgaca

SEQ ID NO: 114320 - DNA, 22 bp, Homo sapiens
gcccctgcctttgaacctggag

SEQ ID NO: 114321 - DNA, 22 bp, Homo sapiens
cagtgggtcctgcgtctgccag

SEQ ID NO: 114322 - DNA, 22 bp, Homo sapiens
tacccagtgccaccctctgagg

SEQ ID NO: 114323 - DNA, 22 bp, Homo sapiens
ggagagcagggaggctgctctg

SEQ ID NO: 114324 - DNA, 22 bp, Homo sapiens
ccactgcactccagcctgccaa

SEQ ID NO: 114325 - DNA, 22 bp, Homo sapiens
tcaccaggctagagtgcagtgg

SEQ ID NO: 114326 - DNA, 22 bp, Homo sapiens
gctgcagtgagccaagatcgtg

SEQ ID NO: 114327 - DNA, 22 bp, Homo sapiens
tgaggcactccaggatgctgtt

SEQ ID NO: 114328 - DNA, 22 bp, Homo sapiens
aggagggtgggaagcagtttta

SEQ ID NO: 114329 - DNA, 22 bp, Homo sapiens
atgcacctgaactccatcagct

SEQ ID NO: 114330 - DNA, 22 bp, Homo sapiens
agcttgggcaacacagcaagac

SEQ ID NO: 114331 - DNA, 22 bp, Homo sapiens
ggtgggagagctctgtctccag

SEQ ID NO: 114332 - DNA, 22 bp, Homo sapiens
cccaggcttttctcttgcccca

SEQ ID NO: 114333 - DNA, 22 bp, Homo sapiens
gccctgagaagaagtcggaggg

SEQ ID NO: 114334 - DNA, 22 bp, Homo sapiens
aaggcaaaagaggtgtcatcac

SEQ ID NO: 114335 - DNA, 22 bp, Homo sapiens
tgacagtgcgggtacatcatag

SEQ ID NO: 114336 - DNA, 22 bp, Homo sapiens
tggtcgaccagttggaaagtaa

SEQ ID NO: 114337 - DNA, 22 bp, Homo sapiens
cactgcactccatcctgggaaa

SEQ ID NO: 114338 - DNA, 22 bp, Homo sapiens
agaggccggccgagcccatggg

SEQ ID NO: 114339 - DNA, 22 bp, Homo sapiens
tacatttataaggcttctctgt

SEQ ID NO: 114340 - DNA, 22 bp, Homo sapiens
tgaagctttaggatgggttcat

SEQ ID NO: 114341 - DNA, 22 bp, Homo sapiens
actgcaacctccgcctgccagg

SEQ ID NO: 114342 - DNA, 22 bp, Homo sapiens
tccaaagtgttgggattatagg

SEQ ID NO: 114343 - DNA, 22 bp, Homo sapiens
gaggctgaggttgcagtgagct

SEQ ID NO: 114344 - DNA, 22 bp, Homo sapiens
agccaccaccactgaaaggtta

SEQ ID NO: 114345 - DNA, 22 bp, Homo sapiens
accactgcccatggtgaaaact

SEQ ID NO: 114346 - DNA, 22 bp, Homo sapiens
caagacttcaccgctctgtgct

SEQ ID NO: 114347 - DNA, 22 bp, Homo sapiens
agctggggctgtggttgtgatt

SEQ ID NO: 114348 - DNA, 22 bp, Homo sapiens
gatgatcatctgtaaagttaga

SEQ ID NO: 114349 - DNA, 22 bp, Homo sapiens
tggctaacaaggtgaaaccccg

SEQ ID NO: 114350 - DNA, 22 bp, Homo sapiens
tagatttgtttccttctctcca

SEQ ID NO: 114351 - DNA, 20 bp, Homo sapiens
tttgcgaggccaaggcgggc

SEQ ID NO: 114352 - DNA, 22 bp, Homo sapiens
atgttcatatccccattctgat

SEQ ID NO: 114353 - DNA, 22 bp, Homo sapiens
attgcactccagcctgggtgac

SEQ ID NO: 114354 - DNA, 22 bp, Homo sapiens
ggtttattgttaataagtttga

SEQ ID NO: 114355 - DNA, 22 bp, Homo sapiens
tgcatggacgtgacttggccaa

SEQ ID NO: 114356 - DNA, 22 bp, Homo sapiens
aggacagagggaccagagccca

SEQ ID NO: 114357 - DNA, 22 bp, Homo sapiens
cagggtttcaccatgttagcag

SEQ ID NO: 114358 - DNA, 22 bp, Homo sapiens
gaggactgaaacttacaggaaa

SEQ ID NO: 114359 - DNA, 22 bp, Homo sapiens
gcagtggggcaatcatagctca

SEQ ID NO: 114360 - DNA, 22 bp, Homo sapiens
gcctacatttcccagttgaatg

SEQ ID NO: 114361 - DNA, 22 bp, Homo sapiens
agttctgcctatatagaaactc

SEQ ID NO: 114362 - DNA, 20 bp, Homo sapiens
cattggacttggcttcatgg

SEQ ID NO: 114363 - DNA, 22 bp, Homo sapiens
gctcactgcaagctccgcctcc

SEQ ID NO: 114364 - DNA, 22 bp, Homo sapiens
catataaatacaacatgtgtta

SEQ ID NO: 114365 - DNA, 22 bp, Homo sapiens
attcatcagctaatggacattt

SEQ ID NO: 114366 - DNA, 22 bp, Homo sapiens
tgagcctgggagatggaggctg

SEQ ID NO: 114367 - DNA, 22 bp, Homo sapiens
atgctctctgtcctgctcagag

SEQ ID NO: 114368 - DNA, 22 bp, Homo sapiens
ctggcccaggtggtcgttgagg

SEQ ID NO: 114369 - DNA, 22 bp, Homo sapiens
ccttggcaggcacgtcctgcgg

SEQ ID NO: 114370 - DNA, 20 bp, Homo sapiens
aaaatatgtataactcttct

SEQ ID NO: 114371 - DNA, 22 bp, Homo sapiens
cacagctgaagtagccatgtgg

SEQ ID NO: 114372 - DNA, 22 bp, Homo sapiens
aagaggttgtctgtgatgagtt

SEQ ID NO: 114373 - DNA, 22 bp, Homo sapiens
aaagtgctcggattacaggtat

SEQ ID NO: 114374 - DNA, 22 bp, Homo sapiens
gtagtctgaacagtaattttgt

SEQ ID NO: 114375 - DNA, 22 bp, Homo sapiens
tgtgttgtgacattcttggatg

SEQ ID NO: 114376 - DNA, 23 bp, Homo sapiens
cgcccagcctcagtgacctgggc

SEQ ID NO: 114377 - DNA, 22 bp, Homo sapiens
agtggagcttttcctatcagag

SEQ ID NO: 114378 - DNA, 22 bp, Homo sapiens
gcagtggcatgatgtgggctca

SEQ ID NO: 114379 - DNA, 22 bp, Homo sapiens
tccttaggcaatttgggagagt

SEQ ID NO: 114380 - DNA, 22 bp, Homo sapiens
tcaaatgctgtattgtagtaat

SEQ ID NO: 114381 - DNA, 22 bp, Homo sapiens
agcgtgaattagttggtacaca

SEQ ID NO: 114382 - DNA, 22 bp, Homo sapiens
caggaggattgcttgaggccag

SEQ ID NO: 114383 - DNA, 22 bp, Homo sapiens
agtatacatagtgcttcctctt

SEQ ID NO: 114384 - DNA, 17 bp, Homo sapiens
cactagtagtctctggc

SEQ ID NO: 114385 - DNA, 22 bp, Homo sapiens
gaggcctgggcaagggggtctg

SEQ ID NO: 114386 - DNA, 22 bp, Homo sapiens
tggacaacatagtgagacctca

SEQ ID NO: 114387 - DNA, 22 bp, Homo sapiens
acacttggagcaacacttatgg

SEQ ID NO: 114388 - DNA, 22 bp, Homo sapiens
caaagtgctaggattacaggcc

SEQ ID NO: 114389 - DNA, 22 bp, Homo sapiens
caaagtgctgggattacaggtg

SEQ ID NO: 114390 - DNA, 22 bp, Homo sapiens
gtgcgggcctgggggtttctct

SEQ ID NO: 114391 - DNA, 22 bp, Homo sapiens
ggctgtggcagctggaagtggt

SEQ ID NO: 114392 - DNA, 22 bp, Homo sapiens
gccagtggtcactgaggaagaa

SEQ ID NO: 114393 - DNA, 22 bp, Homo sapiens
ctctgcctcagtgatttcttta

SEQ ID NO: 114394 - DNA, 22 bp, Homo sapiens
tgaggcaggagaatcacatgaa

SEQ ID NO: 114395 - DNA, 22 bp, Homo sapiens
ctgcatccatgttgctgcaaag

SEQ ID NO: 114396 - DNA, 22 bp, Homo sapiens
ccagcctggttcagaattggct

SEQ ID NO: 114397 - DNA, 22 bp, Homo sapiens
acttcttcttcagctgggggat

SEQ ID NO: 114398 - DNA, 22 bp, Homo sapiens
tagcagcatttttgtagagtat

SEQ ID NO: 114399 - DNA, 22 bp, Homo sapiens
tgccaccccggaccccgaagtg

SEQ ID NO: 114400 - DNA, 22 bp, Homo sapiens
tagatctgatacaattcatctg

SEQ ID NO: 114401 - DNA, 22 bp, Homo sapiens
gagcctggagctggaacgaagc

SEQ ID NO: 114402 - DNA, 22 bp, Homo sapiens
ctcggcaggtggaggttgtagt

SEQ ID NO: 114403 - DNA, 23 bp, Homo sapiens
actcgtggaattctctgcgatcg

SEQ ID NO: 114404 - DNA, 22 bp, Homo sapiens
actctccttttgatcttcagaa

SEQ ID NO: 114405 - DNA, 22 bp, Homo sapiens
ctcactgcaagctcagcctccc

SEQ ID NO: 114406 - DNA, 22 bp, Homo sapiens
acatctagactcttgccctctt

SEQ ID NO: 114407 - DNA, 22 bp, Homo sapiens
ggctgtgtggccgtgggctcta

SEQ ID NO: 114408 - DNA, 22 bp, Homo sapiens
cattccttaacgtggggagtct

SEQ ID NO: 114409 - DNA, 22 bp, Homo sapiens
cccagcagtagagctcatatgg

SEQ ID NO: 114410 - DNA, 22 bp, Homo sapiens
cggggccctggggctgaaggtc

SEQ ID NO: 114411 - DNA, 22 bp, Homo sapiens
atgaaatatcttgaagaaattc

SEQ ID NO: 114412 - DNA, 22 bp, Homo sapiens
tgacagaggagctggaatgatt

SEQ ID NO: 114413 - DNA, 22 bp, Homo sapiens
ccatgtggtgggaaggagaatg

SEQ ID NO: 114414 - DNA, 22 bp, Homo sapiens
tttgaagactactgggagtgaa

SEQ ID NO: 114415 - DNA, 20 bp, Homo sapiens
ataaaataactgccacaaga

SEQ ID NO: 114416 - DNA, 22 bp, Homo sapiens
tcttcccccgtgctccagtgca

SEQ ID NO: 114417 - DNA, 22 bp, Homo sapiens
aggaatgacagatgtccgcacc

SEQ ID NO: 114418 - DNA, 23 bp, Homo sapiens
caggagatggctgctgtgtcagc

SEQ ID NO: 114419 - DNA, 22 bp, Homo sapiens
ttggaatgcacactgagcctgc

SEQ ID NO: 114420 - DNA, 22 bp, Homo sapiens
tggggtgagattcagatattca

SEQ ID NO: 114421 - DNA, 22 bp, Homo sapiens
tcattgccatggcatttgcaga

SEQ ID NO: 114422 - DNA, 22 bp, Homo sapiens
ggaacagttgcgtcatgggcct

SEQ ID NO: 114423 - DNA, 22 bp, Homo sapiens
ggctttgacatgctgaattaaa

SEQ ID NO: 114424 - DNA, 22 bp, Homo sapiens
acccaggccattggcaagagtc

SEQ ID NO: 114425 - DNA, 22 bp, Homo sapiens
tctttcattctagtctgaggtt

SEQ ID NO: 114426 - DNA, 22 bp, Homo sapiens
tgcaatccccgcctcaacagga

SEQ ID NO: 114427 - DNA, 22 bp, Homo sapiens
gctcactgcaagctctgcctcc

SEQ ID NO: 114428 - DNA, 22 bp, Homo sapiens
atattacacacggtatcacggg

SEQ ID NO: 114429 - DNA, 22 bp, Homo sapiens
gcacacggcagcctcctcctga

SEQ ID NO: 114430 - DNA, 22 bp, Homo sapiens
ctgtccatattcaaggggtagg

SEQ ID NO: 114431 - DNA, 22 bp, Homo sapiens
ccgaggtcctggacttggccct

SEQ ID NO: 114432 - DNA, 22 bp, Homo sapiens
ccaaagtgctgggattacaggc

SEQ ID NO: 114433 - DNA, 22 bp, Homo sapiens
gagagtctaggaacctcatata

SEQ ID NO: 114434 - DNA, 22 bp, Homo sapiens
ttgtctaatgagctccacttca

SEQ ID NO: 114435 - DNA, 22 bp, Homo sapiens
tggaatggaaacaaactgagga

SEQ ID NO: 114436 - DNA, 22 bp, Homo sapiens
gagccccaccctagacattctg

SEQ ID NO: 114437 - DNA, 19 bp, Homo sapiens
gcctatgtcttcaaatcat

SEQ ID NO: 114438 - DNA, 22 bp, Homo sapiens
aagggggcggcagccagtggaa

SEQ ID NO: 114439 - DNA, 22 bp, Homo sapiens
cagctgcccctccagggctggg

SEQ ID NO: 114440 - DNA, 22 bp, Homo sapiens
tgagacaggcttccttcttggg

SEQ ID NO: 114441 - DNA, 22 bp, Homo sapiens
tttctcggcagagatgatgggc

SEQ ID NO: 114442 - DNA, 19 bp, Homo sapiens
ttccatctatcttcttact

SEQ ID NO: 114443 - DNA, 22 bp, Homo sapiens
ctgaagagaaagggagctcttc

SEQ ID NO: 114444 - DNA, 22 bp, Homo sapiens
ccaggaggttgaggctgcagtg

SEQ ID NO: 114445 - DNA, 22 bp, Homo sapiens
ttcatatgtgaactcagtgatg

SEQ ID NO: 114446 - DNA, 22 bp, Homo sapiens
gaggctgaggttgcagtgagcc

SEQ ID NO: 114447 - DNA, 22 bp, Homo sapiens
atctagattaggtataagagct

SEQ ID NO: 114448 - DNA, 19 bp, Homo sapiens
ggctgccttctgctcatct

SEQ ID NO: 114449 - DNA, 22 bp, Homo sapiens
acatcctcccgatctactggct

SEQ ID NO: 114450 - DNA, 22 bp, Homo sapiens
aggtgactggtttatctggcag

SEQ ID NO: 114451 - DNA, 22 bp, Homo sapiens
ttccatttggagctcgcagcct

SEQ ID NO: 114452 - DNA, 22 bp, Homo sapiens
ccctgatagcccctatcatcag

SEQ ID NO: 114453 - DNA, 22 bp, Homo sapiens
acaggtcctcaagtcagctggg

SEQ ID NO: 114454 - DNA, 22 bp, Homo sapiens
cgcaccactgaattccagcctg

SEQ ID NO: 114455 - DNA, 22 bp, Homo sapiens
ggcgccagcactgcagcgcctc

SEQ ID NO: 114456 - DNA, 20 bp, Homo sapiens
tgacatagctcttggggtgc

SEQ ID NO: 114457 - DNA, 22 bp, Homo sapiens
aggaatgacaggcctcccgcag

SEQ ID NO: 114458 - DNA, 22 bp, Homo sapiens
caaatactacgattcttgcagt

SEQ ID NO: 114459 - DNA, 22 bp, Homo sapiens
agcccggcttccccggttgcta

SEQ ID NO: 114460 - DNA, 22 bp, Homo sapiens
atgtatacgtgcaagtcacagg

SEQ ID NO: 114461 - DNA, 22 bp, Homo sapiens
gccccagcctcccgagtagctg

SEQ ID NO: 114462 - DNA, 22 bp, Homo sapiens
ccctcaggtgaaaggaaaaatt

SEQ ID NO: 114463 - DNA, 22 bp, Homo sapiens
agagggtgggcacgtgatggat

SEQ ID NO: 114464 - DNA, 22 bp, Homo sapiens
tctgagccagggtctcctccct

SEQ ID NO: 114465 - DNA, 22 bp, Homo sapiens
ggatgttctggggttctcttgt

SEQ ID NO: 114466 - DNA, 22 bp, Homo sapiens
tacttttagcctatttgattct

SEQ ID NO: 114467 - DNA, 22 bp, Homo sapiens
gggcgccgtgggaaacagccgg

SEQ ID NO: 114468 - DNA, 19 bp, Homo sapiens
aggaatggaattaattctg

SEQ ID NO: 114469 - DNA, 22 bp, Homo sapiens
gggctgtaggagctggaatggg

SEQ ID NO: 114470 - DNA, 22 bp, Homo sapiens
atgtctgtttgctgagcccggc

SEQ ID NO: 114471 - DNA, 17 bp, Homo sapiens
catcaaagaaatttcca

SEQ ID NO: 114472 - DNA, 22 bp, Homo sapiens
tacaggcatgtagcatggtgat

SEQ ID NO: 114473 - DNA, 23 bp, Homo sapiens
caccccaccctgaggaggaggga

SEQ ID NO: 114474 - DNA, 22 bp, Homo sapiens
tttgtcttatccaatctctcag

SEQ ID NO: 114475 - DNA, 22 bp, Homo sapiens
cagtggatcctctgactccctc

SEQ ID NO: 114476 - DNA, 21 bp, Homo sapiens
tctctttctggaagcttccct

SEQ ID NO: 114477 - DNA, 22 bp, Homo sapiens
gaggcagaggttgttgcagtga

SEQ ID NO: 114478 - DNA, 22 bp, Homo sapiens
gctgatagactgaatgttggga

SEQ ID NO: 114479 - DNA, 22 bp, Homo sapiens
gataatccactctgctgacttt

SEQ ID NO: 114480 - DNA, 22 bp, Homo sapiens
gtggattacaagacagttgaga

SEQ ID NO: 114481 - DNA, 22 bp, Homo sapiens
tttaagaagttatgttataaat

SEQ ID NO: 114482 - DNA, 22 bp, Homo sapiens
ttagtattaggatcatatttga

SEQ ID NO: 114483 - DNA, 22 bp, Homo sapiens
tgtctgttattggtgtataaga

SEQ ID NO: 114484 - DNA, 22 bp, Homo sapiens
tttaatgtagcgtgaaatgatt

SEQ ID NO: 114485 - DNA, 22 bp, Homo sapiens
tctcatctgccatttgcaggag

SEQ ID NO: 114486 - DNA, 22 bp, Homo sapiens
gcctccagcccacgcaggcctg

SEQ ID NO: 114487 - DNA, 22 bp, Homo sapiens
gtctgctcatgctaccgcgggc

SEQ ID NO: 114488 - DNA, 22 bp, Homo sapiens
aggagcagaccgtagtcctgca

SEQ ID NO: 114489 - DNA, 22 bp, Homo sapiens
gtggcagagccaaggctggagc

SEQ ID NO: 114490 - DNA, 22 bp, Homo sapiens
gtatcacttttgagagtgagaa

SEQ ID NO: 114491 - DNA, 22 bp, Homo sapiens
gacctcgtgatccgccctcctt

SEQ ID NO: 114492 - DNA, 22 bp, Homo sapiens
caaatcctcacctcatcatgaa

SEQ ID NO: 114493 - DNA, 22 bp, Homo sapiens
cgccggcttgaggcaggcggca

SEQ ID NO: 114494 - DNA, 22 bp, Homo sapiens
gaagagtggttatccctgctgt

SEQ ID NO: 114495 - DNA, 22 bp, Homo sapiens
catggcactgagcaggtatgca

SEQ ID NO: 114496 - DNA, 22 bp, Homo sapiens
tttctaatctgattctcctacc

SEQ ID NO: 114497 - DNA, 18 bp, Homo sapiens
tgagttcattagacttcc

SEQ ID NO: 114498 - DNA, 22 bp, Homo sapiens
atgcctgtaatcccagcacttt

SEQ ID NO: 114499 - DNA, 22 bp, Homo sapiens
ctcttagtaatgccatgaagca

SEQ ID NO: 114500 - DNA, 22 bp, Homo sapiens
ggaggggatttagtagatgcta

SEQ ID NO: 114501 - DNA, 22 bp, Homo sapiens
agtggcacaattttgactcccc

SEQ ID NO: 114502 - DNA, 22 bp, Homo sapiens
ttgtgaatggtgccgcaataaa

SEQ ID NO: 114503 - DNA, 22 bp, Homo sapiens
actggacagaggaaatatggag

SEQ ID NO: 114504 - DNA, 22 bp, Homo sapiens
tcacaaatgtttgcatgtgtct

SEQ ID NO: 114505 - DNA, 22 bp, Homo sapiens
gggctgggattgcttgctgtga

SEQ ID NO: 114506 - DNA, 22 bp, Homo sapiens
agccagggtctctcgctctgtt

SEQ ID NO: 114507 - DNA, 22 bp, Homo sapiens
acccaggctggagtgcagtgat

SEQ ID NO: 114508 - DNA, 22 bp, Homo sapiens
gtctctcaaaactagaagagaa

SEQ ID NO: 114509 - DNA, 21 bp, Homo sapiens
agctgcctccacttctgaggc

SEQ ID NO: 114510 - DNA, 22 bp, Homo sapiens
actgcacttcagcctgggtgtc

SEQ ID NO: 114511 - DNA, 22 bp, Homo sapiens
gccaggcgggtctcaaactcct

SEQ ID NO: 114512 - DNA, 22 bp, Homo sapiens
aaaatggtctcagctggcacca

SEQ ID NO: 114513 - DNA, 22 bp, Homo sapiens
aaaagtaattgtggtttttgct

SEQ ID NO: 114514 - DNA, 22 bp, Homo sapiens
tcggagctgtagatgaaaccct

SEQ ID NO: 114515 - DNA, 22 bp, Homo sapiens
cctacagttatattcttgattg

SEQ ID NO: 114516 - DNA, 22 bp, Homo sapiens
gaggggctgccctggtgtcagg

SEQ ID NO: 114517 - DNA, 22 bp, Homo sapiens
gaccttcttgctgtgtcctaac

SEQ ID NO: 114518 - DNA, 23 bp, Homo sapiens
gggtccagccaattccaaggaaa

SEQ ID NO: 114519 - DNA, 22 bp, Homo sapiens
tttcttaggctctaaaatgact

SEQ ID NO: 114520 - DNA, 22 bp, Homo sapiens
tgctcgccccacatgccctcat

SEQ ID NO: 114521 - DNA, 22 bp, Homo sapiens
aatcagaaattgagggtctggt

SEQ ID NO: 114522 - DNA, 22 bp, Homo sapiens
ggaggtgggctaaggactctct

SEQ ID NO: 114523 - DNA, 22 bp, Homo sapiens
tgagaaacacaggcatgaatag

SEQ ID NO: 114524 - DNA, 22 bp, Homo sapiens
tcagtgtgaattcaggagccta

SEQ ID NO: 114525 - DNA, 22 bp, Homo sapiens
ttaggtattttgttatgtcagc

SEQ ID NO: 114526 - DNA, 22 bp, Homo sapiens
gtggcagaccttcccttctcct

SEQ ID NO: 114527 - DNA, 22 bp, Homo sapiens
agagctccagggttttgtagtg

SEQ ID NO: 114528 - DNA, 22 bp, Homo sapiens
tcctgggatcaagtgatcctcc

SEQ ID NO: 114529 - DNA, 22 bp, Homo sapiens
taatgtaaacacagagacagaa

SEQ ID NO: 114530 - DNA, 22 bp, Homo sapiens
tcctgggaggcggaggttgcag

SEQ ID NO: 114531 - DNA, 22 bp, Homo sapiens
tccacaggtccggcatgaacag

SEQ ID NO: 114532 - DNA, 22 bp, Homo sapiens
aaaacctcagttctgctcttaa

SEQ ID NO: 114533 - DNA, 22 bp, Homo sapiens
cccacaggtgtgagcttgctgg

SEQ ID NO: 114534 - DNA, 22 bp, Homo sapiens
ggttccacctggcgaggggtat

SEQ ID NO: 114535 - DNA, 22 bp, Homo sapiens
ccctgctgtcaggtgctgggag

SEQ ID NO: 114536 - DNA, 22 bp, Homo sapiens
aggacttccatggatggattgg

SEQ ID NO: 114537 - DNA, 22 bp, Homo sapiens
gaggcaggcagattgcttgagg

SEQ ID NO: 114538 - DNA, 22 bp, Homo sapiens
aaagagccgctgatgtcagccc

SEQ ID NO: 114539 - DNA, 22 bp, Homo sapiens
tgctaataaactccaggctgag

SEQ ID NO: 114540 - DNA, 22 bp, Homo sapiens
gactccccacgttaaggaatgt

SEQ ID NO: 114541 - DNA, 22 bp, Homo sapiens
aggtggagaagagatgggcagt

SEQ ID NO: 114542 - DNA, 22 bp, Homo sapiens
taggttttcctaaaattctggt

SEQ ID NO: 114543 - DNA, 22 bp, Homo sapiens
tgttttaagggtcaactgtcac

SEQ ID NO: 114544 - DNA, 22 bp, Homo sapiens
gtacccagtgattccttcttca

SEQ ID NO: 114545 - DNA, 22 bp, Homo sapiens
ttgatcaaatcagctactgagg

SEQ ID NO: 114546 - DNA, 22 bp, Homo sapiens
tgattttctccattgtaaattc

SEQ ID NO: 114547 - DNA, 22 bp, Homo sapiens
cttgtcagccaattgtggattt

SEQ ID NO: 114548 - DNA, 22 bp, Homo sapiens
tttacacagaggacactgggct

SEQ ID NO: 114549 - DNA, 22 bp, Homo sapiens
gaagaaggtggcccaggggtag

SEQ ID NO: 114550 - DNA, 22 bp, Homo sapiens
acaggggattgattggaagtct

SEQ ID NO: 114551 - DNA, 18 bp, Homo sapiens
gtcaggcatgaatctggg

SEQ ID NO: 114552 - DNA, 22 bp, Homo sapiens
tatctaataaatctgataagta

SEQ ID NO: 114553 - DNA, 22 bp, Homo sapiens
ggaaatctcagatctcccagat

SEQ ID NO: 114554 - DNA, 22 bp, Homo sapiens
gagcaggaaggccagaagggtc

SEQ ID NO: 114555 - DNA, 22 bp, Homo sapiens
cgtcatcacggcaagcatctcc

SEQ ID NO: 114556 - DNA, 22 bp, Homo sapiens
agctcttacatttaggtctatg

SEQ ID NO: 114557 - DNA, 22 bp, Homo sapiens
gagaacagaagcattcctaatt

SEQ ID NO: 114558 - DNA, 16 bp, Homo sapiens
cttgtctgttgctcat

SEQ ID NO: 114559 - DNA, 17 bp, Homo sapiens
gagacccccactacacc

SEQ ID NO: 114560 - DNA, 18 bp, Homo sapiens
gcctgagggtcaagtgtg

SEQ ID NO: 114561 - DNA, 22 bp, Homo sapiens
ctttaaggtgatgagagatgct

SEQ ID NO: 114562 - DNA, 22 bp, Homo sapiens
ctgggctagaaggaccaggatg

SEQ ID NO: 114563 - DNA, 22 bp, Homo sapiens
ccgggagcaggcgccaccgcca

SEQ ID NO: 114564 - DNA, 22 bp, Homo sapiens
atagacgcggccgctgatgcag

SEQ ID NO: 114565 - DNA, 22 bp, Homo sapiens
catgggtaagactcttttgccc

SEQ ID NO: 114566 - DNA, 22 bp, Homo sapiens
cagtgccagctgcttggcctac

SEQ ID NO: 114567 - DNA, 20 bp, Homo sapiens
tgttgattggtgtcatctca

SEQ ID NO: 114568 - DNA, 22 bp, Homo sapiens
tgagcccagagatctgagctat

SEQ ID NO: 114569 - DNA, 22 bp, Homo sapiens
ttttcatttttgtagatgcaag

SEQ ID NO: 114570 - DNA, 22 bp, Homo sapiens
ggttggacactaggtaggagcg

SEQ ID NO: 114571 - DNA, 22 bp, Homo sapiens
tactgtgtgcccagccgagctg

SEQ ID NO: 114572 - DNA, 22 bp, Homo sapiens
acacttctttgtcacctgcttc

SEQ ID NO: 114573 - DNA, 22 bp, Homo sapiens
tctcaagcttgttggtatgttt

SEQ ID NO: 114574 - DNA, 22 bp, Homo sapiens
ttccacaatggttaagctcgtt

SEQ ID NO: 114575 - DNA, 22 bp, Homo sapiens
gccaaactacaagttaaatttt

SEQ ID NO: 114576 - DNA, 18 bp, Homo sapiens
acacttcctggtggtgtg

SEQ ID NO: 114577 - DNA, 22 bp, Homo sapiens
agcctgcgatcccacctggcct

SEQ ID NO: 114578 - DNA, 22 bp, Homo sapiens
ggccactgctctccagcctggg

SEQ ID NO: 114579 - DNA, 22 bp, Homo sapiens
agcttgtagaaggccacgagca

SEQ ID NO: 114580 - DNA, 16 bp, Homo sapiens
gcagaggaaaggggag

SEQ ID NO: 114581 - DNA, 22 bp, Homo sapiens
aggtggcagatgggggtgctcg

SEQ ID NO: 114582 - DNA, 22 bp, Homo sapiens
cttcagctgcagttatgtttag

SEQ ID NO: 114583 - DNA, 20 bp, Homo sapiens
tttcttgtcggctgttgctg

SEQ ID NO: 114584 - DNA, 19 bp, Homo sapiens
gtgtccatggagcatggag

SEQ ID NO: 114585 - DNA, 22 bp, Homo sapiens
cctgtcacctaggtactgagca

SEQ ID NO: 114586 - DNA, 22 bp, Homo sapiens
acagtccagcctagtatgtata

SEQ ID NO: 114587 - DNA, 22 bp, Homo sapiens
aggatttctgtgcctggaaaat

SEQ ID NO: 114588 - DNA, 22 bp, Homo sapiens
gcaggatgagtgagtacattta

SEQ ID NO: 114589 - DNA, 18 bp, Homo sapiens
tttctcagactctctttc

SEQ ID NO: 114590 - DNA, 22 bp, Homo sapiens
ctgggatgcggaggttgcggtg

SEQ ID NO: 114591 - DNA, 22 bp, Homo sapiens
gtcttagatttcaccgataatg

SEQ ID NO: 114592 - DNA, 22 bp, Homo sapiens
ggccaattccaggagccggcgg

SEQ ID NO: 114593 - DNA, 22 bp, Homo sapiens
tcactgcaatctcagcctcctg

SEQ ID NO: 114594 - DNA, 22 bp, Homo sapiens
tggcaccagggaacaagcattt

SEQ ID NO: 114595 - DNA, 22 bp, Homo sapiens
atacaaaaattagccgggagta

SEQ ID NO: 114596 - DNA, 22 bp, Homo sapiens
tcccaggccacacttggggaac

SEQ ID NO: 114597 - DNA, 22 bp, Homo sapiens
tagcataacaggtaagagtgag

SEQ ID NO: 114598 - DNA, 16 bp, Homo sapiens
gcaggcagatcacatg

SEQ ID NO: 114599 - DNA, 22 bp, Homo sapiens
aggcactgtgcagtcccaagca

SEQ ID NO: 114600 - DNA, 22 bp, Homo sapiens
gcagcctgggcaacagagtgag

SEQ ID NO: 114601 - DNA, 22 bp, Homo sapiens
ggtcgagtcacttgttgccttt

SEQ ID NO: 114602 - DNA, 22 bp, Homo sapiens
agtgttagattcttactcagtt

SEQ ID NO: 114603 - DNA, 22 bp, Homo sapiens
acccaggctggagtgcagtggc

SEQ ID NO: 114604 - DNA, 22 bp, Homo sapiens
agtgctatcgagttctaatgct

SEQ ID NO: 114605 - DNA, 22 bp, Homo sapiens
tagaactaagagttatcattta

SEQ ID NO: 114606 - DNA, 22 bp, Homo sapiens
cggctcactgcagctccgcctc

SEQ ID NO: 114607 - DNA, 22 bp, Homo sapiens
ctaaagtgccaggaatacaggt

SEQ ID NO: 114608 - DNA, 22 bp, Homo sapiens
gtccgtagtggctgatgctttg

SEQ ID NO: 114609 - DNA, 22 bp, Homo sapiens
cccaggggttctgagcagcagc

SEQ ID NO: 114610 - DNA, 22 bp, Homo sapiens
ctgtatttcttggacagttgct

SEQ ID NO: 114611 - DNA, 22 bp, Homo sapiens
ttggccatctaagcccagccac

SEQ ID NO: 114612 - DNA, 22 bp, Homo sapiens
tcacaactgggtgtcttcatca

SEQ ID NO: 114613 - DNA, 19 bp, Homo sapiens
aatgctgcttctttttgca

SEQ ID NO: 114614 - DNA, 22 bp, Homo sapiens
ttccagctaactcacatccctt

SEQ ID NO: 114615 - DNA, 21 bp, Homo sapiens
ctacttaagtaggggattagg

SEQ ID NO: 114616 - DNA, 22 bp, Homo sapiens
ctcctgagctctgaggaagctt

SEQ ID NO: 114617 - DNA, 22 bp, Homo sapiens
actgcaaagggaagccctttct

SEQ ID NO: 114618 - DNA, 22 bp, Homo sapiens
agcccgcatctcgctaaagata

SEQ ID NO: 114619 - DNA, 22 bp, Homo sapiens
atatgtggcattatttctgagg

SEQ ID NO: 114620 - DNA, 22 bp, Homo sapiens
ctctctgggcccagttggcacc

SEQ ID NO: 114621 - DNA, 22 bp, Homo sapiens
ataaaagatcccttctgagctc

SEQ ID NO: 114622 - DNA, 22 bp, Homo sapiens
gggcctcaggttctggagaagg

SEQ ID NO: 114623 - DNA, 22 bp, Homo sapiens
aggaaagcttggcaaactaaat

SEQ ID NO: 114624 - DNA, 22 bp, Homo sapiens
aggtgggcggattcatgaggtc

SEQ ID NO: 114625 - DNA, 22 bp, Homo sapiens
tgacagtgaacaggttaccact

SEQ ID NO: 114626 - DNA, 22 bp, Homo sapiens
gcccgcgccagcctctccatct

SEQ ID NO: 114627 - DNA, 22 bp, Homo sapiens
actttaattaatgaactgtggc

SEQ ID NO: 114628 - DNA, 22 bp, Homo sapiens
ctcagccccagcccagatagca

SEQ ID NO: 114629 - DNA, 22 bp, Homo sapiens
caggctggagtgcaatgacgcc

SEQ ID NO: 114630 - DNA, 22 bp, Homo sapiens
acctggacacctgctgtcatct

SEQ ID NO: 114631 - DNA, 22 bp, Homo sapiens
ggaggtggagctggaagttcca

SEQ ID NO: 114632 - DNA, 22 bp, Homo sapiens
ccagggtggcgtagatgctggg

SEQ ID NO: 114633 - DNA, 22 bp, Homo sapiens
tgatattttatgagctttcata

SEQ ID NO: 114634 - DNA, 22 bp, Homo sapiens
gtcaggactctgacccgtcccg

SEQ ID NO: 114635 - DNA, 22 bp, Homo sapiens
ctcactgcaacctctgcctccc

SEQ ID NO: 114636 - DNA, 22 bp, Homo sapiens
cacatgaaggctggggtcgtga

SEQ ID NO: 114637 - DNA, 22 bp, Homo sapiens
ccaaagtgctgggattacaggt

SEQ ID NO: 114638 - DNA, 22 bp, Homo sapiens
atgcacacgtaccctacaaggc

SEQ ID NO: 114639 - DNA, 19 bp, Homo sapiens
gctgaggtggaggaaggag

SEQ ID NO: 114640 - DNA, 22 bp, Homo sapiens
cagctgctgttcagttttgttt

SEQ ID NO: 114641 - DNA, 19 bp, Homo sapiens
taaaacgtgcatggcagca

SEQ ID NO: 114642 - DNA, 22 bp, Homo sapiens
cgagcatgatgacggctgtggc

SEQ ID NO: 114643 - DNA, 22 bp, Homo sapiens
gctgtgtatcagatgccacggg

SEQ ID NO: 114644 - DNA, 22 bp, Homo sapiens
gggagaagaatgtgtcaattgt

SEQ ID NO: 114645 - DNA, 22 bp, Homo sapiens
catgcacttacctgaaattcaa

SEQ ID NO: 114646 - DNA, 22 bp, Homo sapiens
atttcagtattatacaactgct

SEQ ID NO: 114647 - DNA, 22 bp, Homo sapiens
ttgaagactaatttagataatg

SEQ ID NO: 114648 - DNA, 22 bp, Homo sapiens
tttattctgtgctacatgaaga

SEQ ID NO: 114649 - DNA, 22 bp, Homo sapiens
tacagctgctggtgctccatgc

SEQ ID NO: 114650 - DNA, 22 bp, Homo sapiens
taattataacagttacatctta

SEQ ID NO: 114651 - DNA, 22 bp, Homo sapiens
gctgggttttcttccgggccta

SEQ ID NO: 114652 - DNA, 22 bp, Homo sapiens
attgagaagaaaatctaatata

SEQ ID NO: 114653 - DNA, 18 bp, Homo sapiens
gaggatggaaggagatgc

SEQ ID NO: 114654 - DNA, 22 bp, Homo sapiens
actcctacatattagcattaac

SEQ ID NO: 114655 - DNA, 22 bp, Homo sapiens
tcctgggtccatggcagccgaa

SEQ ID NO: 114656 - DNA, 22 bp, Homo sapiens
agaaaacataggagacaggaaa

SEQ ID NO: 114657 - DNA, 20 bp, Homo sapiens
tatttctgggcaaccattta

SEQ ID NO: 114658 - DNA, 20 bp, Homo sapiens
tttgagaccagtctgcccaa

SEQ ID NO: 114659 - DNA, 22 bp, Homo sapiens
tgcgcggctcagtcatctccag

SEQ ID NO: 114660 - DNA, 22 bp, Homo sapiens
tgaaatgattatatggtgtttg

SEQ ID NO: 114661 - DNA, 22 bp, Homo sapiens
atttcatactaaggctcaaaaa

SEQ ID NO: 114662 - DNA, 22 bp, Homo sapiens
tgggaagggtcaacagctggaa

SEQ ID NO: 114663 - DNA, 22 bp, Homo sapiens
gggcagagactcagaaacagaa

SEQ ID NO: 114664 - DNA, 22 bp, Homo sapiens
tggtagtgactcccccagggct

SEQ ID NO: 114665 - DNA, 22 bp, Homo sapiens
actgcacttcaccctgggtgac

SEQ ID NO: 114666 - DNA, 22 bp, Homo sapiens
gcccagcccagaaaggttcgga

SEQ ID NO: 114667 - DNA, 22 bp, Homo sapiens
cggccaagccggggccccgaag

SEQ ID NO: 114668 - DNA, 22 bp, Homo sapiens
tcactgcactccagcctgggca

SEQ ID NO: 114669 - DNA, 22 bp, Homo sapiens
tgtacttgaacttgactgtaga

SEQ ID NO: 114670 - DNA, 22 bp, Homo sapiens
acagattcactgcactggccat

SEQ ID NO: 114671 - DNA, 22 bp, Homo sapiens
ccaagctacttaggagtctgag

SEQ ID NO: 114672 - DNA, 22 bp, Homo sapiens
ttgctctgactggagtgcagtg

SEQ ID NO: 114673 - DNA, 22 bp, Homo sapiens
ccccacaactcatgttgaaact

SEQ ID NO: 114674 - DNA, 22 bp, Homo sapiens
gcaggctgtctaaagttagagt

SEQ ID NO: 114675 - DNA, 22 bp, Homo sapiens
tgcgttgcgctcctgcagcagg

SEQ ID NO: 114676 - DNA, 23 bp, Homo sapiens
agagcaaggaaatgaggtgtgat

SEQ ID NO: 114677 - DNA, 22 bp, Homo sapiens
ccaggcagcctgctccattctg

SEQ ID NO: 114678 - DNA, 22 bp, Homo sapiens
atgggttcaagtgattctcctg

SEQ ID NO: 114679 - DNA, 22 bp, Homo sapiens
tggcacagactgggccaaggaa

SEQ ID NO: 114680 - DNA, 22 bp, Homo sapiens
gcaggtccagtcaccagagaga

SEQ ID NO: 114681 - DNA, 22 bp, Homo sapiens
attgaaaataaggccagaaaca

SEQ ID NO: 114682 - DNA, 22 bp, Homo sapiens
caaatgtataaatgtactttct

SEQ ID NO: 114683 - DNA, 22 bp, Homo sapiens
tatgtaagttgcaaatgaagga

SEQ ID NO: 114684 - DNA, 22 bp, Homo sapiens
tgcctgttgcccacctgataaa

SEQ ID NO: 114685 - DNA, 22 bp, Homo sapiens
gccagggttcgaatccgtatgg

SEQ ID NO: 114686 - DNA, 22 bp, Homo sapiens
ttgttgtcattgtagaggattt

SEQ ID NO: 114687 - DNA, 22 bp, Homo sapiens
gggccctgggattcagagcaag

SEQ ID NO: 114688 - DNA, 22 bp, Homo sapiens
ccagcatccatgctccctcggg

SEQ ID NO: 114689 - DNA, 22 bp, Homo sapiens
atggagttctgccagcgctgct

SEQ ID NO: 114690 - DNA, 22 bp, Homo sapiens
tgtctggtgggttgacaggcag

SEQ ID NO: 114691 - DNA, 22 bp, Homo sapiens
agtctagtaggatctctgggct

SEQ ID NO: 114692 - DNA, 22 bp, Homo sapiens
cagcccgccctgaactttcggg

SEQ ID NO: 114693 - DNA, 22 bp, Homo sapiens
ctgggatccacgggctcccaag

SEQ ID NO: 114694 - DNA, 22 bp, Homo sapiens
ctggtaggggtgactgttatcg

SEQ ID NO: 114695 - DNA, 22 bp, Homo sapiens
aaagtgctgaaattacaggtgt

SEQ ID NO: 114696 - DNA, 22 bp, Homo sapiens
ccggtcccaggtgccccggtga

SEQ ID NO: 114697 - DNA, 22 bp, Homo sapiens
tttgttttcaatgtgtcattca

SEQ ID NO: 114698 - DNA, 22 bp, Homo sapiens
gcgtggcttagagtggggtacc

SEQ ID NO: 114699 - DNA, 22 bp, Homo sapiens
ttggaatgttttaatataaatt

SEQ ID NO: 114700 - DNA, 22 bp, Homo sapiens
ccaggaggcggaaggtacagtg

SEQ ID NO: 114701 - DNA, 22 bp, Homo sapiens
tttgaagggcacgacaatagtt

SEQ ID NO: 114702 - DNA, 22 bp, Homo sapiens
tagtaagttctcgcattgttat

SEQ ID NO: 114703 - DNA, 22 bp, Homo sapiens
ggtcagccttggatttggtagc

SEQ ID NO: 114704 - DNA, 19 bp, Homo sapiens
catctggatgattctcctg

SEQ ID NO: 114705 - DNA, 22 bp, Homo sapiens
aggagggagcttaagccaggca

SEQ ID NO: 114706 - DNA, 22 bp, Homo sapiens
tcccacaggtggagcttgcagt

SEQ ID NO: 114707 - DNA, 22 bp, Homo sapiens
tgctttgtgacagattagtttt

SEQ ID NO: 114708 - DNA, 22 bp, Homo sapiens
cactgcactccagcccgggcaa

SEQ ID NO: 114709 - DNA, 22 bp, Homo sapiens
agagtactgctgctgggtactg

SEQ ID NO: 114710 - DNA, 22 bp, Homo sapiens
catgcaggcgcaacttctacaa

SEQ ID NO: 114711 - DNA, 23 bp, Homo sapiens
ttctgggctgtggaagcctcggg

SEQ ID NO: 114712 - DNA, 21 bp, Homo sapiens
tcgacctgctgggctcgggct

SEQ ID NO: 114713 - DNA, 22 bp, Homo sapiens
tgagtagagaattcagctaagg

SEQ ID NO: 114714 - DNA, 22 bp, Homo sapiens
tgcagcacttgccaaactaact

SEQ ID NO: 114715 - DNA, 22 bp, Homo sapiens
gcctggagaaaggaaggtggga

SEQ ID NO: 114716 - DNA, 22 bp, Homo sapiens
ttgagcccaggaggcctgggtg

SEQ ID NO: 114717 - DNA, 22 bp, Homo sapiens
tgggaagctgcattttaacaag

SEQ ID NO: 114718 - DNA, 22 bp, Homo sapiens
gccctgttgtcggacgtcaagg

SEQ ID NO: 114719 - DNA, 22 bp, Homo sapiens
ttctgcagtgttaacaatgtca

SEQ ID NO: 114720 - DNA, 22 bp, Homo sapiens
aaaagcaattgcgggttttgcc

SEQ ID NO: 114721 - DNA, 22 bp, Homo sapiens
gctgtatgtgaggccacagtga

SEQ ID NO: 114722 - DNA, 22 bp, Homo sapiens
ccagagctgattcctgggactt

SEQ ID NO: 114723 - DNA, 22 bp, Homo sapiens
ctcagctgcagcctggctggca

SEQ ID NO: 114724 - DNA, 22 bp, Homo sapiens
aggggaggtgtccccaaatctc

SEQ ID NO: 114725 - DNA, 22 bp, Homo sapiens
aaacactcatgtgttactctcc

SEQ ID NO: 114726 - DNA, 22 bp, Homo sapiens
ggcaagaacctcaattaccttt

SEQ ID NO: 114727 - DNA, 22 bp, Homo sapiens
tgattcatcagaataggagttt

SEQ ID NO: 114728 - DNA, 22 bp, Homo sapiens
agccagggacgctgcaggctac

SEQ ID NO: 114729 - DNA, 22 bp, Homo sapiens
gtcttgtcccagctctgccact

SEQ ID NO: 114730 - DNA, 22 bp, Homo sapiens
ggcatcttgttgctcaaatcta

SEQ ID NO: 114731 - DNA, 22 bp, Homo sapiens
agtgcaggccccaggccaggcc

SEQ ID NO: 114732 - DNA, 22 bp, Homo sapiens
ccaggaggcggaggttgcagcg

SEQ ID NO: 114733 - DNA, 22 bp, Homo sapiens
ggcatggacgtctctgaggcca

SEQ ID NO: 114734 - DNA, 22 bp, Homo sapiens
cttaactctacactgcacttta

SEQ ID NO: 114735 - DNA, 22 bp, Homo sapiens
gccagccagaaacgtcacactg

SEQ ID NO: 114736 - DNA, 22 bp, Homo sapiens
gaggcagaagttgcagtgagca

SEQ ID NO: 114737 - DNA, 22 bp, Homo sapiens
ctcaggatattgggctggagca

SEQ ID NO: 114738 - DNA, 22 bp, Homo sapiens
tttaaaaaactagtctgagtct

SEQ ID NO: 114739 - DNA, 22 bp, Homo sapiens
ttctggaaggatgtttctatct

SEQ ID NO: 114740 - DNA, 22 bp, Homo sapiens
atctggttttggctgtgtccct

SEQ ID NO: 114741 - DNA, 22 bp, Homo sapiens
ggatgacagatgcaggctttga

SEQ ID NO: 114742 - DNA, 22 bp, Homo sapiens
gcactttgcccctcctttggca

SEQ ID NO: 114743 - DNA, 19 bp, Homo sapiens
ctgacatgtgggggatgtc

SEQ ID NO: 114744 - DNA, 22 bp, Homo sapiens
gaagagtggttatccctgctgt

SEQ ID NO: 114745 - DNA, 22 bp, Homo sapiens
ctggcagagttgggtctcaaat

SEQ ID NO: 114746 - DNA, 22 bp, Homo sapiens
acatcctcccgatctactggct

SEQ ID NO: 114747 - DNA, 22 bp, Homo sapiens
gtgacatggtttgccgtccctg

SEQ ID NO: 114748 - DNA, 22 bp, Homo sapiens
tggtatgaccgtggtgcaagca

SEQ ID NO: 114749 - DNA, 22 bp, Homo sapiens
tctcgtgcaggccttgctcgga

SEQ ID NO: 114750 - DNA, 22 bp, Homo sapiens
atttttctctttccactgagat

SEQ ID NO: 114751 - DNA, 22 bp, Homo sapiens
atatccagcagcaggtgagtat

SEQ ID NO: 114752 - DNA, 22 bp, Homo sapiens
tacaaaaaattgatactgacga

SEQ ID NO: 114753 - DNA, 22 bp, Homo sapiens
tgacagtgcgggtacatcatag

SEQ ID NO: 114754 - DNA, 22 bp, Homo sapiens
gtggcagagccaaggctggagc

SEQ ID NO: 114755 - DNA, 22 bp, Homo sapiens
gggcagatcacctgaggtcagg

SEQ ID NO: 114756 - DNA, 22 bp, Homo sapiens
agcgtgaattagttggtacaca

SEQ ID NO: 114757 - DNA, 22 bp, Homo sapiens
atggcagaatatctgcatcgca

SEQ ID NO: 114758 - DNA, 22 bp, Homo sapiens
gtggcagaccttcccttctcct

SEQ ID NO: 114759 - DNA, 22 bp, Homo sapiens
ttggcagattctgaacaaagcc

SEQ ID NO: 114760 - DNA, 22 bp, Homo sapiens
ctggcagatagtaagtgatcaa

SEQ ID NO: 114761 - DNA, 22 bp, Homo sapiens
atgctatgtaactggcagatag

SEQ ID NO: 114762 - DNA, 20 bp, Homo sapiens
gtgtgacctcctgtggatgc

SEQ ID NO: 114763 - DNA, 22 bp, Homo sapiens
ggctcactgcaacttccgcctc

SEQ ID NO: 114764 - DNA, 22 bp, Homo sapiens
cttgatctacatagtgaaaccc

SEQ ID NO: 114765 - DNA, 22 bp, Homo sapiens
tggcagtggcgggactcagggc

SEQ ID NO: 114766 - DNA, 22 bp, Homo sapiens
tgcctgttgcccacctgataaa

SEQ ID NO: 114767 - DNA, 22 bp, Homo sapiens
cattgcaacttcaaactcctgg

SEQ ID NO: 114768 - DNA, 22 bp, Homo sapiens
atgtttaaagggttgagaaata

SEQ ID NO: 114769 - DNA, 22 bp, Homo sapiens
cttctgagatgttgttttacag

SEQ ID NO: 114770 - DNA, 22 bp, Homo sapiens
tgcagattcaaatgaaatgcaa

SEQ ID NO: 114771 - DNA, 22 bp, Homo sapiens
ggtaacttagctcatggctgtg

SEQ ID NO: 114772 - DNA, 22 bp, Homo sapiens
gaactttgcgcagttcccgggg

SEQ ID NO: 114773 - DNA, 22 bp, Homo sapiens
attgtggtgtcagttataggca

SEQ ID NO: 114774 - DNA, 18 bp, Homo sapiens
taggttacagccagccag

SEQ ID NO: 114775 - DNA, 22 bp, Homo sapiens
ctttaattgtagctcccataat

SEQ ID NO: 114776 - DNA, 22 bp, Homo sapiens
gctcttgtcaaaaattagttga

SEQ ID NO: 114777 - DNA, 22 bp, Homo sapiens
taacaatacccattctaattac

SEQ ID NO: 114778 - DNA, 21 bp, Homo sapiens
tgtaagtttcatctgaattgg

SEQ ID NO: 114779 - DNA, 22 bp, Homo sapiens
atatgcagtctcttgcccttct

SEQ ID NO: 114780 - DNA, 22 bp, Homo sapiens
catctgctgttccttggactca

SEQ ID NO: 114781 - DNA, 22 bp, Homo sapiens
cacttgttggtggtgaaatcac

SEQ ID NO: 114782 - DNA, 22 bp, Homo sapiens
gttatataagacaaatcagagt

SEQ ID NO: 114783 - DNA, 22 bp, Homo sapiens
tacttttctataggtttgaaat

SEQ ID NO: 114784 - DNA, 22 bp, Homo sapiens
ctaggtgatccactgctctctt

SEQ ID NO: 114785 - DNA, 22 bp, Homo sapiens
gtctatatattgcttgaataat

SEQ ID NO: 114786 - DNA, 22 bp, Homo sapiens
tgggtgctctgcgaccgtaggg

SEQ ID NO: 114787 - DNA, 22 bp, Homo sapiens
aactcactttgtggcttctgaa

SEQ ID NO: 114788 - DNA, 22 bp, Homo sapiens
gccttattacctgcactttgaa

SEQ ID NO: 114789 - DNA, 22 bp, Homo sapiens
acatgtttaagtttgttatatg

SEQ ID NO: 114790 - DNA, 22 bp, Homo sapiens
gattcactcatattttacgttt

SEQ ID NO: 114791 - DNA, 22 bp, Homo sapiens
gtgttaaccagctaaactttgc

SEQ ID NO: 114792 - DNA, 22 bp, Homo sapiens
aagactgtgtctatggctactc

SEQ ID NO: 114793 - DNA, 22 bp, Homo sapiens
tactgtactgcagttctgcaaa

SEQ ID NO: 114794 - DNA, 22 bp, Homo sapiens
ataatacatggttgatcttttc

SEQ ID NO: 114795 - DNA, 22 bp, Homo sapiens
tacaaaaaattgatactgacga

SEQ ID NO: 114796 - DNA, 22 bp, Homo sapiens
tacaagatgacaggtgcatgat

SEQ ID NO: 114797 - DNA, 22 bp, Homo sapiens
acagacaagtagttcagacaag

SEQ ID NO: 114798 - DNA, 22 bp, Homo sapiens
tctgctggaaaaccagggaatt

SEQ ID NO: 114799 - DNA, 22 bp, Homo sapiens
actgcactccagcctgggtgat

SEQ ID NO: 114800 - DNA, 22 bp, Homo sapiens
acacccaggctggcgtgcagtg

SEQ ID NO: 114801 - DNA, 22 bp, Homo sapiens
agcgctgtgggcgtgcgaggag

SEQ ID NO: 114802 - DNA, 22 bp, Homo sapiens
gtctatatattgcttgaataat

SEQ ID NO: 114803 - DNA, 22 bp, Homo sapiens
atacaaaatatatactggagac

SEQ ID NO: 114804 - DNA, 22 bp, Homo sapiens
aacccaggaggtggaggttgtg

SEQ ID NO: 114805 - DNA, 22 bp, Homo sapiens
gtaatctcagctacttgggagg

SEQ ID NO: 114806 - DNA, 22 bp, Homo sapiens
cactgcactccagcctgggaga

SEQ ID NO: 114807 - DNA, 22 bp, Homo sapiens
ccggctactcgggaggctgacg

SEQ ID NO: 114808 - DNA, 22 bp, Homo sapiens
tgggcagggagctggaaccaca

SEQ ID NO: 114809 - DNA, 22 bp, Homo sapiens
gtggggacgggatggctcactg

SEQ ID NO: 114810 - DNA, 22 bp, Homo sapiens
acagattcactgcactggccat

SEQ ID NO: 114811 - DNA, 22 bp, Homo sapiens
ccaggaggcagaagttgcagtg

SEQ ID NO: 114812 - DNA, 22 bp, Homo sapiens
tggtgcttgtggagctggtgct

SEQ ID NO: 114813 - DNA, 22 bp, Homo sapiens
gccttattacctgcactttgaa

SEQ ID NO: 114814 - DNA, 22 bp, Homo sapiens
gcttggaagtaggattgggaga

SEQ ID NO: 114815 - DNA, 22 bp, Homo sapiens
agttgcagacgcagagatgttg

SEQ ID NO: 114816 - DNA, 22 bp, Homo sapiens
aggacagagggaccagagccca

SEQ ID NO: 114817 - DNA, 22 bp, Homo sapiens
cccagtttcaactttccagtgg

SEQ ID NO: 114818 - DNA, 22 bp, Homo sapiens
cggggccctggggctgaaggtc

SEQ ID NO: 114819 - DNA, 22 bp, Homo sapiens
aaggagaaatggtagatgtgca

SEQ ID NO: 114820 - DNA, 22 bp, Homo sapiens
attggtggtgaggacatgccag

SEQ ID NO: 114821 - DNA, 22 bp, Homo sapiens
cgctgataaacgtcacgttccc

SEQ ID NO: 114822 - DNA, 22 bp, Homo sapiens
ctggggaccagtgtctgtttgt

SEQ ID NO: 114823 - DNA, 19 bp, Homo sapiens
ccctcttgcacaaagcaaa

SEQ ID NO: 114824 - DNA, 22 bp, Homo sapiens
acaattctgatggtttcccagt

SEQ ID NO: 114825 - DNA, 22 bp, Homo sapiens
aacccaggaggcggaggttgtg

SEQ ID NO: 114826 - DNA, 22 bp, Homo sapiens
cccccaaagtttgcacggataa

SEQ ID NO: 114827 - DNA, 22 bp, Homo sapiens
ggggctgaacctggaggtggtc

SEQ ID NO: 114828 - DNA, 22 bp, Homo sapiens
atgggctgtccattgctggctg

SEQ ID NO: 114829 - DNA, 22 bp, Homo sapiens
tctaatccttgctacctgggtg

SEQ ID NO: 114830 - DNA, 22 bp, Homo sapiens
gggcggatcatttgaggtcagg

SEQ ID NO: 114831 - DNA, 22 bp, Homo sapiens
aacccaggagttggaggctgtg

SEQ ID NO: 114832 - DNA, 22 bp, Homo sapiens
cactgcacttcagcctgggtga

SEQ ID NO: 114833 - DNA, 22 bp, Homo sapiens
cactgcactccagcctgggtga

SEQ ID NO: 114834 - DNA, 22 bp, Homo sapiens
taacaatacccattctaattac

SEQ ID NO: 114835 - DNA, 22 bp, Homo sapiens
atgaccagccgagataaacaga

SEQ ID NO: 114836 - DNA, 22 bp, Homo sapiens
attgcactccagcctgggggac

SEQ ID NO: 114837 - DNA, 22 bp, Homo sapiens
aacccgggaggcagaggttgtg

SEQ ID NO: 114838 - DNA, 22 bp, Homo sapiens
tggcaggcgggagccatagagg

SEQ ID NO: 114839 - DNA, 22 bp, Homo sapiens
gctggggaggcagcagagaaca

SEQ ID NO: 114840 - DNA, 22 bp, Homo sapiens
tcaggctcaggttaggggccaa

SEQ ID NO: 114841 - DNA, 22 bp, Homo sapiens
atatgcagtctcttgcccttct

SEQ ID NO: 114842 - DNA, 22 bp, Homo sapiens
ggtaacttagctcatggctgtg

SEQ ID NO: 114843 - DNA, 22 bp, Homo sapiens
ctgtaatcccagctacctggga

SEQ ID NO: 114844 - DNA, 22 bp, Homo sapiens
ttattttaccttcctctgagct

SEQ ID NO: 114845 - DNA, 22 bp, Homo sapiens
ccttgctcaagctagtgacggg

SEQ ID NO: 114846 - DNA, 18 bp, Homo sapiens
tctggaacaacttcatgt

SEQ ID NO: 114847 - DNA, 22 bp, Homo sapiens
ctgtaatcccagctactcggga

SEQ ID NO: 114848 - DNA, 22 bp, Homo sapiens
gctgggctgcgtcggggaagcc

SEQ ID NO: 114849 - DNA, 22 bp, Homo sapiens
ttattaggaactcaggattttt

SEQ ID NO: 114850 - DNA, 22 bp, Homo sapiens
tagatgtgttgcctggagttgt

SEQ ID NO: 114851 - DNA, 22 bp, Homo sapiens
ccaggaggcggaggttgcagcg

SEQ ID NO: 114852 - DNA, 18 bp, Homo sapiens
tgtagagccaggtttgcc

SEQ ID NO: 114853 - DNA, 22 bp, Homo sapiens
cacctgtacagggccgggctgg

SEQ ID NO: 114854 - DNA, 22 bp, Homo sapiens
ttggaacatgccggggtccagg

SEQ ID NO: 114855 - DNA, 22 bp, Homo sapiens
actgcactccagcctgggtgac

SEQ ID NO: 114856 - DNA, 22 bp, Homo sapiens
gcagccagagggggtgtgatca

SEQ ID NO: 114857 - DNA, 22 bp, Homo sapiens
tcacagagaaatgtggcacaaa

SEQ ID NO: 114858 - DNA, 22 bp, Homo sapiens
agagaagagtcttgtcaaatta

SEQ ID NO: 114859 - DNA, 22 bp, Homo sapiens
acgcctgtaatcccagcacttt

SEQ ID NO: 114860 - DNA, 22 bp, Homo sapiens
attgcactccggcctgggtgac

SEQ ID NO: 114861 - DNA, 19 bp, Homo sapiens
gcctcatttccacctcccc

SEQ ID NO: 114862 - DNA, 22 bp, Homo sapiens
cttctgagatgttgttttacag

SEQ ID NO: 114863 - DNA, 22 bp, Homo sapiens
caagaggattattaataaataa

SEQ ID NO: 114864 - DNA, 22 bp, Homo sapiens
ttcccacattctttacattcat

SEQ ID NO: 114865 - DNA, 22 bp, Homo sapiens
aactcactttgtggcttctgaa

SEQ ID NO: 114866 - DNA, 22 bp, Homo sapiens
tgggaggccgaggcaggtggat

SEQ ID NO: 114867 - DNA, 22 bp, Homo sapiens
gagatcggtaaagagcatgcac

SEQ ID NO: 114868 - DNA, 23 bp, Homo sapiens
aaataggagtatctggatcatga

SEQ ID NO: 114869 - DNA, 21 bp, Homo sapiens
tgcaatccagcctgggcgaca

SEQ ID NO: 114870 - DNA, 22 bp, Homo sapiens
gggctgtaggagctggaatggg

SEQ ID NO: 114871 - DNA, 22 bp, Homo sapiens
aacccaggagacaggttgcagt

SEQ ID NO: 114872 - DNA, 22 bp, Homo sapiens
tcactgcaacctccacctcccg

SEQ ID NO: 114873 - DNA, 22 bp, Homo sapiens
ttccacattccttacattcata

SEQ ID NO: 114874 - DNA, 22 bp, Homo sapiens
ttctcttttcaccagttgctaa

SEQ ID NO: 114875 - DNA, 22 bp, Homo sapiens
cgtgtggtcccggcaaggcaag

SEQ ID NO: 114876 - DNA, 22 bp, Homo sapiens
acccaggagacggaggtgcagt

SEQ ID NO: 114877 - DNA, 22 bp, Homo sapiens
ggccagaagttggaaaagagcc

SEQ ID NO: 114878 - DNA, 22 bp, Homo sapiens
gaggggtccaggaggcacttac

SEQ ID NO: 114879 - DNA, 22 bp, Homo sapiens
actgggctcaagtgattgtcct

SEQ ID NO: 114880 - DNA, 22 bp, Homo sapiens
cagagagaatcttggcagctga

SEQ ID NO: 114881 - DNA, 22 bp, Homo sapiens
gctcatgactgtaatcccagca

SEQ ID NO: 114882 - DNA, 22 bp, Homo sapiens
ctaggtgatccactgctctctt

SEQ ID NO: 114883 - DNA, 22 bp, Homo sapiens
tgggcttaggtcggaggcggcc

SEQ ID NO: 114884 - DNA, 22 bp, Homo sapiens
tccgggaggcagaggttgcagt

SEQ ID NO: 114885 - DNA, 22 bp, Homo sapiens
acccggagtcggaggttgcagt

SEQ ID NO: 114886 - DNA, 22 bp, Homo sapiens
agaggccggccgagcccatggg

SEQ ID NO: 114887 - DNA, 17 bp, Homo sapiens
tcggtttgccaggcttc

SEQ ID NO: 114888 - DNA, 22 bp, Homo sapiens
gaggcggaggttgcagtgagcc

SEQ ID NO: 114889 - DNA, 22 bp, Homo sapiens
gctcttgtcaaaaattagttga

SEQ ID NO: 114890 - DNA, 22 bp, Homo sapiens
taggtctgtttgggaaatgtga

SEQ ID NO: 114891 - DNA, 22 bp, Homo sapiens
gttcaagaccagcctggccaac

SEQ ID NO: 114892 - DNA, 22 bp, Homo sapiens
cactgcactccagcttgggtga

SEQ ID NO: 114893 - DNA, 22 bp, Homo sapiens
gtggggtagatctttctcagga

SEQ ID NO: 114894 - DNA, 22 bp, Homo sapiens
cgagagttagctaggagtcaca

SEQ ID NO: 114895 - DNA, 22 bp, Homo sapiens
ttatttaatgtgatctgaagag

SEQ ID NO: 114896 - DNA, 22 bp, Homo sapiens
aacccagggtggaggttgcagt

SEQ ID NO: 114897 - DNA, 22 bp, Homo sapiens
actgccaatggtagtttgatgg

SEQ ID NO: 114898 - DNA, 22 bp, Homo sapiens
agtatgtcagagtgaaaatggt

SEQ ID NO: 114899 - DNA, 22 bp, Homo sapiens
taaagggtaggttttactgtaa

SEQ ID NO: 114900 - DNA, 22 bp, Homo sapiens
ggggacctgggcttcaagggtt

SEQ ID NO: 114901 - DNA, 22 bp, Homo sapiens
ggaggtgggctaaggactctct

SEQ ID NO: 114902 - DNA, 22 bp, Homo sapiens
ggggccttttctgaatgtggaa

SEQ ID NO: 114903 - DNA, 22 bp, Homo sapiens
acccggcggagcctgcagtgag

SEQ ID NO: 114904 - DNA, 22 bp, Homo sapiens
acaggtcctcaagtcagctggg

SEQ ID NO: 114905 - DNA, 22 bp, Homo sapiens
tcactgcaacctccacctcctg

SEQ ID NO: 114906 - DNA, 22 bp, Homo sapiens
ctttaattgtagctcccataat

SEQ ID NO: 114907 - DNA, 22 bp, Homo sapiens
gtagcccacctggggagggcga

SEQ ID NO: 114908 - DNA, 22 bp, Homo sapiens
ggggtccctgcaccagcatgtc

SEQ ID NO: 114909 - DNA, 22 bp, Homo sapiens
gctaggagtggtgggtcaagga

SEQ ID NO: 114910 - DNA, 22 bp, Homo sapiens
actgcactcctgcctgggtaac

SEQ ID NO: 114911 - DNA, 22 bp, Homo sapiens
ccaggaggcggaggttgcagtg

SEQ ID NO: 114912 - DNA, 22 bp, Homo sapiens
gggacaatggaggcctctctcc

SEQ ID NO: 114913 - DNA, 22 bp, Homo sapiens
gagatatgttggcagctggtat

SEQ ID NO: 114914 - DNA, 22 bp, Homo sapiens
gagccagactgcctgaagctca

SEQ ID NO: 114915 - DNA, 18 bp, Homo sapiens
ccctcttgcacaaagcaa

SEQ ID NO: 114916 - DNA, 22 bp, Homo sapiens
cacttgttggtggtgaaatcac

SEQ ID NO: 114917 - DNA, 21 bp, Homo sapiens
tcctgtaagcttgggtggctc

SEQ ID NO: 114918 - DNA, 22 bp, Homo sapiens
cctgggctctgtcagaattggg

SEQ ID NO: 114919 - DNA, 22 bp, Homo sapiens
gggcaaaacctgggcatcatga

SEQ ID NO: 114920 - DNA, 22 bp, Homo sapiens
gagacctcttggtatcgctagg

SEQ ID NO: 114921 - DNA, 22 bp, Homo sapiens
agtgaaccaggctgcgtccctg

SEQ ID NO: 114922 - DNA, 21 bp, Homo sapiens
gggcagaggggcctcctgggt

SEQ ID NO: 114923 - DNA, 22 bp, Homo sapiens
aggtgcttggctcgtgcacaca

SEQ ID NO: 114924 - DNA, 22 bp, Homo sapiens
acacagagccaaaccatatcac

SEQ ID NO: 114925 - DNA, 22 bp, Homo sapiens
gagcactgatttatttttgtct

SEQ ID NO: 114926 - DNA, 22 bp, Homo sapiens
agtgctgtctccttcccccggg

SEQ ID NO: 114927 - DNA, 22 bp, Homo sapiens
tggttcctcaagcgctggcggc

SEQ ID NO: 114928 - DNA, 22 bp, Homo sapiens
gaacccggggaggttgcagtga

SEQ ID NO: 114929 - DNA, 22 bp, Homo sapiens
aacccaggagatggaggttgtg

SEQ ID NO: 114930 - DNA, 22 bp, Homo sapiens
gaactttgcgcagttcccgggg

SEQ ID NO: 114931 - DNA, 22 bp, Homo sapiens
gctgctaagcgtttctgttcca

SEQ ID NO: 114932 - DNA, 22 bp, Homo sapiens
ggtgacctcacctggtcccacc

SEQ ID NO: 114933 - DNA, 22 bp, Homo sapiens
tgcactccaggctgggtgacag

SEQ ID NO: 114934 - DNA, 22 bp, Homo sapiens
caagcttgtttctcctgggggt

SEQ ID NO: 114935 - DNA, 22 bp, Homo sapiens
gctgcagtgagccaagatcgtg

SEQ ID NO: 114936 - DNA, 22 bp, Homo sapiens
gcctcctgtcccaggctgagga

SEQ ID NO: 114937 - DNA, 22 bp, Homo sapiens
attgtggtgtcagttataggca

SEQ ID NO: 114938 - DNA, 22 bp, Homo sapiens
aacccgggaggcggaggttgtg

SEQ ID NO: 114939 - DNA, 21 bp, Homo sapiens
tgactgaggcttcttcacaca

SEQ ID NO: 114940 - DNA, 22 bp, Homo sapiens
ttaagctagtgaagtccctcaa

SEQ ID NO: 114941 - DNA, 22 bp, Homo sapiens
atatatttgagaatattcatga

SEQ ID NO: 114942 - DNA, 22 bp, Homo sapiens
ccatcacagtccccatcgtgat

SEQ ID NO: 114943 - DNA, 22 bp, Homo sapiens
tgggtgctctgcgaccgtaggg

SEQ ID NO: 114944 - DNA, 22 bp, Homo sapiens
aacccaggaggcagatgttgtg

SEQ ID NO: 114945 - DNA, 22 bp, Homo sapiens
attgcactccagcctgggtgac

SEQ ID NO: 114946 - DNA, 22 bp, Homo sapiens
gattcactcatattttacgttt

SEQ ID NO: 114947 - DNA, 23 bp, Homo sapiens
ctggggctttcaaatctgggcag

SEQ ID NO: 114948 - DNA, 22 bp, Homo sapiens
aaggtggaggttgcagtgagct

SEQ ID NO: 114949 - DNA, 22 bp, Homo sapiens
gaccctgtttctacaaataatt

SEQ ID NO: 114950 - DNA, 22 bp, Homo sapiens
gttactcttccccggggtctgg

SEQ ID NO: 114951 - DNA, 22 bp, Homo sapiens
aacccaggagccggaggttgtg

SEQ ID NO: 114952 - DNA, 22 bp, Homo sapiens
gcagcgaggtgatgaaatagct

SEQ ID NO: 114953 - DNA, 22 bp, Homo sapiens
tgcaggctcttggtgacgtggg

SEQ ID NO: 114954 - DNA, 22 bp, Homo sapiens
actgcacttcagcctgggtgtc

SEQ ID NO: 114955 - DNA, 22 bp, Homo sapiens
ataaaatttgctactgttaaat

SEQ ID NO: 114956 - DNA, 22 bp, Homo sapiens
tttctggcagcgggacaggggt

SEQ ID NO: 114957 - DNA, 22 bp, Homo sapiens
gggcggatcacctgaggtcagg

SEQ ID NO: 114958 - DNA, 22 bp, Homo sapiens
actgcacttcaccctgggtgac

SEQ ID NO: 114959 - DNA, 17 bp, Homo sapiens
cttcccaccatctcctg

SEQ ID NO: 114960 - DNA, 22 bp, Homo sapiens
catgagatttgggaggggccag

SEQ ID NO: 114961 - DNA, 22 bp, Homo sapiens
cgcgaggtggaggttgcagtga

SEQ ID NO: 114962 - DNA, 22 bp, Homo sapiens
tctaatcctatggtggggaggg

SEQ ID NO: 114963 - DNA, 22 bp, Homo sapiens
acatgtttaagtttgttatatg

SEQ ID NO: 114964 - DNA, 22 bp, Homo sapiens
ggctttgacatgctgaattaaa

SEQ ID NO: 114965 - DNA, 22 bp, Homo sapiens
attgttgggtctcactcctaga

SEQ ID NO: 114966 - DNA, 22 bp, Homo sapiens
tacgcctgtaatcccagcactt

SEQ ID NO: 114967 - DNA, 22 bp, Homo sapiens
cacctgtaatcccagcacttca

SEQ ID NO: 114968 - DNA, 22 bp, Homo sapiens
catagagtgatgtaaggtatgt

SEQ ID NO: 114969 - DNA, 22 bp, Homo sapiens
actggggactctggccttttga

SEQ ID NO: 114970 - DNA, 22 bp, Homo sapiens
ccaagctacttaggagtctgag

SEQ ID NO: 114971 - DNA, 22 bp, Homo sapiens
gaacccaggaggcagaggttgc

SEQ ID NO: 114972 - DNA, 22 bp, Homo sapiens
taccaccatttgcctgctgtat

SEQ ID NO: 114973 - DNA, 22 bp, Homo sapiens
gaggcggaggttgcagtgagct

SEQ ID NO: 114974 - DNA, 22 bp, Homo sapiens
actgcactccagcctgggtaac

SEQ ID NO: 114975 - DNA, 22 bp, Homo sapiens
actgcactccaacctgggtgac

SEQ ID NO: 114976 - DNA, 22 bp, Homo sapiens
tgtagtagcattcacgaagtgt

SEQ ID NO: 114977 - DNA, 20 bp, Homo sapiens
ttcatgggagcaaagaggcc

SEQ ID NO: 114978 - DNA, 22 bp, Homo sapiens
ccacccttgggttcggaggccg

SEQ ID NO: 114979 - DNA, 22 bp, Homo sapiens
gccggggctggggagagacatg

SEQ ID NO: 114980 - DNA, 22 bp, Homo sapiens
caaccccactacacgttggaga

SEQ ID NO: 114981 - DNA, 22 bp, Homo sapiens
tgcactactgtgatacacagcc

SEQ ID NO: 114982 - DNA, 22 bp, Homo sapiens
ttccagctaactcacatccctt

SEQ ID NO: 114983 - DNA, 22 bp, Homo sapiens
agctttggttgccatgatctga

SEQ ID NO: 114984 - DNA, 22 bp, Homo sapiens
gctctagtaggaatgtccctct

SEQ ID NO: 114985 - DNA, 22 bp, Homo sapiens
tgagatcattgacttgttcctg

SEQ ID NO: 114986 - DNA, 22 bp, Homo sapiens
caaatactacgattcttgcagt

SEQ ID NO: 114987 - DNA, 23 bp, Homo sapiens
ggggtcttggaacaggtggccct

SEQ ID NO: 114988 - DNA, 22 bp, Homo sapiens
atagggcctaaaaagtattgct

SEQ ID NO: 114989 - DNA, 22 bp, Homo sapiens
tgctgagcgcatccggcggccg

SEQ ID NO: 114990 - DNA, 22 bp, Homo sapiens
cacctagggtttcgcctttctt

SEQ ID NO: 114991 - DNA, 22 bp, Homo sapiens
atgttggagtcgtaaggcatgg

SEQ ID NO: 114992 - DNA, 22 bp, Homo sapiens
tgcaggctgtgtcatttagtga

SEQ ID NO: 114993 - DNA, 22 bp, Homo sapiens
tacttttctataggtttgaaat

SEQ ID NO: 114994 - DNA, 22 bp, Homo sapiens
tgagtagagaattcagctaagg

SEQ ID NO: 114995 - DNA, 22 bp, Homo sapiens
tgaagactcagaagctaagata

SEQ ID NO: 114996 - DNA, 22 bp, Homo sapiens
ctgagggtcaacttgattgtat

SEQ ID NO: 114997 - DNA, 22 bp, Homo sapiens
gttatataagacaaatcagagt

SEQ ID NO: 114998 - DNA, 22 bp, Homo sapiens
tttgaagggcacgacaatagtt

SEQ ID NO: 114999 - DNA, 22 bp, Homo sapiens
aggagaagccaagttgtgagca

SEQ ID NO: 115000 - DNA, 22 bp, Homo sapiens
cactgcactccatcctgggaaa

SEQ ID NO: 115001 - DNA, 22 bp, Homo sapiens
ggggatggaggcgtgtggtcct

SEQ ID NO: 115002 - DNA, 22 bp, Homo sapiens
catctgctgttccttggactca

SEQ ID NO: 115003 - DNA, 22 bp, Homo sapiens
agaggcaggaggttgacttgag

SEQ ID NO: 115004 - DNA, 22 bp, Homo sapiens
cggagtcttgctatgttgccca

SEQ ID NO: 115005 - DNA, 22 bp, Homo sapiens
gtggcttggaccagtcacagtg

SEQ ID NO: 115006 - DNA, 22 bp, Homo sapiens
atgtcatgaggctagcccccaa

SEQ ID NO: 115007 - DNA, 22 bp, Homo sapiens
gcccagccacagtcactttcat

SEQ ID NO: 115008 - DNA, 22 bp, Homo sapiens
gggtaggcaaagcaatgacgtt

SEQ ID NO: 115009 - DNA, 22 bp, Homo sapiens
aacccgggaggtggaggttatg

SEQ ID NO: 115010 - DNA, 22 bp, Homo sapiens
aggcaacttttggggatgatgg

SEQ ID NO: 115011 - DNA, 22 bp, Homo sapiens
cccacacacatttatgatagga

SEQ ID NO: 115012 - DNA, 21 bp, Homo sapiens
tgtaagtttcatctgaattgg

SEQ ID NO: 115013 - DNA, 22 bp, Homo sapiens
cactgcactccagcctgggtca

SEQ ID NO: 115014 - DNA, 22 bp, Homo sapiens
cttcctcctccatctcgaaggc

SEQ ID NO: 115015 - DNA, 22 bp, Homo sapiens
atggctagcaccgcgttgctgg

SEQ ID NO: 115016 - DNA, 22 bp, Homo sapiens
tgcttctgactaagctgcatga

SEQ ID NO: 115017 - DNA, 22 bp, Homo sapiens
gcttctggtgaggcctcaggaa

SEQ ID NO: 115018 - DNA, 18 bp, Homo sapiens
taggttacagccagccag

SEQ ID NO: 115019 - DNA, 22 bp, Homo sapiens
attgcacttcagcctgggtgac

SEQ ID NO: 115020 - DNA, 19 bp, Homo sapiens
gactccaactttaagcatg

SEQ ID NO: 115021 - DNA, 22 bp, Homo sapiens
gacccggctccaggcccagcag

SEQ ID NO: 115022 - DNA, 22 bp, Homo sapiens
atgtttaaagggttgagaaata

SEQ ID NO: 115023 - DNA, 22 bp, Homo sapiens
tgcagattcaaatgaaatgcaa

SEQ ID NO: 115024 - DNA, 22 bp, Homo sapiens
ggagagcttggagtgcgatttt

SEQ ID NO: 115025 - DNA, 22 bp, Homo sapiens
ctgagcctcctgcttctatttc

SEQ ID NO: 115026 - DNA, 22 bp, Homo sapiens
tcccacacagcccgctcaccgg

SEQ ID NO: 115027 - DNA, 23 bp, Homo sapiens
ggcctcagtgatgatgggttaaa

SEQ ID NO: 115028 - DNA, 22 bp, Homo sapiens
agggaattcactggaacgccct

SEQ ID NO: 115029 - DNA, 20 bp, Homo sapiens
tttgcgaggccaaggcgggc

SEQ ID NO: 115030 - DNA, 22 bp, Homo sapiens
aagacttgaccaggttgaaggc

SEQ ID NO: 115031 - DNA, 22 bp, Homo sapiens
actgcacttcagcctgggtgac

SEQ ID NO: 115032 - DNA, 22 bp, Homo sapiens
tcagcctccgaaagtgctggga

SEQ ID NO: 115033 - DNA, 22 bp, Homo sapiens
agagctaagaaacagaattgct

SEQ ID NO: 115034 - DNA, 22 bp, Homo sapiens
gccaatgacagtctcagttctg

SEQ ID NO: 115035 - DNA, 22 bp, Homo sapiens
gggctgactcctattggatgaa

SEQ ID NO: 115036 - DNA, 22 bp, Homo sapiens
gaccatcctggccaacgtggta

SEQ ID NO: 115037 - DNA, 22 bp, Homo sapiens
gtccaagagtcaagaagggggc

SEQ ID NO: 115038 - DNA, 22 bp, Homo sapiens
tcgcttgaacccaggaagtgga

SEQ ID NO: 115039 - DNA, 22 bp, Homo sapiens
cggaggttgaggctgcagtgag

SEQ ID NO: 115040 - DNA, 22 bp, Homo sapiens
tcaaatgaagacagttgacttg

SEQ ID NO: 115041 - DNA, 22 bp, Homo sapiens
gacctcatgatccacctgcctt

SEQ ID NO: 115042 - DNA, 22 bp, Homo sapiens
ctgcatccatgttgctgcaaag

SEQ ID NO: 115043 - DNA, 19 bp, Homo sapiens
aggaatggaattaattctg

SEQ ID NO: 115044 - DNA, 22 bp, Homo sapiens
tttgtcttatccaatctctcag

SEQ ID NO: 115045 - DNA, 22 bp, Homo sapiens
tatctcattttattgcaaatgt

SEQ ID NO: 115046 - DNA, 20 bp, Homo sapiens
cagcctgcatcatctgcagc

SEQ ID NO: 115047 - DNA, 22 bp, Homo sapiens
gggacaatggaggcctctctcc

SEQ ID NO: 115048 - DNA, 22 bp, Homo sapiens
gctgctaagcgtttctgttcca

SEQ ID NO: 115049 - DNA, 22 bp, Homo sapiens
acaattctgatggtttcccagt

SEQ ID NO: 115050 - DNA, 18 bp, Homo sapiens
cccggctaatttttggta

SEQ ID NO: 115051 - DNA, 22 bp, Homo sapiens
tcagggattgcaaaattcatcc

SEQ ID NO: 115052 - DNA, 23 bp, Homo sapiens
gtgcgccaggacaacctgacgga

SEQ ID NO: 115053 - DNA, 22 bp, Homo sapiens
cgatgaatatttaacgctgtga

SEQ ID NO: 115054 - DNA, 17 bp, Homo sapiens
gtaaggcttgcagatgc

SEQ ID NO: 115055 - DNA, 22 bp, Homo sapiens
agcataagttggtacagccact

SEQ ID NO: 115056 - DNA, 22 bp, Homo sapiens
tatgttgcaccaacctaataat

SEQ ID NO: 115057 - DNA, 19 bp, Homo sapiens
gactccaactttaagcatg

SEQ ID NO: 115058 - DNA, 22 bp, Homo sapiens
cagggtttcaccatgttagcag

SEQ ID NO: 115059 - DNA, 22 bp, Homo sapiens
taaagggtaggttttactgtaa

SEQ ID NO: 115060 - DNA, 22 bp, Homo sapiens
ctcactgcaagctccgcctccc

SEQ ID NO: 115061 - DNA, 22 bp, Homo sapiens
attctcaaaacataacttcact

SEQ ID NO: 115062 - DNA, 22 bp, Homo sapiens
atgccccagtgtgtgcttcctt

SEQ ID NO: 115063 - DNA, 22 bp, Homo sapiens
tgttttaagggtcaactgtcac

SEQ ID NO: 115064 - DNA, 22 bp, Homo sapiens
tcacaacgcctctgcaaatcct

SEQ ID NO: 115065 - DNA, 22 bp, Homo sapiens
gcctgtgtggatgcgccggtgc

SEQ ID NO: 115066 - DNA, 22 bp, Homo sapiens
taattgtaaagtagtagtacag

SEQ ID NO: 115067 - DNA, 22 bp, Homo sapiens
ctgctttgcatagctgccagag

SEQ ID NO: 115068 - DNA, 22 bp, Homo sapiens
gaccttgtgatccacccgcctt

SEQ ID NO: 115069 - DNA, 22 bp, Homo sapiens
attttctatgttgtaattgtta

SEQ ID NO: 115070 - DNA, 22 bp, Homo sapiens
ctcactgcaacctctgcctccc

SEQ ID NO: 115071 - DNA, 22 bp, Homo sapiens
actgcaacctccacctcctggg

SEQ ID NO: 115072 - DNA, 22 bp, Homo sapiens
gtgcacatcgtgcaggtttgtt

SEQ ID NO: 115073 - DNA, 22 bp, Homo sapiens
ggtccccgtggaggctggagcg

SEQ ID NO: 115074 - DNA, 22 bp, Homo sapiens
tgttatcctcagctcacctcta

SEQ ID NO: 115075 - DNA, 22 bp, Homo sapiens
attgtgtcctcattgaccttca

SEQ ID NO: 115076 - DNA, 22 bp, Homo sapiens
catgcctgtaatcccagcactt

SEQ ID NO: 115077 - DNA, 21 bp, Homo sapiens
tgactgaggcttcttcacaca

SEQ ID NO: 115078 - DNA, 22 bp, Homo sapiens
atggctagcaccgcgttgctgg

SEQ ID NO: 115079 - DNA, 22 bp, Homo sapiens
gattgagtctgaggatgctgca

SEQ ID NO: 115080 - DNA, 22 bp, Homo sapiens
actgcaacctccgcctgccagg

SEQ ID NO: 115081 - DNA, 22 bp, Homo sapiens
agaaatatgctgattagatgaa

SEQ ID NO: 115082 - DNA, 22 bp, Homo sapiens
gagacctcttggtatcgctagg

SEQ ID NO: 115083 - DNA, 22 bp, Homo sapiens
ctgctcagtaatagtcctatct

SEQ ID NO: 115084 - DNA, 22 bp, Homo sapiens
tgatttcaagccagggggcgtt

SEQ ID NO: 115085 - DNA, 22 bp, Homo sapiens
tttctataaaaagtgctaggat

SEQ ID NO: 115086 - DNA, 22 bp, Homo sapiens
cctcggctgggccttggccact

SEQ ID NO: 115087 - DNA, 22 bp, Homo sapiens
gacctcgtgatccgccctcctt

SEQ ID NO: 115088 - DNA, 22 bp, Homo sapiens
cgtcattgtcctggacttgcaa

SEQ ID NO: 115089 - DNA, 22 bp, Homo sapiens
atgccactgcactccagcctgg

SEQ ID NO: 115090 - DNA, 22 bp, Homo sapiens
agaggccggccgagcccatggg

SEQ ID NO: 115091 - DNA, 22 bp, Homo sapiens
ccaatgatggtgcccacgatga

SEQ ID NO: 115092 - DNA, 20 bp, Homo sapiens
ataaaataactgccacaaga

SEQ ID NO: 115093 - DNA, 22 bp, Homo sapiens
gtccccgacgtttggcttgatg

SEQ ID NO: 115094 - DNA, 22 bp, Homo sapiens
atgccactgcgctccagcctgg

SEQ ID NO: 115095 - DNA, 22 bp, Homo sapiens
aatgttgcagagtgattgtcca

SEQ ID NO: 115096 - DNA, 22 bp, Homo sapiens
tccaaggagcagtcttcaacct

SEQ ID NO: 115097 - DNA, 22 bp, Homo sapiens
tttgttttcaatgtgtcattca

SEQ ID NO: 115098 - DNA, 22 bp, Homo sapiens
ggaactgaatgtctcggtataa

SEQ ID NO: 115099 - DNA, 22 bp, Homo sapiens
aaggaggcctggcagatgaaga

SEQ ID NO: 115100 - DNA, 22 bp, Homo sapiens
aatggcactttataaatgttaa

SEQ ID NO: 115101 - DNA, 22 bp, Homo sapiens
gcccagccacagtcactttcat

SEQ ID NO: 115102 - DNA, 22 bp, Homo sapiens
cccacacacatttatgatagga

SEQ ID NO: 115103 - DNA, 22 bp, Homo sapiens
tttctttatcatagcatctttg

SEQ ID NO: 115104 - DNA, 21 bp, Homo sapiens
tgtaagtttcatctgaattgg

SEQ ID NO: 115105 - DNA, 20 bp, Homo sapiens
tctcgcactcggagcagccg

SEQ ID NO: 115106 - DNA, 21 bp, Homo sapiens
aaactgaccttgcctgagaca

SEQ ID NO: 115107 - DNA, 22 bp, Homo sapiens
tatggctaattctttactgacc

SEQ ID NO: 115108 - DNA, 22 bp, Homo sapiens
tctgacattttgagaatgacat

SEQ ID NO: 115109 - DNA, 22 bp, Homo sapiens
gatgtgtttccaggatttgttt

SEQ ID NO: 115110 - DNA, 21 bp, Homo sapiens
tcctgtaagcttgggtggctc

SEQ ID NO: 115111 - DNA, 22 bp, Homo sapiens
atgccactgcgctctagcctgg

SEQ ID NO: 115112 - DNA, 23 bp, Homo sapiens
ttttgcaataagtcactggaata

SEQ ID NO: 115113 - DNA, 22 bp, Homo sapiens
ccttgctcaagctagtgacggg

SEQ ID NO: 115114 - DNA, 22 bp, Homo sapiens
aggagggagcttaagccaggca

SEQ ID NO: 115115 - DNA, 22 bp, Homo sapiens
gtctcgtcaatggcaggttccc

SEQ ID NO: 115116 - DNA, 22 bp, Homo sapiens
ttggccatctaagcccagccac

SEQ ID NO: 115117 - DNA, 22 bp, Homo sapiens
tggttcctcaagcgctggcggc

SEQ ID NO: 115118 - DNA, 17 bp, Homo sapiens
cttcccaccatctcctg

SEQ ID NO: 115119 - DNA, 22 bp, Homo sapiens
ctcactgcaagctcagcctccc

SEQ ID NO: 115120 - DNA, 22 bp, Homo sapiens
acaggtcctcaagtcagctggg

SEQ ID NO: 115121 - DNA, 22 bp, Homo sapiens
atgccactgcactccagcctag

SEQ ID NO: 115122 - DNA, 23 bp, Homo sapiens
aaacttgctatggctgaaatcat

SEQ ID NO: 115123 - DNA, 22 bp, Homo sapiens
tctgtgcctgcttccccaccca

SEQ ID NO: 115124 - DNA, 22 bp, Homo sapiens
aagacttgaccaggttgaaggc

SEQ ID NO: 115125 - DNA, 22 bp, Homo sapiens
tagattcagatatttaggacaa

SEQ ID NO: 115126 - DNA, 22 bp, Homo sapiens
aggacttagaacattatgtact

SEQ ID NO: 115127 - DNA, 22 bp, Homo sapiens
aattgcaaattcagacttaaga

SEQ ID NO: 115128 - DNA, 22 bp, Homo sapiens
tgagccaggagtttgaggctgt

SEQ ID NO: 115129 - DNA, 22 bp, Homo sapiens
aggggaatgggtagactgttga

SEQ ID NO: 115130 - DNA, 22 bp, Homo sapiens
tttaatgtagcgtgaaatgatt

SEQ ID NO: 115131 - DNA, 22 bp, Homo sapiens
tgttgctgtatgaataggaagg

SEQ ID NO: 115132 - DNA, 20 bp, Homo sapiens
ttcatgggagcaaagaggcc

SEQ ID NO: 115133 - DNA, 22 bp, Homo sapiens
gatgaatgatggcttgtttctg

SEQ ID NO: 115134 - DNA, 22 bp, Homo sapiens
ttaataaagtatgaattggaaa

SEQ ID NO: 115135 - DNA, 22 bp, Homo sapiens
ctcactgcaagctctgcctcca

SEQ ID NO: 115136 - DNA, 22 bp, Homo sapiens
ttatttaaaagtggtaagattc

SEQ ID NO: 115137 - DNA, 22 bp, Homo sapiens
ttgtgaatggtgccgcaataaa

SEQ ID NO: 115138 - DNA, 22 bp, Homo sapiens
tcggagctgtagatgaaaccct

SEQ ID NO: 115139 - DNA, 22 bp, Homo sapiens
atggccgcctgtccttcccgcc

SEQ ID NO: 115140 - DNA, 22 bp, Homo sapiens
cgctgataaacgtcacgttccc

SEQ ID NO: 115141 - DNA, 22 bp, Homo sapiens
tacaaaaaattgatactgacga

SEQ ID NO: 115142 - DNA, 22 bp, Homo sapiens
gggttactgcttcaaaaaatta

SEQ ID NO: 115143 - DNA, 22 bp, Homo sapiens
gcagtatctatgtgatgggttg

SEQ ID NO: 115144 - DNA, 22 bp, Homo sapiens
atcaacatgtcataaagtgaaa

SEQ ID NO: 115145 - DNA, 22 bp, Homo sapiens
ttgatcaaatcagctactgagg

SEQ ID NO: 115146 - DNA, 22 bp, Homo sapiens
tggaatggaaacaaactgagga

SEQ ID NO: 115147 - DNA, 19 bp, Homo sapiens
agagtattgaatttgccct

SEQ ID NO: 115148 - DNA, 22 bp, Homo sapiens
agcaagattgaggcttcctcag

SEQ ID NO: 115149 - DNA, 22 bp, Homo sapiens
tctgttttgcataatgttcttt

SEQ ID NO: 115150 - DNA, 22 bp, Homo sapiens
aatgtcaaaggctatacattca

SEQ ID NO: 115151 - DNA, 20 bp, Homo sapiens
aggaaaaatggaaactggag

SEQ ID NO: 115152 - DNA, 22 bp, Homo sapiens
atcaagtgaagggctcttgaag

SEQ ID NO: 115153 - DNA, 22 bp, Homo sapiens
ctgagggtcaacttgattgtat

SEQ ID NO: 115154 - DNA, 22 bp, Homo sapiens
atgtttaaagggttgagaaata

SEQ ID NO: 115155 - DNA, 22 bp, Homo sapiens
cggccgcagcagtgtcggccca

SEQ ID NO: 115156 - DNA, 23 bp, Homo sapiens
agcttttaggtggaaatggcact

SEQ ID NO: 115157 - DNA, 22 bp, Homo sapiens
gggaaagaccttcctggggtgt

SEQ ID NO: 115158 - DNA, 23 bp, Homo sapiens
ctcaccaagcgccgccgctgtgt

SEQ ID NO: 115159 - DNA, 22 bp, Homo sapiens
tgatattttatgagctttcata

SEQ ID NO: 115160 - DNA, 22 bp, Homo sapiens
acgtgcaggatctggttggcga

SEQ ID NO: 115161 - DNA, 22 bp, Homo sapiens
ctcgtgatccgcccacctcagc

SEQ ID NO: 115162 - DNA, 22 bp, Homo sapiens
cagtctctaaatcaatctgaat

SEQ ID NO: 115163 - DNA, 22 bp, Homo sapiens
tgcactccaggctgggtgacag

SEQ ID NO: 115164 - DNA, 21 bp, Homo sapiens
gggcagaggggcctcctgggt

SEQ ID NO: 115165 - DNA, 22 bp, Homo sapiens
tgcaatctcggcactttgggag

SEQ ID NO: 115166 - DNA, 19 bp, Homo sapiens
ttgacgttgtggaattaac

SEQ ID NO: 115167 - DNA, 22 bp, Homo sapiens
cggagtcttgctatgttgccca

SEQ ID NO: 115168 - DNA, 22 bp, Homo sapiens
gaggagggagctggaagctctt

SEQ ID NO: 115169 - DNA, 20 bp, Homo sapiens
tggcctctgagatgccacgg

SEQ ID NO: 115170 - DNA, 22 bp, Homo sapiens
actgccaatggtagtttgatgg

SEQ ID NO: 115171 - DNA, 22 bp, Homo sapiens
aaagaaatagatggcatttaaa

SEQ ID NO: 115172 - DNA, 22 bp, Homo sapiens
atgcaactacccccaggatttt

SEQ ID NO: 115173 - DNA, 22 bp, Homo sapiens
agaaaatttaaagagacacaca

SEQ ID NO: 115174 - DNA, 22 bp, Homo sapiens
atgttggagtcgtaaggcatgg

SEQ ID NO: 115175 - DNA, 22 bp, Homo sapiens
cgcaactcagcaacttaactgc

SEQ ID NO: 115176 - DNA, 22 bp, Homo sapiens
cggctcactgcagctccgcctc

SEQ ID NO: 115177 - DNA, 22 bp, Homo sapiens
caaatactacgattcttgcagt

SEQ ID NO: 115178 - DNA, 22 bp, Homo sapiens
tgcgatggcgtagacaaatccc

SEQ ID NO: 115179 - DNA, 22 bp, Homo sapiens
ttcccacattctttacattcat

SEQ ID NO: 115180 - DNA, 22 bp, Homo sapiens
tatctatgtgctctgacctctc

SEQ ID NO: 115181 - DNA, 22 bp, Homo sapiens
cactgcaacctccacctcctgg

SEQ ID NO: 115182 - DNA, 22 bp, Homo sapiens
aaggcaggatgggaaaagattt

SEQ ID NO: 115183 - DNA, 22 bp, Homo sapiens
tctggtgtcagtattctttgaa

SEQ ID NO: 115184 - DNA, 22 bp, Homo sapiens
tcccacacagcccgctcaccgg

SEQ ID NO: 115185 - DNA, 22 bp, Homo sapiens
tgtgttaaggtgcatctagtgc

SEQ ID NO: 115186 - DNA, 22 bp, Homo sapiens
tgtgtctgtgtatacacggcat

SEQ ID NO: 115187 - DNA, 22 bp, Homo sapiens
acacagagccaaaccatatcac

SEQ ID NO: 115188 - DNA, 22 bp, Homo sapiens
ttccacattccttacattcata

SEQ ID NO: 115189 - DNA, 22 bp, Homo sapiens
tttgaaatatgtgtcttttgaa

SEQ ID NO: 115190 - DNA, 22 bp, Homo sapiens
aatgaattgcagtactgacttg

SEQ ID NO: 115191 - DNA, 22 bp, Homo sapiens
ggctcaatgcaacttctgcctc

SEQ ID NO: 115192 - DNA, 23 bp, Homo sapiens
aaataggagtatctggatcatga

SEQ ID NO: 115193 - DNA, 22 bp, Homo sapiens
gttgaaatcctaaccccctagt

SEQ ID NO: 115194 - DNA, 22 bp, Homo sapiens
tcactacaacctccgcctcctg

SEQ ID NO: 115195 - DNA, 18 bp, Homo sapiens
tgtagagccaggtttgcc

SEQ ID NO: 115196 - DNA, 22 bp, Homo sapiens
tgcgccatgtgctctcggccct

SEQ ID NO: 115197 - DNA, 22 bp, Homo sapiens
agagggaagatggtccaatctt

SEQ ID NO: 115198 - DNA, 22 bp, Homo sapiens
acccagccatgttcagttctct

SEQ ID NO: 115199 - DNA, 19 bp, Homo sapiens
agccagccagcaggtatgc

SEQ ID NO: 115200 - DNA, 22 bp, Homo sapiens
catagagtgatgtaaggtatgt

SEQ ID NO: 115201 - DNA, 22 bp, Homo sapiens
ttcaatatgatattagctgtgg

SEQ ID NO: 115202 - DNA, 22 bp, Homo sapiens
tatactctgagaaacgtgtcac

SEQ ID NO: 115203 - DNA, 22 bp, Homo sapiens
ggctcactgcaacttccgcctc

SEQ ID NO: 115204 - DNA, 22 bp, Homo sapiens
gcgcactgggcgcacgcgtagg

SEQ ID NO: 115205 - DNA, 22 bp, Homo sapiens
gtgtgtctcccaagaaggccca

SEQ ID NO: 115206 - DNA, 22 bp, Homo sapiens
tccacgtgagcttcgtgtgcag

SEQ ID NO: 115207 - DNA, 22 bp, Homo sapiens
atgccactgcacttcagcctgg

SEQ ID NO: 115208 - DNA, 22 bp, Homo sapiens
acctggtgggagataattgaat

SEQ ID NO: 115209 - DNA, 22 bp, Homo sapiens
gacccggctccaggcccagcag

SEQ ID NO: 115210 - DNA, 22 bp, Homo sapiens
ttatgatttgccacagattggt

SEQ ID NO: 115211 - DNA, 22 bp, Homo sapiens
gaatgacgccctgtggtcactt

SEQ ID NO: 115212 - DNA, 22 bp, Homo sapiens
cttgtagacccctggactcacg

SEQ ID NO: 115213 - DNA, 22 bp, Homo sapiens
gcaactgaacatgtgtgtggcc

SEQ ID NO: 115214 - DNA, 22 bp, Homo sapiens
ttaatgaaaggcagtttggaac

SEQ ID NO: 115215 - DNA, 22 bp, Homo sapiens
gtgccccagacacgcatgtggg

SEQ ID NO: 115216 - DNA, 22 bp, Homo sapiens
acagattcactgcactggccat

SEQ ID NO: 115217 - DNA, 22 bp, Homo sapiens
attaatgaaactttggttaagc

SEQ ID NO: 115218 - DNA, 22 bp, Homo sapiens
ccatcacagtccccatcgtgat

SEQ ID NO: 115219 - DNA, 23 bp, Homo sapiens
ccactagcacctgttcaacttct

SEQ ID NO: 115220 - DNA, 22 bp, Homo sapiens
agatggtagactatggaacgta

SEQ ID NO: 115221 - DNA, 22 bp, Homo sapiens
tgagggaatattgatagatccg

SEQ ID NO: 115222 - DNA, 22 bp, Homo sapiens
cttagatgaagtcacagaaccc

SEQ ID NO: 115223 - DNA, 22 bp, Homo sapiens
tgactacaacctccacctcccg

SEQ ID NO: 115224 - DNA, 22 bp, Homo sapiens
gactggaaagcctgtcctcaga

SEQ ID NO: 115225 - DNA, 22 bp, Homo sapiens
tttttagtagaggtgggtttca

SEQ ID NO: 115226 - DNA, 22 bp, Homo sapiens
aagtgatgctacgactttgaca

SEQ ID NO: 115227 - DNA, 22 bp, Homo sapiens
tttggtattgcacactgtcttc

SEQ ID NO: 115228 - DNA, 22 bp, Homo sapiens
atctagattaggtataagagct

SEQ ID NO: 115229 - DNA, 22 bp, Homo sapiens
tgtgtgagtaaggctgagagag

SEQ ID NO: 115230 - DNA, 22 bp, Homo sapiens
gagggaaaggttaatacatgat

SEQ ID NO: 115231 - DNA, 23 bp, Homo sapiens
aggatgtaggatgtatggcagag

SEQ ID NO: 115232 - DNA, 22 bp, Homo sapiens
atagggcctaaaaagtattgct

SEQ ID NO: 115233 - DNA, 22 bp, Homo sapiens
tctgtagtaggttgtagttctt

SEQ ID NO: 115234 - DNA, 22 bp, Homo sapiens
agccaggatggtctcgatcggc

SEQ ID NO: 115235 - DNA, 22 bp, Homo sapiens
cagtggcgtgatctctgctcac

SEQ ID NO: 115236 - DNA, 22 bp, Homo sapiens
agatcggctttgcagacctcat

SEQ ID NO: 115237 - DNA, 22 bp, Homo sapiens
tgcccaggctggagtacagtgg

SEQ ID NO: 115238 - DNA, 23 bp, Homo sapiens
aatgggtgcaactatccatgaca

SEQ ID NO: 115239 - DNA, 22 bp, Homo sapiens
ccaagctacttaggagtctgag

SEQ ID NO: 115240 - DNA, 22 bp, Homo sapiens
agtcaataaaagctttagattc

SEQ ID NO: 115241 - DNA, 22 bp, Homo sapiens
aagtcgtggcaggcttgcacga

SEQ ID NO: 115242 - DNA, 22 bp, Homo sapiens
taatgtataacaaatactcatc

SEQ ID NO: 115243 - DNA, 22 bp, Homo sapiens
ttgtgaatagtgccgcaataaa

SEQ ID NO: 115244 - DNA, 22 bp, Homo sapiens
atatatttgagaatattcatga

SEQ ID NO: 115245 - DNA, 22 bp, Homo sapiens
tgctgtgaggttgagaaggaag

SEQ ID NO: 115246 - DNA, 22 bp, Homo sapiens
tctgacattagattaattggaa

SEQ ID NO: 115247 - DNA, 22 bp, Homo sapiens
cttgcctttgtcttcaaaggct

SEQ ID NO: 115248 - DNA, 22 bp, Homo sapiens
ctcactgcaagctctgcctccc

SEQ ID NO: 115249 - DNA, 22 bp, Homo sapiens
aaacttgagccaagggcttggg

SEQ ID NO: 115250 - DNA, 22 bp, Homo sapiens
cccccaaagtttgcacggataa

SEQ ID NO: 115251 - DNA, 22 bp, Homo sapiens
catgatctggtcctactgtggg

SEQ ID NO: 115252 - DNA, 21 bp, Homo sapiens
ggtgtgggatggactgaacca

SEQ ID NO: 115253 - DNA, 22 bp, Homo sapiens
tgagtagagaattcagctaagg

SEQ ID NO: 115254 - DNA, 22 bp, Homo sapiens
aaaactacatttgacattttgt

SEQ ID NO: 115255 - DNA, 20 bp, Homo sapiens
acgtggccaccagtggctta

SEQ ID NO: 115256 - DNA, 22 bp, Homo sapiens
tcaccgaggctggagtgcagtg

SEQ ID NO: 115257 - DNA, 17 bp, Homo sapiens
catccgtgagctcggca

SEQ ID NO: 115258 - DNA, 16 bp, Homo sapiens
ccacctgcagctctca

SEQ ID NO: 115259 - DNA, 19 bp, Homo sapiens
gcctcatttccacctcccc

SEQ ID NO: 115260 - DNA, 22 bp, Homo sapiens
ttatatgtttctgtttggaggc

SEQ ID NO: 115261 - DNA, 22 bp, Homo sapiens
tacttttagcctatttgattct

SEQ ID NO: 115262 - DNA, 21 bp, Homo sapiens
gccatttcacacagacatttg

SEQ ID NO: 115263 - DNA, 22 bp, Homo sapiens
tctgttgcaatgtgcatggtga

SEQ ID NO: 115264 - DNA, 22 bp, Homo sapiens
tcactgcgcttcagcctgggtg

SEQ ID NO: 115265 - DNA, 22 bp, Homo sapiens
ttatttaatgtgatctgaagag

SEQ ID NO: 115266 - DNA, 22 bp, Homo sapiens
taatgtaaacacagagacagaa

SEQ ID NO: 115267 - DNA, 22 bp, Homo sapiens
attataggcttgagccaccgtg

SEQ ID NO: 115268 - DNA, 22 bp, Homo sapiens
tctcccaggcaggagtgcagtg

SEQ ID NO: 115269 - DNA, 22 bp, Homo sapiens
tctcgatctcctgaccttgtga

SEQ ID NO: 115270 - DNA, 22 bp, Homo sapiens
ctcactgcaacctccgcctcct

SEQ ID NO: 115271 - DNA, 22 bp, Homo sapiens
ataaaagatcccttctgagctc

SEQ ID NO: 115272 - DNA, 22 bp, Homo sapiens
gctgcgccggatcccacgttcc

SEQ ID NO: 115273 - DNA, 22 bp, Homo sapiens
tgtggacgtcattaaagcagtg

SEQ ID NO: 115274 - DNA, 22 bp, Homo sapiens
gcagcctcaaactccccagctc

SEQ ID NO: 115275 - DNA, 22 bp, Homo sapiens
atgccacttcattccagcctcg

SEQ ID NO: 115276 - DNA, 22 bp, Homo sapiens
tctcgctctgtcgcccaggctg

SEQ ID NO: 115277 - DNA, 22 bp, Homo sapiens
accgagttagccaggatggtct

SEQ ID NO: 115278 - DNA, 22 bp, Homo sapiens
aggctatttccactcttctcat

SEQ ID NO: 115279 - DNA, 22 bp, Homo sapiens
gaggcagaagttgcagtgagca

SEQ ID NO: 115280 - DNA, 22 bp, Homo sapiens
cttagatgaagtcacagaaccc

SEQ ID NO: 115281 - DNA, 22 bp, Homo sapiens
aaagaaatagatggcatttaaa

SEQ ID NO: 115282 - DNA, 22 bp, Homo sapiens
ttttccttcatatcccttatgt

SEQ ID NO: 115283 - DNA, 22 bp, Homo sapiens
actttcttggtcccatgtttga

SEQ ID NO: 115284 - DNA, 22 bp, Homo sapiens
taacaatacccattctaattac

SEQ ID NO: 115285 - DNA, 22 bp, Homo sapiens
ggctcactgcaacttccgcctc

SEQ ID NO: 115286 - DNA, 22 bp, Homo sapiens
acaaagtgctgacattacaggc

SEQ ID NO: 115287 - DNA, 22 bp, Homo sapiens
cggctcactgcagctccgcctc

SEQ ID NO: 115288 - DNA, 22 bp, Homo sapiens
cactgcactccagcttgggtga

SEQ ID NO: 115289 - DNA, 22 bp, Homo sapiens
attgataaattgcaatggggct

SEQ ID NO: 115290 - DNA, 22 bp, Homo sapiens
ggctgagttgagaggattactt

SEQ ID NO: 115291 - DNA, 22 bp, Homo sapiens
cgggttcacgccattctcctgc

SEQ ID NO: 115292 - DNA, 18 bp, Homo sapiens
ttgcttcttttctctagg

SEQ ID NO: 115293 - DNA, 22 bp, Homo sapiens
cactgcactccagcccgggcaa

SEQ ID NO: 115294 - DNA, 22 bp, Homo sapiens
gtctttcttaaacaacagaaca

SEQ ID NO: 115295 - DNA, 22 bp, Homo sapiens
ggggtgggcgtgcagggacacc

SEQ ID NO: 115296 - DNA, 22 bp, Homo sapiens
tcgtgatctgtccacctcggcc

SEQ ID NO: 115297 - DNA, 22 bp, Homo sapiens
ttctcttttcaccagttgctaa

SEQ ID NO: 115298 - DNA, 22 bp, Homo sapiens
cactgcactccagcctgggaga

SEQ ID NO: 115299 - DNA, 22 bp, Homo sapiens
accctcaacaaattcactctat

SEQ ID NO: 115300 - DNA, 22 bp, Homo sapiens
tgatatgtaactactccttata

SEQ ID NO: 115301 - DNA, 22 bp, Homo sapiens
catcatactgtttacactcaaa

SEQ ID NO: 115302 - DNA, 22 bp, Homo sapiens
agtgaaaacctaatcatgcagt

SEQ ID NO: 115303 - DNA, 22 bp, Homo sapiens
aaagcagaggttgcagtgagct

SEQ ID NO: 115304 - DNA, 22 bp, Homo sapiens
aagaaatgtgaatattgaatag

SEQ ID NO: 115305 - DNA, 22 bp, Homo sapiens
gagccaggggtcagctccgagg

SEQ ID NO: 115306 - DNA, 22 bp, Homo sapiens
ttttcctttgattcccagatgt

SEQ ID NO: 115307 - DNA, 22 bp, Homo sapiens
ttctttgcccatgtttcctaag

SEQ ID NO: 115308 - DNA, 20 bp, Homo sapiens
aaattactgccacacatttc

SEQ ID NO: 115309 - DNA, 22 bp, Homo sapiens
ttttaatactgctattgtagga

SEQ ID NO: 115310 - DNA, 22 bp, Homo sapiens
tggacaacatagtgagacctca

SEQ ID NO: 115311 - DNA, 22 bp, Homo sapiens
ttgttcttgtctttgccttcac

SEQ ID NO: 115312 - DNA, 22 bp, Homo sapiens
atttagacatgtatctgatagc

SEQ ID NO: 115313 - DNA, 22 bp, Homo sapiens
agccaggatggtctcgatcggc

SEQ ID NO: 115314 - DNA, 22 bp, Homo sapiens
agcgccactgcactccagcctg

SEQ ID NO: 115315 - DNA, 22 bp, Homo sapiens
actgcaacacctcctgggttca

SEQ ID NO: 115316 - DNA, 22 bp, Homo sapiens
tcgcccaggctggaagtgcagt

SEQ ID NO: 115317 - DNA, 22 bp, Homo sapiens
cactgcactccatcctgggaaa

SEQ ID NO: 115318 - DNA, 22 bp, Homo sapiens
ttgtccttcttcattcagtccc

SEQ ID NO: 115319 - DNA, 22 bp, Homo sapiens
ttaataaagtatgaattggaaa

SEQ ID NO: 115320 - DNA, 22 bp, Homo sapiens
attgcactccggcctgggtgac

SEQ ID NO: 115321 - DNA, 22 bp, Homo sapiens
ggaaaatgggaacctgaagcca

SEQ ID NO: 115322 - DNA, 22 bp, Homo sapiens
atgccacttcattccagcctcg

SEQ ID NO: 115323 - DNA, 22 bp, Homo sapiens
cgtgtacagtctatcttttttc

SEQ ID NO: 115324 - DNA, 22 bp, Homo sapiens
gccgggttcaagccattctcct

SEQ ID NO: 115325 - DNA, 22 bp, Homo sapiens
cttgtagaattgaaatggtctc

SEQ ID NO: 115326 - DNA, 22 bp, Homo sapiens
tcactgcaacctccacctcctg

SEQ ID NO: 115327 - DNA, 22 bp, Homo sapiens
taagaaatttagttatagaatg

SEQ ID NO: 115328 - DNA, 22 bp, Homo sapiens
ctccttctgggcctggcagtgg

SEQ ID NO: 115329 - DNA, 22 bp, Homo sapiens
cagggtttcaccatgttagcag

SEQ ID NO: 115330 - DNA, 22 bp, Homo sapiens
cttgtgcatttcattcctcagg

SEQ ID NO: 115331 - DNA, 22 bp, Homo sapiens
tgtctattcccccacctccgtt

SEQ ID NO: 115332 - DNA, 22 bp, Homo sapiens
ttctatttttgtggaactgtag

SEQ ID NO: 115333 - DNA, 22 bp, Homo sapiens
gggaggctctgctcagcccccg

SEQ ID NO: 115334 - DNA, 22 bp, Homo sapiens
tctgttttgcataatgttcttt

SEQ ID NO: 115335 - DNA, 22 bp, Homo sapiens
agtactgtcagcagggtgttga

SEQ ID NO: 115336 - DNA, 22 bp, Homo sapiens
aaagtgcaaggattacaggcat

SEQ ID NO: 115337 - DNA, 22 bp, Homo sapiens
ttatttaatgtgatctgaagag

SEQ ID NO: 115338 - DNA, 22 bp, Homo sapiens
ccggctactcgggaggctgacg

SEQ ID NO: 115339 - DNA, 22 bp, Homo sapiens
tcaaagtccttgctttttctgt

SEQ ID NO: 115340 - DNA, 22 bp, Homo sapiens
tctcgctctgtcgcccaggctg

SEQ ID NO: 115341 - DNA, 22 bp, Homo sapiens
gggtattaaaatgaaggagaaa

SEQ ID NO: 115342 - DNA, 22 bp, Homo sapiens
ccagatgtccctctcaggtttg

SEQ ID NO: 115343 - DNA, 22 bp, Homo sapiens
ttaaattttagaaacagactct

SEQ ID NO: 115344 - DNA, 22 bp, Homo sapiens
ctacattaaattggcttactta

SEQ ID NO: 115345 - DNA, 22 bp, Homo sapiens
agagtgtaccaaatatcctaca

SEQ ID NO: 115346 - DNA, 22 bp, Homo sapiens
aaacatggccattcagactgtg

SEQ ID NO: 115347 - DNA, 22 bp, Homo sapiens
cattaaacaaccttgaatcaat

SEQ ID NO: 115348 - DNA, 22 bp, Homo sapiens
agacagggtgatcgcttgagcc

SEQ ID NO: 115349 - DNA, 22 bp, Homo sapiens
tctttcttgtgggtgccctttt

SEQ ID NO: 115350 - DNA, 22 bp, Homo sapiens
tcactgcaacctccacctcccg

SEQ ID NO: 115351 - DNA, 22 bp, Homo sapiens
tgagatgtaaggtatgcttact

SEQ ID NO: 115352 - DNA, 22 bp, Homo sapiens
tttaatcaggcaaagcataata

SEQ ID NO: 115353 - DNA, 22 bp, Homo sapiens
cactgctacctctgcctcccgg

SEQ ID NO: 115354 - DNA, 22 bp, Homo sapiens
catgtgtccacccttgaacaca

SEQ ID NO: 115355 - DNA, 22 bp, Homo sapiens
tctttctacatcatttgcttct

SEQ ID NO: 115356 - DNA, 22 bp, Homo sapiens
cggagtcttgctatgttgccca

SEQ ID NO: 115357 - DNA, 22 bp, Homo sapiens
cactgcactccagcctgggtga

SEQ ID NO: 115358 - DNA, 22 bp, Homo sapiens
aaagcagaactgagagagctgg

SEQ ID NO: 115359 - DNA, 22 bp, Homo sapiens
gaccttgtgatccacccgcctt

SEQ ID NO: 115360 - DNA, 23 bp, Homo sapiens
tctctgcatgtcctgagcacatc

SEQ ID NO: 115361 - DNA, 22 bp, Homo sapiens
aggggtgacacatatcagtgca

SEQ ID NO: 115362 - DNA, 22 bp, Homo sapiens
tcttttgtgattcttcagttac

SEQ ID NO: 115363 - DNA, 22 bp, Homo sapiens
attgcacttcagcctgggtgac

SEQ ID NO: 115364 - DNA, 22 bp, Homo sapiens
cacatttttactgccaacttaa

SEQ ID NO: 115365 - DNA, 22 bp, Homo sapiens
cactgcactccagcctgggtca

SEQ ID NO: 115366 - DNA, 22 bp, Homo sapiens
tagtggatgttcagagatttga

SEQ ID NO: 115367 - DNA, 22 bp, Homo sapiens
ttgcttcttagatattcctctc

SEQ ID NO: 115368 - DNA, 22 bp, Homo sapiens
atgccactgcgctccagcctgg

SEQ ID NO: 115369 - DNA, 22 bp, Homo sapiens
ttcttctttccaattacatggt

SEQ ID NO: 115370 - DNA, 22 bp, Homo sapiens
gaggcagaggttgcagtgagct

SEQ ID NO: 115371 - DNA, 22 bp, Homo sapiens
gattcactcatattttacgttt

SEQ ID NO: 115372 - DNA, 22 bp, Homo sapiens
tcactgcaagctccacctcccg

SEQ ID NO: 115373 - DNA, 22 bp, Homo sapiens
gaagcttgaacagggccaggct

SEQ ID NO: 115374 - DNA, 22 bp, Homo sapiens
gaccctgtttctacaaataatt

SEQ ID NO: 115375 - DNA, 22 bp, Homo sapiens
tagcagcatttttgtagagtat

SEQ ID NO: 115376 - DNA, 22 bp, Homo sapiens
cactgcaacctccacctcctgg

SEQ ID NO: 115377 - DNA, 22 bp, Homo sapiens
ctcattgcaacctccgcctccc

SEQ ID NO: 115378 - DNA, 22 bp, Homo sapiens
aaagcctcccaggttatgagta

SEQ ID NO: 115379 - DNA, 22 bp, Homo sapiens
cccagcgagtttgccggtgaac

SEQ ID NO: 115380 - DNA, 22 bp, Homo sapiens
actgcatttggtaaagtcaaga

SEQ ID NO: 115381 - DNA, 22 bp, Homo sapiens
ggaggagacagtaaaaagcacg

SEQ ID NO: 115382 - DNA, 22 bp, Homo sapiens
agtgctatcgagttctaatgct

SEQ ID NO: 115383 - DNA, 22 bp, Homo sapiens
ttgagcccaggaggcctgggtg

SEQ ID NO: 115384 - DNA, 22 bp, Homo sapiens
tttgttttcaatgtgtcattca

SEQ ID NO: 115385 - DNA, 22 bp, Homo sapiens
aggaaaatggaccagagttgtt

SEQ ID NO: 115386 - DNA, 16 bp, Homo sapiens
tgggtgggaggagcgg

SEQ ID NO: 115387 - DNA, 22 bp, Homo sapiens
cgtcccgggttcacgccattct

SEQ ID NO: 115388 - DNA, 22 bp, Homo sapiens
aaattagtcatgttgtattact

SEQ ID NO: 115389 - DNA, 22 bp, Homo sapiens
atgtgtcaggtacactcattag

SEQ ID NO: 115390 - DNA, 22 bp, Homo sapiens
gaaagacatagttgcaagatgg

SEQ ID NO: 115391 - DNA, 22 bp, Homo sapiens
agaccaaagaaaacacatctgg

SEQ ID NO: 115392 - DNA, 22 bp, Homo sapiens
tgagacgaagtcttgctctgtt

SEQ ID NO: 115393 - DNA, 19 bp, Homo sapiens
ttccatctatcttcttact

SEQ ID NO: 115394 - DNA, 22 bp, Homo sapiens
agcaacacgcagtagtatacga

SEQ ID NO: 115395 - DNA, 22 bp, Homo sapiens
attgcactccagcctgggggac

SEQ ID NO: 115396 - DNA, 22 bp, Homo sapiens
aagcatttcaggtagagatatt

SEQ ID NO: 115397 - DNA, 22 bp, Homo sapiens
gtggattacaagacagttgaga

SEQ ID NO: 115398 - DNA, 22 bp, Homo sapiens
taacatttaaatttttcacata

SEQ ID NO: 115399 - DNA, 22 bp, Homo sapiens
tgagctgacacccaatcatact

SEQ ID NO: 115400 - DNA, 22 bp, Homo sapiens
cctaacatatgtaaaggtcttt

SEQ ID NO: 115401 - DNA, 22 bp, Homo sapiens
ggaggcagaatagagtgtgggt

SEQ ID NO: 115402 - DNA, 22 bp, Homo sapiens
attgcactccagcctgggtgac

SEQ ID NO: 115403 - DNA, 22 bp, Homo sapiens
attataggcttgagccaccgtg

SEQ ID NO: 115404 - DNA, 22 bp, Homo sapiens
ttcatcttgatggcttcctaat

SEQ ID NO: 115405 - DNA, 21 bp, Homo sapiens
cactccacttagaacagggtt

SEQ ID NO: 115406 - DNA, 22 bp, Homo sapiens
tcagtgcacccaattctctcca

SEQ ID NO: 115407 - DNA, 22 bp, Homo sapiens
tttctttatcatagcatctttg

SEQ ID NO: 115408 - DNA, 22 bp, Homo sapiens
atgccactgcactccagcctgg

SEQ ID NO: 115409 - DNA, 22 bp, Homo sapiens
caggctggagttcagtggtgtg

SEQ ID NO: 115410 - DNA, 22 bp, Homo sapiens
actttaaaactgatcatcagag

SEQ ID NO: 115411 - DNA, 22 bp, Homo sapiens
agcagcttgaggctggattcca

SEQ ID NO: 115412 - DNA, 22 bp, Homo sapiens
gtctatatattgcttgaataat

SEQ ID NO: 115413 - DNA, 22 bp, Homo sapiens
atgccactgcactccagcctag

SEQ ID NO: 115414 - DNA, 22 bp, Homo sapiens
gccagatttacagatttgccct

SEQ ID NO: 115415 - DNA, 18 bp, Homo sapiens
tcctttctccctcatctt

SEQ ID NO: 115416 - DNA, 22 bp, Homo sapiens
aaggcaggatgggaaaagattt

SEQ ID NO: 115417 - DNA, 22 bp, Homo sapiens
tctcgatctcctgaccttgtga

SEQ ID NO: 115418 - DNA, 22 bp, Homo sapiens
tttcttctatgtgtgatatttt

SEQ ID NO: 115419 - DNA, 22 bp, Homo sapiens
tagtggatgggtaaagtatttt

SEQ ID NO: 115420 - DNA, 22 bp, Homo sapiens
tcactgcaacctccgcctgctg

SEQ ID NO: 115421 - DNA, 22 bp, Homo sapiens
ttatttaaaagtggtaagattc

SEQ ID NO: 115422 - DNA, 22 bp, Homo sapiens
cactgcacttcagcctgggtga

SEQ ID NO: 115423 - DNA, 22 bp, Homo sapiens
gaggaggcttccgggaggcacg

SEQ ID NO: 115424 - DNA, 22 bp, Homo sapiens
caggctggagtgcagtggtgcc

SEQ ID NO: 115425 - DNA, 22 bp, Homo sapiens
tctcaagcttgttggtatgttt

SEQ ID NO: 115426 - DNA, 20 bp, Homo sapiens
tttcttgtcggctgttgctg

SEQ ID NO: 115427 - DNA, 19 bp, Homo sapiens
agcagtgtagaagtgttcc

SEQ ID NO: 115428 - DNA, 22 bp, Homo sapiens
tcactacaacctccgcctcctg

SEQ ID NO: 115429 - DNA, 22 bp, Homo sapiens
tgcgatgcaacagcttggcgga

SEQ ID NO: 115430 - DNA, 22 bp, Homo sapiens
gctgcagtgagccaagatcgtg

SEQ ID NO: 115431 - DNA, 22 bp, Homo sapiens
actgcacttcaccctgggtgac

SEQ ID NO: 115432 - DNA, 22 bp, Homo sapiens
caggaaagggatgggctgccac

SEQ ID NO: 115433 - DNA, 22 bp, Homo sapiens
ggccgctctccggtgtggatct

SEQ ID NO: 115434 - DNA, 22 bp, Homo sapiens
gccatgcttggtatgctgtgag

SEQ ID NO: 115435 - DNA, 22 bp, Homo sapiens
ggccactgctctccagcctggg

SEQ ID NO: 115436 - DNA, 23 bp, Homo sapiens
ggagtgcaatggcgccatctcgg

SEQ ID NO: 115437 - DNA, 22 bp, Homo sapiens
acctggacacctgctgtcatct

SEQ ID NO: 115438 - DNA, 18 bp, Homo sapiens
tcaaatactttgggcagt

SEQ ID NO: 115439 - DNA, 22 bp, Homo sapiens
gcccaggagttcaagtctagtg

SEQ ID NO: 115440 - DNA, 22 bp, Homo sapiens
cctgggacttggtctggggttt

SEQ ID NO: 115441 - DNA, 22 bp, Homo sapiens
gccctgggcaaggttctggcca

SEQ ID NO: 115442 - DNA, 22 bp, Homo sapiens
tcactgcaacctccacctcccg

SEQ ID NO: 115443 - DNA, 22 bp, Homo sapiens
gcaaaagtacagccggatttct

SEQ ID NO: 115444 - DNA, 22 bp, Homo sapiens
atgccactgcactccagcctag

SEQ ID NO: 115445 - DNA, 22 bp, Homo sapiens
actgtgtgccaggcgctggtct

SEQ ID NO: 115446 - DNA, 22 bp, Homo sapiens
cccaggaggcctgcctggccgg

SEQ ID NO: 115447 - DNA, 22 bp, Homo sapiens
agttggagtgaacatgagattg

SEQ ID NO: 115448 - DNA, 22 bp, Homo sapiens
ggcagcactgcagcttgttggg

SEQ ID NO: 115449 - DNA, 22 bp, Homo sapiens
actgcacttcagcctgggtgtc

SEQ ID NO: 115450 - DNA, 22 bp, Homo sapiens
caaaatgcatctgagaccaggc

SEQ ID NO: 115451 - DNA, 22 bp, Homo sapiens
ggccgtgctccaaagtcatcgt

SEQ ID NO: 115452 - DNA, 22 bp, Homo sapiens
cagctgcccctccagggctggg

SEQ ID NO: 115453 - DNA, 22 bp, Homo sapiens
gtgtttggtcagacgtccgggg

SEQ ID NO: 115454 - DNA, 22 bp, Homo sapiens
tgaggcaggacttgcataaagt

SEQ ID NO: 115455 - DNA, 22 bp, Homo sapiens
agatcggctttgcagacctcat

SEQ ID NO: 115456 - DNA, 22 bp, Homo sapiens
gaggcagaagttgcagtgagca

SEQ ID NO: 115457 - DNA, 22 bp, Homo sapiens
ggtttattgttaataagtttga

SEQ ID NO: 115458 - DNA, 22 bp, Homo sapiens
ctcactgcaacctctgcctccc

SEQ ID NO: 115459 - DNA, 22 bp, Homo sapiens
ccctggaggttgaggctgcagt

SEQ ID NO: 115460 - DNA, 22 bp, Homo sapiens
cggagtcttgctatgttgccca

SEQ ID NO: 115461 - DNA, 22 bp, Homo sapiens
tgctccagcaccaagagctcca

SEQ ID NO: 115462 - DNA, 22 bp, Homo sapiens
catttacatttaaggttaatat

SEQ ID NO: 115463 - DNA, 22 bp, Homo sapiens
cagcgtctcgttgtgggcctcg

SEQ ID NO: 115464 - DNA, 22 bp, Homo sapiens
cccaggggttcaaggctgcagt

SEQ ID NO: 115465 - DNA, 22 bp, Homo sapiens
agttgcagacgcagagatgttg

SEQ ID NO: 115466 - DNA, 22 bp, Homo sapiens
actgcaacctccacctcctggg

SEQ ID NO: 115467 - DNA, 18 bp, Homo sapiens
tgtccctgcaaataacat

SEQ ID NO: 115468 - DNA, 22 bp, Homo sapiens
tgtctggtgggttgacaggcag

SEQ ID NO: 115469 - DNA, 22 bp, Homo sapiens
gtggagagagataagcctggtc

SEQ ID NO: 115470 - DNA, 22 bp, Homo sapiens
tcactgcaacctccacctcctg

SEQ ID NO: 115471 - DNA, 22 bp, Homo sapiens
gcccaggaggagaggctgcagt

SEQ ID NO: 115472 - DNA, 22 bp, Homo sapiens
tcaccggcagacgtggcctgat

SEQ ID NO: 115473 - DNA, 22 bp, Homo sapiens
aaagcagaggttgcagtgagct

SEQ ID NO: 115474 - DNA, 22 bp, Homo sapiens
cctgggcctctcaaagtgctgg

SEQ ID NO: 115475 - DNA, 22 bp, Homo sapiens
ttccagctaactcacatccctt

SEQ ID NO: 115476 - DNA, 22 bp, Homo sapiens
taggaatggtgctcagcagaaa

SEQ ID NO: 115477 - DNA, 22 bp, Homo sapiens
tgactcctggtatggatgacag

SEQ ID NO: 115478 - DNA, 22 bp, Homo sapiens
ctcattgcaacctccgcctccc

SEQ ID NO: 115479 - DNA, 22 bp, Homo sapiens
tttcttctatgtgtgatatttt

SEQ ID NO: 115480 - DNA, 22 bp, Homo sapiens
aaagaggcaatcaatgtagcaa

SEQ ID NO: 115481 - DNA, 22 bp, Homo sapiens
ccaggcaggcgatggtgcagtg

SEQ ID NO: 115482 - DNA, 22 bp, Homo sapiens
cggccaagccggggccccgaag

SEQ ID NO: 115483 - DNA, 22 bp, Homo sapiens
gcccagtagttcaaggttgcag

SEQ ID NO: 115484 - DNA, 22 bp, Homo sapiens
tcctgggccctccggatcaggt

SEQ ID NO: 115485 - DNA, 22 bp, Homo sapiens
agtgagagtattaatgtgaact

SEQ ID NO: 115486 - DNA, 22 bp, Homo sapiens
tgtggcccgatcttgggagaca

SEQ ID NO: 115487 - DNA, 22 bp, Homo sapiens
tactgtgtgcccagccgagctg

SEQ ID NO: 115488 - DNA, 22 bp, Homo sapiens
ggagagtgggagcaactgttgc

SEQ ID NO: 115489 - DNA, 22 bp, Homo sapiens
catggtgggtgtagtttccgcc

SEQ ID NO: 115490 - DNA, 22 bp, Homo sapiens
cccagggaggcccaggctctgc

SEQ ID NO: 115491 - DNA, 22 bp, Homo sapiens
agcacctgtcaagtccaggctg

SEQ ID NO: 115492 - DNA, 22 bp, Homo sapiens
aaggaaagctgtggttctgaga

SEQ ID NO: 115493 - DNA, 22 bp, Homo sapiens
gcatatgatcacgtgtgtcggt

SEQ ID NO: 115494 - DNA, 22 bp, Homo sapiens
ctcattgcccagatccccacag

SEQ ID NO: 115495 - DNA, 22 bp, Homo sapiens
cccaggaagtggaggttgcagt

SEQ ID NO: 115496 - DNA, 22 bp, Homo sapiens
tgaggcaggagaatcacatgaa

SEQ ID NO: 115497 - DNA, 22 bp, Homo sapiens
tgaggcaggaggattgcaggat

SEQ ID NO: 115498 - DNA, 22 bp, Homo sapiens
actgcactccaacctgggtgac

SEQ ID NO: 115499 - DNA, 22 bp, Homo sapiens
gatggtgcaggtgaagtgctgg

SEQ ID NO: 115500 - DNA, 22 bp, Homo sapiens
tgaggcaggaggttgagaactg

SEQ ID NO: 115501 - DNA, 22 bp, Homo sapiens
tctaatcctatggtggggaggg

SEQ ID NO: 115502 - DNA, 22 bp, Homo sapiens
tggctagcactctacctttctc

SEQ ID NO: 115503 - DNA, 22 bp, Homo sapiens
gtggcccaggctggagtgcagt

SEQ ID NO: 115504 - DNA, 22 bp, Homo sapiens
agaggcagtatacaatccgagc

SEQ ID NO: 115505 - DNA, 22 bp, Homo sapiens
tccctgaggatggttgtattta

SEQ ID NO: 115506 - DNA, 18 bp, Homo sapiens
gcagctagccaggggggc

SEQ ID NO: 115507 - DNA, 22 bp, Homo sapiens
gctactgattgaccttggagag

SEQ ID NO: 115508 - DNA, 22 bp, Homo sapiens
cccaggaggcagaagttgcagt

SEQ ID NO: 115509 - DNA, 22 bp, Homo sapiens
aggagagctggtgtctggaatc

SEQ ID NO: 115510 - DNA, 22 bp, Homo sapiens
cccaggaggttgaggctgcagt

SEQ ID NO: 115511 - DNA, 22 bp, Homo sapiens
cgagagttagctaggagtcaca

SEQ ID NO: 115512 - DNA, 22 bp, Homo sapiens
cagctgctgttcagttttgttt

SEQ ID NO: 115513 - DNA, 22 bp, Homo sapiens
gcaactgaacatgtgtgtggcc

SEQ ID NO: 115514 - DNA, 22 bp, Homo sapiens
aggaactccacggtcttgtcgg

SEQ ID NO: 115515 - DNA, 22 bp, Homo sapiens
attggtagttttgtatttctct

SEQ ID NO: 115516 - DNA, 22 bp, Homo sapiens
cttctcggccgtgtggatgcgc

SEQ ID NO: 115517 - DNA, 22 bp, Homo sapiens
cccatgaggtggaggttgcagt

SEQ ID NO: 115518 - DNA, 22 bp, Homo sapiens
actctgcctgcggtgggcggga

SEQ ID NO: 115519 - DNA, 22 bp, Homo sapiens
cagtgccagctgcttggcctac

SEQ ID NO: 115520 - DNA, 22 bp, Homo sapiens
tgaactcgggaggaggctgcag

SEQ ID NO: 115521 - DNA, 22 bp, Homo sapiens
ctgtctgcaggatagtaccctc

SEQ ID NO: 115522 - DNA, 22 bp, Homo sapiens
cccagcgagtttgccggtgaac

SEQ ID NO: 115523 - DNA, 22 bp, Homo sapiens
gctgcagtgagccaagatcgtg

SEQ ID NO: 115524 - DNA, 22 bp, Homo sapiens
gcctcctgagtagctgggattg

SEQ ID NO: 115525 - DNA, 22 bp, Homo sapiens
agcagcagtgttctggaattct

SEQ ID NO: 115526 - DNA, 22 bp, Homo sapiens
gaggcagaggttgcagtgagct

SEQ ID NO: 115527 - DNA, 22 bp, Homo sapiens
tggcaccagggaacaagcattt

SEQ ID NO: 115528 - DNA, 22 bp, Homo sapiens
agatttatgtggtcacactcag

SEQ ID NO: 115529 - DNA, 22 bp, Homo sapiens
gggtggcaccacgtgtcttcaa

SEQ ID NO: 115530 - DNA, 22 bp, Homo sapiens
agttattactctttaacatatt

SEQ ID NO: 115531 - DNA, 22 bp, Homo sapiens
gccatgggcaaatgcagagctg

SEQ ID NO: 115532 - DNA, 22 bp, Homo sapiens
ctgctgggatagaagtatctca

SEQ ID NO: 115533 - DNA, 22 bp, Homo sapiens
aggaggggttctcgggtgctga

SEQ ID NO: 115534 - DNA, 22 bp, Homo sapiens
cacatgaaggctggggtcgtga

SEQ ID NO: 115535 - DNA, 22 bp, Homo sapiens
ctgcgcagcaatcagagaggag

SEQ ID NO: 115536 - DNA, 22 bp, Homo sapiens
atggtggctcatgcatgcaatc

SEQ ID NO: 115537 - DNA, 20 bp, Homo sapiens
tcacatcctctcccaacatg

SEQ ID NO: 115538 - DNA, 22 bp, Homo sapiens
taagaaatttagttatagaatg

SEQ ID NO: 115539 - DNA, 22 bp, Homo sapiens
tttgggcaggcttttccctaga

SEQ ID NO: 115540 - DNA, 22 bp, Homo sapiens
ccagggatgcagaggttgcagt

SEQ ID NO: 115541 - DNA, 21 bp, Homo sapiens
ggtgacacgtggccccgctct

SEQ ID NO: 115542 - DNA, 22 bp, Homo sapiens
atgccactgcacttcagcttgg

SEQ ID NO: 115543 - DNA, 23 bp, Homo sapiens
ccagtgattgcctggaaggaggt

SEQ ID NO: 115544 - DNA, 22 bp, Homo sapiens
tcctgggatcaagtgatcctcc

SEQ ID NO: 115545 - DNA, 22 bp, Homo sapiens
tgggactcactcttttggccag

SEQ ID NO: 115546 - DNA, 22 bp, Homo sapiens
aggtggagaagagatgggcagt

SEQ ID NO: 115547 - DNA, 22 bp, Homo sapiens
gtccctgataagagccatcgat

SEQ ID NO: 115548 - DNA, 22 bp, Homo sapiens
atttagaactttgtttgccaat

SEQ ID NO: 115549 - DNA, 22 bp, Homo sapiens
aaagcagaactgagagagctgg

SEQ ID NO: 115550 - DNA, 22 bp, Homo sapiens
actgcactccagcctgggtgat

SEQ ID NO: 115551 - DNA, 22 bp, Homo sapiens
ggcagcttgtcctggaggatgg

SEQ ID NO: 115552 - DNA, 22 bp, Homo sapiens
gcttggccagcagccgggatgc

SEQ ID NO: 115553 - DNA, 21 bp, Homo sapiens
gggcagaggggcctcctgggt

SEQ ID NO: 115554 - DNA, 22 bp, Homo sapiens
atctggttttggctgtgtccct

SEQ ID NO: 115555 - DNA, 22 bp, Homo sapiens
gggtacagttcttccagtgtca

SEQ ID NO: 115556 - DNA, 22 bp, Homo sapiens
tgggcagggagctggaaccaca

SEQ ID NO: 115557 - DNA, 22 bp, Homo sapiens
tgggcagttttctatgctgcaa

SEQ ID NO: 115558 - DNA, 22 bp, Homo sapiens
tttttgggtccaggctgtatct

SEQ ID NO: 115559 - DNA, 22 bp, Homo sapiens
cccgggaggcggaggttgcagt

SEQ ID NO: 115560 - DNA, 22 bp, Homo sapiens
tctggtgtcagtattctttgaa

SEQ ID NO: 115561 - DNA, 22 bp, Homo sapiens
gggttcagtccctcttgctact

SEQ ID NO: 115562 - DNA, 22 bp, Homo sapiens
tggcacgacaattggcaccaat

SEQ ID NO: 115563 - DNA, 22 bp, Homo sapiens
gtcggccacgcaggtgcggtag

SEQ ID NO: 115564 - DNA, 22 bp, Homo sapiens
cagcagcagtggctgcagaaca

SEQ ID NO: 115565 - DNA, 22 bp, Homo sapiens
tgctgggggtagctctgcgtag

SEQ ID NO: 115566 - DNA, 22 bp, Homo sapiens
tttgaggttagctagcagatca

SEQ ID NO: 115567 - DNA, 21 bp, Homo sapiens
taggtgggagccccagtatgc

SEQ ID NO: 115568 - DNA, 22 bp, Homo sapiens
tccagggagagccgctgctcca

SEQ ID NO: 115569 - DNA, 22 bp, Homo sapiens
cccaggagttggaggctgcagt

SEQ ID NO: 115570 - DNA, 22 bp, Homo sapiens
cccaggaggcggaggttgcagt

SEQ ID NO: 115571 - DNA, 22 bp, Homo sapiens
ttgagcaggatggctatgcaca

SEQ ID NO: 115572 - DNA, 22 bp, Homo sapiens
acatcctcccgatctactggct

SEQ ID NO: 115573 - DNA, 22 bp, Homo sapiens
aagagggctgcaatcttattgc

SEQ ID NO: 115574 - DNA, 20 bp, Homo sapiens
gggcagagccagccagtccc

SEQ ID NO: 115575 - DNA, 22 bp, Homo sapiens
tggcacagactgggccaaggaa

SEQ ID NO: 115576 - DNA, 22 bp, Homo sapiens
aggccttaccatagctgtagca

SEQ ID NO: 115577 - DNA, 18 bp, Homo sapiens
cagctgccagctcatgga

SEQ ID NO: 115578 - DNA, 22 bp, Homo sapiens
tgtgggagaaggaagcaagctg

SEQ ID NO: 115579 - DNA, 22 bp, Homo sapiens
aggccagcagcatgacggcatc

SEQ ID NO: 115580 - DNA, 20 bp, Homo sapiens
gccactgggcaccagcaggg

SEQ ID NO: 115581 - DNA, 22 bp, Homo sapiens
gtccctgagcctggcatttccc

SEQ ID NO: 115582 - DNA, 22 bp, Homo sapiens
tcgcccaggctggaagtgcagt

SEQ ID NO: 115583 - DNA, 22 bp, Homo sapiens
ctgggagtggtgacagctctcg

SEQ ID NO: 115584 - DNA, 22 bp, Homo sapiens
ctgggcagctgtatcagggagt

SEQ ID NO: 115585 - DNA, 21 bp, Homo sapiens
agaaggcaaaagcagacatct

SEQ ID NO: 115586 - DNA, 22 bp, Homo sapiens
tcagggattgcaaaattcatcc

SEQ ID NO: 115587 - DNA, 22 bp, Homo sapiens
aactatgttaataagtttcatt

SEQ ID NO: 115588 - DNA, 22 bp, Homo sapiens
aggacagagggaccagagccca

SEQ ID NO: 115589 - DNA, 22 bp, Homo sapiens
gagggagggactagcattctct

SEQ ID NO: 115590 - DNA, 22 bp, Homo sapiens
atgccactgcgctctagcctgg

SEQ ID NO: 115591 - DNA, 22 bp, Homo sapiens
agcatttatcttttgtttgagt

SEQ ID NO: 115592 - DNA, 22 bp, Homo sapiens
ctgtccctgagcaactcctgtt

SEQ ID NO: 115593 - DNA, 22 bp, Homo sapiens
cccagtttcaactttccagtgg

SEQ ID NO: 115594 - DNA, 22 bp, Homo sapiens
aagaagagaactggcatcctaa

SEQ ID NO: 115595 - DNA, 22 bp, Homo sapiens
gccctgagaagaagtcggaggg

SEQ ID NO: 115596 - DNA, 23 bp, Homo sapiens
ccaagactgttaggagtggggag

SEQ ID NO: 115597 - DNA, 22 bp, Homo sapiens
tcagtgttaatcagtggtacct

SEQ ID NO: 115598 - DNA, 22 bp, Homo sapiens
atgccactgcgctccagcctgg

SEQ ID NO: 115599 - DNA, 22 bp, Homo sapiens
gctgtgtatcagatgccacggg

SEQ ID NO: 115600 - DNA, 22 bp, Homo sapiens
cctagagctctgctttatctaa

SEQ ID NO: 115601 - DNA, 22 bp, Homo sapiens
gggacatctttctagtcagggt

SEQ ID NO: 115602 - DNA, 22 bp, Homo sapiens
actgccaatggtagtttgatgg

SEQ ID NO: 115603 - DNA, 22 bp, Homo sapiens
atgggttcaagtgattctcctg

SEQ ID NO: 115604 - DNA, 22 bp, Homo sapiens
tggcactgagcagccgcggcag

SEQ ID NO: 115605 - DNA, 22 bp, Homo sapiens
atcacaaaggtctcagagcaca

SEQ ID NO: 115606 - DNA, 22 bp, Homo sapiens
aagttactggcaagggctgcag

SEQ ID NO: 115607 - DNA, 22 bp, Homo sapiens
gcagctattgtctcctgggccc

SEQ ID NO: 115608 - DNA, 22 bp, Homo sapiens
tcgaactcatagtcgtagctgt

SEQ ID NO: 115609 - DNA, 22 bp, Homo sapiens
aacagtgtttttcttcagcact

SEQ ID NO: 115610 - DNA, 22 bp, Homo sapiens
gccctgtgcaggtgtgcagcag

SEQ ID NO: 115611 - DNA, 22 bp, Homo sapiens
gcctggattccttgtttctcag

SEQ ID NO: 115612 - DNA, 22 bp, Homo sapiens
gggaggttgaggctgcagtgag

SEQ ID NO: 115613 - DNA, 22 bp, Homo sapiens
ctcagccccagcccagatagca

SEQ ID NO: 115614 - DNA, 22 bp, Homo sapiens
aagaggtaaccatagcaaccac

SEQ ID NO: 115615 - DNA, 22 bp, Homo sapiens
gggccctgggattcagagcaag

SEQ ID NO: 115616 - DNA, 22 bp, Homo sapiens
cgtgccactgcactctagcctg

SEQ ID NO: 115617 - DNA, 22 bp, Homo sapiens
cctcttctaggacgtccttgtg

SEQ ID NO: 115618 - DNA, 22 bp, Homo sapiens
cccaggaggcagagatagcagt

SEQ ID NO: 115619 - DNA, 20 bp, Homo sapiens
tggcctctgagatgccacgg

SEQ ID NO: 115620 - DNA, 22 bp, Homo sapiens
tggtatgtaaattgtaactcaa

SEQ ID NO: 115621 - DNA, 22 bp, Homo sapiens
ggtggcagtagcactgggcctg

SEQ ID NO: 115622 - DNA, 22 bp, Homo sapiens
tgctgagcgcatccggcggccg

SEQ ID NO: 115623 - DNA, 22 bp, Homo sapiens
atacaaaatatatactggagac

SEQ ID NO: 115624 - DNA, 22 bp, Homo sapiens
cctgggaggctgaggctgcagt

SEQ ID NO: 115625 - DNA, 22 bp, Homo sapiens
gaggaggcttccgggaggcacg

SEQ ID NO: 115626 - DNA, 23 bp, Homo sapiens
ttctgggctgtggaagcctcggg

SEQ ID NO: 115627 - DNA, 22 bp, Homo sapiens
ggagaagaggagctggaagcct

SEQ ID NO: 115628 - DNA, 22 bp, Homo sapiens
ctgggctagaaggaccaggatg

SEQ ID NO: 115629 - DNA, 22 bp, Homo sapiens
gagctcattcattcattgcctg

SEQ ID NO: 115630 - DNA, 22 bp, Homo sapiens
aggcaacttttggggatgatgg

SEQ ID NO: 115631 - DNA, 22 bp, Homo sapiens
cccaggaggtggagcttgcagt

SEQ ID NO: 115632 - DNA, 22 bp, Homo sapiens
caggcagggagctggaaaggat

SEQ ID NO: 115633 - DNA, 22 bp, Homo sapiens
tacatttataaggcttctctgt

SEQ ID NO: 115634 - DNA, 22 bp, Homo sapiens
tgaggcaggtggattacaaggt

SEQ ID NO: 115635 - DNA, 22 bp, Homo sapiens
gcgtctgagttgcgggggctca

SEQ ID NO: 115636 - DNA, 22 bp, Homo sapiens
agaggcaggaggttgacttgag

SEQ ID NO: 115637 - DNA, 22 bp, Homo sapiens
cccaggatggggctgcagttat

SEQ ID NO: 115638 - DNA, 22 bp, Homo sapiens
tgcctactagtactattttgtg

SEQ ID NO: 115639 - DNA, 22 bp, Homo sapiens
tgtgaactggcaggtggacggg

SEQ ID NO: 115640 - DNA, 22 bp, Homo sapiens
ggctccaccctgcttccagaag

SEQ ID NO: 115641 - DNA, 22 bp, Homo sapiens
cagtggcgtgatctctgctcac

SEQ ID NO: 115642 - DNA, 22 bp, Homo sapiens
atacaaaaattagccgggagta

SEQ ID NO: 115643 - DNA, 22 bp, Homo sapiens
gtggtgtaggtcacagttagga

SEQ ID NO: 115644 - DNA, 22 bp, Homo sapiens
cccaggaggtggagttcacagt

SEQ ID NO: 115645 - DNA, 22 bp, Homo sapiens
cccagcaggaggaggttgcagt

SEQ ID NO: 115646 - DNA, 22 bp, Homo sapiens
gcctcctgtcccaggctgagga

SEQ ID NO: 115647 - DNA, 22 bp, Homo sapiens
tggctccacaggccagggtgtg

SEQ ID NO: 115648 - DNA, 22 bp, Homo sapiens
atgccactgcacttcagcctgg

SEQ ID NO: 115649 - DNA, 22 bp, Homo sapiens
tctatgcttgagacagatgggg

SEQ ID NO: 115650 - DNA, 22 bp, Homo sapiens
agagtgcaaccgaaacaagcag

SEQ ID NO: 115651 - DNA, 22 bp, Homo sapiens
aggatgagccgcgcaagctgac

SEQ ID NO: 115652 - DNA, 22 bp, Homo sapiens
aaaccgcaattacttttgcgtc

SEQ ID NO: 115653 - DNA, 22 bp, Homo sapiens
tcctgagccctactctagacga

SEQ ID NO: 115654 - DNA, 22 bp, Homo sapiens
tcatgcctggaatctcaccact

SEQ ID NO: 115655 - DNA, 18 bp, Homo sapiens
tgagttcattagacttcc

SEQ ID NO: 115656 - DNA, 22 bp, Homo sapiens
ctcactgcaagctctgcctccc

SEQ ID NO: 115657 - DNA, 22 bp, Homo sapiens
tcctcagcttttatttcacttg

SEQ ID NO: 115658 - DNA, 22 bp, Homo sapiens
gccgtggggagagagggtgcgt

SEQ ID NO: 115659 - DNA, 22 bp, Homo sapiens
cagcagcattgctctggattcc

SEQ ID NO: 115660 - DNA, 22 bp, Homo sapiens
atggtactggggtcccggagtt

SEQ ID NO: 115661 - DNA, 22 bp, Homo sapiens
ctgctcttcacactacacccgt

SEQ ID NO: 115662 - DNA, 22 bp, Homo sapiens
ccccaggacgtggccctcatag

SEQ ID NO: 115663 - DNA, 22 bp, Homo sapiens
tcagtgatttctggggtgaggg

SEQ ID NO: 115664 - DNA, 22 bp, Homo sapiens
ctgagatctttatacgaggcac

SEQ ID NO: 115665 - DNA, 22 bp, Homo sapiens
cctgaggatgccagcatgggtg

SEQ ID NO: 115666 - DNA, 22 bp, Homo sapiens
gtggggtagatctttctcagga

SEQ ID NO: 115667 - DNA, 22 bp, Homo sapiens
ggccctggcagccacgaaagcc

SEQ ID NO: 115668 - DNA, 22 bp, Homo sapiens
aatggaatacctaggtggccca

SEQ ID NO: 115669 - DNA, 22 bp, Homo sapiens
ggaggtgggctaaggactctct

SEQ ID NO: 115670 - DNA, 22 bp, Homo sapiens
aacttaggaaaataaggcatga

SEQ ID NO: 115671 - DNA, 22 bp, Homo sapiens
caggcagaagaagtggaaggac

SEQ ID NO: 115672 - DNA, 23 bp, Homo sapiens
acagtcgtaggtatccttttcct

SEQ ID NO: 115673 - DNA, 22 bp, Homo sapiens
gaccatcctggccaacgtggta

SEQ ID NO: 115674 - DNA, 22 bp, Homo sapiens
tgagccaggagtttgaggctgt

SEQ ID NO: 115675 - DNA, 22 bp, Homo sapiens
atagagtgatgtaaggtatgtg

SEQ ID NO: 115676 - DNA, 22 bp, Homo sapiens
gcccagagtttgaagatacagt

SEQ ID NO: 115677 - DNA, 22 bp, Homo sapiens
atatattttttgagacagagtc

SEQ ID NO: 115678 - DNA, 22 bp, Homo sapiens
ctggtctgccacccacacccct

SEQ ID NO: 115679 - DNA, 22 bp, Homo sapiens
tgaggcaggagaatcaccggaa

SEQ ID NO: 115680 - DNA, 22 bp, Homo sapiens
gggccctgcgactcgcggcgga

SEQ ID NO: 115681 - DNA, 22 bp, Homo sapiens
actgcactccagcctgggtgac

SEQ ID NO: 115682 - DNA, 22 bp, Homo sapiens
tgccgcagtgcggggagggccc

SEQ ID NO: 115683 - DNA, 22 bp, Homo sapiens
tcaccgaggctggagtgcagtg

SEQ ID NO: 115684 - DNA, 22 bp, Homo sapiens
actgcacttcagcctgggtgac

SEQ ID NO: 115685 - DNA, 22 bp, Homo sapiens
ggaggcagaatagagtgtgggt

SEQ ID NO: 115686 - DNA, 18 bp, Homo sapiens
taggagagaatttattta

SEQ ID NO: 115687 - DNA, 22 bp, Homo sapiens
atattacacacggtatcacggg

SEQ ID NO: 115688 - DNA, 22 bp, Homo sapiens
cagcaggaggtgagtagcaggt

SEQ ID NO: 115689 - DNA, 22 bp, Homo sapiens
tcagtgccatgggcagacaggc

SEQ ID NO: 115690 - DNA, 22 bp, Homo sapiens
ctgccttttaaagccagtgtta

SEQ ID NO: 115691 - DNA, 22 bp, Homo sapiens
cccattgtggttgttgaggata

SEQ ID NO: 115692 - DNA, 23 bp, Homo sapiens
gcagaggagcaagctggacacca

SEQ ID NO: 115693 - DNA, 22 bp, Homo sapiens
cagcagagaaattacatatttg

SEQ ID NO: 115694 - DNA, 22 bp, Homo sapiens
gctctgccagcccaaggcgcag

SEQ ID NO: 115695 - DNA, 22 bp, Homo sapiens
agagggatcaccctgtttctgg

SEQ ID NO: 115696 - DNA, 22 bp, Homo sapiens
gtatcggtttatttttgggata

SEQ ID NO: 115697 - DNA, 22 bp, Homo sapiens
cccaggaggcagagcttgcagt

SEQ ID NO: 115698 - DNA, 22 bp, Homo sapiens
gggtccaggcggcatagttgta

SEQ ID NO: 115699 - DNA, 22 bp, Homo sapiens
gcccaggaggcagaggttgtgg

SEQ ID NO: 115700 - DNA, 22 bp, Homo sapiens
gcaggcagaggtggaggagaca

SEQ ID NO: 115701 - DNA, 22 bp, Homo sapiens
gctctctgcagcctccttggag

SEQ ID NO: 115702 - DNA, 22 bp, Homo sapiens
ctgctcttgagggactgcggtc

SEQ ID NO: 115703 - DNA, 22 bp, Homo sapiens
gggagaggttacccgagcaact

SEQ ID NO: 115704 - DNA, 22 bp, Homo sapiens
agtccaggcattccagccattc

SEQ ID NO: 115705 - DNA, 18 bp, Homo sapiens
actctttctgcccacagg

SEQ ID NO: 115706 - DNA, 23 bp, Homo sapiens
tatgaactgcattgctggtgtgt

SEQ ID NO: 115707 - DNA, 22 bp, Homo sapiens
tcccagctactctagaggctga

SEQ ID NO: 115708 - DNA, 22 bp, Homo sapiens
cctggagagctcgggccaggca

SEQ ID NO: 115709 - DNA, 22 bp, Homo sapiens
atgccactgcactccagcctgg

SEQ ID NO: 115710 - DNA, 22 bp, Homo sapiens
cccgggaggcagaggttgcagt

SEQ ID NO: 115711 - DNA, 22 bp, Homo sapiens
atctgagctccgcctcctgtca

SEQ ID NO: 115712 - DNA, 22 bp, Homo sapiens
ccctgggattcaatttcactct

SEQ ID NO: 115713 - DNA, 22 bp, Homo sapiens
ggacaagcctgtgagtgggttt

SEQ ID NO: 115714 - DNA, 19 bp, Homo sapiens
ccagagagctaggtacaga

SEQ ID NO: 115715 - DNA, 22 bp, Homo sapiens
tacaaaaaattgatactgacga

SEQ ID NO: 115716 - DNA, 22 bp, Homo sapiens
gggctagcctcttccctgctcc

SEQ ID NO: 115717 - DNA, 22 bp, Homo sapiens
ccccggaggcggaggttgcagt

SEQ ID NO: 115718 - DNA, 22 bp, Homo sapiens
cccaggaggcgcaggttgcggt

SEQ ID NO: 115719 - DNA, 22 bp, Homo sapiens
cttggattcctcatatgcacag

SEQ ID NO: 115720 - DNA, 22 bp, Homo sapiens
ggaggggatttagtagatgcta

SEQ ID NO: 115721 - DNA, 20 bp, Homo sapiens
gggcagtggcgctatctcag

SEQ ID NO: 115722 - DNA, 22 bp, Homo sapiens
aaggagaggttgtccgtgttgt

SEQ ID NO: 115723 - DNA, 22 bp, Homo sapiens
tgttcttgagcctttagaccta

SEQ ID NO: 115724 - DNA, 22 bp, Homo sapiens
ctgaacttattgagtgcttgct

SEQ ID NO: 115725 - DNA, 22 bp, Homo sapiens
agctgccgatgcccagctgcat

SEQ ID NO: 115726 - DNA, 23 bp, Homo sapiens
aggatgtaggatgtatggcagag

SEQ ID NO: 115727 - DNA, 22 bp, Homo sapiens
tgacctattagatttccttgcc

SEQ ID NO: 115728 - DNA, 22 bp, Homo sapiens
tgatattttatgagctttcata

SEQ ID NO: 115729 - DNA, 22 bp, Homo sapiens
cccgggaggaggaagttgcagt

SEQ ID NO: 115730 - DNA, 22 bp, Homo sapiens
ggctcactgcaacttccgcctc

SEQ ID NO: 115731 - DNA, 22 bp, Homo sapiens
cccaggaattggaggctgcagt

SEQ ID NO: 115732 - DNA, 22 bp, Homo sapiens
tttgtgaataggttggcttcca

SEQ ID NO: 115733 - DNA, 22 bp, Homo sapiens
ggggatggaggcgtgtggtcct

SEQ ID NO: 115734 - DNA, 22 bp, Homo sapiens
acggtgctgggtattggggttc

SEQ ID NO: 115735 - DNA, 22 bp, Homo sapiens
ctggcaagaaatatatatctta

SEQ ID NO: 115736 - DNA, 22 bp, Homo sapiens
atgattgaaaatgacattgcca

SEQ ID NO: 115737 - DNA, 22 bp, Homo sapiens
tgaggcaggagttcaggctgcg

SEQ ID NO: 115738 - DNA, 22 bp, Homo sapiens
ctgggatccacgggctcccaag

SEQ ID NO: 115739 - DNA, 22 bp, Homo sapiens
tgtgtggattcatctcaaagag

SEQ ID NO: 115740 - DNA, 22 bp, Homo sapiens
tgtctcatctcttaaccccact

SEQ ID NO: 115741 - DNA, 23 bp, Homo sapiens
aggcgagctcttctccagcacgt

SEQ ID NO: 115742 - DNA, 22 bp, Homo sapiens
acccaggagacggaggtgcagt

SEQ ID NO: 115743 - DNA, 21 bp, Homo sapiens
acctgagctccacctcctgcc

SEQ ID NO: 115744 - DNA, 22 bp, Homo sapiens
gctggtagacctcactgcactc

SEQ ID NO: 115745 - DNA, 22 bp, Homo sapiens
catgcctgtaatcccagcactt

SEQ ID NO: 115746 - DNA, 22 bp, Homo sapiens
atcctcagacttcacgttccat

SEQ ID NO: 115747 - DNA, 20 bp, Homo sapiens
attagctcaggtgaggtcat

SEQ ID NO: 115748 - DNA, 22 bp, Homo sapiens
cccaggaggtcaaggctgcagt

SEQ ID NO: 115749 - DNA, 22 bp, Homo sapiens
agcccaggagtttgaggctgtg

SEQ ID NO: 115750 - DNA, 22 bp, Homo sapiens
agatgtgtttctagttcctgca

SEQ ID NO: 115751 - DNA, 22 bp, Homo sapiens
ggaggaggggtgactgaatgct

SEQ ID NO: 115752 - DNA, 21 bp, Homo sapiens
gggcctggctgcgcaggacgg

SEQ ID NO: 115753 - DNA, 22 bp, Homo sapiens
ttgggctcaggagtttgagacc

SEQ ID NO: 115754 - DNA, 22 bp, Homo sapiens
attgctaggaacaggttgcacc

SEQ ID NO: 115755 - DNA, 22 bp, Homo sapiens
ggaggacaggggctgcagcaca

SEQ ID NO: 115756 - DNA, 22 bp, Homo sapiens
tggtatgaccgtggtgcaagca

SEQ ID NO: 115757 - DNA, 22 bp, Homo sapiens
gtagctctgtttaaagttcttt

SEQ ID NO: 115758 - DNA, 22 bp, Homo sapiens
gtggcccaggttggagtgcagt

SEQ ID NO: 115759 - DNA, 22 bp, Homo sapiens
gcctgtgtggatgcgccggtgc

SEQ ID NO: 115760 - DNA, 22 bp, Homo sapiens
caggcaggtcagtgaagaagga

SEQ ID NO: 115761 - DNA, 22 bp, Homo sapiens
tggatctcggcaatgcgggact

SEQ ID NO: 115762 - DNA, 22 bp, Homo sapiens
tttaaaaaactagtctgagtct

SEQ ID NO: 115763 - DNA, 22 bp, Homo sapiens
tcccctggtgccacgatctgct

SEQ ID NO: 115764 - DNA, 22 bp, Homo sapiens
ttatttaaaagtggtaagattc

SEQ ID NO: 115765 - DNA, 22 bp, Homo sapiens
tgctcttcacagtttcagcatc

SEQ ID NO: 115766 - DNA, 22 bp, Homo sapiens
aaccaccattctctcctcttcc

SEQ ID NO: 115767 - DNA, 22 bp, Homo sapiens
ccattgtaaattctgtggaagt

SEQ ID NO: 115768 - DNA, 22 bp, Homo sapiens
cccaggaggtggaggctgcagt

SEQ ID NO: 115769 - DNA, 22 bp, Homo sapiens
ggtctgtctgcctcaggagatg

SEQ ID NO: 115770 - DNA, 22 bp, Homo sapiens
atgccacttcattccagcctcg

SEQ ID NO: 115771 - DNA, 22 bp, Homo sapiens
cccaggagttagaggttgtggt

SEQ ID NO: 115772 - DNA, 22 bp, Homo sapiens
cccaggaggtcgaagctgcagt

SEQ ID NO: 115773 - DNA, 22 bp, Homo sapiens
cccagaaggtcgaggctgcagt

SEQ ID NO: 115774 - DNA, 22 bp, Homo sapiens
caccagcagcggtgtgagggtg

SEQ ID NO: 115775 - DNA, 22 bp, Homo sapiens
gcaggagaacaaagcaagctgc

SEQ ID NO: 115776 - DNA, 22 bp, Homo sapiens
gcagggaggtttgctgacctgg

SEQ ID NO: 115777 - DNA, 22 bp, Homo sapiens
ctgggcctggggctgttgagag

SEQ ID NO: 115778 - DNA, 22 bp, Homo sapiens
tgccctggctcttcttgttcca

SEQ ID NO: 115779 - DNA, 22 bp, Homo sapiens
ccagcagagcatggggaggaag

SEQ ID NO: 115780 - DNA, 22 bp, Homo sapiens
cttagagatgggttttacttag

SEQ ID NO: 115781 - DNA, 22 bp, Homo sapiens
cactgcaacctccacctcctgg

SEQ ID NO: 115782 - DNA, 22 bp, Homo sapiens
cccagggagagcgcggaggcgg

SEQ ID NO: 115783 - DNA, 22 bp, Homo sapiens
aggccagcctcaggcagggacc

SEQ ID NO: 115784 - DNA, 22 bp, Homo sapiens
acgtagcactgagagatgcagg

SEQ ID NO: 115785 - DNA, 22 bp, Homo sapiens
ctcagggccaaggatgctgttg

SEQ ID NO: 115786 - DNA, 21 bp, Homo sapiens
tccctgagcccaaggggctcc

SEQ ID NO: 115787 - DNA, 22 bp, Homo sapiens
tgtacttgaacttgactgtaga

SEQ ID NO: 115788 - DNA, 22 bp, Homo sapiens
cccaggaggcagatgttgcagt

SEQ ID NO: 115789 - DNA, 22 bp, Homo sapiens
ggccctgggccctctagcttgt

SEQ ID NO: 115790 - DNA, 22 bp, Homo sapiens
aggagggagcttaagccaggca

SEQ ID NO: 115791 - DNA, 22 bp, Homo sapiens
actccacaccacgggggccgcc

SEQ ID NO: 115792 - DNA, 21 bp, Homo sapiens
tggacttatggagtgtttctt

SEQ ID NO: 115793 - DNA, 22 bp, Homo sapiens
atggccctaatgagttggtgtt

SEQ ID NO: 115794 - DNA, 22 bp, Homo sapiens
cctcccctcagacagagactgg

SEQ ID NO: 115795 - DNA, 22 bp, Homo sapiens
acaaacagagttgaaaaatagg

SEQ ID NO: 115796 - DNA, 23 bp, Homo sapiens
gcctgggagttgcgatctgcccg

SEQ ID NO: 115797 - DNA, 22 bp, Homo sapiens
gtggagggtgattgccggctgt

SEQ ID NO: 115798 - DNA, 22 bp, Homo sapiens
cccgggaggtggaggttgcagt

SEQ ID NO: 115799 - DNA, 22 bp, Homo sapiens
gagagcaggaggcagcgggacg

SEQ ID NO: 115800 - DNA, 22 bp, Homo sapiens
tggcacaggatctcagcggcca

SEQ ID NO: 115801 - DNA, 22 bp, Homo sapiens
catcctctccagcagtggagtg

SEQ ID NO: 115802 - DNA, 22 bp, Homo sapiens
catggcattgcataacggggct

SEQ ID NO: 115803 - DNA, 19 bp, Homo sapiens
ctctgggcaagtcacttaa

SEQ ID NO: 115804 - DNA, 23 bp, Homo sapiens
tgaggcaggcggatcacgaggtc

SEQ ID NO: 115805 - DNA, 22 bp, Homo sapiens
ctccttctgggcctggcagtgg

SEQ ID NO: 115806 - DNA, 22 bp, Homo sapiens
cccaagaggtggaggttgcagt

SEQ ID NO: 115807 - DNA, 22 bp, Homo sapiens
gagctgggcctgcgagtgctgc

SEQ ID NO: 115808 - DNA, 22 bp, Homo sapiens
ctcactgcaagctctgcctcca

SEQ ID NO: 115809 - DNA, 22 bp, Homo sapiens
tgttaaatgctcagctcgggga

SEQ ID NO: 115810 - DNA, 22 bp, Homo sapiens
gggccatgagaggttcatcaac

SEQ ID NO: 115811 - DNA, 22 bp, Homo sapiens
aaccaccattctctcctcttcc

SEQ ID NO: 115812 - DNA, 22 bp, Homo sapiens
attggccatttgcatgtattat

SEQ ID NO: 115813 - DNA, 20 bp, Homo sapiens
tcacatcctctcccaacatg

SEQ ID NO: 115814 - DNA, 22 bp, Homo sapiens
aagaaatgtgaatattgaatag

SEQ ID NO: 115815 - DNA, 21 bp, Homo sapiens
agctgcctccacttctgaggc

SEQ ID NO: 115816 - DNA, 22 bp, Homo sapiens
acagttaattgttgttgggtgt

SEQ ID NO: 115817 - DNA, 22 bp, Homo sapiens
gattcactcatattttacgttt

SEQ ID NO: 115818 - DNA, 22 bp, Homo sapiens
gtgaaatatttaacgtccaggt

SEQ ID NO: 115819 - DNA, 22 bp, Homo sapiens
tcactgcaacctccacctcccg

SEQ ID NO: 115820 - DNA, 23 bp, Homo sapiens
ggatggacgtgatgccttagcca

SEQ ID NO: 115821 - DNA, 22 bp, Homo sapiens
cttctttcaagaatggattagg

SEQ ID NO: 115822 - DNA, 22 bp, Homo sapiens
agaaaatgtgaacttgtgaatt

SEQ ID NO: 115823 - DNA, 22 bp, Homo sapiens
ttggccatctaagcccagccac

SEQ ID NO: 115824 - DNA, 22 bp, Homo sapiens
ccattgtaaattctgtggaagt

SEQ ID NO: 115825 - DNA, 22 bp, Homo sapiens
gtcatcttgctgttttagatct

SEQ ID NO: 115826 - DNA, 22 bp, Homo sapiens
ctggtagtttgcaaaatggtgt

SEQ ID NO: 115827 - DNA, 22 bp, Homo sapiens
tgttgagtatatacctacaagt

SEQ ID NO: 115828 - DNA, 22 bp, Homo sapiens
acagttaataagtagtaagtca

SEQ ID NO: 115829 - DNA, 22 bp, Homo sapiens
tgcaggctcttggtgacgtggg

SEQ ID NO: 115830 - DNA, 22 bp, Homo sapiens
atcgcaagtttaaaaatctttg

SEQ ID NO: 115831 - DNA, 22 bp, Homo sapiens
acatcttttactctggttcggg

SEQ ID NO: 115832 - DNA, 22 bp, Homo sapiens
tgggactcactcttttggccag

SEQ ID NO: 115833 - DNA, 22 bp, Homo sapiens
ggcaagaaccacaattactttt

SEQ ID NO: 115834 - DNA, 22 bp, Homo sapiens
ttttaatactgctattgtagga

SEQ ID NO: 115835 - DNA, 22 bp, Homo sapiens
gactggaaagcctgtcctcaga

SEQ ID NO: 115836 - DNA, 22 bp, Homo sapiens
cccgactagctgggattacagg

SEQ ID NO: 115837 - DNA, 22 bp, Homo sapiens
cacgttaacagctaacagatga

SEQ ID NO: 115838 - DNA, 22 bp, Homo sapiens
tccacagtggttgaactagtaa

SEQ ID NO: 115839 - DNA, 23 bp, Homo sapiens
aaataggagtatctggatcatga

SEQ ID NO: 115840 - DNA, 22 bp, Homo sapiens
tctcgctctgtcgcccaggctg

SEQ ID NO: 115841 - DNA, 22 bp, Homo sapiens
tctgttgactcctagcagccat

SEQ ID NO: 115842 - DNA, 22 bp, Homo sapiens
tgtttcttacgtttttagaggc

SEQ ID NO: 115843 - DNA, 22 bp, Homo sapiens
gaatttcctctaaacccctgag

SEQ ID NO: 115844 - DNA, 22 bp, Homo sapiens
ttggaaacgtcaccttttcctt

SEQ ID NO: 115845 - DNA, 22 bp, Homo sapiens
tgagcaggcgcagcaggaggtc

SEQ ID NO: 115846 - DNA, 22 bp, Homo sapiens
tacatgctccttatgagaatct

SEQ ID NO: 115847 - DNA, 22 bp, Homo sapiens
cctgagtagctggaattaaagg

SEQ ID NO: 115848 - DNA, 22 bp, Homo sapiens
actgttttctgtaaagggccag

SEQ ID NO: 115849 - DNA, 22 bp, Homo sapiens
tagctcaaaggttaagtgtgga

SEQ ID NO: 115850 - DNA, 22 bp, Homo sapiens
ttttggccacatccttttgagt

SEQ ID NO: 115851 - DNA, 22 bp, Homo sapiens
ctcgcaagtcgctccggttact

SEQ ID NO: 115852 - DNA, 22 bp, Homo sapiens
ggcaagaacctcaattaccttt

SEQ ID NO: 115853 - DNA, 19 bp, Homo sapiens
gttctttcatagtaagagc

SEQ ID NO: 115854 - DNA, 22 bp, Homo sapiens
catctttgcccatccacttcca

SEQ ID NO: 115855 - DNA, 22 bp, Homo sapiens
gaatgctacttgactcagctca

SEQ ID NO: 115856 - DNA, 22 bp, Homo sapiens
tgcacgtgtgagcattcacatg

SEQ ID NO: 115857 - DNA, 22 bp, Homo sapiens
ttgctttcccaaggcagaacat

SEQ ID NO: 115858 - DNA, 22 bp, Homo sapiens
ggccttggttccaaagcaggca

SEQ ID NO: 115859 - DNA, 22 bp, Homo sapiens
tagtttcatctccaccctgccc

SEQ ID NO: 115860 - DNA, 22 bp, Homo sapiens
ggagaagaggagctggaagcct

SEQ ID NO: 115861 - DNA, 22 bp, Homo sapiens
attataggcttgagccaccgtg

SEQ ID NO: 115862 - DNA, 22 bp, Homo sapiens
gcatctaaataaacgtgggagt

SEQ ID NO: 115863 - DNA, 22 bp, Homo sapiens
gtctgctcatgctaccgcgggc

SEQ ID NO: 115864 - DNA, 20 bp, Homo sapiens
tttgagaccagtctgcccaa

SEQ ID NO: 115865 - DNA, 20 bp, Homo sapiens
tgttgattggtgtcatctca

SEQ ID NO: 115866 - DNA, 22 bp, Homo sapiens
gggaaatctcgtcctctattta

SEQ ID NO: 115867 - DNA, 22 bp, Homo sapiens
gtgagactcgcctttgtgtagc

SEQ ID NO: 115868 - DNA, 21 bp, Homo sapiens
cactccacttagaacagggtt

SEQ ID NO: 115869 - DNA, 22 bp, Homo sapiens
tgtttctgtatgatcaatattg

SEQ ID NO: 115870 - DNA, 22 bp, Homo sapiens
agtactgtcagcagggtgttga

SEQ ID NO: 115871 - DNA, 22 bp, Homo sapiens
accatgtcatttattggccaaa

SEQ ID NO: 115872 - DNA, 22 bp, Homo sapiens
gaatatcccgctatgcaaagta

SEQ ID NO: 115873 - DNA, 22 bp, Homo sapiens
gtatagaaacccagaaagatag

SEQ ID NO: 115874 - DNA, 22 bp, Homo sapiens
aactctatttaccctactaaac

SEQ ID NO: 115875 - DNA, 22 bp, Homo sapiens
actgttgaagtgccagcttgat

SEQ ID NO: 115876 - DNA, 22 bp, Homo sapiens
tgagtggacacctgcttcttta

SEQ ID NO: 115877 - DNA, 22 bp, Homo sapiens
tgactacaacctccacctcccg

SEQ ID NO: 115878 - DNA, 22 bp, Homo sapiens
ctgtggctctcagaggctgctg

SEQ ID NO: 115879 - DNA, 22 bp, Homo sapiens
tcactgcaacctccacctcctg

SEQ ID NO: 115880 - DNA, 22 bp, Homo sapiens
aggaatggtgctcagcagaaat

SEQ ID NO: 115881 - DNA, 22 bp, Homo sapiens
aggctagaggcttctggcttca

SEQ ID NO: 115882 - DNA, 22 bp, Homo sapiens
tataccatgtgtgcacactccc

SEQ ID NO: 115883 - DNA, 22 bp, Homo sapiens
atatacacatctttttaaatat

SEQ ID NO: 115884 - DNA, 22 bp, Homo sapiens
tgctgttagtaaggaacatgac

SEQ ID NO: 115885 - DNA, 19 bp, Homo sapiens
gactccaactttaagcatg

SEQ ID NO: 115886 - DNA, 22 bp, Homo sapiens
gccatgactctccataccaaag

SEQ ID NO: 115887 - DNA, 22 bp, Homo sapiens
tctgttttgcataatgttcttt

SEQ ID NO: 115888 - DNA, 22 bp, Homo sapiens
aaggagtctgggccattcagag

SEQ ID NO: 115889 - DNA, 22 bp, Homo sapiens
tgcacgtgggctctctgctctt

SEQ ID NO: 115890 - DNA, 22 bp, Homo sapiens
cactgcaacctccacctcctgg

SEQ ID NO: 115891 - DNA, 22 bp, Homo sapiens
catgatctggtcctactgtggg

SEQ ID NO: 115892 - DNA, 22 bp, Homo sapiens
ttggatccatctcaggcatagg

SEQ ID NO: 115893 - DNA, 22 bp, Homo sapiens
tcaccgaggctggagtgcagtg

SEQ ID NO: 115894 - DNA, 22 bp, Homo sapiens
tccacagtggttgaactagttt

SEQ ID NO: 115895 - DNA, 22 bp, Homo sapiens
ataaaagatcccttctgagctc

SEQ ID NO: 115896 - DNA, 22 bp, Homo sapiens
tgactggattgtcattacgacg

SEQ ID NO: 115897 - DNA, 22 bp, Homo sapiens
tctaaattactttgggcagtat

SEQ ID NO: 115898 - DNA, 21 bp, Homo sapiens
caaaagagactgattcttgga

SEQ ID NO: 115899 - DNA, 21 bp, Homo sapiens
ggcaagaaacacaatcaagta

SEQ ID NO: 115900 - DNA, 21 bp, Homo sapiens
aagaggaagcattatggcata

SEQ ID NO: 115901 - DNA, 22 bp, Homo sapiens
cagtggcgtgatctctgctcac

SEQ ID NO: 115902 - DNA, 22 bp, Homo sapiens
ttccacattccttacattcata

SEQ ID NO: 115903 - DNA, 22 bp, Homo sapiens
actgcaacctccgcctgccagg

SEQ ID NO: 115904 - DNA, 22 bp, Homo sapiens
agatcacagtggcaactccctt

SEQ ID NO: 115905 - DNA, 22 bp, Homo sapiens
accctcttgagggaagcacttt

SEQ ID NO: 115906 - DNA, 22 bp, Homo sapiens
ggaggtggaggttgcagtgagc

SEQ ID NO: 115907 - DNA, 22 bp, Homo sapiens
tccagcagtccatgtgagacac

SEQ ID NO: 115908 - DNA, 22 bp, Homo sapiens
agccagggacgctgcaggctac

SEQ ID NO: 115909 - DNA, 20 bp, Homo sapiens
gttaggaggttggacatgga

SEQ ID NO: 115910 - DNA, 22 bp, Homo sapiens
atacaaaatatatactggagac

SEQ ID NO: 115911 - DNA, 22 bp, Homo sapiens
gggcccctgggaattctgtgat

SEQ ID NO: 115912 - DNA, 22 bp, Homo sapiens
ctggcccaggtggtcgttgagg

SEQ ID NO: 115913 - DNA, 22 bp, Homo sapiens
actgcactccagcctcggggtc

SEQ ID NO: 115914 - DNA, 22 bp, Homo sapiens
gtggcccatcacgtttcgcctt

SEQ ID NO: 115915 - DNA, 19 bp, Homo sapiens
ggctgccttctgctcatct

SEQ ID NO: 115916 - DNA, 22 bp, Homo sapiens
agcattccacactgaagtctgc

SEQ ID NO: 115917 - DNA, 22 bp, Homo sapiens
aaggttcctctctccacccagc

SEQ ID NO: 115918 - DNA, 22 bp, Homo sapiens
tcctgggaggcggaggttgcag

SEQ ID NO: 115919 - DNA, 22 bp, Homo sapiens
ttggaacatgccggggtccagg

SEQ ID NO: 115920 - DNA, 21 bp, Homo sapiens
caaaagagactgattcttgga

SEQ ID NO: 115921 - DNA, 22 bp, Homo sapiens
agaaatatgctgattagatgaa

SEQ ID NO: 115922 - DNA, 20 bp, Homo sapiens
agagatggggtatcaccgta

SEQ ID NO: 115923 - DNA, 22 bp, Homo sapiens
tcactgcaacctccacctcccg

SEQ ID NO: 115924 - DNA, 22 bp, Homo sapiens
gaggtggctgcttgctgggaaa

SEQ ID NO: 115925 - DNA, 22 bp, Homo sapiens
cccattcatcctcgcttccttc

SEQ ID NO: 115926 - DNA, 22 bp, Homo sapiens
ggaggcagaatagagtgtgggt

SEQ ID NO: 115927 - DNA, 22 bp, Homo sapiens
cgggcgcactccgggcagctgt

SEQ ID NO: 115928 - DNA, 22 bp, Homo sapiens
gtgcagagaggaccttggggag

SEQ ID NO: 115929 - DNA, 22 bp, Homo sapiens
cttgcctacttgtcaaccagca

SEQ ID NO: 115930 - DNA, 22 bp, Homo sapiens
accatgttggccaagctggtct

SEQ ID NO: 115931 - DNA, 22 bp, Homo sapiens
agcctattccaggatgagctca

SEQ ID NO: 115932 - DNA, 22 bp, Homo sapiens
ggccagcctggggctcccagac

SEQ ID NO: 115933 - DNA, 22 bp, Homo sapiens
cacccaggctggagtgcagtgg

SEQ ID NO: 115934 - DNA, 19 bp, Homo sapiens
gcagacaggtccagagagg

SEQ ID NO: 115935 - DNA, 22 bp, Homo sapiens
tgtgaatggacaattaaatcta

SEQ ID NO: 115936 - DNA, 22 bp, Homo sapiens
gagtccaagctagagccactca

SEQ ID NO: 115937 - DNA, 22 bp, Homo sapiens
gggccggagctgggtcccgcgc

SEQ ID NO: 115938 - DNA, 22 bp, Homo sapiens
accccaggaagtggaggtcatg

SEQ ID NO: 115939 - DNA, 22 bp, Homo sapiens
ttggccatctaagcccagccac

SEQ ID NO: 115940 - DNA, 22 bp, Homo sapiens
cctgggaggctgaggctgcagt

SEQ ID NO: 115941 - DNA, 22 bp, Homo sapiens
gtggcaagatgactactcactg

SEQ ID NO: 115942 - DNA, 22 bp, Homo sapiens
tggcccagtatgtataatctta

SEQ ID NO: 115943 - DNA, 22 bp, Homo sapiens
ccaaagtgctgggattacaggt

SEQ ID NO: 115944 - DNA, 22 bp, Homo sapiens
acaggcacctgccaccacatct

SEQ ID NO: 115945 - DNA, 22 bp, Homo sapiens
ggctttgacatgctgaattaaa

SEQ ID NO: 115946 - DNA, 22 bp, Homo sapiens
actggacagaggaaatatggag

SEQ ID NO: 115947 - DNA, 22 bp, Homo sapiens
gggaggcagtgctggaggctgg

SEQ ID NO: 115948 - DNA, 22 bp, Homo sapiens
cttgtagaattgaaatggtctc

SEQ ID NO: 115949 - DNA, 22 bp, Homo sapiens
gggagctggagctggaagactc

SEQ ID NO: 115950 - DNA, 22 bp, Homo sapiens
cacccaggcaaggattctgcaa

SEQ ID NO: 115951 - DNA, 22 bp, Homo sapiens
agggagcaaaggtttcagggtt

SEQ ID NO: 115952 - DNA, 22 bp, Homo sapiens
ttgtaagtcacaccagggcagg

SEQ ID NO: 115953 - DNA, 23 bp, Homo sapiens
aaactacaacgccaggcactgag

SEQ ID NO: 115954 - DNA, 22 bp, Homo sapiens
gggccaccccactgcccacgct

SEQ ID NO: 115955 - DNA, 19 bp, Homo sapiens
catctggatgattctcctg

SEQ ID NO: 115956 - DNA, 21 bp, Homo sapiens
cttccccaggctggtctgtat

SEQ ID NO: 115957 - DNA, 22 bp, Homo sapiens
cagcgtctcgttgtgggcctcg

SEQ ID NO: 115958 - DNA, 22 bp, Homo sapiens
ttatttaaaagtggtaagattc

SEQ ID NO: 115959 - DNA, 22 bp, Homo sapiens
tacagaagcttttgaaaagatg

SEQ ID NO: 115960 - DNA, 22 bp, Homo sapiens
ttatttaatgtgatctgaagag

SEQ ID NO: 115961 - DNA, 22 bp, Homo sapiens
cctcttctaggacgtccttgtg

SEQ ID NO: 115962 - DNA, 22 bp, Homo sapiens
ggctgccttccctgagccccgg

SEQ ID NO: 115963 - DNA, 22 bp, Homo sapiens
atacagggacatccagtttttc

SEQ ID NO: 115964 - DNA, 22 bp, Homo sapiens
ctgcactgacttccccggctgc

SEQ ID NO: 115965 - DNA, 22 bp, Homo sapiens
aggggagagttaatgtgaatgt

SEQ ID NO: 115966 - DNA, 22 bp, Homo sapiens
ggtccccccatggtgagcactg

SEQ ID NO: 115967 - DNA, 22 bp, Homo sapiens
aaggccttgccgaaggatgcca

SEQ ID NO: 115968 - DNA, 22 bp, Homo sapiens
ggtgacctcacctggtcccacc

SEQ ID NO: 115969 - DNA, 22 bp, Homo sapiens
ttcaggcccagcacagcgcgtg

SEQ ID NO: 115970 - DNA, 22 bp, Homo sapiens
tcgcccagctcatctcccacaa

SEQ ID NO: 115971 - DNA, 22 bp, Homo sapiens
ccaaagtgctaggattacaggt

SEQ ID NO: 115972 - DNA, 22 bp, Homo sapiens
tccgaggccaaagctgtgaata

SEQ ID NO: 115973 - DNA, 16 bp, Homo sapiens
atgctgctattagagg

SEQ ID NO: 115974 - DNA, 22 bp, Homo sapiens
gcccaggctggagtgcagtggc

SEQ ID NO: 115975 - DNA, 22 bp, Homo sapiens
tgagccatgggactccaaggga

SEQ ID NO: 115976 - DNA, 22 bp, Homo sapiens
ttcttctttccaattacatggt

SEQ ID NO: 115977 - DNA, 22 bp, Homo sapiens
gaggaggcttccgggaggcacg

SEQ ID NO: 115978 - DNA, 22 bp, Homo sapiens
tggtgctgccaggctcctgcca

SEQ ID NO: 115979 - DNA, 22 bp, Homo sapiens
cagcctttgggtcagaagattc

SEQ ID NO: 115980 - DNA, 22 bp, Homo sapiens
gcccagccacagtcactttcat

SEQ ID NO: 115981 - DNA, 22 bp, Homo sapiens
ttgcttgcattgtccctggtga

SEQ ID NO: 115982 - DNA, 22 bp, Homo sapiens
gccagggttcgaatccgtatgg

SEQ ID NO: 115983 - DNA, 22 bp, Homo sapiens
ggagaagcagcttcttgatgaa

SEQ ID NO: 115984 - DNA, 22 bp, Homo sapiens
cagcagcagtgttctagaatct

SEQ ID NO: 115985 - DNA, 20 bp, Homo sapiens
tttgagaccagtctgcccaa

SEQ ID NO: 115986 - DNA, 23 bp, Homo sapiens
aaaacagcttcctccagtggctc

SEQ ID NO: 115987 - DNA, 22 bp, Homo sapiens
gggtccctggaattacttgaca

SEQ ID NO: 115988 - DNA, 22 bp, Homo sapiens
caggagtgttgattgctcagga

SEQ ID NO: 115989 - DNA, 22 bp, Homo sapiens
catgatctggtcctactgtggg

SEQ ID NO: 115990 - DNA, 22 bp, Homo sapiens
tggaggagaccgcattttattt

SEQ ID NO: 115991 - DNA, 22 bp, Homo sapiens
ccactgcacttcagcctgggtg

SEQ ID NO: 115992 - DNA, 22 bp, Homo sapiens
aagcagagaatctgggagcgag

SEQ ID NO: 115993 - DNA, 22 bp, Homo sapiens
tcaccttgtgatctccctgcct

SEQ ID NO: 115994 - DNA, 22 bp, Homo sapiens
ggcagcactgcagcttgttggg

SEQ ID NO: 115995 - DNA, 22 bp, Homo sapiens
ctggcaggttatagagctgccc

SEQ ID NO: 115996 - DNA, 22 bp, Homo sapiens
aaattagtgcaccaggttgaag

SEQ ID NO: 115997 - DNA, 22 bp, Homo sapiens
gggacttaatgcagagagggac

SEQ ID NO: 115998 - DNA, 22 bp, Homo sapiens
cctggaggcggaggttgcagtg

SEQ ID NO: 115999 - DNA, 22 bp, Homo sapiens
aaaaaattatcatagttcctga

SEQ ID NO: 116000 - DNA, 22 bp, Homo sapiens
ctcttagtaatgccatgaagca

SEQ ID NO: 116001 - DNA, 22 bp, Homo sapiens
tggaacgtcgtaatgttggtta

SEQ ID NO: 116002 - DNA, 22 bp, Homo sapiens
atggcagcggagctggaaatga

SEQ ID NO: 116003 - DNA, 22 bp, Homo sapiens
ttgcccagagtcacccagctca

SEQ ID NO: 116004 - DNA, 22 bp, Homo sapiens
ggagcagggaattacagcgcag

SEQ ID NO: 116005 - DNA, 22 bp, Homo sapiens
tcactgcagcctctgcctcccg

SEQ ID NO: 116006 - DNA, 22 bp, Homo sapiens
ggagaggggaacttgttgcttg

SEQ ID NO: 116007 - DNA, 22 bp, Homo sapiens
gtggcccaggttggagtgcagt

SEQ ID NO: 116008 - DNA, 22 bp, Homo sapiens
gagcaggaaggccagaagggtc

SEQ ID NO: 116009 - DNA, 22 bp, Homo sapiens
acagacaagtagttcagacaag

SEQ ID NO: 116010 - DNA, 22 bp, Homo sapiens
tggagaattctatgttgagggg

SEQ ID NO: 116011 - DNA, 19 bp, Homo sapiens
acccagcccaggagtggca

SEQ ID NO: 116012 - DNA, 22 bp, Homo sapiens
taattagtgtccagcttctgct

SEQ ID NO: 116013 - DNA, 22 bp, Homo sapiens
gtggcccaggctggagtgcagt

SEQ ID NO: 116014 - DNA, 22 bp, Homo sapiens
tgccatagcaatggtaagctga

SEQ ID NO: 116015 - DNA, 22 bp, Homo sapiens
ccaagcagagcagcctctctgg

SEQ ID NO: 116016 - DNA, 22 bp, Homo sapiens
gggagaggttacccgagcaact

SEQ ID NO: 116017 - DNA, 22 bp, Homo sapiens
tcactgcaagctccacctcccg

SEQ ID NO: 116018 - DNA, 22 bp, Homo sapiens
ccttttgctctcccatccagaa

SEQ ID NO: 116019 - DNA, 22 bp, Homo sapiens
attataggcttgagccaccgtg

SEQ ID NO: 116020 - DNA, 22 bp, Homo sapiens
gcctcctggggtgccatcatct

SEQ ID NO: 116021 - DNA, 22 bp, Homo sapiens
tggtgccatcatagctcactgc

SEQ ID NO: 116022 - DNA, 22 bp, Homo sapiens
atccaccctgtggtggctttct

SEQ ID NO: 116023 - DNA, 22 bp, Homo sapiens
ctggaaggagcccgggcggatc

SEQ ID NO: 116024 - DNA, 22 bp, Homo sapiens
tccttaggcaatttgggagagt

SEQ ID NO: 116025 - DNA, 22 bp, Homo sapiens
agaggccggccgagcccatggg

SEQ ID NO: 116026 - DNA, 22 bp, Homo sapiens
ggcctgcctcacagtcagcacc

SEQ ID NO: 116027 - DNA, 22 bp, Homo sapiens
ggggcaggagcccttcttcagc

SEQ ID NO: 116028 - DNA, 22 bp, Homo sapiens
acagcagagcctggtacttact

SEQ ID NO: 116029 - DNA, 22 bp, Homo sapiens
ggcaggaggtgagtggcgggtg

SEQ ID NO: 116030 - DNA, 22 bp, Homo sapiens
gtctgctcatgctaccgcgggc

SEQ ID NO: 116031 - DNA, 22 bp, Homo sapiens
gccaccctggacgcactgttcg

SEQ ID NO: 116032 - DNA, 22 bp, Homo sapiens
gggagtgggtttggcctaggcc

SEQ ID NO: 116033 - DNA, 22 bp, Homo sapiens
atggccgcctgtccttcccgcc

SEQ ID NO: 116034 - DNA, 22 bp, Homo sapiens
aggggaatgggtagactgttga

SEQ ID NO: 116035 - DNA, 22 bp, Homo sapiens
tgcagaaacaagccatcattca

SEQ ID NO: 116036 - DNA, 22 bp, Homo sapiens
actgcactccagcctgggtaac

SEQ ID NO: 116037 - DNA, 22 bp, Homo sapiens
actgcactccaacctgggtgac

SEQ ID NO: 116038 - DNA, 22 bp, Homo sapiens
atgcagaagactgaaaagctga

SEQ ID NO: 116039 - DNA, 22 bp, Homo sapiens
gcactgcaggtgggtggagagg

SEQ ID NO: 116040 - DNA, 22 bp, Homo sapiens
tgcctccctggcaagtctctcc

SEQ ID NO: 116041 - DNA, 22 bp, Homo sapiens
ggcatggacgtctctgaggcca

SEQ ID NO: 116042 - DNA, 22 bp, Homo sapiens
acgcccagactcccatactttg

SEQ ID NO: 116043 - DNA, 22 bp, Homo sapiens
cagctttgccaagtaaggtctt

SEQ ID NO: 116044 - DNA, 22 bp, Homo sapiens
ctgcactgagcatctaacctta

SEQ ID NO: 116045 - DNA, 22 bp, Homo sapiens
agatggagtctcactcttgttg

SEQ ID NO: 116046 - DNA, 22 bp, Homo sapiens
ggcgctcagtgttgccccagag

SEQ ID NO: 116047 - DNA, 22 bp, Homo sapiens
cccaggaggcctgcctggccgg

SEQ ID NO: 116048 - DNA, 22 bp, Homo sapiens
aggagggagcttaagccaggca

SEQ ID NO: 116049 - DNA, 19 bp, Homo sapiens
ctctggagtcattgctccc

SEQ ID NO: 116050 - DNA, 22 bp, Homo sapiens
agggtgaatctcacaactctta

SEQ ID NO: 116051 - DNA, 22 bp, Homo sapiens
gaacactgctgttgggttctga

SEQ ID NO: 116052 - DNA, 22 bp, Homo sapiens
ttttccttcatatcccttatgt

SEQ ID NO: 116053 - DNA, 22 bp, Homo sapiens
tcctggatggcctgcaggcggt

SEQ ID NO: 116054 - DNA, 22 bp, Homo sapiens
atgaccagccgagataaacaga

SEQ ID NO: 116055 - DNA, 18 bp, Homo sapiens
tggttccttgaaggggca

SEQ ID NO: 116056 - DNA, 22 bp, Homo sapiens
atgttggagtcgtaaggcatgg

SEQ ID NO: 116057 - DNA, 22 bp, Homo sapiens
gccatgcttggtatgctgtgag

SEQ ID NO: 116058 - DNA, 22 bp, Homo sapiens
tgagataatcatgtgatttcat

SEQ ID NO: 116059 - DNA, 22 bp, Homo sapiens
gctcatgactgtaatcccagca

SEQ ID NO: 116060 - DNA, 22 bp, Homo sapiens
tgagcaggcgcagcaggaggtc

SEQ ID NO: 116061 - DNA, 22 bp, Homo sapiens
ccgaggtcctggacttggccct

SEQ ID NO: 116062 - DNA, 22 bp, Homo sapiens
caggaaagggatgggctgccac

SEQ ID NO: 116063 - DNA, 22 bp, Homo sapiens
gggaagtgatggagccaggatt

SEQ ID NO: 116064 - DNA, 22 bp, Homo sapiens
gctgtcttgctcactcttgcag

SEQ ID NO: 116065 - DNA, 19 bp, Homo sapiens
actgcactccagcctgggt

SEQ ID NO: 116066 - DNA, 22 bp, Homo sapiens
accctggacatcttgtcatagc

SEQ ID NO: 116067 - DNA, 22 bp, Homo sapiens
acagcagcaatagcagtgacat

SEQ ID NO: 116068 - DNA, 22 bp, Homo sapiens
ggtcagccttggatttggtagc

SEQ ID NO: 116069 - DNA, 22 bp, Homo sapiens
ttctttcagaacacaagtgatt

SEQ ID NO: 116070 - DNA, 19 bp, Homo sapiens
agggttacccgctgccacc

SEQ ID NO: 116071 - DNA, 22 bp, Homo sapiens
cagctcacccatcacgtctgct

SEQ ID NO: 116072 - DNA, 23 bp, Homo sapiens
gcctgggagttgcgatctgcccg

SEQ ID NO: 116073 - DNA, 22 bp, Homo sapiens
cccacgtcgaacttgctccaga

SEQ ID NO: 116074 - DNA, 22 bp, Homo sapiens
gggccctgggattcagagcaag

SEQ ID NO: 116075 - DNA, 22 bp, Homo sapiens
tttgcttgattaggatatggaa

SEQ ID NO: 116076 - DNA, 22 bp, Homo sapiens
ctcagcagtatactctgaagat

SEQ ID NO: 116077 - DNA, 23 bp, Homo sapiens
caccactttctccttctccttgg

SEQ ID NO: 116078 - DNA, 22 bp, Homo sapiens
agttgctttggatataacttct

SEQ ID NO: 116079 - DNA, 19 bp, Homo sapiens
tttgatagggcataatata

SEQ ID NO: 116080 - DNA, 22 bp, Homo sapiens
ggcgccagcactgcagcgcctc

SEQ ID NO: 116081 - DNA, 22 bp, Homo sapiens
ggcagacctctccagccccaca

SEQ ID NO: 116082 - DNA, 22 bp, Homo sapiens
gtgacaatattagctcaggggc

SEQ ID NO: 116083 - DNA, 22 bp, Homo sapiens
gccagggtcctgaagaccaagt

SEQ ID NO: 116084 - DNA, 22 bp, Homo sapiens
acgatgatgaaagagaacattc

SEQ ID NO: 116085 - DNA, 22 bp, Homo sapiens
actgcacttcagcctgggtgac

SEQ ID NO: 116086 - DNA, 22 bp, Homo sapiens
tcactgcaacctccacctcctg

SEQ ID NO: 116087 - DNA, 22 bp, Homo sapiens
actgcacttcagcctgggtgtc

SEQ ID NO: 116088 - DNA, 22 bp, Homo sapiens
gaggagggagctggaagctctt

SEQ ID NO: 116089 - DNA, 22 bp, Homo sapiens
gcccaggctggagtgcagtggt

SEQ ID NO: 116090 - DNA, 22 bp, Homo sapiens
gccagggttcaagctattctcc

SEQ ID NO: 116091 - DNA, 22 bp, Homo sapiens
tggcaaaatgagcaattacttt

SEQ ID NO: 116092 - DNA, 22 bp, Homo sapiens
ggtaccaccaattcagctgcca

SEQ ID NO: 116093 - DNA, 22 bp, Homo sapiens
ccttgctcaagctagtgacggg

SEQ ID NO: 116094 - DNA, 22 bp, Homo sapiens
tggagagttctgtagatatcta

SEQ ID NO: 116095 - DNA, 22 bp, Homo sapiens
atacctgtgtatccacaagcgt

SEQ ID NO: 116096 - DNA, 22 bp, Homo sapiens
gggagctgagctggaagagaat

SEQ ID NO: 116097 - DNA, 22 bp, Homo sapiens
tcactgcaacctctgcctcccg

SEQ ID NO: 116098 - DNA, 22 bp, Homo sapiens
taggtagctttggcgtttcttg

SEQ ID NO: 116099 - DNA, 18 bp, Homo sapiens
cagcctctgattggttgc

SEQ ID NO: 116100 - DNA, 22 bp, Homo sapiens
tctctcaggctggagtgcagtg

SEQ ID NO: 116101 - DNA, 20 bp, Homo sapiens
tcagccttgaatgcttgaaa

SEQ ID NO: 116102 - DNA, 22 bp, Homo sapiens
agaggaggctctgggatcgtcc

SEQ ID NO: 116103 - DNA, 22 bp, Homo sapiens
ggtgacgaatccatagcatcga

SEQ ID NO: 116104 - DNA, 22 bp, Homo sapiens
ggacacgtggctgaaggcggcc

SEQ ID NO: 116105 - DNA, 22 bp, Homo sapiens
gctggaggatggactggaagaa

SEQ ID NO: 116106 - DNA, 22 bp, Homo sapiens
ccaaagtgctgggattacaggc

SEQ ID NO: 116107 - DNA, 22 bp, Homo sapiens
gctgacccctacaggttgtgtt

SEQ ID NO: 116108 - DNA, 22 bp, Homo sapiens
gccctagcgccagctcagcacc

SEQ ID NO: 116109 - DNA, 22 bp, Homo sapiens
tagaaaagccccagctggaggg

SEQ ID NO: 116110 - DNA, 22 bp, Homo sapiens
gtggaggagaggcgccttgcgg

SEQ ID NO: 116111 - DNA, 22 bp, Homo sapiens
gagtggggggtccgtctcagtg

SEQ ID NO: 116112 - DNA, 22 bp, Homo sapiens
atgagttgaagctacaagaggc

SEQ ID NO: 116113 - DNA, 22 bp, Homo sapiens
gctccctggtagccatgctctc

SEQ ID NO: 116114 - DNA, 21 bp, Homo sapiens
tggcggggacttgtggctgcc

SEQ ID NO: 116115 - DNA, 22 bp, Homo sapiens
atggccaggcacctctggctga

SEQ ID NO: 116116 - DNA, 22 bp, Homo sapiens
tgtgacctcatcttaactggaa

SEQ ID NO: 116117 - DNA, 19 bp, Homo sapiens
actgcactttagcctgggc

SEQ ID NO: 116118 - DNA, 22 bp, Homo sapiens
gcaggatgagtgagtacattta

SEQ ID NO: 116119 - DNA, 22 bp, Homo sapiens
agcccaggttgaggctgcagtg

SEQ ID NO: 116120 - DNA, 22 bp, Homo sapiens
aaattagtcatgttgtattact

SEQ ID NO: 116121 - DNA, 22 bp, Homo sapiens
gagagcaggaggcagcgggacg

SEQ ID NO: 116122 - DNA, 22 bp, Homo sapiens
cacccaggctggagtgcagtga

SEQ ID NO: 116123 - DNA, 22 bp, Homo sapiens
attgcacatctgcactacagcc

SEQ ID NO: 116124 - DNA, 22 bp, Homo sapiens
acccagccatgttcagttctct

SEQ ID NO: 116125 - DNA, 22 bp, Homo sapiens
cagtgcttttaaaacaacatca

SEQ ID NO: 116126 - DNA, 22 bp, Homo sapiens
actgcacttcaccctgggtgac

SEQ ID NO: 116127 - DNA, 22 bp, Homo sapiens
cccacacacatttatgatagga

SEQ ID NO: 116128 - DNA, 22 bp, Homo sapiens
gaaagagaacctgggcctagat

SEQ ID NO: 116129 - DNA, 22 bp, Homo sapiens
tgacaggaaacatgcagtgatt

SEQ ID NO: 116130 - DNA, 22 bp, Homo sapiens
aaggatgattggtaatgacact

SEQ ID NO: 116131 - DNA, 22 bp, Homo sapiens
agttggagtgaacatgagattg

SEQ ID NO: 116132 - DNA, 22 bp, Homo sapiens
aaccccgctcaggctgggtgag

SEQ ID NO: 116133 - DNA, 22 bp, Homo sapiens
ccaggcaggcgatggtgcagtg

SEQ ID NO: 116134 - DNA, 22 bp, Homo sapiens
aaacatctactgtaggctggag

SEQ ID NO: 116135 - DNA, 22 bp, Homo sapiens
agcagcagtgttctggaattct

SEQ ID NO: 116136 - DNA, 22 bp, Homo sapiens
ttttcctttgattcccagatgt

SEQ ID NO: 116137 - DNA, 22 bp, Homo sapiens
ttcctgcgcccttctcgcccgc

SEQ ID NO: 116138 - DNA, 22 bp, Homo sapiens
ggaggagcatgagagggtagtg

SEQ ID NO: 116139 - DNA, 22 bp, Homo sapiens
actgcactccagcctgggtgat

SEQ ID NO: 116140 - DNA, 22 bp, Homo sapiens
gggccctgcgactcgcggcgga

SEQ ID NO: 116141 - DNA, 22 bp, Homo sapiens
ctcattgcaacctccgcctccc

SEQ ID NO: 116142 - DNA, 22 bp, Homo sapiens
ccaaagtgctgagattacaggt

SEQ ID NO: 116143 - DNA, 22 bp, Homo sapiens
aagcagaatagaggcccttccc

SEQ ID NO: 116144 - DNA, 22 bp, Homo sapiens
tcaggggcttgaggtgcatgtc

SEQ ID NO: 116145 - DNA, 22 bp, Homo sapiens
ggacaagcctgtgagtgggttt

SEQ ID NO: 116146 - DNA, 22 bp, Homo sapiens
agtccaaagcagatgagggcca

SEQ ID NO: 116147 - DNA, 22 bp, Homo sapiens
tccctgcaggtgtgcaagctga

SEQ ID NO: 116148 - DNA, 22 bp, Homo sapiens
cttctcttcctttgtcaactga

SEQ ID NO: 116149 - DNA, 22 bp, Homo sapiens
tgtgggagaaggaagcaagctg

SEQ ID NO: 116150 - DNA, 22 bp, Homo sapiens
cagggggctcaaaggagagtgc

SEQ ID NO: 116151 - DNA, 22 bp, Homo sapiens
gatggtgcaggtgaagtgctgg

SEQ ID NO: 116152 - DNA, 22 bp, Homo sapiens
ctactggccatctgatctacaa

SEQ ID NO: 116153 - DNA, 22 bp, Homo sapiens
cactgcactccagcttgggcaa

SEQ ID NO: 116154 - DNA, 22 bp, Homo sapiens
gaaactctcgcatcctgggaac

SEQ ID NO: 116155 - DNA, 22 bp, Homo sapiens
tttaaaaaactagtctgagtct

SEQ ID NO: 116156 - DNA, 22 bp, Homo sapiens
gcccagcccagaaaggttcgga

SEQ ID NO: 116157 - DNA, 22 bp, Homo sapiens
agcagcagtatccttccccggc

SEQ ID NO: 116158 - DNA, 22 bp, Homo sapiens
acccagggctcaagcgtaggca

SEQ ID NO: 116159 - DNA, 22 bp, Homo sapiens
tgatcagcatcttcccagctcg

SEQ ID NO: 116160 - DNA, 21 bp, Homo sapiens
atgtagggtttgccttctcta

SEQ ID NO: 116161 - DNA, 22 bp, Homo sapiens
actgcactcctgcctgggtaac

SEQ ID NO: 116162 - DNA, 22 bp, Homo sapiens
gacaggaggcagagctcaggtg

SEQ ID NO: 116163 - DNA, 22 bp, Homo sapiens
aggactgggtgcagagggcatc

SEQ ID NO: 116164 - DNA, 22 bp, Homo sapiens
aaggagtctgggccattcagag

SEQ ID NO: 116165 - DNA, 22 bp, Homo sapiens
taagggttcagaatgcagtggt

SEQ ID NO: 116166 - DNA, 22 bp, Homo sapiens
aataaaatggtcagttttctca

SEQ ID NO: 116167 - DNA, 15 bp, Homo sapiens
tggcccacccgttga

SEQ ID NO: 116168 - DNA, 22 bp, Homo sapiens
tgggcagggagctggaaccaca

SEQ ID NO: 116169 - DNA, 22 bp, Homo sapiens
cacccaggttggagtgcagtgg

SEQ ID NO: 116170 - DNA, 21 bp, Homo sapiens
ggccccgcagacccagcacgt

SEQ ID NO: 116171 - DNA, 23 bp, Homo sapiens
acagcaagaggaccagatgtgag

SEQ ID NO: 116172 - DNA, 22 bp, Homo sapiens
accatgtcatttattggccaaa

SEQ ID NO: 116173 - DNA, 22 bp, Homo sapiens
ggaggaggggtgactgaatgct

SEQ ID NO: 116174 - DNA, 22 bp, Homo sapiens
ccaaagtgctaggattacaggc

SEQ ID NO: 116175 - DNA, 22 bp, Homo sapiens
ataaaatttgctactgttaaat

SEQ ID NO: 116176 - DNA, 23 bp, Homo sapiens
ggagtgcaatggcgccatctcgg

SEQ ID NO: 116177 - DNA, 22 bp, Homo sapiens
gagggagggactagcattctct

SEQ ID NO: 116178 - DNA, 22 bp, Homo sapiens
gcgagggcacgcggttgaaggc

SEQ ID NO: 116179 - DNA, 22 bp, Homo sapiens
ccagcagagcatggggaggaag

SEQ ID NO: 116180 - DNA, 23 bp, Homo sapiens
aggatgtaggatgtatggcagag

SEQ ID NO: 116181 - DNA, 22 bp, Homo sapiens
gcaggaggttgagccaggactg

SEQ ID NO: 116182 - DNA, 22 bp, Homo sapiens
ggagagggtaggggtcctgccc

SEQ ID NO: 116183 - DNA, 22 bp, Homo sapiens
gttatataagacaaatcagagt

SEQ ID NO: 116184 - DNA, 22 bp, Homo sapiens
gctaggttggggaagttctcct

SEQ ID NO: 116185 - DNA, 22 bp, Homo sapiens
gcctcaaatgtggagcactatt

SEQ ID NO: 116186 - DNA, 22 bp, Homo sapiens
cattggccttttatcctagagg

SEQ ID NO: 116187 - DNA, 22 bp, Homo sapiens
taacaatacccattctaattac

SEQ ID NO: 116188 - DNA, 22 bp, Homo sapiens
ggccctgggccctctagcttgt

SEQ ID NO: 116189 - DNA, 22 bp, Homo sapiens
accctggaggtggaggtgcagt

SEQ ID NO: 116190 - DNA, 22 bp, Homo sapiens
ctctttggatagaattacaaag

SEQ ID NO: 116191 - DNA, 21 bp, Homo sapiens
gggcactgaaagggaatagca

SEQ ID NO: 116192 - DNA, 22 bp, Homo sapiens
ggctccctgcaacctccgcctc

SEQ ID NO: 116193 - DNA, 22 bp, Homo sapiens
tgcaccctcatcagtcaaatgg

SEQ ID NO: 116194 - DNA, 22 bp, Homo sapiens
actgcactccagcctgggtgac

SEQ ID NO: 116195 - DNA, 23 bp, Homo sapiens
tgttccagatacgccttttcctc

SEQ ID NO: 116196 - DNA, 22 bp, Homo sapiens
ctgagatctttatacgaggcac

SEQ ID NO: 116197 - DNA, 22 bp, Homo sapiens
agccagtgcagctggaaattca

SEQ ID NO: 116198 - DNA, 19 bp, Homo sapiens
gccttcccaccacccgtcc

SEQ ID NO: 116199 - DNA, 22 bp, Homo sapiens
ggccactgctctccagcctggg

SEQ ID NO: 116200 - DNA, 22 bp, Homo sapiens
actgcactccagcccgagcaac

SEQ ID NO: 116201 - DNA, 21 bp, Homo sapiens
gctgctcgagatccagtgctt

SEQ ID NO: 116202 - DNA, 22 bp, Homo sapiens
ggcaaggtgctacagacagtga

SEQ ID NO: 116203 - DNA, 22 bp, Homo sapiens
caggagtgtctccacacagcaa

SEQ ID NO: 116204 - DNA, 21 bp, Homo sapiens
ccgccgctgatagctctgggc

SEQ ID NO: 116205 - DNA, 22 bp, Homo sapiens
cccatgcaccctctaagaagga

SEQ ID NO: 116206 - DNA, 19 bp, Homo sapiens
tctgaagaattagagagca

SEQ ID NO: 116207 - DNA, 23 bp, Homo sapiens
cgcccagcctcagtgacctgggc

SEQ ID NO: 116208 - DNA, 22 bp, Homo sapiens
catgttggtgtgctgcacccgt

SEQ ID NO: 116209 - DNA, 22 bp, Homo sapiens
tacaaaaaattgatactgacga

SEQ ID NO: 116210 - DNA, 22 bp, Homo sapiens
acaattctgatggtttcccagt

SEQ ID NO: 116211 - DNA, 22 bp, Homo sapiens
aggtgggcggattcatgaggtc

SEQ ID NO: 116212 - DNA, 22 bp, Homo sapiens
gggcaggaacaaatcaaatgat

SEQ ID NO: 116213 - DNA, 22 bp, Homo sapiens
cactgcactccagcctggcgac

SEQ ID NO: 116214 - DNA, 22 bp, Homo sapiens
tagctttgtttatcaaggggca

SEQ ID NO: 116215 - DNA, 22 bp, Homo sapiens
tcagagtctgtgcattctgcta

SEQ ID NO: 116216 - DNA, 22 bp, Homo sapiens
gcatatgatcacgtgtgtcggt

SEQ ID NO: 116217 - DNA, 21 bp, Homo sapiens
gctcctggtgctgcgtggcgc

SEQ ID NO: 116218 - DNA, 22 bp, Homo sapiens
cactgcactccagcctgggtca

SEQ ID NO: 116219 - DNA, 22 bp, Homo sapiens
attataggcttgagccaccgtg

SEQ ID NO: 116220 - DNA, 22 bp, Homo sapiens
agcgccactgcactccagcctg

SEQ ID NO: 116221 - DNA, 21 bp, Homo sapiens
cactccacttagaacagggtt

SEQ ID NO: 116222 - DNA, 18 bp, Homo sapiens
cccggctaatttttggta

SEQ ID NO: 116223 - DNA, 22 bp, Homo sapiens
atgccactgcactccagcctag

SEQ ID NO: 116224 - DNA, 22 bp, Homo sapiens
tactaggaagcagctgcattgg

SEQ ID NO: 116225 - DNA, 22 bp, Homo sapiens
ttattagagtgctttgagaaag

SEQ ID NO: 116226 - DNA, 22 bp, Homo sapiens
gtggccaaatcatgtcaaaggc

SEQ ID NO: 116227 - DNA, 22 bp, Homo sapiens
ctggccaagatggtgaaacccc

SEQ ID NO: 116228 - DNA, 22 bp, Homo sapiens
gaccctgtttctacaaataatt

SEQ ID NO: 116229 - DNA, 22 bp, Homo sapiens
atgccactgcgctccagcctgg

SEQ ID NO: 116230 - DNA, 22 bp, Homo sapiens
agctcctgaaaatccagactgg

SEQ ID NO: 116231 - DNA, 22 bp, Homo sapiens
tcactgcaacctccacctcccg

SEQ ID NO: 116232 - DNA, 22 bp, Homo sapiens
acgcctgtaatcccagcacttt

SEQ ID NO: 116233 - DNA, 22 bp, Homo sapiens
gctggccacagatccccaggga

SEQ ID NO: 116234 - DNA, 22 bp, Homo sapiens
cactgcactccagcccgggcaa

SEQ ID NO: 116235 - DNA, 22 bp, Homo sapiens
ttgtggttaaccgcacattttt

SEQ ID NO: 116236 - DNA, 22 bp, Homo sapiens
aggtttctttatgctgctagaa

SEQ ID NO: 116237 - DNA, 18 bp, Homo sapiens
actctttctgcccacagg

SEQ ID NO: 116238 - DNA, 21 bp, Homo sapiens
ccaccaggtcttctgctcggg

SEQ ID NO: 116239 - DNA, 22 bp, Homo sapiens
ggtcagccttggatttggtagc

SEQ ID NO: 116240 - DNA, 22 bp, Homo sapiens
ttgtgagtagtgccgcaataaa

SEQ ID NO: 116241 - DNA, 22 bp, Homo sapiens
agcataagttggtacagccact

SEQ ID NO: 116242 - DNA, 22 bp, Homo sapiens
tatcacatttggagatttatga

SEQ ID NO: 116243 - DNA, 19 bp, Homo sapiens
aggaatggaattaattctg

SEQ ID NO: 116244 - DNA, 22 bp, Homo sapiens
cggggttcatccatgctgtggc

SEQ ID NO: 116245 - DNA, 22 bp, Homo sapiens
atcactgtgtatgtatatgcag

SEQ ID NO: 116246 - DNA, 22 bp, Homo sapiens
aaggagaaatggtagatgtgca

SEQ ID NO: 116247 - DNA, 22 bp, Homo sapiens
gctcactgcaacctctgcctcc

SEQ ID NO: 116248 - DNA, 22 bp, Homo sapiens
ttcaccttgaatatgtcttaaa

SEQ ID NO: 116249 - DNA, 22 bp, Homo sapiens
catagagtgatgtaaggtatgt

SEQ ID NO: 116250 - DNA, 22 bp, Homo sapiens
tttatgtagttacggactatca

SEQ ID NO: 116251 - DNA, 22 bp, Homo sapiens
caccttgtgatcctcttgcctt

SEQ ID NO: 116252 - DNA, 21 bp, Homo sapiens
cgcagagcgaacttgcggcgc

SEQ ID NO: 116253 - DNA, 22 bp, Homo sapiens
cactgctacctctgcctcccgg

SEQ ID NO: 116254 - DNA, 22 bp, Homo sapiens
ggtggctgcaatggctaacttc

SEQ ID NO: 116255 - DNA, 22 bp, Homo sapiens
cttctcggggttcccgcgccct

SEQ ID NO: 116256 - DNA, 22 bp, Homo sapiens
ggcgtttcaccatgttgaccag

SEQ ID NO: 116257 - DNA, 22 bp, Homo sapiens
atgccactgcactccagcctgg

SEQ ID NO: 116258 - DNA, 22 bp, Homo sapiens
tctcctggtacccttcctagca

SEQ ID NO: 116259 - DNA, 22 bp, Homo sapiens
actggccagccaacaacaatag

SEQ ID NO: 116260 - DNA, 18 bp, Homo sapiens
tgtccctgcaaataacat

SEQ ID NO: 116261 - DNA, 22 bp, Homo sapiens
tctcctggagcccagatgctgg

SEQ ID NO: 116262 - DNA, 22 bp, Homo sapiens
tctctcaggctggagtgcagtg

SEQ ID NO: 116263 - DNA, 22 bp, Homo sapiens
gttaggatatggtgaaatggag

SEQ ID NO: 116264 - DNA, 22 bp, Homo sapiens
ttcaatatgatattagctgtgg

SEQ ID NO: 116265 - DNA, 22 bp, Homo sapiens
ttttaatactgctattgtagga

SEQ ID NO: 116266 - DNA, 22 bp, Homo sapiens
gtagaccatttatctggggagt

SEQ ID NO: 116267 - DNA, 22 bp, Homo sapiens
tacgcctgtaatcccagcactt

SEQ ID NO: 116268 - DNA, 22 bp, Homo sapiens
aagaggtagcagtcacaaaaga

SEQ ID NO: 116269 - DNA, 22 bp, Homo sapiens
cagtcacaagcgtacctaattt

SEQ ID NO: 116270 - DNA, 22 bp, Homo sapiens
cttgatctacatagtgaaaccc

SEQ ID NO: 116271 - DNA, 22 bp, Homo sapiens
gctgtctcatacaaggccctgc

SEQ ID NO: 116272 - DNA, 22 bp, Homo sapiens
gagagtctagtgcacctagttt

SEQ ID NO: 116273 - DNA, 22 bp, Homo sapiens
tttctggcagcgggacaggggt

SEQ ID NO: 116274 - DNA, 18 bp, Homo sapiens
gaggtagataagattttc

SEQ ID NO: 116275 - DNA, 22 bp, Homo sapiens
ctctgcctgtctcatcctgcaa

SEQ ID NO: 116276 - DNA, 22 bp, Homo sapiens
catgtctgtgtacacatgcaca

SEQ ID NO: 116277 - DNA, 22 bp, Homo sapiens
gatataggttcatagtgttaca

SEQ ID NO: 116278 - DNA, 22 bp, Homo sapiens
agcatgcgcttgatcagctcca

SEQ ID NO: 116279 - DNA, 23 bp, Homo sapiens
ggagtgcaatggcgccatctcgg

SEQ ID NO: 116280 - DNA, 22 bp, Homo sapiens
ctcattgcaacctccgcctccc

SEQ ID NO: 116281 - DNA, 22 bp, Homo sapiens
aggggaatgggtagactgttga

SEQ ID NO: 116282 - DNA, 22 bp, Homo sapiens
tatgtgtttgacaccctgcaag

SEQ ID NO: 116283 - DNA, 22 bp, Homo sapiens
agcccggcttccccggttgcta

SEQ ID NO: 116284 - DNA, 22 bp, Homo sapiens
ccctcccaggagtggccagaga

SEQ ID NO: 116285 - DNA, 22 bp, Homo sapiens
tctcgctctgtcgcccaggctg

SEQ ID NO: 116286 - DNA, 21 bp, Homo sapiens
atgtagggtttgccttctcta

SEQ ID NO: 116287 - DNA, 22 bp, Homo sapiens
atgttggccaggctggtcttga

SEQ ID NO: 116288 - DNA, 22 bp, Homo sapiens
ttatcacttatgagctttttgc

SEQ ID NO: 116289 - DNA, 22 bp, Homo sapiens
ggtttgttggggtccaggccca

SEQ ID NO: 116290 - DNA, 20 bp, Homo sapiens
aactcctagcctcaagtgat

SEQ ID NO: 116291 - DNA, 22 bp, Homo sapiens
gtgttgatgacattttagaaac

SEQ ID NO: 116292 - DNA, 22 bp, Homo sapiens
gtggctgcagcggctgtggaga

SEQ ID NO: 116293 - DNA, 22 bp, Homo sapiens
ctgagggtcaacttgattgtat

SEQ ID NO: 116294 - DNA, 22 bp, Homo sapiens
actctggccatcttggaccttg

SEQ ID NO: 116295 - DNA, 22 bp, Homo sapiens
cagtctctaaatcaatctgaat

SEQ ID NO: 116296 - DNA, 22 bp, Homo sapiens
ttttatctgtgacatctggcag

SEQ ID NO: 116297 - DNA, 22 bp, Homo sapiens
gttcaagaccagcctggccaac

SEQ ID NO: 116298 - DNA, 22 bp, Homo sapiens
aggaaataggaccagacaaagc

SEQ ID NO: 116299 - DNA, 22 bp, Homo sapiens
gagcactgatttatttttgtct

SEQ ID NO: 116300 - DNA, 22 bp, Homo sapiens
ttaaatattatgttgtctgcaa

SEQ ID NO: 116301 - DNA, 22 bp, Homo sapiens
aggtcacccgtttgactatcca

SEQ ID NO: 116302 - DNA, 22 bp, Homo sapiens
tgagacgaagtcttgctctgtt

SEQ ID NO: 116303 - DNA, 22 bp, Homo sapiens
actgcaacctccacctcctggg

SEQ ID NO: 116304 - DNA, 22 bp, Homo sapiens
ccctctacagggaagcgctttc

SEQ ID NO: 116305 - DNA, 22 bp, Homo sapiens
aatgccttggagagcctagagg

SEQ ID NO: 116306 - DNA, 22 bp, Homo sapiens
gctcactgcaagctctgcctcc

SEQ ID NO: 116307 - DNA, 23 bp, Homo sapiens
atgacactcctgtgcgcaccctg

SEQ ID NO: 116308 - DNA, 22 bp, Homo sapiens
accatgttggccaagctggtct

SEQ ID NO: 116309 - DNA, 22 bp, Homo sapiens
tccttgactgtgaggaactagc

SEQ ID NO: 116310 - DNA, 19 bp, Homo sapiens
gcctatgtcttcaaatcat

SEQ ID NO: 116311 - DNA, 22 bp, Homo sapiens
cttctcttcctttgtcaactga

SEQ ID NO: 116312 - DNA, 22 bp, Homo sapiens
cactgcacttcagcctgggtga

SEQ ID NO: 116313 - DNA, 22 bp, Homo sapiens
acaactccttcttgggtcctgg

SEQ ID NO: 116314 - DNA, 22 bp, Homo sapiens
tggagccagagcgcagcctggg

SEQ ID NO: 116315 - DNA, 22 bp, Homo sapiens
cccacgtcgaacttgctccaga

SEQ ID NO: 116316 - DNA, 19 bp, Homo sapiens
atcccaaggagctgggact

SEQ ID NO: 116317 - DNA, 22 bp, Homo sapiens
tttttgggtccaggctgtatct

SEQ ID NO: 116318 - DNA, 22 bp, Homo sapiens
cttcttatcaagtggcaaatct

SEQ ID NO: 116319 - DNA, 22 bp, Homo sapiens
ttgtgaatagtgccgctataaa

SEQ ID NO: 116320 - DNA, 22 bp, Homo sapiens
tgcctccctggcaagtctctcc

SEQ ID NO: 116321 - DNA, 22 bp, Homo sapiens
gaccttcttgctgtgtcctaac

SEQ ID NO: 116322 - DNA, 22 bp, Homo sapiens
ctcctggaggatagtgactggg

SEQ ID NO: 116323 - DNA, 22 bp, Homo sapiens
tcaccgccttgcccggccgggc

SEQ ID NO: 116324 - DNA, 22 bp, Homo sapiens
cactgcaacctccacctcctgg

SEQ ID NO: 116325 - DNA, 22 bp, Homo sapiens
gggtacttaatatttacggggt

SEQ ID NO: 116326 - DNA, 22 bp, Homo sapiens
ggcatagatttctttaggttta

SEQ ID NO: 116327 - DNA, 22 bp, Homo sapiens
ataaaatttgctactgttaaat

SEQ ID NO: 116328 - DNA, 22 bp, Homo sapiens
cggccaagccggggccccgaag

SEQ ID NO: 116329 - DNA, 22 bp, Homo sapiens
ggtcacgtgaccgcacctgcct

SEQ ID NO: 116330 - DNA, 18 bp, Homo sapiens
atggtctcatactgggag

SEQ ID NO: 116331 - DNA, 22 bp, Homo sapiens
gctgggttttcttccgggccta

SEQ ID NO: 116332 - DNA, 23 bp, Homo sapiens
ggaagctcacgtagtcctgcact

SEQ ID NO: 116333 - DNA, 22 bp, Homo sapiens
cgggttcacgccattctcctgc

SEQ ID NO: 116334 - DNA, 22 bp, Homo sapiens
atagaatatgacttttagatcc

SEQ ID NO: 116335 - DNA, 22 bp, Homo sapiens
ctccagttggccccagttggtt

SEQ ID NO: 116336 - DNA, 22 bp, Homo sapiens
cagaggtagcatgctgtggctt

SEQ ID NO: 116337 - DNA, 22 bp, Homo sapiens
ggagctgttcaggactgcttca

SEQ ID NO: 116338 - DNA, 22 bp, Homo sapiens
cactgcactccagcctgggtga

SEQ ID NO: 116339 - DNA, 22 bp, Homo sapiens
ttattaggaactcaggattttt

SEQ ID NO: 116340 - DNA, 22 bp, Homo sapiens
gaccagtcattactcatgccct

SEQ ID NO: 116341 - DNA, 22 bp, Homo sapiens
cggctcactgcagctccgcctc

SEQ ID NO: 116342 - DNA, 22 bp, Homo sapiens
gtgctccctccttcctcaagga

SEQ ID NO: 116343 - DNA, 22 bp, Homo sapiens
cagcctttgggtcagaagattc

SEQ ID NO: 116344 - DNA, 17 bp, Homo sapiens
acttcccacccctccag

SEQ ID NO: 116345 - DNA, 22 bp, Homo sapiens
actgcaacacctcctgggttca

SEQ ID NO: 116346 - DNA, 22 bp, Homo sapiens
tcttagaaattccccagtggct

SEQ ID NO: 116347 - DNA, 22 bp, Homo sapiens
gctcaagccttctgcccacctc

SEQ ID NO: 116348 - DNA, 22 bp, Homo sapiens
gaaaattattgaaaatggctct

SEQ ID NO: 116349 - DNA, 22 bp, Homo sapiens
ttcatatgtgaactcagtgatg

SEQ ID NO: 116350 - DNA, 22 bp, Homo sapiens
gcaccgccttggaccgcccgct

SEQ ID NO: 116351 - DNA, 22 bp, Homo sapiens
tgctgtgaggttgagaaggaag

SEQ ID NO: 116352 - DNA, 22 bp, Homo sapiens
acaaagtgctgacattacaggc

SEQ ID NO: 116353 - DNA, 22 bp, Homo sapiens
tttttagtagaggtgggtttca

SEQ ID NO: 116354 - DNA, 22 bp, Homo sapiens
cattaggacgccccgcccatac

SEQ ID NO: 116355 - DNA, 22 bp, Homo sapiens
gtcactgtatccaggttccagc

SEQ ID NO: 116356 - DNA, 22 bp, Homo sapiens
gagagtctaggaacctcatata

SEQ ID NO: 116357 - DNA, 22 bp, Homo sapiens
agtggactcttcccagtgcttg

SEQ ID NO: 116358 - DNA, 23 bp, Homo sapiens
aaaacagcttcctccagtggctc

SEQ ID NO: 116359 - DNA, 22 bp, Homo sapiens
cgcatgagacctgccggccatc

SEQ ID NO: 116360 - DNA, 22 bp, Homo sapiens
ttgtgctgtgagaatgctcatt

SEQ ID NO: 116361 - DNA, 19 bp, Homo sapiens
cattaggattagagacaag

SEQ ID NO: 116362 - DNA, 22 bp, Homo sapiens
ggagacagggttgaaccacgca

SEQ ID NO: 116363 - DNA, 22 bp, Homo sapiens
aacagctttgtatacagtaact

SEQ ID NO: 116364 - DNA, 22 bp, Homo sapiens
gaagccttgaactgcaaacccc

SEQ ID NO: 116365 - DNA, 22 bp, Homo sapiens
cgagcatgatgacggctgtggc

SEQ ID NO: 116366 - DNA, 22 bp, Homo sapiens
aactcactttgtggcttctgaa

SEQ ID NO: 116367 - DNA, 17 bp, Homo sapiens
aatctgtttacagtcag

SEQ ID NO: 116368 - DNA, 22 bp, Homo sapiens
aggtcaccatggcatgctccac

SEQ ID NO: 116369 - DNA, 22 bp, Homo sapiens
gcacggctaatttttgtatttt

SEQ ID NO: 116370 - DNA, 22 bp, Homo sapiens
ttggcgcccaggacgccgccgc

SEQ ID NO: 116371 - DNA, 22 bp, Homo sapiens
ccacccttgggttcggaggccg

SEQ ID NO: 116372 - DNA, 22 bp, Homo sapiens
tcccagagctctggaggttgga

SEQ ID NO: 116373 - DNA, 22 bp, Homo sapiens
ttactggctgggcctgagggct

SEQ ID NO: 116374 - DNA, 22 bp, Homo sapiens
atgccacttcattccagcctcg

SEQ ID NO: 116375 - DNA, 22 bp, Homo sapiens
acatttatataactcactagga

SEQ ID NO: 116376 - DNA, 22 bp, Homo sapiens
tcactgcaacctccacctcctg

SEQ ID NO: 116377 - DNA, 21 bp, Homo sapiens
tcactagtgccttctgtcatt

SEQ ID NO: 116378 - DNA, 22 bp, Homo sapiens
aacagcttgctgcaccttaata

SEQ ID NO: 116379 - DNA, 22 bp, Homo sapiens
atattagtttggagactacaat

SEQ ID NO: 116380 - DNA, 22 bp, Homo sapiens
gtaatctcagctacttgggagg

SEQ ID NO: 116381 - DNA, 22 bp, Homo sapiens
gccatgcttggtatgctgtgag

SEQ ID NO: 116382 - DNA, 22 bp, Homo sapiens
ttgagggtctggatctgctgct

SEQ ID NO: 116383 - DNA, 22 bp, Homo sapiens
cggtcaggtgcagcgttggcac

SEQ ID NO: 116384 - DNA, 19 bp, Homo sapiens
atctgccttagtgctgctg

SEQ ID NO: 116385 - DNA, 22 bp, Homo sapiens
cccattcatcctcgcttccttc

SEQ ID NO: 116386 - DNA, 22 bp, Homo sapiens
ttgggctcaggagtttgagacc

SEQ ID NO: 116387 - DNA, 22 bp, Homo sapiens
ttgacacagtcaacttgatttt

SEQ ID NO: 116388 - DNA, 18 bp, Homo sapiens
ttcacaagggcttggttt

SEQ ID NO: 116389 - DNA, 22 bp, Homo sapiens
tctgagccagggtctcctccct

SEQ ID NO: 116390 - DNA, 22 bp, Homo sapiens
gtatcacttttgagagtgagaa

SEQ ID NO: 116391 - DNA, 22 bp, Homo sapiens
ttaataaagtatgaattggaaa

SEQ ID NO: 116392 - DNA, 22 bp, Homo sapiens
aagaggtaaccatagcaaccac

SEQ ID NO: 116393 - DNA, 22 bp, Homo sapiens
gtggccaacctggccctgaact

SEQ ID NO: 116394 - DNA, 22 bp, Homo sapiens
actttatttcctattgcatcca

SEQ ID NO: 116395 - DNA, 22 bp, Homo sapiens
cactgcactccagcttgggtga

SEQ ID NO: 116396 - DNA, 22 bp, Homo sapiens
agaacctctggatacagtttaa

SEQ ID NO: 116397 - DNA, 22 bp, Homo sapiens
tagggtacatgtgcacaacatg

SEQ ID NO: 116398 - DNA, 22 bp, Homo sapiens
caggctggagtgcagtggggcg

SEQ ID NO: 116399 - DNA, 22 bp, Homo sapiens
atatacacatctttttaaatat

SEQ ID NO: 116400 - DNA, 22 bp, Homo sapiens
tgggccgtggagcactctgaga

SEQ ID NO: 116401 - DNA, 22 bp, Homo sapiens
gagctgggcctgcgagtgctgc

SEQ ID NO: 116402 - DNA, 22 bp, Homo sapiens
acatggcgggagtttcagatac

SEQ ID NO: 116403 - DNA, 22 bp, Homo sapiens
tcactgcaacctctgcctcccg

SEQ ID NO: 116404 - DNA, 22 bp, Homo sapiens
gtagatgagctcacatgacctt

SEQ ID NO: 116405 - DNA, 22 bp, Homo sapiens
gggagctgagctggaagagaat

SEQ ID NO: 116406 - DNA, 22 bp, Homo sapiens
tcactgcaagctcctcctcctg

SEQ ID NO: 116407 - DNA, 23 bp, Homo sapiens
aggatgtaggatgtatggcagag

SEQ ID NO: 116408 - DNA, 19 bp, Homo sapiens
gcctcatttccacctcccc

SEQ ID NO: 116409 - DNA, 18 bp, Homo sapiens
actctttctgcccacagg

SEQ ID NO: 116410 - DNA, 22 bp, Homo sapiens
ggctagggatctagaccaggac

SEQ ID NO: 116411 - DNA, 22 bp, Homo sapiens
cattacagaatatgtaatgatc

SEQ ID NO: 116412 - DNA, 22 bp, Homo sapiens
tgagcctgagttcaaggctgca

SEQ ID NO: 116413 - DNA, 22 bp, Homo sapiens
agttgcagacgcagagatgttg

SEQ ID NO: 116414 - DNA, 22 bp, Homo sapiens
catcagaacgtgagctccttgt

SEQ ID NO: 116415 - DNA, 22 bp, Homo sapiens
gggctaaatgcagaaatgcaga

SEQ ID NO: 116416 - DNA, 22 bp, Homo sapiens
gcctgttctccagcatccaggt

SEQ ID NO: 116417 - DNA, 22 bp, Homo sapiens
tgttacagcagaattgaaagag

SEQ ID NO: 116418 - DNA, 22 bp, Homo sapiens
agcgggtctgcaagccttccct

SEQ ID NO: 116419 - DNA, 22 bp, Homo sapiens
catccgcatgcaagtgctgtcc

SEQ ID NO: 116420 - DNA, 19 bp, Homo sapiens
gactccaactttaagcatg

SEQ ID NO: 116421 - DNA, 22 bp, Homo sapiens
tctgcaggtaagcgttcttgga

SEQ ID NO: 116422 - DNA, 22 bp, Homo sapiens
atgtttaaagggttgagaaata

SEQ ID NO: 116423 - DNA, 22 bp, Homo sapiens
agcgggctcacccggttgttgt

SEQ ID NO: 116424 - DNA, 22 bp, Homo sapiens
gcagcctcaaactccccagctc

SEQ ID NO: 116425 - DNA, 20 bp, Homo sapiens
ggcagagggcctgggagaag

SEQ ID NO: 116426 - DNA, 22 bp, Homo sapiens
tatgccactgctctccatccta

SEQ ID NO: 116427 - DNA, 22 bp, Homo sapiens
aggctagaggcttctggcttca

SEQ ID NO: 116428 - DNA, 22 bp, Homo sapiens
aatggtttctgaagttaggcag

SEQ ID NO: 116429 - DNA, 22 bp, Homo sapiens
cagggtttcaccatgttagcag

SEQ ID NO: 116430 - DNA, 22 bp, Homo sapiens
acttgccccagaattgctgctg

SEQ ID NO: 116431 - DNA, 22 bp, Homo sapiens
tgtccttcttgtcttgcccaaa

SEQ ID NO: 116432 - DNA, 22 bp, Homo sapiens
gatagtcacctcccttaacttt

SEQ ID NO: 116433 - DNA, 22 bp, Homo sapiens
ttaataaagtatgaattggaaa

SEQ ID NO: 116434 - DNA, 22 bp, Homo sapiens
cactgcactccagcctgggtca

SEQ ID NO: 116435 - DNA, 22 bp, Homo sapiens
ttaggatttgaaaaggggcaga

SEQ ID NO: 116436 - DNA, 22 bp, Homo sapiens
ccccacaactcatgttgaaact

SEQ ID NO: 116437 - DNA, 22 bp, Homo sapiens
acgcctgtaatcccagcacttt

SEQ ID NO: 116438 - DNA, 22 bp, Homo sapiens
tggcacttttcccagttttggt

SEQ ID NO: 116439 - DNA, 22 bp, Homo sapiens
gacgagagactccatccaccac

SEQ ID NO: 116440 - DNA, 18 bp, Homo sapiens
gatcgggggcgccccaag

SEQ ID NO: 116441 - DNA, 20 bp, Homo sapiens
tgtggtttttgccagttgaa

SEQ ID NO: 116442 - DNA, 22 bp, Homo sapiens
aagggggcggcagccagtggaa

SEQ ID NO: 116443 - DNA, 22 bp, Homo sapiens
cctcctgcacctccaggaactc

SEQ ID NO: 116444 - DNA, 22 bp, Homo sapiens
tgtggaaggggccccatgacca

SEQ ID NO: 116445 - DNA, 22 bp, Homo sapiens
gggaggttgaggctgcagtgag

SEQ ID NO: 116446 - DNA, 22 bp, Homo sapiens
aggattgtgcctccagtcagaa

SEQ ID NO: 116447 - DNA, 22 bp, Homo sapiens
tctttggtttctgtctctgtaa

SEQ ID NO: 116448 - DNA, 22 bp, Homo sapiens
tcaccaggctggagtgcagtgg

SEQ ID NO: 116449 - DNA, 22 bp, Homo sapiens
cttatcagattatctgggctgt

SEQ ID NO: 116450 - DNA, 22 bp, Homo sapiens
atgaaaacggaccagagctatt

SEQ ID NO: 116451 - DNA, 22 bp, Homo sapiens
aagacacaatgtagcccagcac

SEQ ID NO: 116452 - DNA, 22 bp, Homo sapiens
agacgctattttgaggggtcta

SEQ ID NO: 116453 - DNA, 22 bp, Homo sapiens
tctgctttcttactaaaaatga

SEQ ID NO: 116454 - DNA, 22 bp, Homo sapiens
gtgctccctccttcctcaagga

SEQ ID NO: 116455 - DNA, 22 bp, Homo sapiens
tgctgagcgcatccggcggccg

SEQ ID NO: 116456 - DNA, 22 bp, Homo sapiens
caaagtgctggaattacaggtg

SEQ ID NO: 116457 - DNA, 22 bp, Homo sapiens
gcttcggggtccaagcgcgtgt

SEQ ID NO: 116458 - DNA, 22 bp, Homo sapiens
ggggtgggcgtgcagggacacc

SEQ ID NO: 116459 - DNA, 22 bp, Homo sapiens
caacaacatgggattcatttct

SEQ ID NO: 116460 - DNA, 22 bp, Homo sapiens
attctcaaaacataacttcact

SEQ ID NO: 116461 - DNA, 22 bp, Homo sapiens
aggcactgtgcagtcccaagca

SEQ ID NO: 116462 - DNA, 22 bp, Homo sapiens
ggaggtggaggttgcagtgagc

SEQ ID NO: 116463 - DNA, 22 bp, Homo sapiens
gcactggccgcacgcgtagggc

SEQ ID NO: 116464 - DNA, 22 bp, Homo sapiens
tcactgcactccagcactcagg

SEQ ID NO: 116465 - DNA, 22 bp, Homo sapiens
ctgggaggcggaggttgtagtg

SEQ ID NO: 116466 - DNA, 22 bp, Homo sapiens
tgtgaaagatactaggcagagg

SEQ ID NO: 116467 - DNA, 22 bp, Homo sapiens
gccagggttcgaatccgtatgg

SEQ ID NO: 116468 - DNA, 22 bp, Homo sapiens
cagagatgtgatccagctgtct

SEQ ID NO: 116469 - DNA, 22 bp, Homo sapiens
aaaatcctgctgactcgagatg

SEQ ID NO: 116470 - DNA, 22 bp, Homo sapiens
aggggatggagctggaaggcag

SEQ ID NO: 116471 - DNA, 22 bp, Homo sapiens
agagtgtaccaaatatcctaca

SEQ ID NO: 116472 - DNA, 22 bp, Homo sapiens
cacagagatggtctggcaggtg

SEQ ID NO: 116473 - DNA, 22 bp, Homo sapiens
gggccatgagaggttcatcaac

SEQ ID NO: 116474 - DNA, 22 bp, Homo sapiens
acggtgctgggtattggggttc

SEQ ID NO: 116475 - DNA, 22 bp, Homo sapiens
tcttttgtgattctttagttac

SEQ ID NO: 116476 - DNA, 22 bp, Homo sapiens
tagattcagatatttaggacaa

SEQ ID NO: 116477 - DNA, 22 bp, Homo sapiens
caggctggagtgcagtggtgcc

SEQ ID NO: 116478 - DNA, 22 bp, Homo sapiens
tcagacaactctggaggctggc

SEQ ID NO: 116479 - DNA, 22 bp, Homo sapiens
gctgtgtatcagatgccacggg

SEQ ID NO: 116480 - DNA, 22 bp, Homo sapiens
ttggcgcccaggacgccgccgc

SEQ ID NO: 116481 - DNA, 22 bp, Homo sapiens
ccaggctggagtgcagtggcac

SEQ ID NO: 116482 - DNA, 22 bp, Homo sapiens
tgctccatgcgctcggccggcg

SEQ ID NO: 116483 - DNA, 22 bp, Homo sapiens
ggcctcgcggcttctggtggct

SEQ ID NO: 116484 - DNA, 22 bp, Homo sapiens
tgggtggcagcttcagcatgtt

SEQ ID NO: 116485 - DNA, 22 bp, Homo sapiens
catttacatttaaggttaatat

SEQ ID NO: 116486 - DNA, 22 bp, Homo sapiens
atccccctgtatctggaagaat

SEQ ID NO: 116487 - DNA, 22 bp, Homo sapiens
gttcaagaccagcctggccaac

SEQ ID NO: 116488 - DNA, 22 bp, Homo sapiens
agagggcattaactctgtcttg

SEQ ID NO: 116489 - DNA, 22 bp, Homo sapiens
ctggtgtggactccgcgcggag

SEQ ID NO: 116490 - DNA, 22 bp, Homo sapiens
gaaaattattgaaaatggctct

SEQ ID NO: 116491 - DNA, 22 bp, Homo sapiens
caggagtgttgattgctcagga

SEQ ID NO: 116492 - DNA, 22 bp, Homo sapiens
tgtaggagtccaatcaggagac

SEQ ID NO: 116493 - DNA, 22 bp, Homo sapiens
cagagctgtccaaaccctgaca

SEQ ID NO: 116494 - DNA, 22 bp, Homo sapiens
gcccagagttcaaggctgcagt

SEQ ID NO: 116495 - DNA, 22 bp, Homo sapiens
tgtgacctcatcttaactggaa

SEQ ID NO: 116496 - DNA, 22 bp, Homo sapiens
tcactcaggctggagtgcagtg

SEQ ID NO: 116497 - DNA, 22 bp, Homo sapiens
tgggaagggtcaacagctggaa

SEQ ID NO: 116498 - DNA, 22 bp, Homo sapiens
ataaaatttgctactgttaaat

SEQ ID NO: 116499 - DNA, 22 bp, Homo sapiens
ccacagtctatgcaacaaggtc

SEQ ID NO: 116500 - DNA, 22 bp, Homo sapiens
ttactcgtgacaatgtccttga

SEQ ID NO: 116501 - DNA, 22 bp, Homo sapiens
tttggcatgggctatttgcttt

SEQ ID NO: 116502 - DNA, 22 bp, Homo sapiens
tttcttcctgctttgtcccatg

SEQ ID NO: 116503 - DNA, 22 bp, Homo sapiens
aggaggggttctcgggtgctga

SEQ ID NO: 116504 - DNA, 22 bp, Homo sapiens
tggagacacaggaccagactgc

SEQ ID NO: 116505 - DNA, 21 bp, Homo sapiens
tccttcagtctagatgattgt

SEQ ID NO: 116506 - DNA, 22 bp, Homo sapiens
ggtgtccgcgctgtagaaggtc

SEQ ID NO: 116507 - DNA, 22 bp, Homo sapiens
tagcataacaggtaagagtgag

SEQ ID NO: 116508 - DNA, 22 bp, Homo sapiens
gaaaggagagggttaaggagct

SEQ ID NO: 116509 - DNA, 22 bp, Homo sapiens
agtgctgggctatctactgcta

SEQ ID NO: 116510 - DNA, 22 bp, Homo sapiens
tcagccccacggggtcagccaa

SEQ ID NO: 116511 - DNA, 22 bp, Homo sapiens
gagaacagaagcattcctaatt

SEQ ID NO: 116512 - DNA, 23 bp, Homo sapiens
cagagctggctcagagctgcctg

SEQ ID NO: 116513 - DNA, 22 bp, Homo sapiens
gggccggagctgggtcccgcgc

SEQ ID NO: 116514 - DNA, 21 bp, Homo sapiens
ccaccaggtcttctgctcggg

SEQ ID NO: 116515 - DNA, 22 bp, Homo sapiens
agcagagcaaagctcagaaatg

SEQ ID NO: 116516 - DNA, 18 bp, Homo sapiens
cttgttcttctcttggcg

SEQ ID NO: 116517 - DNA, 22 bp, Homo sapiens
gccttgccgctcagcagtgggg

SEQ ID NO: 116518 - DNA, 22 bp, Homo sapiens
cagggggctcaaaggagagtgc

SEQ ID NO: 116519 - DNA, 16 bp, Homo sapiens
atgctgctattagagg

SEQ ID NO: 116520 - DNA, 22 bp, Homo sapiens
gcctccggagttgcagtgtctt

SEQ ID NO: 116521 - DNA, 22 bp, Homo sapiens
acctggacacctgctgtcatct

SEQ ID NO: 116522 - DNA, 22 bp, Homo sapiens
gcctcctgagtagctgggattg

SEQ ID NO: 116523 - DNA, 22 bp, Homo sapiens
cacagtcctgccagagggcctt

SEQ ID NO: 116524 - DNA, 22 bp, Homo sapiens
aagtccaggtcctcattccatc

SEQ ID NO: 116525 - DNA, 22 bp, Homo sapiens
ggcgtgggcgaggtgctctatc

SEQ ID NO: 116526 - DNA, 22 bp, Homo sapiens
gactgtggggaagcagatgcca

SEQ ID NO: 116527 - DNA, 22 bp, Homo sapiens
tccaactttctcctccggcttg

SEQ ID NO: 116528 - DNA, 22 bp, Homo sapiens
agtcccaacagcttacaaggaa

SEQ ID NO: 116529 - DNA, 22 bp, Homo sapiens
aaagcctcccaggttatgagta

SEQ ID NO: 116530 - DNA, 22 bp, Homo sapiens
agccaggatggtctcgatcggc

SEQ ID NO: 116531 - DNA, 22 bp, Homo sapiens
ccagggtggcgtagatgctggg

SEQ ID NO: 116532 - DNA, 21 bp, Homo sapiens
taggtgggagccccagtatgc

SEQ ID NO: 116533 - DNA, 22 bp, Homo sapiens
tcgcgggttgcacatggccatc

SEQ ID NO: 116534 - DNA, 22 bp, Homo sapiens
caggccagggttgagaagagaa

SEQ ID NO: 116535 - DNA, 22 bp, Homo sapiens
tgagatcattgacttgttcctg

SEQ ID NO: 116536 - DNA, 22 bp, Homo sapiens
attcttcctcatcaatctgtag

SEQ ID NO: 116537 - DNA, 22 bp, Homo sapiens
cctcgcggcactcgggccggat

SEQ ID NO: 116538 - DNA, 22 bp, Homo sapiens
gagccaggaggcagagactgca

SEQ ID NO: 116539 - DNA, 23 bp, Homo sapiens
gggggccgtcctggggattatag

SEQ ID NO: 116540 - DNA, 22 bp, Homo sapiens
gagagcaggaggcagcgggacg

SEQ ID NO: 116541 - DNA, 22 bp, Homo sapiens
ttctgattgctgatgaggccca

SEQ ID NO: 116542 - DNA, 22 bp, Homo sapiens
cccagcagtagagctcatatgg

SEQ ID NO: 116543 - DNA, 22 bp, Homo sapiens
atgcacacgtaccctacaaggc

SEQ ID NO: 116544 - DNA, 22 bp, Homo sapiens
ttgtgtgtactggttatgggca

SEQ ID NO: 116545 - DNA, 22 bp, Homo sapiens
agtccaaagcagatgagggcca

SEQ ID NO: 116546 - DNA, 22 bp, Homo sapiens
tccagggagagccgctgctcca

SEQ ID NO: 116547 - DNA, 22 bp, Homo sapiens
ttgcatcagaattacttggagg

SEQ ID NO: 116548 - DNA, 22 bp, Homo sapiens
cacgttaacagctaacagatga

SEQ ID NO: 116549 - DNA, 22 bp, Homo sapiens
aggaaagcttggcaaactaaat

SEQ ID NO: 116550 - DNA, 22 bp, Homo sapiens
gtggggtagatctttctcagga

SEQ ID NO: 116551 - DNA, 22 bp, Homo sapiens
ggtcgctgtgtaggttcagcta

SEQ ID NO: 116552 - DNA, 22 bp, Homo sapiens
ccagcatccatgctccctcggg

SEQ ID NO: 116553 - DNA, 22 bp, Homo sapiens
cactccagcctcagtgacagag

SEQ ID NO: 116554 - DNA, 23 bp, Homo sapiens
cagagctggcttcatgggtgtgc

SEQ ID NO: 116555 - DNA, 18 bp, Homo sapiens
tcttccaacactgacacc

SEQ ID NO: 116556 - DNA, 22 bp, Homo sapiens
gatgatcatctgtaaagttaga

SEQ ID NO: 116557 - DNA, 22 bp, Homo sapiens
ccagcagagcatggggaggaag

SEQ ID NO: 116558 - DNA, 22 bp, Homo sapiens
catccaggctggagtacagtgg

SEQ ID NO: 116559 - DNA, 22 bp, Homo sapiens
ataaaaactgacccatcctttg

SEQ ID NO: 116560 - DNA, 22 bp, Homo sapiens
ttagtgcttggcacacaataca

SEQ ID NO: 116561 - DNA, 22 bp, Homo sapiens
ctcagccccagcccagatagca

SEQ ID NO: 116562 - DNA, 17 bp, Homo sapiens
tccttcagtgcctctgc

SEQ ID NO: 116563 - DNA, 22 bp, Homo sapiens
aaattacagccttgggtagctt

SEQ ID NO: 116564 - DNA, 22 bp, Homo sapiens
actgccaatggtagtttgatgg

SEQ ID NO: 116565 - DNA, 22 bp, Homo sapiens
tggtggctaccaggtcctgggg

SEQ ID NO: 116566 - DNA, 22 bp, Homo sapiens
tgtggttttggttcagaaacaa

SEQ ID NO: 116567 - DNA, 22 bp, Homo sapiens
tgaaatgtgttctagtgttttg

SEQ ID NO: 116568 - DNA, 22 bp, Homo sapiens
tctaattttggcattttaacct

SEQ ID NO: 116569 - DNA, 22 bp, Homo sapiens
ctacaaaagtaattgtggtttt

SEQ ID NO: 116570 - DNA, 22 bp, Homo sapiens
agaacctcaattatttttgcac

SEQ ID NO: 116571 - DNA, 22 bp, Homo sapiens
gagggggctagcgcagtgccca

SEQ ID NO: 116572 - DNA, 22 bp, Homo sapiens
tgggaaggggagctggaaagga

SEQ ID NO: 116573 - DNA, 22 bp, Homo sapiens
atctggttttggctgtgtccct

SEQ ID NO: 116574 - DNA, 22 bp, Homo sapiens
gggtggtggccagcagtgggca

SEQ ID NO: 116575 - DNA, 22 bp, Homo sapiens
tatactctgagaaacgtgtcac

SEQ ID NO: 116576 - DNA, 22 bp, Homo sapiens
aaatgcctcattttctctcact

SEQ ID NO: 116577 - DNA, 22 bp, Homo sapiens
gcaggcggaggttgcagtgagc

SEQ ID NO: 116578 - DNA, 22 bp, Homo sapiens
aggaaaatggaccagagttgtt

SEQ ID NO: 116579 - DNA, 22 bp, Homo sapiens
acacagagccaaaccatatcac

SEQ ID NO: 116580 - DNA, 23 bp, Homo sapiens
aaataggagtatctggatcatga

SEQ ID NO: 116581 - DNA, 22 bp, Homo sapiens
caggctggagtgcagtggcgcc

SEQ ID NO: 116582 - DNA, 22 bp, Homo sapiens
cggctggtgtcgggcacagcaa

SEQ ID NO: 116583 - DNA, 22 bp, Homo sapiens
gtaatctcagctacttgggagg

SEQ ID NO: 116584 - DNA, 22 bp, Homo sapiens
tgcactccaggctgggtgacag

SEQ ID NO: 116585 - DNA, 22 bp, Homo sapiens
actaggggctcaggcccaggga

SEQ ID NO: 116586 - DNA, 22 bp, Homo sapiens
ggtccccgtggaggctggagcg

SEQ ID NO: 116587 - DNA, 22 bp, Homo sapiens
caaagtgctgggattacaggtg

SEQ ID NO: 116588 - DNA, 22 bp, Homo sapiens
aatataacacagatggcctgtt

SEQ ID NO: 116589 - DNA, 19 bp, Homo sapiens
agggttacccgctgccacc

SEQ ID NO: 116590 - DNA, 22 bp, Homo sapiens
ggctttgggggtgtccaagaaa

SEQ ID NO: 116591 - DNA, 22 bp, Homo sapiens
tggtctgctgaacagccgtatc

SEQ ID NO: 116592 - DNA, 17 bp, Homo sapiens
tgcatgtcctttgttcc

SEQ ID NO: 116593 - DNA, 22 bp, Homo sapiens
ggggccttggatctgtgccccg

SEQ ID NO: 116594 - DNA, 19 bp, Homo sapiens
tcctggggaggggcatggc

SEQ ID NO: 116595 - DNA, 22 bp, Homo sapiens
aagaactgagtacgttaataaa

SEQ ID NO: 116596 - DNA, 22 bp, Homo sapiens
aataaaatggtcagttttctca

SEQ ID NO: 116597 - DNA, 22 bp, Homo sapiens
ttaatgaaaggcagtttggaac

SEQ ID NO: 116598 - DNA, 22 bp, Homo sapiens
acaattctgatggtttcccagt

SEQ ID NO: 116599 - DNA, 22 bp, Homo sapiens
ctgggtggcagagcctgcagtg

SEQ ID NO: 116600 - DNA, 22 bp, Homo sapiens
cagtgacgtaaactgcatgtgc

SEQ ID NO: 116601 - DNA, 22 bp, Homo sapiens
ttataagctctgaaatctccta

SEQ ID NO: 116602 - DNA, 22 bp, Homo sapiens
ttggatccatctcaggcatagg

SEQ ID NO: 116603 - DNA, 19 bp, Homo sapiens
gatgctcattcaggtggaa

SEQ ID NO: 116604 - DNA, 22 bp, Homo sapiens
agctgattccactttttcccca

SEQ ID NO: 116605 - DNA, 22 bp, Homo sapiens
gctgctgcttgaaggctcggag

SEQ ID NO: 116606 - DNA, 22 bp, Homo sapiens
aatcagaaattgagggtctggt

SEQ ID NO: 116607 - DNA, 22 bp, Homo sapiens
tcaccaggctagagtgcagtgg

SEQ ID NO: 116608 - DNA, 22 bp, Homo sapiens
ctgctcttgagggactgcggtc

SEQ ID NO: 116609 - DNA, 20 bp, Homo sapiens
aaattactgccacacatttc

SEQ ID NO: 116610 - DNA, 22 bp, Homo sapiens
atgccactgcactccagcctag

SEQ ID NO: 116611 - DNA, 22 bp, Homo sapiens
cccaggctggagtgcagtggcg

SEQ ID NO: 116612 - DNA, 22 bp, Homo sapiens
gtggctgcagcggctgtggaga

SEQ ID NO: 116613 - DNA, 22 bp, Homo sapiens
tggaaatgtttcttgagctcag

SEQ ID NO: 116614 - DNA, 22 bp, Homo sapiens
tcccggcgctgggaggtgggtc

SEQ ID NO: 116615 - DNA, 22 bp, Homo sapiens
aaggctcggcaatgtgcggctc

SEQ ID NO: 116616 - DNA, 22 bp, Homo sapiens
cctagagctctgctttatctaa

SEQ ID NO: 116617 - DNA, 22 bp, Homo sapiens
ccggctcggcgaccaggctgaa

SEQ ID NO: 116618 - DNA, 22 bp, Homo sapiens
gagtcgagcagaaagccgtcgg

SEQ ID NO: 116619 - DNA, 22 bp, Homo sapiens
ttgacctatgtttcttcatctg

SEQ ID NO: 116620 - DNA, 22 bp, Homo sapiens
ggtggcagtagcactgggcctg

SEQ ID NO: 116621 - DNA, 22 bp, Homo sapiens
attgaaaataaggccagaaaca

SEQ ID NO: 116622 - DNA, 22 bp, Homo sapiens
cttctcggccgtgtggatgcgc

SEQ ID NO: 116623 - DNA, 22 bp, Homo sapiens
gtctttatttgagattgtcatt

SEQ ID NO: 116624 - DNA, 22 bp, Homo sapiens
gggaggcagtgctggaggctgg

SEQ ID NO: 116625 - DNA, 22 bp, Homo sapiens
acatcccatgcgcatctggcaa

SEQ ID NO: 116626 - DNA, 22 bp, Homo sapiens
tgcctgttgcccacctgataaa

SEQ ID NO: 116627 - DNA, 22 bp, Homo sapiens
gtggcctggctggcaccacctc

SEQ ID NO: 116628 - DNA, 22 bp, Homo sapiens
acccaagttttccatgcctgtt

SEQ ID NO: 116629 - DNA, 22 bp, Homo sapiens
attctaaatcagagagctctgt

SEQ ID NO: 116630 - DNA, 22 bp, Homo sapiens
ctcttagtaatgccatgaagca

SEQ ID NO: 116631 - DNA, 22 bp, Homo sapiens
tctgtcttagccatctcaggct

SEQ ID NO: 116632 - DNA, 22 bp, Homo sapiens
gtgccgcgacgcagtcggtgcc

SEQ ID NO: 116633 - DNA, 22 bp, Homo sapiens
gcggggggaggaacatcttgca

SEQ ID NO: 116634 - DNA, 22 bp, Homo sapiens
ccacccttgggttcggaggccg

SEQ ID NO: 116635 - DNA, 22 bp, Homo sapiens
tcactgcagcctctgcctcccg

SEQ ID NO: 116636 - DNA, 22 bp, Homo sapiens
gaccagtcattactcatgccct

SEQ ID NO: 116637 - DNA, 22 bp, Homo sapiens
tgccgtggggctgaggctggag

SEQ ID NO: 116638 - DNA, 22 bp, Homo sapiens
ccttcccatgcagcctgtctga

SEQ ID NO: 116639 - DNA, 22 bp, Homo sapiens
gcctgtgtggatgcgccggtgc

SEQ ID NO: 116640 - DNA, 20 bp, Homo sapiens
gccaacgcgctggggctgcc

SEQ ID NO: 116641 - DNA, 22 bp, Homo sapiens
aacctcaaactcttgggcttaa

SEQ ID NO: 116642 - DNA, 20 bp, Homo sapiens
ataaaataactgccacaaga

SEQ ID NO: 116643 - DNA, 22 bp, Homo sapiens
ttcaccctggaccagaaattgg

SEQ ID NO: 116644 - DNA, 22 bp, Homo sapiens
ccacagtcctggcttctgtctg

SEQ ID NO: 116645 - DNA, 19 bp, Homo sapiens
ctctggagtcattgctccc

SEQ ID NO: 116646 - DNA, 19 bp, Homo sapiens
taaaacgtgcatggcagca

SEQ ID NO: 116647 - DNA, 22 bp, Homo sapiens
gaggggcacagtaaagggtccc

SEQ ID NO: 116648 - DNA, 22 bp, Homo sapiens
cagctgctgttcagttttgttt

SEQ ID NO: 116649 - DNA, 22 bp, Homo sapiens
cgtcccgggttcacgccattct

SEQ ID NO: 116650 - DNA, 22 bp, Homo sapiens
aagtcattggtagcttgatagg

SEQ ID NO: 116651 - DNA, 22 bp, Homo sapiens
accagcctggccaacatggtga

SEQ ID NO: 116652 - DNA, 22 bp, Homo sapiens
ctcggcaggtggaggttgtagt

SEQ ID NO: 116653 - DNA, 22 bp, Homo sapiens
gccgtgtcatctgcgggtggca

SEQ ID NO: 116654 - DNA, 17 bp, Homo sapiens
cgggcatggagggcagg

SEQ ID NO: 116655 - DNA, 20 bp, Homo sapiens
gggactgtcccatcctcatc

SEQ ID NO: 116656 - DNA, 22 bp, Homo sapiens
tggatctcggcaatgcgggact

SEQ ID NO: 116657 - DNA, 22 bp, Homo sapiens
cccactgtttccctgaggctct

SEQ ID NO: 116658 - DNA, 22 bp, Homo sapiens
gagcccaggcagaggttgcagt

SEQ ID NO: 116659 - DNA, 22 bp, Homo sapiens
ttctcttttcaccagttgctaa

SEQ ID NO: 116660 - DNA, 22 bp, Homo sapiens
ctggctgggagcgagctgctca

SEQ ID NO: 116661 - DNA, 22 bp, Homo sapiens
ggaggtgggctaaggactctct

SEQ ID NO: 116662 - DNA, 22 bp, Homo sapiens
gccccagcctcccgagtagctg

SEQ ID NO: 116663 - DNA, 22 bp, Homo sapiens
tactttaatatatgtgaagttc

SEQ ID NO: 116664 - DNA, 22 bp, Homo sapiens
cggagtcttgctatgttgccca

SEQ ID NO: 116665 - DNA, 22 bp, Homo sapiens
ctcggggatccatccacgtggc

SEQ ID NO: 116666 - DNA, 22 bp, Homo sapiens
actttaaaactgatcatcagag

SEQ ID NO: 116667 - DNA, 22 bp, Homo sapiens
tgtatattctgcctaaaagctt

SEQ ID NO: 116668 - DNA, 16 bp, Homo sapiens
gtagccgtggccgctg

SEQ ID NO: 116669 - DNA, 22 bp, Homo sapiens
tcaaatgaagacagttgacttg

SEQ ID NO: 116670 - DNA, 22 bp, Homo sapiens
tagcttatcccacagtgcccag

SEQ ID NO: 116671 - DNA, 22 bp, Homo sapiens
cccacgtcgaacttgctccaga

SEQ ID NO: 116672 - DNA, 22 bp, Homo sapiens
caaatgtataaatgtactttct

SEQ ID NO: 116673 - DNA, 22 bp, Homo sapiens
catccaggctgaagtgcagtgg

SEQ ID NO: 116674 - DNA, 22 bp, Homo sapiens
ggctggtgttgagtgcctgtag

SEQ ID NO: 116675 - DNA, 22 bp, Homo sapiens
tcccaggccacacttggggaac

SEQ ID NO: 116676 - DNA, 22 bp, Homo sapiens
tgagcaggcgcagcaggaggtc

SEQ ID NO: 116677 - DNA, 22 bp, Homo sapiens
aacttaggaaaataaggcatga

SEQ ID NO: 116678 - DNA, 22 bp, Homo sapiens
gcaggtctgttgattacagtca

SEQ ID NO: 116679 - DNA, 22 bp, Homo sapiens
ggtaccaccaattcagctgcca

SEQ ID NO: 116680 - DNA, 22 bp, Homo sapiens
tcagccagccagctacaggctt

SEQ ID NO: 116681 - DNA, 22 bp, Homo sapiens
tgctcttcacagtttcagcatc

SEQ ID NO: 116682 - DNA, 22 bp, Homo sapiens
ttgtgaaacattcatggatttg

SEQ ID NO: 116683 - DNA, 22 bp, Homo sapiens
agaggaggctctgggatcgtcc

SEQ ID NO: 116684 - DNA, 22 bp, Homo sapiens
caggagtgtctccacacagcaa

SEQ ID NO: 116685 - DNA, 23 bp, Homo sapiens
ctcaccaagcgccgccgctgtgt

SEQ ID NO: 116686 - DNA, 22 bp, Homo sapiens
gagagagctctgtgcctgggat

SEQ ID NO: 116687 - DNA, 22 bp, Homo sapiens
ggatgttctggggttctcttgt

SEQ ID NO: 116688 - DNA, 22 bp, Homo sapiens
tcagggattgcaaaattcatcc

SEQ ID NO: 116689 - DNA, 22 bp, Homo sapiens
gctgtctcatacaaggccctgc

SEQ ID NO: 116690 - DNA, 22 bp, Homo sapiens
gcaggtctatcaggctgcaggt

SEQ ID NO: 116691 - DNA, 22 bp, Homo sapiens
gtccaagagtcaagaagggggc

SEQ ID NO: 116692 - DNA, 22 bp, Homo sapiens
ttgtgctgtgagaatgctcatt

SEQ ID NO: 116693 - DNA, 22 bp, Homo sapiens
aaccaccaccgtaatttaccca

SEQ ID NO: 116694 - DNA, 22 bp, Homo sapiens
atgccaggaacaaacagtggtg

SEQ ID NO: 116695 - DNA, 22 bp, Homo sapiens
acaagcgggccacagtgctggt

SEQ ID NO: 116696 - DNA, 22 bp, Homo sapiens
agtgttagattcttactcagtt

SEQ ID NO: 116697 - DNA, 22 bp, Homo sapiens
ggagctcctggcagtgacagag

SEQ ID NO: 116698 - DNA, 22 bp, Homo sapiens
gaccttgtgatccagccacctt

SEQ ID NO: 116699 - DNA, 22 bp, Homo sapiens
atgccacttcattccagcctcg

SEQ ID NO: 116700 - DNA, 22 bp, Homo sapiens
ctcgggcttgaggctgtttacc

SEQ ID NO: 116701 - DNA, 17 bp, Homo sapiens
gtaaggcttgcagatgc

SEQ ID NO: 116702 - DNA, 22 bp, Homo sapiens
ggcaatcattggcattctctgg

SEQ ID NO: 116703 - DNA, 22 bp, Homo sapiens
tctttgctattgtgaatagtgc

SEQ ID NO: 116704 - DNA, 14 bp, Homo sapiens
aagatcaccttcct

SEQ ID NO: 116705 - DNA, 22 bp, Homo sapiens
aaattgtaatgacttcacttga

SEQ ID NO: 116706 - DNA, 22 bp, Homo sapiens
ggtttgttggggtccaggccca

SEQ ID NO: 116707 - DNA, 22 bp, Homo sapiens
ataatacatggttgatcttttc

SEQ ID NO: 116708 - DNA, 22 bp, Homo sapiens
ggtcacgtgaccgcacctgcct

SEQ ID NO: 116709 - DNA, 22 bp, Homo sapiens
aaaagcaattgcagttcttgcc

SEQ ID NO: 116710 - DNA, 22 bp, Homo sapiens
aagaatgagctcaaagatctta

SEQ ID NO: 116711 - DNA, 22 bp, Homo sapiens
tcgggctcgctctcctagcgga

SEQ ID NO: 116712 - DNA, 19 bp, Homo sapiens
ccagagagctaggtacaga

SEQ ID NO: 116713 - DNA, 22 bp, Homo sapiens
cggggccctggggctgaaggtc

SEQ ID NO: 116714 - DNA, 22 bp, Homo sapiens
gcactttgcccctcctttggca

SEQ ID NO: 116715 - DNA, 21 bp, Homo sapiens
ttggccgtgcagatgaacagc

SEQ ID NO: 116716 - DNA, 22 bp, Homo sapiens
agaggccggccgagcccatggg

SEQ ID NO: 116717 - DNA, 22 bp, Homo sapiens
aaaatcttgtgacttaggaagg

SEQ ID NO: 116718 - DNA, 22 bp, Homo sapiens
cactgcactccagcctgggtga

SEQ ID NO: 116719 - DNA, 22 bp, Homo sapiens
gaggtggccaagcgaggaaggg

SEQ ID NO: 116720 - DNA, 22 bp, Homo sapiens
aggagccagtggagttcctgcc

SEQ ID NO: 116721 - DNA, 17 bp, Homo sapiens
cagtcgaggaggacctg

SEQ ID NO: 116722 - DNA, 22 bp, Homo sapiens
ccaggggttggaggttgcagtg

SEQ ID NO: 116723 - DNA, 22 bp, Homo sapiens
tacaacaatttccacattagaa

SEQ ID NO: 116724 - DNA, 22 bp, Homo sapiens
ggtcccaggttgacagggagac

SEQ ID NO: 116725 - DNA, 22 bp, Homo sapiens
actgcaacctccgcctgccagg

SEQ ID NO: 116726 - DNA, 19 bp, Homo sapiens
gactcacaccttccgctgt

SEQ ID NO: 116727 - DNA, 22 bp, Homo sapiens
tccacgtgagcttcgtgtgcag

SEQ ID NO: 116728 - DNA, 22 bp, Homo sapiens
acatatgcgatcataggatgca

SEQ ID NO: 116729 - DNA, 22 bp, Homo sapiens
ttcagcagtgcagacacccagt

SEQ ID NO: 116730 - DNA, 22 bp, Homo sapiens
tgtgtgattgcaggagatgtgg

SEQ ID NO: 116731 - DNA, 22 bp, Homo sapiens
cacagctgtgagaagggagcct

SEQ ID NO: 116732 - DNA, 22 bp, Homo sapiens
gaggcaggcagattgcttgagg

SEQ ID NO: 116733 - DNA, 22 bp, Homo sapiens
aaaaagtattggccatggttga

SEQ ID NO: 116734 - DNA, 22 bp, Homo sapiens
ctggcaagaaatatatatctta

SEQ ID NO: 116735 - DNA, 22 bp, Homo sapiens
tccttcagcctcccagctcaaa

SEQ ID NO: 116736 - DNA, 22 bp, Homo sapiens
aaagatcacgtcccaggactcg

SEQ ID NO: 116737 - DNA, 22 bp, Homo sapiens
ggcgccgcactcggtgcagccg

SEQ ID NO: 116738 - DNA, 22 bp, Homo sapiens
cttgtattaggaagaatgcttt

SEQ ID NO: 116739 - DNA, 22 bp, Homo sapiens
caggctggagttcagtggtgtg

SEQ ID NO: 116740 - DNA, 22 bp, Homo sapiens
accctccccaagaggtcgtgcc

SEQ ID NO: 116741 - DNA, 22 bp, Homo sapiens
cagcagcattgctctggattcc

SEQ ID NO: 116742 - DNA, 22 bp, Homo sapiens
gagacgtggcctttgcctgagc

SEQ ID NO: 116743 - DNA, 22 bp, Homo sapiens
ttgcaattgctatggagagcgt

SEQ ID NO: 116744 - DNA, 22 bp, Homo sapiens
cgggcaaggcgagactaggccc

SEQ ID NO: 116745 - DNA, 22 bp, Homo sapiens
ggggtctcactatgttacccag

SEQ ID NO: 116746 - DNA, 22 bp, Homo sapiens
agttgggtttgtgtcagttgca

SEQ ID NO: 116747 - DNA, 22 bp, Homo sapiens
tttctggcagcgggacaggggt

SEQ ID NO: 116748 - DNA, 22 bp, Homo sapiens
ttgttgtcattgtagaggattt

SEQ ID NO: 116749 - DNA, 21 bp, Homo sapiens
ctagcccctactccaagttga

SEQ ID NO: 116750 - DNA, 22 bp, Homo sapiens
cagagagaatcttggcagctga

SEQ ID NO: 116751 - DNA, 22 bp, Homo sapiens
gcctggattccttgtttctcag

SEQ ID NO: 116752 - DNA, 22 bp, Homo sapiens
tgtggtgccgagagtctggacg

SEQ ID NO: 116753 - DNA, 22 bp, Homo sapiens
caggtggcagtgcctgcattct

SEQ ID NO: 116754 - DNA, 21 bp, Homo sapiens
tactgtagccttgcactgtag

SEQ ID NO: 116755 - DNA, 22 bp, Homo sapiens
ttatttaatgtgatctgaagag

SEQ ID NO: 116756 - DNA, 22 bp, Homo sapiens
atatatttgagaatattcatga

SEQ ID NO: 116757 - DNA, 22 bp, Homo sapiens
aggtgcttggctcgtgcacaca

SEQ ID NO: 116758 - DNA, 22 bp, Homo sapiens
tggttgtggtcctccacatcgc

SEQ ID NO: 116759 - DNA, 22 bp, Homo sapiens
gtttctctgtctgttacattgg

SEQ ID NO: 116760 - DNA, 22 bp, Homo sapiens
ctatggtgatagaaatcagaat

SEQ ID NO: 116761 - DNA, 22 bp, Homo sapiens
ctcgcatgccctgcctcatcca

SEQ ID NO: 116762 - DNA, 22 bp, Homo sapiens
gtgtggtcgaagttctcccgga

SEQ ID NO: 116763 - DNA, 22 bp, Homo sapiens
atgctttctcttagttcattga

SEQ ID NO: 116764 - DNA, 22 bp, Homo sapiens
ggttggacactaggtaggagcg

SEQ ID NO: 116765 - DNA, 22 bp, Homo sapiens
ttatttaaaagtggtaagattc

SEQ ID NO: 116766 - DNA, 22 bp, Homo sapiens
gaggagggagctggaagctctt

SEQ ID NO: 116767 - DNA, 22 bp, Homo sapiens
ccaggcaggcgatggtgcagtg

SEQ ID NO: 116768 - DNA, 22 bp, Homo sapiens
tgtgtggattcatctcaaagag

SEQ ID NO: 116769 - DNA, 22 bp, Homo sapiens
ctgctcagtaatagtcctatct

SEQ ID NO: 116770 - DNA, 22 bp, Homo sapiens
ggtgttgcagttgaagactggt

SEQ ID NO: 116771 - DNA, 22 bp, Homo sapiens
cttcagctcttggtaaatgttt

SEQ ID NO: 116772 - DNA, 22 bp, Homo sapiens
cccagagcatgtgctgcctttg

SEQ ID NO: 116773 - DNA, 22 bp, Homo sapiens
ttgaccactgaatggttctgaa

SEQ ID NO: 116774 - DNA, 22 bp, Homo sapiens
tactgtactgcagttctgcaaa

SEQ ID NO: 116775 - DNA, 22 bp, Homo sapiens
ggtggctgcaatggctaacttc

SEQ ID NO: 116776 - DNA, 22 bp, Homo sapiens
ccaatgatggtgcccacgatga

SEQ ID NO: 116777 - DNA, 22 bp, Homo sapiens
tttaaaaaactagtctgagtct

SEQ ID NO: 116778 - DNA, 22 bp, Homo sapiens
agagagcccgggccagggcaca

SEQ ID NO: 116779 - DNA, 22 bp, Homo sapiens
caggcagggagctggaaaggat

SEQ ID NO: 116780 - DNA, 22 bp, Homo sapiens
cccaaaggttgaggctgcagtg

SEQ ID NO: 116781 - DNA, 22 bp, Homo sapiens
gctcggtggccagcctgaggcc

SEQ ID NO: 116782 - DNA, 22 bp, Homo sapiens
gcctccggagtcacagtgtctt

SEQ ID NO: 116783 - DNA, 22 bp, Homo sapiens
gccactgagcccggccattgtt

SEQ ID NO: 116784 - DNA, 22 bp, Homo sapiens
gagtggggggtccgtctcagtg

SEQ ID NO: 116785 - DNA, 22 bp, Homo sapiens
gaatgacgccctgtggtcactt

SEQ ID NO: 116786 - DNA, 22 bp, Homo sapiens
gaggtggatgttgcagtgagct

SEQ ID NO: 116787 - DNA, 22 bp, Homo sapiens
ctgtcctggggaaagccagccc

SEQ ID NO: 116788 - DNA, 22 bp, Homo sapiens
aggggctcctttgtgctgcgtc

SEQ ID NO: 116789 - DNA, 22 bp, Homo sapiens
ctgctcttcacactacacccgt

SEQ ID NO: 116790 - DNA, 22 bp, Homo sapiens
gaggcaggaggattgcttgagc

SEQ ID NO: 116791 - DNA, 23 bp, Homo sapiens
atgacactcctgtgcgcaccctg

SEQ ID NO: 116792 - DNA, 22 bp, Homo sapiens
ggagaagaggagctggaagcct

SEQ ID NO: 116793 - DNA, 22 bp, Homo sapiens
tgtggacgtcattaaagcagtg

SEQ ID NO: 116794 - DNA, 22 bp, Homo sapiens
ggctgggcaggtctgcacaggg

SEQ ID NO: 116795 - DNA, 22 bp, Homo sapiens
gaaactctcgcatcctgggaac

SEQ ID NO: 116796 - DNA, 22 bp, Homo sapiens
cagccccatggtgtgctccagc

SEQ ID NO: 116797 - DNA, 22 bp, Homo sapiens
gtgctttgttaagtctgaaatt

SEQ ID NO: 116798 - DNA, 22 bp, Homo sapiens
atcctagaatcagcccttgctg

SEQ ID NO: 116799 - DNA, 22 bp, Homo sapiens
caaagtgctaggattacaggcg

SEQ ID NO: 116800 - DNA, 22 bp, Homo sapiens
atgccactgcactccagcctgg

SEQ ID NO: 116801 - DNA, 22 bp, Homo sapiens
cagcccaggactgcaggtgttt

SEQ ID NO: 116802 - DNA, 22 bp, Homo sapiens
ggtgagcagctgtctgtatgga

SEQ ID NO: 116803 - DNA, 22 bp, Homo sapiens
tagagctggccgggacagctgg

SEQ ID NO: 116804 - DNA, 22 bp, Homo sapiens
agccagggtctctcgctctgtt

SEQ ID NO: 116805 - DNA, 22 bp, Homo sapiens
gtggtgtttgagctgccaggga

SEQ ID NO: 116806 - DNA, 22 bp, Homo sapiens
aatggaatacctaggtggccca

SEQ ID NO: 116807 - DNA, 22 bp, Homo sapiens
tcaccagatctctctgtaatgg

SEQ ID NO: 116808 - DNA, 22 bp, Homo sapiens
gagaagtcatttgaccacctag

SEQ ID NO: 116809 - DNA, 22 bp, Homo sapiens
ttggccatctaagcccagccac

SEQ ID NO: 116810 - DNA, 22 bp, Homo sapiens
gcaggcagatcacctgtcagga

SEQ ID NO: 116811 - DNA, 22 bp, Homo sapiens
cagcagagaaattacatatttg

SEQ ID NO: 116812 - DNA, 22 bp, Homo sapiens
ggggtggatttcaggcggtgtc

SEQ ID NO: 116813 - DNA, 22 bp, Homo sapiens
accctcaacaaattcactctat

SEQ ID NO: 116814 - DNA, 23 bp, Homo sapiens
ctcaaccctagtaagggagtagg

SEQ ID NO: 116815 - DNA, 22 bp, Homo sapiens
ctggagggctgcagcgaggctg

SEQ ID NO: 116816 - DNA, 21 bp, Homo sapiens
tcttttctcagctttgtggtt

SEQ ID NO: 116817 - DNA, 22 bp, Homo sapiens
tctgttgcaatgtgcatggtga

SEQ ID NO: 116818 - DNA, 22 bp, Homo sapiens
gccacctcggctttctctgctc

SEQ ID NO: 116819 - DNA, 22 bp, Homo sapiens
aggagcagaccgtagtcctgca

SEQ ID NO: 116820 - DNA, 22 bp, Homo sapiens
ggtgtagctctgtgtcccactg

SEQ ID NO: 116821 - DNA, 22 bp, Homo sapiens
agggtggcactggtggctctat

SEQ ID NO: 116822 - DNA, 22 bp, Homo sapiens
catggcggtcaggatgtaggtg

SEQ ID NO: 116823 - DNA, 22 bp, Homo sapiens
cgtggggcgggtggacacttgc

SEQ ID NO: 116824 - DNA, 22 bp, Homo sapiens
tcaaaattaaaccaacgtccag

SEQ ID NO: 116825 - DNA, 22 bp, Homo sapiens
tgaatgtgatgctaaacatatg

SEQ ID NO: 116826 - DNA, 22 bp, Homo sapiens
ttgtgctctgtgttatttaagg

SEQ ID NO: 116827 - DNA, 22 bp, Homo sapiens
ttcagcttgctgactgcggcag

SEQ ID NO: 116828 - DNA, 22 bp, Homo sapiens
ctgggaggcggaggttgcagtg

SEQ ID NO: 116829 - DNA, 22 bp, Homo sapiens
cctggaggcggaggttgcagtg

SEQ ID NO: 116830 - DNA, 22 bp, Homo sapiens
tgtgtctttgttccaggtacga

SEQ ID NO: 116831 - DNA, 22 bp, Homo sapiens
tgtctttgttattgtggacagg

SEQ ID NO: 116832 - DNA, 23 bp, Homo sapiens
tgagctgggcctgcaggggtctc

SEQ ID NO: 116833 - DNA, 22 bp, Homo sapiens
gggagctggagctggaagactc

SEQ ID NO: 116834 - DNA, 22 bp, Homo sapiens
tttattctgtgctacatgaaga

SEQ ID NO: 116835 - DNA, 22 bp, Homo sapiens
tctcccaggcaggagtgcagtg

SEQ ID NO: 116836 - DNA, 22 bp, Homo sapiens
ttggaagacaatgctgattctc

SEQ ID NO: 116837 - DNA, 22 bp, Homo sapiens
ctccagttggccccagttggtt

SEQ ID NO: 116838 - DNA, 22 bp, Homo sapiens
gcagtggcatgatgtgggctca

SEQ ID NO: 116839 - DNA, 22 bp, Homo sapiens
caggcaggtcagtgaagaagga

SEQ ID NO: 116840 - DNA, 22 bp, Homo sapiens
ctgtccctgagcaactcctgtt

SEQ ID NO: 116841 - DNA, 22 bp, Homo sapiens
gccatcatatcccctgtgacct

SEQ ID NO: 116842 - DNA, 22 bp, Homo sapiens
atgcacctgaactccatcagct

SEQ ID NO: 116843 - DNA, 22 bp, Homo sapiens
tactgtgtgcccagccgagctg

SEQ ID NO: 116844 - DNA, 22 bp, Homo sapiens
ggggtccctgcaccagcatgtc

SEQ ID NO: 116845 - DNA, 22 bp, Homo sapiens
gaccttgtgatctgcccacctt

SEQ ID NO: 116846 - DNA, 20 bp, Homo sapiens
ctgggtggcaagcaaggggg

SEQ ID NO: 116847 - DNA, 22 bp, Homo sapiens
gctcaagccttctgcccacctc

SEQ ID NO: 116848 - DNA, 22 bp, Homo sapiens
accaggcccgctgctatggtgg

SEQ ID NO: 116849 - DNA, 22 bp, Homo sapiens
tgacctattagatttccttgcc

SEQ ID NO: 116850 - DNA, 22 bp, Homo sapiens
atgttatgtctgggaaggggta

SEQ ID NO: 116851 - DNA, 22 bp, Homo sapiens
gctgggttttcttccgggccta

SEQ ID NO: 116852 - DNA, 22 bp, Homo sapiens
cattctgcgatcctcaagcaca

SEQ ID NO: 116853 - DNA, 22 bp, Homo sapiens
attgtaaatagtgccacaataa

SEQ ID NO: 116854 - DNA, 22 bp, Homo sapiens
ttgaaaagttttgaaacactct

SEQ ID NO: 116855 - DNA, 22 bp, Homo sapiens
gcagatcaacactctctttcaa

SEQ ID NO: 116856 - DNA, 22 bp, Homo sapiens
ctgatcctcctttaagtagctg

SEQ ID NO: 116857 - DNA, 22 bp, Homo sapiens
gggacatctttctagtcagggt

SEQ ID NO: 116858 - DNA, 22 bp, Homo sapiens
tcctgagataaatctcatgtga

SEQ ID NO: 116859 - DNA, 22 bp, Homo sapiens
agggccagcactcctggcagga

SEQ ID NO: 116860 - DNA, 22 bp, Homo sapiens
atggggagctcaccacctgttt

SEQ ID NO: 116861 - DNA, 22 bp, Homo sapiens
ttgactgtgatgggctcagctg

SEQ ID NO: 116862 - DNA, 22 bp, Homo sapiens
cttgtctgctataaaaatccag

SEQ ID NO: 116863 - DNA, 23 bp, Homo sapiens
ctgtggtgaggccctagaatctg

SEQ ID NO: 116864 - DNA, 22 bp, Homo sapiens
tgttcttgagcctttagaccta

SEQ ID NO: 116865 - DNA, 22 bp, Homo sapiens
aggtggggaggagtgtctcttt

SEQ ID NO: 116866 - DNA, 22 bp, Homo sapiens
aggtattattagcatctctatt

SEQ ID NO: 116867 - DNA, 16 bp, Homo sapiens
cttgtctgttgctcat

SEQ ID NO: 116868 - DNA, 22 bp, Homo sapiens
actcggggtggagagagcggtg

SEQ ID NO: 116869 - DNA, 22 bp, Homo sapiens
ggtgacctcacctggtcccacc

SEQ ID NO: 116870 - DNA, 18 bp, Homo sapiens
catgggtgacaggtggat

SEQ ID NO: 116871 - DNA, 22 bp, Homo sapiens
gctgctttgtctgtaaaatgga

SEQ ID NO: 116872 - DNA, 22 bp, Homo sapiens
gggcgccgtgggaaacagccgg

SEQ ID NO: 116873 - DNA, 22 bp, Homo sapiens
ttccagagagttattcccctgg

SEQ ID NO: 116874 - DNA, 22 bp, Homo sapiens
agaggggcccggttctccgtct

SEQ ID NO: 116875 - DNA, 22 bp, Homo sapiens
gccgggtgcagcgggcccgcca

SEQ ID NO: 116876 - DNA, 22 bp, Homo sapiens
tttctttatcatagcatctttg

SEQ ID NO: 116877 - DNA, 22 bp, Homo sapiens
gcctcctggggtgccatcatct

SEQ ID NO: 116878 - DNA, 23 bp, Homo sapiens
ggttctgccgcttactgctgtgc

SEQ ID NO: 116879 - DNA, 22 bp, Homo sapiens
aggctctgtcaggcggagcagc

SEQ ID NO: 116880 - DNA, 22 bp, Homo sapiens
agcaagattgaggcttcctcag

SEQ ID NO: 116881 - DNA, 22 bp, Homo sapiens
cttgcctttgtcttcaaaggct

SEQ ID NO: 116882 - DNA, 22 bp, Homo sapiens
cacaaaccttctgcagcctgta

SEQ ID NO: 116883 - DNA, 23 bp, Homo sapiens
actgattcttgaagttgacaagt

SEQ ID NO: 116884 - DNA, 22 bp, Homo sapiens
tggtggggccagacttcagctc

SEQ ID NO: 116885 - DNA, 22 bp, Homo sapiens
acaaacagagttgaaaaatagg

SEQ ID NO: 116886 - DNA, 19 bp, Homo sapiens
ctgctgccggagactcgtc

SEQ ID NO: 116887 - DNA, 22 bp, Homo sapiens
tccttagacaaagagtgggctt

SEQ ID NO: 116888 - DNA, 22 bp, Homo sapiens
atgccactgcgctccagcctgg

SEQ ID NO: 116889 - DNA, 22 bp, Homo sapiens
gcggccttgtggcggagcaggc

SEQ ID NO: 116890 - DNA, 22 bp, Homo sapiens
gagctcattcattcattgcctg

SEQ ID NO: 116891 - DNA, 22 bp, Homo sapiens
atatattttttgagacagagtc

SEQ ID NO: 116892 - DNA, 22 bp, Homo sapiens
aaaggacacacaggaggtgtct

SEQ ID NO: 116893 - DNA, 22 bp, Homo sapiens
ctgctttaaaactgatacatga

SEQ ID NO: 116894 - DNA, 22 bp, Homo sapiens
tcggggtctttgacacgctctg

SEQ ID NO: 116895 - DNA, 22 bp, Homo sapiens
ggtgggagagctctgtctccag

SEQ ID NO: 116896 - DNA, 22 bp, Homo sapiens
tatcagcgtgcaaatctttgga

SEQ ID NO: 116897 - DNA, 19 bp, Homo sapiens
ttgacgttgtggaattaac

SEQ ID NO: 116898 - DNA, 22 bp, Homo sapiens
gcccagcacctctctcagggtt

SEQ ID NO: 116899 - DNA, 22 bp, Homo sapiens
cggtctcccgtgtgtgtgcgct

SEQ ID NO: 116900 - DNA, 22 bp, Homo sapiens
aggggcacgagtagagctctag

SEQ ID NO: 116901 - DNA, 22 bp, Homo sapiens
gagccccaccctagacattctg

SEQ ID NO: 116902 - DNA, 22 bp, Homo sapiens
cgagagttagctaggagtcaca

SEQ ID NO: 116903 - DNA, 22 bp, Homo sapiens
cagcagcccacgcgtgctgtcc

SEQ ID NO: 116904 - DNA, 22 bp, Homo sapiens
tcaatgtgaattaagaatactt

SEQ ID NO: 116905 - DNA, 22 bp, Homo sapiens
gtgtttggtcagacgtccgggg

SEQ ID NO: 116906 - DNA, 22 bp, Homo sapiens
tagggggctttgctgcttgaca

SEQ ID NO: 116907 - DNA, 21 bp, Homo sapiens
gctgctcgagatccagtgctt

SEQ ID NO: 116908 - DNA, 22 bp, Homo sapiens
ccagggatgcagaggttgcagt

SEQ ID NO: 116909 - DNA, 22 bp, Homo sapiens
tacctcaagttccaggaaagcg

SEQ ID NO: 116910 - DNA, 22 bp, Homo sapiens
tccacaggtccggcatgaacag

SEQ ID NO: 116911 - DNA, 22 bp, Homo sapiens
tgggtgtccagaccctgcacat

SEQ ID NO: 116912 - DNA, 22 bp, Homo sapiens
gccgggaccaaggccacggagc

SEQ ID NO: 116913 - DNA, 22 bp, Homo sapiens
tcactgcgcttcagcctgggtg

SEQ ID NO: 116914 - DNA, 22 bp, Homo sapiens
tgggatgccggcaggaggcaat

SEQ ID NO: 116915 - DNA, 23 bp, Homo sapiens
tgttccagatacgccttttcctc

SEQ ID NO: 116916 - DNA, 22 bp, Homo sapiens
gccatgactctccataccaaag

SEQ ID NO: 116917 - DNA, 22 bp, Homo sapiens
agcgccactgcactccagcctg

SEQ ID NO: 116918 - DNA, 22 bp, Homo sapiens
aatttcggttcaaggcccagtt

SEQ ID NO: 116919 - DNA, 22 bp, Homo sapiens
ttgtgttaaggtgcatctagtg

SEQ ID NO: 116920 - DNA, 22 bp, Homo sapiens
cggggttcatccatgctgtggc

SEQ ID NO: 116921 - DNA, 22 bp, Homo sapiens
taattataacagttacatctta

SEQ ID NO: 116922 - DNA, 22 bp, Homo sapiens
cccagctcttcaagtcaccccc

SEQ ID NO: 116923 - DNA, 22 bp, Homo sapiens
cagcagcagtggctgcagaaca

SEQ ID NO: 116924 - DNA, 22 bp, Homo sapiens
acctcctggcctcaagcaatcc

SEQ ID NO: 116925 - DNA, 22 bp, Homo sapiens
gaccctgtttctacaaataatt

SEQ ID NO: 116926 - DNA, 22 bp, Homo sapiens
tgtgcctactgatagagccaag

SEQ ID NO: 116927 - DNA, 22 bp, Homo sapiens
tttctcttcactgtgtgcctca

SEQ ID NO: 116928 - DNA, 22 bp, Homo sapiens
acttttaaatgagtttcagttg

SEQ ID NO: 116929 - DNA, 20 bp, Homo sapiens
caagggtttgcattggcttt

SEQ ID NO: 116930 - DNA, 22 bp, Homo sapiens
aggggaccaaaatgtcctgcct

SEQ ID NO: 116931 - DNA, 22 bp, Homo sapiens
cgtgcgcctcagcctcgtgcgc

SEQ ID NO: 116932 - DNA, 22 bp, Homo sapiens
ggggcaggagcccttcttcagc

SEQ ID NO: 116933 - DNA, 21 bp, Homo sapiens
aaactgaccttgcctgagaca

SEQ ID NO: 116934 - DNA, 22 bp, Homo sapiens
tggtatgaccgtggtgcaagca

SEQ ID NO: 116935 - DNA, 22 bp, Homo sapiens
tctgcaacattcctctccccac

SEQ ID NO: 116936 - DNA, 22 bp, Homo sapiens
tccacaaggcagctcctccagg

SEQ ID NO: 116937 - DNA, 22 bp, Homo sapiens
aggtcaccatggcatgctccac

SEQ ID NO: 116938 - DNA, 22 bp, Homo sapiens
ggctgcaggttggttggcagct

SEQ ID NO: 116939 - DNA, 22 bp, Homo sapiens
gcttaattctggctcagtttcc

SEQ ID NO: 116940 - DNA, 22 bp, Homo sapiens
acagattcactgcactggccat

SEQ ID NO: 116941 - DNA, 22 bp, Homo sapiens
tacgggcacgcaccacgatgcc

SEQ ID NO: 116942 - DNA, 22 bp, Homo sapiens
tacgcctgtaatcccagcactt

SEQ ID NO: 116943 - DNA, 22 bp, Homo sapiens
cggccgcagcagtgtcggccca

SEQ ID NO: 116944 - DNA, 22 bp, Homo sapiens
cagtggcgtgatctctgctcac

SEQ ID NO: 116945 - DNA, 22 bp, Homo sapiens
caaagtgctaggattacaggcc

SEQ ID NO: 116946 - DNA, 22 bp, Homo sapiens
tcttttgtgattcttcagttac

SEQ ID NO: 116947 - DNA, 22 bp, Homo sapiens
tacaaaaaattgatactgacga

SEQ ID NO: 116948 - DNA, 23 bp, Homo sapiens
ggctgggagctccgggtgcacgt

SEQ ID NO: 116949 - DNA, 22 bp, Homo sapiens
aagatgcggttgaccatggtgt

SEQ ID NO: 116950 - DNA, 22 bp, Homo sapiens
tagtttcatctccaccctgccc

SEQ ID NO: 116951 - DNA, 22 bp, Homo sapiens
tcttgcacttcatgaatatgtt

SEQ ID NO: 116952 - DNA, 22 bp, Homo sapiens
ctgggaggcagaggttgtagtg

SEQ ID NO: 116953 - DNA, 22 bp, Homo sapiens
tggcacaggatctcagcggcca

SEQ ID NO: 116954 - DNA, 22 bp, Homo sapiens
tcccagtttttctccactaagg

SEQ ID NO: 116955 - DNA, 22 bp, Homo sapiens
ctgggcacagcgttgggctctt

SEQ ID NO: 116956 - DNA, 22 bp, Homo sapiens
ggcagcactgcagcttgttggg

SEQ ID NO: 116957 - DNA, 22 bp, Homo sapiens
actgcactccagcccgagcaac

SEQ ID NO: 116958 - DNA, 21 bp, Homo sapiens
cagagctgtccaaaccctgac

SEQ ID NO: 116959 - DNA, 22 bp, Homo sapiens
tgtgactaggcctgagctcttg

SEQ ID NO: 116960 - DNA, 22 bp, Homo sapiens
gtcgtggagctcacagtgtgcc

SEQ ID NO: 116961 - DNA, 22 bp, Homo sapiens
tgtcttcgctacaatgaaaagg

SEQ ID NO: 116962 - DNA, 22 bp, Homo sapiens
ctcataaggagctcacaaccta

SEQ ID NO: 116963 - DNA, 22 bp, Homo sapiens
tagcagcaaagcaggatctgct

SEQ ID NO: 116964 - DNA, 22 bp, Homo sapiens
gggagaggttacccgagcaact

SEQ ID NO: 116965 - DNA, 22 bp, Homo sapiens
attaatgaaactttggttaagc

SEQ ID NO: 116966 - DNA, 22 bp, Homo sapiens
gagtgtgtcggtcagcgtggcg

SEQ ID NO: 116967 - DNA, 22 bp, Homo sapiens
gcttctcgggcctgatgtcgtc

SEQ ID NO: 116968 - DNA, 22 bp, Homo sapiens
ctgccctttgaaagaacgtctt

SEQ ID NO: 116969 - DNA, 22 bp, Homo sapiens
aggaaataggaccagacaaagc

SEQ ID NO: 116970 - DNA, 22 bp, Homo sapiens
gcaggcagaggtggaggagaca

SEQ ID NO: 116971 - DNA, 22 bp, Homo sapiens
tgccacctgtacatgctatctg

SEQ ID NO: 116972 - DNA, 22 bp, Homo sapiens
acagtccagcctagtatgtata

SEQ ID NO: 116973 - DNA, 22 bp, Homo sapiens
aaagcactgcacatatatttgc

SEQ ID NO: 116974 - DNA, 22 bp, Homo sapiens
ccaaagtgctggggttacaggc

SEQ ID NO: 116975 - DNA, 22 bp, Homo sapiens
tgggcagggagctggaaccaca

SEQ ID NO: 116976 - DNA, 22 bp, Homo sapiens
ggttcccggatctccgagtccc

SEQ ID NO: 116977 - DNA, 22 bp, Homo sapiens
gtccccgacgtttggcttgatg

SEQ ID NO: 116978 - DNA, 22 bp, Homo sapiens
ctgctcctgtccagcagggcca

SEQ ID NO: 116979 - DNA, 22 bp, Homo sapiens
caggctggagtgcagtggcgct

SEQ ID NO: 116980 - DNA, 22 bp, Homo sapiens
cactgcacttcagcctgggtga

SEQ ID NO: 116981 - DNA, 22 bp, Homo sapiens
tcttaattctgtgtcttcacta

SEQ ID NO: 116982 - DNA, 22 bp, Homo sapiens
ggaggcagaatagagtgtgggt

SEQ ID NO: 116983 - DNA, 20 bp, Homo sapiens
acgtggccaccagtggctta

SEQ ID NO: 116984 - DNA, 22 bp, Homo sapiens
tgtctggtgggttgacaggcag

SEQ ID NO: 116985 - DNA, 21 bp, Homo sapiens
attctttgatgtgcaataagt

SEQ ID NO: 116986 - DNA, 22 bp, Homo sapiens
gagcacagtaaagcagtgtcac

SEQ ID NO: 116987 - DNA, 22 bp, Homo sapiens
agactttaacaatgggtatgaa

SEQ ID NO: 116988 - DNA, 22 bp, Homo sapiens
agtggcctggagccccgcctgg

SEQ ID NO: 116989 - DNA, 23 bp, Homo sapiens
tcagaacagttcttggtgcatag

SEQ ID NO: 116990 - DNA, 22 bp, Homo sapiens
gagtgtatggaaggaagagatt

SEQ ID NO: 116991 - DNA, 22 bp, Homo sapiens
ttttctcttccctctggacctg

SEQ ID NO: 116992 - DNA, 22 bp, Homo sapiens
tgaagcaaattgtttagcctga

SEQ ID NO: 116993 - DNA, 22 bp, Homo sapiens
ttctccgctaagttctctgcag

SEQ ID NO: 116994 - DNA, 22 bp, Homo sapiens
ctctttggatagaattacaaag

SEQ ID NO: 116995 - DNA, 22 bp, Homo sapiens
tctgagacaggaagtggagggt

SEQ ID NO: 116996 - DNA, 22 bp, Homo sapiens
atgccactgcacttcagcttgg

SEQ ID NO: 116997 - DNA, 22 bp, Homo sapiens
ctgcatccatgttgctgcaaag

SEQ ID NO: 116998 - DNA, 22 bp, Homo sapiens
tggttcctcaagcgctggcggc

SEQ ID NO: 116999 - DNA, 22 bp, Homo sapiens
acagagacacggaagctaaaga

SEQ ID NO: 117000 - DNA, 22 bp, Homo sapiens
taacaatacccattctaattac

SEQ ID NO: 117001 - DNA, 22 bp, Homo sapiens
tccaagatctacagcagtttag

SEQ ID NO: 117002 - DNA, 22 bp, Homo sapiens
gaaagacatagttgcaagatgg

SEQ ID NO: 117003 - DNA, 22 bp, Homo sapiens
gagacacaggcacagaagaggc

SEQ ID NO: 117004 - DNA, 22 bp, Homo sapiens
atgttctacagatggaaagggg

SEQ ID NO: 117005 - DNA, 22 bp, Homo sapiens
cagagctggtgtgtcctggcat

SEQ ID NO: 117006 - DNA, 22 bp, Homo sapiens
tcaccggcagacgtggcctgat

SEQ ID NO: 117007 - DNA, 22 bp, Homo sapiens
ggggccttttctgaatgtggaa

SEQ ID NO: 117008 - DNA, 22 bp, Homo sapiens
caaggtgccatgctgggcgggg

SEQ ID NO: 117009 - DNA, 22 bp, Homo sapiens
ggggccgaccgcggttcaggcc

SEQ ID NO: 117010 - DNA, 22 bp, Homo sapiens
cgtgccactgcactctagcctg

SEQ ID NO: 117011 - DNA, 22 bp, Homo sapiens
gacagacacaattgatccatga

SEQ ID NO: 117012 - DNA, 22 bp, Homo sapiens
ggccgtgctccaaagtcatcgt

SEQ ID NO: 117013 - DNA, 22 bp, Homo sapiens
tggtatgtaaattgtaactcaa

SEQ ID NO: 117014 - DNA, 21 bp, Homo sapiens
cactccacttagaacagggtt

SEQ ID NO: 117015 - DNA, 21 bp, Homo sapiens
acgggaatgaacatggtggag

SEQ ID NO: 117016 - DNA, 22 bp, Homo sapiens
gagatgggcgagaaggtggact

SEQ ID NO: 117017 - DNA, 22 bp, Homo sapiens
tcaaattgtcatcttgataatg

SEQ ID NO: 117018 - DNA, 22 bp, Homo sapiens
gcaggagaacaaagcaagctgc

SEQ ID NO: 117019 - DNA, 22 bp, Homo sapiens
tgatttatgcattatactgttg

SEQ ID NO: 117020 - DNA, 22 bp, Homo sapiens
tccgcccgcacgtatggagtgg

SEQ ID NO: 117021 - DNA, 22 bp, Homo sapiens
actccacatttgaacacagttc

SEQ ID NO: 117022 - DNA, 22 bp, Homo sapiens
ctgggaggcagaggttgcagtg

SEQ ID NO: 117023 - DNA, 22 bp, Homo sapiens
caaagtgctgggattacaggct

SEQ ID NO: 117024 - DNA, 22 bp, Homo sapiens
gagctgaaggagaaagcagggg

SEQ ID NO: 117025 - DNA, 22 bp, Homo sapiens
atagagtgatgtaaggtatgtg

SEQ ID NO: 117026 - DNA, 22 bp, Homo sapiens
aaggagtctgggccattcagag

SEQ ID NO: 117027 - DNA, 22 bp, Homo sapiens
tgccgcagtgcggggagggccc

SEQ ID NO: 117028 - DNA, 22 bp, Homo sapiens
gagagtctaggaacctcatata

SEQ ID NO: 117029 - DNA, 22 bp, Homo sapiens
tcacagagttaaaagtttcttt

SEQ ID NO: 117030 - DNA, 22 bp, Homo sapiens
gggacttaatgcagagagggac

SEQ ID NO: 117031 - DNA, 23 bp, Homo sapiens
aatgggtgcaactatccatgaca

SEQ ID NO: 117032 - DNA, 22 bp, Homo sapiens
tacatgctccttatgagaatct

SEQ ID NO: 117033 - DNA, 20 bp, Homo sapiens
ccagagctgatggctgcccg

SEQ ID NO: 117034 - DNA, 22 bp, Homo sapiens
tgagccgtggtctctgagggtg

SEQ ID NO: 117035 - DNA, 22 bp, Homo sapiens
agggtgaatctcacaactctta

SEQ ID NO: 117036 - DNA, 22 bp, Homo sapiens
aggacagagggaccagagccca

SEQ ID NO: 117037 - DNA, 22 bp, Homo sapiens
tccagctctgctgtgcgccggt

SEQ ID NO: 117038 - DNA, 22 bp, Homo sapiens
tctacctggagtccgttgttaa

SEQ ID NO: 117039 - DNA, 22 bp, Homo sapiens
aggctggagtgcagtggtgtga

SEQ ID NO: 117040 - DNA, 22 bp, Homo sapiens
aagtgctgggattataggcatg

SEQ ID NO: 117041 - DNA, 21 bp, Homo sapiens
gccatttcacacagacatttg

SEQ ID NO: 117042 - DNA, 22 bp, Homo sapiens
gcctcctgtcccaggctgagga

SEQ ID NO: 117043 - DNA, 22 bp, Homo sapiens
aactatgttaataagtttcatt

SEQ ID NO: 117044 - DNA, 22 bp, Homo sapiens
cctagagctctgctttatctaa

SEQ ID NO: 117045 - DNA, 22 bp, Homo sapiens
tggtattacttctagacacaag

SEQ ID NO: 117046 - DNA, 22 bp, Homo sapiens
acattacctggcatttgatctt

SEQ ID NO: 117047 - DNA, 22 bp, Homo sapiens
gaccatcctggccaacgtggta

SEQ ID NO: 117048 - DNA, 22 bp, Homo sapiens
ttacctaaaatagctcaattta

SEQ ID NO: 117049 - DNA, 22 bp, Homo sapiens
aagtggactaatacaaggacta

SEQ ID NO: 117050 - DNA, 22 bp, Homo sapiens
gctcaagccttctgcccacctc

SEQ ID NO: 117051 - DNA, 22 bp, Homo sapiens
ttgacctatgtttcttcatctg

SEQ ID NO: 117052 - DNA, 23 bp, Homo sapiens
tgttccagatacgccttttcctc

SEQ ID NO: 117053 - DNA, 22 bp, Homo sapiens
aggacttagaacattatgtact

SEQ ID NO: 117054 - DNA, 22 bp, Homo sapiens
acacttggagcaacacttatgg

SEQ ID NO: 117055 - DNA, 22 bp, Homo sapiens
accatgttggccaagctggtct

SEQ ID NO: 117056 - DNA, 22 bp, Homo sapiens
aggtattattagcatctctatt

SEQ ID NO: 117057 - DNA, 22 bp, Homo sapiens
attataggcttgagccaccgtg

SEQ ID NO: 117058 - DNA, 21 bp, Homo sapiens
tgtaagtttcatctgaattgg

SEQ ID NO: 117059 - DNA, 22 bp, Homo sapiens
ggctcactgcaacttccgcctc

SEQ ID NO: 117060 - DNA, 22 bp, Homo sapiens
tctcgctctgtcgcccaggctg

SEQ ID NO: 117061 - DNA, 22 bp, Homo sapiens
cttcctttgctgttcggaggtt

SEQ ID NO: 117062 - DNA, 22 bp, Homo sapiens
ttgttgtcattgtagaggattt

SEQ ID NO: 117063 - DNA, 22 bp, Homo sapiens
cctcgacctccccaggctcagg

SEQ ID NO: 117064 - DNA, 22 bp, Homo sapiens
tgctcatcaacatgatgatcat

SEQ ID NO: 117065 - DNA, 22 bp, Homo sapiens
gtagttctgcagtgtcacctga

SEQ ID NO: 117066 - DNA, 21 bp, Homo sapiens
tactgtagccttgcactgtag

SEQ ID NO: 117067 - DNA, 22 bp, Homo sapiens
atacaaaatatatactggagac

SEQ ID NO: 117068 - DNA, 18 bp, Homo sapiens
tgagaggctattttttgc

SEQ ID NO: 117069 - DNA, 22 bp, Homo sapiens
gaaagacatagttgcaagatgg

SEQ ID NO: 117070 - DNA, 18 bp, Homo sapiens
tcctttctccctcatctt

SEQ ID NO: 117071 - DNA, 22 bp, Homo sapiens
cactgcacttcagcctgggtga

SEQ ID NO: 117072 - DNA, 22 bp, Homo sapiens
tagagcaatgctctactccttg

SEQ ID NO: 117073 - DNA, 22 bp, Homo sapiens
cactgcactccagcctgggtga

SEQ ID NO: 117074 - DNA, 22 bp, Homo sapiens
gggcggatcacctgaggtcagg

SEQ ID NO: 117075 - DNA, 22 bp, Homo sapiens
actgcactccagcctgggtgat

SEQ ID NO: 117076 - DNA, 22 bp, Homo sapiens
tgagccaagttcacaccattgc

SEQ ID NO: 117077 - DNA, 22 bp, Homo sapiens
atcatgttttaattagcaaact

SEQ ID NO: 117078 - DNA, 22 bp, Homo sapiens
tccacgctgtgtgaccttgggc

SEQ ID NO: 117079 - DNA, 22 bp, Homo sapiens
aaggcaggatgggaaaagattt

SEQ ID NO: 117080 - DNA, 22 bp, Homo sapiens
cactgcactccatcctgggaaa

SEQ ID NO: 117081 - DNA, 22 bp, Homo sapiens
cactgcactccagcctgggaga

SEQ ID NO: 117082 - DNA, 22 bp, Homo sapiens
tcactgcaacctccacctcctg

SEQ ID NO: 117083 - DNA, 22 bp, Homo sapiens
ttccagctaactcacatccctt

SEQ ID NO: 117084 - DNA, 17 bp, Homo sapiens
tgtatttatcatgtcag

SEQ ID NO: 117085 - DNA, 22 bp, Homo sapiens
tcactgcaacctccacctcccg

SEQ ID NO: 117086 - DNA, 22 bp, Homo sapiens
cttcctttgctgttcggaggtt

SEQ ID NO: 117087 - DNA, 22 bp, Homo sapiens
aacccgggaggcggaggttgtg

SEQ ID NO: 117088 - DNA, 22 bp, Homo sapiens
tgcactccaggctgggtgacag

SEQ ID NO: 117089 - DNA, 22 bp, Homo sapiens
aagtcagacagctgagctgcct

SEQ ID NO: 117090 - DNA, 22 bp, Homo sapiens
cactgcactccagcctgggtca

SEQ ID NO: 117091 - DNA, 19 bp, Homo sapiens
catggtgaaaccccgtctc

SEQ ID NO: 117092 - DNA, 22 bp, Homo sapiens
gcataaactccaaaaggcaggg

SEQ ID NO: 117093 - DNA, 22 bp, Homo sapiens
aagagggctgcaatcttattgc

SEQ ID NO: 117094 - DNA, 22 bp, Homo sapiens
ttgagcccaggaggcctgggtg

SEQ ID NO: 117095 - DNA, 22 bp, Homo sapiens
aaaaatcacttttataggcagc

SEQ ID NO: 117096 - DNA, 22 bp, Homo sapiens
attgtggtgtcagttataggca

SEQ ID NO: 117097 - DNA, 22 bp, Homo sapiens
atggcagaatatctgcatcgca

SEQ ID NO: 117098 - DNA, 22 bp, Homo sapiens
ctgcgttctgcctggcggccta

SEQ ID NO: 117099 - DNA, 22 bp, Homo sapiens
gtgtggaatggagtttttgccc

SEQ ID NO: 117100 - DNA, 22 bp, Homo sapiens
atgtgggccgtgcgggtgtcct

SEQ ID NO: 117101 - DNA, 22 bp, Homo sapiens
gaggcagaggttgttgcagtga

SEQ ID NO: 117102 - DNA, 22 bp, Homo sapiens
cggaggttgaggctgcagtgag

SEQ ID NO: 117103 - DNA, 22 bp, Homo sapiens
ttcctttctctggactgcagcc

SEQ ID NO: 117104 - DNA, 22 bp, Homo sapiens
aattgaaaatattgtagaccat

SEQ ID NO: 117105 - DNA, 22 bp, Homo sapiens
acgcctgtaatcccagcacttt

SEQ ID NO: 117106 - DNA, 22 bp, Homo sapiens
tacgcctgtaatcccagcactt

SEQ ID NO: 117107 - DNA, 19 bp, Homo sapiens
atgtacccagtgtcaatcc

SEQ ID NO: 117108 - DNA, 22 bp, Homo sapiens
tactgcactccagcctgggtga

SEQ ID NO: 117109 - DNA, 22 bp, Homo sapiens
actgcactccagcctgggtgac

SEQ ID NO: 117110 - DNA, 18 bp, Homo sapiens
gtcaggcatgaatctggg

SEQ ID NO: 117111 - DNA, 22 bp, Homo sapiens
actgcacttcagcctgggtgtc

SEQ ID NO: 117112 - DNA, 22 bp, Homo sapiens
cactgcactccagcttgggtga

SEQ ID NO: 117113 - DNA, 22 bp, Homo sapiens
agatttatgtggtcacactcag

SEQ ID NO: 117114 - DNA, 22 bp, Homo sapiens
ttgatacccaagtgttatgggt

SEQ ID NO: 117115 - DNA, 22 bp, Homo sapiens
actgcactcctgcctgggtaac

SEQ ID NO: 117116 - DNA, 22 bp, Homo sapiens
agttgcagacgcagagatgttg

SEQ ID NO: 117117 - DNA, 22 bp, Homo sapiens
gacaattgcttttgccgaataa

SEQ ID NO: 117118 - DNA, 22 bp, Homo sapiens
actgcacttcaccctgggtgac

SEQ ID NO: 117119 - DNA, 22 bp, Homo sapiens
aacccgggaggcagaggttgtg

SEQ ID NO: 117120 - DNA, 22 bp, Homo sapiens
tagatgaccttgtgttaggcaa

SEQ ID NO: 117121 - DNA, 22 bp, Homo sapiens
tagtatagattgaagcagatca

SEQ ID NO: 117122 - DNA, 22 bp, Homo sapiens
aagaatgagctcaaagatctta

SEQ ID NO: 117123 - DNA, 22 bp, Homo sapiens
cactgcactccagcctgggcaa

SEQ ID NO: 117124 - DNA, 22 bp, Homo sapiens
tatccgtgatgtttataaacca

SEQ ID NO: 117125 - DNA, 22 bp, Homo sapiens
atcacaaaggtctcagagcaca

SEQ ID NO: 117126 - DNA, 22 bp, Homo sapiens
agacggattacctgaggtcagg

SEQ ID NO: 117127 - DNA, 22 bp, Homo sapiens
gggttcagtccctcttgctact

SEQ ID NO: 117128 - DNA, 20 bp, Homo sapiens
ctgtggaattttaccatgcg

SEQ ID NO: 117129 - DNA, 22 bp, Homo sapiens
tggctaacaaggtgaaaccccg

SEQ ID NO: 117130 - DNA, 22 bp, Homo sapiens
tctgcgttgctcacgctgggag

SEQ ID NO: 117131 - DNA, 22 bp, Homo sapiens
cgcaccactgaattccagcctg

SEQ ID NO: 117132 - DNA, 22 bp, Homo sapiens
tctcatttacttccacaggctg

SEQ ID NO: 117133 - DNA, 22 bp, Homo sapiens
ccggctactcgggaggctgacg

SEQ ID NO: 117134 - DNA, 22 bp, Homo sapiens
caattgacaatgacagtgtcaa

SEQ ID NO: 117135 - DNA, 22 bp, Homo sapiens
gggcggatcatttgaggtcagg

SEQ ID NO: 117136 - DNA, 22 bp, Homo sapiens
caggcagaagaagtggaaggac

SEQ ID NO: 117137 - DNA, 22 bp, Homo sapiens
tcgcaccattgcactccagcca

SEQ ID NO: 117138 - DNA, 22 bp, Homo sapiens
gaagtattactctgaatgtatt

SEQ ID NO: 117139 - DNA, 22 bp, Homo sapiens
attgataaattgcaatggggct

SEQ ID NO: 117140 - DNA, 22 bp, Homo sapiens
actgcactccagcctgggtaac

SEQ ID NO: 117141 - DNA, 22 bp, Homo sapiens
actgcactccaacctgggtgac

SEQ ID NO: 117142 - DNA, 22 bp, Homo sapiens
aacctgggcttgaacagtgcct

SEQ ID NO: 117143 - DNA, 22 bp, Homo sapiens
actgcacttcagcctgggtgac

SEQ ID NO: 117144 - DNA, 22 bp, Homo sapiens
gagcctggagctggaacgaagc

SEQ ID NO: 117145 - DNA, 22 bp, Homo sapiens
ttcccttaaattatggcatcta

SEQ ID NO: 117146 - DNA, 22 bp, Homo sapiens
tcttgaattgtactcccataag

SEQ ID NO: 117147 - DNA, 22 bp, Homo sapiens
ctgtaatcccagctactcggga

SEQ ID NO: 117148 - DNA, 22 bp, Homo sapiens
gtccaagagtcaagaagggggc

SEQ ID NO: 117149 - DNA, 22 bp, Homo sapiens
ggctcagatggtttgttctaga

SEQ ID NO: 117150 - DNA, 22 bp, Homo sapiens
ttgtttccataattaagtgtga

SEQ ID NO: 117151 - DNA, 22 bp, Homo sapiens
agcttgtgtttttctaagtatc

SEQ ID NO: 117152 - DNA, 22 bp, Homo sapiens
cttgatctacatagtgaaaccc

SEQ ID NO: 117153 - DNA, 22 bp, Homo sapiens
tcactgcaacctccacctcccg

SEQ ID NO: 117154 - DNA, 22 bp, Homo sapiens
acaagaagggtgattaggggca

SEQ ID NO: 117155 - DNA, 22 bp, Homo sapiens
tccgggaggcagaggttgcagt

SEQ ID NO: 117156 - DNA, 22 bp, Homo sapiens
tcacagagatgaacttttgata

SEQ ID NO: 117157 - DNA, 22 bp, Homo sapiens
ccctggaggttgaggctgcagt

SEQ ID NO: 117158 - DNA, 22 bp, Homo sapiens
tgacagtgaacaggttaccact

SEQ ID NO: 117159 - DNA, 22 bp, Homo sapiens
tccttgtgctgagggtgttgct

SEQ ID NO: 117160 - DNA, 22 bp, Homo sapiens
tgcccaggctggagtgcagtgg

SEQ ID NO: 117161 - DNA, 22 bp, Homo sapiens
attctaatggcagagactcctg

SEQ ID NO: 117162 - DNA, 22 bp, Homo sapiens
tggggatcataaattgatggag

SEQ ID NO: 117163 - DNA, 22 bp, Homo sapiens
aagttactggcaagggctgcag

SEQ ID NO: 117164 - DNA, 22 bp, Homo sapiens
cggagtcttgctatgttgccca

SEQ ID NO: 117165 - DNA, 22 bp, Homo sapiens
aaccaccattctctcctcttcc

SEQ ID NO: 117166 - DNA, 22 bp, Homo sapiens
aagcctaggcctactctggttt

SEQ ID NO: 117167 - DNA, 18 bp, Homo sapiens
cagctgccagctcatgga

SEQ ID NO: 117168 - DNA, 22 bp, Homo sapiens
aaagatcacgtcccaggactcg

SEQ ID NO: 117169 - DNA, 22 bp, Homo sapiens
cgggttcacgccattctcctgc

SEQ ID NO: 117170 - DNA, 19 bp, Homo sapiens
ttctctgctacattctcag

SEQ ID NO: 117171 - DNA, 22 bp, Homo sapiens
aatatttcttctaaagcccttt

SEQ ID NO: 117172 - DNA, 22 bp, Homo sapiens
aactcaaagatgcatgacgctt

SEQ ID NO: 117173 - DNA, 22 bp, Homo sapiens
gaactctctcatctgtcagttg

SEQ ID NO: 117174 - DNA, 22 bp, Homo sapiens
tgttcagaacaaaggtaaatga

SEQ ID NO: 117175 - DNA, 22 bp, Homo sapiens
ccacagaattctgtctccagga

SEQ ID NO: 117176 - DNA, 19 bp, Homo sapiens
tctcacagctctactatgt

SEQ ID NO: 117177 - DNA, 22 bp, Homo sapiens
aagtgctgagactacaggcatg

SEQ ID NO: 117178 - DNA, 22 bp, Homo sapiens
ggcccaggctggagtgcagtgg

SEQ ID NO: 117179 - DNA, 22 bp, Homo sapiens
ctccagttggccccagttggtt

SEQ ID NO: 117180 - DNA, 22 bp, Homo sapiens
tgaggctccttgtagagagtgg

SEQ ID NO: 117181 - DNA, 22 bp, Homo sapiens
gttgctcaggcaggagtacagt

SEQ ID NO: 117182 - DNA, 22 bp, Homo sapiens
agaagccaccagctgaggaaga

SEQ ID NO: 117183 - DNA, 22 bp, Homo sapiens
atgcagtggcttcagtgtcagt

SEQ ID NO: 117184 - DNA, 22 bp, Homo sapiens
gcccagccacagtcactttcat

SEQ ID NO: 117185 - DNA, 22 bp, Homo sapiens
gagaaagctaaataagttgatt

SEQ ID NO: 117186 - DNA, 22 bp, Homo sapiens
tgcccagggtggagtgcagtgg

SEQ ID NO: 117187 - DNA, 22 bp, Homo sapiens
cacttgttggtggtgaaatcac

SEQ ID NO: 117188 - DNA, 22 bp, Homo sapiens
agcccaggctggagtgcagtgg

SEQ ID NO: 117189 - DNA, 22 bp, Homo sapiens
tcactgcaacctccacctcctg

SEQ ID NO: 117190 - DNA, 22 bp, Homo sapiens
acagcccagctctttctctgca

SEQ ID NO: 117191 - DNA, 22 bp, Homo sapiens
gaaactctcgcatcctgggaac

SEQ ID NO: 117192 - DNA, 22 bp, Homo sapiens
aaagcagaactgagagagctgg

SEQ ID NO: 117193 - DNA, 21 bp, Homo sapiens
ggagtttttctggaagggact

SEQ ID NO: 117194 - DNA, 22 bp, Homo sapiens
tttaaaaaactagtctgagtct

SEQ ID NO: 117195 - DNA, 22 bp, Homo sapiens
accctcaacaaattcactctat

SEQ ID NO: 117196 - DNA, 20 bp, Homo sapiens
tcaggtgacacacgtggcac

SEQ ID NO: 117197 - DNA, 22 bp, Homo sapiens
tgtttcctttctggtgagcata

SEQ ID NO: 117198 - DNA, 22 bp, Homo sapiens
tgagacgaagtcttgctctgtt

SEQ ID NO: 117199 - DNA, 22 bp, Homo sapiens
atctattttaaatggcagtaaa

SEQ ID NO: 117200 - DNA, 23 bp, Homo sapiens
aatggtcttcctccacccctctg

SEQ ID NO: 117201 - DNA, 22 bp, Homo sapiens
atggctagcaccgcgttgctgg

SEQ ID NO: 117202 - DNA, 22 bp, Homo sapiens
tctcgctctgtcgcccaggctg

SEQ ID NO: 117203 - DNA, 22 bp, Homo sapiens
aaatcggttggttcaaggtaat

SEQ ID NO: 117204 - DNA, 22 bp, Homo sapiens
tgacagtgcgggtacatcatag

SEQ ID NO: 117205 - DNA, 22 bp, Homo sapiens
gtgcatgtcggggtgcatgtca

SEQ ID NO: 117206 - DNA, 22 bp, Homo sapiens
cagctgcccctccagggctggg

SEQ ID NO: 117207 - DNA, 22 bp, Homo sapiens
ttccttacattcatatggcttc

SEQ ID NO: 117208 - DNA, 22 bp, Homo sapiens
ggatgttctggggttctcttgt

SEQ ID NO: 117209 - DNA, 22 bp, Homo sapiens
accagaagctggagcacaagga

SEQ ID NO: 117210 - DNA, 22 bp, Homo sapiens
cacccaggcaaggattctgcaa

SEQ ID NO: 117211 - DNA, 22 bp, Homo sapiens
ctaaagtgccaggaatacaggt

SEQ ID NO: 117212 - DNA, 22 bp, Homo sapiens
accctggaggtggaggtgcagt

SEQ ID NO: 117213 - DNA, 22 bp, Homo sapiens
tgcacgtgtgagcattcacatg

SEQ ID NO: 117214 - DNA, 22 bp, Homo sapiens
ctgaggagaggtggcctgtgtt

SEQ ID NO: 117215 - DNA, 22 bp, Homo sapiens
ctctgctgtgccgccagggcct

SEQ ID NO: 117216 - DNA, 22 bp, Homo sapiens
ggatgttgattgaatggccatt

SEQ ID NO: 117217 - DNA, 22 bp, Homo sapiens
agcccaggttgaggctgcagtg

SEQ ID NO: 117218 - DNA, 22 bp, Homo sapiens
tttgaggttagctagcagatca

SEQ ID NO: 117219 - DNA, 22 bp, Homo sapiens
tgcccaggctggagtacagtgg

SEQ ID NO: 117220 - DNA, 22 bp, Homo sapiens
aagtgctgggattacaggcatg

SEQ ID NO: 117221 - DNA, 22 bp, Homo sapiens
acagaactgggaaatgcacata

SEQ ID NO: 117222 - DNA, 22 bp, Homo sapiens
atgttctacagatggaaagggg

SEQ ID NO: 117223 - DNA, 22 bp, Homo sapiens
ttgagactgagtctcgccctgt

SEQ ID NO: 117224 - DNA, 22 bp, Homo sapiens
cctcggaggcggaggctgcagt

SEQ ID NO: 117225 - DNA, 22 bp, Homo sapiens
tacttttcctggaaccactgct

SEQ ID NO: 117226 - DNA, 22 bp, Homo sapiens
gcctggagaaaggaaggtggga

SEQ ID NO: 117227 - DNA, 22 bp, Homo sapiens
acatttatataactcactagga

SEQ ID NO: 117228 - DNA, 22 bp, Homo sapiens
tttctaatctgattctcctacc

SEQ ID NO: 117229 - DNA, 22 bp, Homo sapiens
ggaggtggaggttgcagtgagc

SEQ ID NO: 117230 - DNA, 20 bp, Homo sapiens
aaaatatgtataactcttct

SEQ ID NO: 117231 - DNA, 22 bp, Homo sapiens
gttctgagtcctcctttgaagg

SEQ ID NO: 117232 - DNA, 21 bp, Homo sapiens
caatggcgagatcttggctca

SEQ ID NO: 117233 - DNA, 22 bp, Homo sapiens
tgcctaggctggagtgtagtgg

SEQ ID NO: 117234 - DNA, 22 bp, Homo sapiens
gggaagtgatggagccaggatt

SEQ ID NO: 117235 - DNA, 22 bp, Homo sapiens
gctggagaggatcccaaagcca

SEQ ID NO: 117236 - DNA, 22 bp, Homo sapiens
gccgggaccaaggccacggagc

SEQ ID NO: 117237 - DNA, 22 bp, Homo sapiens
gggccatgagaggttcatcaac

SEQ ID NO: 117238 - DNA, 22 bp, Homo sapiens
tagtgccctcccctttgggata

SEQ ID NO: 117239 - DNA, 22 bp, Homo sapiens
gacccaggggcagggagaaagt

SEQ ID NO: 117240 - DNA, 22 bp, Homo sapiens
gtgccactgcactctagcctag

SEQ ID NO: 117241 - DNA, 22 bp, Homo sapiens
caaccccactacacgttggaga

SEQ ID NO: 117242 - DNA, 22 bp, Homo sapiens
actgtacctcaaactctggaac

SEQ ID NO: 117243 - DNA, 22 bp, Homo sapiens
acgcccagactcccatactttg

SEQ ID NO: 117244 - DNA, 22 bp, Homo sapiens
ccttgctcaagctagtgacggg

SEQ ID NO: 117245 - DNA, 22 bp, Homo sapiens
acccgggaggcaggagtcatag

SEQ ID NO: 117246 - DNA, 22 bp, Homo sapiens
gcgccccatctacagtactttt

SEQ ID NO: 117247 - DNA, 22 bp, Homo sapiens
cacccaggctggagtgcagtgg

SEQ ID NO: 117248 - DNA, 22 bp, Homo sapiens
ctgggagtggtgacagctctcg

SEQ ID NO: 117249 - DNA, 22 bp, Homo sapiens
ctggcaggagcattcacagagg

SEQ ID NO: 117250 - DNA, 22 bp, Homo sapiens
gctggcagacttcctctggaac

SEQ ID NO: 117251 - DNA, 22 bp, Homo sapiens
gcagaggacacaggagggcaag

SEQ ID NO: 117252 - DNA, 22 bp, Homo sapiens
cccaggaattggaggctgcagt

SEQ ID NO: 117253 - DNA, 22 bp, Homo sapiens
gcagggtctgaggccacagagg

SEQ ID NO: 117254 - DNA, 22 bp, Homo sapiens
agcctgggccctgcctcttctc

SEQ ID NO: 117255 - DNA, 17 bp, Homo sapiens
cgggcatggagggcagg

SEQ ID NO: 117256 - DNA, 17 bp, Homo sapiens
ggctgcagtccaggagg

SEQ ID NO: 117257 - DNA, 22 bp, Homo sapiens
gctgctctcagagctcatgctg

SEQ ID NO: 117258 - DNA, 22 bp, Homo sapiens
ctgggctagaaggaccaggatg

SEQ ID NO: 117259 - DNA, 19 bp, Homo sapiens
gactccaactttaagcatg

SEQ ID NO: 117260 - DNA, 22 bp, Homo sapiens
agtgaccgaggcacttggcaac

SEQ ID NO: 117261 - DNA, 22 bp, Homo sapiens
gctgggctgcgtcggggaagcc

SEQ ID NO: 117262 - DNA, 22 bp, Homo sapiens
ggggaccctcaggactgcgtct

SEQ ID NO: 117263 - DNA, 21 bp, Homo sapiens
ctggaggcaggtggtgccagg

SEQ ID NO: 117264 - DNA, 22 bp, Homo sapiens
ggcctgggctccgggagttact

SEQ ID NO: 117265 - DNA, 22 bp, Homo sapiens
gccatgcttggtatgctgtgag

SEQ ID NO: 117266 - DNA, 22 bp, Homo sapiens
aacccaggagttggaggctgtg

SEQ ID NO: 117267 - DNA, 22 bp, Homo sapiens
ggaactcctgctccaagcagct

SEQ ID NO: 117268 - DNA, 22 bp, Homo sapiens
tggtctgctgaacagccgtatc

SEQ ID NO: 117269 - DNA, 22 bp, Homo sapiens
ttcctagggcagagccgctggg

SEQ ID NO: 117270 - DNA, 21 bp, Homo sapiens
tgactgaggcttcttcacaca

SEQ ID NO: 117271 - DNA, 22 bp, Homo sapiens
acccaggctggagtgcagtggc

SEQ ID NO: 117272 - DNA, 22 bp, Homo sapiens
ggggccgaccgcggttcaggcc

SEQ ID NO: 117273 - DNA, 22 bp, Homo sapiens
gctccctggtagccatgctctc

SEQ ID NO: 117274 - DNA, 20 bp, Homo sapiens
acgtggccaccagtggctta

SEQ ID NO: 117275 - DNA, 22 bp, Homo sapiens
cctggaagttggaggttgcagt

SEQ ID NO: 117276 - DNA, 22 bp, Homo sapiens
aacccaggaggcggaggttgtg

SEQ ID NO: 117277 - DNA, 18 bp, Homo sapiens
gaccccgggatctgtcga

SEQ ID NO: 117278 - DNA, 22 bp, Homo sapiens
acccaggccattggcaagagtc

SEQ ID NO: 117279 - DNA, 22 bp, Homo sapiens
acccaggctggcgtgcagtggc

SEQ ID NO: 117280 - DNA, 22 bp, Homo sapiens
acccaggctggagtgcagtgat

SEQ ID NO: 117281 - DNA, 22 bp, Homo sapiens
ccggagtgtctggcctgctggg

SEQ ID NO: 117282 - DNA, 22 bp, Homo sapiens
aagcctggactatcgcgtgtgc

SEQ ID NO: 117283 - DNA, 22 bp, Homo sapiens
acagcccagctctttctctgca

SEQ ID NO: 117284 - DNA, 22 bp, Homo sapiens
cccacgtcgaacttgctccaga

SEQ ID NO: 117285 - DNA, 22 bp, Homo sapiens
agctgccgatgcccagctgcat

SEQ ID NO: 117286 - DNA, 22 bp, Homo sapiens
ggcgctcagtgttgccccagag

SEQ ID NO: 117287 - DNA, 19 bp, Homo sapiens
gttggcactgaaaatggct

SEQ ID NO: 117288 - DNA, 22 bp, Homo sapiens
gaggagggagctggaagctctt

SEQ ID NO: 117289 - DNA, 22 bp, Homo sapiens
cacccaggttggagtgcagtgg

SEQ ID NO: 117290 - DNA, 22 bp, Homo sapiens
tggttgtggtcctccacatcgc

SEQ ID NO: 117291 - DNA, 22 bp, Homo sapiens
acgtggcggccgccgtgagcgg

SEQ ID NO: 117292 - DNA, 22 bp, Homo sapiens
agcgccactgcactccagcctg

SEQ ID NO: 117293 - DNA, 22 bp, Homo sapiens
cggtcaggtgcagcgttggcac

SEQ ID NO: 117294 - DNA, 22 bp, Homo sapiens
agaggccggccgagcccatggg

SEQ ID NO: 117295 - DNA, 22 bp, Homo sapiens
ggtcacgtgaccgcacctgcct

SEQ ID NO: 117296 - DNA, 22 bp, Homo sapiens
acccaggctggagtgcagtggg

SEQ ID NO: 117297 - DNA, 22 bp, Homo sapiens
taggcatgcaaataaatgtgca

SEQ ID NO: 117298 - DNA, 22 bp, Homo sapiens
tcctgggacaagccgtggaagt

SEQ ID NO: 117299 - DNA, 22 bp, Homo sapiens
aacccagggtggaggttgcagt

SEQ ID NO: 117300 - DNA, 22 bp, Homo sapiens
ctccagttggccccagttggtt

SEQ ID NO: 117301 - DNA, 22 bp, Homo sapiens
accccaggaagtggaggtcatg

SEQ ID NO: 117302 - DNA, 22 bp, Homo sapiens
cacccaggcaaggattctgcaa

SEQ ID NO: 117303 - DNA, 22 bp, Homo sapiens
ccactgtgcccagcctcatggg

SEQ ID NO: 117304 - DNA, 22 bp, Homo sapiens
cacgcctgtaatcccagcactt

SEQ ID NO: 117305 - DNA, 22 bp, Homo sapiens
ctgcatccatgttgctgcaaag

SEQ ID NO: 117306 - DNA, 22 bp, Homo sapiens
accaggcccgctgctatggtgg

SEQ ID NO: 117307 - DNA, 22 bp, Homo sapiens
tgcgcctctaatctcgggcgtc

SEQ ID NO: 117308 - DNA, 22 bp, Homo sapiens
aacccaggagccggaggttgtg

SEQ ID NO: 117309 - DNA, 22 bp, Homo sapiens
tctcaagcttgttggtatgttt

SEQ ID NO: 117310 - DNA, 22 bp, Homo sapiens
ttccagctaactcacatccctt

SEQ ID NO: 117311 - DNA, 22 bp, Homo sapiens
tgccgcagtgcggggagggccc

SEQ ID NO: 117312 - DNA, 22 bp, Homo sapiens
cacccaggctggagtgcagtga

SEQ ID NO: 117313 - DNA, 22 bp, Homo sapiens
cacccaggctggaatgcagtgg

SEQ ID NO: 117314 - DNA, 22 bp, Homo sapiens
cccgtgtgtgcgaggctcccgc

SEQ ID NO: 117315 - DNA, 22 bp, Homo sapiens
cctggcaggtggcgccctcggc

SEQ ID NO: 117316 - DNA, 22 bp, Homo sapiens
cacccaggctggattgcagtgg

SEQ ID NO: 117317 - DNA, 22 bp, Homo sapiens
aaccccgctcaggctgggtgag

SEQ ID NO: 117318 - DNA, 22 bp, Homo sapiens
ccgggagcaggcgccaccgcca

SEQ ID NO: 117319 - DNA, 22 bp, Homo sapiens
gtgccgcgacgcagtcggtgcc

SEQ ID NO: 117320 - DNA, 22 bp, Homo sapiens
acccaggagacggaggtgcagt

SEQ ID NO: 117321 - DNA, 22 bp, Homo sapiens
aagctgcagcacagagaggtgg

SEQ ID NO: 117322 - DNA, 22 bp, Homo sapiens
gcgagcctctggagtcctctgg

SEQ ID NO: 117323 - DNA, 22 bp, Homo sapiens
cggggccctggggctgaaggtc

SEQ ID NO: 117324 - DNA, 22 bp, Homo sapiens
gtggggcctgtggcttccgtgg

SEQ ID NO: 117325 - DNA, 22 bp, Homo sapiens
tccctctacagggaagcgcttt

SEQ ID NO: 117326 - DNA, 22 bp, Homo sapiens
ggctccccaggtccaggagctg

SEQ ID NO: 117327 - DNA, 21 bp, Homo sapiens
tcacgtggtcacatgagcttt

SEQ ID NO: 117328 - DNA, 22 bp, Homo sapiens
cgtgtggacatgactagctgcc

SEQ ID NO: 117329 - DNA, 22 bp, Homo sapiens
agcggcgccgagcttggccagg

SEQ ID NO: 117330 - DNA, 22 bp, Homo sapiens
gggctgcatcagcaggacccgg

SEQ ID NO: 117331 - DNA, 22 bp, Homo sapiens
ggacacgtggctgaaggcggcc

SEQ ID NO: 117332 - DNA, 22 bp, Homo sapiens
agcccaggagtttgaggctgtg

SEQ ID NO: 117333 - DNA, 22 bp, Homo sapiens
tcgcccaggctggaagtgcagt

SEQ ID NO: 117334 - DNA, 22 bp, Homo sapiens
gtgcgcaccctcccggcatccc

SEQ ID NO: 117335 - DNA, 22 bp, Homo sapiens
cacccaggctggagagcagtgg

SEQ ID NO: 117336 - DNA, 22 bp, Homo sapiens
aacccaggagacaggttgcagt

SEQ ID NO: 117337 - DNA, 22 bp, Homo sapiens
gtcactgtatccaggttccagc

SEQ ID NO: 117338 - DNA, 22 bp, Homo sapiens
aacccaggaggtggaggttgtg

SEQ ID NO: 117339 - DNA, 22 bp, Homo sapiens
cggagcctgcttgttgcagctg

SEQ ID NO: 117340 - DNA, 22 bp, Homo sapiens
aacccaggagatggaggttgtg

SEQ ID NO: 117341 - DNA, 22 bp, Homo sapiens
ttgcagcccgggttggtttgtg

SEQ ID NO: 117342 - DNA, 22 bp, Homo sapiens
gcgggccaccttggagagcgct

SEQ ID NO: 117343 - DNA, 22 bp, Homo sapiens
tgcactccaggctgggtgacag

SEQ ID NO: 117344 - DNA, 22 bp, Homo sapiens
acacccaggctggcgtgcagtg

SEQ ID NO: 117345 - DNA, 22 bp, Homo sapiens
agacgcggtggtgcatgcctgt

SEQ ID NO: 117346 - DNA, 21 bp, Homo sapiens
cagggccaatcctgacctcta

SEQ ID NO: 117347 - DNA, 22 bp, Homo sapiens
ggagagtggattccagctgtat

SEQ ID NO: 117348 - DNA, 23 bp, Homo sapiens
gcagaggagcaagctggacacca

SEQ ID NO: 117349 - DNA, 22 bp, Homo sapiens
agcctgggcaacagagcaaaac

SEQ ID NO: 117350 - DNA, 22 bp, Homo sapiens
tcagcctgctccaagtgctgcc

SEQ ID NO: 117351 - DNA, 23 bp, Homo sapiens
aaataggagtatctggatcatga

SEQ ID NO: 117352 - DNA, 22 bp, Homo sapiens
gtgacaatattagctcaggggc

SEQ ID NO: 117353 - DNA, 22 bp, Homo sapiens
aggattgtgcctccagtcagaa

SEQ ID NO: 117354 - DNA, 22 bp, Homo sapiens
gagccaggttggaggctgcagt

SEQ ID NO: 117355 - DNA, 22 bp, Homo sapiens
tgtgtcagaaggcaatggggat

SEQ ID NO: 117356 - DNA, 22 bp, Homo sapiens
agggccagcactcctggcagga

SEQ ID NO: 117357 - DNA, 22 bp, Homo sapiens
ccctctctgctgcatagaggaa

SEQ ID NO: 117358 - DNA, 23 bp, Homo sapiens
cagagctggctcagagctgcctg

SEQ ID NO: 117359 - DNA, 22 bp, Homo sapiens
agatttatgtggtcacactcag

SEQ ID NO: 117360 - DNA, 22 bp, Homo sapiens
aatggctctgatgttgttgtga

SEQ ID NO: 117361 - DNA, 22 bp, Homo sapiens
tggagccagagcgcagcctggg

SEQ ID NO: 117362 - DNA, 22 bp, Homo sapiens
gggtacagttcttccagtgtca

SEQ ID NO: 117363 - DNA, 22 bp, Homo sapiens
cagccctcctaccctgccaggc

SEQ ID NO: 117364 - DNA, 22 bp, Homo sapiens
cttgaggctgcactccagggcc

SEQ ID NO: 117365 - DNA, 22 bp, Homo sapiens
tcctgggaggcggaggttgcag

SEQ ID NO: 117366 - DNA, 22 bp, Homo sapiens
agcctctcagagtgctgggatt

SEQ ID NO: 117367 - DNA, 19 bp, Homo sapiens
tcctgcctggggccgcctg

SEQ ID NO: 117368 - DNA, 23 bp, Homo sapiens
gcctgggagttgcgatctgcccg

SEQ ID NO: 117369 - DNA, 22 bp, Homo sapiens
tgggaacagaggacttgactgt

SEQ ID NO: 117370 - DNA, 22 bp, Homo sapiens
tgcctaggctggagtgtagtgg

SEQ ID NO: 117371 - DNA, 22 bp, Homo sapiens
ccaggagctggagggtgcagtg

SEQ ID NO: 117372 - DNA, 22 bp, Homo sapiens
agggcgacaatggagagcgttt

SEQ ID NO: 117373 - DNA, 22 bp, Homo sapiens
gggctgggattgcttgctgtga

SEQ ID NO: 117374 - DNA, 20 bp, Homo sapiens
ctcttccggaggggcgctcc

SEQ ID NO: 117375 - DNA, 22 bp, Homo sapiens
cccaggaggtcgaagctgcagt

SEQ ID NO: 117376 - DNA, 22 bp, Homo sapiens
ccagagctgattcctgggactt

SEQ ID NO: 117377 - DNA, 22 bp, Homo sapiens
tgctgggattacagtcatgagc

SEQ ID NO: 117378 - DNA, 22 bp, Homo sapiens
ctcttagtaatgccatgaagca

SEQ ID NO: 117379 - DNA, 22 bp, Homo sapiens
tcctgggacaagccgtggaagt

SEQ ID NO: 117380 - DNA, 22 bp, Homo sapiens
agcctgggccctgcctcttctc

SEQ ID NO: 117381 - DNA, 22 bp, Homo sapiens
tgcccaggctggagtgcagtgg

SEQ ID NO: 117382 - DNA, 22 bp, Homo sapiens
tccaggctttggggcaggagcg

SEQ ID NO: 117383 - DNA, 22 bp, Homo sapiens
ctgtcctggggaaagccagccc

SEQ ID NO: 117384 - DNA, 22 bp, Homo sapiens
gagccaggaggcagagactgca

SEQ ID NO: 117385 - DNA, 22 bp, Homo sapiens
tgagagcctgtgttcaaatgcc

SEQ ID NO: 117386 - DNA, 18 bp, Homo sapiens
taggttacagccagccag

SEQ ID NO: 117387 - DNA, 22 bp, Homo sapiens
agggctggagccacagctggga

SEQ ID NO: 117388 - DNA, 22 bp, Homo sapiens
ccctcccagatgggcttgaggt

SEQ ID NO: 117389 - DNA, 21 bp, Homo sapiens
cagggccaatcctgacctcta

SEQ ID NO: 117390 - DNA, 22 bp, Homo sapiens
aggagcagaccgtagtcctgca

SEQ ID NO: 117391 - DNA, 22 bp, Homo sapiens
aggaaggcttctttggtcttct

SEQ ID NO: 117392 - DNA, 22 bp, Homo sapiens
tctgaggctgaatggactccgt

SEQ ID NO: 117393 - DNA, 22 bp, Homo sapiens
cgggagcctctgggtcacactg

SEQ ID NO: 117394 - DNA, 22 bp, Homo sapiens
gccagggtcctgaagaccaagt

SEQ ID NO: 117395 - DNA, 22 bp, Homo sapiens
agaggccggccgagcccatggg

SEQ ID NO: 117396 - DNA, 22 bp, Homo sapiens
gcatggcttcggggtgctgcct

SEQ ID NO: 117397 - DNA, 19 bp, Homo sapiens
caggcctcttaccctctct

SEQ ID NO: 117398 - DNA, 22 bp, Homo sapiens
cggctggtgtcgggcacagcaa

SEQ ID NO: 117399 - DNA, 22 bp, Homo sapiens
aagaggttgtctgtgatgagtt

SEQ ID NO: 117400 - DNA, 22 bp, Homo sapiens
gagcccaggaagtggaggctga

SEQ ID NO: 117401 - DNA, 23 bp, Homo sapiens
ggctgggagctccgggtgcacgt

SEQ ID NO: 117402 - DNA, 22 bp, Homo sapiens
ctgggcagctgtatcagggagt

SEQ ID NO: 117403 - DNA, 22 bp, Homo sapiens
tgaggcaggagttcaggctgcg

SEQ ID NO: 117404 - DNA, 22 bp, Homo sapiens
ccagaccctccattcaagctcc

SEQ ID NO: 117405 - DNA, 22 bp, Homo sapiens
tgcctccaacagcccatcctag

SEQ ID NO: 117406 - DNA, 22 bp, Homo sapiens
gccgtgtcatctgcgggtggca

SEQ ID NO: 117407 - DNA, 22 bp, Homo sapiens
aggagccagtggagttcctgcc

SEQ ID NO: 117408 - DNA, 19 bp, Homo sapiens
ctgctgccggagactcgtc

SEQ ID NO: 117409 - DNA, 22 bp, Homo sapiens
cgtgattggcttctgcattgga

SEQ ID NO: 117410 - DNA, 22 bp, Homo sapiens
cctgaccaacgtggtgaaaccc

SEQ ID NO: 117411 - DNA, 22 bp, Homo sapiens
gcctgtgtggatgcgccggtgc

SEQ ID NO: 117412 - DNA, 21 bp, Homo sapiens
ccagagcctgagaggattatg

SEQ ID NO: 117413 - DNA, 23 bp, Homo sapiens
tgaggcaggcggatcacgaggtc

SEQ ID NO: 117414 - DNA, 22 bp, Homo sapiens
gaccacacttttcccctgctag

SEQ ID NO: 117415 - DNA, 22 bp, Homo sapiens
gaagccttgaactgcaaacccc

SEQ ID NO: 117416 - DNA, 22 bp, Homo sapiens
ctctgcctgtctcatcctgcaa

SEQ ID NO: 117417 - DNA, 22 bp, Homo sapiens
gggctagcctcttccctgctcc

SEQ ID NO: 117418 - DNA, 22 bp, Homo sapiens
tgcccagggtggagtgcagtgg

SEQ ID NO: 117419 - DNA, 22 bp, Homo sapiens
acccgggcaaggattctgagag

SEQ ID NO: 117420 - DNA, 22 bp, Homo sapiens
gcctggccaacgtggtgaaacc

SEQ ID NO: 117421 - DNA, 22 bp, Homo sapiens
cagcctggtccccggctcaccc

SEQ ID NO: 117422 - DNA, 22 bp, Homo sapiens
aacccaggagttggaggctgtg

SEQ ID NO: 117423 - DNA, 22 bp, Homo sapiens
ggagaagaggagctggaagcct

SEQ ID NO: 117424 - DNA, 22 bp, Homo sapiens
ggcagagcttgcagtgagccga

SEQ ID NO: 117425 - DNA, 22 bp, Homo sapiens
gcccagtggtaaaagcaggcct

SEQ ID NO: 117426 - DNA, 22 bp, Homo sapiens
ggggaccctcaggactgcgtct

SEQ ID NO: 117427 - DNA, 22 bp, Homo sapiens
tggattcacaccattctcctgc

SEQ ID NO: 117428 - DNA, 22 bp, Homo sapiens
aaccaccattctctcctcttcc

SEQ ID NO: 117429 - DNA, 22 bp, Homo sapiens
aaggccttgccgaaggatgcca

SEQ ID NO: 117430 - DNA, 22 bp, Homo sapiens
gttccaggtggtcacagagctc

SEQ ID NO: 117431 - DNA, 22 bp, Homo sapiens
cacccaggcaaggattctgcaa

SEQ ID NO: 117432 - DNA, 22 bp, Homo sapiens
cttgtcagccaattgtggattt

SEQ ID NO: 117433 - DNA, 22 bp, Homo sapiens
gcctccagcccacgcaggcctg

SEQ ID NO: 117434 - DNA, 22 bp, Homo sapiens
tccttaggcaatttgggagagt

SEQ ID NO: 117435 - DNA, 22 bp, Homo sapiens
ggtgacagtggttaaaatttgt

SEQ ID NO: 117436 - DNA, 22 bp, Homo sapiens
gggagctggagctggaagactc

SEQ ID NO: 117437 - DNA, 22 bp, Homo sapiens
ctgagggtcaacttgattgtat

SEQ ID NO: 117438 - DNA, 22 bp, Homo sapiens
ggcctggcagagcgcgcggctg

SEQ ID NO: 117439 - DNA, 22 bp, Homo sapiens
cctgggccctcaccgccggtgg

SEQ ID NO: 117440 - DNA, 22 bp, Homo sapiens
cggctgggttcggctgcaggcc

SEQ ID NO: 117441 - DNA, 22 bp, Homo sapiens
cagaccagaaggaagccgacaa

SEQ ID NO: 117442 - DNA, 18 bp, Homo sapiens
atggtctcatactgggag

SEQ ID NO: 117443 - DNA, 22 bp, Homo sapiens
gagccaggtcgggccgcggcga

SEQ ID NO: 117444 - DNA, 22 bp, Homo sapiens
ctcccggctgctccggctcccg

SEQ ID NO: 117445 - DNA, 22 bp, Homo sapiens
ctcctctttagccccagctgga

SEQ ID NO: 117446 - DNA, 22 bp, Homo sapiens
gggcctgtgtgttcaggagcct

SEQ ID NO: 117447 - DNA, 22 bp, Homo sapiens
tgaggcaggaggattgcaggat

SEQ ID NO: 117448 - DNA, 22 bp, Homo sapiens
cctgtctctgcagggccctgcc

SEQ ID NO: 117449 - DNA, 21 bp, Homo sapiens
ggcctcccggaccgcagcgcc

SEQ ID NO: 117450 - DNA, 22 bp, Homo sapiens
ccctgggattcaatttcactct

SEQ ID NO: 117451 - DNA, 22 bp, Homo sapiens
gagccaggggtcagctccgagg

SEQ ID NO: 117452 - DNA, 22 bp, Homo sapiens
cctgaccagcaggacgggggca

SEQ ID NO: 117453 - DNA, 22 bp, Homo sapiens
agcctgggcaacagagcaaaac

SEQ ID NO: 117454 - DNA, 22 bp, Homo sapiens
ggccaggcgatgacccctccac

SEQ ID NO: 117455 - DNA, 22 bp, Homo sapiens
tcagggctgcagaagaggcagg

SEQ ID NO: 117456 - DNA, 22 bp, Homo sapiens
ccacccttgggttcggaggccg

SEQ ID NO: 117457 - DNA, 22 bp, Homo sapiens
ctgaggcctctcccactccagc

SEQ ID NO: 117458 - DNA, 22 bp, Homo sapiens
cccaggaggcagaagttgcagt

SEQ ID NO: 117459 - DNA, 23 bp, Homo sapiens
agcagccagagatcctcggccct

SEQ ID NO: 117460 - DNA, 22 bp, Homo sapiens
cccagagcatgtgctgcctttg

SEQ ID NO: 117461 - DNA, 22 bp, Homo sapiens
ggctgggcctctccctcagctg

SEQ ID NO: 117462 - DNA, 22 bp, Homo sapiens
gcctgtcccgcaccggagcccg

SEQ ID NO: 117463 - DNA, 22 bp, Homo sapiens
ggcctgggctccgggagttact

SEQ ID NO: 117464 - DNA, 22 bp, Homo sapiens
cgccaggcttggtagctcatgc

SEQ ID NO: 117465 - DNA, 22 bp, Homo sapiens
tctctcttttttgaacccgctc

SEQ ID NO: 117466 - DNA, 22 bp, Homo sapiens
tcctgggatcaagtgatcctcc

SEQ ID NO: 117467 - DNA, 22 bp, Homo sapiens
accacccagccagcttctccct

SEQ ID NO: 117468 - DNA, 20 bp, Homo sapiens
ccagagctgatggctgcccg

SEQ ID NO: 117469 - DNA, 22 bp, Homo sapiens
tactgtgtgcccagccgagctg

SEQ ID NO: 117470 - DNA, 22 bp, Homo sapiens
ggggcattgtgtctgggttcct

SEQ ID NO: 117471 - DNA, 22 bp, Homo sapiens
tcagtgtgaattcaggagccta

SEQ ID NO: 117472 - DNA, 22 bp, Homo sapiens
tgcctccctggcaagtctctcc

SEQ ID NO: 117473 - DNA, 22 bp, Homo sapiens
cttctggcgttggaggtctgag

SEQ ID NO: 117474 - DNA, 18 bp, Homo sapiens
agcatcactgatcatcct

SEQ ID NO: 117475 - DNA, 22 bp, Homo sapiens
gggagctggagctggaagactc

SEQ ID NO: 117476 - DNA, 22 bp, Homo sapiens
cagagagaatcttggcagctga

SEQ ID NO: 117477 - DNA, 22 bp, Homo sapiens
ttctgtgctcaaaactttccaa

SEQ ID NO: 117478 - DNA, 22 bp, Homo sapiens
cttggggcagcccaggctgagc

SEQ ID NO: 117479 - DNA, 22 bp, Homo sapiens
ttggggtcccacaggctgcctg

SEQ ID NO: 117480 - DNA, 23 bp, Homo sapiens
tcagaacagttcttggtgcatag

SEQ ID NO: 117481 - DNA, 22 bp, Homo sapiens
gggacgacaggctctgtggtag

SEQ ID NO: 117482 - DNA, 22 bp, Homo sapiens
ctgctctgctgatcagtgtctc

SEQ ID NO: 117483 - DNA, 22 bp, Homo sapiens
tggggtacttgtatcaaagcac

SEQ ID NO: 117484 - DNA, 22 bp, Homo sapiens
agtcaaagatgaccgagttcct

SEQ ID NO: 117485 - DNA, 22 bp, Homo sapiens
tgtgagaaatataggccgtgct

SEQ ID NO: 117486 - DNA, 22 bp, Homo sapiens
tcccagagctctggaggttgga

SEQ ID NO: 117487 - DNA, 17 bp, Homo sapiens
cgggcatggagggcagg

SEQ ID NO: 117488 - DNA, 22 bp, Homo sapiens
ggcctcgcggcttctggtggct

SEQ ID NO: 117489 - DNA, 22 bp, Homo sapiens
gctcccaccttaaccttcacat

SEQ ID NO: 117490 - DNA, 22 bp, Homo sapiens
aggctctcaccctctgaccaga

SEQ ID NO: 117491 - DNA, 22 bp, Homo sapiens
ctggcctaaaaatacagaacaa

SEQ ID NO: 117492 - DNA, 22 bp, Homo sapiens
ccaggaggcggaaggtacagtg

SEQ ID NO: 117493 - DNA, 22 bp, Homo sapiens
gagtgggaatgttctaagaatt

SEQ ID NO: 117494 - DNA, 22 bp, Homo sapiens
tagcccctgcctttgaacctgg

SEQ ID NO: 117495 - DNA, 18 bp, Homo sapiens
tgagagcattcgaggcaa

SEQ ID NO: 117496 - DNA, 22 bp, Homo sapiens
cagggccagcgtctcgggctat

SEQ ID NO: 117497 - DNA, 19 bp, Homo sapiens
gggcttggggctgaagcct

SEQ ID NO: 117498 - DNA, 23 bp, Homo sapiens
atgacactcctgtgcgcaccctg

SEQ ID NO: 117499 - DNA, 22 bp, Homo sapiens
cccaggaggcagagatagcagt

SEQ ID NO: 117500 - DNA, 22 bp, Homo sapiens
tgctgtgaggttgagaaggaag

SEQ ID NO: 117501 - DNA, 22 bp, Homo sapiens
gatttgtggtgtgaggaagagc

SEQ ID NO: 117502 - DNA, 22 bp, Homo sapiens
caccctccagctcccgggggct

SEQ ID NO: 117503 - DNA, 22 bp, Homo sapiens
gctgtggcctggcgcagagctg

SEQ ID NO: 117504 - DNA, 22 bp, Homo sapiens
caagcttgtttctcctgggggt

SEQ ID NO: 117505 - DNA, 22 bp, Homo sapiens
gcagggcacaaggacgcacagg

SEQ ID NO: 117506 - DNA, 22 bp, Homo sapiens
cggctggtgtcgggcacagcaa

SEQ ID NO: 117507 - DNA, 22 bp, Homo sapiens
tagactagaggatcagcaaggg

SEQ ID NO: 117508 - DNA, 22 bp, Homo sapiens
cctccaaccataggtccagggg

SEQ ID NO: 117509 - DNA, 22 bp, Homo sapiens
cccaggaagtggaggttgcagt

SEQ ID NO: 117510 - DNA, 22 bp, Homo sapiens
ggcagagcttgcagtgagccga

SEQ ID NO: 117511 - DNA, 22 bp, Homo sapiens
tcacccaggctggagtgtagtg

SEQ ID NO: 117512 - DNA, 22 bp, Homo sapiens
gtggcagagccaaggctggagc

SEQ ID NO: 117513 - DNA, 22 bp, Homo sapiens
tggagccagagcgcagcctggg

SEQ ID NO: 117514 - DNA, 22 bp, Homo sapiens
tcctcagaatcacctggcagct

SEQ ID NO: 117515 - DNA, 22 bp, Homo sapiens
cccggacagaggggcagagtgt

SEQ ID NO: 117516 - DNA, 22 bp, Homo sapiens
agagcagctcgctacctctcta

SEQ ID NO: 117517 - DNA, 22 bp, Homo sapiens
catgatggggaatgttaaggga

SEQ ID NO: 117518 - DNA, 22 bp, Homo sapiens
accacctcatcaagctggattg

SEQ ID NO: 117519 - DNA, 22 bp, Homo sapiens
attaagtgactaaagtaatgct

SEQ ID NO: 117520 - DNA, 22 bp, Homo sapiens
tggcagtggcgggactcagggc

SEQ ID NO: 117521 - DNA, 22 bp, Homo sapiens
agggctggagccacagctggga

SEQ ID NO: 117522 - DNA, 22 bp, Homo sapiens
gggttgaggcggatgtcggcgg

SEQ ID NO: 117523 - DNA, 22 bp, Homo sapiens
caggaaggggctcactctggcc

SEQ ID NO: 117524 - DNA, 22 bp, Homo sapiens
tcccagattcctgctcttatat

SEQ ID NO: 117525 - DNA, 22 bp, Homo sapiens
gtggtgtaggtcacagttagga

SEQ ID NO: 117526 - DNA, 22 bp, Homo sapiens
ccttcccatgcagcctgtctga

SEQ ID NO: 117527 - DNA, 22 bp, Homo sapiens
tagaaaagccccagctggaggg

SEQ ID NO: 117528 - DNA, 22 bp, Homo sapiens
aggctcagatccttgtgtcctg

SEQ ID NO: 117529 - DNA, 22 bp, Homo sapiens
gccacctcggctttctctgctc

SEQ ID NO: 117530 - DNA, 22 bp, Homo sapiens
cgtgagcaaaatggacactccc

SEQ ID NO: 117531 - DNA, 19 bp, Homo sapiens
cccaggaagcggaggttgc

SEQ ID NO: 117532 - DNA, 22 bp, Homo sapiens
tggccttggccgtgctggggtc

SEQ ID NO: 117533 - DNA, 22 bp, Homo sapiens
ggccttggcctagccctccagg

SEQ ID NO: 117534 - DNA, 22 bp, Homo sapiens
ctgctccccagcctgcgccttt

SEQ ID NO: 117535 - DNA, 22 bp, Homo sapiens
ctccaggccatggctgcggagg

SEQ ID NO: 117536 - DNA, 20 bp, Homo sapiens
gggcagagccagccagtccc

SEQ ID NO: 117537 - DNA, 22 bp, Homo sapiens
gaggtgctgctgtacttcttgc

SEQ ID NO: 117538 - DNA, 20 bp, Homo sapiens
ggcagagggcctgggagaag

SEQ ID NO: 117539 - DNA, 20 bp, Homo sapiens
agcggctggcggaggacacg

SEQ ID NO: 117540 - DNA, 22 bp, Homo sapiens
cagatcaaacaaaatgggttag

SEQ ID NO: 117541 - DNA, 22 bp, Homo sapiens
ctccaggctcgtccaagatcga

SEQ ID NO: 117542 - DNA, 22 bp, Homo sapiens
gaccttgtgctccgaggcgggc

SEQ ID NO: 117543 - DNA, 22 bp, Homo sapiens
tgtgtctttgttccaggtacga

SEQ ID NO: 117544 - DNA, 22 bp, Homo sapiens
ctgggaggcagaggttgcagtg

SEQ ID NO: 117545 - DNA, 22 bp, Homo sapiens
ctccagtcttctcatgtatccc

SEQ ID NO: 117546 - DNA, 21 bp, Homo sapiens
ccaccaggtcttctgctcggg

SEQ ID NO: 117547 - DNA, 22 bp, Homo sapiens
cccagggaggcccaggctctgc

SEQ ID NO: 117548 - DNA, 22 bp, Homo sapiens
agtccaggcattccagccattc

SEQ ID NO: 117549 - DNA, 22 bp, Homo sapiens
aggggagccagggctgcgagtt

SEQ ID NO: 117550 - DNA, 22 bp, Homo sapiens
actaggggctcaggcccaggga

SEQ ID NO: 117551 - DNA, 22 bp, Homo sapiens
gaggaggcttccgggaggcacg

SEQ ID NO: 117552 - DNA, 22 bp, Homo sapiens
aggtgactggtttatctggcag

SEQ ID NO: 117553 - DNA, 22 bp, Homo sapiens
tcacctctactcagcctagttc

SEQ ID NO: 117554 - DNA, 22 bp, Homo sapiens
tcttgggcatgtgtttgatttc

SEQ ID NO: 117555 - DNA, 22 bp, Homo sapiens
gaccttgtgatccagccacctt

SEQ ID NO: 117556 - DNA, 22 bp, Homo sapiens
ctctgcctgtctcatcctgcaa

SEQ ID NO: 117557 - DNA, 18 bp, Homo sapiens
tggaggaaaaatctcatg

SEQ ID NO: 117558 - DNA, 22 bp, Homo sapiens
gcccagtggtaaaagcaggcct

SEQ ID NO: 117559 - DNA, 22 bp, Homo sapiens
ggaaaggcctgggtgtcctggg

SEQ ID NO: 117560 - DNA, 22 bp, Homo sapiens
gtccttccacatggccaacttc

SEQ ID NO: 117561 - DNA, 22 bp, Homo sapiens
tgggcagggagctggaaccaca

SEQ ID NO: 117562 - DNA, 22 bp, Homo sapiens
ggcccaggctggagtgcagtgg

SEQ ID NO: 117563 - DNA, 22 bp, Homo sapiens
ctcagggccaaggatgctgttg

SEQ ID NO: 117564 - DNA, 22 bp, Homo sapiens
gcaggtggatcaccacgtcagg

SEQ ID NO: 117565 - DNA, 22 bp, Homo sapiens
agccaagcactcaactcctgga

SEQ ID NO: 117566 - DNA, 22 bp, Homo sapiens
tcagagagcagaacttttttac

SEQ ID NO: 117567 - DNA, 22 bp, Homo sapiens
accctccccaagaggtcgtgcc

SEQ ID NO: 117568 - DNA, 22 bp, Homo sapiens
tacaggcatgtagcatggtgat

SEQ ID NO: 117569 - DNA, 22 bp, Homo sapiens
tcaggctcaggttaggggccaa

SEQ ID NO: 117570 - DNA, 22 bp, Homo sapiens
gctccctggtagccatgctctc

SEQ ID NO: 117571 - DNA, 22 bp, Homo sapiens
ccccaggacgtggccctcatag

SEQ ID NO: 117572 - DNA, 22 bp, Homo sapiens
gaggtcctctcggaaccccttt

SEQ ID NO: 117573 - DNA, 22 bp, Homo sapiens
ctggggaacgcagcgagcagcg

SEQ ID NO: 117574 - DNA, 22 bp, Homo sapiens
ctgggaggcggaggttgcagtg

SEQ ID NO: 117575 - DNA, 22 bp, Homo sapiens
ttctcctttcattccctgtaga

SEQ ID NO: 117576 - DNA, 22 bp, Homo sapiens
ttgtggttaaccgcacattttt

SEQ ID NO: 117577 - DNA, 22 bp, Homo sapiens
acactctagagggaagcgcttt

SEQ ID NO: 117578 - DNA, 22 bp, Homo sapiens
agtgactggtgtgaagttaaat

SEQ ID NO: 117579 - DNA, 22 bp, Homo sapiens
cgggcaaggcgagactaggccc

SEQ ID NO: 117580 - DNA, 22 bp, Homo sapiens
tggggagtgatgcctcggataa

SEQ ID NO: 117581 - DNA, 22 bp, Homo sapiens
cccagcaaggccagctcagggc

SEQ ID NO: 117582 - DNA, 22 bp, Homo sapiens
gcccagccacagtcactttcat

SEQ ID NO: 117583 - DNA, 22 bp, Homo sapiens
atcccaggcggcacaggttgca

SEQ ID NO: 117584 - DNA, 22 bp, Homo sapiens
atgattgaaaatgacattgcca

SEQ ID NO: 117585 - DNA, 22 bp, Homo sapiens
ttctcctacttaaggccttcca

SEQ ID NO: 117586 - DNA, 22 bp, Homo sapiens
tgcctcaagccctccactgcac

SEQ ID NO: 117587 - DNA, 22 bp, Homo sapiens
ggccttggagtcagccttgagc

SEQ ID NO: 117588 - DNA, 22 bp, Homo sapiens
ggctcactgcaacttccgcctc

SEQ ID NO: 117589 - DNA, 22 bp, Homo sapiens
ggctgggcaggtctgcacaggg

SEQ ID NO: 117590 - DNA, 22 bp, Homo sapiens
agggccagcactcctggcagga

SEQ ID NO: 117591 - DNA, 22 bp, Homo sapiens
aggtgacaggacaggagctggt

SEQ ID NO: 117592 - DNA, 22 bp, Homo sapiens
aggggttggacataagacagaa

SEQ ID NO: 117593 - DNA, 19 bp, Homo sapiens
gcagacaggtccagagagg

SEQ ID NO: 117594 - DNA, 22 bp, Homo sapiens
ggagcagggaattacagcgcag

SEQ ID NO: 117595 - DNA, 22 bp, Homo sapiens
tccttaggaaaatgatgagggg

SEQ ID NO: 117596 - DNA, 22 bp, Homo sapiens
aatcagaaattgagggtctggt

SEQ ID NO: 117597 - DNA, 22 bp, Homo sapiens
gggctgtaggagctggaatggg

SEQ ID NO: 117598 - DNA, 22 bp, Homo sapiens
gcgtctcaaggcccccaggcca

SEQ ID NO: 117599 - DNA, 17 bp, Homo sapiens
gtaaggcttgcagatgc

SEQ ID NO: 117600 - DNA, 22 bp, Homo sapiens
cttcttgctgggggcctcagtg

SEQ ID NO: 117601 - DNA, 22 bp, Homo sapiens
ttgctgacctttgctctccgtt

SEQ ID NO: 117602 - DNA, 22 bp, Homo sapiens
cagcccaggactgcaggtgttt

SEQ ID NO: 117603 - DNA, 22 bp, Homo sapiens
cccaggatggggctgcagttat

SEQ ID NO: 117604 - DNA, 22 bp, Homo sapiens
caggaaggcgcggctgtgcctg

SEQ ID NO: 117605 - DNA, 22 bp, Homo sapiens
tgtctcctcggctgtccagcca

SEQ ID NO: 117606 - DNA, 22 bp, Homo sapiens
agtgctgtctccttcccccggg

SEQ ID NO: 117607 - DNA, 22 bp, Homo sapiens
gggagctgagctggaagagaat

SEQ ID NO: 117608 - DNA, 22 bp, Homo sapiens
cacagagctggaaaggctgggc

SEQ ID NO: 117609 - DNA, 22 bp, Homo sapiens
gtggggtagatctttctcagga

SEQ ID NO: 117610 - DNA, 22 bp, Homo sapiens
atgcttgcccatgtttctgaag

SEQ ID NO: 117611 - DNA, 22 bp, Homo sapiens
ttcagacaggcagctgggctgg

SEQ ID NO: 117612 - DNA, 22 bp, Homo sapiens
gaggaggcagcctatcccttag

SEQ ID NO: 117613 - DNA, 22 bp, Homo sapiens
tccttgccctaaatgtctgtgt

SEQ ID NO: 117614 - DNA, 22 bp, Homo sapiens
gcctcactgcagccccaggaag

SEQ ID NO: 117615 - DNA, 18 bp, Homo sapiens
acacttcctggtggtgtg

SEQ ID NO: 117616 - DNA, 22 bp, Homo sapiens
ctctccattccctacagttttc

SEQ ID NO: 117617 - DNA, 17 bp, Homo sapiens
tggttgtgggaactgaa

SEQ ID NO: 117618 - DNA, 22 bp, Homo sapiens
acaagcgggccacagtgctggt

SEQ ID NO: 117619 - DNA, 22 bp, Homo sapiens
ctctgcctcagtgatttcttta

SEQ ID NO: 117620 - DNA, 22 bp, Homo sapiens
gtagagcagggagcaggaagct

SEQ ID NO: 117621 - DNA, 22 bp, Homo sapiens
gcttcttgcctgtgtagagaat

SEQ ID NO: 117622 - DNA, 22 bp, Homo sapiens
agacagggtgatcgcttgagcc

SEQ ID NO: 117623 - DNA, 16 bp, Homo sapiens
aggctcagaggctgga

SEQ ID NO: 117624 - DNA, 22 bp, Homo sapiens
caggctggagtgcagtggggcg

SEQ ID NO: 117625 - DNA, 22 bp, Homo sapiens
cagtggcgtgatctctgctcac

SEQ ID NO: 117626 - DNA, 22 bp, Homo sapiens
gctggaggatggactggaagaa

SEQ ID NO: 117627 - DNA, 22 bp, Homo sapiens
gggagctgaaggagccggcggg

SEQ ID NO: 117628 - DNA, 22 bp, Homo sapiens
ggaaggggtgggtgagcctcag

SEQ ID NO: 117629 - DNA, 19 bp, Homo sapiens
atctgccttagtgctgctg

SEQ ID NO: 117630 - DNA, 22 bp, Homo sapiens
ctgctcctgtccagcagggcca

SEQ ID NO: 117631 - DNA, 21 bp, Homo sapiens
ctcccagggtgactgttcaac

SEQ ID NO: 117632 - DNA, 22 bp, Homo sapiens
gttggtcctttgagcaagatcc

SEQ ID NO: 117633 - DNA, 22 bp, Homo sapiens
ggaggcccagaaggaagcccag

SEQ ID NO: 117634 - DNA, 22 bp, Homo sapiens
gctgctctcagagctcatgctg

SEQ ID NO: 117635 - DNA, 22 bp, Homo sapiens
gtccaggcctgcctctgaggag

SEQ ID NO: 117636 - DNA, 22 bp, Homo sapiens
gcaggaggttgagccaggactg

SEQ ID NO: 117637 - DNA, 22 bp, Homo sapiens
gtctccttgtggatctcaagga

SEQ ID NO: 117638 - DNA, 22 bp, Homo sapiens
tagggcaatatttcccagaaaa

SEQ ID NO: 117639 - DNA, 22 bp, Homo sapiens
ttcccaggaagcctctccaagc

SEQ ID NO: 117640 - DNA, 22 bp, Homo sapiens
gggcagagagctggaactcctt

SEQ ID NO: 117641 - DNA, 22 bp, Homo sapiens
gaggcctcatgaggtgagcatt

SEQ ID NO: 117642 - DNA, 22 bp, Homo sapiens
gcagggaggtttgctgacctgg

SEQ ID NO: 117643 - DNA, 20 bp, Homo sapiens
tggcctctgagatgccacgg

SEQ ID NO: 117644 - DNA, 22 bp, Homo sapiens
caggctggagttcagtggtgtg

SEQ ID NO: 117645 - DNA, 22 bp, Homo sapiens
accactgcactccagtctgggc

SEQ ID NO: 117646 - DNA, 22 bp, Homo sapiens
gcagaggacacaggagggcaag

SEQ ID NO: 117647 - DNA, 22 bp, Homo sapiens
tcaccttgtgatctccctgcct

SEQ ID NO: 117648 - DNA, 22 bp, Homo sapiens
aggggcgtgctcttccccgacg

SEQ ID NO: 117649 - DNA, 22 bp, Homo sapiens
gggcagagactcagaaacagaa

SEQ ID NO: 117650 - DNA, 22 bp, Homo sapiens
gtggtgtttgagctgccaggga

SEQ ID NO: 117651 - DNA, 22 bp, Homo sapiens
gagcccaggagtttgatgctgc

SEQ ID NO: 117652 - DNA, 22 bp, Homo sapiens
ggctcactgcaacctctgcctc

SEQ ID NO: 117653 - DNA, 22 bp, Homo sapiens
agcccaggctggagtgcagtgg

SEQ ID NO: 117654 - DNA, 22 bp, Homo sapiens
gcccaggagttcaagtctagtg

SEQ ID NO: 117655 - DNA, 22 bp, Homo sapiens
tcatcagaggcatctggcaagg

SEQ ID NO: 117656 - DNA, 22 bp, Homo sapiens
agatgctgctccacaggccagg

SEQ ID NO: 117657 - DNA, 22 bp, Homo sapiens
tcgccccgaggcagccctatgc

SEQ ID NO: 117658 - DNA, 22 bp, Homo sapiens
gacctggtccttgtactttgaa

SEQ ID NO: 117659 - DNA, 22 bp, Homo sapiens
tccaggctttggggcaggagcg

SEQ ID NO: 117660 - DNA, 22 bp, Homo sapiens
tagcacagcttcttgatgtcac

SEQ ID NO: 117661 - DNA, 22 bp, Homo sapiens
tctcagggctcagagctcaggc

SEQ ID NO: 117662 - DNA, 22 bp, Homo sapiens
gaggagggagctggaagctctt

SEQ ID NO: 117663 - DNA, 22 bp, Homo sapiens
ttctgccttggcagggtggtcc

SEQ ID NO: 117664 - DNA, 22 bp, Homo sapiens
catcagaacgtgagctccttgt

SEQ ID NO: 117665 - DNA, 22 bp, Homo sapiens
cagagcccctcgtctccaccac

SEQ ID NO: 117666 - DNA, 22 bp, Homo sapiens
gcgttggggaccccgaagctgg

SEQ ID NO: 117667 - DNA, 22 bp, Homo sapiens
acttgccccagaattgctgctg

SEQ ID NO: 117668 - DNA, 22 bp, Homo sapiens
tgttgcccaggttctctcctgc

SEQ ID NO: 117669 - DNA, 22 bp, Homo sapiens
cttgctgccagccaccatactg

SEQ ID NO: 117670 - DNA, 22 bp, Homo sapiens
ggctccccaggtccaggagctg

SEQ ID NO: 117671 - DNA, 22 bp, Homo sapiens
caggctggagtgcagtggtgcc

SEQ ID NO: 117672 - DNA, 22 bp, Homo sapiens
ggctccctgcaacctccgcctc

SEQ ID NO: 117673 - DNA, 22 bp, Homo sapiens
gaaaagagacagggtgggtgat

SEQ ID NO: 117674 - DNA, 22 bp, Homo sapiens
tctgagccagggtctcctccct

SEQ ID NO: 117675 - DNA, 22 bp, Homo sapiens
ggctcactgcaaactgtgcctc

SEQ ID NO: 117676 - DNA, 22 bp, Homo sapiens
ccagaagcagagcctgaggcag

SEQ ID NO: 117677 - DNA, 22 bp, Homo sapiens
cccagggagagcgcggaggcgg

SEQ ID NO: 117678 - DNA, 22 bp, Homo sapiens
accccaggaagtggaggtcatg

SEQ ID NO: 117679 - DNA, 22 bp, Homo sapiens
cttgtcttgcacacggttgcca

SEQ ID NO: 117680 - DNA, 22 bp, Homo sapiens
aaggcaaaagaggtgtcatcac

SEQ ID NO: 117681 - DNA, 22 bp, Homo sapiens
tgagatgaataactcctgctaa

SEQ ID NO: 117682 - DNA, 22 bp, Homo sapiens
gagctgggcctgcgagtgctgc

SEQ ID NO: 117683 - DNA, 22 bp, Homo sapiens
taggcactgtgtttgtaggagt

SEQ ID NO: 117684 - DNA, 22 bp, Homo sapiens
catgatggctcatgcttgtaat

SEQ ID NO: 117685 - DNA, 22 bp, Homo sapiens
aaggctgagacagcacaggtcc

SEQ ID NO: 117686 - DNA, 22 bp, Homo sapiens
agcccttagtacatttctcaag

SEQ ID NO: 117687 - DNA, 22 bp, Homo sapiens
ccctcccagatgggcttgaggt

SEQ ID NO: 117688 - DNA, 22 bp, Homo sapiens
ggtgagcagctgtctgtatgga

SEQ ID NO: 117689 - DNA, 22 bp, Homo sapiens
agtgagagtattaatgtgaact

SEQ ID NO: 117690 - DNA, 22 bp, Homo sapiens
ccaggcaggcgatggtgcagtg

SEQ ID NO: 117691 - DNA, 22 bp, Homo sapiens
ggttccccaggcggcccttgga

SEQ ID NO: 117692 - DNA, 22 bp, Homo sapiens
gaccttgtgatccacccgcttt

SEQ ID NO: 117693 - DNA, 22 bp, Homo sapiens
aggagctgtcagagtgccagag

SEQ ID NO: 117694 - DNA, 22 bp, Homo sapiens
aaggtgggcagatcacaaggtc

SEQ ID NO: 117695 - DNA, 22 bp, Homo sapiens
ttctttgcccatgtttcctaag

SEQ ID NO: 117696 - DNA, 22 bp, Homo sapiens
ctctgcctcccaggttcaagcg

SEQ ID NO: 117697 - DNA, 22 bp, Homo sapiens
actctccttttgatcttcagaa

SEQ ID NO: 117698 - DNA, 22 bp, Homo sapiens
acggggctagagaaggtttctt

SEQ ID NO: 117699 - DNA, 20 bp, Homo sapiens
cagcagtggatgagagtttt

SEQ ID NO: 117700 - DNA, 22 bp, Homo sapiens
ccagatgtccctctcaggtttg

SEQ ID NO: 117701 - DNA, 22 bp, Homo sapiens
tcagaacatgtttgagtaagac

SEQ ID NO: 117702 - DNA, 22 bp, Homo sapiens
tagcccaggctggagtgcaggg

SEQ ID NO: 117703 - DNA, 22 bp, Homo sapiens
gagcccaggaagtggaggctga

SEQ ID NO: 117704 - DNA, 22 bp, Homo sapiens
gagcccaggcagaggttgcagt

SEQ ID NO: 117705 - DNA, 22 bp, Homo sapiens
acagagcaataacagggagagg

SEQ ID NO: 117706 - DNA, 22 bp, Homo sapiens
ccctcccaggagtggccagaga

SEQ ID NO: 117707 - DNA, 22 bp, Homo sapiens
aggtacatggggtgtgtgcacg

SEQ ID NO: 117708 - DNA, 22 bp, Homo sapiens
cttcctcctccatctcgaaggc

SEQ ID NO: 117709 - DNA, 22 bp, Homo sapiens
ccggctcggcgaccaggctgaa

SEQ ID NO: 117710 - DNA, 21 bp, Homo sapiens
agaaggcaaaagcagacatct

SEQ ID NO: 117711 - DNA, 22 bp, Homo sapiens
aggtcaccatggcatgctccac

SEQ ID NO: 117712 - DNA, 19 bp, Homo sapiens
gccttcccaccacccgtcc

SEQ ID NO: 117713 - DNA, 22 bp, Homo sapiens
ctgagcagatgaccagccccag

SEQ ID NO: 117714 - DNA, 22 bp, Homo sapiens
ctcctgggaaaggctggacaca

SEQ ID NO: 117715 - DNA, 22 bp, Homo sapiens
tcaccttgtgatccgcccacct

SEQ ID NO: 117716 - DNA, 22 bp, Homo sapiens
cactgcactccagctgggtgac

SEQ ID NO: 117717 - DNA, 22 bp, Homo sapiens
cagggatggcgctggctgcccg

SEQ ID NO: 117718 - DNA, 22 bp, Homo sapiens
ggaggagcatgagagggtagtg

SEQ ID NO: 117719 - DNA, 22 bp, Homo sapiens
gtctcctccctttcattcacct

SEQ ID NO: 117720 - DNA, 22 bp, Homo sapiens
tggggtacacgtggggcaggat

SEQ ID NO: 117721 - DNA, 22 bp, Homo sapiens
tgggcaggggccctgcttccgt

SEQ ID NO: 117722 - DNA, 21 bp, Homo sapiens
gaacccagcagcagtgctctg

SEQ ID NO: 117723 - DNA, 22 bp, Homo sapiens
gggaggctctgctcagcccccg

SEQ ID NO: 117724 - DNA, 22 bp, Homo sapiens
agtgcaggccccaggccaggcc

SEQ ID NO: 117725 - DNA, 22 bp, Homo sapiens
gtgagccgagtatagttcatag

SEQ ID NO: 117726 - DNA, 22 bp, Homo sapiens
ctgtaatcccagctacctggga

SEQ ID NO: 117727 - DNA, 22 bp, Homo sapiens
caatagtaaattacggaggaga

SEQ ID NO: 117728 - DNA, 22 bp, Homo sapiens
ttccagctaactcacatccctt

SEQ ID NO: 117729 - DNA, 22 bp, Homo sapiens
ccggctactcgggaggctgacg

SEQ ID NO: 117730 - DNA, 22 bp, Homo sapiens
actgcactcctgcctgggtaac

SEQ ID NO: 117731 - DNA, 22 bp, Homo sapiens
gcggtagctcaagcttgtaatc

SEQ ID NO: 117732 - DNA, 22 bp, Homo sapiens
tgtaagtagtaatggaaggaca

SEQ ID NO: 117733 - DNA, 22 bp, Homo sapiens
atacaaagtattaatcctggat

SEQ ID NO: 117734 - DNA, 22 bp, Homo sapiens
atacctgtgtatccacaagcgt

SEQ ID NO: 117735 - DNA, 22 bp, Homo sapiens
tgtctcatctcttaaccccact

SEQ ID NO: 117736 - DNA, 22 bp, Homo sapiens
ctcaggagttggaggctacagt

SEQ ID NO: 117737 - DNA, 19 bp, Homo sapiens
catggtgaaaccccgtctc

SEQ ID NO: 117738 - DNA, 22 bp, Homo sapiens
tgagatgaataactcctgctaa

SEQ ID NO: 117739 - DNA, 22 bp, Homo sapiens
agccaggatggtctcgatcggc

SEQ ID NO: 117740 - DNA, 22 bp, Homo sapiens
gtaatctcagctacttgggagg

SEQ ID NO: 117741 - DNA, 22 bp, Homo sapiens
tctaatcctatggtggggaggg

SEQ ID NO: 117742 - DNA, 21 bp, Homo sapiens
tcctgtaagcttgggtggctc

SEQ ID NO: 117743 - DNA, 22 bp, Homo sapiens
tggctaacaaggtgaaaccccg

SEQ ID NO: 117744 - DNA, 22 bp, Homo sapiens
gaccctgtttctacaaataatt

SEQ ID NO: 117745 - DNA, 22 bp, Homo sapiens
actgcactccagcctgggtaac

SEQ ID NO: 117746 - DNA, 21 bp, Homo sapiens
tgcaatccagcctgggcgaca

SEQ ID NO: 117747 - DNA, 22 bp, Homo sapiens
gttgaggtgatgccagccctgc

SEQ ID NO: 117748 - DNA, 22 bp, Homo sapiens
ggtggttcacgcctataatccc

SEQ ID NO: 117749 - DNA, 22 bp, Homo sapiens
ctgtaatcccagctactcggga

SEQ ID NO: 117750 - DNA, 22 bp, Homo sapiens
tggacaacatagtgagacctca

SEQ ID NO: 117751 - DNA, 16 bp, Homo sapiens
aaacccagcccctgcg

SEQ ID NO: 117752 - DNA, 17 bp, Homo sapiens
aaatcaactccagctcc

SEQ ID NO: 117753 - DNA, 16 bp, Homo sapiens
aaatgatcttttcaag

SEQ ID NO: 117754 - DNA, 17 bp, Homo sapiens
aacactgcttgtgtttt

SEQ ID NO: 117755 - DNA, 16 bp, Homo sapiens
aacactgtcttgaaga

SEQ ID NO: 117756 - DNA, 14 bp, Homo sapiens
aacccagcccctgc

SEQ ID NO: 117757 - DNA, 16 bp, Homo sapiens
aaccctcgccctgtcc

SEQ ID NO: 117758 - DNA, 17 bp, Homo sapiens
aaccctcgccctgtccc

SEQ ID NO: 117759 - DNA, 18 bp, Homo sapiens
aaccctcgccctgtccct

SEQ ID NO: 117760 - DNA, 21 bp, Homo sapiens
aaccctcgccctgtccctccc

SEQ ID NO: 117761 - DNA, 22 bp, Homo sapiens
aaccctcgccctgtccctccca

SEQ ID NO: 117762 - DNA, 20 bp, Homo sapiens
aaccgtccccggcccctgcc

SEQ ID NO: 117763 - DNA, 13 bp, Homo sapiens
aactcaatatttt

SEQ ID NO: 117764 - DNA, 14 bp, Homo sapiens
aactcaatattttc

SEQ ID NO: 117765 - DNA, 19 bp, Homo sapiens
aagaaggcagcaggtggca

SEQ ID NO: 117766 - DNA, 14 bp, Homo sapiens
aagccacagctggt

SEQ ID NO: 117767 - DNA, 13 bp, Homo sapiens
aagccgcccagtg

SEQ ID NO: 117768 - DNA, 18 bp, Homo sapiens
aaggaggtagctcccagc

SEQ ID NO: 117769 - DNA, 20 bp, Homo sapiens
aaggcagggagcgagggaga

SEQ ID NO: 117770 - DNA, 14 bp, Homo sapiens
aagttaaattttat

SEQ ID NO: 117771 - DNA, 21 bp, Homo sapiens
aatgccatggacagaagaagg

SEQ ID NO: 117772 - DNA, 20 bp, Homo sapiens
aatggcacagcccaaagaag

SEQ ID NO: 117773 - DNA, 17 bp, Homo sapiens
aatggtttgaatataaa

SEQ ID NO: 117774 - DNA, 19 bp, Homo sapiens
aatggtttgcaaggaagcc

SEQ ID NO: 117775 - DNA, 12 bp, Homo sapiens
aattaacactgc

SEQ ID NO: 117776 - DNA, 17 bp, Homo sapiens
aattctgagctggccct

SEQ ID NO: 117777 - DNA, 22 bp, Homo sapiens
aattctgagctggccctttcca

SEQ ID NO: 117778 - DNA, 17 bp, Homo sapiens
aattcttacaaacatgt

SEQ ID NO: 117779 - DNA, 12 bp, Homo sapiens
aatttaaagcaa

SEQ ID NO: 117780 - DNA, 20 bp, Homo sapiens
acaatttaaagcaaaggagt

SEQ ID NO: 117781 - DNA, 11 bp, Homo sapiens
acacagcagcg

SEQ ID NO: 117782 - DNA, 20 bp, Homo sapiens
acaccatgttcccagctcag

SEQ ID NO: 117783 - DNA, 12 bp, Homo sapiens
acactgccagcc

SEQ ID NO: 117784 - DNA, 20 bp, Homo sapiens
acactgccagccgccaccgg

SEQ ID NO: 117785 - DNA, 13 bp, Homo sapiens
acactgtcttgaa

SEQ ID NO: 117786 - DNA, 12 bp, Homo sapiens
acagaacactgt

SEQ ID NO: 117787 - DNA, 18 bp, Homo sapiens
acagagctgggatgtttc

SEQ ID NO: 117788 - DNA, 21 bp, Homo sapiens
acagagctgggatgtttctgt

SEQ ID NO: 117789 - DNA, 19 bp, Homo sapiens
acagcactgcctgccaagc

SEQ ID NO: 117790 - DNA, 15 bp, Homo sapiens
acagcccctggcact

SEQ ID NO: 117791 - DNA, 22 bp, Homo sapiens
acagtcacacagagcgcctcac

SEQ ID NO: 117792 - DNA, 18 bp, Homo sapiens
acagtgactgggccctgt

SEQ ID NO: 117793 - DNA, 20 bp, Homo sapiens
acatgaaggagacagcagca

SEQ ID NO: 117794 - DNA, 13 bp, Homo sapiens
accacccccagtc

SEQ ID NO: 117795 - DNA, 15 bp, Homo sapiens
accagccatcatgtg

SEQ ID NO: 117796 - DNA, 16 bp, Homo sapiens
accatgttcccagctc

SEQ ID NO: 117797 - DNA, 17 bp, Homo sapiens
accatgttcccagctca

SEQ ID NO: 117798 - DNA, 12 bp, Homo sapiens
accccgccagcc

SEQ ID NO: 117799 - DNA, 22 bp, Homo sapiens
accccgccagcctacactgcca

SEQ ID NO: 117800 - DNA, 18 bp, Homo sapiens
accccgcccctgcatgcc

SEQ ID NO: 117801 - DNA, 11 bp, Homo sapiens
acccctcagtg

SEQ ID NO: 117802 - DNA, 17 bp, Homo sapiens
acccctcagtgctcggc

SEQ ID NO: 117803 - DNA, 14 bp, Homo sapiens
accctcgccctgtc

SEQ ID NO: 117804 - DNA, 14 bp, Homo sapiens
accggggcacacgg

SEQ ID NO: 117805 - DNA, 13 bp, Homo sapiens
accggtgccaaac

SEQ ID NO: 117806 - DNA, 14 bp, Homo sapiens
accgtgccagcagc

SEQ ID NO: 117807 - DNA, 13 bp, Homo sapiens
acctcagtttctc

SEQ ID NO: 117808 - DNA, 20 bp, Homo sapiens
acctccccgcagagctccct

SEQ ID NO: 117809 - DNA, 20 bp, Homo sapiens
acgcacagcactgcctgcca

SEQ ID NO: 117810 - DNA, 16 bp, Homo sapiens
acgcaccccgcccctg

SEQ ID NO: 117811 - DNA, 18 bp, Homo sapiens
acgcaccccgcccctgca

SEQ ID NO: 117812 - DNA, 22 bp, Homo sapiens
actacaatttaaagcaaaggag

SEQ ID NO: 117813 - DNA, 15 bp, Homo sapiens
actatattgtacaca

SEQ ID NO: 117814 - DNA, 12 bp, Homo sapiens
actcaatatttt

SEQ ID NO: 117815 - DNA, 21 bp, Homo sapiens
actcaatattttccatgaaaa

SEQ ID NO: 117816 - DNA, 22 bp, Homo sapiens
actcaatattttccatgaaaat

SEQ ID NO: 117817 - DNA, 22 bp, Homo sapiens
actcgaagcccttccagtggta

SEQ ID NO: 117818 - DNA, 15 bp, Homo sapiens
actgcaggtggcctc

SEQ ID NO: 117819 - DNA, 21 bp, Homo sapiens
actgcaggtggcctccctcca

SEQ ID NO: 117820 - DNA, 12 bp, Homo sapiens
actgcctgccaa

SEQ ID NO: 117821 - DNA, 13 bp, Homo sapiens
actgggccctgtc

SEQ ID NO: 117822 - DNA, 21 bp, Homo sapiens
actgggccctgtccagggcag

SEQ ID NO: 117823 - DNA, 18 bp, Homo sapiens
acttgacagaacactgtc

SEQ ID NO: 117824 - DNA, 15 bp, Homo sapiens
actttgctccgtgga

SEQ ID NO: 117825 - DNA, 23 bp, Homo sapiens
acttttttgctatccagctattt

SEQ ID NO: 117826 - DNA, 15 bp, Homo sapiens
agaaagacagagctg

SEQ ID NO: 117827 - DNA, 16 bp, Homo sapiens
agaacacaaggtcatt

SEQ ID NO: 117828 - DNA, 16 bp, Homo sapiens
agaaggaaaaggcagg

SEQ ID NO: 117829 - DNA, 19 bp, Homo sapiens
agaaggggacagcgccacc

SEQ ID NO: 117830 - DNA, 15 bp, Homo sapiens
agaatggggtgcatg

SEQ ID NO: 117831 - DNA, 18 bp, Homo sapiens
agaccccatggtccatcc

SEQ ID NO: 117832 - DNA, 14 bp, Homo sapiens
agagaaggcttcct

SEQ ID NO: 117833 - DNA, 21 bp, Homo sapiens
agagaggtgggcagcagctca

SEQ ID NO: 117834 - DNA, 18 bp, Homo sapiens
agagccccaaagatccca

SEQ ID NO: 117835 - DNA, 17 bp, Homo sapiens
agagcgcctcacctgca

SEQ ID NO: 117836 - DNA, 22 bp, Homo sapiens
agagcgcctcacctgcatcctc

SEQ ID NO: 117837 - DNA, 16 bp, Homo sapiens
agagggacgcacagca

SEQ ID NO: 117838 - DNA, 12 bp, Homo sapiens
agagtgctgaga

SEQ ID NO: 117839 - DNA, 22 bp, Homo sapiens
agagtgctgagaaggacacctc

SEQ ID NO: 117840 - DNA, 20 bp, Homo sapiens
agcactcaaccaacctcccc

SEQ ID NO: 117841 - DNA, 16 bp, Homo sapiens
agcactgcctgccaag

SEQ ID NO: 117842 - DNA, 14 bp, Homo sapiens
agccaaggctcccg

SEQ ID NO: 117843 - DNA, 14 bp, Homo sapiens
agccagcgcctgcc

SEQ ID NO: 117844 - DNA, 15 bp, Homo sapiens
agccagcgcctgccc

SEQ ID NO: 117845 - DNA, 20 bp, Homo sapiens
agccatcatgtgcctggaaa

SEQ ID NO: 117846 - DNA, 17 bp, Homo sapiens
agccatctccgtggcca

SEQ ID NO: 117847 - DNA, 19 bp, Homo sapiens
agcctacactgccagccgc

SEQ ID NO: 117848 - DNA, 21 bp, Homo sapiens
agcctccccccgctggggagc

SEQ ID NO: 117849 - DNA, 18 bp, Homo sapiens
agcgcagccgagccccag

SEQ ID NO: 117850 - DNA, 15 bp, Homo sapiens
agcgcctcacctgca

SEQ ID NO: 117851 - DNA, 16 bp, Homo sapiens
agctcagtgccaaaga

SEQ ID NO: 117852 - DNA, 14 bp, Homo sapiens
agctcccttcctga

SEQ ID NO: 117853 - DNA, 15 bp, Homo sapiens
agctcggatcacatg

SEQ ID NO: 117854 - DNA, 15 bp, Homo sapiens
agctggccctttcca

SEQ ID NO: 117855 - DNA, 22 bp, Homo sapiens
agctgtctgcggagccagcgcc

SEQ ID NO: 117856 - DNA, 15 bp, Homo sapiens
agcttcatttccgtg

SEQ ID NO: 117857 - DNA, 16 bp, Homo sapiens
agcttcatttccgtga

SEQ ID NO: 117858 - DNA, 15 bp, Homo sapiens
aggaagccacagctg

SEQ ID NO: 117859 - DNA, 16 bp, Homo sapiens
aggaagccacagctgg

SEQ ID NO: 117860 - DNA, 19 bp, Homo sapiens
aggaccctggctcttctct

SEQ ID NO: 117861 - DNA, 13 bp, Homo sapiens
aggagacagcagc

SEQ ID NO: 117862 - DNA, 22 bp, Homo sapiens
aggagcccgtcaggccacagcc

SEQ ID NO: 117863 - DNA, 18 bp, Homo sapiens
aggccacagcccctggca

SEQ ID NO: 117864 - DNA, 20 bp, Homo sapiens
agggacgcacagcactgcct

SEQ ID NO: 117865 - DNA, 23 bp, Homo sapiens
agggacgcacagcactgcctgcc

SEQ ID NO: 117866 - DNA, 16 bp, Homo sapiens
aggggttgtcaagaga

SEQ ID NO: 117867 - DNA, 22 bp, Homo sapiens
aggggttgtcaagagagagtca

SEQ ID NO: 117868 - DNA, 15 bp, Homo sapiens
aggtgggcagcagct

SEQ ID NO: 117869 - DNA, 15 bp, Homo sapiens
aggtttctgaaaatt

SEQ ID NO: 117870 - DNA, 21 bp, Homo sapiens
agtccccatgattccctcctc

SEQ ID NO: 117871 - DNA, 20 bp, Homo sapiens
agtctctcaaagaccccatg

SEQ ID NO: 117872 - DNA, 18 bp, Homo sapiens
agtgactgggccctgtcc

SEQ ID NO: 117873 - DNA, 19 bp, Homo sapiens
agtgactgggccctgtcca

SEQ ID NO: 117874 - DNA, 21 bp, Homo sapiens
agtgactgggccctgtccagg

SEQ ID NO: 117875 - DNA, 16 bp, Homo sapiens
agtgctcggcagtcat

SEQ ID NO: 117876 - DNA, 18 bp, Homo sapiens
agtgctgagaaggacacc

SEQ ID NO: 117877 - DNA, 22 bp, Homo sapiens
agtgctgcgagatcgctggcag

SEQ ID NO: 117878 - DNA, 19 bp, Homo sapiens
agtgctggccacacagcag

SEQ ID NO: 117879 - DNA, 21 bp, Homo sapiens
agtggtaccagctcactccct

SEQ ID NO: 117880 - DNA, 21 bp, Homo sapiens
agtttctcctttattgctcct

SEQ ID NO: 117881 - DNA, 20 bp, Homo sapiens
agtttcttggtctcagcttc

SEQ ID NO: 117882 - DNA, 13 bp, Homo sapiens
atataaacactat

SEQ ID NO: 117883 - DNA, 14 bp, Homo sapiens
atatatacatatat

SEQ ID NO: 117884 - DNA, 16 bp, Homo sapiens
atatggggatgcagca

SEQ ID NO: 117885 - DNA, 11 bp, Homo sapiens
atattttaatt

SEQ ID NO: 117886 - DNA, 14 bp, Homo sapiens
atcctctcccccac

SEQ ID NO: 117887 - DNA, 17 bp, Homo sapiens
atctctctttaatataa

SEQ ID NO: 117888 - DNA, 15 bp, Homo sapiens
atgaaggagacagca

SEQ ID NO: 117889 - DNA, 16 bp, Homo sapiens
atgaaggagacagcag

SEQ ID NO: 117890 - DNA, 19 bp, Homo sapiens
atgaaggtttctgaaaatt

SEQ ID NO: 117891 - DNA, 17 bp, Homo sapiens
atgaccttctaggaagc

SEQ ID NO: 117892 - DNA, 15 bp, Homo sapiens
atgatcttttcaagt

SEQ ID NO: 117893 - DNA, 13 bp, Homo sapiens
atgattccctcct

SEQ ID NO: 117894 - DNA, 14 bp, Homo sapiens
atgcaacaacatgt

SEQ ID NO: 117895 - DNA, 17 bp, Homo sapiens
atgcacgcaccccgccc

SEQ ID NO: 117896 - DNA, 19 bp, Homo sapiens
atgcaggccccgccccctc

SEQ ID NO: 117897 - DNA, 22 bp, Homo sapiens
atgccagccgggtacctcagtt

SEQ ID NO: 117898 - DNA, 18 bp, Homo sapiens
atgccataaaagccgccc

SEQ ID NO: 117899 - DNA, 20 bp, Homo sapiens
atgccataaaagccgcccag

SEQ ID NO: 117900 - DNA, 14 bp, Homo sapiens
atgccttttatttc

SEQ ID NO: 117901 - DNA, 19 bp, Homo sapiens
atggacagaagaaggcagc

SEQ ID NO: 117902 - DNA, 14 bp, Homo sapiens
atgtataatatttt

SEQ ID NO: 117903 - DNA, 14 bp, Homo sapiens
atgtatgattacat

SEQ ID NO: 117904 - DNA, 15 bp, Homo sapiens
atgtcccatctgctc

SEQ ID NO: 117905 - DNA, 20 bp, Homo sapiens
atgtcccatctgctcctccc

SEQ ID NO: 117906 - DNA, 22 bp, Homo sapiens
atgtcccatctgctcctcccat

SEQ ID NO: 117907 - DNA, 20 bp, Homo sapiens
atgtggagggtggcgccctg

SEQ ID NO: 117908 - DNA, 13 bp, Homo sapiens
atgttcccagctc

SEQ ID NO: 117909 - DNA, 15 bp, Homo sapiens
atgttcccagctcag

SEQ ID NO: 117910 - DNA, 23 bp, Homo sapiens
atgttcccagctcagtgccaaag

SEQ ID NO: 117911 - DNA, 17 bp, Homo sapiens
atgtttttgtgtatttg

SEQ ID NO: 117912 - DNA, 16 bp, Homo sapiens
attctgagctggccct

SEQ ID NO: 117913 - DNA, 16 bp, Homo sapiens
atttccaagagctgag

SEQ ID NO: 117914 - DNA, 12 bp, Homo sapiens
atttgttaatgg

SEQ ID NO: 117915 - DNA, 20 bp, Homo sapiens
caaacatgtggttaatgcca

SEQ ID NO: 117916 - DNA, 21 bp, Homo sapiens
caacaacatgtataatatttt

SEQ ID NO: 117917 - DNA, 19 bp, Homo sapiens
caacctccccgcagagctc

SEQ ID NO: 117918 - DNA, 20 bp, Homo sapiens
caacctccccgcagagctcc

SEQ ID NO: 117919 - DNA, 14 bp, Homo sapiens
caactccagctccc

SEQ ID NO: 117920 - DNA, 20 bp, Homo sapiens
caagaaggggacagcgccac

SEQ ID NO: 117921 - DNA, 14 bp, Homo sapiens
caagagccccaaag

SEQ ID NO: 117922 - DNA, 15 bp, Homo sapiens
caaggctcccgttcc

SEQ ID NO: 117923 - DNA, 13 bp, Homo sapiens
caatattttccat

SEQ ID NO: 117924 - DNA, 18 bp, Homo sapiens
caatggcttactccagga

SEQ ID NO: 117925 - DNA, 16 bp, Homo sapiens
caatggtttgcaagga

SEQ ID NO: 117926 - DNA, 18 bp, Homo sapiens
caatggtttgcaaggaag

SEQ ID NO: 117927 - DNA, 19 bp, Homo sapiens
caatggtttgcaaggaagc

SEQ ID NO: 117928 - DNA, 18 bp, Homo sapiens
caatgtgactaccgtgcc

SEQ ID NO: 117929 - DNA, 19 bp, Homo sapiens
caattcttacaaacatgtg

SEQ ID NO: 117930 - DNA, 23 bp, Homo sapiens
cacaaccgtccccggcccctgcc

SEQ ID NO: 117931 - DNA, 17 bp, Homo sapiens
cacaagagccccaaaga

SEQ ID NO: 117932 - DNA, 22 bp, Homo sapiens
cacagagcgcctcacctgcatc

SEQ ID NO: 117933 - DNA, 12 bp, Homo sapiens
cacagcactgcc

SEQ ID NO: 117934 - DNA, 17 bp, Homo sapiens
cacagcccctggcactg

SEQ ID NO: 117935 - DNA, 20 bp, Homo sapiens
cacagcccctggcactgcag

SEQ ID NO: 117936 - DNA, 16 bp, Homo sapiens
cacagtgactgggccc

SEQ ID NO: 117937 - DNA, 20 bp, Homo sapiens
cacagtgactgggccctgtc

SEQ ID NO: 117938 - DNA, 24 bp, Homo sapiens
cacatcagctccactttcagtgaa

SEQ ID NO: 117939 - DNA, 20 bp, Homo sapiens
cacatgaaggagacagcagc

SEQ ID NO: 117940 - DNA, 21 bp, Homo sapiens
cacatgaaggagacagcagca

SEQ ID NO: 117941 - DNA, 19 bp, Homo sapiens
caccacccccagtcccccc

SEQ ID NO: 117942 - DNA, 16 bp, Homo sapiens
caccaggtagaacaca

SEQ ID NO: 117943 - DNA, 19 bp, Homo sapiens
caccatgttcccagctcag

SEQ ID NO: 117944 - DNA, 14 bp, Homo sapiens
cacccacccatgca

SEQ ID NO: 117945 - DNA, 23 bp, Homo sapiens
caccccgccagcctacactgcca

SEQ ID NO: 117946 - DNA, 16 bp, Homo sapiens
caccccgcccctgcat

SEQ ID NO: 117947 - DNA, 20 bp, Homo sapiens
caccccgcccctgcatgcct

SEQ ID NO: 117948 - DNA, 15 bp, Homo sapiens
caccttatatttacg

SEQ ID NO: 117949 - DNA, 22 bp, Homo sapiens
cacgggcctctgcttgccagcc

SEQ ID NO: 117950 - DNA, 23 bp, Homo sapiens
cactgcaggtggcctccctccag

SEQ ID NO: 117951 - DNA, 15 bp, Homo sapiens
cactgccagccgcca

SEQ ID NO: 117952 - DNA, 13 bp, Homo sapiens
cactgcctgccaa

SEQ ID NO: 117953 - DNA, 14 bp, Homo sapiens
cactgcctgccaag

SEQ ID NO: 117954 - DNA, 14 bp, Homo sapiens
cactgtcttgaaga

SEQ ID NO: 117955 - DNA, 19 bp, Homo sapiens
cagagaaggcttcctccag

SEQ ID NO: 117956 - DNA, 22 bp, Homo sapiens
cagagactcgagtccccatgat

SEQ ID NO: 117957 - DNA, 15 bp, Homo sapiens
cagagctcccttcct

SEQ ID NO: 117958 - DNA, 16 bp, Homo sapiens
cagcacccacccatgc

SEQ ID NO: 117959 - DNA, 22 bp, Homo sapiens
cagcactcaaccaacctccccg

SEQ ID NO: 117960 - DNA, 12 bp, Homo sapiens
cagcactgcctg

SEQ ID NO: 117961 - DNA, 13 bp, Homo sapiens
cagcactgcctgc

SEQ ID NO: 117962 - DNA, 16 bp, Homo sapiens
cagcactgcctgccaa

SEQ ID NO: 117963 - DNA, 14 bp, Homo sapiens
cagcagcacccacc
